United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 46

SEQ ID NO: 1647065 - RNA, 12 nt, Human
cccccagcccuc

SEQ ID NO: 1647066 - RNA, 14 nt, Human
ccaccugcugagcc

SEQ ID NO: 1647067 - RNA, 18 nt, Human
caugaauuaguuuuauau

SEQ ID NO: 1647068 - RNA, 20 nt, Human
gcauuguuggcuguuccugc

SEQ ID NO: 1647069 - RNA, 18 nt, Human
acauaaaauacaaaaacu

SEQ ID NO: 1647070 - RNA, 15 nt, Human
ugaaacccugucucu

SEQ ID NO: 1647071 - RNA, 15 nt, Human
agucuguuuucccuc

SEQ ID NO: 1647072 - RNA, 18 nt, Human
gacauuugcucauggaau

SEQ ID NO: 1647073 - RNA, 18 nt, Human
acuuuaugcuaagugaaa

SEQ ID NO: 1647074 - RNA, 21 nt, Human
caagacccaaaaggcagaagc

SEQ ID NO: 1647075 - RNA, 20 nt, Human
cccugccccccagcccuccu

SEQ ID NO: 1647076 - RNA, 23 nt, Human
cacaagaaaugaaagcagggacu

SEQ ID NO: 1647077 - RNA, 12 nt, Human
gguauuuuaauc

SEQ ID NO: 1647078 - RNA, 18 nt, Human
cugagggcauagaaguaa

SEQ ID NO: 1647079 - RNA, 18 nt, Human
agagaaugagagacacac

SEQ ID NO: 1647080 - RNA, 18 nt, Human
ucugcaagaagaaaucau

SEQ ID NO: 1647081 - RNA, 23 nt, Human
cuuaagaagacugcauuauauuu

SEQ ID NO: 1647082 - RNA, 16 nt, Human
cacaucaggaaagaga

SEQ ID NO: 1647083 - RNA, 17 nt, Human
aucauuuacuuuuaaac

SEQ ID NO: 1647084 - RNA, 18 nt, Human
cacaaguaaaaggaaaug

SEQ ID NO: 1647085 - RNA, 17 nt, Human
gccuccuuuuaaaguaa

SEQ ID NO: 1647086 - RNA, 14 nt, Human
aaauguaaaauagu

SEQ ID NO: 1647087 - RNA, 22 nt, Human
agaaauaggaaauauuuuaaug

SEQ ID NO: 1647088 - RNA, 15 nt, Human
cagaacuaaaaauua

SEQ ID NO: 1647089 - RNA, 17 nt, Human
uccuacaagacacagug

SEQ ID NO: 1647090 - RNA, 12 nt, Human
aauauauuuccu

SEQ ID NO: 1647091 - RNA, 13 nt, Human
caccaaggagcca

SEQ ID NO: 1647092 - RNA, 18 nt, Human
uguacuuuauuuucuaua

SEQ ID NO: 1647093 - RNA, 13 nt, Human
cuuagcccuuccc

SEQ ID NO: 1647094 - RNA, 15 nt, Human
uuaauucugaaagca

SEQ ID NO: 1647095 - RNA, 16 nt, Human
auaucaauuuaaaaaa

SEQ ID NO: 1647096 - RNA, 15 nt, Human
cuggaaacacauguu

SEQ ID NO: 1647097 - RNA, 21 nt, Human
cccuagaaagccaugugcagc

SEQ ID NO: 1647098 - RNA, 16 nt, Human
ugaaguacucauacau

SEQ ID NO: 1647099 - RNA, 16 nt, Human
acauuuauauuuuugu

SEQ ID NO: 1647100 - RNA, 16 nt, Human
auuuaaggauucugag

SEQ ID NO: 1647101 - RNA, 14 nt, Human
cucaauaaauaaau

SEQ ID NO: 1647102 - RNA, 19 nt, Human
caacucccugccccccagc

SEQ ID NO: 1647103 - RNA, 16 nt, Human
aagaaaauaacaauaa

SEQ ID NO: 1647104 - RNA, 21 nt, Human
auuuuuucucuaggaaauauu

SEQ ID NO: 1647105 - RNA, 15 nt, Human
auaggaaauauuuua

SEQ ID NO: 1647106 - RNA, 15 nt, Human
cauuccaagccucau

SEQ ID NO: 1647107 - RNA, 19 nt, Human
aaaaucuuauaauuuaaaa

SEQ ID NO: 1647108 - RNA, 19 nt, Human
uauuuuaauaauguuucaa

SEQ ID NO: 1647109 - RNA, 11 nt, Human
uaguuagcuuu

SEQ ID NO: 1647110 - RNA, 16 nt, Human
gacauuugcucaugga

SEQ ID NO: 1647111 - RNA, 21 nt, Human
aaguuuaugguuguauuauuu

SEQ ID NO: 1647112 - RNA, 21 nt, Human
ccuggugccucaccccuugcc

SEQ ID NO: 1647113 - RNA, 16 nt, Human
agcccugccucaagcu

SEQ ID NO: 1647114 - RNA, 15 nt, Human
uagaauauauuuccu

SEQ ID NO: 1647115 - RNA, 14 nt, Human
cccugccccccagc

SEQ ID NO: 1647116 - RNA, 22 nt, Human
agaagcaccaaucaugaauuag

SEQ ID NO: 1647117 - RNA, 22 nt, Human
auuacuguaagaaaauaucacu

SEQ ID NO: 1647118 - RNA, 13 nt, Human
gaugggcaaaaaa

SEQ ID NO: 1647119 - RNA, 15 nt, Human
aaauauuuauuuuaa

SEQ ID NO: 1647120 - RNA, 16 nt, Human
guuccuuccucugagc

SEQ ID NO: 1647121 - RNA, 17 nt, Human
aagcuuuuuuugaauca

SEQ ID NO: 1647122 - RNA, 18 nt, Human
gccuuggggcugaugcag

SEQ ID NO: 1647123 - RNA, 14 nt, Human
cccugucucaauaa

SEQ ID NO: 1647124 - RNA, 13 nt, Human
ugcauuucuaaag

SEQ ID NO: 1647125 - RNA, 14 nt, Human
augcuccuccaggg

SEQ ID NO: 1647126 - RNA, 16 nt, Human
cuagaaccaccugccu

SEQ ID NO: 1647127 - RNA, 17 nt, Human
auuuucuauaauuuaaa

SEQ ID NO: 1647128 - RNA, 17 nt, Human
ugaccacugcagaagac

SEQ ID NO: 1647129 - RNA, 23 nt, Human
ggucucagugucaaugcagcccc

SEQ ID NO: 1647130 - RNA, 14 nt, Human
uuaugauuaaguaa

SEQ ID NO: 1647131 - RNA, 19 nt, Human
aauuuuguuauguauauuu

SEQ ID NO: 1647132 - RNA, 13 nt, Human
uuaaaaaagaaac

SEQ ID NO: 1647133 - RNA, 20 nt, Human
ugauuucugagcauuuaaua

SEQ ID NO: 1647134 - RNA, 19 nt, Human
gccugaucaccugcccugc

SEQ ID NO: 1647135 - RNA, 16 nt, Human
agguugcagugagccg

SEQ ID NO: 1647136 - RNA, 17 nt, Human
aacaaaaaucaaacuuu

SEQ ID NO: 1647137 - RNA, 23 nt, Human
cauuguggucacaggaaguagag

SEQ ID NO: 1647138 - RNA, 12 nt, Human
ugccaaaauaua

SEQ ID NO: 1647139 - RNA, 22 nt, Human
cagcacgggggccaaggaugcc

SEQ ID NO: 1647140 - RNA, 22 nt, Human
cacagauuugagcucagcccug

SEQ ID NO: 1647141 - RNA, 23 nt, Human
gcugaguguuucacaccuuaucu

SEQ ID NO: 1647142 - RNA, 18 nt, Human
ugaagcuguguccucaug

SEQ ID NO: 1647143 - RNA, 16 nt, Human
aaaauaacaauaaaag

SEQ ID NO: 1647144 - RNA, 15 nt, Human
ucuggcuccagcugg

SEQ ID NO: 1647145 - RNA, 19 nt, Human
aaacaauaacgauaaaaga

SEQ ID NO: 1647146 - RNA, 18 nt, Human
auuugcuggagcucugcc

SEQ ID NO: 1647147 - RNA, 17 nt, Human
agaggcaaagaaaggag

SEQ ID NO: 1647148 - RNA, 23 nt, Human
cagagucaagggugugugcagca

SEQ ID NO: 1647149 - RNA, 20 nt, Human
uguuggugaacuugguuuua

SEQ ID NO: 1647150 - RNA, 18 nt, Human
auguuucauaagaauucu

SEQ ID NO: 1647151 - RNA, 23 nt, Human
ugucuucaggggccacaccaacc

SEQ ID NO: 1647152 - RNA, 16 nt, Human
augcuguauuuuaaaa

SEQ ID NO: 1647153 - RNA, 18 nt, Human
auagcuacuaauuuuaaa

SEQ ID NO: 1647154 - RNA, 17 nt, Human
cuccaaguucaaaacuu

SEQ ID NO: 1647155 - RNA, 13 nt, Human
uauuucuaugaaa

SEQ ID NO: 1647156 - RNA, 21 nt, Human
gagcaucuccucaacucugag

SEQ ID NO: 1647157 - RNA, 18 nt, Human
augagcacgcauggaaaa

SEQ ID NO: 1647158 - RNA, 20 nt, Human
aagucuuucacauuuaaaua

SEQ ID NO: 1647159 - RNA, 11 nt, Human
aaaaaaaggaa

SEQ ID NO: 1647160 - RNA, 12 nt, Human
gccagggcaaga

SEQ ID NO: 1647161 - RNA, 21 nt, Human
aaagauuugauguauguaaua

SEQ ID NO: 1647162 - RNA, 15 nt, Human
agagugugaggaaaa

SEQ ID NO: 1647163 - RNA, 13 nt, Human
ccaaaagguauuu

SEQ ID NO: 1647164 - RNA, 20 nt, Human
agaaggcuguggauuuaaug

SEQ ID NO: 1647165 - RNA, 12 nt, Human
uguuugaaagcu

SEQ ID NO: 1647166 - RNA, 18 nt, Human
uaaguuuuuuuuuaaaaa

SEQ ID NO: 1647167 - RNA, 15 nt, Human
auaucuuaucuuccu

SEQ ID NO: 1647168 - RNA, 19 nt, Human
ugcuugucccuguggaagu

SEQ ID NO: 1647169 - RNA, 19 nt, Human
uaucuauguagaauauauu

SEQ ID NO: 1647170 - RNA, 16 nt, Human
auuccaccuacaugag

SEQ ID NO: 1647171 - RNA, 22 nt, Human
uauuucuaugaaauauuauguu

SEQ ID NO: 1647172 - RNA, 23 nt, Human
ggaacaguuaccucugccucaga

SEQ ID NO: 1647173 - RNA, 20 nt, Human
uuugcaagccagauuuuccu

SEQ ID NO: 1647174 - RNA, 17 nt, Human
guggcucugugugcucu

SEQ ID NO: 1647175 - RNA, 19 nt, Human
auuggagcucgugggacag

SEQ ID NO: 1647176 - RNA, 19 nt, Human
gcucauggaauuggagcuc

SEQ ID NO: 1647177 - RNA, 17 nt, Human
acacuguuaucuucacu

SEQ ID NO: 1647178 - RNA, 21 nt, Human
aaagaaaauaacgauaaaaga

SEQ ID NO: 1647179 - RNA, 14 nt, Human
ucuccucaacucug

SEQ ID NO: 1647180 - RNA, 19 nt, Human
guccaggucuaccaaaaau

SEQ ID NO: 1647181 - RNA, 14 nt, Human
agaaaugaaagcag

SEQ ID NO: 1647182 - RNA, 22 nt, Human
auaucuuuuuuuuaauaaacca

SEQ ID NO: 1647183 - RNA, 15 nt, Human
cuaaggcaggaggau

SEQ ID NO: 1647184 - RNA, 22 nt, Human
agcccuccuuaucaaaggacac

SEQ ID NO: 1647185 - RNA, 19 nt, Human
cccugccucaagcuaugug

SEQ ID NO: 1647186 - RNA, 15 nt, Human
ucaagaucagccugg

SEQ ID NO: 1647187 - RNA, 22 nt, Human
uuuuauagcuacuaauuuuaaa

SEQ ID NO: 1647188 - RNA, 17 nt, Human
auaucaauuuaaaaaaa

SEQ ID NO: 1647189 - RNA, 11 nt, Human
ugccauaaaac

SEQ ID NO: 1647190 - RNA, 23 nt, Human
auauaacaaugcuguauuuuaaa

SEQ ID NO: 1647191 - RNA, 18 nt, Human
cagucucccucccuuggg

SEQ ID NO: 1647192 - RNA, 17 nt, Human
uaacugauuuguaacaa

SEQ ID NO: 1647193 - RNA, 15 nt, Human
guuuuucuuuucauu

SEQ ID NO: 1647194 - RNA, 18 nt, Human
uaucaaaagaaagaaaau

SEQ ID NO: 1647195 - RNA, 20 nt, Human
aguugauuaagaaaggaagu

SEQ ID NO: 1647196 - RNA, 20 nt, Human
aauaagccagacaucaacag

SEQ ID NO: 1647197 - RNA, 18 nt, Human
uaauaauguuucaaacau

SEQ ID NO: 1647198 - RNA, 15 nt, Human
cuggacucaccuccc

SEQ ID NO: 1647199 - RNA, 16 nt, Human
cuacacuccagugaga

SEQ ID NO: 1647200 - RNA, 15 nt, Human
uuuaauaauuuuuaa

SEQ ID NO: 1647201 - RNA, 13 nt, Human
uacauaaaauaca

SEQ ID NO: 1647202 - RNA, 24 nt, Human
ccccugagcuugcagagaugaggc

SEQ ID NO: 1647203 - RNA, 22 nt, Human
cagaucuaugccacaagaaccc

SEQ ID NO: 1647204 - RNA, 13 nt, Human
gaaccuaggguga

SEQ ID NO: 1647205 - RNA, 20 nt, Human
ucacuguauguccuuggugc

SEQ ID NO: 1647206 - RNA, 17 nt, Human
augccccgucccccucu

SEQ ID NO: 1647207 - RNA, 19 nt, Human
gaucacuuuaggccuggug

SEQ ID NO: 1647208 - RNA, 21 nt, Human
auaguuguaccgcaaugugac

SEQ ID NO: 1647209 - RNA, 23 nt, Human
auaauguguucauucuggaauaa

SEQ ID NO: 1647210 - RNA, 15 nt, Human
ccacaggaaccacaa

SEQ ID NO: 1647211 - RNA, 14 nt, Human
acauagugaggagc

SEQ ID NO: 1647212 - RNA, 20 nt, Human
auuacccccagcuuugagga

SEQ ID NO: 1647213 - RNA, 17 nt, Human
uaaauuuaucauuuagu

SEQ ID NO: 1647214 - RNA, 23 nt, Human
gcccuggugccucaccccuugcc

SEQ ID NO: 1647215 - RNA, 12 nt, Human
aagaaaauaaca

SEQ ID NO: 1647216 - RNA, 18 nt, Human
ccugucucaauaaauaaa

SEQ ID NO: 1647217 - RNA, 17 nt, Human
ucauacuucuuaggguu

SEQ ID NO: 1647218 - RNA, 21 nt, Human
uuuucaggcuagauguaugua

SEQ ID NO: 1647219 - RNA, 20 nt, Human
agcccuuccccucugcagcu

SEQ ID NO: 1647220 - RNA, 20 nt, Human
caaauguucaucaaugaaug

SEQ ID NO: 1647221 - RNA, 19 nt, Human
acuccuguucaugcccaua

SEQ ID NO: 1647222 - RNA, 16 nt, Human
aaaauccauacauuug

SEQ ID NO: 1647223 - RNA, 20 nt, Human
gcuuccaggcuggcgugcag

SEQ ID NO: 1647224 - RNA, 17 nt, Human
caaccuucugaggagcu

SEQ ID NO: 1647225 - RNA, 15 nt, Human
auauagaaauguauu

SEQ ID NO: 1647226 - RNA, 14 nt, Human
auuuuaucugcuau

SEQ ID NO: 1647227 - RNA, 16 nt, Human
cagauccccaagccug

SEQ ID NO: 1647228 - RNA, 22 nt, Human
caucgcaauguaagacucggga

SEQ ID NO: 1647229 - RNA, 15 nt, Human
gccuugggaccccug

SEQ ID NO: 1647230 - RNA, 11 nt, Human
cugacaaagac

SEQ ID NO: 1647231 - RNA, 22 nt, Human
aaaucaggguuaguauugucca

SEQ ID NO: 1647232 - RNA, 22 nt, Human
caggggccacaccaaccuucug

SEQ ID NO: 1647233 - RNA, 12 nt, Human
aauacuuuauaa

SEQ ID NO: 1647234 - RNA, 17 nt, Human
ugaaauaagccagacau

SEQ ID NO: 1647235 - RNA, 13 nt, Human
ugaaagaaaauaa

SEQ ID NO: 1647236 - RNA, 14 nt, Human
cucccugcccccca

SEQ ID NO: 1647237 - RNA, 14 nt, Human
gccagggcaagaga

SEQ ID NO: 1647238 - RNA, 19 nt, Human
agaguuuagcuggaaaagu

SEQ ID NO: 1647239 - RNA, 14 nt, Human
agauuucaaaaaaa

SEQ ID NO: 1647240 - RNA, 17 nt, Human
cacauguuccccuuggg

SEQ ID NO: 1647241 - RNA, 18 nt, Human
uuuauguuuaauucugaa

SEQ ID NO: 1647242 - RNA, 21 nt, Human
aacuuguaaaggaauuuaaaa

SEQ ID NO: 1647243 - RNA, 16 nt, Human
ccuacaugagguacug

SEQ ID NO: 1647244 - RNA, 18 nt, Human
ccaaccuggaguugaaaa

SEQ ID NO: 1647245 - RNA, 16 nt, Human
ccccaucucuucuggg

SEQ ID NO: 1647246 - RNA, 19 nt, Human
cuccuuggagacagggccc

SEQ ID NO: 1647247 - RNA, 12 nt, Human
agaauauauuuc

SEQ ID NO: 1647248 - RNA, 14 nt, Human
gcaaagcccagcuu

SEQ ID NO: 1647249 - RNA, 22 nt, Human
cucugagccuugggaccccuga

SEQ ID NO: 1647250 - RNA, 14 nt, Human
uuaaacuuugauuu

SEQ ID NO: 1647251 - RNA, 20 nt, Human
acaagacacagugaccauac

SEQ ID NO: 1647252 - RNA, 17 nt, Human
uaccaaaaaaaggaagg

SEQ ID NO: 1647253 - RNA, 16 nt, Human
cagggcucacagaauu

SEQ ID NO: 1647254 - RNA, 12 nt, Human
auauaaauaaaa

SEQ ID NO: 1647255 - RNA, 19 nt, Human
caucaaggguacacugccu

SEQ ID NO: 1647256 - RNA, 17 nt, Human
aggcuagaaccaccugc

SEQ ID NO: 1647257 - RNA, 17 nt, Human
ucuauaauuuaaauaua

SEQ ID NO: 1647258 - RNA, 22 nt, Human
uccagccuucucucaaggagag

SEQ ID NO: 1647259 - RNA, 22 nt, Human
uucaauaucuuuuuuuuaauaa

SEQ ID NO: 1647260 - RNA, 17 nt, Human
gcaaauugucacaggac

SEQ ID NO: 1647261 - RNA, 17 nt, Human
accugcugagccccaag

SEQ ID NO: 1647262 - RNA, 17 nt, Human
ggcacaacacaucagga

SEQ ID NO: 1647263 - RNA, 21 nt, Human
aggguuaugauuaaguaauga

SEQ ID NO: 1647264 - RNA, 17 nt, Human
aggccaugggacaggga

SEQ ID NO: 1647265 - RNA, 13 nt, Human
uccccaaaugcuu

SEQ ID NO: 1647266 - RNA, 13 nt, Human
aagcauuccaacu

SEQ ID NO: 1647267 - RNA, 20 nt, Human
ccucaagcuaugugagcuca

SEQ ID NO: 1647268 - RNA, 20 nt, Human
agaugcaguucugaagaaga

SEQ ID NO: 1647269 - RNA, 16 nt, Human
acaugucuagagaaca

SEQ ID NO: 1647270 - RNA, 20 nt, Human
uaacgauaaaagacagugaa

SEQ ID NO: 1647271 - RNA, 16 nt, Human
gaaucacuugaacccg

SEQ ID NO: 1647272 - RNA, 15 nt, Human
ccugccccccagccc

SEQ ID NO: 1647273 - RNA, 21 nt, Human
accaaggagccaaacauccua

SEQ ID NO: 1647274 - RNA, 17 nt, Human
uagaauauauuuccuua

SEQ ID NO: 1647275 - RNA, 13 nt, Human
gagacagcucugc

SEQ ID NO: 1647276 - RNA, 16 nt, Human
ccuccuuaucaaagga

SEQ ID NO: 1647277 - RNA, 20 nt, Human
agcagugagccaaauguaaa

SEQ ID NO: 1647278 - RNA, 15 nt, Human
uucacuguaaaauaa

SEQ ID NO: 1647279 - RNA, 17 nt, Human
gaaaaucaggcuggcca

SEQ ID NO: 1647280 - RNA, 15 nt, Human
ugagcucaccagucc

SEQ ID NO: 1647281 - RNA, 17 nt, Human
ccaaaagguauuuuaau

SEQ ID NO: 1647282 - RNA, 12 nt, Human
aggaaauauuuu

SEQ ID NO: 1647283 - RNA, 21 nt, Human
aaaugucuugcuugauuguau

SEQ ID NO: 1647284 - RNA, 20 nt, Human
agaauucuguugauggaaau

SEQ ID NO: 1647285 - RNA, 22 nt, Human
aauuuuagacauucuuuaucuu

SEQ ID NO: 1647286 - RNA, 17 nt, Human
auguuuacagaucccca

SEQ ID NO: 1647287 - RNA, 24 nt, Human
cauucuggaauaauccuaaacaua

SEQ ID NO: 1647288 - RNA, 13 nt, Human
aaguaaaggcaaa

SEQ ID NO: 1647289 - RNA, 18 nt, Human
ggaaggcugaggcaggag

SEQ ID NO: 1647290 - RNA, 15 nt, Human
aaaucaaacuuuaca

SEQ ID NO: 1647291 - RNA, 17 nt, Human
cagggcugaagcugugu

SEQ ID NO: 1647292 - RNA, 17 nt, Human
gacucaccucccccauc

SEQ ID NO: 1647293 - RNA, 12 nt, Human
gcucagcccugg

SEQ ID NO: 1647294 - RNA, 17 nt, Human
auaaaguacaagagcuu

SEQ ID NO: 1647295 - RNA, 16 nt, Human
guuuuuuuuuaaaaaa

SEQ ID NO: 1647296 - RNA, 14 nt, Human
ccuugaugaagaag

SEQ ID NO: 1647297 - RNA, 14 nt, Human
aaagaaacaaaaau

SEQ ID NO: 1647298 - RNA, 14 nt, Human
ggcuacagugagcc

SEQ ID NO: 1647299 - RNA, 14 nt, Human
aagaagugaaaauc

SEQ ID NO: 1647300 - RNA, 21 nt, Human
ccaguccauugggcaggcaga

SEQ ID NO: 1647301 - RNA, 13 nt, Human
uuuucuuuucauu

SEQ ID NO: 1647302 - RNA, 18 nt, Human
uauagcuacuaauuuuaa

SEQ ID NO: 1647303 - RNA, 20 nt, Human
ggaaaguuuucuccacugga

SEQ ID NO: 1647304 - RNA, 23 nt, Human
gaaaacaauaacgauaaaagaca

SEQ ID NO: 1647305 - RNA, 12 nt, Human
ugacauuagaug

SEQ ID NO: 1647306 - RNA, 22 nt, Human
augguuguauuauuuuuuaaaa

SEQ ID NO: 1647307 - RNA, 19 nt, Human
cagaaagcagaacagugau

SEQ ID NO: 1647308 - RNA, 22 nt, Human
cuuguacucugaaaguuuugga

SEQ ID NO: 1647309 - RNA, 17 nt, Human
ugaaaaucuuauaauuu

SEQ ID NO: 1647310 - RNA, 14 nt, Human
aaaagacagugaaa

SEQ ID NO: 1647311 - RNA, 14 nt, Human
cuggccgggagccu

SEQ ID NO: 1647312 - RNA, 20 nt, Human
acuagaguuuagcuggaaaa

SEQ ID NO: 1647313 - RNA, 17 nt, Human
uauuuauuaaguauuuu

SEQ ID NO: 1647314 - RNA, 20 nt, Human
ccgaggugggcagaucacuu

SEQ ID NO: 1647315 - RNA, 12 nt, Human
acugaaaucaua

SEQ ID NO: 1647316 - RNA, 18 nt, Human
auuuuagacauucuuuau

SEQ ID NO: 1647317 - RNA, 22 nt, Human
ugguuguauuauuuuuuaaaaa

SEQ ID NO: 1647318 - RNA, 22 nt, Human
aggcacaguggcucacaccugu

SEQ ID NO: 1647319 - RNA, 17 nt, Human
gccaugugcagccacca

SEQ ID NO: 1647320 - RNA, 21 nt, Human
auccccaagccuggcaaggga

SEQ ID NO: 1647321 - RNA, 17 nt, Human
caaaacuuauuggaaug

SEQ ID NO: 1647322 - RNA, 22 nt, Human
uuuauagcuacuaauuuuaaaa

SEQ ID NO: 1647323 - RNA, 13 nt, Human
augaguugcaguu

SEQ ID NO: 1647324 - RNA, 18 nt, Human
uuuuauaucaauuuaaaa

SEQ ID NO: 1647325 - RNA, 20 nt, Human
gccgggcgugguggugagug

SEQ ID NO: 1647326 - RNA, 11 nt, Human
agugucugcug

SEQ ID NO: 1647327 - RNA, 20 nt, Human
gcuggagacauugaggcagg

SEQ ID NO: 1647328 - RNA, 18 nt, Human
cagagacagaaagcagaa

SEQ ID NO: 1647329 - RNA, 20 nt, Human
accucugccucagaaaacaa

SEQ ID NO: 1647330 - RNA, 14 nt, Human
auuuaaauauaugc

SEQ ID NO: 1647331 - RNA, 16 nt, Human
cuuuuaguuuuuaaag

SEQ ID NO: 1647332 - RNA, 19 nt, Human
aguugauuuaaggccaggc

SEQ ID NO: 1647333 - RNA, 22 nt, Human
auauuuacaaaugggaaacaaa

SEQ ID NO: 1647334 - RNA, 15 nt, Human
uuuaaggauucugag

SEQ ID NO: 1647335 - RNA, 15 nt, Human
auauaaauaaaaaua

SEQ ID NO: 1647336 - RNA, 14 nt, Human
aagcaucacaugaa

SEQ ID NO: 1647337 - RNA, 14 nt, Human
aauuagaaauguaa

SEQ ID NO: 1647338 - RNA, 17 nt, Human
uuccaagugauugaaac

SEQ ID NO: 1647339 - RNA, 16 nt, Human
uaagaaauaggaaaua

SEQ ID NO: 1647340 - RNA, 17 nt, Human
uugccaaauauaaauaa

SEQ ID NO: 1647341 - RNA, 20 nt, Human
ugguuguauuauuuuuuaaa

SEQ ID NO: 1647342 - RNA, 14 nt, Human
ucucagaaggaaag

SEQ ID NO: 1647343 - RNA, 18 nt, Human
gcauggccacaucugagc

SEQ ID NO: 1647344 - RNA, 15 nt, Human
aggcaccucucuggg

SEQ ID NO: 1647345 - RNA, 13 nt, Human
aagacaaggaaaa

SEQ ID NO: 1647346 - RNA, 14 nt, Human
agauguagaggaga

SEQ ID NO: 1647347 - RNA, 16 nt, Human
gugaaaccuggucucu

SEQ ID NO: 1647348 - RNA, 16 nt, Human
gacaagcucacagacc

SEQ ID NO: 1647349 - RNA, 18 nt, Human
auuuauuacuguaagaaa

SEQ ID NO: 1647350 - RNA, 19 nt, Human
agcuacuaauuuuaaaaug

SEQ ID NO: 1647351 - RNA, 16 nt, Human
cuucggccuccauccu

SEQ ID NO: 1647352 - RNA, 20 nt, Human
ucauucacucaacaaacaua

SEQ ID NO: 1647353 - RNA, 13 nt, Human
ugaauauaaauuu

SEQ ID NO: 1647354 - RNA, 20 nt, Human
ccaaauguucaucaaugaau

SEQ ID NO: 1647355 - RNA, 21 nt, Human
cacuugaacccgggaggcaga

SEQ ID NO: 1647356 - RNA, 14 nt, Human
ucuaggaaauauuu

SEQ ID NO: 1647357 - RNA, 19 nt, Human
uuggcaagcucuaucacca

SEQ ID NO: 1647358 - RNA, 18 nt, Human
auauuucuguuaaaauau

SEQ ID NO: 1647359 - RNA, 18 nt, Human
acauguuacaacacggac

SEQ ID NO: 1647360 - RNA, 21 nt, Human
acgcucucuggccuucggccu

SEQ ID NO: 1647361 - RNA, 14 nt, Human
gcguugagccacca

SEQ ID NO: 1647362 - RNA, 17 nt, Human
agauagaugaagaagcu

SEQ ID NO: 1647363 - RNA, 18 nt, Human
aguagcugcccuuucuca

SEQ ID NO: 1647364 - RNA, 16 nt, Human
cacuaguauuucuaug

SEQ ID NO: 1647365 - RNA, 21 nt, Human
agucaagggugugugcagcau

SEQ ID NO: 1647366 - RNA, 20 nt, Human
aagacagugaaagaaaauaa

SEQ ID NO: 1647367 - RNA, 16 nt, Human
cuccauccugaggcuc

SEQ ID NO: 1647368 - RNA, 22 nt, Human
cugccagaaucuagagcaaagc

SEQ ID NO: 1647369 - RNA, 18 nt, Human
ugccauaauuacuauguc

SEQ ID NO: 1647370 - RNA, 20 nt, Human
gaaacauuugguaaggggaa

SEQ ID NO: 1647371 - RNA, 13 nt, Human
ugggaggcugaga

SEQ ID NO: 1647372 - RNA, 13 nt, Human
uaaauauauauuu

SEQ ID NO: 1647373 - RNA, 18 nt, Human
auaggaaauauuuuaaug

SEQ ID NO: 1647374 - RNA, 16 nt, Human
ucuucucagaaggaaa

SEQ ID NO: 1647375 - RNA, 20 nt, Human
gaaaauaacgauaaaagaca

SEQ ID NO: 1647376 - RNA, 17 nt, Human
uucacuuuuauaagaaa

SEQ ID NO: 1647377 - RNA, 20 nt, Human
gcccauccugccccugagcc

SEQ ID NO: 1647378 - RNA, 22 nt, Human
uauuucagauaaucacaauaca

SEQ ID NO: 1647379 - RNA, 16 nt, Human
cugagcgacagugaga

SEQ ID NO: 1647380 - RNA, 18 nt, Human
caugaagauguagaggag

SEQ ID NO: 1647381 - RNA, 15 nt, Human
uauaaauaaaaauaa

SEQ ID NO: 1647382 - RNA, 18 nt, Human
uguaaaggaauuuaaaaa

SEQ ID NO: 1647383 - RNA, 16 nt, Human
ugagccccggaggucg

SEQ ID NO: 1647384 - RNA, 13 nt, Human
agcgacagugaga

SEQ ID NO: 1647385 - RNA, 13 nt, Human
uaaagaaacaaaa

SEQ ID NO: 1647386 - RNA, 22 nt, Human
ugagacucugucucaguccaug

SEQ ID NO: 1647387 - RNA, 11 nt, Human
gcaugguuuag

SEQ ID NO: 1647388 - RNA, 19 nt, Human
uuauauuucuguuaaaaua

SEQ ID NO: 1647389 - RNA, 18 nt, Human
augucugaaauggaacag

SEQ ID NO: 1647390 - RNA, 16 nt, Human
uuaaauuguaauaggc

SEQ ID NO: 1647391 - RNA, 16 nt, Human
agugagacagcucugc

SEQ ID NO: 1647392 - RNA, 18 nt, Human
ccuugggaccccugagcu

SEQ ID NO: 1647393 - RNA, 20 nt, Human
gaaacugcccacucugcaag

SEQ ID NO: 1647394 - RNA, 22 nt, Human
uguuuuuccaguaguuagcuuu

SEQ ID NO: 1647395 - RNA, 23 nt, Human
aauuaaaaccucuuugugucccu

SEQ ID NO: 1647396 - RNA, 18 nt, Human
cauagguuuaauaauuuu

SEQ ID NO: 1647397 - RNA, 16 nt, Human
auacauguuacaacac

SEQ ID NO: 1647398 - RNA, 13 nt, Human
cgggaggcagagg

SEQ ID NO: 1647399 - RNA, 21 nt, Human
aauuuacagagacagaaagca

SEQ ID NO: 1647400 - RNA, 21 nt, Human
gggagccugaucaccugcccu

SEQ ID NO: 1647401 - RNA, 14 nt, Human
ugaagauguagagg

SEQ ID NO: 1647402 - RNA, 17 nt, Human
acuauuuaauuauuuca

SEQ ID NO: 1647403 - RNA, 14 nt, Human
uaaagaaacaaaaa

SEQ ID NO: 1647404 - RNA, 22 nt, Human
uggguuccuuccucugagccuu

SEQ ID NO: 1647405 - RNA, 19 nt, Human
acuauuuaauuauuucacu

SEQ ID NO: 1647406 - RNA, 11 nt, Human
aaagaaacaaa

SEQ ID NO: 1647407 - RNA, 22 nt, Human
auauauaacaaugcuguauuuu

SEQ ID NO: 1647408 - RNA, 18 nt, Human
augggggcagcaccuccu

SEQ ID NO: 1647409 - RNA, 18 nt, Human
acaagccuccuuuuaaag

SEQ ID NO: 1647410 - RNA, 14 nt, Human
acaagcagcccuua

SEQ ID NO: 1647411 - RNA, 17 nt, Human
aaauaacgauaaaagac

SEQ ID NO: 1647412 - RNA, 16 nt, Human
cauagaaguaaaaaca

SEQ ID NO: 1647413 - RNA, 20 nt, Human
guugagccaccaagcuggug

SEQ ID NO: 1647414 - RNA, 16 nt, Human
gaugggcaaaaaacca

SEQ ID NO: 1647415 - RNA, 15 nt, Human
aauacaaaaacuuag

SEQ ID NO: 1647416 - RNA, 15 nt, Human
cuguaaaauaauaac

SEQ ID NO: 1647417 - RNA, 17 nt, Human
acaucgcagacacaugu

SEQ ID NO: 1647418 - RNA, 13 nt, Human
agagguccacaac

SEQ ID NO: 1647419 - RNA, 20 nt, Human
aggugacuauuauauuucca

SEQ ID NO: 1647420 - RNA, 13 nt, Human
cuucucaacucca

SEQ ID NO: 1647421 - RNA, 14 nt, Human
cauuuauguuccuu

SEQ ID NO: 1647422 - RNA, 20 nt, Human
auuacauuuguauaaaauaa

SEQ ID NO: 1647423 - RNA, 14 nt, Human
auuuccaagaaaua

SEQ ID NO: 1647424 - RNA, 13 nt, Human
ccugccccccagc

SEQ ID NO: 1647425 - RNA, 18 nt, Human
agucuguuuucccuccuu

SEQ ID NO: 1647426 - RNA, 15 nt, Human
aaaaauaacaaugaa

SEQ ID NO: 1647427 - RNA, 16 nt, Human
ccugagcgacagugag

SEQ ID NO: 1647428 - RNA, 19 nt, Human
cugccagaaucuagagcaa

SEQ ID NO: 1647429 - RNA, 16 nt, Human
cccuauccuacuuccc

SEQ ID NO: 1647430 - RNA, 17 nt, Human
aauaugcucuaaacaug

SEQ ID NO: 1647431 - RNA, 21 nt, Human
ugcuggccaccugcugagccc

SEQ ID NO: 1647432 - RNA, 12 nt, Human
uaagaagacugc

SEQ ID NO: 1647433 - RNA, 20 nt, Human
aaaagacagugaaagaaaau

SEQ ID NO: 1647434 - RNA, 13 nt, Human
acacuuaaaaaug

SEQ ID NO: 1647435 - RNA, 20 nt, Human
aaagacagugaaagaaaaua

SEQ ID NO: 1647436 - RNA, 18 nt, Human
acuugccauaaaacuuag

SEQ ID NO: 1647437 - RNA, 14 nt, Human
gagacacugucucu

SEQ ID NO: 1647438 - RNA, 14 nt, Human
acuuugauuuuaua

SEQ ID NO: 1647439 - RNA, 14 nt, Human
augggaacaaggaa

SEQ ID NO: 1647440 - RNA, 22 nt, Human
cugcuggagacauugaggcagg

SEQ ID NO: 1647441 - RNA, 18 nt, Human
aaaagacaaggaaaaaau

SEQ ID NO: 1647442 - RNA, 15 nt, Human
ccugcaaagcccagc

SEQ ID NO: 1647443 - RNA, 14 nt, Human
uauuuauuuuaaua

SEQ ID NO: 1647444 - RNA, 12 nt, Human
uaaaaauuaaaa

SEQ ID NO: 1647445 - RNA, 16 nt, Human
ccuuccccucugcagc

SEQ ID NO: 1647446 - RNA, 15 nt, Human
uguuaucuucacuuu

SEQ ID NO: 1647447 - RNA, 17 nt, Human
auuuaguuauaaaaaua

SEQ ID NO: 1647448 - RNA, 21 nt, Human
cucaguccaugaagauguaga

SEQ ID NO: 1647449 - RNA, 17 nt, Human
cauuuguauaaaauaau

SEQ ID NO: 1647450 - RNA, 20 nt, Human
ggccaugggacagggaggac

SEQ ID NO: 1647451 - RNA, 15 nt, Human
cgagacaagcagccc

SEQ ID NO: 1647452 - RNA, 14 nt, Human
uuuguauaaaauaa

SEQ ID NO: 1647453 - RNA, 19 nt, Human
aucuauguagaauauauuu

SEQ ID NO: 1647454 - RNA, 14 nt, Human
uugggaaaaaguaa

SEQ ID NO: 1647455 - RNA, 14 nt, Human
ccaugggacaggga

SEQ ID NO: 1647456 - RNA, 13 nt, Human
aaacauccuacaa

SEQ ID NO: 1647457 - RNA, 20 nt, Human
aaggagccaaacauccuaca

SEQ ID NO: 1647458 - RNA, 20 nt, Human
aaggaugccccgucccccuc

SEQ ID NO: 1647459 - RNA, 22 nt, Human
gcagaugaugcuuugagaacau

SEQ ID NO: 1647460 - RNA, 16 nt, Human
agcuaaauauauauuu

SEQ ID NO: 1647461 - RNA, 19 nt, Human
acauauagcagcucuugaa

SEQ ID NO: 1647462 - RNA, 12 nt, Human
guugauggaaau

SEQ ID NO: 1647463 - RNA, 18 nt, Human
cccacuagacccacugga

SEQ ID NO: 1647464 - RNA, 19 nt, Human
uaggugacuauuauauuuc

SEQ ID NO: 1647465 - RNA, 12 nt, Human
ccaggcugagcc

SEQ ID NO: 1647466 - RNA, 15 nt, Human
guucugcagauaaac

SEQ ID NO: 1647467 - RNA, 23 nt, Human
ggaugguucccuugaugaagaag

SEQ ID NO: 1647468 - RNA, 15 nt, Human
uccauccugaggcuc

SEQ ID NO: 1647469 - RNA, 12 nt, Human
aagaaaauaacg

SEQ ID NO: 1647470 - RNA, 22 nt, Human
uugccuaggcauagcccugccu

SEQ ID NO: 1647471 - RNA, 17 nt, Human
caggcuggcgugcagca

SEQ ID NO: 1647472 - RNA, 16 nt, Human
acauccuacaagacac

SEQ ID NO: 1647473 - RNA, 18 nt, Human
ugagcucagcccuggugg

SEQ ID NO: 1647474 - RNA, 17 nt, Human
uaaaagacaaggaaaaa

SEQ ID NO: 1647475 - RNA, 19 nt, Human
caagcagcccuuagcccuu

SEQ ID NO: 1647476 - RNA, 12 nt, Human
auaaaauacaaa

SEQ ID NO: 1647477 - RNA, 16 nt, Human
aaauaacaaugaaagu

SEQ ID NO: 1647478 - RNA, 21 nt, Human
auauaugcuaagucuuauaua

SEQ ID NO: 1647479 - RNA, 17 nt, Human
guccgaggugggcagau

SEQ ID NO: 1647480 - RNA, 18 nt, Human
uuuuaucugcuaugcuau

SEQ ID NO: 1647481 - RNA, 21 nt, Human
ucaguuccagccuucucucaa

SEQ ID NO: 1647482 - RNA, 13 nt, Human
uguauauuuuaua

SEQ ID NO: 1647483 - RNA, 22 nt, Human
gagucaagggugugugcagcau

SEQ ID NO: 1647484 - RNA, 16 nt, Human
ccucagucucccuccc

SEQ ID NO: 1647485 - RNA, 16 nt, Human
ucucuaggaaauauuu

SEQ ID NO: 1647486 - RNA, 21 nt, Human
uuagauaaggcuguucuuuaa

SEQ ID NO: 1647487 - RNA, 19 nt, Human
uggaaauguuuacagaucc

SEQ ID NO: 1647488 - RNA, 13 nt, Human
cuaggcauagccc

SEQ ID NO: 1647489 - RNA, 15 nt, Human
ugccccgucccccuc

SEQ ID NO: 1647490 - RNA, 14 nt, Human
ugcuggagcucugc

SEQ ID NO: 1647491 - RNA, 14 nt, Human
uaaaagacaaggaa

SEQ ID NO: 1647492 - RNA, 16 nt, Human
ccuccuuuuaaaguaa

SEQ ID NO: 1647493 - RNA, 13 nt, Human
uauauuuuagaua

SEQ ID NO: 1647494 - RNA, 19 nt, Human
cacaggaaccacaagacug

SEQ ID NO: 1647495 - RNA, 16 nt, Human
uuuaaggauucugaga

SEQ ID NO: 1647496 - RNA, 21 nt, Human
cgacagugagacucugucuca

SEQ ID NO: 1647497 - RNA, 20 nt, Human
agccuuuuuuugaaaaaaag

SEQ ID NO: 1647498 - RNA, 14 nt, Human
cugaaacaaaauua

SEQ ID NO: 1647499 - RNA, 12 nt, Human
agcuuucuuccu

SEQ ID NO: 1647500 - RNA, 17 nt, Human
aauaacgauaaaagaca

SEQ ID NO: 1647501 - RNA, 13 nt, Human
aaauccuugaaga

SEQ ID NO: 1647502 - RNA, 19 nt, Human
gaggcagagguugcaguga

SEQ ID NO: 1647503 - RNA, 14 nt, Human
auugaggcaggcac

SEQ ID NO: 1647504 - RNA, 17 nt, Human
uucucuaggaaauauuu

SEQ ID NO: 1647505 - RNA, 19 nt, Human
cagagucaagggugugugc

SEQ ID NO: 1647506 - RNA, 13 nt, Human
ucuauaauuuaaa

SEQ ID NO: 1647507 - RNA, 15 nt, Human
uucaagaccagccug

SEQ ID NO: 1647508 - RNA, 15 nt, Human
uuucaaaaaaaaacc

SEQ ID NO: 1647509 - RNA, 14 nt, Human
gaaggugaucuggc

SEQ ID NO: 1647510 - RNA, 18 nt, Human
aggaaaaaauaacaauga

SEQ ID NO: 1647511 - RNA, 21 nt, Human
ggaaagaauaaccaacacccu

SEQ ID NO: 1647512 - RNA, 21 nt, Human
cauuuucuucucacauuuaua

SEQ ID NO: 1647513 - RNA, 19 nt, Human
uaccauuauggauaaagau

SEQ ID NO: 1647514 - RNA, 15 nt, Human
aaaagacaaggaaaa

SEQ ID NO: 1647515 - RNA, 15 nt, Human
uugacccacaagaaa

SEQ ID NO: 1647516 - RNA, 15 nt, Human
gcuguauuuuaaaag

SEQ ID NO: 1647517 - RNA, 22 nt, Human
caaaugggaaacaaaaggauaa

SEQ ID NO: 1647518 - RNA, 21 nt, Human
aauaauguuucaaacauauau

SEQ ID NO: 1647519 - RNA, 21 nt, Human
augucauuugcuggagcucug

SEQ ID NO: 1647520 - RNA, 17 nt, Human
guguccccuauccuacu

SEQ ID NO: 1647521 - RNA, 16 nt, Human
aaaagcaucacaugaa

SEQ ID NO: 1647522 - RNA, 16 nt, Human
cuuuaugcuaagugaa

SEQ ID NO: 1647523 - RNA, 13 nt, Human
gauuguaaaaugg

SEQ ID NO: 1647524 - RNA, 11 nt, Human
aacaaggaagg

SEQ ID NO: 1647525 - RNA, 17 nt, Human
caaauauaaauaaaaau

SEQ ID NO: 1647526 - RNA, 15 nt, Human
aaaaaauaacaauga

SEQ ID NO: 1647527 - RNA, 11 nt, Human
agacacaugug

SEQ ID NO: 1647528 - RNA, 19 nt, Human
cuuccagauccuggaaauc

SEQ ID NO: 1647529 - RNA, 15 nt, Human
accaaggcugauuaa

SEQ ID NO: 1647530 - RNA, 12 nt, Human
uauaauuuaaaa

SEQ ID NO: 1647531 - RNA, 18 nt, Human
auuaaguuuuuuuuuaaa

SEQ ID NO: 1647532 - RNA, 15 nt, Human
aagugaaaaucuaca

SEQ ID NO: 1647533 - RNA, 11 nt, Human
ucaccuccccc

SEQ ID NO: 1647534 - RNA, 23 nt, Human
uguggaaggugaucuggcucugg

SEQ ID NO: 1647535 - RNA, 17 nt, Human
uuagaugggcauggugg

SEQ ID NO: 1647536 - RNA, 18 nt, Human
acaaaugcauuucuaaag

SEQ ID NO: 1647537 - RNA, 12 nt, Human
agaaaacaauaa

SEQ ID NO: 1647538 - RNA, 22 nt, Human
gaagugaaaaucuacacuccag

SEQ ID NO: 1647539 - RNA, 16 nt, Human
gcaucccuagaaagcc

SEQ ID NO: 1647540 - RNA, 18 nt, Human
cuggggcuuuaacuccug

SEQ ID NO: 1647541 - RNA, 15 nt, Human
uuggggaauauguua

SEQ ID NO: 1647542 - RNA, 22 nt, Human
uaaaauaauuuuuauauuugaa

SEQ ID NO: 1647543 - RNA, 22 nt, Human
uucuacuggcugccagaaucua

SEQ ID NO: 1647544 - RNA, 18 nt, Human
gcuccauuuuuagugaaa

SEQ ID NO: 1647545 - RNA, 23 nt, Human
aggagcuguugagguaccuccaa

SEQ ID NO: 1647546 - RNA, 19 nt, Human
ugagcgcccacuagaccca

SEQ ID NO: 1647547 - RNA, 21 nt, Human
gccaaauauaaauaaaaauaa

SEQ ID NO: 1647548 - RNA, 20 nt, Human
uauaugcuaagucuuauaua

SEQ ID NO: 1647549 - RNA, 20 nt, Human
cuucaacucccugcccccca

SEQ ID NO: 1647550 - RNA, 18 nt, Human
uguauuauuuuuuaaaaa

SEQ ID NO: 1647551 - RNA, 16 nt, Human
uagaaaacaggcaaau

SEQ ID NO: 1647552 - RNA, 16 nt, Human
aaaaauuccaagugau

SEQ ID NO: 1647553 - RNA, 18 nt, Human
augaugcuuugagaacau

SEQ ID NO: 1647554 - RNA, 13 nt, Human
gcuggagcucugc

SEQ ID NO: 1647555 - RNA, 19 nt, Human
ccuccagggagucucagcu

SEQ ID NO: 1647556 - RNA, 22 nt, Human
uguucugauauuggacaguaaa

SEQ ID NO: 1647557 - RNA, 20 nt, Human
gacaggcacuaucuggguuu

SEQ ID NO: 1647558 - RNA, 21 nt, Human
caauuuuguuauguauauuuu

SEQ ID NO: 1647559 - RNA, 17 nt, Human
aaagcagggacuugaac

SEQ ID NO: 1647560 - RNA, 21 nt, Human
caagacugcacaucaaaauau

SEQ ID NO: 1647561 - RNA, 17 nt, Human
gaacagauuucaaaaaa

SEQ ID NO: 1647562 - RNA, 13 nt, Human
ucucccucccuug

SEQ ID NO: 1647563 - RNA, 12 nt, Human
auaacuggaaac

SEQ ID NO: 1647564 - RNA, 15 nt, Human
ucagucucccucccu

SEQ ID NO: 1647565 - RNA, 14 nt, Human
uauaauuuaaaaua

SEQ ID NO: 1647566 - RNA, 20 nt, Human
ugccccccagcccuccuuau

SEQ ID NO: 1647567 - RNA, 13 nt, Human
cuacauaaaauac

SEQ ID NO: 1647568 - RNA, 18 nt, Human
gcagugucugcuggagac

SEQ ID NO: 1647569 - RNA, 18 nt, Human
cugagucccaggcugagc

SEQ ID NO: 1647570 - RNA, 23 nt, Human
uaauuuguaguguuggagaagaa

SEQ ID NO: 1647571 - RNA, 19 nt, Human
uauauuuuuuguuaaauga

SEQ ID NO: 1647572 - RNA, 21 nt, Human
ccauaccccuggccaaggaag

SEQ ID NO: 1647573 - RNA, 21 nt, Human
gaagcuagaaaacaggcaaau

SEQ ID NO: 1647574 - RNA, 21 nt, Human
agacaagaaggaaagauuuug

SEQ ID NO: 1647575 - RNA, 15 nt, Human
uauuuauuuuaauaa

SEQ ID NO: 1647576 - RNA, 16 nt, Human
agauagaugaagaagc

SEQ ID NO: 1647577 - RNA, 12 nt, Human
agaaucuagagc

SEQ ID NO: 1647578 - RNA, 13 nt, Human
auaucuucagaaa

SEQ ID NO: 1647579 - RNA, 13 nt, Human
ucuacuaaaaaua

SEQ ID NO: 1647580 - RNA, 21 nt, Human
cuaggaugggaacaaggaagg

SEQ ID NO: 1647581 - RNA, 14 nt, Human
aaauaggaaauauu

SEQ ID NO: 1647582 - RNA, 15 nt, Human
auuugguaaggggaa

SEQ ID NO: 1647583 - RNA, 19 nt, Human
gucaaucagccuaguugau

SEQ ID NO: 1647584 - RNA, 20 nt, Human
ccgauaucuucagaaaaccu

SEQ ID NO: 1647585 - RNA, 18 nt, Human
cucuauguucuaagaagu

SEQ ID NO: 1647586 - RNA, 16 nt, Human
agccuacuaaaugcuc

SEQ ID NO: 1647587 - RNA, 14 nt, Human
agacaucaacagau

SEQ ID NO: 1647588 - RNA, 14 nt, Human
gagaggcaaagaaa

SEQ ID NO: 1647589 - RNA, 23 nt, Human
aagccauccccgcuccugguugg

SEQ ID NO: 1647590 - RNA, 15 nt, Human
ugggacagggaggac

SEQ ID NO: 1647591 - RNA, 17 nt, Human
caaacauauauaacaau

SEQ ID NO: 1647592 - RNA, 20 nt, Human
cacuagacccacuggacuca

SEQ ID NO: 1647593 - RNA, 22 nt, Human
caagcacuaaacaaagagugaa

SEQ ID NO: 1647594 - RNA, 22 nt, Human
ucugguagcuaaauauauauuu

SEQ ID NO: 1647595 - RNA, 14 nt, Human
aggaaagaugugaa

SEQ ID NO: 1647596 - RNA, 22 nt, Human
cucuggccuucggccuccaucc

SEQ ID NO: 1647597 - RNA, 18 nt, Human
uaggugacuauuauauuu

SEQ ID NO: 1647598 - RNA, 13 nt, Human
aaaugaaagcagg

SEQ ID NO: 1647599 - RNA, 21 nt, Human
auacaguggagacaucuggaa

SEQ ID NO: 1647600 - RNA, 16 nt, Human
caugguuuagaaagcu

SEQ ID NO: 1647601 - RNA, 22 nt, Human
gcagagagguagggauggggcu

SEQ ID NO: 1647602 - RNA, 23 nt, Human
gacacauaucaaacugaaacaaa

SEQ ID NO: 1647603 - RNA, 19 nt, Human
gucaaauugugugaaaggu

SEQ ID NO: 1647604 - RNA, 21 nt, Human
gaaagcagggacuugaaccca

SEQ ID NO: 1647605 - RNA, 16 nt, Human
aacaauaaaagacaag

SEQ ID NO: 1647606 - RNA, 20 nt, Human
cuggccaccugcugagcccc

SEQ ID NO: 1647607 - RNA, 14 nt, Human
aucuaugccacaag

SEQ ID NO: 1647608 - RNA, 15 nt, Human
gucucuugaggcaca

SEQ ID NO: 1647609 - RNA, 22 nt, Human
caugucuagagaacacugugcu

SEQ ID NO: 1647610 - RNA, 13 nt, Human
cuagcagugagcc

SEQ ID NO: 1647611 - RNA, 15 nt, Human
uaugcuuguaacugu

SEQ ID NO: 1647612 - RNA, 14 nt, Human
ucccuugaugaaga

SEQ ID NO: 1647613 - RNA, 19 nt, Human
ucaauucuugccaaauaua

SEQ ID NO: 1647614 - RNA, 16 nt, Human
acugcuaguuuauaua

SEQ ID NO: 1647615 - RNA, 14 nt, Human
ggccuucggccucc

SEQ ID NO: 1647616 - RNA, 19 nt, Human
aaaauaacgauaaaagaca

SEQ ID NO: 1647617 - RNA, 13 nt, Human
uuggacgagaaaa

SEQ ID NO: 1647618 - RNA, 21 nt, Human
aguuguugcccacagcuguau

SEQ ID NO: 1647619 - RNA, 19 nt, Human
ggacucaccucccccaucu

SEQ ID NO: 1647620 - RNA, 23 nt, Human
cucagcccuggugggcagagagg

SEQ ID NO: 1647621 - RNA, 22 nt, Human
gaggggagcaugggaagugacg

SEQ ID NO: 1647622 - RNA, 21 nt, Human
cacaugaacuuguaaaggaau

SEQ ID NO: 1647623 - RNA, 18 nt, Human
aucuggcucuggacaggc

SEQ ID NO: 1647624 - RNA, 22 nt, Human
ugcuggagacauugaggcaggc

SEQ ID NO: 1647625 - RNA, 15 nt, Human
agcucuaucaccaag

SEQ ID NO: 1647626 - RNA, 19 nt, Human
cugccccccagcccuccuu

SEQ ID NO: 1647627 - RNA, 23 nt, Human
aaccugccagcuggccuugugag

SEQ ID NO: 1647628 - RNA, 22 nt, Human
aucuucacuuuuauaagaaaua

SEQ ID NO: 1647629 - RNA, 23 nt, Human
ucacagaaugacugacaaagaca

SEQ ID NO: 1647630 - RNA, 18 nt, Human
agucuucagcagagaagu

SEQ ID NO: 1647631 - RNA, 15 nt, Human
gaaaugauguuucau

SEQ ID NO: 1647632 - RNA, 21 nt, Human
uaauaggcguaacuaauuuua

SEQ ID NO: 1647633 - RNA, 21 nt, Human
aaaaaguucugcagauaaaca

SEQ ID NO: 1647634 - RNA, 23 nt, Human
gaacagauuucaaaaaaaaaccc

SEQ ID NO: 1647635 - RNA, 20 nt, Human
aaauccuugaagauuuacca

SEQ ID NO: 1647636 - RNA, 13 nt, Human
gaagaacugaaau

SEQ ID NO: 1647637 - RNA, 18 nt, Human
uucaauaucuuuuuuuua

SEQ ID NO: 1647638 - RNA, 15 nt, Human
uacaaaugcauuucu

SEQ ID NO: 1647639 - RNA, 15 nt, Human
agcuaaauauauauu

SEQ ID NO: 1647640 - RNA, 13 nt, Human
cauggaaaaguuu

SEQ ID NO: 1647641 - RNA, 20 nt, Human
aucuauguagaauauauuuc

SEQ ID NO: 1647642 - RNA, 21 nt, Human
cuccauggaaacgaagcacca

SEQ ID NO: 1647643 - RNA, 23 nt, Human
auacaguggagacaucuggaaag

SEQ ID NO: 1647644 - RNA, 14 nt, Human
acgagaaaacaaua

SEQ ID NO: 1647645 - RNA, 17 nt, Human
acuugaacccauauuug

SEQ ID NO: 1647646 - RNA, 14 nt, Human
ugagguugugugug

SEQ ID NO: 1647647 - RNA, 14 nt, Human
ucaaugcagccccc

SEQ ID NO: 1647648 - RNA, 18 nt, Human
auccccaagccuggcaag

SEQ ID NO: 1647649 - RNA, 20 nt, Human
gagcaucaucuucuggguua

SEQ ID NO: 1647650 - RNA, 20 nt, Human
ggagccugaucaccugcccu

SEQ ID NO: 1647651 - RNA, 14 nt, Human
agcucuaucaccaa

SEQ ID NO: 1647652 - RNA, 16 nt, Human
aauuuuuaauuauaug

SEQ ID NO: 1647653 - RNA, 18 nt, Human
uaaaauccauacauuugu

SEQ ID NO: 1647654 - RNA, 23 nt, Human
gaucuacaugucuagagaacacu

SEQ ID NO: 1647655 - RNA, 18 nt, Human
acugccuucucaacucca

SEQ ID NO: 1647656 - RNA, 17 nt, Human
augcagagguccacaac

SEQ ID NO: 1647657 - RNA, 22 nt, Human
agcuuguauuccuuuuucucuc

SEQ ID NO: 1647658 - RNA, 14 nt, Human
ugagcucaccaguc

SEQ ID NO: 1647659 - RNA, 20 nt, Human
cacuguggguagacacacau

SEQ ID NO: 1647660 - RNA, 14 nt, Human
uuagagaauuuccu

SEQ ID NO: 1647661 - RNA, 22 nt, Human
caggauuagauaaggcuguucu

SEQ ID NO: 1647662 - RNA, 13 nt, Human
uuuagugaaauau

SEQ ID NO: 1647663 - RNA, 15 nt, Human
aguauaggccaggca

SEQ ID NO: 1647664 - RNA, 19 nt, Human
uauuuaauuauuucacuuu

SEQ ID NO: 1647665 - RNA, 22 nt, Human
aaccuacacgagauacagaauu

SEQ ID NO: 1647666 - RNA, 14 nt, Human
cauggccacaucug

SEQ ID NO: 1647667 - RNA, 18 nt, Human
auucuugccaaauauaaa

SEQ ID NO: 1647668 - RNA, 17 nt, Human
aaauguucaucaaugaa

SEQ ID NO: 1647669 - RNA, 13 nt, Human
auaaauaaaaaua

SEQ ID NO: 1647670 - RNA, 21 nt, Human
caucuagcaugucgucaaagc

SEQ ID NO: 1647671 - RNA, 16 nt, Human
ugacuuaaugccacua

SEQ ID NO: 1647672 - RNA, 16 nt, Human
agacauugaggcaggc

SEQ ID NO: 1647673 - RNA, 19 nt, Human
gaaugggggcagcaccucc

SEQ ID NO: 1647674 - RNA, 18 nt, Human
ccucuggcuccagcuggc

SEQ ID NO: 1647675 - RNA, 14 nt, Human
cacaacacacagau

SEQ ID NO: 1647676 - RNA, 12 nt, Human
ggcugaugcagu

SEQ ID NO: 1647677 - RNA, 16 nt, Human
ggggcagcaccuccua

SEQ ID NO: 1647678 - RNA, 12 nt, Human
ucuauguagaau

SEQ ID NO: 1647679 - RNA, 16 nt, Human
uaucaaaagaaagaaa

SEQ ID NO: 1647680 - RNA, 16 nt, Human
auuuuuagugaaauau

SEQ ID NO: 1647681 - RNA, 16 nt, Human
uugccauaauuacuau

SEQ ID NO: 1647682 - RNA, 18 nt, Human
cuggguuaggccuugccu

SEQ ID NO: 1647683 - RNA, 17 nt, Human
cugagcgacagugagac

SEQ ID NO: 1647684 - RNA, 21 nt, Human
auuauauuuauuacuguaaga

SEQ ID NO: 1647685 - RNA, 21 nt, Human
aggaugggaacaaggaaggaa

SEQ ID NO: 1647686 - RNA, 15 nt, Human
acaaaugggaaacaa

SEQ ID NO: 1647687 - RNA, 17 nt, Human
ugucuucaggggccaca

SEQ ID NO: 1647688 - RNA, 13 nt, Human
uaagugcagcccc

SEQ ID NO: 1647689 - RNA, 17 nt, Human
aaaaauccuacuuucau

SEQ ID NO: 1647690 - RNA, 18 nt, Human
uucugauauuggacagua

SEQ ID NO: 1647691 - RNA, 12 nt, Human
gccauaaaacuu

SEQ ID NO: 1647692 - RNA, 13 nt, Human
caacaucuaguga

SEQ ID NO: 1647693 - RNA, 19 nt, Human
gcacuaguauuucuaugaa

SEQ ID NO: 1647694 - RNA, 21 nt, Human
gcauggccacaucugagcccc

SEQ ID NO: 1647695 - RNA, 16 nt, Human
uucaguuauuauauuu

SEQ ID NO: 1647696 - RNA, 17 nt, Human
ccuauccuacuuccccu

SEQ ID NO: 1647697 - RNA, 14 nt, Human
acuuuuauaagaaa

SEQ ID NO: 1647698 - RNA, 16 nt, Human
gcuguuaaucuuucaa

SEQ ID NO: 1647699 - RNA, 18 nt, Human
gagucccaggcugagccu

SEQ ID NO: 1647700 - RNA, 16 nt, Human
ugcauagguuuaauaa

SEQ ID NO: 1647701 - RNA, 14 nt, Human
agcguugagccacc

SEQ ID NO: 1647702 - RNA, 12 nt, Human
ccagucccuccc

SEQ ID NO: 1647703 - RNA, 19 nt, Human
auagugaggagcuuugaaa

SEQ ID NO: 1647704 - RNA, 17 nt, Human
ucccuccccaaaugcuu

SEQ ID NO: 1647705 - RNA, 13 nt, Human
aauaucucuucuc

SEQ ID NO: 1647706 - RNA, 23 nt, Human
gggccuaugcagagguccacaac

SEQ ID NO: 1647707 - RNA, 21 nt, Human
caaaguugauuaagaaaggaa

SEQ ID NO: 1647708 - RNA, 22 nt, Human
caccagucugacuguuuccauc

SEQ ID NO: 1647709 - RNA, 21 nt, Human
auacuauuuaauuauuucacu

SEQ ID NO: 1647710 - RNA, 22 nt, Human
uccuuuuaaagaaacaaaaauc

SEQ ID NO: 1647711 - RNA, 19 nt, Human
uuuuaucugcuaugcuauu

SEQ ID NO: 1647712 - RNA, 17 nt, Human
agcuggaaacacauguu

SEQ ID NO: 1647713 - RNA, 23 nt, Human
gaccccugagcuugcagagauga

SEQ ID NO: 1647714 - RNA, 16 nt, Human
agcuccagugauaaga

SEQ ID NO: 1647715 - RNA, 13 nt, Human
aagacagugaaag

SEQ ID NO: 1647716 - RNA, 15 nt, Human
gauuaagaaaggaag

SEQ ID NO: 1647717 - RNA, 14 nt, Human
ugugaaaagcucca

SEQ ID NO: 1647718 - RNA, 20 nt, Human
ucaagucuuucacauuuaaa

SEQ ID NO: 1647719 - RNA, 22 nt, Human
cucagcuucacccugaggugag

SEQ ID NO: 1647720 - RNA, 21 nt, Human
ccaugugcagccaccagucca

SEQ ID NO: 1647721 - RNA, 16 nt, Human
caaaaaaaggaaggaa

SEQ ID NO: 1647722 - RNA, 15 nt, Human
ugucaauaaaaucca

SEQ ID NO: 1647723 - RNA, 17 nt, Human
gugccuguaaucacagc

SEQ ID NO: 1647724 - RNA, 14 nt, Human
uuauuauauuuaca

SEQ ID NO: 1647725 - RNA, 16 nt, Human
aaauguaauuauguuc

SEQ ID NO: 1647726 - RNA, 19 nt, Human
ucuucacuuuuauaagaaa

SEQ ID NO: 1647727 - RNA, 23 nt, Human
uuuguauaaaauaauuuuuauau

SEQ ID NO: 1647728 - RNA, 12 nt, Human
caauaaauaaau

SEQ ID NO: 1647729 - RNA, 19 nt, Human
cuucacccugaggugagca

SEQ ID NO: 1647730 - RNA, 20 nt, Human
uggaacagauuucaaaaaaa

SEQ ID NO: 1647731 - RNA, 14 nt, Human
cacccugagguugu

SEQ ID NO: 1647732 - RNA, 13 nt, Human
ccucuggcuccag

SEQ ID NO: 1647733 - RNA, 21 nt, Human
auucauagcagcuuauucaca

SEQ ID NO: 1647734 - RNA, 14 nt, Human
uauauauuuuagau

SEQ ID NO: 1647735 - RNA, 12 nt, Human
acagagacagaa

SEQ ID NO: 1647736 - RNA, 23 nt, Human
gaggcauuuaggccaugggacag

SEQ ID NO: 1647737 - RNA, 15 nt, Human
augcccauaccccug

SEQ ID NO: 1647738 - RNA, 23 nt, Human
cgaaauacguuaggaggacaaaa

SEQ ID NO: 1647739 - RNA, 17 nt, Human
caagaaaugaaagcagg

SEQ ID NO: 1647740 - RNA, 13 nt, Human
uggcuccagcugg

SEQ ID NO: 1647741 - RNA, 13 nt, Human
ggcaggcacugcc

SEQ ID NO: 1647742 - RNA, 13 nt, Human
agacacagugacc

SEQ ID NO: 1647743 - RNA, 23 nt, Human
gcuaugcuauugaaguuuuggca

SEQ ID NO: 1647744 - RNA, 15 nt, Human
uggacgagaaaacaa

SEQ ID NO: 1647745 - RNA, 20 nt, Human
ugagagacacacugaagaag

SEQ ID NO: 1647746 - RNA, 22 nt, Human
aauugacccacaagaaaugaaa

SEQ ID NO: 1647747 - RNA, 24 nt, Human
uaauuuaaaauaugcucuaaacau

SEQ ID NO: 1647748 - RNA, 16 nt, Human
acagagacagaaagca

SEQ ID NO: 1647749 - RNA, 13 nt, Human
aggauuugaaauu

SEQ ID NO: 1647750 - RNA, 17 nt, Human
acaagaaaugaaagcag

SEQ ID NO: 1647751 - RNA, 13 nt, Human
gaccagccugguc

SEQ ID NO: 1647752 - RNA, 17 nt, Human
aucaaggguacacugcc

SEQ ID NO: 1647753 - RNA, 19 nt, Human
aaacaaaaggauaaugaau

SEQ ID NO: 1647754 - RNA, 15 nt, Human
auuuuaaaagaauga

SEQ ID NO: 1647755 - RNA, 18 nt, Human
auguuccuaauaaagcuu

SEQ ID NO: 1647756 - RNA, 15 nt, Human
ucugucucaguccau

SEQ ID NO: 1647757 - RNA, 15 nt, Human
aggguuuggaagcca

SEQ ID NO: 1647758 - RNA, 21 nt, Human
auggaaauacacuguuaucuu

SEQ ID NO: 1647759 - RNA, 19 nt, Human
uguuggacgagaaaacaau

SEQ ID NO: 1647760 - RNA, 12 nt, Human
gucccaggcuga

SEQ ID NO: 1647761 - RNA, 12 nt, Human
gaugagagaaca

SEQ ID NO: 1647762 - RNA, 22 nt, Human
cuuguaaaggaauuuaaaaauc

SEQ ID NO: 1647763 - RNA, 21 nt, Human
aagcuccauuuuuagugaaau

SEQ ID NO: 1647764 - RNA, 20 nt, Human
auauuuuauaucaauuuaaa

SEQ ID NO: 1647765 - RNA, 19 nt, Human
aauguuuacagauccccaa

SEQ ID NO: 1647766 - RNA, 14 nt, Human
agaauucauucacu

SEQ ID NO: 1647767 - RNA, 15 nt, Human
aauucugaaagcaac

SEQ ID NO: 1647768 - RNA, 13 nt, Human
ucucagggcagau

SEQ ID NO: 1647769 - RNA, 22 nt, Human
agacacugucucuaccaaaaaa

SEQ ID NO: 1647770 - RNA, 15 nt, Human
ucucagaaggaaaga

SEQ ID NO: 1647771 - RNA, 22 nt, Human
gcuccuccagggagucucagcu

SEQ ID NO: 1647772 - RNA, 17 nt, Human
ggaaggcugaggcagga

SEQ ID NO: 1647773 - RNA, 14 nt, Human
uuaauuauuucacu

SEQ ID NO: 1647774 - RNA, 14 nt, Human
gagcccauggcacu

SEQ ID NO: 1647775 - RNA, 19 nt, Human
ugaaauggacuuuuguaca

SEQ ID NO: 1647776 - RNA, 23 nt, Human
ggcuaagcuucacuguaaaauaa

SEQ ID NO: 1647777 - RNA, 21 nt, Human
aaucaccaaggcugauuaaac

SEQ ID NO: 1647778 - RNA, 17 nt, Human
gaaagccaugugcagcc

SEQ ID NO: 1647779 - RNA, 20 nt, Human
uuuagacauucuuuaucuuu

SEQ ID NO: 1647780 - RNA, 19 nt, Human
cuggcucuggacaggcacu

SEQ ID NO: 1647781 - RNA, 20 nt, Human
ggucaacauagugagacacu

SEQ ID NO: 1647782 - RNA, 17 nt, Human
acuccugcuagaacagu

SEQ ID NO: 1647783 - RNA, 16 nt, Human
aaauauuuauuuuaau

SEQ ID NO: 1647784 - RNA, 20 nt, Human
auaaauggcuuccuggcaau

SEQ ID NO: 1647785 - RNA, 13 nt, Human
aaggaaggaaaga

SEQ ID NO: 1647786 - RNA, 16 nt, Human
cauuauggauaaagau

SEQ ID NO: 1647787 - RNA, 22 nt, Human
aggauggcuaguaucaaaagaa

SEQ ID NO: 1647788 - RNA, 20 nt, Human
cuauguagaauauauuuccu

SEQ ID NO: 1647789 - RNA, 19 nt, Human
uccauccugaggcuccacu

SEQ ID NO: 1647790 - RNA, 23 nt, Human
cugaaaucauacuucuuaggguu

SEQ ID NO: 1647791 - RNA, 21 nt, Human
acuccagccagggcaagagag

SEQ ID NO: 1647792 - RNA, 15 nt, Human
ugaugggcaaaaaac

SEQ ID NO: 1647793 - RNA, 15 nt, Human
aaggguacacugccu

SEQ ID NO: 1647794 - RNA, 18 nt, Human
acagaaagcagaacagug

SEQ ID NO: 1647795 - RNA, 22 nt, Human
ucuuccuggauuccucacuuug

SEQ ID NO: 1647796 - RNA, 19 nt, Human
ugauggaguuucucuagaa

SEQ ID NO: 1647797 - RNA, 19 nt, Human
aaguugcauagguuuaaua

SEQ ID NO: 1647798 - RNA, 16 nt, Human
uguccccuauccuacu

SEQ ID NO: 1647799 - RNA, 23 nt, Human
aauauuuauuuuaauaauguuuc

SEQ ID NO: 1647800 - RNA, 16 nt, Human
ggcugaggcaggagga

SEQ ID NO: 1647801 - RNA, 19 nt, Human
aaucagagauaaagcuuag

SEQ ID NO: 1647802 - RNA, 12 nt, Human
cagaacagugau

SEQ ID NO: 1647803 - RNA, 22 nt, Human
uucuaugcuuguaacugucuuc

SEQ ID NO: 1647804 - RNA, 18 nt, Human
gccugagcgacagugaga

SEQ ID NO: 1647805 - RNA, 14 nt, Human
cuccagugagacag

SEQ ID NO: 1647806 - RNA, 14 nt, Human
aguauaggccaggc

SEQ ID NO: 1647807 - RNA, 16 nt, Human
augccccgucccccuc

SEQ ID NO: 1647808 - RNA, 23 nt, Human
acugucuuguuggacgagaaaac

SEQ ID NO: 1647809 - RNA, 22 nt, Human
gacucaccucccccaucucuuc

SEQ ID NO: 1647810 - RNA, 12 nt, Human
aucuucacuuuu

SEQ ID NO: 1647811 - RNA, 22 nt, Human
gugaacaaauuuacagagacag

SEQ ID NO: 1647812 - RNA, 19 nt, Human
ucuuaucuuccuauaauuu

SEQ ID NO: 1647813 - RNA, 14 nt, Human
ugcagcuuccaggc

SEQ ID NO: 1647814 - RNA, 15 nt, Human
uaucuucacuuuuau

SEQ ID NO: 1647815 - RNA, 18 nt, Human
gcccuggugggcagagag

SEQ ID NO: 1647816 - RNA, 17 nt, Human
cacaccaaccuucugag

SEQ ID NO: 1647817 - RNA, 18 nt, Human
agauauuaacugagaagg

SEQ ID NO: 1647818 - RNA, 22 nt, Human
cggaggucgaggcuacagugag

SEQ ID NO: 1647819 - RNA, 21 nt, Human
uuauuuucuauaauuuaaaua

SEQ ID NO: 1647820 - RNA, 18 nt, Human
ggaugggaacaaggaagg

SEQ ID NO: 1647821 - RNA, 15 nt, Human
cccugagguugugug

SEQ ID NO: 1647822 - RNA, 15 nt, Human
auuuauuaaguauuu

SEQ ID NO: 1647823 - RNA, 23 nt, Human
aggaccggccuuugcaccuccau

SEQ ID NO: 1647824 - RNA, 21 nt, Human
cuuccaggcuggcgugcagca

SEQ ID NO: 1647825 - RNA, 13 nt, Human
ucacuguaaaaua

SEQ ID NO: 1647826 - RNA, 12 nt, Human
caggcauggugg

SEQ ID NO: 1647827 - RNA, 17 nt, Human
uucuccacuggaaaacu

SEQ ID NO: 1647828 - RNA, 15 nt, Human
auuucuaugaaauau

SEQ ID NO: 1647829 - RNA, 13 nt, Human
uuguaacugucuu

SEQ ID NO: 1647830 - RNA, 14 nt, Human
agagacagaaagca

SEQ ID NO: 1647831 - RNA, 20 nt, Human
agcauuguuggcuguuccug

SEQ ID NO: 1647832 - RNA, 16 nt, Human
ugccucaccccuugcc

SEQ ID NO: 1647833 - RNA, 18 nt, Human
uguucaagaccagccugg

SEQ ID NO: 1647834 - RNA, 18 nt, Human
ccauccugccccugagcc

SEQ ID NO: 1647835 - RNA, 20 nt, Human
aauuguaggugacuauuaua

SEQ ID NO: 1647836 - RNA, 18 nt, Human
ugcuauuuauuaaguauu

SEQ ID NO: 1647837 - RNA, 13 nt, Human
uagcuaaguuuug

SEQ ID NO: 1647838 - RNA, 21 nt, Human
caaggaaaaaauaacaaugaa

SEQ ID NO: 1647839 - RNA, 17 nt, Human
uuuuuaauuauauggcu

SEQ ID NO: 1647840 - RNA, 15 nt, Human
ucugcagauaaacag

SEQ ID NO: 1647841 - RNA, 23 nt, Human
aucucuucuggguuccuuccucu

SEQ ID NO: 1647842 - RNA, 23 nt, Human
ugauguuucauaagaauucuguu

SEQ ID NO: 1647843 - RNA, 19 nt, Human
cuuuuaaagaaacaaaaau

SEQ ID NO: 1647844 - RNA, 23 nt, Human
aaugcuccuccagggagucucag

SEQ ID NO: 1647845 - RNA, 22 nt, Human
agaucacuugagcucaggaggu

SEQ ID NO: 1647846 - RNA, 18 nt, Human
ucaagggugugugcagca

SEQ ID NO: 1647847 - RNA, 16 nt, Human
caaacugaaacaaaau

SEQ ID NO: 1647848 - RNA, 22 nt, Human
cucagcccuggugggcagagag

SEQ ID NO: 1647849 - RNA, 21 nt, Human
agggugauauuaaccaggggc

SEQ ID NO: 1647850 - RNA, 14 nt, Human
cugccccccagccc

SEQ ID NO: 1647851 - RNA, 16 nt, Human
aaauaguuuaugauuc

SEQ ID NO: 1647852 - RNA, 18 nt, Human
uggcucuggacaggcacu

SEQ ID NO: 1647853 - RNA, 13 nt, Human
gagcucaggaggu

SEQ ID NO: 1647854 - RNA, 19 nt, Human
cccccucuggcuccagcug

SEQ ID NO: 1647855 - RNA, 15 nt, Human
cuucucuucacaguc

SEQ ID NO: 1647856 - RNA, 22 nt, Human
cccccugcaaagcccagcuuga

SEQ ID NO: 1647857 - RNA, 21 nt, Human
uuacauuuguauaaaauaauu

SEQ ID NO: 1647858 - RNA, 20 nt, Human
ucuguuuucccuccuuggag

SEQ ID NO: 1647859 - RNA, 13 nt, Human
auuuuuuaaaaaa

SEQ ID NO: 1647860 - RNA, 14 nt, Human
acaugucuagagaa

SEQ ID NO: 1647861 - RNA, 15 nt, Human
gaucuggcucuggac

SEQ ID NO: 1647862 - RNA, 23 nt, Human
auuucugagcauuuaauauggau

SEQ ID NO: 1647863 - RNA, 19 nt, Human
gagccugaucaccugcccu

SEQ ID NO: 1647864 - RNA, 14 nt, Human
uauauuuccuuauu

SEQ ID NO: 1647865 - RNA, 19 nt, Human
ugaaauuguauuacaaauc

SEQ ID NO: 1647866 - RNA, 15 nt, Human
ccuggugggcagaga

SEQ ID NO: 1647867 - RNA, 19 nt, Human
cugcaaagcccagcuugaa

SEQ ID NO: 1647868 - RNA, 14 nt, Human
ggagcaucuccuca

SEQ ID NO: 1647869 - RNA, 20 nt, Human
caagcucuaucaccaaggag

SEQ ID NO: 1647870 - RNA, 22 nt, Human
cugaaacaaaauuagaaaugua

SEQ ID NO: 1647871 - RNA, 20 nt, Human
gaccauacuaauuauacccc

SEQ ID NO: 1647872 - RNA, 15 nt, Human
ucaccagucccuccc

SEQ ID NO: 1647873 - RNA, 16 nt, Human
acuaguuucccuugca

SEQ ID NO: 1647874 - RNA, 23 nt, Human
cucuugaggcacagaaacuccug

SEQ ID NO: 1647875 - RNA, 16 nt, Human
aucacuuuaggccugg

SEQ ID NO: 1647876 - RNA, 15 nt, Human
acauccuacaagaca

SEQ ID NO: 1647877 - RNA, 13 nt, Human
ccagcccuccuua

SEQ ID NO: 1647878 - RNA, 15 nt, Human
aaacugaaacaaaau

SEQ ID NO: 1647879 - RNA, 17 nt, Human
auggcuaguaucaaaag

SEQ ID NO: 1647880 - RNA, 17 nt, Human
cauaguaccucugcuau

SEQ ID NO: 1647881 - RNA, 17 nt, Human
cucugauccgagcucag

SEQ ID NO: 1647882 - RNA, 13 nt, Human
cucugcagcuucc

SEQ ID NO: 1647883 - RNA, 19 nt, Human
agaaaauaacgauaaaaga

SEQ ID NO: 1647884 - RNA, 20 nt, Human
gaaacgaggauugggaaaaa

SEQ ID NO: 1647885 - RNA, 20 nt, Human
guucugcagauaaacaguag

SEQ ID NO: 1647886 - RNA, 23 nt, Human
uagacacacaugaaguccaagca

SEQ ID NO: 1647887 - RNA, 21 nt, Human
ccuuuuuuugaaaaaaagcuu

SEQ ID NO: 1647888 - RNA, 23 nt, Human
ugaaaugaguuuuucuuuucauu

SEQ ID NO: 1647889 - RNA, 19 nt, Human
ucccucccaaguaaauguu

SEQ ID NO: 1647890 - RNA, 14 nt, Human
uugugauugauuau

SEQ ID NO: 1647891 - RNA, 18 nt, Human
uaaaagacaaggaaaaaa

SEQ ID NO: 1647892 - RNA, 17 nt, Human
gaucuacaugucuagag

SEQ ID NO: 1647893 - RNA, 21 nt, Human
uagaugagagaacagggcuga

SEQ ID NO: 1647894 - RNA, 19 nt, Human
guaguccuguaauggaagc

SEQ ID NO: 1647895 - RNA, 16 nt, Human
ucccugccccccagcc

SEQ ID NO: 1647896 - RNA, 17 nt, Human
aaagcuccauuuuuagu

SEQ ID NO: 1647897 - RNA, 19 nt, Human
gcacacagcacgggggcca

SEQ ID NO: 1647898 - RNA, 13 nt, Human
acaugucuagaga

SEQ ID NO: 1647899 - RNA, 17 nt, Human
uuuuauaugcuauuuau

SEQ ID NO: 1647900 - RNA, 13 nt, Human
auccugaggcucc

SEQ ID NO: 1647901 - RNA, 13 nt, Human
cuuaucaaaggac

SEQ ID NO: 1647902 - RNA, 19 nt, Human
uaaugaaguguuuagcaua

SEQ ID NO: 1647903 - RNA, 19 nt, Human
gaaaauaacgauaaaagac

SEQ ID NO: 1647904 - RNA, 18 nt, Human
agguccacaacacacaga

SEQ ID NO: 1647905 - RNA, 18 nt, Human
ugggauacuauuuaauua

SEQ ID NO: 1647906 - RNA, 11 nt, Human
uuauauuucca

SEQ ID NO: 1647907 - RNA, 16 nt, Human
auuuuaauaauguuuc

SEQ ID NO: 1647908 - RNA, 15 nt, Human
agguguguugcagug

SEQ ID NO: 1647909 - RNA, 20 nt, Human
aggagaggcaaagaaaggag

SEQ ID NO: 1647910 - RNA, 15 nt, Human
acgagauacagaauu

SEQ ID NO: 1647911 - RNA, 17 nt, Human
aaucuuucacaggggac

SEQ ID NO: 1647912 - RNA, 21 nt, Human
acagcccuucuuuccacagaa

SEQ ID NO: 1647913 - RNA, 15 nt, Human
ccacaucugagcccc

SEQ ID NO: 1647914 - RNA, 12 nt, Human
cuccaaggaccg

SEQ ID NO: 1647915 - RNA, 16 nt, Human
agccucagucucccuc

SEQ ID NO: 1647916 - RNA, 21 nt, Human
uccccuugggggugguggaug

SEQ ID NO: 1647917 - RNA, 16 nt, Human
ucagucucccucccuu

SEQ ID NO: 1647918 - RNA, 20 nt, Human
ucuucagcagagaaguuuuc

SEQ ID NO: 1647919 - RNA, 18 nt, Human
aguuuauauagaaaugua

SEQ ID NO: 1647920 - RNA, 18 nt, Human
uggccaccugcugagccc

SEQ ID NO: 1647921 - RNA, 14 nt, Human
aaauauuauuuuau

SEQ ID NO: 1647922 - RNA, 17 nt, Human
uguuggcuguuccugca

SEQ ID NO: 1647923 - RNA, 17 nt, Human
uggcuaagcaaaaugug

SEQ ID NO: 1647924 - RNA, 22 nt, Human
uaaaguugauuuaaggccaggc

SEQ ID NO: 1647925 - RNA, 18 nt, Human
cagugaaagaaaauaaca

SEQ ID NO: 1647926 - RNA, 14 nt, Human
ccucugcagcuucc

SEQ ID NO: 1647927 - RNA, 14 nt, Human
uaguuucccuugca

SEQ ID NO: 1647928 - RNA, 19 nt, Human
gagguacugagagugaaca

SEQ ID NO: 1647929 - RNA, 17 nt, Human
auuucuaaaaguuuaag

SEQ ID NO: 1647930 - RNA, 16 nt, Human
aaauauaaauaaaaau

SEQ ID NO: 1647931 - RNA, 21 nt, Human
caacacacagauuugagcuca

SEQ ID NO: 1647932 - RNA, 12 nt, Human
gaaaauaacaau

SEQ ID NO: 1647933 - RNA, 17 nt, Human
uuucacauuuaaauaaa

SEQ ID NO: 1647934 - RNA, 11 nt, Human
ccugagcccca

SEQ ID NO: 1647935 - RNA, 17 nt, Human
gacagucaccucaugga

SEQ ID NO: 1647936 - RNA, 23 nt, Human
auuaccauuauggauaaagauga

SEQ ID NO: 1647937 - RNA, 13 nt, Human
guaacuaauuuua

SEQ ID NO: 1647938 - RNA, 21 nt, Human
cagagguccacaacacacaga

SEQ ID NO: 1647939 - RNA, 22 nt, Human
ccauuucuugagguaaaagcau

SEQ ID NO: 1647940 - RNA, 14 nt, Human
uccacaacacacag

SEQ ID NO: 1647941 - RNA, 14 nt, Human
gaaaaaauaacaau

SEQ ID NO: 1647942 - RNA, 11 nt, Human
aacauuuaugu

SEQ ID NO: 1647943 - RNA, 15 nt, Human
gugaacuugguuuua

SEQ ID NO: 1647944 - RNA, 17 nt, Human
cagacaucaacagauaa

SEQ ID NO: 1647945 - RNA, 14 nt, Human
ucuauaauuuaaau

SEQ ID NO: 1647946 - RNA, 16 nt, Human
aaugaaagcagggacu

SEQ ID NO: 1647947 - RNA, 16 nt, Human
gugagacagcucugca

SEQ ID NO: 1647948 - RNA, 18 nt, Human
acagucucuugaggcaca

SEQ ID NO: 1647949 - RNA, 22 nt, Human
aaugggcacaggguuuauguuu

SEQ ID NO: 1647950 - RNA, 16 nt, Human
ugugagaugcuagaac

SEQ ID NO: 1647951 - RNA, 17 nt, Human
cugagaugggagaauca

SEQ ID NO: 1647952 - RNA, 16 nt, Human
agggcaguguucccug

SEQ ID NO: 1647953 - RNA, 20 nt, Human
cucagcuucacccugaggug

SEQ ID NO: 1647954 - RNA, 17 nt, Human
gcucaccagucccuccc

SEQ ID NO: 1647955 - RNA, 14 nt, Human
uucuggaauaaucc

SEQ ID NO: 1647956 - RNA, 23 nt, Human
agcuggaaacacauguuccccuu

SEQ ID NO: 1647957 - RNA, 22 nt, Human
gauaagagauguugacucuaaa

SEQ ID NO: 1647958 - RNA, 12 nt, Human
aucuucagaaaa

SEQ ID NO: 1647959 - RNA, 16 nt, Human
ugagcucaggagguca

SEQ ID NO: 1647960 - RNA, 20 nt, Human
ucagaauuucuaaaaguuua

SEQ ID NO: 1647961 - RNA, 19 nt, Human
acauuuauguuccuuuuaa

SEQ ID NO: 1647962 - RNA, 16 nt, Human
auuuaguuauaaaaau

SEQ ID NO: 1647963 - RNA, 15 nt, Human
uaaauaaauaaauaa

SEQ ID NO: 1647964 - RNA, 15 nt, Human
auaaauaaauaaaua

SEQ ID NO: 1647965 - RNA, 16 nt, Human
acaugaaguccaagca

SEQ ID NO: 1647966 - RNA, 14 nt, Human
ucucuacauaaaau

SEQ ID NO: 1647967 - RNA, 17 nt, Human
gcucaggaggucaagau

SEQ ID NO: 1647968 - RNA, 22 nt, Human
ucucagcuucacccugagguga

SEQ ID NO: 1647969 - RNA, 10 nt, Human
aaacacaugu

SEQ ID NO: 1647970 - RNA, 20 nt, Human
guaucaaaagaaagaaaauc

SEQ ID NO: 1647971 - RNA, 16 nt, Human
agaugagagaacaggg

SEQ ID NO: 1647972 - RNA, 14 nt, Human
gucccaggcugagc

SEQ ID NO: 1647973 - RNA, 21 nt, Human
cugguagcuaaauauauauuu

SEQ ID NO: 1647974 - RNA, 18 nt, Human
cucccuuggggccuaugc

SEQ ID NO: 1647975 - RNA, 19 nt, Human
gcauggccacaucugagcc

SEQ ID NO: 1647976 - RNA, 19 nt, Human
auuuugugaagcaaaauuu

SEQ ID NO: 1647977 - RNA, 22 nt, Human
cuuuaaugccgauaucuucaga

SEQ ID NO: 1647978 - RNA, 17 nt, Human
uuagauagaugaagaag

SEQ ID NO: 1647979 - RNA, 23 nt, Human
acuggcuaauuagcauggccaca

SEQ ID NO: 1647980 - RNA, 22 nt, Human
cgugcuugucccuguggaagua

SEQ ID NO: 1647981 - RNA, 15 nt, Human
uccaagccucauguc

SEQ ID NO: 1647982 - RNA, 17 nt, Human
cccccugcaaagcccag

SEQ ID NO: 1647983 - RNA, 11 nt, Human
augggacaggg

SEQ ID NO: 1647984 - RNA, 18 nt, Human
cuucacuguaaaauaaua

SEQ ID NO: 1647985 - RNA, 23 nt, Human
aauaggcugaugggcaaaaaacc

SEQ ID NO: 1647986 - RNA, 19 nt, Human
gaaggcaccucucuggguu

SEQ ID NO: 1647987 - RNA, 18 nt, Human
aaauaacgauaaaagaca

SEQ ID NO: 1647988 - RNA, 18 nt, Human
cuggaaacuucagcgguu

SEQ ID NO: 1647989 - RNA, 16 nt, Human
guuggcuguuccugca

SEQ ID NO: 1647990 - RNA, 21 nt, Human
uuuuauggcacuaguauuucu

SEQ ID NO: 1647991 - RNA, 14 nt, Human
gauuaguacacacu

SEQ ID NO: 1647992 - RNA, 15 nt, Human
ccaugugcagccacc

SEQ ID NO: 1647993 - RNA, 13 nt, Human
auguagaauauau

SEQ ID NO: 1647994 - RNA, 14 nt, Human
uuccccucugcagc

SEQ ID NO: 1647995 - RNA, 14 nt, Human
uugacccacaagaa

SEQ ID NO: 1647996 - RNA, 15 nt, Human
agaggcaaagaaagg

SEQ ID NO: 1647997 - RNA, 16 nt, Human
uuuucucuaggaaaua

SEQ ID NO: 1647998 - RNA, 17 nt, Human
uauauuguagauaauac

SEQ ID NO: 1647999 - RNA, 20 nt, Human
auccucgaggcccuagcauu

SEQ ID NO: 1648000 - RNA, 18 nt, Human
ucaaggguacacugccuu

SEQ ID NO: 1648001 - RNA, 17 nt, Human
cagcagugccaaaauau

SEQ ID NO: 1648002 - RNA, 20 nt, Human
ugcagccaccaguccauugg

SEQ ID NO: 1648003 - RNA, 13 nt, Human
ccccagcccuccu

SEQ ID NO: 1648004 - RNA, 13 nt, Human
cuaugaaauauua

SEQ ID NO: 1648005 - RNA, 22 nt, Human
ggccauuacccccagcuuugag

SEQ ID NO: 1648006 - RNA, 23 nt, Human
ccacaccaaccuucugaggagcu

SEQ ID NO: 1648007 - RNA, 15 nt, Human
agaauaccacaggaa

SEQ ID NO: 1648008 - RNA, 22 nt, Human
uagacacacaugaaguccaagc

SEQ ID NO: 1648009 - RNA, 14 nt, Human
agguugcagugagc

SEQ ID NO: 1648010 - RNA, 16 nt, Human
ugcagugucugcugga

SEQ ID NO: 1648011 - RNA, 17 nt, Human
agugauuaccagggacu

SEQ ID NO: 1648012 - RNA, 23 nt, Human
uauuuuauuaggaguaccauaau

SEQ ID NO: 1648013 - RNA, 15 nt, Human
uuuagugaaauauua

SEQ ID NO: 1648014 - RNA, 14 nt, Human
guauuuuaaaagaa

SEQ ID NO: 1648015 - RNA, 21 nt, Human
uggggcuuuaacuccugcuag

SEQ ID NO: 1648016 - RNA, 22 nt, Human
aggacaccauuuuggcaagcuc

SEQ ID NO: 1648017 - RNA, 23 nt, Human
uuuauuaggaguaccauaauucu

SEQ ID NO: 1648018 - RNA, 14 nt, Human
aucaccaaggcuga

SEQ ID NO: 1648019 - RNA, 12 nt, Human
cuuaucuuccua

SEQ ID NO: 1648020 - RNA, 14 nt, Human
auuugaaauuguau

SEQ ID NO: 1648021 - RNA, 16 nt, Human
auaacuggaaacuuca

SEQ ID NO: 1648022 - RNA, 18 nt, Human
aacaaugcuguauuuuaa

SEQ ID NO: 1648023 - RNA, 21 nt, Human
ucuggguugaagggcaguguu

SEQ ID NO: 1648024 - RNA, 15 nt, Human
agauuucaaaaaaaa

SEQ ID NO: 1648025 - RNA, 19 nt, Human
cugagccucagucucccuc

SEQ ID NO: 1648026 - RNA, 19 nt, Human
gcaggcacugccaaaacau

SEQ ID NO: 1648027 - RNA, 16 nt, Human
aaaagcuccauuuuua

SEQ ID NO: 1648028 - RNA, 17 nt, Human
uuauuucccucccaagu

SEQ ID NO: 1648029 - RNA, 20 nt, Human
uaggaauugacccacaagaa

SEQ ID NO: 1648030 - RNA, 18 nt, Human
cuaauaucuuaucuuccu

SEQ ID NO: 1648031 - RNA, 14 nt, Human
gggcuggaugcucu

SEQ ID NO: 1648032 - RNA, 23 nt, Human
ucuuagaugcaguucugaagaag

SEQ ID NO: 1648033 - RNA, 22 nt, Human
cuucagaaaaccuaagcaaacu

SEQ ID NO: 1648034 - RNA, 18 nt, Human
uguggucacaggaaguag

SEQ ID NO: 1648035 - RNA, 15 nt, Human
acuuuauaaaggauu

SEQ ID NO: 1648036 - RNA, 15 nt, Human
ggccuucggccucca

SEQ ID NO: 1648037 - RNA, 16 nt, Human
ccacuuggucugugag

SEQ ID NO: 1648038 - RNA, 23 nt, Human
aaauuuacagagacagaaagcag

SEQ ID NO: 1648039 - RNA, 18 nt, Human
gccccgucccccucuggc

SEQ ID NO: 1648040 - RNA, 15 nt, Human
uuaguuuuuaaagua

SEQ ID NO: 1648041 - RNA, 15 nt, Human
gucaaugcagccccc

SEQ ID NO: 1648042 - RNA, 15 nt, Human
uggagacaucuggaa

SEQ ID NO: 1648043 - RNA, 15 nt, Human
ucacaggacagcccu

SEQ ID NO: 1648044 - RNA, 14 nt, Human
uucagccugaaaga

SEQ ID NO: 1648045 - RNA, 20 nt, Human
cccugcacuccagccugagc

SEQ ID NO: 1648046 - RNA, 17 nt, Human
cuagaaaacaggcaaau

SEQ ID NO: 1648047 - RNA, 19 nt, Human
uuugccaaguucuccacua

SEQ ID NO: 1648048 - RNA, 15 nt, Human
cagugucugcuggag

SEQ ID NO: 1648049 - RNA, 19 nt, Human
uuguacucugaaaguuuug

SEQ ID NO: 1648050 - RNA, 15 nt, Human
augauaacuggaaac

SEQ ID NO: 1648051 - RNA, 20 nt, Human
cagucccuccccaaaugcuu

SEQ ID NO: 1648052 - RNA, 10 nt, Human
accugagccc

SEQ ID NO: 1648053 - RNA, 14 nt, Human
aauggcuaagcaaa

SEQ ID NO: 1648054 - RNA, 14 nt, Human
agcucaccaguccc

SEQ ID NO: 1648055 - RNA, 14 nt, Human
cuuguacucugaaa

SEQ ID NO: 1648056 - RNA, 14 nt, Human
acguuaggaggaca

SEQ ID NO: 1648057 - RNA, 20 nt, Human
uugauaaguacaugauaagc

SEQ ID NO: 1648058 - RNA, 20 nt, Human
gagccugaucaccugcccug

SEQ ID NO: 1648059 - RNA, 19 nt, Human
ugggacaggggagaaccua

SEQ ID NO: 1648060 - RNA, 20 nt, Human
cauaucaaacugaaacaaaa

SEQ ID NO: 1648061 - RNA, 22 nt, Human
ugaauggcuaagcaaaauguga

SEQ ID NO: 1648062 - RNA, 20 nt, Human
uuaaauggucaauuuuguua

SEQ ID NO: 1648063 - RNA, 17 nt, Human
ugaaggauuuauguuua

SEQ ID NO: 1648064 - RNA, 23 nt, Human
agccuugggaccccugagcuugc

SEQ ID NO: 1648065 - RNA, 16 nt, Human
uauucagaauuucuaa

SEQ ID NO: 1648066 - RNA, 19 nt, Human
cgcccacuagacccacugg

SEQ ID NO: 1648067 - RNA, 14 nt, Human
aucaaaagaaagaa

SEQ ID NO: 1648068 - RNA, 14 nt, Human
ugagaugcuagaac

SEQ ID NO: 1648069 - RNA, 21 nt, Human
cuggccaccugcugagcccca

SEQ ID NO: 1648070 - RNA, 18 nt, Human
ugaggcaggcacugccaa

SEQ ID NO: 1648071 - RNA, 17 nt, Human
cagucucuugaggcaca

SEQ ID NO: 1648072 - RNA, 21 nt, Human
aaaauuuuuucucuaggaaau

SEQ ID NO: 1648073 - RNA, 21 nt, Human
uuccugacugcuaguuuauau

SEQ ID NO: 1648074 - RNA, 20 nt, Human
acuauagugugagccaggaa

SEQ ID NO: 1648075 - RNA, 14 nt, Human
cucaacucugagug

SEQ ID NO: 1648076 - RNA, 12 nt, Human
uuauuucacuuu

SEQ ID NO: 1648077 - RNA, 16 nt, Human
agggaggacgcucucu

SEQ ID NO: 1648078 - RNA, 17 nt, Human
cuaauaucuuaucuucc

SEQ ID NO: 1648079 - RNA, 17 nt, Human
uaggaugggaacaagga

SEQ ID NO: 1648080 - RNA, 16 nt, Human
aaagaaaggagauaca

SEQ ID NO: 1648081 - RNA, 15 nt, Human
auauuuuuuguuaaa

SEQ ID NO: 1648082 - RNA, 22 nt, Human
caucucuucuggguuccuuccu

SEQ ID NO: 1648083 - RNA, 23 nt, Human
acugcuaguuuauauagaaaugu

SEQ ID NO: 1648084 - RNA, 14 nt, Human
aagcucuaucacca

SEQ ID NO: 1648085 - RNA, 17 nt, Human
auaucuuaucuuccuau

SEQ ID NO: 1648086 - RNA, 20 nt, Human
gacauuugcucauggaauug

SEQ ID NO: 1648087 - RNA, 20 nt, Human
uaucauuuaguuauaaaaau

SEQ ID NO: 1648088 - RNA, 16 nt, Human
agaugcuagaacuccc

SEQ ID NO: 1648089 - RNA, 15 nt, Human
ccuugccaugugcua

SEQ ID NO: 1648090 - RNA, 13 nt, Human
ccccucugcagcu

SEQ ID NO: 1648091 - RNA, 21 nt, Human
cucagcuucacccugagguga

SEQ ID NO: 1648092 - RNA, 14 nt, Human
aacgauaaaagaca

SEQ ID NO: 1648093 - RNA, 23 nt, Human
ugcauagguuuaauaauuuuuaa

SEQ ID NO: 1648094 - RNA, 15 nt, Human
aagcacuaaacaaag

SEQ ID NO: 1648095 - RNA, 21 nt, Human
aauaauccucaguuuuuguga

SEQ ID NO: 1648096 - RNA, 21 nt, Human
aggaagaucccuuuguccaca

SEQ ID NO: 1648097 - RNA, 22 nt, Human
gaugcaguucugaagaagaugg

SEQ ID NO: 1648098 - RNA, 12 nt, Human
agacagugaaag

SEQ ID NO: 1648099 - RNA, 18 nt, Human
cuuuucccaacuccagaa

SEQ ID NO: 1648100 - RNA, 20 nt, Human
aaaacaagcacuaaacaaag

SEQ ID NO: 1648101 - RNA, 22 nt, Human
aauuuuuucucuaggaaauauu

SEQ ID NO: 1648102 - RNA, 12 nt, Human
uucucuaggaaa

SEQ ID NO: 1648103 - RNA, 13 nt, Human
aacgucacaucuu

SEQ ID NO: 1648104 - RNA, 17 nt, Human
agcuucacuguaaaaua

SEQ ID NO: 1648105 - RNA, 16 nt, Human
cuuagcccuuccccuc

SEQ ID NO: 1648106 - RNA, 18 nt, Human
uucucuaggaaauauuua

SEQ ID NO: 1648107 - RNA, 15 nt, Human
cuccagggagucuca

SEQ ID NO: 1648108 - RNA, 21 nt, Human
ccaaggaugccccgucccccu

SEQ ID NO: 1648109 - RNA, 21 nt, Human
accaacacccugagguugugu

SEQ ID NO: 1648110 - RNA, 21 nt, Human
uauuauuuuauagcuacuaau

SEQ ID NO: 1648111 - RNA, 23 nt, Human
acguaaucguguccccuauccua

SEQ ID NO: 1648112 - RNA, 21 nt, Human
gccucaagcuaugugagcuca

SEQ ID NO: 1648113 - RNA, 18 nt, Human
cuuccucugagccuuggg

SEQ ID NO: 1648114 - RNA, 19 nt, Human
augaguaacugauuuguaa

SEQ ID NO: 1648115 - RNA, 14 nt, Human
uaguaucaaaagaa

SEQ ID NO: 1648116 - RNA, 20 nt, Human
acaucuggaaaguuuucucc

SEQ ID NO: 1648117 - RNA, 17 nt, Human
aauaaaguguuugaaag

SEQ ID NO: 1648118 - RNA, 15 nt, Human
agaaaacaauaacga

SEQ ID NO: 1648119 - RNA, 19 nt, Human
gcccuuccccucugcagcu

SEQ ID NO: 1648120 - RNA, 14 nt, Human
uaaauaguuuauga

SEQ ID NO: 1648121 - RNA, 15 nt, Human
cugcacuccagccug

SEQ ID NO: 1648122 - RNA, 14 nt, Human
ugcuagaacucccu

SEQ ID NO: 1648123 - RNA, 16 nt, Human
uuagauagaugaagaa

SEQ ID NO: 1648124 - RNA, 13 nt, Human
aauuuuuauauuu

SEQ ID NO: 1648125 - RNA, 22 nt, Human
uaccucugcuauuugcuguuau

SEQ ID NO: 1648126 - RNA, 20 nt, Human
agggcaguguucccuggggc

SEQ ID NO: 1648127 - RNA, 23 nt, Human
cuagacccacuggacucaccucc

SEQ ID NO: 1648128 - RNA, 15 nt, Human
aagaaaauaacaaua

SEQ ID NO: 1648129 - RNA, 15 nt, Human
acaagacccaaaagg

SEQ ID NO: 1648130 - RNA, 23 nt, Human
aucgcagacacaugugcuggcca

SEQ ID NO: 1648131 - RNA, 21 nt, Human
gcagcauuguuggcuguuccu

SEQ ID NO: 1648132 - RNA, 17 nt, Human
cucgugggacagucacc

SEQ ID NO: 1648133 - RNA, 14 nt, Human
uuuuauaugcuauu

SEQ ID NO: 1648134 - RNA, 21 nt, Human
gaaggaaagaauaaccaacac

SEQ ID NO: 1648135 - RNA, 19 nt, Human
gaaagaaaauaacaauaaa

SEQ ID NO: 1648136 - RNA, 16 nt, Human
ugcaaauugucacagg

SEQ ID NO: 1648137 - RNA, 13 nt, Human
ucccaaguaaaug

SEQ ID NO: 1648138 - RNA, 21 nt, Human
cugagccucagucucccuccc

SEQ ID NO: 1648139 - RNA, 21 nt, Human
cagcccuuagcccuuccccuc

SEQ ID NO: 1648140 - RNA, 18 nt, Human
aagaccucauuuugaagg

SEQ ID NO: 1648141 - RNA, 22 nt, Human
uugaaaaucuuauaauuuaaaa

SEQ ID NO: 1648142 - RNA, 17 nt, Human
uccacaacacacagauu

SEQ ID NO: 1648143 - RNA, 17 nt, Human
uaugcuauugaaguuuu

SEQ ID NO: 1648144 - RNA, 15 nt, Human
ugguuuagaaagcuu

SEQ ID NO: 1648145 - RNA, 18 nt, Human
cacuccagugagacagcu

SEQ ID NO: 1648146 - RNA, 21 nt, Human
ugggaggcugagaugggagaa

SEQ ID NO: 1648147 - RNA, 14 nt, Human
aaccugagccccaa

SEQ ID NO: 1648148 - RNA, 12 nt, Human
uauucacaagac

SEQ ID NO: 1648149 - RNA, 22 nt, Human
gaugcaguuguugcccacagcu

SEQ ID NO: 1648150 - RNA, 14 nt, Human
caaggcuagaacca

SEQ ID NO: 1648151 - RNA, 23 nt, Human
uccacaaguaaaaggaaaugcuc

SEQ ID NO: 1648152 - RNA, 20 nt, Human
auaagccagacaucaacaga

SEQ ID NO: 1648153 - RNA, 13 nt, Human
uaguuuuuaaagu

SEQ ID NO: 1648154 - RNA, 15 nt, Human
augaauuaaguuuuu

SEQ ID NO: 1648155 - RNA, 18 nt, Human
auguuaaaacugggacag

SEQ ID NO: 1648156 - RNA, 12 nt, Human
gacgagaaaaca

SEQ ID NO: 1648157 - RNA, 16 nt, Human
acaugaacuuguaaag

SEQ ID NO: 1648158 - RNA, 19 nt, Human
uaguuuaugauuccaccua

SEQ ID NO: 1648159 - RNA, 18 nt, Human
aucagcaucccuagaaag

SEQ ID NO: 1648160 - RNA, 13 nt, Human
uuauguuuaauuc

SEQ ID NO: 1648161 - RNA, 18 nt, Human
uaauuagcauggccacau

SEQ ID NO: 1648162 - RNA, 15 nt, Human
gacaguauggcagcu

SEQ ID NO: 1648163 - RNA, 19 nt, Human
acgaaauacguuaggagga

SEQ ID NO: 1648164 - RNA, 13 nt, Human
aacucccugcccc

SEQ ID NO: 1648165 - RNA, 17 nt, Human
caccugcugagccccaa

SEQ ID NO: 1648166 - RNA, 16 nt, Human
auccuacaagacacag

SEQ ID NO: 1648167 - RNA, 13 nt, Human
ccaggcugagccu

SEQ ID NO: 1648168 - RNA, 20 nt, Human
auuacuguaagaaaauauca

SEQ ID NO: 1648169 - RNA, 17 nt, Human
auucagaauuucuaaaa

SEQ ID NO: 1648170 - RNA, 18 nt, Human
uacuuuauuuucuauaau

SEQ ID NO: 1648171 - RNA, 17 nt, Human
gauaaaagacagugaaa

SEQ ID NO: 1648172 - RNA, 17 nt, Human
cuucacuguaaaauaau

SEQ ID NO: 1648173 - RNA, 21 nt, Human
gucucuaccaaaaaaaggaag

SEQ ID NO: 1648174 - RNA, 23 nt, Human
uguugcccacagcuguaugauuc

SEQ ID NO: 1648175 - RNA, 23 nt, Human
aucaccaaggcugauuaaaccaa

SEQ ID NO: 1648176 - RNA, 15 nt, Human
aaugaauggcuaagc

SEQ ID NO: 1648177 - RNA, 17 nt, Human
cuucuagcagugagcca

SEQ ID NO: 1648178 - RNA, 13 nt, Human
ccaccugccuaua

SEQ ID NO: 1648179 - RNA, 15 nt, Human
uucuguuaaaauaua

SEQ ID NO: 1648180 - RNA, 15 nt, Human
agucaccucauggaa

SEQ ID NO: 1648181 - RNA, 13 nt, Human
uuucuaaaaguuu

SEQ ID NO: 1648182 - RNA, 14 nt, Human
aggaaggaaagaug

SEQ ID NO: 1648183 - RNA, 21 nt, Human
caguaguuagcuuucuuccug

SEQ ID NO: 1648184 - RNA, 22 nt, Human
aucaccaaggcugauuaaacca

SEQ ID NO: 1648185 - RNA, 22 nt, Human
gcacagccucuuagaugcaguu

SEQ ID NO: 1648186 - RNA, 13 nt, Human
ucuaagaagugaa

SEQ ID NO: 1648187 - RNA, 20 nt, Human
uggauuuaauguggaaauga

SEQ ID NO: 1648188 - RNA, 17 nt, Human
aguauuucuaugaaaua

SEQ ID NO: 1648189 - RNA, 18 nt, Human
cuccauccugaggcucca

SEQ ID NO: 1648190 - RNA, 17 nt, Human
cucguggaacaguuacc

SEQ ID NO: 1648191 - RNA, 15 nt, Human
aguucugaagaagau

SEQ ID NO: 1648192 - RNA, 17 nt, Human
gggcuaaggcaggagga

SEQ ID NO: 1648193 - RNA, 20 nt, Human
acaagacccaaaaggcagaa

SEQ ID NO: 1648194 - RNA, 22 nt, Human
ucuggguuccuuccucugagcc

SEQ ID NO: 1648195 - RNA, 13 nt, Human
aaaaauccuacuu

SEQ ID NO: 1648196 - RNA, 14 nt, Human
ccgcuuaagcuuuc

SEQ ID NO: 1648197 - RNA, 14 nt, Human
aaaacuuauuggaa

SEQ ID NO: 1648198 - RNA, 21 nt, Human
aaugugacuuaaugccacuaa

SEQ ID NO: 1648199 - RNA, 18 nt, Human
agcauuguuggcuguucc

SEQ ID NO: 1648200 - RNA, 14 nt, Human
cccacuugccauaa

SEQ ID NO: 1648201 - RNA, 16 nt, Human
ugcacaucaaaauaug

SEQ ID NO: 1648202 - RNA, 18 nt, Human
ugcaagaagaaaucauga

SEQ ID NO: 1648203 - RNA, 22 nt, Human
ccacagcuguaugauucccagc

SEQ ID NO: 1648204 - RNA, 13 nt, Human
aaaaaugguuuaa

SEQ ID NO: 1648205 - RNA, 14 nt, Human
cuacagaacuaaaa

SEQ ID NO: 1648206 - RNA, 21 nt, Human
caacacaucaggaaagagagc

SEQ ID NO: 1648207 - RNA, 22 nt, Human
acacauaucaaacugaaacaaa

SEQ ID NO: 1648208 - RNA, 14 nt, Human
acgcauggaaaagu

SEQ ID NO: 1648209 - RNA, 19 nt, Human
aagucuuucacauuuaaau

SEQ ID NO: 1648210 - RNA, 12 nt, Human
cuuccucugagc

SEQ ID NO: 1648211 - RNA, 12 nt, Human
acaagaaaugaa

SEQ ID NO: 1648212 - RNA, 18 nt, Human
ucuaugaaauauuauguu

SEQ ID NO: 1648213 - RNA, 19 nt, Human
augaauuacauuuguauaa

SEQ ID NO: 1648214 - RNA, 12 nt, Human
aaugcagccccc

SEQ ID NO: 1648215 - RNA, 15 nt, Human
cugacucuuaagaag

SEQ ID NO: 1648216 - RNA, 21 nt, Human
cugauauuggacaguaaaauc

SEQ ID NO: 1648217 - RNA, 14 nt, Human
caucaucuucuggg

SEQ ID NO: 1648218 - RNA, 14 nt, Human
ggccacaucugagc

SEQ ID NO: 1648219 - RNA, 14 nt, Human
cuucacccugaggu

SEQ ID NO: 1648220 - RNA, 21 nt, Human
gagauuuugcuugagcaggau

SEQ ID NO: 1648221 - RNA, 15 nt, Human
aacgauaaaagacag

SEQ ID NO: 1648222 - RNA, 14 nt, Human
aauaguuuaugauu

SEQ ID NO: 1648223 - RNA, 14 nt, Human
gccaggcauggugg

SEQ ID NO: 1648224 - RNA, 22 nt, Human
uaauaggcguaacuaauuuuaa

SEQ ID NO: 1648225 - RNA, 20 nt, Human
aacagucucuugaggcacag

SEQ ID NO: 1648226 - RNA, 13 nt, Human
cucagaaaacaag

SEQ ID NO: 1648227 - RNA, 18 nt, Human
ccaaccuucugaggagcu

SEQ ID NO: 1648228 - RNA, 15 nt, Human
cuuuucccaacucca

SEQ ID NO: 1648229 - RNA, 19 nt, Human
acuuuuauaagaaauagga

SEQ ID NO: 1648230 - RNA, 15 nt, Human
aaugucugaaaugga

SEQ ID NO: 1648231 - RNA, 15 nt, Human
aagucauuauuagga

SEQ ID NO: 1648232 - RNA, 22 nt, Human
uugacccacaagaaaugaaagc

SEQ ID NO: 1648233 - RNA, 16 nt, Human
gccaaauguaaaauag

SEQ ID NO: 1648234 - RNA, 17 nt, Human
gcaagcucuaucaccaa

SEQ ID NO: 1648235 - RNA, 22 nt, Human
ugugagcucaccagucccuccc

SEQ ID NO: 1648236 - RNA, 11 nt, Human
auuaaaaccuc

SEQ ID NO: 1648237 - RNA, 17 nt, Human
auguugacaugggacau

SEQ ID NO: 1648238 - RNA, 18 nt, Human
auuauuuuuuaaaaaaau

SEQ ID NO: 1648239 - RNA, 19 nt, Human
cucacauuuauauuuuugu

SEQ ID NO: 1648240 - RNA, 15 nt, Human
caaauccaaugaaau

SEQ ID NO: 1648241 - RNA, 22 nt, Human
ucugcuggagacauugaggcag

SEQ ID NO: 1648242 - RNA, 14 nt, Human
cacaucaggaaaga

SEQ ID NO: 1648243 - RNA, 14 nt, Human
acagaauuuuaugc

SEQ ID NO: 1648244 - RNA, 13 nt, Human
caucgcagacaca

SEQ ID NO: 1648245 - RNA, 16 nt, Human
acaugugcuggccacc

SEQ ID NO: 1648246 - RNA, 21 nt, Human
cuccagggagucucagcuuca

SEQ ID NO: 1648247 - RNA, 15 nt, Human
ugagacacugucucu

SEQ ID NO: 1648248 - RNA, 20 nt, Human
agagaucucuguagaaggag

SEQ ID NO: 1648249 - RNA, 23 nt, Human
cugagaaggcuguggauuuaaug

SEQ ID NO: 1648250 - RNA, 14 nt, Human
auaaauaaauaaau

SEQ ID NO: 1648251 - RNA, 14 nt, Human
uaaauaaauaaaua

SEQ ID NO: 1648252 - RNA, 22 nt, Human
uaauaucuuaucuuccuauaau

SEQ ID NO: 1648253 - RNA, 18 nt, Human
aggcauagcccugccuca

SEQ ID NO: 1648254 - RNA, 19 nt, Human
auacuaauuauacccccug

SEQ ID NO: 1648255 - RNA, 17 nt, Human
agucuucagcagagaag

SEQ ID NO: 1648256 - RNA, 15 nt, Human
auuuaauuauuucac

SEQ ID NO: 1648257 - RNA, 21 nt, Human
auuauauuuccaagaaauauu

SEQ ID NO: 1648258 - RNA, 22 nt, Human
cuucaacucccugccccccagc

SEQ ID NO: 1648259 - RNA, 16 nt, Human
agugaaagaaaauaac

SEQ ID NO: 1648260 - RNA, 21 nt, Human
cucaaaacuucagacauagaa

SEQ ID NO: 1648261 - RNA, 12 nt, Human
accccugagcuu

SEQ ID NO: 1648262 - RNA, 13 nt, Human
ggugugugcagca

SEQ ID NO: 1648263 - RNA, 22 nt, Human
agcauuguuggcuguuccugca

SEQ ID NO: 1648264 - RNA, 19 nt, Human
gucuuucacauuuaaauaa

SEQ ID NO: 1648265 - RNA, 15 nt, Human
aaaauaacaaugaaa

SEQ ID NO: 1648266 - RNA, 17 nt, Human
ucuaccaaaaaaaggaa

SEQ ID NO: 1648267 - RNA, 16 nt, Human
ccugaucaccugcccu

SEQ ID NO: 1648268 - RNA, 21 nt, Human
cucagugucaaugcagccccc

SEQ ID NO: 1648269 - RNA, 12 nt, Human
auuuuaaaagaa

SEQ ID NO: 1648270 - RNA, 13 nt, Human
aucuggcucugga

SEQ ID NO: 1648271 - RNA, 23 nt, Human
gaaaaucuuauaauuuaaaauau

SEQ ID NO: 1648272 - RNA, 18 nt, Human
uaaauugacacuuaaaaa

SEQ ID NO: 1648273 - RNA, 15 nt, Human
cacuuggucugugag

SEQ ID NO: 1648274 - RNA, 12 nt, Human
aagaaaggaagu

SEQ ID NO: 1648275 - RNA, 19 nt, Human
ccuccauccugaggcucca

SEQ ID NO: 1648276 - RNA, 15 nt, Human
gaacuaaaaauuaaa

SEQ ID NO: 1648277 - RNA, 18 nt, Human
aaauauaaauaaaaauaa

SEQ ID NO: 1648278 - RNA, 22 nt, Human
agaaaacaauaacgauaaaaga

SEQ ID NO: 1648279 - RNA, 11 nt, Human
cuauuuaauua

SEQ ID NO: 1648280 - RNA, 17 nt, Human
uuuccaugaguugcagu

SEQ ID NO: 1648281 - RNA, 22 nt, Human
agaaugagagacacacugaaga

SEQ ID NO: 1648282 - RNA, 19 nt, Human
uggccacaucugagccccg

SEQ ID NO: 1648283 - RNA, 17 nt, Human
guagaaugggggcagca

SEQ ID NO: 1648284 - RNA, 22 nt, Human
gucucagcuucacccugaggug

SEQ ID NO: 1648285 - RNA, 18 nt, Human
acuggacucaccuccccc

SEQ ID NO: 1648286 - RNA, 20 nt, Human
cagagaaguuuucuggaggu

SEQ ID NO: 1648287 - RNA, 19 nt, Human
uaucucauuuccaagcaag

SEQ ID NO: 1648288 - RNA, 23 nt, Human
aguaauuggaaaggcagcucuaa

SEQ ID NO: 1648289 - RNA, 18 nt, Human
ugauuauuuuauguuuua

SEQ ID NO: 1648290 - RNA, 20 nt, Human
agcccuggugggcagagagg

SEQ ID NO: 1648291 - RNA, 16 nt, Human
ugcuguauuuuaaaag

SEQ ID NO: 1648292 - RNA, 19 nt, Human
auaauuuuuauauuugaaa

SEQ ID NO: 1648293 - RNA, 18 nt, Human
caagccucauguccacug

SEQ ID NO: 1648294 - RNA, 21 nt, Human
cuaaauugacacuuaaaaaug

SEQ ID NO: 1648295 - RNA, 17 nt, Human
gacaaggaaaaaauaac

SEQ ID NO: 1648296 - RNA, 23 nt, Human
auuccugacugcuaguuuauaua

SEQ ID NO: 1648297 - RNA, 17 nt, Human
gcaugguuuagaaagcu

SEQ ID NO: 1648298 - RNA, 19 nt, Human
gguuuaauaauuuuuaauu

SEQ ID NO: 1648299 - RNA, 12 nt, Human
uaguacacacuu

SEQ ID NO: 1648300 - RNA, 19 nt, Human
aaucuacacuccagugaga

SEQ ID NO: 1648301 - RNA, 23 nt, Human
uugaaguuuuggcaauugacuau

SEQ ID NO: 1648302 - RNA, 23 nt, Human
gauaaggcuguucuuuaaauguc

SEQ ID NO: 1648303 - RNA, 21 nt, Human
uugccuaggcauagcccugcc

SEQ ID NO: 1648304 - RNA, 22 nt, Human
auauaugcuaagucuuauauau

SEQ ID NO: 1648305 - RNA, 16 nt, Human
acuuuuauaagaaaua

SEQ ID NO: 1648306 - RNA, 12 nt, Human
gacccugucuca

SEQ ID NO: 1648307 - RNA, 21 nt, Human
uugaggaaaaugggcuuugga

SEQ ID NO: 1648308 - RNA, 17 nt, Human
aggaaaaugggcuuugg

SEQ ID NO: 1648309 - RNA, 18 nt, Human
gaggcuccacuuggucug

SEQ ID NO: 1648310 - RNA, 18 nt, Human
gcaaagcccagcuugaaa

SEQ ID NO: 1648311 - RNA, 21 nt, Human
gacugcuaguuuauauagaaa

SEQ ID NO: 1648312 - RNA, 15 nt, Human
aaagaaagaaaauca

SEQ ID NO: 1648313 - RNA, 22 nt, Human
aauuccuaccucuucaccugac

SEQ ID NO: 1648314 - RNA, 12 nt, Human
cuacaagacaca

SEQ ID NO: 1648315 - RNA, 15 nt, Human
auagaaguaaaaaca

SEQ ID NO: 1648316 - RNA, 17 nt, Human
cauaaaauacaaaaacu

SEQ ID NO: 1648317 - RNA, 21 nt, Human
gucaagaucagccugggcaac

SEQ ID NO: 1648318 - RNA, 20 nt, Human
aaaguugauuaagaaaggaa

SEQ ID NO: 1648319 - RNA, 16 nt, Human
ccauuuuuagugaaau

SEQ ID NO: 1648320 - RNA, 14 nt, Human
aaauauaaauaaaa

SEQ ID NO: 1648321 - RNA, 14 nt, Human
auaaauaaaaauaa

SEQ ID NO: 1648322 - RNA, 14 nt, Human
ccugccccccagcc

SEQ ID NO: 1648323 - RNA, 22 nt, Human
ugggcacuguggguagacacac

SEQ ID NO: 1648324 - RNA, 22 nt, Human
agaauuuuaugcggcauuuucu

SEQ ID NO: 1648325 - RNA, 17 nt, Human
agucugacuguuuccau

SEQ ID NO: 1648326 - RNA, 16 nt, Human
guuucacaccuuaucu

SEQ ID NO: 1648327 - RNA, 12 nt, Human
uuuuuuuuaaaa

SEQ ID NO: 1648328 - RNA, 18 nt, Human
acaaaugggaaacaaaag

SEQ ID NO: 1648329 - RNA, 15 nt, Human
cucguggaacaguua

SEQ ID NO: 1648330 - RNA, 19 nt, Human
cuggccuucggccuccauc

SEQ ID NO: 1648331 - RNA, 13 nt, Human
aaggcaggaggau

SEQ ID NO: 1648332 - RNA, 13 nt, Human
aagugcagccccg

SEQ ID NO: 1648333 - RNA, 18 nt, Human
uaggaaauauuuuaaugu

SEQ ID NO: 1648334 - RNA, 17 nt, Human
cucuuuugggauuuuug

SEQ ID NO: 1648335 - RNA, 22 nt, Human
acagauuugagcucagcccugg

SEQ ID NO: 1648336 - RNA, 11 nt, Human
aaccugagccc

SEQ ID NO: 1648337 - RNA, 18 nt, Human
auguuccuuuuaaagaaa

SEQ ID NO: 1648338 - RNA, 12 nt, Human
cuucaacucccu

SEQ ID NO: 1648339 - RNA, 18 nt, Human
aaauauuuauuuuaauaa

SEQ ID NO: 1648340 - RNA, 17 nt, Human
agagacagaaagcagaa

SEQ ID NO: 1648341 - RNA, 14 nt, Human
cugcugagucccag

SEQ ID NO: 1648342 - RNA, 17 nt, Human
aauucuugccaaauaua

SEQ ID NO: 1648343 - RNA, 17 nt, Human
gauaucuucagaaaacc

SEQ ID NO: 1648344 - RNA, 23 nt, Human
uagauaggucagugcaaauacuc

SEQ ID NO: 1648345 - RNA, 19 nt, Human
auuuucuauaauuuaaaua

SEQ ID NO: 1648346 - RNA, 23 nt, Human
cuaguaauuggaaaggcagcucu

SEQ ID NO: 1648347 - RNA, 20 nt, Human
uuuaaggccaggcauggugg

SEQ ID NO: 1648348 - RNA, 20 nt, Human
cugagguuguguguggaagg

SEQ ID NO: 1648349 - RNA, 23 nt, Human
cuugauaaauggcuuccuggcaa

SEQ ID NO: 1648350 - RNA, 17 nt, Human
aaacauccuacaagaca

SEQ ID NO: 1648351 - RNA, 22 nt, Human
uuauaagaaauaggaaauauuu

SEQ ID NO: 1648352 - RNA, 13 nt, Human
auuuuaaaagaau

SEQ ID NO: 1648353 - RNA, 17 nt, Human
uuaauaauuuuuaauua

SEQ ID NO: 1648354 - RNA, 17 nt, Human
ugacuauuauauuucca

SEQ ID NO: 1648355 - RNA, 16 nt, Human
aaauauuccuuaagau

SEQ ID NO: 1648356 - RNA, 18 nt, Human
uauuucuguuaaaauaua

SEQ ID NO: 1648357 - RNA, 21 nt, Human
agccucuuagaugcaguucug

SEQ ID NO: 1648358 - RNA, 15 nt, Human
uucggccuccauccu

SEQ ID NO: 1648359 - RNA, 12 nt, Human
ucuacacuccag

SEQ ID NO: 1648360 - RNA, 23 nt, Human
cucuacuaaaaauacaaaaaaaa

SEQ ID NO: 1648361 - RNA, 17 nt, Human
aagacaaggaaaaaaua

SEQ ID NO: 1648362 - RNA, 15 nt, Human
caagcucacagaccu

SEQ ID NO: 1648363 - RNA, 18 nt, Human
cauagugagacacugucu

SEQ ID NO: 1648364 - RNA, 18 nt, Human
auaauccuaaacauauga

SEQ ID NO: 1648365 - RNA, 11 nt, Human
ugcagugagcc

SEQ ID NO: 1648366 - RNA, 22 nt, Human
ccauacuaauuauacccccugc

SEQ ID NO: 1648367 - RNA, 12 nt, Human
caucaggaaaga

SEQ ID NO: 1648368 - RNA, 23 nt, Human
gccccugcacuccagccugagcg

SEQ ID NO: 1648369 - RNA, 14 nt, Human
cugcaaagcccagc

SEQ ID NO: 1648370 - RNA, 17 nt, Human
ucagcguuaauguaaag

SEQ ID NO: 1648371 - RNA, 15 nt, Human
gcagagguugcagug

SEQ ID NO: 1648372 - RNA, 12 nt, Human
uaaaugcucaau

SEQ ID NO: 1648373 - RNA, 14 nt, Human
ccaggcaugguggu

SEQ ID NO: 1648374 - RNA, 22 nt, Human
cuuccuaauuccacagcugcuc

SEQ ID NO: 1648375 - RNA, 13 nt, Human
uaacaauaaaaga

SEQ ID NO: 1648376 - RNA, 13 nt, Human
ccuuugcaccucc

SEQ ID NO: 1648377 - RNA, 23 nt, Human
cuaggaugggaacaaggaaggaa

SEQ ID NO: 1648378 - RNA, 11 nt, Human
accauuuuuac

SEQ ID NO: 1648379 - RNA, 13 nt, Human
agaaguaaaaaca

SEQ ID NO: 1648380 - RNA, 19 nt, Human
cuguuauuuuaucugcuau

SEQ ID NO: 1648381 - RNA, 17 nt, Human
uuaaauggucaauuuug

SEQ ID NO: 1648382 - RNA, 17 nt, Human
uugugaagcaaaauuuu

SEQ ID NO: 1648383 - RNA, 14 nt, Human
ggagauacagugga

SEQ ID NO: 1648384 - RNA, 16 nt, Human
acaucaggaaagagag

SEQ ID NO: 1648385 - RNA, 18 nt, Human
auuuaggccaugggacag

SEQ ID NO: 1648386 - RNA, 16 nt, Human
cccuuuacccccauga

SEQ ID NO: 1648387 - RNA, 14 nt, Human
gcagaucacuugag

SEQ ID NO: 1648388 - RNA, 18 nt, Human
aaaguaacccuacaaaac

SEQ ID NO: 1648389 - RNA, 18 nt, Human
gcagcccuuagcccuucc

SEQ ID NO: 1648390 - RNA, 12 nt, Human
cuaccaaaaaaa

SEQ ID NO: 1648391 - RNA, 18 nt, Human
gaugcaguucugaagaag

SEQ ID NO: 1648392 - RNA, 19 nt, Human
caugaguaacugauuugua

SEQ ID NO: 1648393 - RNA, 19 nt, Human
uguggauuuaauguggaaa

SEQ ID NO: 1648394 - RNA, 19 nt, Human
guacugagagugaacaaau

SEQ ID NO: 1648395 - RNA, 22 nt, Human
cugcucaauaaaguacaagagc

SEQ ID NO: 1648396 - RNA, 15 nt, Human
cauguccacugguuc

SEQ ID NO: 1648397 - RNA, 21 nt, Human
agucucccucccuuggggccu

SEQ ID NO: 1648398 - RNA, 15 nt, Human
uauaauuuaaauaua

SEQ ID NO: 1648399 - RNA, 12 nt, Human
guagacacacau

SEQ ID NO: 1648400 - RNA, 12 nt, Human
aaggaugccccg

SEQ ID NO: 1648401 - RNA, 21 nt, Human
uaagucaucugaugagaacaa

SEQ ID NO: 1648402 - RNA, 21 nt, Human
aacauagugagacacugucuc

SEQ ID NO: 1648403 - RNA, 17 nt, Human
caaauaagucaucugau

SEQ ID NO: 1648404 - RNA, 22 nt, Human
cagcccuggugggcagagaggu

SEQ ID NO: 1648405 - RNA, 22 nt, Human
cacuuccaagagccuuuuuuug

SEQ ID NO: 1648406 - RNA, 13 nt, Human
ugccagcuggccu

SEQ ID NO: 1648407 - RNA, 22 nt, Human
gaauuucuucaacucccugccc

SEQ ID NO: 1648408 - RNA, 19 nt, Human
gcuuguauuccuuuuucuc

SEQ ID NO: 1648409 - RNA, 19 nt, Human
augcagagguccacaacac

SEQ ID NO: 1648410 - RNA, 15 nt, Human
cauuuacuuuuaaac

SEQ ID NO: 1648411 - RNA, 23 nt, Human
gcuggcgugcagcaucagcaucc

SEQ ID NO: 1648412 - RNA, 14 nt, Human
uacuaauuuuaaaa

SEQ ID NO: 1648413 - RNA, 17 nt, Human
guuuaauaauuuuuaau

SEQ ID NO: 1648414 - RNA, 15 nt, Human
aaauguauucuuuua

SEQ ID NO: 1648415 - RNA, 15 nt, Human
cuaagcaaaauguga

SEQ ID NO: 1648416 - RNA, 19 nt, Human
ggucgaggcuacagugagc

SEQ ID NO: 1648417 - RNA, 17 nt, Human
ccugccccccagcccuc

SEQ ID NO: 1648418 - RNA, 16 nt, Human
auaguaccucugcuau

SEQ ID NO: 1648419 - RNA, 17 nt, Human
cugcacuccagccugag

SEQ ID NO: 1648420 - RNA, 16 nt, Human
aaguaaaggcaaacuu

SEQ ID NO: 1648421 - RNA, 15 nt, Human
agugacaagcucaca

SEQ ID NO: 1648422 - RNA, 15 nt, Human
ugcagauaaacagua

SEQ ID NO: 1648423 - RNA, 18 nt, Human
cagcugcucaauaaagua

SEQ ID NO: 1648424 - RNA, 17 nt, Human
cccacuagacccacugg

SEQ ID NO: 1648425 - RNA, 16 nt, Human
uagcuacuaauuuuaa

SEQ ID NO: 1648426 - RNA, 21 nt, Human
uccuacaagacacagugacca

SEQ ID NO: 1648427 - RNA, 22 nt, Human
agucuuucacauuuaaauaaag

SEQ ID NO: 1648428 - RNA, 22 nt, Human
ggguuccuuccucugagccuug

SEQ ID NO: 1648429 - RNA, 11 nt, Human
ucaccugcccu

SEQ ID NO: 1648430 - RNA, 17 nt, Human
ccugagcuugcagagau

SEQ ID NO: 1648431 - RNA, 15 nt, Human
cuaguaauuggaaag

SEQ ID NO: 1648432 - RNA, 16 nt, Human
uugauuaagaaaggaa

SEQ ID NO: 1648433 - RNA, 22 nt, Human
ugaaaaaguucugcagauaaac

SEQ ID NO: 1648434 - RNA, 14 nt, Human
auuuaaggccaggc

SEQ ID NO: 1648435 - RNA, 14 nt, Human
acugccaucauuua

SEQ ID NO: 1648436 - RNA, 15 nt, Human
cccaucucaggugug

SEQ ID NO: 1648437 - RNA, 16 nt, Human
caaaguugauuaagaa

SEQ ID NO: 1648438 - RNA, 16 nt, Human
aucaaaagaaagaaaa

SEQ ID NO: 1648439 - RNA, 14 nt, Human
acacugaagaagca

SEQ ID NO: 1648440 - RNA, 22 nt, Human
uauaagaaauaggaaauauuuu

SEQ ID NO: 1648441 - RNA, 15 nt, Human
auaucaauuuaaaaa

SEQ ID NO: 1648442 - RNA, 22 nt, Human
uuuccuuauucagaauuucuaa

SEQ ID NO: 1648443 - RNA, 21 nt, Human
ccuuccccucugcagcuucca

SEQ ID NO: 1648444 - RNA, 22 nt, Human
uaaaacaagcacuaaacaaaga

SEQ ID NO: 1648445 - RNA, 23 nt, Human
aucuaugccacaagaacccccuu

SEQ ID NO: 1648446 - RNA, 17 nt, Human
ccaucaguuccagccuu

SEQ ID NO: 1648447 - RNA, 19 nt, Human
caggcagauguuccuaaua

SEQ ID NO: 1648448 - RNA, 22 nt, Human
cuggguuccuuccucugagccu

SEQ ID NO: 1648449 - RNA, 20 nt, Human
ucugguagcuaaauauauau

SEQ ID NO: 1648450 - RNA, 20 nt, Human
aagggcuguuauaaucuuuc

SEQ ID NO: 1648451 - RNA, 16 nt, Human
aacgagacaagcagcc

SEQ ID NO: 1648452 - RNA, 16 nt, Human
accucugccucagaaa

SEQ ID NO: 1648453 - RNA, 15 nt, Human
guuauaaaaauauau

SEQ ID NO: 1648454 - RNA, 15 nt, Human
aaacaauuugaauau

SEQ ID NO: 1648455 - RNA, 14 nt, Human
agcguuaauguaaa

SEQ ID NO: 1648456 - RNA, 23 nt, Human
uaaaagacagugaaagaaaauaa

SEQ ID NO: 1648457 - RNA, 18 nt, Human
uauaggauguggggaagu

SEQ ID NO: 1648458 - RNA, 22 nt, Human
uggaagccagaucuaugccaca

SEQ ID NO: 1648459 - RNA, 14 nt, Human
ccacuggacucacc

SEQ ID NO: 1648460 - RNA, 21 nt, Human
acaugagguacugagagugaa

SEQ ID NO: 1648461 - RNA, 19 nt, Human
gagccucagucucccuccc

SEQ ID NO: 1648462 - RNA, 23 nt, Human
auaucuuuuuuuuaauaaaccau

SEQ ID NO: 1648463 - RNA, 13 nt, Human
accaacacccuga

SEQ ID NO: 1648464 - RNA, 22 nt, Human
uggaaaguuuaugguuguauua

SEQ ID NO: 1648465 - RNA, 20 nt, Human
ccauuguggucacaggaagu

SEQ ID NO: 1648466 - RNA, 21 nt, Human
gaaaaaaagcuuuuuuugaau

SEQ ID NO: 1648467 - RNA, 15 nt, Human
gacucaccuccccca

SEQ ID NO: 1648468 - RNA, 21 nt, Human
ugaauuguaggugacuauuau

SEQ ID NO: 1648469 - RNA, 18 nt, Human
ccugaaagaggaaugaag

SEQ ID NO: 1648470 - RNA, 14 nt, Human
aacuuugauuuuau

SEQ ID NO: 1648471 - RNA, 16 nt, Human
cuggaugcucucguug

SEQ ID NO: 1648472 - RNA, 16 nt, Human
ugcuaagucuuauaua

SEQ ID NO: 1648473 - RNA, 15 nt, Human
cuucugaggagcugu

SEQ ID NO: 1648474 - RNA, 15 nt, Human
auuauuuuuuaaaaa

SEQ ID NO: 1648475 - RNA, 19 nt, Human
cucaagcuaugugagcuca

SEQ ID NO: 1648476 - RNA, 14 nt, Human
aaaacuucagacau

SEQ ID NO: 1648477 - RNA, 16 nt, Human
aaguugauuaagaaag

SEQ ID NO: 1648478 - RNA, 22 nt, Human
ccuuccccucugcagcuuccag

SEQ ID NO: 1648479 - RNA, 14 nt, Human
guaacugauuugua

SEQ ID NO: 1648480 - RNA, 23 nt, Human
ugaaaaucuuauaauuuaaaaua

SEQ ID NO: 1648481 - RNA, 11 nt, Human
caaaaaucaaa

SEQ ID NO: 1648482 - RNA, 14 nt, Human
uaauuauuucacuu

SEQ ID NO: 1648483 - RNA, 17 nt, Human
acacuaagagagaauga

SEQ ID NO: 1648484 - RNA, 14 nt, Human
cugaggcuccacuu

SEQ ID NO: 1648485 - RNA, 13 nt, Human
uauuuauuuuaau

SEQ ID NO: 1648486 - RNA, 12 nt, Human
cagacacaugug

SEQ ID NO: 1648487 - RNA, 20 nt, Human
aggacaaaaggaauguguaa

SEQ ID NO: 1648488 - RNA, 14 nt, Human
accacaagacugca

SEQ ID NO: 1648489 - RNA, 14 nt, Human
aucuauguagaaua

SEQ ID NO: 1648490 - RNA, 19 nt, Human
auaaaagacaaggaaaaaa

SEQ ID NO: 1648491 - RNA, 20 nt, Human
ugauuauaugucacuuugcu

SEQ ID NO: 1648492 - RNA, 23 nt, Human
cccagcccuccuuaucaaaggac

SEQ ID NO: 1648493 - RNA, 20 nt, Human
ccuccugccuaagugcagcc

SEQ ID NO: 1648494 - RNA, 23 nt, Human
aagagccuuuuuuugaaaaaaag

SEQ ID NO: 1648495 - RNA, 12 nt, Human
cagugaaagaaa

SEQ ID NO: 1648496 - RNA, 16 nt, Human
uugucaauaaaaucca

SEQ ID NO: 1648497 - RNA, 18 nt, Human
cauggugaaaccuggucu

SEQ ID NO: 1648498 - RNA, 22 nt, Human
ggacagcccuucuuuccacaga

SEQ ID NO: 1648499 - RNA, 17 nt, Human
ugcccauaccccuggcc

SEQ ID NO: 1648500 - RNA, 19 nt, Human
agagccuuuuuuugaaaaa

SEQ ID NO: 1648501 - RNA, 20 nt, Human
ggccuaugcagagguccaca

SEQ ID NO: 1648502 - RNA, 14 nt, Human
cuuucauaauaagu

SEQ ID NO: 1648503 - RNA, 14 nt, Human
ugagcucagcccug

SEQ ID NO: 1648504 - RNA, 15 nt, Human
agggaagacaagaag

SEQ ID NO: 1648505 - RNA, 17 nt, Human
aaaguacaagagcuuaa

SEQ ID NO: 1648506 - RNA, 18 nt, Human
uuacagguccugcugaaa

SEQ ID NO: 1648507 - RNA, 13 nt, Human
aguuaccucugcc

SEQ ID NO: 1648508 - RNA, 13 nt, Human
cacauuuaaauaa

SEQ ID NO: 1648509 - RNA, 21 nt, Human
ugccuguaaucacagcuacuu

SEQ ID NO: 1648510 - RNA, 18 nt, Human
ccuuccuaauuccacagc

SEQ ID NO: 1648511 - RNA, 12 nt, Human
aaagaaacaaaa

SEQ ID NO: 1648512 - RNA, 15 nt, Human
cgaagcaccaucauu

SEQ ID NO: 1648513 - RNA, 18 nt, Human
gagccucagucucccucc

SEQ ID NO: 1648514 - RNA, 16 nt, Human
gagcucgugggacagu

SEQ ID NO: 1648515 - RNA, 20 nt, Human
gggcaagagagcgagacccu

SEQ ID NO: 1648516 - RNA, 17 nt, Human
acccacuggacucaccu

SEQ ID NO: 1648517 - RNA, 16 nt, Human
aauugacccacaagaa

SEQ ID NO: 1648518 - RNA, 19 nt, Human
cagcuacuugggaggcuga

SEQ ID NO: 1648519 - RNA, 13 nt, Human
aaaauaacgauaa

SEQ ID NO: 1648520 - RNA, 12 nt, Human
ucaccccuugcc

SEQ ID NO: 1648521 - RNA, 18 nt, Human
aaacaaaauuagaaaugu

SEQ ID NO: 1648522 - RNA, 19 nt, Human
cucuugaggcacagaaacu

SEQ ID NO: 1648523 - RNA, 13 nt, Human
caagaaggaaaga

SEQ ID NO: 1648524 - RNA, 21 nt, Human
cccuauccuacuuccccuucc

SEQ ID NO: 1648525 - RNA, 14 nt, Human
agaaaauaacaaua

SEQ ID NO: 1648526 - RNA, 16 nt, Human
acuguauguccuuggu

SEQ ID NO: 1648527 - RNA, 18 nt, Human
acacuguuaucuucacuu

SEQ ID NO: 1648528 - RNA, 22 nt, Human
guguccccuauccuacuucccc

SEQ ID NO: 1648529 - RNA, 16 nt, Human
aagaaauauuccuuaa

SEQ ID NO: 1648530 - RNA, 22 nt, Human
ugaagcaaaauuuuuucucuag

SEQ ID NO: 1648531 - RNA, 21 nt, Human
gcccauccugccccugagccc

SEQ ID NO: 1648532 - RNA, 16 nt, Human
ugcuauugaaguuuug

SEQ ID NO: 1648533 - RNA, 15 nt, Human
ggacucaccuccccc

SEQ ID NO: 1648534 - RNA, 15 nt, Human
gccucuuagaugcag

SEQ ID NO: 1648535 - RNA, 23 nt, Human
cucagucucccucccuuggggcc

SEQ ID NO: 1648536 - RNA, 15 nt, Human
accucccccaucucu

SEQ ID NO: 1648537 - RNA, 17 nt, Human
aagacagugaaagaaaa

SEQ ID NO: 1648538 - RNA, 23 nt, Human
uggcuugaguuuaaauuguaaua

SEQ ID NO: 1648539 - RNA, 22 nt, Human
agaaagugacaagcucacagac

SEQ ID NO: 1648540 - RNA, 15 nt, Human
ccaaaauauaaucag

SEQ ID NO: 1648541 - RNA, 19 nt, Human
uguuugccgcuuaagcuuu

SEQ ID NO: 1648542 - RNA, 21 nt, Human
caggcacuaucuggguuuugg

SEQ ID NO: 1648543 - RNA, 14 nt, Human
acccgggaggcaga

SEQ ID NO: 1648544 - RNA, 11 nt, Human
auuuuugaagc

SEQ ID NO: 1648545 - RNA, 15 nt, Human
uuauaugcuauuuau

SEQ ID NO: 1648546 - RNA, 20 nt, Human
agaagaacugaaaucauacu

SEQ ID NO: 1648547 - RNA, 18 nt, Human
aacugccaucauuuacuu

SEQ ID NO: 1648548 - RNA, 15 nt, Human
uguuaaaugauuuca

SEQ ID NO: 1648549 - RNA, 14 nt, Human
auauuuauuuuaau

SEQ ID NO: 1648550 - RNA, 20 nt, Human
uaaaagacaaggaaaaaaua

SEQ ID NO: 1648551 - RNA, 21 nt, Human
acaaagacaucgauugauaug

SEQ ID NO: 1648552 - RNA, 21 nt, Human
aaaauaugccccauucaacau

SEQ ID NO: 1648553 - RNA, 18 nt, Human
cuuuccaugaguugcagu

SEQ ID NO: 1648554 - RNA, 21 nt, Human
ucagggcagaugaugcuuuga

SEQ ID NO: 1648555 - RNA, 16 nt, Human
uuagagaauuuccuua

SEQ ID NO: 1648556 - RNA, 18 nt, Human
uuuauggcacuaguauuu

SEQ ID NO: 1648557 - RNA, 21 nt, Human
aggcucuuuugggauuuuuga

SEQ ID NO: 1648558 - RNA, 23 nt, Human
augucaauucuugccaaauauaa

SEQ ID NO: 1648559 - RNA, 16 nt, Human
gcuucuguuccgugcu

SEQ ID NO: 1648560 - RNA, 20 nt, Human
uccagccugagcgacaguga

SEQ ID NO: 1648561 - RNA, 13 nt, Human
aagaucagccugg

SEQ ID NO: 1648562 - RNA, 19 nt, Human
aaggaaguauaggccaggc

SEQ ID NO: 1648563 - RNA, 21 nt, Human
guacuccagccagggcaagag

SEQ ID NO: 1648564 - RNA, 15 nt, Human
cauuuaguuauaaaa

SEQ ID NO: 1648565 - RNA, 13 nt, Human
uaaaauacaaaaa

SEQ ID NO: 1648566 - RNA, 16 nt, Human
ugagccccgaaucuga

SEQ ID NO: 1648567 - RNA, 14 nt, Human
uauaauuuaaauau

SEQ ID NO: 1648568 - RNA, 20 nt, Human
aagaugguaccaccagucug

SEQ ID NO: 1648569 - RNA, 16 nt, Human
cugaucaccugcccug

SEQ ID NO: 1648570 - RNA, 23 nt, Human
aucacagcuacuugggaggcuga

SEQ ID NO: 1648571 - RNA, 22 nt, Human
gucucuaccaaaaaaaggaagg

SEQ ID NO: 1648572 - RNA, 18 nt, Human
agauccccaagccuggca

SEQ ID NO: 1648573 - RNA, 20 nt, Human
uuucuucaacucccugcccc

SEQ ID NO: 1648574 - RNA, 22 nt, Human
cuuccccucugcagcuuccagg

SEQ ID NO: 1648575 - RNA, 15 nt, Human
ucauaagaauucugu

SEQ ID NO: 1648576 - RNA, 16 nt, Human
cuaaaaauuaaaaccu

SEQ ID NO: 1648577 - RNA, 18 nt, Human
cauuauggauaaagauga

SEQ ID NO: 1648578 - RNA, 21 nt, Human
caucucagguguguugcagug

SEQ ID NO: 1648579 - RNA, 14 nt, Human
gggaagacaagaag

SEQ ID NO: 1648580 - RNA, 15 nt, Human
cccugcaaagcccag

SEQ ID NO: 1648581 - RNA, 23 nt, Human
aauacacuguuaucuucacuuuu

SEQ ID NO: 1648582 - RNA, 13 nt, Human
guuuucccaucuc

SEQ ID NO: 1648583 - RNA, 15 nt, Human
uaacaauaaaagaca

SEQ ID NO: 1648584 - RNA, 16 nt, Human
ugagccaaauguaaaa

SEQ ID NO: 1648585 - RNA, 13 nt, Human
gccacaagaaccc

SEQ ID NO: 1648586 - RNA, 18 nt, Human
cuccccaaaugcuuucca

SEQ ID NO: 1648587 - RNA, 17 nt, Human
gcagcaucagcaucccu

SEQ ID NO: 1648588 - RNA, 15 nt, Human
aauuauuucacuuua

SEQ ID NO: 1648589 - RNA, 17 nt, Human
aaauccuacuuucauaa

SEQ ID NO: 1648590 - RNA, 14 nt, Human
cuuggucugugaga

SEQ ID NO: 1648591 - RNA, 16 nt, Human
ugagaugcuagaacuc

SEQ ID NO: 1648592 - RNA, 12 nt, Human
uaccuccaagga

SEQ ID NO: 1648593 - RNA, 22 nt, Human
ugauugugggauacuauuuaau

SEQ ID NO: 1648594 - RNA, 17 nt, Human
aauaacaauaaaagaca

SEQ ID NO: 1648595 - RNA, 17 nt, Human
aggguguguaaguagau

SEQ ID NO: 1648596 - RNA, 16 nt, Human
aaguauaggccaggca

SEQ ID NO: 1648597 - RNA, 21 nt, Human
agcccuuccccucugcagcuu

SEQ ID NO: 1648598 - RNA, 15 nt, Human
cucaacaaacauaau

SEQ ID NO: 1648599 - RNA, 12 nt, Human
cuugguuuuaau

SEQ ID NO: 1648600 - RNA, 23 nt, Human
cagcaccuccuaagaaggcaccu

SEQ ID NO: 1648601 - RNA, 18 nt, Human
gaaaauaacgauaaaaga

SEQ ID NO: 1648602 - RNA, 18 nt, Human
gaaggugaucuggcucug

SEQ ID NO: 1648603 - RNA, 19 nt, Human
uugugccccugcacuccag

SEQ ID NO: 1648604 - RNA, 19 nt, Human
augaaagcagggacuugaa

SEQ ID NO: 1648605 - RNA, 17 nt, Human
uucacuguaaaauaaua

SEQ ID NO: 1648606 - RNA, 20 nt, Human
gauugugccccugcacucca

SEQ ID NO: 1648607 - RNA, 12 nt, Human
aguguuugaaag

SEQ ID NO: 1648608 - RNA, 18 nt, Human
ucuucuggguuccuuccu

SEQ ID NO: 1648609 - RNA, 21 nt, Human
gaaaugaguuuuucuuuucau

SEQ ID NO: 1648610 - RNA, 14 nt, Human
cucuugaggcacag

SEQ ID NO: 1648611 - RNA, 22 nt, Human
aagaugagaugguuucuagaga

SEQ ID NO: 1648612 - RNA, 17 nt, Human
uacaaaugcauuucuaa

SEQ ID NO: 1648613 - RNA, 22 nt, Human
uuugaaacgaggauugggaaaa

SEQ ID NO: 1648614 - RNA, 12 nt, Human
acaugagguacu

SEQ ID NO: 1648615 - RNA, 14 nt, Human
ggccgggagccuga

SEQ ID NO: 1648616 - RNA, 22 nt, Human
accuaacgaaguauccuucagc

SEQ ID NO: 1648617 - RNA, 16 nt, Human
gcuucacuguaaaaua

SEQ ID NO: 1648618 - RNA, 14 nt, Human
auccaaugaaauga

SEQ ID NO: 1648619 - RNA, 16 nt, Human
ugaauuaguuuuauau

SEQ ID NO: 1648620 - RNA, 14 nt, Human
cauuuacuuuuaaa

SEQ ID NO: 1648621 - RNA, 18 nt, Human
ggcacagaaacuccuguu

SEQ ID NO: 1648622 - RNA, 12 nt, Human
caacccaaaugu

SEQ ID NO: 1648623 - RNA, 21 nt, Human
gaaauguuuacagauccccaa

SEQ ID NO: 1648624 - RNA, 20 nt, Human
ccagcuugaaaccuucacuu

SEQ ID NO: 1648625 - RNA, 21 nt, Human
uuccuaauuccacagcugcuc

SEQ ID NO: 1648626 - RNA, 19 nt, Human
auuauuuuuuaaaaaaauu

SEQ ID NO: 1648627 - RNA, 15 nt, Human
ggcaagcucuaucac

SEQ ID NO: 1648628 - RNA, 17 nt, Human
agaaucacuugaacccg

SEQ ID NO: 1648629 - RNA, 16 nt, Human
uaaaagacaaggaaaa

SEQ ID NO: 1648630 - RNA, 16 nt, Human
acuaaacaaagaguga

SEQ ID NO: 1648631 - RNA, 14 nt, Human
uggcucugugugcu

SEQ ID NO: 1648632 - RNA, 11 nt, Human
ugugugcagca

SEQ ID NO: 1648633 - RNA, 20 nt, Human
ggcuaauaucuuaucuuccu

SEQ ID NO: 1648634 - RNA, 13 nt, Human
cuauuauauuucc

SEQ ID NO: 1648635 - RNA, 21 nt, Human
gacagucaccucauggaauug

SEQ ID NO: 1648636 - RNA, 23 nt, Human
auguuaaaacugggacaggggag

SEQ ID NO: 1648637 - RNA, 21 nt, Human
auuauauggcuugaguuuaaa

SEQ ID NO: 1648638 - RNA, 13 nt, Human
aucucaauauuuc

SEQ ID NO: 1648639 - RNA, 23 nt, Human
ucuagcaugucgucaaagcugaa

SEQ ID NO: 1648640 - RNA, 21 nt, Human
cuuguuggacgagaaaacaau

SEQ ID NO: 1648641 - RNA, 14 nt, Human
auuauuucacuuua

SEQ ID NO: 1648642 - RNA, 20 nt, Human
agcuacuaauuuuaaaaugu

SEQ ID NO: 1648643 - RNA, 14 nt, Human
aaucucaauauuuc

SEQ ID NO: 1648644 - RNA, 21 nt, Human
aacauggugaaaccuggucuc

SEQ ID NO: 1648645 - RNA, 16 nt, Human
auauuuccaagaaaua

SEQ ID NO: 1648646 - RNA, 19 nt, Human
ccgggcgugguggugagug

SEQ ID NO: 1648647 - RNA, 15 nt, Human
cuacuaauuuuaaaa

SEQ ID NO: 1648648 - RNA, 15 nt, Human
aauauauuuccuuau

SEQ ID NO: 1648649 - RNA, 20 nt, Human
uuaacacaugauccugcaau

SEQ ID NO: 1648650 - RNA, 19 nt, Human
cuggggcuuuaacuccugc

SEQ ID NO: 1648651 - RNA, 21 nt, Human
ugaccauacuaauuauacccc

SEQ ID NO: 1648652 - RNA, 12 nt, Human
aacuuuacagaa

SEQ ID NO: 1648653 - RNA, 20 nt, Human
agggaagacaagaaggaaag

SEQ ID NO: 1648654 - RNA, 22 nt, Human
cauuuaguuauaaaaauauaua

SEQ ID NO: 1648655 - RNA, 14 nt, Human
gucucaauaaauaa

SEQ ID NO: 1648656 - RNA, 16 nt, Human
caucugaugagaacaa

SEQ ID NO: 1648657 - RNA, 13 nt, Human
cugccuucucaac

SEQ ID NO: 1648658 - RNA, 11 nt, Human
cauaugaaaag

SEQ ID NO: 1648659 - RNA, 17 nt, Human
gcaucuccucaacucug

SEQ ID NO: 1648660 - RNA, 18 nt, Human
uauaacaaugcuguauuu

SEQ ID NO: 1648661 - RNA, 15 nt, Human
cuugugaggagcugg

SEQ ID NO: 1648662 - RNA, 12 nt, Human
cauagaaguaaa

SEQ ID NO: 1648663 - RNA, 22 nt, Human
acuuugauuuuauaugcuauuu

SEQ ID NO: 1648664 - RNA, 23 nt, Human
gcauuguuggcuguuccugcagu

SEQ ID NO: 1648665 - RNA, 14 nt, Human
cuggaaaucagggu

SEQ ID NO: 1648666 - RNA, 21 nt, Human
agucuguuuucccuccuugga

SEQ ID NO: 1648667 - RNA, 17 nt, Human
aggcaggaggaucacuu

SEQ ID NO: 1648668 - RNA, 21 nt, Human
auguuuacagauccccaagcc

SEQ ID NO: 1648669 - RNA, 16 nt, Human
guugauggaaauacac

SEQ ID NO: 1648670 - RNA, 12 nt, Human
gacagugaaaga

SEQ ID NO: 1648671 - RNA, 20 nt, Human
caccuccuaagaaggcaccu

SEQ ID NO: 1648672 - RNA, 22 nt, Human
accccugagcuugcagagauga

SEQ ID NO: 1648673 - RNA, 12 nt, Human
uauuauuuuuua

SEQ ID NO: 1648674 - RNA, 23 nt, Human
caugcugucuacacuaagagaga

SEQ ID NO: 1648675 - RNA, 18 nt, Human
cuaauuagcauggccaca

SEQ ID NO: 1648676 - RNA, 17 nt, Human
uacagaacuaaaaauua

SEQ ID NO: 1648677 - RNA, 15 nt, Human
cccccagcccuccuu

SEQ ID NO: 1648678 - RNA, 16 nt, Human
gucuaucuuugagcgc

SEQ ID NO: 1648679 - RNA, 14 nt, Human
aauuguauuacaaa

SEQ ID NO: 1648680 - RNA, 23 nt, Human
caccaaggagccaaacauccuac

SEQ ID NO: 1648681 - RNA, 16 nt, Human
uaaacuuugauuuuau

SEQ ID NO: 1648682 - RNA, 16 nt, Human
ccagucccuccccaaa

SEQ ID NO: 1648683 - RNA, 14 nt, Human
uauuaaguauuuua

SEQ ID NO: 1648684 - RNA, 16 nt, Human
gagcaucaucuucugg

SEQ ID NO: 1648685 - RNA, 20 nt, Human
aaaaaccugagccccaaaag

SEQ ID NO: 1648686 - RNA, 16 nt, Human
uuucuauaauuuaaau

SEQ ID NO: 1648687 - RNA, 18 nt, Human
uuuucucuccucucccca

SEQ ID NO: 1648688 - RNA, 12 nt, Human
uuaauaaaccau

SEQ ID NO: 1648689 - RNA, 22 nt, Human
aacaaggaaggaaagaugugaa

SEQ ID NO: 1648690 - RNA, 15 nt, Human
acuauuauauuucca

SEQ ID NO: 1648691 - RNA, 18 nt, Human
caaggcugauuaaaccaa

SEQ ID NO: 1648692 - RNA, 18 nt, Human
uaggaugggaacaaggaa

SEQ ID NO: 1648693 - RNA, 18 nt, Human
agugucaaugcagccccc

SEQ ID NO: 1648694 - RNA, 23 nt, Human
auuuuagauagaugaagaagcua

SEQ ID NO: 1648695 - RNA, 15 nt, Human
cuucaacucccugcc

SEQ ID NO: 1648696 - RNA, 18 nt, Human
cauggaauuggagcucgu

SEQ ID NO: 1648697 - RNA, 15 nt, Human
acagugaaagaaaau

SEQ ID NO: 1648698 - RNA, 15 nt, Human
uaaaguaaaggcaaa

SEQ ID NO: 1648699 - RNA, 22 nt, Human
agcuguguccucaugagggcug

SEQ ID NO: 1648700 - RNA, 15 nt, Human
uuuaugguuguauua

SEQ ID NO: 1648701 - RNA, 18 nt, Human
cagauuugagcucagccc

SEQ ID NO: 1648702 - RNA, 15 nt, Human
ucauaauaaguugca

SEQ ID NO: 1648703 - RNA, 20 nt, Human
cugcacuccagccugagcga

SEQ ID NO: 1648704 - RNA, 17 nt, Human
caggaaucacuggcugu

SEQ ID NO: 1648705 - RNA, 22 nt, Human
gagucccaggcugagccucagu

SEQ ID NO: 1648706 - RNA, 19 nt, Human
cccacuugccauaaaacuu

SEQ ID NO: 1648707 - RNA, 14 nt, Human
caggcacaguggcu

SEQ ID NO: 1648708 - RNA, 15 nt, Human
ugauuucauucaaua

SEQ ID NO: 1648709 - RNA, 21 nt, Human
ugaugcuacaggauuugaaau

SEQ ID NO: 1648710 - RNA, 17 nt, Human
uuucauaagaauucugu

SEQ ID NO: 1648711 - RNA, 19 nt, Human
uugugggauacuauuuaau

SEQ ID NO: 1648712 - RNA, 18 nt, Human
ugaaaaaguucugcagau

SEQ ID NO: 1648713 - RNA, 15 nt, Human
cacaggacagcccuu

SEQ ID NO: 1648714 - RNA, 13 nt, Human
cugagagugaaca

SEQ ID NO: 1648715 - RNA, 19 nt, Human
gaccggccuuugcaccucc

SEQ ID NO: 1648716 - RNA, 21 nt, Human
uuagaaauguaauuauguucu

SEQ ID NO: 1648717 - RNA, 20 nt, Human
accucauggaauuggagcuc

SEQ ID NO: 1648718 - RNA, 24 nt, Human
uggcagaucuacaugucuagagaa

SEQ ID NO: 1648719 - RNA, 19 nt, Human
ccugccuaagugcagcccc

SEQ ID NO: 1648720 - RNA, 16 nt, Human
ucaguuuuugugaaaa

SEQ ID NO: 1648721 - RNA, 17 nt, Human
agauacaguggagacau

SEQ ID NO: 1648722 - RNA, 15 nt, Human
gcuguucuuuaaaug

SEQ ID NO: 1648723 - RNA, 17 nt, Human
ugcacaucaaaauaugc

SEQ ID NO: 1648724 - RNA, 22 nt, Human
caaacaauuugaauauaaauuu

SEQ ID NO: 1648725 - RNA, 13 nt, Human
aaaauaacaauga

SEQ ID NO: 1648726 - RNA, 18 nt, Human
ggcucuggacaggcacua

SEQ ID NO: 1648727 - RNA, 14 nt, Human
aaagaggaaugaag

SEQ ID NO: 1648728 - RNA, 18 nt, Human
ccugccuaagugcagccc

SEQ ID NO: 1648729 - RNA, 17 nt, Human
ccaagcugguggcucug

SEQ ID NO: 1648730 - RNA, 10 nt, Human
caacucccug

SEQ ID NO: 1648731 - RNA, 15 nt, Human
uaucaauuuaaaaaa

SEQ ID NO: 1648732 - RNA, 22 nt, Human
cauaaauguugacaugggacau

SEQ ID NO: 1648733 - RNA, 19 nt, Human
acauuuguauaaaauaauu

SEQ ID NO: 1648734 - RNA, 12 nt, Human
gcaaagcccagc

SEQ ID NO: 1648735 - RNA, 14 nt, Human
ugcucauggaauug

SEQ ID NO: 1648736 - RNA, 16 nt, Human
ucuucaacucccugcc

SEQ ID NO: 1648737 - RNA, 12 nt, Human
uuuuauauuuga

SEQ ID NO: 1648738 - RNA, 19 nt, Human
cauaucaaacugaaacaaa

SEQ ID NO: 1648739 - RNA, 20 nt, Human
uugaacccgggaggcagagg

SEQ ID NO: 1648740 - RNA, 19 nt, Human
aauauaugaggcuacagaa

SEQ ID NO: 1648741 - RNA, 18 nt, Human
accaagcugguggcucug

SEQ ID NO: 1648742 - RNA, 14 nt, Human
auauauuuccuuau

SEQ ID NO: 1648743 - RNA, 17 nt, Human
acaaaugggaaacaaaa

SEQ ID NO: 1648744 - RNA, 11 nt, Human
aggcaggagga

SEQ ID NO: 1648745 - RNA, 18 nt, Human
gccccugcacuccagccu

SEQ ID NO: 1648746 - RNA, 21 nt, Human
gcccccacuugccauaaaacu

SEQ ID NO: 1648747 - RNA, 14 nt, Human
auuuauuuuaauaa

SEQ ID NO: 1648748 - RNA, 16 nt, Human
ugcaugguuuagaaag

SEQ ID NO: 1648749 - RNA, 19 nt, Human
gguuccuuccucugagccu

SEQ ID NO: 1648750 - RNA, 20 nt, Human
aaaugauguuucauaagaau

SEQ ID NO: 1648751 - RNA, 14 nt, Human
ugaucaccugcccu

SEQ ID NO: 1648752 - RNA, 22 nt, Human
uggagacauugaggcaggcacu

SEQ ID NO: 1648753 - RNA, 18 nt, Human
uuuuagugaaauauuauu

SEQ ID NO: 1648754 - RNA, 22 nt, Human
accauuucuugagguaaaagca

SEQ ID NO: 1648755 - RNA, 18 nt, Human
cugagccuugggaccccu

SEQ ID NO: 1648756 - RNA, 12 nt, Human
cuaagaagugaa

SEQ ID NO: 1648757 - RNA, 14 nt, Human
ccugcugagcccca

SEQ ID NO: 1648758 - RNA, 19 nt, Human
aaaauaacaauaaaagaca

SEQ ID NO: 1648759 - RNA, 15 nt, Human
ggcuggcgugcagca

SEQ ID NO: 1648760 - RNA, 17 nt, Human
auuagcauggccacauc

SEQ ID NO: 1648761 - RNA, 16 nt, Human
acauuugcucauggaa

SEQ ID NO: 1648762 - RNA, 18 nt, Human
uuguacucugaaaguuuu

SEQ ID NO: 1648763 - RNA, 17 nt, Human
uuauauuugaaauauug

SEQ ID NO: 1648764 - RNA, 21 nt, Human
aauuccugacugcuaguuuau

SEQ ID NO: 1648765 - RNA, 18 nt, Human
acaaggaaggaaagaugu

SEQ ID NO: 1648766 - RNA, 12 nt, Human
acugaaacaaaa

SEQ ID NO: 1648767 - RNA, 15 nt, Human
aagccaugugcagcc

SEQ ID NO: 1648768 - RNA, 15 nt, Human
uuuaaaugucugaaa

SEQ ID NO: 1648769 - RNA, 18 nt, Human
cuaggcauagcccugccu

SEQ ID NO: 1648770 - RNA, 16 nt, Human
aauuccacagcugcuc

SEQ ID NO: 1648771 - RNA, 15 nt, Human
ucaagggugugugca

SEQ ID NO: 1648772 - RNA, 14 nt, Human
cugccagcuggccu

SEQ ID NO: 1648773 - RNA, 16 nt, Human
cugagcuugcagagau

SEQ ID NO: 1648774 - RNA, 18 nt, Human
gcacuccagccugagcga

SEQ ID NO: 1648775 - RNA, 16 nt, Human
aauaaaguguuugaaa

SEQ ID NO: 1648776 - RNA, 22 nt, Human
cauuuaaauaaaguguuugaaa

SEQ ID NO: 1648777 - RNA, 18 nt, Human
uaauuauuucacuuuaga

SEQ ID NO: 1648778 - RNA, 15 nt, Human
uggacucaccucccc

SEQ ID NO: 1648779 - RNA, 18 nt, Human
acagagacagaaagcaga

SEQ ID NO: 1648780 - RNA, 23 nt, Human
caggcauggugguuuacgccuau

SEQ ID NO: 1648781 - RNA, 19 nt, Human
auuguaguccuguaaugga

SEQ ID NO: 1648782 - RNA, 11 nt, Human
aaaggaaggaa

SEQ ID NO: 1648783 - RNA, 21 nt, Human
uauaagaaauaggaaauauuu

SEQ ID NO: 1648784 - RNA, 14 nt, Human
aagcugaguguuuc

SEQ ID NO: 1648785 - RNA, 12 nt, Human
caagaaggaaag

SEQ ID NO: 1648786 - RNA, 11 nt, Human
gccaugggaca

SEQ ID NO: 1648787 - RNA, 22 nt, Human
auauuuuagauagaugaagaag

SEQ ID NO: 1648788 - RNA, 18 nt, Human
cagagucaagggugugug

SEQ ID NO: 1648789 - RNA, 22 nt, Human
aaggagaggcaaagaaaggaga

SEQ ID NO: 1648790 - RNA, 18 nt, Human
auuuuaacucuauaaugu

SEQ ID NO: 1648791 - RNA, 14 nt, Human
cucaccccuugcca

SEQ ID NO: 1648792 - RNA, 13 nt, Human
aacauuuauguuc

SEQ ID NO: 1648793 - RNA, 22 nt, Human
aaacauguuuaucguauuugau

SEQ ID NO: 1648794 - RNA, 17 nt, Human
augauuaaguaaugaua

SEQ ID NO: 1648795 - RNA, 18 nt, Human
cagccucuuagaugcagu

SEQ ID NO: 1648796 - RNA, 14 nt, Human
cguguccccuaucc

SEQ ID NO: 1648797 - RNA, 19 nt, Human
gagacauugaggcaggcac

SEQ ID NO: 1648798 - RNA, 23 nt, Human
aggaugguucccuugaugaagaa

SEQ ID NO: 1648799 - RNA, 18 nt, Human
auggccacaucugagccc

SEQ ID NO: 1648800 - RNA, 12 nt, Human
cuuaagcuuuca

SEQ ID NO: 1648801 - RNA, 19 nt, Human
uacuucuuaggguuaugau

SEQ ID NO: 1648802 - RNA, 22 nt, Human
agcagcauaaauguugacaugg

SEQ ID NO: 1648803 - RNA, 19 nt, Human
uguaguguuggagaagaac

SEQ ID NO: 1648804 - RNA, 18 nt, Human
ugccuaggcauagcccug

SEQ ID NO: 1648805 - RNA, 21 nt, Human
cuggccuucggccuccauccu

SEQ ID NO: 1648806 - RNA, 16 nt, Human
ggcagagagguaggga

SEQ ID NO: 1648807 - RNA, 22 nt, Human
aggcugaugggcaaaaaaccaa

SEQ ID NO: 1648808 - RNA, 16 nt, Human
gaauggcuaagcaaaa

SEQ ID NO: 1648809 - RNA, 16 nt, Human
cuaggcauagcccugc

SEQ ID NO: 1648810 - RNA, 16 nt, Human
aguuuauauagaaaug

SEQ ID NO: 1648811 - RNA, 18 nt, Human
ccugaggugagcaucauc

SEQ ID NO: 1648812 - RNA, 19 nt, Human
agcucugcccauccugccc

SEQ ID NO: 1648813 - RNA, 14 nt, Human
gaggcacagaaacu

SEQ ID NO: 1648814 - RNA, 22 nt, Human
uggacgagaaaacaauaacgau

SEQ ID NO: 1648815 - RNA, 23 nt, Human
aguacucauacauguuacaacac

SEQ ID NO: 1648816 - RNA, 18 nt, Human
uaaugaauacuuuauaaa

SEQ ID NO: 1648817 - RNA, 22 nt, Human
gagccucagucucccucccuug

SEQ ID NO: 1648818 - RNA, 20 nt, Human
cagcuuccaggcuggcgugc

SEQ ID NO: 1648819 - RNA, 18 nt, Human
uuccuaauaaagcuucug

SEQ ID NO: 1648820 - RNA, 14 nt, Human
aaaagaaacauuug

SEQ ID NO: 1648821 - RNA, 16 nt, Human
uggaaacgaagcacca

SEQ ID NO: 1648822 - RNA, 23 nt, Human
ucaugcccauaccccuggccaag

SEQ ID NO: 1648823 - RNA, 23 nt, Human
accuccauggaaacgaagcacca

SEQ ID NO: 1648824 - RNA, 18 nt, Human
cuuugagcgcccacuaga

SEQ ID NO: 1648825 - RNA, 17 nt, Human
aacaguuaccucugccu

SEQ ID NO: 1648826 - RNA, 20 nt, Human
cuaaaugucaaucagccuag

SEQ ID NO: 1648827 - RNA, 18 nt, Human
ugcagugucugcuggaga

SEQ ID NO: 1648828 - RNA, 13 nt, Human
aguguuuagcaua

SEQ ID NO: 1648829 - RNA, 18 nt, Human
gggaacaaggaaggaaag

SEQ ID NO: 1648830 - RNA, 17 nt, Human
caaauccaaugaaauga

SEQ ID NO: 1648831 - RNA, 16 nt, Human
ccugccccccagcccu

SEQ ID NO: 1648832 - RNA, 13 nt, Human
auaacgauaaaag

SEQ ID NO: 1648833 - RNA, 15 nt, Human
aggaacuggugucuu

SEQ ID NO: 1648834 - RNA, 20 nt, Human
ucugaaaguuuuggaaacgu

SEQ ID NO: 1648835 - RNA, 19 nt, Human
acuggacucaccuccccca

SEQ ID NO: 1648836 - RNA, 17 nt, Human
uguucuaagaagugaaa

SEQ ID NO: 1648837 - RNA, 15 nt, Human
uacaggauuugaaau

SEQ ID NO: 1648838 - RNA, 21 nt, Human
acagugauuaccagggacuga

SEQ ID NO: 1648839 - RNA, 19 nt, Human
ggagccugaucaccugccc

SEQ ID NO: 1648840 - RNA, 20 nt, Human
uuaaguuuuuuuuuaaaaaa

SEQ ID NO: 1648841 - RNA, 23 nt, Human
agaguuuagcuggaaaaguaugu

SEQ ID NO: 1648842 - RNA, 16 nt, Human
ucaaacuuuacagaaa

SEQ ID NO: 1648843 - RNA, 14 nt, Human
ugcuaagucuuaua

SEQ ID NO: 1648844 - RNA, 15 nt, Human
auaauccuaaacaua

SEQ ID NO: 1648845 - RNA, 18 nt, Human
gaccccugagcuugcaga

SEQ ID NO: 1648846 - RNA, 18 nt, Human
uccuaauuccacagcugc

SEQ ID NO: 1648847 - RNA, 13 nt, Human
uaagaaaggaagu

SEQ ID NO: 1648848 - RNA, 14 nt, Human
cucuggcuccagcu

SEQ ID NO: 1648849 - RNA, 15 nt, Human
uccagauccuggaaa

SEQ ID NO: 1648850 - RNA, 12 nt, Human
caggacagcccu

SEQ ID NO: 1648851 - RNA, 15 nt, Human
gccccugcacuccag

SEQ ID NO: 1648852 - RNA, 17 nt, Human
uaucaauuuaaaaaaaa

SEQ ID NO: 1648853 - RNA, 15 nt, Human
aaaaaagaaacauuu

SEQ ID NO: 1648854 - RNA, 13 nt, Human
acaagaaggaaag

SEQ ID NO: 1648855 - RNA, 18 nt, Human
auaucaaacugaaacaaa

SEQ ID NO: 1648856 - RNA, 20 nt, Human
ugaggcuccacuuggucugu

SEQ ID NO: 1648857 - RNA, 18 nt, Human
auguuagagaauuuccuu

SEQ ID NO: 1648858 - RNA, 20 nt, Human
aauuuuuucucuaggaaaua

SEQ ID NO: 1648859 - RNA, 21 nt, Human
uuuguauaaaauaauuuuuau

SEQ ID NO: 1648860 - RNA, 19 nt, Human
uauauuuuugugauuuugu

SEQ ID NO: 1648861 - RNA, 15 nt, Human
ugcuguauuuuaaaa

SEQ ID NO: 1648862 - RNA, 17 nt, Human
cugccucagaaaacaag

SEQ ID NO: 1648863 - RNA, 12 nt, Human
caccuccuaaga

SEQ ID NO: 1648864 - RNA, 16 nt, Human
cuguggauuuaaugug

SEQ ID NO: 1648865 - RNA, 16 nt, Human
uaaauaaauaaauaaa

SEQ ID NO: 1648866 - RNA, 16 nt, Human
aaauaaauaaauaaau

SEQ ID NO: 1648867 - RNA, 16 nt, Human
auaaauaaauaaauaa

SEQ ID NO: 1648868 - RNA, 19 nt, Human
auucagaauuucuaaaagu

SEQ ID NO: 1648869 - RNA, 16 nt, Human
aauaaauaaauaaaua

SEQ ID NO: 1648870 - RNA, 18 nt, Human
agcagugccaaaauauaa

SEQ ID NO: 1648871 - RNA, 16 nt, Human
ccaggcugagccucag

SEQ ID NO: 1648872 - RNA, 19 nt, Human
uggcaaacugccaucauuu

SEQ ID NO: 1648873 - RNA, 23 nt, Human
ccccucuggcuccagcuggccgg

SEQ ID NO: 1648874 - RNA, 14 nt, Human
agaauauauuuccu

SEQ ID NO: 1648875 - RNA, 17 nt, Human
cuccuuaucaaaggaca

SEQ ID NO: 1648876 - RNA, 22 nt, Human
gccugguguguucaagaccagc

SEQ ID NO: 1648877 - RNA, 13 nt, Human
aucuacacuccag

SEQ ID NO: 1648878 - RNA, 19 nt, Human
auugaggacacugauaugg

SEQ ID NO: 1648879 - RNA, 16 nt, Human
aagacugcacaucaaa

SEQ ID NO: 1648880 - RNA, 20 nt, Human
uaauucugguagcuaaauau

SEQ ID NO: 1648881 - RNA, 16 nt, Human
augcuaagugaaauaa

SEQ ID NO: 1648882 - RNA, 12 nt, Human
gccccugagccc

SEQ ID NO: 1648883 - RNA, 19 nt, Human
agacucgggauuaguacac

SEQ ID NO: 1648884 - RNA, 13 nt, Human
auuccucacuuug

SEQ ID NO: 1648885 - RNA, 12 nt, Human
acaagacacagu

SEQ ID NO: 1648886 - RNA, 16 nt, Human
cucagcccuggugggc

SEQ ID NO: 1648887 - RNA, 20 nt, Human
uaucuucacuuuuauaagaa

SEQ ID NO: 1648888 - RNA, 20 nt, Human
gaaauacacuguuaucuuca

SEQ ID NO: 1648889 - RNA, 17 nt, Human
ccagggaagacaagaag

SEQ ID NO: 1648890 - RNA, 15 nt, Human
acaugugcuggccac

SEQ ID NO: 1648891 - RNA, 17 nt, Human
aggagaggcaaagaaag

SEQ ID NO: 1648892 - RNA, 14 nt, Human
gcuuuaacuccugc

SEQ ID NO: 1648893 - RNA, 18 nt, Human
ccugcaaagcccagcuug

SEQ ID NO: 1648894 - RNA, 15 nt, Human
cuccacuggaaaacu

SEQ ID NO: 1648895 - RNA, 22 nt, Human
caucaucuucuggguuaggccu

SEQ ID NO: 1648896 - RNA, 22 nt, Human
gucaagaucagccugggcaaca

SEQ ID NO: 1648897 - RNA, 22 nt, Human
aauaauccuaaacauaugaauu

SEQ ID NO: 1648898 - RNA, 15 nt, Human
auuucauucaauauc

SEQ ID NO: 1648899 - RNA, 12 nt, Human
ucuuaagaagac

SEQ ID NO: 1648900 - RNA, 14 nt, Human
uauuauauuuccaa

SEQ ID NO: 1648901 - RNA, 14 nt, Human
guccauugggcagg

SEQ ID NO: 1648902 - RNA, 19 nt, Human
uaucacuugucaauaaaau

SEQ ID NO: 1648903 - RNA, 12 nt, Human
auuucaaaaaaa

SEQ ID NO: 1648904 - RNA, 16 nt, Human
ucagcagagaaguuuu

SEQ ID NO: 1648905 - RNA, 11 nt, Human
ccacaucugag

SEQ ID NO: 1648906 - RNA, 18 nt, Human
uuguaaaggaauuuaaaa

SEQ ID NO: 1648907 - RNA, 16 nt, Human
agcuugaaaccuucac

SEQ ID NO: 1648908 - RNA, 17 nt, Human
agguccacaacacacag

SEQ ID NO: 1648909 - RNA, 23 nt, Human
uaucuauguagaauauauuuccu

SEQ ID NO: 1648910 - RNA, 13 nt, Human
agcuucuguuccg

SEQ ID NO: 1648911 - RNA, 11 nt, Human
cgauaaaagac

SEQ ID NO: 1648912 - RNA, 19 nt, Human
auuaaguuuuuuuuuaaaa

SEQ ID NO: 1648913 - RNA, 19 nt, Human
ccccuauccuacuuccccu

SEQ ID NO: 1648914 - RNA, 15 nt, Human
cuugaaaacuuuaug

SEQ ID NO: 1648915 - RNA, 13 nt, Human
auugauuauaugu

SEQ ID NO: 1648916 - RNA, 16 nt, Human
uggucugugagaugcu

SEQ ID NO: 1648917 - RNA, 22 nt, Human
auguuccuuuuaaagaaacaaa

SEQ ID NO: 1648918 - RNA, 21 nt, Human
gucucagugucaaugcagccc

SEQ ID NO: 1648919 - RNA, 16 nt, Human
uucacauuuaaauaaa

SEQ ID NO: 1648920 - RNA, 13 nt, Human
aucaaugaaugaa

SEQ ID NO: 1648921 - RNA, 20 nt, Human
gaauucauucacucaacaaa

SEQ ID NO: 1648922 - RNA, 19 nt, Human
cuucuggguuccuuccucu

SEQ ID NO: 1648923 - RNA, 15 nt, Human
agagacagaaagcag

SEQ ID NO: 1648924 - RNA, 15 nt, Human
aaaauacaaaaaaaa

SEQ ID NO: 1648925 - RNA, 15 nt, Human
uaaauaaauaaaaac

SEQ ID NO: 1648926 - RNA, 20 nt, Human
cacagcacgggggccaagga

SEQ ID NO: 1648927 - RNA, 21 nt, Human
ccucuguucugcacacagcac

SEQ ID NO: 1648928 - RNA, 22 nt, Human
agacccugucucaauaaauaaa

SEQ ID NO: 1648929 - RNA, 16 nt, Human
uaaugaauacuuuaua

SEQ ID NO: 1648930 - RNA, 13 nt, Human
ggaaguagaggag

SEQ ID NO: 1648931 - RNA, 23 nt, Human
uuuaaugccgauaucuucagaaa

SEQ ID NO: 1648932 - RNA, 11 nt, Human
auuuaaaaauc

SEQ ID NO: 1648933 - RNA, 15 nt, Human
ugcuucuguuuuaua

SEQ ID NO: 1648934 - RNA, 16 nt, Human
gucucuacauaaaaua

SEQ ID NO: 1648935 - RNA, 18 nt, Human
cccaagccuggcaaggga

SEQ ID NO: 1648936 - RNA, 21 nt, Human
aucuuuuuuuuaauaaaccau

SEQ ID NO: 1648937 - RNA, 20 nt, Human
ucuaugagggcuaauaucuu

SEQ ID NO: 1648938 - RNA, 18 nt, Human
uuuugugaagcaaaauuu

SEQ ID NO: 1648939 - RNA, 13 nt, Human
uguccacaaguaa

SEQ ID NO: 1648940 - RNA, 21 nt, Human
cuauuuaauuauuucacuuua

SEQ ID NO: 1648941 - RNA, 16 nt, Human
gauuuaaggccaggca

SEQ ID NO: 1648942 - RNA, 16 nt, Human
caugggacagggagga

SEQ ID NO: 1648943 - RNA, 14 nt, Human
cucccuuggggccu

SEQ ID NO: 1648944 - RNA, 17 nt, Human
ccccuggccaaggaaga

SEQ ID NO: 1648945 - RNA, 15 nt, Human
uagggugauauuaac

SEQ ID NO: 1648946 - RNA, 15 nt, Human
cagcuggccuuguga

SEQ ID NO: 1648947 - RNA, 22 nt, Human
acaugagguacugagagugaac

SEQ ID NO: 1648948 - RNA, 16 nt, Human
aagcuucacuguaaaa

SEQ ID NO: 1648949 - RNA, 20 nt, Human
uguaaaggaauuuaaaaauc

SEQ ID NO: 1648950 - RNA, 17 nt, Human
gaaacaaaaaucaaacu

SEQ ID NO: 1648951 - RNA, 19 nt, Human
uucuuuaucuuuuuaguau

SEQ ID NO: 1648952 - RNA, 13 nt, Human
ugauuauauguca

SEQ ID NO: 1648953 - RNA, 19 nt, Human
cauggaauuggagcucgug

SEQ ID NO: 1648954 - RNA, 16 nt, Human
acaaaaggaaugugua

SEQ ID NO: 1648955 - RNA, 16 nt, Human
uauaaauuuaucauuu

SEQ ID NO: 1648956 - RNA, 15 nt, Human
caaaacuuauuggaa

SEQ ID NO: 1648957 - RNA, 22 nt, Human
agugagcagucaggaaagagaa

SEQ ID NO: 1648958 - RNA, 18 nt, Human
aucuauguagaauauauu

SEQ ID NO: 1648959 - RNA, 15 nt, Human
aagaaggaaagauuu

SEQ ID NO: 1648960 - RNA, 20 nt, Human
guguggaaggugaucuggcu

SEQ ID NO: 1648961 - RNA, 15 nt, Human
cuuaagaagacugca

SEQ ID NO: 1648962 - RNA, 18 nt, Human
guuaguauuguccagguc

SEQ ID NO: 1648963 - RNA, 14 nt, Human
gagcucagcccugg

SEQ ID NO: 1648964 - RNA, 18 nt, Human
auuuguauaaaauaauuu

SEQ ID NO: 1648965 - RNA, 18 nt, Human
cccacuggacucaccucc

SEQ ID NO: 1648966 - RNA, 15 nt, Human
cucgugggacaguca

SEQ ID NO: 1648967 - RNA, 20 nt, Human
agcagcccuuagcccuuccc

SEQ ID NO: 1648968 - RNA, 20 nt, Human
augucgucaaagcugaaaug

SEQ ID NO: 1648969 - RNA, 19 nt, Human
uauguagaauauauuuccu

SEQ ID NO: 1648970 - RNA, 20 nt, Human
ccauacuaauuauacccccu

SEQ ID NO: 1648971 - RNA, 12 nt, Human
gauaaaagacag

SEQ ID NO: 1648972 - RNA, 23 nt, Human
uaggauggcuaguaucaaaagaa

SEQ ID NO: 1648973 - RNA, 16 nt, Human
uauccuacuuccccuu

SEQ ID NO: 1648974 - RNA, 14 nt, Human
cuuuacagaaagau

SEQ ID NO: 1648975 - RNA, 13 nt, Human
ucuaccaaaaaaa

SEQ ID NO: 1648976 - RNA, 14 nt, Human
auuuguauaaaaua

SEQ ID NO: 1648977 - RNA, 16 nt, Human
uuaauaauuuuuaauu

SEQ ID NO: 1648978 - RNA, 12 nt, Human
aauuuuaaaaug

SEQ ID NO: 1648979 - RNA, 18 nt, Human
uaaaagacagugaaagaa

SEQ ID NO: 1648980 - RNA, 24 nt, Human
cuggcuaauuagcauggccacauc

SEQ ID NO: 1648981 - RNA, 16 nt, Human
ucaaaagaaagaaaau

SEQ ID NO: 1648982 - RNA, 22 nt, Human
gaaaaucuuauaauuuaaaaua

SEQ ID NO: 1648983 - RNA, 23 nt, Human
gauauuaaccaggggccaugaau

SEQ ID NO: 1648984 - RNA, 16 nt, Human
ggaacaaggaaggaaa

SEQ ID NO: 1648985 - RNA, 16 nt, Human
gucauuauuaggaagu

SEQ ID NO: 1648986 - RNA, 12 nt, Human
ugugaggagcug

SEQ ID NO: 1648987 - RNA, 14 nt, Human
acuggacucaccuc

SEQ ID NO: 1648988 - RNA, 19 nt, Human
aacugaaacaaaauuagaa

SEQ ID NO: 1648989 - RNA, 14 nt, Human
caccaaccuucuga

SEQ ID NO: 1648990 - RNA, 15 nt, Human
auauugacuuuuuau

SEQ ID NO: 1648991 - RNA, 21 nt, Human
aagaaauaggaaauauuuuaa

SEQ ID NO: 1648992 - RNA, 21 nt, Human
ccuccccaaaugcuuuccaug

SEQ ID NO: 1648993 - RNA, 21 nt, Human
acuauuauauuuccaagaaau

SEQ ID NO: 1648994 - RNA, 14 nt, Human
ugagcuugcagaga

SEQ ID NO: 1648995 - RNA, 17 nt, Human
gacgagaaaacaauaac

SEQ ID NO: 1648996 - RNA, 23 nt, Human
ggccuccauccugaggcuccacu

SEQ ID NO: 1648997 - RNA, 18 nt, Human
gaugccccgucccccucu

SEQ ID NO: 1648998 - RNA, 23 nt, Human
uccaacuaucucauuuccaagca

SEQ ID NO: 1648999 - RNA, 14 nt, Human
gggcaagagagcga

SEQ ID NO: 1649000 - RNA, 20 nt, Human
aaagaaaggagauacagugg

SEQ ID NO: 1649001 - RNA, 20 nt, Human
uagaugcaguucugaagaag

SEQ ID NO: 1649002 - RNA, 18 nt, Human
cucuggccuucggccucc

SEQ ID NO: 1649003 - RNA, 14 nt, Human
cacaagaaaugaaa

SEQ ID NO: 1649004 - RNA, 21 nt, Human
aagacaagaaggaaagauuuu

SEQ ID NO: 1649005 - RNA, 22 nt, Human
ccgggagccugaucaccugccc

SEQ ID NO: 1649006 - RNA, 22 nt, Human
ccccuuccuaauuccacagcug

SEQ ID NO: 1649007 - RNA, 22 nt, Human
uacaugagguacugagagugaa

SEQ ID NO: 1649008 - RNA, 14 nt, Human
cccugaggugagca

SEQ ID NO: 1649009 - RNA, 16 nt, Human
cauuuaguuauaaaaa

SEQ ID NO: 1649010 - RNA, 20 nt, Human
auuuccuuauucagaauuuc

SEQ ID NO: 1649011 - RNA, 22 nt, Human
gaaaacaauaacgauaaaagac

SEQ ID NO: 1649012 - RNA, 18 nt, Human
cccucuggcuccagcugg

SEQ ID NO: 1649013 - RNA, 20 nt, Human
uuuaaauaaaguguuugaaa

SEQ ID NO: 1649014 - RNA, 17 nt, Human
uccugccccugagccca

SEQ ID NO: 1649015 - RNA, 22 nt, Human
auuuucuucucacauuuauauu

SEQ ID NO: 1649016 - RNA, 12 nt, Human
auuauauuucca

SEQ ID NO: 1649017 - RNA, 23 nt, Human
ucggccuccauccugaggcucca

SEQ ID NO: 1649018 - RNA, 19 nt, Human
agagaacagggcugaagcu

SEQ ID NO: 1649019 - RNA, 18 nt, Human
cagcuuauugucuaguga

SEQ ID NO: 1649020 - RNA, 20 nt, Human
agggcagaugaugcuuugag

SEQ ID NO: 1649021 - RNA, 15 nt, Human
agacagcucugcaua

SEQ ID NO: 1649022 - RNA, 12 nt, Human
agauuucaaaaa

SEQ ID NO: 1649023 - RNA, 18 nt, Human
acaaauccaaugaaauga

SEQ ID NO: 1649024 - RNA, 22 nt, Human
ugaguuuuucuuuucauuuacc

SEQ ID NO: 1649025 - RNA, 18 nt, Human
aguucuccacuagcuaug

SEQ ID NO: 1649026 - RNA, 19 nt, Human
caaguaaaaggaaaugcuc

SEQ ID NO: 1649027 - RNA, 12 nt, Human
ccagcuuugagg

SEQ ID NO: 1649028 - RNA, 16 nt, Human
gaaaaaauaacaauga

SEQ ID NO: 1649029 - RNA, 22 nt, Human
acccugaggugagcaucaucuu

SEQ ID NO: 1649030 - RNA, 17 nt, Human
acauagugagacacugu

SEQ ID NO: 1649031 - RNA, 21 nt, Human
aaacaauaacgauaaaagaca

SEQ ID NO: 1649032 - RNA, 14 nt, Human
augggccauaugaa

SEQ ID NO: 1649033 - RNA, 14 nt, Human
caaaugcauuucua

SEQ ID NO: 1649034 - RNA, 14 nt, Human
caucucaggugugu

SEQ ID NO: 1649035 - RNA, 20 nt, Human
uaugcuauuuauuaaguauu

SEQ ID NO: 1649036 - RNA, 13 nt, Human
cacaacuauauug

SEQ ID NO: 1649037 - RNA, 20 nt, Human
aggcugagaugggagaauca

SEQ ID NO: 1649038 - RNA, 17 nt, Human
cuuccucugagccuugg

SEQ ID NO: 1649039 - RNA, 18 nt, Human
ggggcuuuaacuccugcu

SEQ ID NO: 1649040 - RNA, 19 nt, Human
auccuacaagacacaguga

SEQ ID NO: 1649041 - RNA, 13 nt, Human
cacuuugaagagu

SEQ ID NO: 1649042 - RNA, 19 nt, Human
uauacugugugcuaaaaca

SEQ ID NO: 1649043 - RNA, 15 nt, Human
uucacauuuaaauaa

SEQ ID NO: 1649044 - RNA, 20 nt, Human
ugagucccaggcugagccuc

SEQ ID NO: 1649045 - RNA, 20 nt, Human
gcuugcagagaugaggccgc

SEQ ID NO: 1649046 - RNA, 13 nt, Human
acggggugaaacc

SEQ ID NO: 1649047 - RNA, 14 nt, Human
acuauuauauuucc

SEQ ID NO: 1649048 - RNA, 20 nt, Human
uuugccgcuuaagcuuucag

SEQ ID NO: 1649049 - RNA, 12 nt, Human
aaaauaacaaua

SEQ ID NO: 1649050 - RNA, 12 nt, Human
gcugaggcagga

SEQ ID NO: 1649051 - RNA, 16 nt, Human
aaagacaaggaaaaaa

SEQ ID NO: 1649052 - RNA, 21 nt, Human
aaagcugaaauggacuuuugu

SEQ ID NO: 1649053 - RNA, 12 nt, Human
aaaagaaagaaa

SEQ ID NO: 1649054 - RNA, 14 nt, Human
cugcuaguuuauau

SEQ ID NO: 1649055 - RNA, 13 nt, Human
ucuagagcaaagc

SEQ ID NO: 1649056 - RNA, 12 nt, Human
cucccugccccc

SEQ ID NO: 1649057 - RNA, 13 nt, Human
ccugagcuugcag

SEQ ID NO: 1649058 - RNA, 16 nt, Human
ucuugagguaaaagca

SEQ ID NO: 1649059 - RNA, 16 nt, Human
aaggagaggcaaagaa

SEQ ID NO: 1649060 - RNA, 16 nt, Human
ucuuggggaauauguu

SEQ ID NO: 1649061 - RNA, 19 nt, Human
uaggaggacaaaaggaaug

SEQ ID NO: 1649062 - RNA, 16 nt, Human
uguugagguaccucca

SEQ ID NO: 1649063 - RNA, 20 nt, Human
ucagaaggaaagaauaacca

SEQ ID NO: 1649064 - RNA, 13 nt, Human
aacaaaauuagaa

SEQ ID NO: 1649065 - RNA, 15 nt, Human
uaaaaggaaaugcuc

SEQ ID NO: 1649066 - RNA, 14 nt, Human
uggcuugaguuuaa

SEQ ID NO: 1649067 - RNA, 23 nt, Human
cacagaaacuccuguucaugccc

SEQ ID NO: 1649068 - RNA, 16 nt, Human
aucaauuuaaaaaaaa

SEQ ID NO: 1649069 - RNA, 20 nt, Human
gaagggacacauaucaaacu

SEQ ID NO: 1649070 - RNA, 13 nt, Human
gguccacaacaca

SEQ ID NO: 1649071 - RNA, 12 nt, Human
cuguuaucuuca

SEQ ID NO: 1649072 - RNA, 13 nt, Human
ugaaaaucuuaua

SEQ ID NO: 1649073 - RNA, 15 nt, Human
ccagcacagccucuu

SEQ ID NO: 1649074 - RNA, 22 nt, Human
gcuauuugcuguuauuuuaucu

SEQ ID NO: 1649075 - RNA, 21 nt, Human
uuccuagucuguuuucccucc

SEQ ID NO: 1649076 - RNA, 20 nt, Human
accuacacgagauacagaau

SEQ ID NO: 1649077 - RNA, 21 nt, Human
aggacagcccuucuuuccaca

SEQ ID NO: 1649078 - RNA, 12 nt, Human
auaaaaacaaag

SEQ ID NO: 1649079 - RNA, 17 nt, Human
aagaaacaaaaaucaaa

SEQ ID NO: 1649080 - RNA, 13 nt, Human
aucaggcuggcca

SEQ ID NO: 1649081 - RNA, 19 nt, Human
ccccucuggcuccagcugg

SEQ ID NO: 1649082 - RNA, 18 nt, Human
caaguaaaaggaaaugcu

SEQ ID NO: 1649083 - RNA, 14 nt, Human
gcugauuaaaccaa

SEQ ID NO: 1649084 - RNA, 14 nt, Human
agaugcuagaacuc

SEQ ID NO: 1649085 - RNA, 20 nt, Human
aacaaugcuguauuuuaaaa

SEQ ID NO: 1649086 - RNA, 15 nt, Human
acaaaguugauuaag

SEQ ID NO: 1649087 - RNA, 15 nt, Human
aaggaauuuaaaaau

SEQ ID NO: 1649088 - RNA, 15 nt, Human
ggccaccugcugagc

SEQ ID NO: 1649089 - RNA, 15 nt, Human
uugacacuuaaaaau

SEQ ID NO: 1649090 - RNA, 18 nt, Human
gcuauaggauguggggaa

SEQ ID NO: 1649091 - RNA, 14 nt, Human
uauguauauuuuau

SEQ ID NO: 1649092 - RNA, 18 nt, Human
auagugagacacugucuc

SEQ ID NO: 1649093 - RNA, 21 nt, Human
accaccugccuauauuuuuug

SEQ ID NO: 1649094 - RNA, 20 nt, Human
auguuccuuuuaaagaaaca

SEQ ID NO: 1649095 - RNA, 18 nt, Human
uuccaagaaauauuccuu

SEQ ID NO: 1649096 - RNA, 13 nt, Human
uacagagacagaa

SEQ ID NO: 1649097 - RNA, 14 nt, Human
guagcuaaauauau

SEQ ID NO: 1649098 - RNA, 14 nt, Human
cgucccccucuggc

SEQ ID NO: 1649099 - RNA, 17 nt, Human
uaauuuuuauauuugaa

SEQ ID NO: 1649100 - RNA, 12 nt, Human
ccugccagcugg

SEQ ID NO: 1649101 - RNA, 15 nt, Human
ucuuauaauuuaaaa

SEQ ID NO: 1649102 - RNA, 18 nt, Human
acauuuauauuuuuguga

SEQ ID NO: 1649103 - RNA, 21 nt, Human
ucuucaacucccugcccccca

SEQ ID NO: 1649104 - RNA, 23 nt, Human
uaagaauucuguugauggaaaua

SEQ ID NO: 1649105 - RNA, 20 nt, Human
uaguuauaaaaauauauagc

SEQ ID NO: 1649106 - RNA, 17 nt, Human
agcucugcccauccugc

SEQ ID NO: 1649107 - RNA, 17 nt, Human
gcagcauuguuggcugu

SEQ ID NO: 1649108 - RNA, 13 nt, Human
caaaaaaaaaccc

SEQ ID NO: 1649109 - RNA, 18 nt, Human
cagggaggacgcucucug

SEQ ID NO: 1649110 - RNA, 16 nt, Human
cuaguuuauauagaaa

SEQ ID NO: 1649111 - RNA, 12 nt, Human
caugggaaguga

SEQ ID NO: 1649112 - RNA, 16 nt, Human
cacgggggccaaggau

SEQ ID NO: 1649113 - RNA, 13 nt, Human
caaaaggaaugug

SEQ ID NO: 1649114 - RNA, 14 nt, Human
gaacgagacaagca

SEQ ID NO: 1649115 - RNA, 18 nt, Human
cagaaagcagaacaguga

SEQ ID NO: 1649116 - RNA, 13 nt, Human
ugggcaaaaaacc

SEQ ID NO: 1649117 - RNA, 18 nt, Human
acaugaacuuguaaagga

SEQ ID NO: 1649118 - RNA, 16 nt, Human
cuggguugaagggcag

SEQ ID NO: 1649119 - RNA, 15 nt, Human
uccacaaguaaaagg

SEQ ID NO: 1649120 - RNA, 18 nt, Human
ccuuugcaccuccaugga

SEQ ID NO: 1649121 - RNA, 16 nt, Human
augagcacgcauggaa

SEQ ID NO: 1649122 - RNA, 17 nt, Human
ccaguaguuagcuuucu

SEQ ID NO: 1649123 - RNA, 21 nt, Human
cuugaggcacagaaacuccug

SEQ ID NO: 1649124 - RNA, 16 nt, Human
gcaggcagauguuccu

SEQ ID NO: 1649125 - RNA, 21 nt, Human
uagggugauauuaaccagggg

SEQ ID NO: 1649126 - RNA, 18 nt, Human
uuaucauuuaguuauaaa

SEQ ID NO: 1649127 - RNA, 17 nt, Human
aaggugaucuggcucug

SEQ ID NO: 1649128 - RNA, 16 nt, Human
auuauacccccugcaa

SEQ ID NO: 1649129 - RNA, 22 nt, Human
cccuauccuacuuccccuuccu

SEQ ID NO: 1649130 - RNA, 12 nt, Human
uuauucacugua

SEQ ID NO: 1649131 - RNA, 19 nt, Human
guauucuuuuaguuuuuaa

SEQ ID NO: 1649132 - RNA, 22 nt, Human
cccagcccuccuuaucaaagga

SEQ ID NO: 1649133 - RNA, 19 nt, Human
aaauuaaaaccucuuugug

SEQ ID NO: 1649134 - RNA, 11 nt, Human
auggauaaaga

SEQ ID NO: 1649135 - RNA, 16 nt, Human
aaaguguuugaaagcu

SEQ ID NO: 1649136 - RNA, 15 nt, Human
cuccucaacucugag

SEQ ID NO: 1649137 - RNA, 13 nt, Human
agaaaugaaagca

SEQ ID NO: 1649138 - RNA, 22 nt, Human
acauccuacaagacacagugac

SEQ ID NO: 1649139 - RNA, 11 nt, Human
acugggacagg

SEQ ID NO: 1649140 - RNA, 14 nt, Human
agaaauaggaaaua

SEQ ID NO: 1649141 - RNA, 23 nt, Human
agcccuccuuaucaaaggacacc

SEQ ID NO: 1649142 - RNA, 13 nt, Human
uaugaaauauuau

SEQ ID NO: 1649143 - RNA, 21 nt, Human
uccauccugaggcuccacuug

SEQ ID NO: 1649144 - RNA, 18 nt, Human
accaccugccuauauuuu

SEQ ID NO: 1649145 - RNA, 20 nt, Human
aagcuucacuguaaaauaau

SEQ ID NO: 1649146 - RNA, 16 nt, Human
gccaugugcuaguaau

SEQ ID NO: 1649147 - RNA, 19 nt, Human
auguuuacagauccccaag

SEQ ID NO: 1649148 - RNA, 14 nt, Human
acuaauuuuaaaau

SEQ ID NO: 1649149 - RNA, 14 nt, Human
uaacuaauuuuaac

SEQ ID NO: 1649150 - RNA, 14 nt, Human
aagcaacccaaaug

SEQ ID NO: 1649151 - RNA, 15 nt, Human
aaugauuaugaauua

SEQ ID NO: 1649152 - RNA, 19 nt, Human
uggggcuuuaacuccugcu

SEQ ID NO: 1649153 - RNA, 18 nt, Human
cacuugccauaaaacuua

SEQ ID NO: 1649154 - RNA, 22 nt, Human
cccaugauguuuagaaacacaa

SEQ ID NO: 1649155 - RNA, 21 nt, Human
gaacagucucuugaggcacag

SEQ ID NO: 1649156 - RNA, 14 nt, Human
uaauccuaaacaua

SEQ ID NO: 1649157 - RNA, 18 nt, Human
augauguuucauaagaau

SEQ ID NO: 1649158 - RNA, 19 nt, Human
cuagaguuuagcuggaaaa

SEQ ID NO: 1649159 - RNA, 20 nt, Human
cuuccaggcuggcgugcagc

SEQ ID NO: 1649160 - RNA, 12 nt, Human
cuccauuuuuag

SEQ ID NO: 1649161 - RNA, 17 nt, Human
auuauuuuuuaaaaaaa

SEQ ID NO: 1649162 - RNA, 20 nt, Human
aaauaauuuuuauauuugaa

SEQ ID NO: 1649163 - RNA, 19 nt, Human
auuucuucaacucccugcc

SEQ ID NO: 1649164 - RNA, 23 nt, Human
acucuauguucuaagaagugaaa

SEQ ID NO: 1649165 - RNA, 13 nt, Human
gggcugaagcugu

SEQ ID NO: 1649166 - RNA, 15 nt, Human
aggcagauguuccua

SEQ ID NO: 1649167 - RNA, 12 nt, Human
cugaggagcugu

SEQ ID NO: 1649168 - RNA, 16 nt, Human
uucccaacuccagaaa

SEQ ID NO: 1649169 - RNA, 15 nt, Human
aacaaggaaggaaag

SEQ ID NO: 1649170 - RNA, 19 nt, Human
ugaucaccugcccugcuga

SEQ ID NO: 1649171 - RNA, 21 nt, Human
acacugucucuaccaaaaaaa

SEQ ID NO: 1649172 - RNA, 18 nt, Human
gaaacaaaaggauaauga

SEQ ID NO: 1649173 - RNA, 23 nt, Human
uccagguagaggguguguaagua

SEQ ID NO: 1649174 - RNA, 17 nt, Human
ccacuggacucaccucc

SEQ ID NO: 1649175 - RNA, 20 nt, Human
auaaauaaaaacaaaguuga

SEQ ID NO: 1649176 - RNA, 21 nt, Human
ugaacaaauuuacagagacag

SEQ ID NO: 1649177 - RNA, 23 nt, Human
gcuguggauuuaauguggaaaug

SEQ ID NO: 1649178 - RNA, 14 nt, Human
ccagcuggccggga

SEQ ID NO: 1649179 - RNA, 13 nt, Human
acaagaaaugaaa

SEQ ID NO: 1649180 - RNA, 22 nt, Human
ucccuagaaagccaugugcagc

SEQ ID NO: 1649181 - RNA, 11 nt, Human
aaauaaauaaa

SEQ ID NO: 1649182 - RNA, 12 nt, Human
cuggcuccagcu

SEQ ID NO: 1649183 - RNA, 16 nt, Human
uauuuuaauguuucuu

SEQ ID NO: 1649184 - RNA, 16 nt, Human
uccugcaauuccacuu

SEQ ID NO: 1649185 - RNA, 20 nt, Human
aauuuugugaagcaaaauuu

SEQ ID NO: 1649186 - RNA, 16 nt, Human
uuauauuuccaagaaa

SEQ ID NO: 1649187 - RNA, 13 nt, Human
uuaugcuaaguga

SEQ ID NO: 1649188 - RNA, 11 nt, Human
uucacagggga

SEQ ID NO: 1649189 - RNA, 15 nt, Human
augggaacaaggaag

SEQ ID NO: 1649190 - RNA, 14 nt, Human
augaugcuuugaga

SEQ ID NO: 1649191 - RNA, 17 nt, Human
ucgggauuaguacacac

SEQ ID NO: 1649192 - RNA, 14 nt, Human
auccuugaagauuu

SEQ ID NO: 1649193 - RNA, 16 nt, Human
uccuguaauggaagca

SEQ ID NO: 1649194 - RNA, 22 nt, Human
uccaugaguugcaguuuuuucc

SEQ ID NO: 1649195 - RNA, 17 nt, Human
aacugccaucauuuacu

SEQ ID NO: 1649196 - RNA, 19 nt, Human
cucugcauacucauuagga

SEQ ID NO: 1649197 - RNA, 17 nt, Human
uaucuucagaaaaccua

SEQ ID NO: 1649198 - RNA, 23 nt, Human
aggugaucuggcucuggacaggc

SEQ ID NO: 1649199 - RNA, 17 nt, Human
uaugcuaagugaaauaa

SEQ ID NO: 1649200 - RNA, 18 nt, Human
uauuuucaguuauuauau

SEQ ID NO: 1649201 - RNA, 19 nt, Human
caagagagcgagacccugu

SEQ ID NO: 1649202 - RNA, 14 nt, Human
cucagucucccucc

SEQ ID NO: 1649203 - RNA, 16 nt, Human
cagucucccucccuug

SEQ ID NO: 1649204 - RNA, 21 nt, Human
ucauucacucaacaaacauaa

SEQ ID NO: 1649205 - RNA, 17 nt, Human
aguugauaaguacauga

SEQ ID NO: 1649206 - RNA, 16 nt, Human
uaggauguugaaaaag

SEQ ID NO: 1649207 - RNA, 17 nt, Human
cuaucucauuuccaagc

SEQ ID NO: 1649208 - RNA, 16 nt, Human
ugaugggcaaaaaacc

SEQ ID NO: 1649209 - RNA, 17 nt, Human
ccugggcaacaugguga

SEQ ID NO: 1649210 - RNA, 20 nt, Human
acagaacuaaaaauuaaaac

SEQ ID NO: 1649211 - RNA, 15 nt, Human
uguauuuuaaaagaa

SEQ ID NO: 1649212 - RNA, 14 nt, Human
cucccucccuuggg

SEQ ID NO: 1649213 - RNA, 20 nt, Human
ggugggcagaucacuugagc

SEQ ID NO: 1649214 - RNA, 14 nt, Human
aaaaaaggaaggaa

SEQ ID NO: 1649215 - RNA, 19 nt, Human
gccccccagcccuccuuau

SEQ ID NO: 1649216 - RNA, 17 nt, Human
gauggaguuucucuaga

SEQ ID NO: 1649217 - RNA, 17 nt, Human
uuauaucaauuuaaaaa

SEQ ID NO: 1649218 - RNA, 15 nt, Human
uggauuccucacuuu

SEQ ID NO: 1649219 - RNA, 14 nt, Human
cagagaaguuuucu

SEQ ID NO: 1649220 - RNA, 21 nt, Human
gcugagucccaggcugagccu

SEQ ID NO: 1649221 - RNA, 15 nt, Human
gacagggaggacgcu

SEQ ID NO: 1649222 - RNA, 22 nt, Human
gugccucaccccuugccauaau

SEQ ID NO: 1649223 - RNA, 19 nt, Human
agaaacaaaaaucaaacuu

SEQ ID NO: 1649224 - RNA, 21 nt, Human
ggagacauugaggcaggcacu

SEQ ID NO: 1649225 - RNA, 18 nt, Human
gauuucaaaaaaaaaccc

SEQ ID NO: 1649226 - RNA, 13 nt, Human
uuauaaaaauaua

SEQ ID NO: 1649227 - RNA, 14 nt, Human
ugggcagaucacuu

SEQ ID NO: 1649228 - RNA, 12 nt, Human
aauuuaaauaua

SEQ ID NO: 1649229 - RNA, 22 nt, Human
uuugcuguuauuuuaucugcua

SEQ ID NO: 1649230 - RNA, 23 nt, Human
aauguauucuuuuaguuuuuaaa

SEQ ID NO: 1649231 - RNA, 22 nt, Human
aaugauguuucauaagaauucu

SEQ ID NO: 1649232 - RNA, 17 nt, Human
uguaaaggaauuuaaaa

SEQ ID NO: 1649233 - RNA, 19 nt, Human
agccuucucucaaggagag

SEQ ID NO: 1649234 - RNA, 22 nt, Human
cagacacaugugcuggccaccu

SEQ ID NO: 1649235 - RNA, 21 nt, Human
aauuuuuauauuugaaauauu

SEQ ID NO: 1649236 - RNA, 13 nt, Human
acaaggaaaaaau

SEQ ID NO: 1649237 - RNA, 23 nt, Human
caauaacgauaaaagacagugaa

SEQ ID NO: 1649238 - RNA, 21 nt, Human
ucuuaggguuaugauuaagua

SEQ ID NO: 1649239 - RNA, 22 nt, Human
gucucuacuaaaaauacaaaaa

SEQ ID NO: 1649240 - RNA, 15 nt, Human
uaggaaauauuuauu

SEQ ID NO: 1649241 - RNA, 22 nt, Human
caauaaaagacaaggaaaaaau

SEQ ID NO: 1649242 - RNA, 16 nt, Human
ggccuccauccugagg

SEQ ID NO: 1649243 - RNA, 16 nt, Human
aguaaaggcaaacuua

SEQ ID NO: 1649244 - RNA, 22 nt, Human
ucugcuaugcuauugaaguuuu

SEQ ID NO: 1649245 - RNA, 20 nt, Human
aaugauguuucauaagaauu

SEQ ID NO: 1649246 - RNA, 13 nt, Human
cugaugggcaaaa

SEQ ID NO: 1649247 - RNA, 19 nt, Human
ggaauuucuucaacucccu

SEQ ID NO: 1649248 - RNA, 12 nt, Human
cuuuaucuuuuu

SEQ ID NO: 1649249 - RNA, 13 nt, Human
ccucccccaucuc

SEQ ID NO: 1649250 - RNA, 22 nt, Human
accaaucaugaauuaguuuuau

SEQ ID NO: 1649251 - RNA, 14 nt, Human
auugucuagugaaa

SEQ ID NO: 1649252 - RNA, 16 nt, Human
uuuauauuugaaauau

SEQ ID NO: 1649253 - RNA, 16 nt, Human
aaauauuauguuaaaa

SEQ ID NO: 1649254 - RNA, 16 nt, Human
gacauagaauuaacac

SEQ ID NO: 1649255 - RNA, 18 nt, Human
uaagcuucacuguaaaau

SEQ ID NO: 1649256 - RNA, 20 nt, Human
cucuaccaaaaaaaggaagg

SEQ ID NO: 1649257 - RNA, 17 nt, Human
acaaaugcauuucuaaa

SEQ ID NO: 1649258 - RNA, 20 nt, Human
auuuugugauugauuauaug

SEQ ID NO: 1649259 - RNA, 19 nt, Human
uuuccaagaaauauuccuu

SEQ ID NO: 1649260 - RNA, 17 nt, Human
ccaccugcugagcccca

SEQ ID NO: 1649261 - RNA, 22 nt, Human
aucuauguagaauauauuuccu

SEQ ID NO: 1649262 - RNA, 17 nt, Human
uuauuacuguaagaaaa

SEQ ID NO: 1649263 - RNA, 13 nt, Human
aggcauagcccug

SEQ ID NO: 1649264 - RNA, 23 nt, Human
gucucccucccuuggggccuaug

SEQ ID NO: 1649265 - RNA, 15 nt, Human
uuauagcuacuaauu

SEQ ID NO: 1649266 - RNA, 15 nt, Human
aauaacgauaaaaga

SEQ ID NO: 1649267 - RNA, 19 nt, Human
ccccugcaaagcccagcuu

SEQ ID NO: 1649268 - RNA, 19 nt, Human
agucccuccccaaaugcuu

SEQ ID NO: 1649269 - RNA, 12 nt, Human
agacaucuggaa

SEQ ID NO: 1649270 - RNA, 13 nt, Human
caucugagccccg

SEQ ID NO: 1649271 - RNA, 15 nt, Human
gccccauucaacauc

SEQ ID NO: 1649272 - RNA, 23 nt, Human
uuuuauagcuacuaauuuuaaaa

SEQ ID NO: 1649273 - RNA, 21 nt, Human
ugaaacgaggauugggaaaaa

SEQ ID NO: 1649274 - RNA, 16 nt, Human
agauaaggcuguucuu

SEQ ID NO: 1649275 - RNA, 13 nt, Human
uuuuaaaaaagaa

SEQ ID NO: 1649276 - RNA, 16 nt, Human
gaagccagaucuaugc

SEQ ID NO: 1649277 - RNA, 16 nt, Human
auaaauaaauaaaaac

SEQ ID NO: 1649278 - RNA, 13 nt, Human
ccuccuuuuaaag

SEQ ID NO: 1649279 - RNA, 19 nt, Human
cccacuggacucaccuccc

SEQ ID NO: 1649280 - RNA, 16 nt, Human
augaauacuuuauaaa

SEQ ID NO: 1649281 - RNA, 20 nt, Human
ucuucuggguuccuuccucu

SEQ ID NO: 1649282 - RNA, 17 nt, Human
aaauauaaauaaaaaua

SEQ ID NO: 1649283 - RNA, 14 nt, Human
aggacaaaaggaau

SEQ ID NO: 1649284 - RNA, 19 nt, Human
cuaccaaaaaaaggaagga

SEQ ID NO: 1649285 - RNA, 19 nt, Human
cagagaugaggccgccaug

SEQ ID NO: 1649286 - RNA, 22 nt, Human
cuccuccagggagucucagcuu

SEQ ID NO: 1649287 - RNA, 23 nt, Human
gcuuuggucuaucuuugagcgcc

SEQ ID NO: 1649288 - RNA, 16 nt, Human
cuggccuucggccucc

SEQ ID NO: 1649289 - RNA, 23 nt, Human
cccgcuccugguuggucacagaa

SEQ ID NO: 1649290 - RNA, 16 nt, Human
gacauugaggcaggca

SEQ ID NO: 1649291 - RNA, 18 nt, Human
acucuuaagaagacugca

SEQ ID NO: 1649292 - RNA, 12 nt, Human
gguuuauauaag

SEQ ID NO: 1649293 - RNA, 19 nt, Human
gugaacuugguuuuaauua

SEQ ID NO: 1649294 - RNA, 18 nt, Human
auaccccuggccaaggaa

SEQ ID NO: 1649295 - RNA, 22 nt, Human
ggcacaacacaucaggaaagag

SEQ ID NO: 1649296 - RNA, 22 nt, Human
aacaaaguugauuaagaaagga

SEQ ID NO: 1649297 - RNA, 15 nt, Human
ggaacaaggaaggaa

SEQ ID NO: 1649298 - RNA, 14 nt, Human
aaagagaacuucca

SEQ ID NO: 1649299 - RNA, 17 nt, Human
agggagucucagcuuca

SEQ ID NO: 1649300 - RNA, 17 nt, Human
ggccaugggacagggag

SEQ ID NO: 1649301 - RNA, 16 nt, Human
cugcacuccagccuga

SEQ ID NO: 1649302 - RNA, 17 nt, Human
ccuacuuccccuuccua

SEQ ID NO: 1649303 - RNA, 13 nt, Human
auugaggcaggca

SEQ ID NO: 1649304 - RNA, 14 nt, Human
ggcuccagcuggcc

SEQ ID NO: 1649305 - RNA, 23 nt, Human
aacuuguaaaggaauuuaaaaau

SEQ ID NO: 1649306 - RNA, 16 nt, Human
uagaaagccaugugca

SEQ ID NO: 1649307 - RNA, 15 nt, Human
cuaagugcagccccg

SEQ ID NO: 1649308 - RNA, 20 nt, Human
cugauauuggacaguaaaau

SEQ ID NO: 1649309 - RNA, 19 nt, Human
gauggaguuucucuagaag

SEQ ID NO: 1649310 - RNA, 19 nt, Human
uggaacaguuaccucugcc

SEQ ID NO: 1649311 - RNA, 17 nt, Human
caauaaauaaauaaaua

SEQ ID NO: 1649312 - RNA, 17 nt, Human
cuacaugucuagagaac

SEQ ID NO: 1649313 - RNA, 16 nt, Human
auaaauaaaaacaaag

SEQ ID NO: 1649314 - RNA, 18 nt, Human
gaaaauaucacuugucaa

SEQ ID NO: 1649315 - RNA, 16 nt, Human
aaaugggaaacaaaag

SEQ ID NO: 1649316 - RNA, 22 nt, Human
cacuaguauuucuaugaaauau

SEQ ID NO: 1649317 - RNA, 14 nt, Human
aaauuuaucauuua

SEQ ID NO: 1649318 - RNA, 15 nt, Human
aauuuaucauuuagu

SEQ ID NO: 1649319 - RNA, 18 nt, Human
aaguugauaugccuuuuc

SEQ ID NO: 1649320 - RNA, 18 nt, Human
cuuagaugggcauggugg

SEQ ID NO: 1649321 - RNA, 14 nt, Human
agcucguggaacag

SEQ ID NO: 1649322 - RNA, 19 nt, Human
auuuuagauagaugaagaa

SEQ ID NO: 1649323 - RNA, 14 nt, Human
cugaacccagggaa

SEQ ID NO: 1649324 - RNA, 12 nt, Human
agugcagccccg

SEQ ID NO: 1649325 - RNA, 21 nt, Human
acacaucaggaaagagagcac

SEQ ID NO: 1649326 - RNA, 23 nt, Human
cccuagaaagccaugugcagcca

SEQ ID NO: 1649327 - RNA, 16 nt, Human
gccaaggaagaucccu

SEQ ID NO: 1649328 - RNA, 19 nt, Human
caagaaggaaagauuuugu

SEQ ID NO: 1649329 - RNA, 16 nt, Human
guccgaggugggcaga

SEQ ID NO: 1649330 - RNA, 20 nt, Human
ugagagugaacaaauuuaca

SEQ ID NO: 1649331 - RNA, 20 nt, Human
uuaaugccacuaaauugaca

SEQ ID NO: 1649332 - RNA, 23 nt, Human
caagagagcgagacccugucuca

SEQ ID NO: 1649333 - RNA, 14 nt, Human
cuucucuucacagu

SEQ ID NO: 1649334 - RNA, 12 nt, Human
gcugaugcaguu

SEQ ID NO: 1649335 - RNA, 13 nt, Human
uuuaaaaaagaaa

SEQ ID NO: 1649336 - RNA, 18 nt, Human
uauuuucuauaauuuaaa

SEQ ID NO: 1649337 - RNA, 16 nt, Human
uaaaauccauacauuu

SEQ ID NO: 1649338 - RNA, 18 nt, Human
ugggcacaggguuuaugu

SEQ ID NO: 1649339 - RNA, 17 nt, Human
gggcaguguucccuggg

SEQ ID NO: 1649340 - RNA, 19 nt, Human
cuaagcuucacuguaaaau

SEQ ID NO: 1649341 - RNA, 15 nt, Human
ucuugaggcacagaa

SEQ ID NO: 1649342 - RNA, 18 nt, Human
guuucaaacauauauaac

SEQ ID NO: 1649343 - RNA, 22 nt, Human
agcacagccucuuagaugcagu

SEQ ID NO: 1649344 - RNA, 13 nt, Human
aacacaacuauau

SEQ ID NO: 1649345 - RNA, 18 nt, Human
gaauuuccuuacucuuga

SEQ ID NO: 1649346 - RNA, 18 nt, Human
acuguacuccagccaggg

SEQ ID NO: 1649347 - RNA, 18 nt, Human
aacagauuucaaaaaaaa

SEQ ID NO: 1649348 - RNA, 15 nt, Human
ggcaauagucaaauu

SEQ ID NO: 1649349 - RNA, 16 nt, Human
uuauaauuuaaaauau

SEQ ID NO: 1649350 - RNA, 18 nt, Human
ccuucggccuccauccug

SEQ ID NO: 1649351 - RNA, 22 nt, Human
ggcagcuuuccucaaaacuuca

SEQ ID NO: 1649352 - RNA, 18 nt, Human
uagugaaauauuauuuua

SEQ ID NO: 1649353 - RNA, 17 nt, Human
ugaauauaaauuuauca

SEQ ID NO: 1649354 - RNA, 19 nt, Human
aggucuaccaaaaaucuca

SEQ ID NO: 1649355 - RNA, 17 nt, Human
cccaggcugagccucag

SEQ ID NO: 1649356 - RNA, 21 nt, Human
uaggugacuauuauauuucca

SEQ ID NO: 1649357 - RNA, 19 nt, Human
ucuguuuucccuccuugga

SEQ ID NO: 1649358 - RNA, 13 nt, Human
acuguaaaauaau

SEQ ID NO: 1649359 - RNA, 13 nt, Human
ugugcuggccacc

SEQ ID NO: 1649360 - RNA, 20 nt, Human
aucauuuaguuauaaaaaua

SEQ ID NO: 1649361 - RNA, 17 nt, Human
ggcucuggacaggcacu

SEQ ID NO: 1649362 - RNA, 19 nt, Human
acaauaacgauaaaagaca

SEQ ID NO: 1649363 - RNA, 15 nt, Human
uccauugggcaggca

SEQ ID NO: 1649364 - RNA, 23 nt, Human
ugucaauucuugccaaauauaaa

SEQ ID NO: 1649365 - RNA, 16 nt, Human
ccucaaaacuucagac

SEQ ID NO: 1649366 - RNA, 16 nt, Human
aggaggaucacuugag

SEQ ID NO: 1649367 - RNA, 13 nt, Human
aggccuggugugu

SEQ ID NO: 1649368 - RNA, 14 nt, Human
cagucucccucccu

SEQ ID NO: 1649369 - RNA, 20 nt, Human
uuacaaauccaaugaaauga

SEQ ID NO: 1649370 - RNA, 17 nt, Human
agaaugacugacaaaga

SEQ ID NO: 1649371 - RNA, 17 nt, Human
uuccaagccucaugucc

SEQ ID NO: 1649372 - RNA, 13 nt, Human
cuacagugagcca

SEQ ID NO: 1649373 - RNA, 13 nt, Human
uuuaacuccugcu

SEQ ID NO: 1649374 - RNA, 16 nt, Human
aauauuuuaauguuuc

SEQ ID NO: 1649375 - RNA, 22 nt, Human
aauaugccccauucaacaucua

SEQ ID NO: 1649376 - RNA, 20 nt, Human
agccuaguugaucagcuuau

SEQ ID NO: 1649377 - RNA, 20 nt, Human
aaguucaaaacuuauuggaa

SEQ ID NO: 1649378 - RNA, 21 nt, Human
cuagucuguuuucccuccuug

SEQ ID NO: 1649379 - RNA, 19 nt, Human
cucaccucccccaucucuu

SEQ ID NO: 1649380 - RNA, 20 nt, Human
uaagugaaauaagccagaca

SEQ ID NO: 1649381 - RNA, 17 nt, Human
auaauuuaaauauaugc

SEQ ID NO: 1649382 - RNA, 16 nt, Human
cugcugagccccaagu

SEQ ID NO: 1649383 - RNA, 14 nt, Human
aauauuauguuaaa

SEQ ID NO: 1649384 - RNA, 13 nt, Human
cugaagcuguguc

SEQ ID NO: 1649385 - RNA, 20 nt, Human
uuccacagaagcuccaggua

SEQ ID NO: 1649386 - RNA, 18 nt, Human
uacauuuguauaaaauaa

SEQ ID NO: 1649387 - RNA, 13 nt, Human
aggcuagauguau

SEQ ID NO: 1649388 - RNA, 18 nt, Human
uaauuuuagacauucuuu

SEQ ID NO: 1649389 - RNA, 12 nt, Human
uacuauuuaauu

SEQ ID NO: 1649390 - RNA, 20 nt, Human
uguaagaaaauaucacuugu

SEQ ID NO: 1649391 - RNA, 17 nt, Human
caaagagaaagaggguu

SEQ ID NO: 1649392 - RNA, 15 nt, Human
acucaacaaacauaa

SEQ ID NO: 1649393 - RNA, 20 nt, Human
guaaaauagugaauaaaguc

SEQ ID NO: 1649394 - RNA, 18 nt, Human
uauguuagagaauuuccu

SEQ ID NO: 1649395 - RNA, 22 nt, Human
guacacugccuucucaacucca

SEQ ID NO: 1649396 - RNA, 14 nt, Human
gaaaacaauaacga

SEQ ID NO: 1649397 - RNA, 20 nt, Human
aauaagucaucugaugagaa

SEQ ID NO: 1649398 - RNA, 22 nt, Human
aaucacuggcuguuaaucuuuc

SEQ ID NO: 1649399 - RNA, 14 nt, Human
uacaugucuagaga

SEQ ID NO: 1649400 - RNA, 16 nt, Human
aagaaaggagauacag

SEQ ID NO: 1649401 - RNA, 16 nt, Human
ucuuuuaguuuuuaaa

SEQ ID NO: 1649402 - RNA, 14 nt, Human
gcuggcgugcagca

SEQ ID NO: 1649403 - RNA, 21 nt, Human
aguuagcuuucuuccuggauu

SEQ ID NO: 1649404 - RNA, 18 nt, Human
ugagaugguuucuagaga

SEQ ID NO: 1649405 - RNA, 18 nt, Human
agcugcucaauaaaguac

SEQ ID NO: 1649406 - RNA, 23 nt, Human
gauagauaggucagugcaaauac

SEQ ID NO: 1649407 - RNA, 20 nt, Human
aauaauuuuuauauuugaaa

SEQ ID NO: 1649408 - RNA, 14 nt, Human
uuuuaaaaaagaaa

SEQ ID NO: 1649409 - RNA, 15 nt, Human
guggagacaucugga

SEQ ID NO: 1649410 - RNA, 17 nt, Human
cuucugaggagcuguug

SEQ ID NO: 1649411 - RNA, 15 nt, Human
aauauaaauaaaaau

SEQ ID NO: 1649412 - RNA, 20 nt, Human
gaacguaaucguguccccua

SEQ ID NO: 1649413 - RNA, 14 nt, Human
cagagguugcagug

SEQ ID NO: 1649414 - RNA, 17 nt, Human
augauuauuuuauguuu

SEQ ID NO: 1649415 - RNA, 15 nt, Human
aaauauaaauaaaaa

SEQ ID NO: 1649416 - RNA, 18 nt, Human
uaauuuuaacucuauaau

SEQ ID NO: 1649417 - RNA, 20 nt, Human
cuugccauaauuacuauguc

SEQ ID NO: 1649418 - RNA, 15 nt, Human
aaaugauguuucaua

SEQ ID NO: 1649419 - RNA, 20 nt, Human
acagaaagauuugauguaug

SEQ ID NO: 1649420 - RNA, 19 nt, Human
uacaaaaaaaaaaaaaaau

SEQ ID NO: 1649421 - RNA, 18 nt, Human
agccugaucaccugcccu

SEQ ID NO: 1649422 - RNA, 14 nt, Human
cagagucaagggug

SEQ ID NO: 1649423 - RNA, 22 nt, Human
uaagaauucuguugauggaaau

SEQ ID NO: 1649424 - RNA, 13 nt, Human
cacacugaagaag

SEQ ID NO: 1649425 - RNA, 16 nt, Human
agugaaggauuuaugu

SEQ ID NO: 1649426 - RNA, 15 nt, Human
gcaacccaaauguuc

SEQ ID NO: 1649427 - RNA, 17 nt, Human
uccagcuggccgggagc

SEQ ID NO: 1649428 - RNA, 17 nt, Human
agcccuuccccucugca

SEQ ID NO: 1649429 - RNA, 13 nt, Human
acacacaugaagu

SEQ ID NO: 1649430 - RNA, 16 nt, Human
uggcaauugacuauag

SEQ ID NO: 1649431 - RNA, 15 nt, Human
ucaguuuuugugaaa

SEQ ID NO: 1649432 - RNA, 17 nt, Human
agcuaaauauauauuuu

SEQ ID NO: 1649433 - RNA, 11 nt, Human
agaauauauuu

SEQ ID NO: 1649434 - RNA, 14 nt, Human
ccacaaucuaggau

SEQ ID NO: 1649435 - RNA, 19 nt, Human
gugacuuaaugccacuaaa

SEQ ID NO: 1649436 - RNA, 17 nt, Human
aaccuagggugauauua

SEQ ID NO: 1649437 - RNA, 16 nt, Human
cagaagcaacccaaau

SEQ ID NO: 1649438 - RNA, 22 nt, Human
caaggaugccccgucccccucu

SEQ ID NO: 1649439 - RNA, 23 nt, Human
cccacuggacucaccucccccau

SEQ ID NO: 1649440 - RNA, 14 nt, Human
auuuauuaaguauu

SEQ ID NO: 1649441 - RNA, 19 nt, Human
ugccucaagcuaugugagc

SEQ ID NO: 1649442 - RNA, 14 nt, Human
cacuuauaggaauu

SEQ ID NO: 1649443 - RNA, 15 nt, Human
ucucaauaaauaaau

SEQ ID NO: 1649444 - RNA, 14 nt, Human
gaaaguuuucucca

SEQ ID NO: 1649445 - RNA, 15 nt, Human
uaacgauaaaagaca

SEQ ID NO: 1649446 - RNA, 15 nt, Human
gcuguuaaucuuuca

SEQ ID NO: 1649447 - RNA, 22 nt, Human
cuggugucuucaggggccacac

SEQ ID NO: 1649448 - RNA, 13 nt, Human
cacuguaaaauaa

SEQ ID NO: 1649449 - RNA, 17 nt, Human
auauuugaaauauugac

SEQ ID NO: 1649450 - RNA, 20 nt, Human
ucacaugaacuuguaaagga

SEQ ID NO: 1649451 - RNA, 19 nt, Human
aaucaaacuuuacagaaag

SEQ ID NO: 1649452 - RNA, 21 nt, Human
cugcccugcugagucccaggc

SEQ ID NO: 1649453 - RNA, 17 nt, Human
ugcauuuuggaaggcug

SEQ ID NO: 1649454 - RNA, 17 nt, Human
cucaugagggcuggaug

SEQ ID NO: 1649455 - RNA, 21 nt, Human
auuuacaaaugggaaacaaaa

SEQ ID NO: 1649456 - RNA, 13 nt, Human
caacauagugaga

SEQ ID NO: 1649457 - RNA, 12 nt, Human
aauaauuuuuaa

SEQ ID NO: 1649458 - RNA, 15 nt, Human
gauccugcaauucca

SEQ ID NO: 1649459 - RNA, 17 nt, Human
ccugucgguuuauucac

SEQ ID NO: 1649460 - RNA, 15 nt, Human
aaacauaugaauuau

SEQ ID NO: 1649461 - RNA, 19 nt, Human
uccacaaguaaaaggaaau

SEQ ID NO: 1649462 - RNA, 14 nt, Human
agaaacaaaaauca

SEQ ID NO: 1649463 - RNA, 16 nt, Human
caggcugagccucagu

SEQ ID NO: 1649464 - RNA, 23 nt, Human
caucucuucuggguuccuuccuc

SEQ ID NO: 1649465 - RNA, 20 nt, Human
acggacgaaccuugaaaacu

SEQ ID NO: 1649466 - RNA, 14 nt, Human
cuaagcauuccaac

SEQ ID NO: 1649467 - RNA, 19 nt, Human
cuaguaucaaaagaaagaa

SEQ ID NO: 1649468 - RNA, 17 nt, Human
uaaaagacagugaaaga

SEQ ID NO: 1649469 - RNA, 16 nt, Human
aauuacauuuguauaa

SEQ ID NO: 1649470 - RNA, 23 nt, Human
caacggggugaaacccugucucu

SEQ ID NO: 1649471 - RNA, 15 nt, Human
augugcagccaccag

SEQ ID NO: 1649472 - RNA, 15 nt, Human
cucccugccccccag

SEQ ID NO: 1649473 - RNA, 16 nt, Human
ccacuuauaggaauug

SEQ ID NO: 1649474 - RNA, 21 nt, Human
gcccugcugagucccaggcug

SEQ ID NO: 1649475 - RNA, 21 nt, Human
cucuucuggguuccuuccucu

SEQ ID NO: 1649476 - RNA, 14 nt, Human
aguuuuuuuuuaaa

SEQ ID NO: 1649477 - RNA, 22 nt, Human
aguauguuagugcaaauuguca

SEQ ID NO: 1649478 - RNA, 16 nt, Human
aaggagauacagugga

SEQ ID NO: 1649479 - RNA, 12 nt, Human
acaccuuaucua

SEQ ID NO: 1649480 - RNA, 11 nt, Human
auaauuuaaau

SEQ ID NO: 1649481 - RNA, 18 nt, Human
aacaaaguugauuaagaa

SEQ ID NO: 1649482 - RNA, 21 nt, Human
gacagugaaagaaaauaacaa

SEQ ID NO: 1649483 - RNA, 16 nt, Human
ccuaugcagaggucca

SEQ ID NO: 1649484 - RNA, 14 nt, Human
auuauuuuuuaaaa

SEQ ID NO: 1649485 - RNA, 15 nt, Human
gaauauauuuccuua

SEQ ID NO: 1649486 - RNA, 14 nt, Human
auuguccaggucua

SEQ ID NO: 1649487 - RNA, 16 nt, Human
accuccuaagaaggca

SEQ ID NO: 1649488 - RNA, 14 nt, Human
cuaagucuuauaua

SEQ ID NO: 1649489 - RNA, 19 nt, Human
uagugagcagucaggaaag

SEQ ID NO: 1649490 - RNA, 15 nt, Human
agcaccaucauuccc

SEQ ID NO: 1649491 - RNA, 19 nt, Human
accccugagcuugcagaga

SEQ ID NO: 1649492 - RNA, 15 nt, Human
gaaagaaaauaacga

SEQ ID NO: 1649493 - RNA, 19 nt, Human
acuauuauauuuccaagaa

SEQ ID NO: 1649494 - RNA, 19 nt, Human
uguuaucuucacuuuuaua

SEQ ID NO: 1649495 - RNA, 14 nt, Human
uaugaauuacauuu

SEQ ID NO: 1649496 - RNA, 14 nt, Human
ugcaccuccaugga

SEQ ID NO: 1649497 - RNA, 21 nt, Human
uccuucagccugaaagaggaa

SEQ ID NO: 1649498 - RNA, 19 nt, Human
agaugagagaacagggcug

SEQ ID NO: 1649499 - RNA, 19 nt, Human
accauuuuggcaagcucua

SEQ ID NO: 1649500 - RNA, 14 nt, Human
caaggaaggaaaga

SEQ ID NO: 1649501 - RNA, 14 nt, Human
uccagauccuggaa

SEQ ID NO: 1649502 - RNA, 19 nt, Human
uuauggcacuaguauuucu

SEQ ID NO: 1649503 - RNA, 17 nt, Human
agaaacaaaaaucaaac

SEQ ID NO: 1649504 - RNA, 23 nt, Human
gcuggccuugugaggagcuggaa

SEQ ID NO: 1649505 - RNA, 14 nt, Human
auuucuaugaaaua

SEQ ID NO: 1649506 - RNA, 17 nt, Human
uccauccugaggcucca

SEQ ID NO: 1649507 - RNA, 13 nt, Human
uuccucugagccu

SEQ ID NO: 1649508 - RNA, 15 nt, Human
cugaggcaggaggau

SEQ ID NO: 1649509 - RNA, 20 nt, Human
cuacuuccccuuccuaauuc

SEQ ID NO: 1649510 - RNA, 17 nt, Human
caugagggcuggaugcu

SEQ ID NO: 1649511 - RNA, 20 nt, Human
uauacugugugcuaaaacaa

SEQ ID NO: 1649512 - RNA, 14 nt, Human
uacguuaggaggac

SEQ ID NO: 1649513 - RNA, 13 nt, Human
uuuuauaugcuau

SEQ ID NO: 1649514 - RNA, 15 nt, Human
aauagugaauaaagu

SEQ ID NO: 1649515 - RNA, 20 nt, Human
caggcugagccucagucucc

SEQ ID NO: 1649516 - RNA, 18 nt, Human
uuuaguuauaaaaauaua

SEQ ID NO: 1649517 - RNA, 17 nt, Human
gaucuggcucuggacag

SEQ ID NO: 1649518 - RNA, 14 nt, Human
cagauccuggaaau

SEQ ID NO: 1649519 - RNA, 20 nt, Human
cuggccuucggccuccaucc

SEQ ID NO: 1649520 - RNA, 18 nt, Human
ggaggacgcucucuggcc

SEQ ID NO: 1649521 - RNA, 12 nt, Human
cuguuaaaauau

SEQ ID NO: 1649522 - RNA, 16 nt, Human
ccugcaaagcccagcu

SEQ ID NO: 1649523 - RNA, 21 nt, Human
gauaaaagacagugaaagaaa

SEQ ID NO: 1649524 - RNA, 19 nt, Human
cugccaaaacaucaaccug

SEQ ID NO: 1649525 - RNA, 22 nt, Human
aacucccugccccccagcccuc

SEQ ID NO: 1649526 - RNA, 19 nt, Human
aaagacagugaaagaaaau

SEQ ID NO: 1649527 - RNA, 21 nt, Human
auggcagcuuuccucaaaacu

SEQ ID NO: 1649528 - RNA, 12 nt, Human
acauaaaauaca

SEQ ID NO: 1649529 - RNA, 20 nt, Human
acuccagugagacagcucug

SEQ ID NO: 1649530 - RNA, 21 nt, Human
acaguuaccucugccucagaa

SEQ ID NO: 1649531 - RNA, 23 nt, Human
aucuuccuauaauuuuagacauu

SEQ ID NO: 1649532 - RNA, 20 nt, Human
uauguccuuggugccuggag

SEQ ID NO: 1649533 - RNA, 10 nt, Human
ccugagcccc

SEQ ID NO: 1649534 - RNA, 16 nt, Human
uagaauauauuuccuu

SEQ ID NO: 1649535 - RNA, 18 nt, Human
aggaugggaacaaggaag

SEQ ID NO: 1649536 - RNA, 19 nt, Human
acaaauuuacagagacaga

SEQ ID NO: 1649537 - RNA, 21 nt, Human
agggcagaugaugcuuugaga

SEQ ID NO: 1649538 - RNA, 22 nt, Human
ucaacuccaaacugacucuuaa

SEQ ID NO: 1649539 - RNA, 12 nt, Human
uagcauuucucc

SEQ ID NO: 1649540 - RNA, 11 nt, Human
aauuuaaauau

SEQ ID NO: 1649541 - RNA, 13 nt, Human
aaaugggaaacaa

SEQ ID NO: 1649542 - RNA, 19 nt, Human
agcguugagccaccaagcu

SEQ ID NO: 1649543 - RNA, 18 nt, Human
uacaugucuagagaacac

SEQ ID NO: 1649544 - RNA, 12 nt, Human
uacuaaaugcuc

SEQ ID NO: 1649545 - RNA, 18 nt, Human
cuguuuucccuccuugga

SEQ ID NO: 1649546 - RNA, 14 nt, Human
uaaaauccauacau

SEQ ID NO: 1649547 - RNA, 18 nt, Human
uuacuguaagaaaauauc

SEQ ID NO: 1649548 - RNA, 20 nt, Human
uaacaagccuccuuuuaaag

SEQ ID NO: 1649549 - RNA, 18 nt, Human
auagucaaauugugugaa

SEQ ID NO: 1649550 - RNA, 18 nt, Human
ggaacuggugucuucagg

SEQ ID NO: 1649551 - RNA, 15 nt, Human
uaguauggcaaacug

SEQ ID NO: 1649552 - RNA, 11 nt, Human
caucuagugag

SEQ ID NO: 1649553 - RNA, 18 nt, Human
uuuguuaaaugauuucau

SEQ ID NO: 1649554 - RNA, 16 nt, Human
gccuucucucaaggag

SEQ ID NO: 1649555 - RNA, 15 nt, Human
aauugacccacaaga

SEQ ID NO: 1649556 - RNA, 21 nt, Human
ucaagucuuucacauuuaaau

SEQ ID NO: 1649557 - RNA, 14 nt, Human
aaaaaggaaggaag

SEQ ID NO: 1649558 - RNA, 16 nt, Human
uccucacuuugaagag

SEQ ID NO: 1649559 - RNA, 18 nt, Human
acaaaaggauaaugaaua

SEQ ID NO: 1649560 - RNA, 19 nt, Human
cucuguucugcacacagca

SEQ ID NO: 1649561 - RNA, 14 nt, Human
cuacaagacacagu

SEQ ID NO: 1649562 - RNA, 14 nt, Human
ggcaccucucuggg

SEQ ID NO: 1649563 - RNA, 18 nt, Human
aucuuauaauuuaaaaua

SEQ ID NO: 1649564 - RNA, 22 nt, Human
aaaguugauuuaaggccaggca

SEQ ID NO: 1649565 - RNA, 19 nt, Human
cuuccuaauuccacagcug

SEQ ID NO: 1649566 - RNA, 20 nt, Human
ggguuccuuccucugagccu

SEQ ID NO: 1649567 - RNA, 12 nt, Human
acacugaagaag

SEQ ID NO: 1649568 - RNA, 14 nt, Human
uauaaauaaaaaua

SEQ ID NO: 1649569 - RNA, 14 nt, Human
cacuaaacaaagag

SEQ ID NO: 1649570 - RNA, 22 nt, Human
ggggugguuuucccaucucagg

SEQ ID NO: 1649571 - RNA, 16 nt, Human
gucuucaggggccaca

SEQ ID NO: 1649572 - RNA, 17 nt, Human
cccacuggacucaccuc

SEQ ID NO: 1649573 - RNA, 20 nt, Human
aucuacaugucuagagaaca

SEQ ID NO: 1649574 - RNA, 16 nt, Human
agguacuucaaauccu

SEQ ID NO: 1649575 - RNA, 19 nt, Human
caaaacuuauuggaauguu

SEQ ID NO: 1649576 - RNA, 17 nt, Human
ucuuucacauuuaaaua

SEQ ID NO: 1649577 - RNA, 23 nt, Human
uguucccuggggcuuuaacuccu

SEQ ID NO: 1649578 - RNA, 11 nt, Human
guauggcaaac

SEQ ID NO: 1649579 - RNA, 15 nt, Human
gaaaacaaggaugaa

SEQ ID NO: 1649580 - RNA, 21 nt, Human
uuauguuuaauucugaaagca

SEQ ID NO: 1649581 - RNA, 23 nt, Human
uuuauauuucuguuaaaauauau

SEQ ID NO: 1649582 - RNA, 23 nt, Human
uguagguagaucuggucuuuaga

SEQ ID NO: 1649583 - RNA, 23 nt, Human
caacacccugagguugugugugg

SEQ ID NO: 1649584 - RNA, 21 nt, Human
auaugcucuaaacauguuuau

SEQ ID NO: 1649585 - RNA, 19 nt, Human
ucaccaaggcugauuaaac

SEQ ID NO: 1649586 - RNA, 14 nt, Human
cuggagcucugccc

SEQ ID NO: 1649587 - RNA, 12 nt, Human
gcaacaugguga

SEQ ID NO: 1649588 - RNA, 23 nt, Human
cuggccgggagccugaucaccug

SEQ ID NO: 1649589 - RNA, 16 nt, Human
aucacuugagccccgg

SEQ ID NO: 1649590 - RNA, 17 nt, Human
cuccuaagaaggcaccu

SEQ ID NO: 1649591 - RNA, 13 nt, Human
uguuuucccuccu

SEQ ID NO: 1649592 - RNA, 15 nt, Human
aagccagauuuuccu

SEQ ID NO: 1649593 - RNA, 15 nt, Human
uugcucauggaauug

SEQ ID NO: 1649594 - RNA, 12 nt, Human
uauaggccaggc

SEQ ID NO: 1649595 - RNA, 14 nt, Human
ugcuucuguuuuau

SEQ ID NO: 1649596 - RNA, 13 nt, Human
augcuagaacucc

SEQ ID NO: 1649597 - RNA, 18 nt, Human
uauauuuccuuauucaga

SEQ ID NO: 1649598 - RNA, 24 nt, Human
cauaugaaaaggcuaagcuucacu

SEQ ID NO: 1649599 - RNA, 22 nt, Human
aagcugguggcucugugugcuc

SEQ ID NO: 1649600 - RNA, 22 nt, Human
uucauucacucaacaaacauaa

SEQ ID NO: 1649601 - RNA, 20 nt, Human
augcuucuguuuuauaauuu

SEQ ID NO: 1649602 - RNA, 15 nt, Human
acaucaacagauaaa

SEQ ID NO: 1649603 - RNA, 20 nt, Human
cagcuggccgggagccugau

SEQ ID NO: 1649604 - RNA, 20 nt, Human
aauucuugccaaauauaaau

SEQ ID NO: 1649605 - RNA, 16 nt, Human
aacuugguuuuaauua

SEQ ID NO: 1649606 - RNA, 22 nt, Human
aaacuuuacagaaagauuugau

SEQ ID NO: 1649607 - RNA, 19 nt, Human
caaagugucuugaauugua

SEQ ID NO: 1649608 - RNA, 16 nt, Human
guccauugggcaggca

SEQ ID NO: 1649609 - RNA, 17 nt, Human
gaagcaccaaucaugaa

SEQ ID NO: 1649610 - RNA, 22 nt, Human
ugaauuguaggugacuauuaua

SEQ ID NO: 1649611 - RNA, 12 nt, Human
ucccccucuggc

SEQ ID NO: 1649612 - RNA, 18 nt, Human
agcaaaauuuuuucucua

SEQ ID NO: 1649613 - RNA, 19 nt, Human
uccccuauccuacuucccc

SEQ ID NO: 1649614 - RNA, 21 nt, Human
ccugaucaccugcccugcuga

SEQ ID NO: 1649615 - RNA, 17 nt, Human
ccuuggugccuggagcc

SEQ ID NO: 1649616 - RNA, 22 nt, Human
uaauucugguagcuaaauauau

SEQ ID NO: 1649617 - RNA, 22 nt, Human
cuacauaaaauacaaaaacuua

SEQ ID NO: 1649618 - RNA, 14 nt, Human
cauagaaguaaaaa

SEQ ID NO: 1649619 - RNA, 23 nt, Human
uugauuuuauaugcuauuuauua

SEQ ID NO: 1649620 - RNA, 16 nt, Human
uaaauaaaaauaaucc

SEQ ID NO: 1649621 - RNA, 21 nt, Human
acaaggaaggaaagaugugaa

SEQ ID NO: 1649622 - RNA, 22 nt, Human
ggcauuuaggccaugggacagg

SEQ ID NO: 1649623 - RNA, 18 nt, Human
cuccauuuuuagugaaau

SEQ ID NO: 1649624 - RNA, 20 nt, Human
agccuucucucaaggagagg

SEQ ID NO: 1649625 - RNA, 18 nt, Human
auuagaaauguaauuaug

SEQ ID NO: 1649626 - RNA, 20 nt, Human
cucuguucugcacacagcac

SEQ ID NO: 1649627 - RNA, 15 nt, Human
auuucacuuuagaaa

SEQ ID NO: 1649628 - RNA, 16 nt, Human
cauuuguauaaaauaa

SEQ ID NO: 1649629 - RNA, 20 nt, Human
augguuuagaaagcuugccc

SEQ ID NO: 1649630 - RNA, 19 nt, Human
aguauuucuaugaaauauu

SEQ ID NO: 1649631 - RNA, 16 nt, Human
gccuaagugcagcccc

SEQ ID NO: 1649632 - RNA, 13 nt, Human
auugggcaggcag

SEQ ID NO: 1649633 - RNA, 15 nt, Human
cuggguuccuuccuc

SEQ ID NO: 1649634 - RNA, 15 nt, Human
cuguauguccuuggu

SEQ ID NO: 1649635 - RNA, 13 nt, Human
cacaacacacaga

SEQ ID NO: 1649636 - RNA, 22 nt, Human
agggagucucagcuucacccug

SEQ ID NO: 1649637 - RNA, 14 nt, Human
uauuugcuguuauu

SEQ ID NO: 1649638 - RNA, 23 nt, Human
cauccucgaggcccuagcauuuc

SEQ ID NO: 1649639 - RNA, 11 nt, Human
cuguuuuauaa

SEQ ID NO: 1649640 - RNA, 16 nt, Human
ugaaauuguauuacaa

SEQ ID NO: 1649641 - RNA, 14 nt, Human
auauuugaaauauu

SEQ ID NO: 1649642 - RNA, 14 nt, Human
ggcaauagucaaau

SEQ ID NO: 1649643 - RNA, 19 nt, Human
agauuugagcucagcccug

SEQ ID NO: 1649644 - RNA, 23 nt, Human
agccccaaguggaacgagacaag

SEQ ID NO: 1649645 - RNA, 23 nt, Human
uaaguuuuuuuuuaaaaaagaaa

SEQ ID NO: 1649646 - RNA, 17 nt, Human
agacacacugaagaagc

SEQ ID NO: 1649647 - RNA, 17 nt, Human
cccaucucagguguguu

SEQ ID NO: 1649648 - RNA, 13 nt, Human
cugcacuccagcc

SEQ ID NO: 1649649 - RNA, 14 nt, Human
agcuggaaacacau

SEQ ID NO: 1649650 - RNA, 19 nt, Human
caauucuugccaaauauaa

SEQ ID NO: 1649651 - RNA, 23 nt, Human
cucaggggggugguuuucccauc

SEQ ID NO: 1649652 - RNA, 23 nt, Human
agccaccaguccauugggcaggc

SEQ ID NO: 1649653 - RNA, 23 nt, Human
cuacacgagauacagaauuuuau

SEQ ID NO: 1649654 - RNA, 18 nt, Human
ggaaagaauaaccaacac

SEQ ID NO: 1649655 - RNA, 17 nt, Human
agaugggagaaucacuu

SEQ ID NO: 1649656 - RNA, 21 nt, Human
ugaaauggacuuuuguacaua

SEQ ID NO: 1649657 - RNA, 14 nt, Human
uauuugaaauauug

SEQ ID NO: 1649658 - RNA, 14 nt, Human
gccauuacccccag

SEQ ID NO: 1649659 - RNA, 21 nt, Human
cagacacaugugcuggccacc

SEQ ID NO: 1649660 - RNA, 20 nt, Human
augcaguuguugcccacagc

SEQ ID NO: 1649661 - RNA, 23 nt, Human
agaaugauuaugaauuacauuug

SEQ ID NO: 1649662 - RNA, 17 nt, Human
caggagcaucuccucaa

SEQ ID NO: 1649663 - RNA, 20 nt, Human
auaauccuaaacauaugaau

SEQ ID NO: 1649664 - RNA, 16 nt, Human
gucuguuuucccuccu

SEQ ID NO: 1649665 - RNA, 21 nt, Human
acagugaaagaaaauaacaau

SEQ ID NO: 1649666 - RNA, 13 nt, Human
uaguuuauauaga

SEQ ID NO: 1649667 - RNA, 20 nt, Human
ccagugagacagcucugcau

SEQ ID NO: 1649668 - RNA, 18 nt, Human
uagcccuuccccucugca

SEQ ID NO: 1649669 - RNA, 14 nt, Human
cagcaucagcaucc

SEQ ID NO: 1649670 - RNA, 23 nt, Human
gagaaaugagcacgcauggaaaa

SEQ ID NO: 1649671 - RNA, 12 nt, Human
agcuuggaaugu

SEQ ID NO: 1649672 - RNA, 21 nt, Human
ucacaugaacuuguaaaggaa

SEQ ID NO: 1649673 - RNA, 21 nt, Human
uugaggcacagaaacuccugu

SEQ ID NO: 1649674 - RNA, 20 nt, Human
acuuuauuuucuauaauuua

SEQ ID NO: 1649675 - RNA, 16 nt, Human
ugugcagccaccaguc

SEQ ID NO: 1649676 - RNA, 22 nt, Human
uauccuacuuccccuuccuaau

SEQ ID NO: 1649677 - RNA, 15 nt, Human
ccaaggagccaaaca

SEQ ID NO: 1649678 - RNA, 21 nt, Human
cagugagacagcucugcauac

SEQ ID NO: 1649679 - RNA, 20 nt, Human
accggccuuugcaccuccau

SEQ ID NO: 1649680 - RNA, 17 nt, Human
ugaugcuuugagaacau

SEQ ID NO: 1649681 - RNA, 21 nt, Human
auguuuaauucugaaagcaac

SEQ ID NO: 1649682 - RNA, 20 nt, Human
acuaaauugacacuuaaaaa

SEQ ID NO: 1649683 - RNA, 16 nt, Human
cccccagcccuccuua

SEQ ID NO: 1649684 - RNA, 22 nt, Human
aaacaaggaugaauuaaguuuu

SEQ ID NO: 1649685 - RNA, 16 nt, Human
gaugcuuugagaacau

SEQ ID NO: 1649686 - RNA, 20 nt, Human
accugauuucugagcauuua

SEQ ID NO: 1649687 - RNA, 18 nt, Human
uccagcuggccgggagcc

SEQ ID NO: 1649688 - RNA, 22 nt, Human
aauaagucaucugaugagaaca

SEQ ID NO: 1649689 - RNA, 23 nt, Human
aaaauaucacuugucaauaaaau

SEQ ID NO: 1649690 - RNA, 13 nt, Human
gcagaacagugau

SEQ ID NO: 1649691 - RNA, 13 nt, Human
ugccaaaauauaa

SEQ ID NO: 1649692 - RNA, 15 nt, Human
gaaaugaaagcaggg

SEQ ID NO: 1649693 - RNA, 18 nt, Human
agaagcaacccaaauguu

SEQ ID NO: 1649694 - RNA, 22 nt, Human
cuugaauuguaggugacuauua

SEQ ID NO: 1649695 - RNA, 15 nt, Human
uuauauuucuguuaa

SEQ ID NO: 1649696 - RNA, 14 nt, Human
ccccugagcuugca

SEQ ID NO: 1649697 - RNA, 17 nt, Human
aacaaaauuagaaaugu

SEQ ID NO: 1649698 - RNA, 22 nt, Human
auggaaauguuuacagaucccc

SEQ ID NO: 1649699 - RNA, 18 nt, Human
auccuucagccugaaaga

SEQ ID NO: 1649700 - RNA, 16 nt, Human
uacauuuguauaaaau

SEQ ID NO: 1649701 - RNA, 15 nt, Human
uuucccagucuucag

SEQ ID NO: 1649702 - RNA, 22 nt, Human
auguccuuggugccuggagccu

SEQ ID NO: 1649703 - RNA, 15 nt, Human
aauguuuguccuugg

SEQ ID NO: 1649704 - RNA, 19 nt, Human
ccuuagcccuuccccucug

SEQ ID NO: 1649705 - RNA, 15 nt, Human
caaggagaggcaaag

SEQ ID NO: 1649706 - RNA, 19 nt, Human
acuaucucauuuccaagca

SEQ ID NO: 1649707 - RNA, 17 nt, Human
guauuauuuuuuaaaaa

SEQ ID NO: 1649708 - RNA, 21 nt, Human
uuauagcuacuaauuuuaaaa

SEQ ID NO: 1649709 - RNA, 21 nt, Human
caccagucugacuguuuccau

SEQ ID NO: 1649710 - RNA, 21 nt, Human
uauuacuguaagaaaauauca

SEQ ID NO: 1649711 - RNA, 15 nt, Human
uagauaggccauggg

SEQ ID NO: 1649712 - RNA, 23 nt, Human
caucaacagauaaauaguuuaug

SEQ ID NO: 1649713 - RNA, 14 nt, Human
aauauuauuuuaua

SEQ ID NO: 1649714 - RNA, 22 nt, Human
augcagagguccacaacacaca

SEQ ID NO: 1649715 - RNA, 15 nt, Human
cccacucugcaagaa

SEQ ID NO: 1649716 - RNA, 20 nt, Human
aaagagugaaggauuuaugu

SEQ ID NO: 1649717 - RNA, 14 nt, Human
agagaauuuccuua

SEQ ID NO: 1649718 - RNA, 14 nt, Human
aauauuuauuuuaa

SEQ ID NO: 1649719 - RNA, 17 nt, Human
uauauuuccaagaaaua

SEQ ID NO: 1649720 - RNA, 20 nt, Human
uuagcauaguaccucugcua

SEQ ID NO: 1649721 - RNA, 19 nt, Human
ucagugucaaugcagcccc

SEQ ID NO: 1649722 - RNA, 18 nt, Human
ucaccagucccuccccaa

SEQ ID NO: 1649723 - RNA, 22 nt, Human
ccgggaggcagagguugcagug

SEQ ID NO: 1649724 - RNA, 19 nt, Human
gacagucaccucauggaau

SEQ ID NO: 1649725 - RNA, 18 nt, Human
gaaaugaaagcagggacu

SEQ ID NO: 1649726 - RNA, 17 nt, Human
auaaguacaugauaagc

SEQ ID NO: 1649727 - RNA, 23 nt, Human
ugaauuacauuuguauaaaauaa

SEQ ID NO: 1649728 - RNA, 20 nt, Human
uuucauaagaauucuguuga

SEQ ID NO: 1649729 - RNA, 22 nt, Human
acaccuuguacuuuauuuucua

SEQ ID NO: 1649730 - RNA, 22 nt, Human
caugaguaacugauuuguaaca

SEQ ID NO: 1649731 - RNA, 22 nt, Human
caguauggcagcuuuccucaaa

SEQ ID NO: 1649732 - RNA, 14 nt, Human
agcaaguauuagaa

SEQ ID NO: 1649733 - RNA, 20 nt, Human
aguugauuuaaggccaggca

SEQ ID NO: 1649734 - RNA, 20 nt, Human
acaaugacuuguacucugaa

SEQ ID NO: 1649735 - RNA, 18 nt, Human
aaaaccuaagcaaacuua

SEQ ID NO: 1649736 - RNA, 18 nt, Human
auucugguagcuaaauau

SEQ ID NO: 1649737 - RNA, 19 nt, Human
accuccuaagaaggcaccu

SEQ ID NO: 1649738 - RNA, 23 nt, Human
aggcugaggcaggaggaucacuu

SEQ ID NO: 1649739 - RNA, 22 nt, Human
cuaagcuucacuguaaaauaau

SEQ ID NO: 1649740 - RNA, 16 nt, Human
gauuaagaaaggaagu

SEQ ID NO: 1649741 - RNA, 13 nt, Human
ccucauggaauug

SEQ ID NO: 1649742 - RNA, 20 nt, Human
gggaggcagagguugcagug

SEQ ID NO: 1649743 - RNA, 14 nt, Human
cagauccccaagcc

SEQ ID NO: 1649744 - RNA, 15 nt, Human
auaaauaaaaauaau

SEQ ID NO: 1649745 - RNA, 21 nt, Human
augaauacuuuauaaaggauu

SEQ ID NO: 1649746 - RNA, 14 nt, Human
uaaaggaauuuaaa

SEQ ID NO: 1649747 - RNA, 18 nt, Human
aagucuuucacauuuaaa

SEQ ID NO: 1649748 - RNA, 18 nt, Human
aaaucuuauaauuuaaaa

SEQ ID NO: 1649749 - RNA, 19 nt, Human
cagcacgggggccaaggau

SEQ ID NO: 1649750 - RNA, 17 nt, Human
ugaacuugguuuuaauu

SEQ ID NO: 1649751 - RNA, 17 nt, Human
cugaucaccugcccugc

SEQ ID NO: 1649752 - RNA, 14 nt, Human
uggacucaccuccc

SEQ ID NO: 1649753 - RNA, 22 nt, Human
uuuauaagaaauaggaaauauu

SEQ ID NO: 1649754 - RNA, 19 nt, Human
cucauggaauuggagcucg

SEQ ID NO: 1649755 - RNA, 16 nt, Human
uuucacauuuaaauaa

SEQ ID NO: 1649756 - RNA, 22 nt, Human
cuccugccuaagugcagccccg

SEQ ID NO: 1649757 - RNA, 21 nt, Human
gccuauagucccacuacuugu

SEQ ID NO: 1649758 - RNA, 19 nt, Human
uaccccuggccaaggaaga

SEQ ID NO: 1649759 - RNA, 23 nt, Human
uguugagguaccuccaaggaccg

SEQ ID NO: 1649760 - RNA, 20 nt, Human
cugaggcaggaggaucacuu

SEQ ID NO: 1649761 - RNA, 13 nt, Human
auagugagacacu

SEQ ID NO: 1649762 - RNA, 17 nt, Human
caagccuccuuuuaaag

SEQ ID NO: 1649763 - RNA, 22 nt, Human
ucuagcaugucgucaaagcuga

SEQ ID NO: 1649764 - RNA, 19 nt, Human
aagcuuguauuccuuuuuc

SEQ ID NO: 1649765 - RNA, 23 nt, Human
uugacccucacaggagcaucucc

SEQ ID NO: 1649766 - RNA, 14 nt, Human
gaucuaugccacaa

SEQ ID NO: 1649767 - RNA, 15 nt, Human
ccgucccccucuggc

SEQ ID NO: 1649768 - RNA, 15 nt, Human
gccuaagugcagccc

SEQ ID NO: 1649769 - RNA, 17 nt, Human
uuauaaucuuucacagg

SEQ ID NO: 1649770 - RNA, 11 nt, Human
aauuccacagc

SEQ ID NO: 1649771 - RNA, 17 nt, Human
ugaucaccugcccugcu

SEQ ID NO: 1649772 - RNA, 18 nt, Human
aaagaaaaucaggcuggc

SEQ ID NO: 1649773 - RNA, 17 nt, Human
acucaccucccccaucu

SEQ ID NO: 1649774 - RNA, 17 nt, Human
agggcauagaaguaaaa

SEQ ID NO: 1649775 - RNA, 14 nt, Human
ccaaugaaaugagu

SEQ ID NO: 1649776 - RNA, 14 nt, Human
cugagucccaggcu

SEQ ID NO: 1649777 - RNA, 20 nt, Human
aauucugguagcuaaauaua

SEQ ID NO: 1649778 - RNA, 13 nt, Human
agccucagucucc

SEQ ID NO: 1649779 - RNA, 21 nt, Human
gcagaucuacaugucuagaga

SEQ ID NO: 1649780 - RNA, 22 nt, Human
cuuuccacagaagcuccaggua

SEQ ID NO: 1649781 - RNA, 15 nt, Human
aagccuggcaaggga

SEQ ID NO: 1649782 - RNA, 18 nt, Human
gaagcaccaaucaugaau

SEQ ID NO: 1649783 - RNA, 13 nt, Human
ccacaacacacag

SEQ ID NO: 1649784 - RNA, 19 nt, Human
acuucagcgguuuauauaa

SEQ ID NO: 1649785 - RNA, 13 nt, Human
gugagcaucaucu

SEQ ID NO: 1649786 - RNA, 15 nt, Human
guaaggggaauugag

SEQ ID NO: 1649787 - RNA, 12 nt, Human
agggauggggcu

SEQ ID NO: 1649788 - RNA, 17 nt, Human
uuacagagacagaaagc

SEQ ID NO: 1649789 - RNA, 22 nt, Human
ccucccuuggggccuaugcaga

SEQ ID NO: 1649790 - RNA, 22 nt, Human
aucaucaagucuuucacauuua

SEQ ID NO: 1649791 - RNA, 19 nt, Human
cucugcaagaagaaaucau

SEQ ID NO: 1649792 - RNA, 20 nt, Human
acaccuuaucuauguagaau

SEQ ID NO: 1649793 - RNA, 22 nt, Human
cagugagccaaauguaaaauag

SEQ ID NO: 1649794 - RNA, 14 nt, Human
caguucugaagaag

SEQ ID NO: 1649795 - RNA, 21 nt, Human
auauuuccuuauucagaauuu

SEQ ID NO: 1649796 - RNA, 22 nt, Human
ggacaguaaaauccacagacca

SEQ ID NO: 1649797 - RNA, 17 nt, Human
uccuuggugccuggagc

SEQ ID NO: 1649798 - RNA, 17 nt, Human
cuggacucaccuccccc

SEQ ID NO: 1649799 - RNA, 22 nt, Human
augucuagagaacacugugcuc

SEQ ID NO: 1649800 - RNA, 12 nt, Human
aaaugaaagcag

SEQ ID NO: 1649801 - RNA, 21 nt, Human
uauaaaauaauuuuuauauuu

SEQ ID NO: 1649802 - RNA, 15 nt, Human
ccccugagcuugcag

SEQ ID NO: 1649803 - RNA, 14 nt, Human
acccaaaaggcaga

SEQ ID NO: 1649804 - RNA, 18 nt, Human
ugccauguggcagaucua

SEQ ID NO: 1649805 - RNA, 13 nt, Human
acaauaaaagaca

SEQ ID NO: 1649806 - RNA, 16 nt, Human
gcagcaucagcauccc

SEQ ID NO: 1649807 - RNA, 17 nt, Human
gccaugggacagggagg

SEQ ID NO: 1649808 - RNA, 17 nt, Human
guuuaauucugaaagca

SEQ ID NO: 1649809 - RNA, 15 nt, Human
ccacaagaaaugaaa

SEQ ID NO: 1649810 - RNA, 14 nt, Human
ccugccccugagcc

SEQ ID NO: 1649811 - RNA, 20 nt, Human
uggaaacacauguuccccuu

SEQ ID NO: 1649812 - RNA, 21 nt, Human
uauacugugugcuaaaacaag

SEQ ID NO: 1649813 - RNA, 14 nt, Human
aggggaccagagag

SEQ ID NO: 1649814 - RNA, 12 nt, Human
uucagccugaaa

SEQ ID NO: 1649815 - RNA, 15 nt, Human
aauauauauuuuaga

SEQ ID NO: 1649816 - RNA, 13 nt, Human
uggacgagaaaac

SEQ ID NO: 1649817 - RNA, 20 nt, Human
gaaaauaacaauaaaagaca

SEQ ID NO: 1649818 - RNA, 19 nt, Human
cuuggggccuaugcagagg

SEQ ID NO: 1649819 - RNA, 21 nt, Human
uuuauauaagcuuguauuccu

SEQ ID NO: 1649820 - RNA, 17 nt, Human
agucccaggcugagccu

SEQ ID NO: 1649821 - RNA, 22 nt, Human
aaacauccuacaagacacagug

SEQ ID NO: 1649822 - RNA, 20 nt, Human
cuggcuaauuagcauggcca

SEQ ID NO: 1649823 - RNA, 23 nt, Human
auucaauaucuuuuuuuuaauaa

SEQ ID NO: 1649824 - RNA, 20 nt, Human
cuucuuuguguuauuucccu

SEQ ID NO: 1649825 - RNA, 22 nt, Human
aaaugauguuucauaagaauuc

SEQ ID NO: 1649826 - RNA, 17 nt, Human
guuccuuuuaaagaaac

SEQ ID NO: 1649827 - RNA, 19 nt, Human
agugaggagcuuugaaacg

SEQ ID NO: 1649828 - RNA, 21 nt, Human
cuccagcuggccgggagccug

SEQ ID NO: 1649829 - RNA, 14 nt, Human
caaggaaaaaauaa

SEQ ID NO: 1649830 - RNA, 22 nt, Human
uuagauaaggcuguucuuuaaa

SEQ ID NO: 1649831 - RNA, 12 nt, Human
uaagaaggcacc

SEQ ID NO: 1649832 - RNA, 19 nt, Human
aacacaucaggaaagagag

SEQ ID NO: 1649833 - RNA, 23 nt, Human
cagagguugcagugagccgagau

SEQ ID NO: 1649834 - RNA, 21 nt, Human
ugagaaggcuguggauuuaau

SEQ ID NO: 1649835 - RNA, 17 nt, Human
aguaaaaggaaaugcuc

SEQ ID NO: 1649836 - RNA, 23 nt, Human
gaaaaaguucugcagauaaacag

SEQ ID NO: 1649837 - RNA, 16 nt, Human
ccugagcuugcagaga

SEQ ID NO: 1649838 - RNA, 16 nt, Human
uguaguccuguaaugg

SEQ ID NO: 1649839 - RNA, 20 nt, Human
uggggcuuuaacuccugcua

SEQ ID NO: 1649840 - RNA, 21 nt, Human
ccccugcaaagcccagcuuga

SEQ ID NO: 1649841 - RNA, 14 nt, Human
auuuaauuauuuca

SEQ ID NO: 1649842 - RNA, 19 nt, Human
ugagucccaggcugagccu

SEQ ID NO: 1649843 - RNA, 22 nt, Human
caaugcuguauuuuaaaagaau

SEQ ID NO: 1649844 - RNA, 21 nt, Human
cucaagcuaugugagcucacc

SEQ ID NO: 1649845 - RNA, 19 nt, Human
aagccaugugcagccacca

SEQ ID NO: 1649846 - RNA, 21 nt, Human
ccagccuggucaacauaguga

SEQ ID NO: 1649847 - RNA, 13 nt, Human
cucaccuccccca

SEQ ID NO: 1649848 - RNA, 21 nt, Human
agaauucuguugauggaaaua

SEQ ID NO: 1649849 - RNA, 13 nt, Human
uagcauggccaca

SEQ ID NO: 1649850 - RNA, 21 nt, Human
cuucucacauuuauauuuuug

SEQ ID NO: 1649851 - RNA, 14 nt, Human
gauaaaagacagug

SEQ ID NO: 1649852 - RNA, 20 nt, Human
aaugaauacuuuauaaagga

SEQ ID NO: 1649853 - RNA, 21 nt, Human
uacaugagguacugagaguga

SEQ ID NO: 1649854 - RNA, 19 nt, Human
uguauacugugugcuaaaa

SEQ ID NO: 1649855 - RNA, 19 nt, Human
ugaacaaauuuacagagac

SEQ ID NO: 1649856 - RNA, 13 nt, Human
agcccagcuugaa

SEQ ID NO: 1649857 - RNA, 14 nt, Human
caucauuuacuuuu

SEQ ID NO: 1649858 - RNA, 17 nt, Human
uucaaaacuuauuggaa

SEQ ID NO: 1649859 - RNA, 21 nt, Human
cuacauaaaauacaaaaacuu

SEQ ID NO: 1649860 - RNA, 17 nt, Human
ggaaauauuuauuuuaa

SEQ ID NO: 1649861 - RNA, 15 nt, Human
gagaugcuagaacuc

SEQ ID NO: 1649862 - RNA, 23 nt, Human
ggucuaucuuugagcgcccacua

SEQ ID NO: 1649863 - RNA, 16 nt, Human
ugauuuaaggccaggc

SEQ ID NO: 1649864 - RNA, 22 nt, Human
ugucucuacuaaaaauacaaaa

SEQ ID NO: 1649865 - RNA, 16 nt, Human
ggagaggcaaagaaag

SEQ ID NO: 1649866 - RNA, 21 nt, Human
cuauguucuaagaagugaaaa

SEQ ID NO: 1649867 - RNA, 11 nt, Human
gagguaaaagc

SEQ ID NO: 1649868 - RNA, 21 nt, Human
aauaggcugaugggcaaaaaa

SEQ ID NO: 1649869 - RNA, 21 nt, Human
uggaaacguauucaaacaauu

SEQ ID NO: 1649870 - RNA, 16 nt, Human
cgcauggaaaaguuuc

SEQ ID NO: 1649871 - RNA, 15 nt, Human
auaugcuucuuugug

SEQ ID NO: 1649872 - RNA, 13 nt, Human
agcucugcccauc

SEQ ID NO: 1649873 - RNA, 21 nt, Human
uguaaaauggugugaccacug

SEQ ID NO: 1649874 - RNA, 20 nt, Human
aaacuuuaugcuaagugaaa

SEQ ID NO: 1649875 - RNA, 15 nt, Human
augggacagggagga

SEQ ID NO: 1649876 - RNA, 23 nt, Human
caaagcugaaauggacuuuugua

SEQ ID NO: 1649877 - RNA, 22 nt, Human
cuccagccugagcgacagugag

SEQ ID NO: 1649878 - RNA, 14 nt, Human
augauguuuagaaa

SEQ ID NO: 1649879 - RNA, 20 nt, Human
cauagugagacacugucucu

SEQ ID NO: 1649880 - RNA, 15 nt, Human
guguugcagugucug

SEQ ID NO: 1649881 - RNA, 13 nt, Human
ucugcagcuucca

SEQ ID NO: 1649882 - RNA, 20 nt, Human
cuuccccucugcagcuucca

SEQ ID NO: 1649883 - RNA, 13 nt, Human
ucuuauaauuuaa

SEQ ID NO: 1649884 - RNA, 14 nt, Human
cuugagguaaaagc

SEQ ID NO: 1649885 - RNA, 15 nt, Human
aucuuuaacccacua

SEQ ID NO: 1649886 - RNA, 23 nt, Human
accucucuggguugaagggcagu

SEQ ID NO: 1649887 - RNA, 18 nt, Human
auaaaguguuugaaagcu

SEQ ID NO: 1649888 - RNA, 15 nt, Human
ugagcucagcccugg

SEQ ID NO: 1649889 - RNA, 16 nt, Human
auaauccuaaacauau

SEQ ID NO: 1649890 - RNA, 13 nt, Human
agaauauauuucc

SEQ ID NO: 1649891 - RNA, 16 nt, Human
gauguugacucuaaag

SEQ ID NO: 1649892 - RNA, 19 nt, Human
ucugagcauuuaauaugga

SEQ ID NO: 1649893 - RNA, 18 nt, Human
ugagccaccaagcuggug

SEQ ID NO: 1649894 - RNA, 20 nt, Human
cagccugagcgacagugaga

SEQ ID NO: 1649895 - RNA, 23 nt, Human
augaauuaaguuuuuuuuuaaaa

SEQ ID NO: 1649896 - RNA, 16 nt, Human
gaaguaucuugguugu

SEQ ID NO: 1649897 - RNA, 21 nt, Human
acugaaacaaaauuagaaaug

SEQ ID NO: 1649898 - RNA, 17 nt, Human
aaaggaaggaagggaca

SEQ ID NO: 1649899 - RNA, 14 nt, Human
uccacuuggucugu

SEQ ID NO: 1649900 - RNA, 19 nt, Human
augaaguacucauacaugu

SEQ ID NO: 1649901 - RNA, 15 nt, Human
uauuucacuuuagaa

SEQ ID NO: 1649902 - RNA, 13 nt, Human
augauuccaccua

SEQ ID NO: 1649903 - RNA, 20 nt, Human
uaugcuucuguuuuauaauu

SEQ ID NO: 1649904 - RNA, 17 nt, Human
auguuucauaagaauuc

SEQ ID NO: 1649905 - RNA, 14 nt, Human
ccuuaucaaaggac

SEQ ID NO: 1649906 - RNA, 16 nt, Human
gagaaacuggaacucu

SEQ ID NO: 1649907 - RNA, 20 nt, Human
gagccucagucucccucccu

SEQ ID NO: 1649908 - RNA, 20 nt, Human
guuccuuccucugagccuug

SEQ ID NO: 1649909 - RNA, 22 nt, Human
ggaaaugauguuucauaagaau

SEQ ID NO: 1649910 - RNA, 14 nt, Human
aucaggaaagagag

SEQ ID NO: 1649911 - RNA, 17 nt, Human
cuaaggcaggaggauca

SEQ ID NO: 1649912 - RNA, 22 nt, Human
gcuugcagagaugaggccgcca

SEQ ID NO: 1649913 - RNA, 20 nt, Human
ccccuauccuacuuccccuu

SEQ ID NO: 1649914 - RNA, 20 nt, Human
ucaauaaaauccauacauuu

SEQ ID NO: 1649915 - RNA, 16 nt, Human
cucaauaaaguacaag

SEQ ID NO: 1649916 - RNA, 23 nt, Human
caccucauggaauuggagcucgu

SEQ ID NO: 1649917 - RNA, 19 nt, Human
cccuuccccucugcagcuu

SEQ ID NO: 1649918 - RNA, 13 nt, Human
uccuacuuccccu

SEQ ID NO: 1649919 - RNA, 17 nt, Human
caauaacgauaaaagac

SEQ ID NO: 1649920 - RNA, 19 nt, Human
cuccagcuggccgggagcc

SEQ ID NO: 1649921 - RNA, 13 nt, Human
cccugcacuccag

SEQ ID NO: 1649922 - RNA, 21 nt, Human
agaagcuagaaaacaggcaaa

SEQ ID NO: 1649923 - RNA, 22 nt, Human
uuccccuuccuaauuccacagc

SEQ ID NO: 1649924 - RNA, 15 nt, Human
uuacagagacagaaa

SEQ ID NO: 1649925 - RNA, 17 nt, Human
gacagugaaagaaaaua

SEQ ID NO: 1649926 - RNA, 13 nt, Human
aacaagccuccuu

SEQ ID NO: 1649927 - RNA, 23 nt, Human
ucucuaccaaaaaaaggaaggaa

SEQ ID NO: 1649928 - RNA, 15 nt, Human
gcccacuagacccac

SEQ ID NO: 1649929 - RNA, 12 nt, Human
uaguuuuuaaag

SEQ ID NO: 1649930 - RNA, 22 nt, Human
cuggagacauugaggcaggcac

SEQ ID NO: 1649931 - RNA, 13 nt, Human
cuuuccaugaguu

SEQ ID NO: 1649932 - RNA, 14 nt, Human
ggacucaccucccc

SEQ ID NO: 1649933 - RNA, 11 nt, Human
acuuugaagag

SEQ ID NO: 1649934 - RNA, 23 nt, Human
uaacgauaaaagacagugaaaga

SEQ ID NO: 1649935 - RNA, 21 nt, Human
cucuugaaguauauauaucau

SEQ ID NO: 1649936 - RNA, 23 nt, Human
uuacgaaauacguuaggaggaca

SEQ ID NO: 1649937 - RNA, 19 nt, Human
aauauuauguuaaaacugg

SEQ ID NO: 1649938 - RNA, 18 nt, Human
gacccacuggacucaccu

SEQ ID NO: 1649939 - RNA, 20 nt, Human
aucaaccugccagcuggccu

SEQ ID NO: 1649940 - RNA, 18 nt, Human
uuuuaaaaaagaaacauu

SEQ ID NO: 1649941 - RNA, 23 nt, Human
aaagcccagcuugaaaccuucac

SEQ ID NO: 1649942 - RNA, 11 nt, Human
ggucacaggaa

SEQ ID NO: 1649943 - RNA, 20 nt, Human
agcuucacuguaaaauaaua

SEQ ID NO: 1649944 - RNA, 15 nt, Human
caggaaguagaggag

SEQ ID NO: 1649945 - RNA, 15 nt, Human
caggcaaauuccuga

SEQ ID NO: 1649946 - RNA, 15 nt, Human
uaaaagacaaggaaa

SEQ ID NO: 1649947 - RNA, 18 nt, Human
gccuucggccuccauccu

SEQ ID NO: 1649948 - RNA, 17 nt, Human
cucacaggagcaucucc

SEQ ID NO: 1649949 - RNA, 18 nt, Human
aucuacacuccagugaga

SEQ ID NO: 1649950 - RNA, 18 nt, Human
gaaaauaacaauaaaaga

SEQ ID NO: 1649951 - RNA, 23 nt, Human
agcucugcccauccugccccuga

SEQ ID NO: 1649952 - RNA, 14 nt, Human
cuguaaucacagcu

SEQ ID NO: 1649953 - RNA, 16 nt, Human
cuucuggguuccuucc

SEQ ID NO: 1649954 - RNA, 16 nt, Human
auuuguauaaaauaau

SEQ ID NO: 1649955 - RNA, 24 nt, Human
ugucuugaauuguaggugacuauu

SEQ ID NO: 1649956 - RNA, 16 nt, Human
aaaauaauccucaguu

SEQ ID NO: 1649957 - RNA, 12 nt, Human
uauauuuccuua

SEQ ID NO: 1649958 - RNA, 19 nt, Human
auuuaguuauaaaaauaua

SEQ ID NO: 1649959 - RNA, 22 nt, Human
auaacaaugcuguauuuuaaaa

SEQ ID NO: 1649960 - RNA, 23 nt, Human
caaauaagucaucugaugagaac

SEQ ID NO: 1649961 - RNA, 22 nt, Human
uuccuagucuguuuucccuccu

SEQ ID NO: 1649962 - RNA, 22 nt, Human
ccaaacauccuacaagacacag

SEQ ID NO: 1649963 - RNA, 16 nt, Human
acaaauccaaugaaau

SEQ ID NO: 1649964 - RNA, 19 nt, Human
uccagaaagugacaagcuc

SEQ ID NO: 1649965 - RNA, 17 nt, Human
cuaagcuucacuguaaa

SEQ ID NO: 1649966 - RNA, 15 nt, Human
ugaaauuguauuaca

SEQ ID NO: 1649967 - RNA, 16 nt, Human
gccucagucucccucc

SEQ ID NO: 1649968 - RNA, 23 nt, Human
aggaggaucacuuuaggccuggu

SEQ ID NO: 1649969 - RNA, 22 nt, Human
cugaaauggaacagauuucaaa

SEQ ID NO: 1649970 - RNA, 22 nt, Human
cuaggaugggaacaaggaagga

SEQ ID NO: 1649971 - RNA, 22 nt, Human
uaucuauguagaauauauuucc

SEQ ID NO: 1649972 - RNA, 18 nt, Human
ccaagcugguggcucugu

SEQ ID NO: 1649973 - RNA, 14 nt, Human
gacaagaaggaaag

SEQ ID NO: 1649974 - RNA, 14 nt, Human
uuucuaugaaauau

SEQ ID NO: 1649975 - RNA, 23 nt, Human
uaaaauauaugaggcuacagaac

SEQ ID NO: 1649976 - RNA, 18 nt, Human
ucuauguagaauauauuu

SEQ ID NO: 1649977 - RNA, 16 nt, Human
uauuuuugugauuuug

SEQ ID NO: 1649978 - RNA, 21 nt, Human
cauuucuugagguaaaagcau

SEQ ID NO: 1649979 - RNA, 15 nt, Human
uucugcacacagcac

SEQ ID NO: 1649980 - RNA, 19 nt, Human
uggagccuacuaaaugcuc

SEQ ID NO: 1649981 - RNA, 20 nt, Human
aaaaucuuauaauuuaaaau

SEQ ID NO: 1649982 - RNA, 14 nt, Human
ucuuuuuuuuaaua

SEQ ID NO: 1649983 - RNA, 17 nt, Human
ccucagucucccucccu

SEQ ID NO: 1649984 - RNA, 14 nt, Human
aaauaaauaaauaa

SEQ ID NO: 1649985 - RNA, 14 nt, Human
aucucuucucagaa

SEQ ID NO: 1649986 - RNA, 17 nt, Human
guuagagaauuuccuua

SEQ ID NO: 1649987 - RNA, 20 nt, Human
cugcacacagcacgggggcc

SEQ ID NO: 1649988 - RNA, 19 nt, Human
auguuccuuuuaaagaaac

SEQ ID NO: 1649989 - RNA, 16 nt, Human
ucuaaaaguuuaaguu

SEQ ID NO: 1649990 - RNA, 20 nt, Human
uaaaacaagcacuaaacaaa

SEQ ID NO: 1649991 - RNA, 11 nt, Human
aaaaaggaagg

SEQ ID NO: 1649992 - RNA, 22 nt, Human
aaaaaaccugagccccaaaagg

SEQ ID NO: 1649993 - RNA, 14 nt, Human
acaagagcuuaaca

SEQ ID NO: 1649994 - RNA, 14 nt, Human
caugaacuuguaaa

SEQ ID NO: 1649995 - RNA, 20 nt, Human
cccuuccuaauuccacagcu

SEQ ID NO: 1649996 - RNA, 15 nt, Human
cucccuuggggccua

SEQ ID NO: 1649997 - RNA, 16 nt, Human
guuaucuucacuuuua

SEQ ID NO: 1649998 - RNA, 18 nt, Human
ugcauagguuuaauaauu

SEQ ID NO: 1649999 - RNA, 12 nt, Human
uaauuccacagc

SEQ ID NO: 1650000 - RNA, 18 nt, Human
cuacauaaaauacaaaaa

SEQ ID NO: 1650001 - RNA, 17 nt, Human
cucugcaagaagaaauc

SEQ ID NO: 1650002 - RNA, 18 nt, Human
caguuguugcccacagcu

SEQ ID NO: 1650003 - RNA, 14 nt, Human
caagaaggaaagau

SEQ ID NO: 1650004 - RNA, 20 nt, Human
cugagccucagucucccucc

SEQ ID NO: 1650005 - RNA, 23 nt, Human
uggaaauguuuacagauccccaa

SEQ ID NO: 1650006 - RNA, 13 nt, Human
caguuauuauauu

SEQ ID NO: 1650007 - RNA, 12 nt, Human
ggcagcaccucc

SEQ ID NO: 1650008 - RNA, 20 nt, Human
guccccuauccuacuucccc

SEQ ID NO: 1650009 - RNA, 23 nt, Human
aaaaugggcuuuggaugauuauu

SEQ ID NO: 1650010 - RNA, 20 nt, Human
agaaaaccuaagcaaacuua

SEQ ID NO: 1650011 - RNA, 23 nt, Human
ggaugaauuaaguuuuuuuuuaa

SEQ ID NO: 1650012 - RNA, 22 nt, Human
uucauagaguucccaugaacua

SEQ ID NO: 1650013 - RNA, 12 nt, Human
aauaaaaacaaa

SEQ ID NO: 1650014 - RNA, 15 nt, Human
gcacagccucuuaga

SEQ ID NO: 1650015 - RNA, 21 nt, Human
uaucuuccuauaauuuuagac

SEQ ID NO: 1650016 - RNA, 15 nt, Human
cagugaaagaaaaua

SEQ ID NO: 1650017 - RNA, 14 nt, Human
accauuuuuacuug

SEQ ID NO: 1650018 - RNA, 16 nt, Human
aagaagcuagaaaaca

SEQ ID NO: 1650019 - RNA, 17 nt, Human
accugagccccaaaagg

SEQ ID NO: 1650020 - RNA, 12 nt, Human
uaaauauauauu

SEQ ID NO: 1650021 - RNA, 23 nt, Human
uauguuaaaacugggacagggga

SEQ ID NO: 1650022 - RNA, 19 nt, Human
cagugagccaaauguaaaa

SEQ ID NO: 1650023 - RNA, 21 nt, Human
cuaguaucaaaagaaagaaaa

SEQ ID NO: 1650024 - RNA, 13 nt, Human
aauuauuucacuu

SEQ ID NO: 1650025 - RNA, 18 nt, Human
auuauuucacuuuagaaa

SEQ ID NO: 1650026 - RNA, 15 nt, Human
uggcuaauuagcaug

SEQ ID NO: 1650027 - RNA, 17 nt, Human
guugauuuaaggccagg

SEQ ID NO: 1650028 - RNA, 13 nt, Human
aaaguguuugaaa

SEQ ID NO: 1650029 - RNA, 16 nt, Human
auuccuuaagauauua

SEQ ID NO: 1650030 - RNA, 18 nt, Human
aaacugccaucauuuacu

SEQ ID NO: 1650031 - RNA, 15 nt, Human
uccucaacucugagu

SEQ ID NO: 1650032 - RNA, 15 nt, Human
auccugccccugagc

SEQ ID NO: 1650033 - RNA, 17 nt, Human
ccucuggcuccagcugg

SEQ ID NO: 1650034 - RNA, 18 nt, Human
cuccagccugagcgacag

SEQ ID NO: 1650035 - RNA, 19 nt, Human
uggugagugccuguaauca

SEQ ID NO: 1650036 - RNA, 16 nt, Human
uucuauaauuuaaaua

SEQ ID NO: 1650037 - RNA, 13 nt, Human
auuggacaguaaa

SEQ ID NO: 1650038 - RNA, 13 nt, Human
gacaaggaaaaaa

SEQ ID NO: 1650039 - RNA, 20 nt, Human
ccaacacccugagguugugu

SEQ ID NO: 1650040 - RNA, 17 nt, Human
guugcugggggggauug

SEQ ID NO: 1650041 - RNA, 17 nt, Human
gaugggaacaaggaagg

SEQ ID NO: 1650042 - RNA, 21 nt, Human
aagucuuucacauuuaaauaa

SEQ ID NO: 1650043 - RNA, 20 nt, Human
ugaaaaucuuauaauuuaaa

SEQ ID NO: 1650044 - RNA, 13 nt, Human
guuguguguggaa

SEQ ID NO: 1650045 - RNA, 22 nt, Human
ugaccauacuaauuauaccccc

SEQ ID NO: 1650046 - RNA, 15 nt, Human
cuaucuuugagcgcc

SEQ ID NO: 1650047 - RNA, 20 nt, Human
aacaagccuccuuuuaaagu

SEQ ID NO: 1650048 - RNA, 18 nt, Human
auggcuugaguuuaaauu

SEQ ID NO: 1650049 - RNA, 16 nt, Human
ccaugugcagccacca

SEQ ID NO: 1650050 - RNA, 17 nt, Human
gucaaaguucauagagu

SEQ ID NO: 1650051 - RNA, 20 nt, Human
ucucguugacccucacagga

SEQ ID NO: 1650052 - RNA, 15 nt, Human
agccucagucucccu

SEQ ID NO: 1650053 - RNA, 17 nt, Human
guuucuagagaugguuu

SEQ ID NO: 1650054 - RNA, 14 nt, Human
uugccaugugcuag

SEQ ID NO: 1650055 - RNA, 21 nt, Human
aaggcaggaggaucacuugag

SEQ ID NO: 1650056 - RNA, 14 nt, Human
gccaggcacagugg

SEQ ID NO: 1650057 - RNA, 22 nt, Human
gcuaauuagcauggccacaucu

SEQ ID NO: 1650058 - RNA, 15 nt, Human
gccucagucucccuc

SEQ ID NO: 1650059 - RNA, 13 nt, Human
ccagcacagccuc

SEQ ID NO: 1650060 - RNA, 21 nt, Human
cuguuaucuucacuuuuauaa

SEQ ID NO: 1650061 - RNA, 12 nt, Human
uugggcaggcag

SEQ ID NO: 1650062 - RNA, 16 nt, Human
agugaaauauuauuuu

SEQ ID NO: 1650063 - RNA, 16 nt, Human
cuucacuguaaaauaa

SEQ ID NO: 1650064 - RNA, 18 nt, Human
uuggggccuaugcagagg

SEQ ID NO: 1650065 - RNA, 18 nt, Human
auuuuuagugaaauauua

SEQ ID NO: 1650066 - RNA, 19 nt, Human
auuguaggugacuauuaua

SEQ ID NO: 1650067 - RNA, 17 nt, Human
cuuccuaauuccacagc

SEQ ID NO: 1650068 - RNA, 16 nt, Human
gaaauguauucuuuua

SEQ ID NO: 1650069 - RNA, 16 nt, Human
ggcuaauaucuuaucu

SEQ ID NO: 1650070 - RNA, 12 nt, Human
ccuucagccuga

SEQ ID NO: 1650071 - RNA, 23 nt, Human
ugaauuauguuugcauguucacu

SEQ ID NO: 1650072 - RNA, 19 nt, Human
uuuccugaaaacccuugcc

SEQ ID NO: 1650073 - RNA, 13 nt, Human
cccaaaaggcaga

SEQ ID NO: 1650074 - RNA, 22 nt, Human
caacacaucaggaaagagagca

SEQ ID NO: 1650075 - RNA, 23 nt, Human
uacaaaugggaaacaaaaggaua

SEQ ID NO: 1650076 - RNA, 17 nt, Human
cuacagaacuaaaaauu

SEQ ID NO: 1650077 - RNA, 21 nt, Human
ugccagcuggccuugugagga

SEQ ID NO: 1650078 - RNA, 16 nt, Human
cuagaacucccuuuca

SEQ ID NO: 1650079 - RNA, 15 nt, Human
aauacuuuauaaagg

SEQ ID NO: 1650080 - RNA, 20 nt, Human
agccuuggggcugaugcagu

SEQ ID NO: 1650081 - RNA, 13 nt, Human
aagaccagccugg

SEQ ID NO: 1650082 - RNA, 18 nt, Human
uccaggcuggcgugcagc

SEQ ID NO: 1650083 - RNA, 19 nt, Human
auucccagccagcacagcc

SEQ ID NO: 1650084 - RNA, 15 nt, Human
caaggaaaaaauaac

SEQ ID NO: 1650085 - RNA, 13 nt, Human
cucugagccuugg

SEQ ID NO: 1650086 - RNA, 17 nt, Human
uccucugagccuuggga

SEQ ID NO: 1650087 - RNA, 16 nt, Human
caaaaggauaaugaau

SEQ ID NO: 1650088 - RNA, 19 nt, Human
uggcaagcucuaucaccaa

SEQ ID NO: 1650089 - RNA, 20 nt, Human
uccaagccucauguccacug

SEQ ID NO: 1650090 - RNA, 19 nt, Human
accaaaaaaaggaaggaag

SEQ ID NO: 1650091 - RNA, 17 nt, Human
ccaaaaaucucaauauu

SEQ ID NO: 1650092 - RNA, 20 nt, Human
caagagccuuuuuuugaaaa

SEQ ID NO: 1650093 - RNA, 14 nt, Human
cucugccucagaaa

SEQ ID NO: 1650094 - RNA, 19 nt, Human
agugccuccaaguucaaaa

SEQ ID NO: 1650095 - RNA, 17 nt, Human
ucugguagcuaaauaua

SEQ ID NO: 1650096 - RNA, 13 nt, Human
cuccacuggaaaa

SEQ ID NO: 1650097 - RNA, 21 nt, Human
auaauuuuuauauuugaaaua

SEQ ID NO: 1650098 - RNA, 17 nt, Human
gccuaagugcagccccg

SEQ ID NO: 1650099 - RNA, 18 nt, Human
gaagcaaaauuuuuucuc

SEQ ID NO: 1650100 - RNA, 13 nt, Human
auaauuuuagaca

SEQ ID NO: 1650101 - RNA, 14 nt, Human
uaauaucuuaucuu

SEQ ID NO: 1650102 - RNA, 22 nt, Human
cugccaaaacaucaaccugcca

SEQ ID NO: 1650103 - RNA, 20 nt, Human
ggcaggaggaucacuugagc

SEQ ID NO: 1650104 - RNA, 22 nt, Human
uagaaauguauucuuuuaguuu

SEQ ID NO: 1650105 - RNA, 19 nt, Human
agcagcuuauucacaagac

SEQ ID NO: 1650106 - RNA, 17 nt, Human
ucucuggccuucggccu

SEQ ID NO: 1650107 - RNA, 18 nt, Human
auagaauuaacacaugau

SEQ ID NO: 1650108 - RNA, 17 nt, Human
gcccuuccccucugcag

SEQ ID NO: 1650109 - RNA, 16 nt, Human
ccccugcacuccagcc

SEQ ID NO: 1650110 - RNA, 12 nt, Human
cauguuccccuu

SEQ ID NO: 1650111 - RNA, 22 nt, Human
auauuuccuuauucagaauuuc

SEQ ID NO: 1650112 - RNA, 21 nt, Human
ccaaauauaaauaaaaauaau

SEQ ID NO: 1650113 - RNA, 15 nt, Human
cugccagcuggccuu

SEQ ID NO: 1650114 - RNA, 14 nt, Human
auuuauguuuaauu

SEQ ID NO: 1650115 - RNA, 14 nt, Human
aauauaaauaaaaa

SEQ ID NO: 1650116 - RNA, 17 nt, Human
aacagauuucaaaaaaa

SEQ ID NO: 1650117 - RNA, 12 nt, Human
ggaggcugagau

SEQ ID NO: 1650118 - RNA, 16 nt, Human
uaacaauaaaagacaa

SEQ ID NO: 1650119 - RNA, 23 nt, Human
ggaggcagagguugcagugagcc

SEQ ID NO: 1650120 - RNA, 22 nt, Human
ucucucaaggagaggcaaagaa

SEQ ID NO: 1650121 - RNA, 22 nt, Human
uacugagagugaacaaauuuac

SEQ ID NO: 1650122 - RNA, 19 nt, Human
uggugaacuugguuuuaau

SEQ ID NO: 1650123 - RNA, 23 nt, Human
guaauuccguagguuauuuucag

SEQ ID NO: 1650124 - RNA, 16 nt, Human
cuucaacucccugccc

SEQ ID NO: 1650125 - RNA, 17 nt, Human
gaagaccucauuuugaa

SEQ ID NO: 1650126 - RNA, 13 nt, Human
uaacgauaaaaga

SEQ ID NO: 1650127 - RNA, 19 nt, Human
ccauccugccccugagccc

SEQ ID NO: 1650128 - RNA, 16 nt, Human
cugcucucaguucacu

SEQ ID NO: 1650129 - RNA, 15 nt, Human
gcaagcucuaucacc

SEQ ID NO: 1650130 - RNA, 23 nt, Human
uuuccaucaaggguacacugccu

SEQ ID NO: 1650131 - RNA, 22 nt, Human
ucuacuaaaaauacaaaaaaaa

SEQ ID NO: 1650132 - RNA, 18 nt, Human
uauguuccuuuuaaagaa

SEQ ID NO: 1650133 - RNA, 17 nt, Human
caucagcaucccuagaa

SEQ ID NO: 1650134 - RNA, 12 nt, Human
caaguaaauguu

SEQ ID NO: 1650135 - RNA, 15 nt, Human
acuuuuauaagaaau

SEQ ID NO: 1650136 - RNA, 21 nt, Human
gcgagacccugucucaauaaa

SEQ ID NO: 1650137 - RNA, 18 nt, Human
aaaguugauuaagaaagg

SEQ ID NO: 1650138 - RNA, 14 nt, Human
agugucuugaauug

SEQ ID NO: 1650139 - RNA, 13 nt, Human
agacagcucugca

SEQ ID NO: 1650140 - RNA, 20 nt, Human
uaauaucuuaucuuccuaua

SEQ ID NO: 1650141 - RNA, 22 nt, Human
uucugguagcuaaauauauauu

SEQ ID NO: 1650142 - RNA, 14 nt, Human
acaaauccaaugaa

SEQ ID NO: 1650143 - RNA, 12 nt, Human
gacacugucucu

SEQ ID NO: 1650144 - RNA, 23 nt, Human
aacuccugcuagaacagucucuu

SEQ ID NO: 1650145 - RNA, 22 nt, Human
aauuacauuuguauaaaauaau

SEQ ID NO: 1650146 - RNA, 21 nt, Human
ccucccuuggggccuaugcag

SEQ ID NO: 1650147 - RNA, 19 nt, Human
aagcuaugugagcucacca

SEQ ID NO: 1650148 - RNA, 12 nt, Human
acucccugcccc

SEQ ID NO: 1650149 - RNA, 18 nt, Human
cuucucacauuuauauuu

SEQ ID NO: 1650150 - RNA, 17 nt, Human
uaugccacaagaacccc

SEQ ID NO: 1650151 - RNA, 17 nt, Human
aggcuggcgugcagcau

SEQ ID NO: 1650152 - RNA, 17 nt, Human
agcuacuaauuuuaaaa

SEQ ID NO: 1650153 - RNA, 15 nt, Human
cagccagcacagccu

SEQ ID NO: 1650154 - RNA, 23 nt, Human
cacuggacucaccucccccaucu

SEQ ID NO: 1650155 - RNA, 22 nt, Human
gaauuaaguuuuuuuuuaaaaa

SEQ ID NO: 1650156 - RNA, 12 nt, Human
agggacccccaa

SEQ ID NO: 1650157 - RNA, 15 nt, Human
cugaaagaggaauga

SEQ ID NO: 1650158 - RNA, 22 nt, Human
uuuaauaauguuucaaacauau

SEQ ID NO: 1650159 - RNA, 14 nt, Human
ggaaguagaggagg

SEQ ID NO: 1650160 - RNA, 17 nt, Human
ccccaguuguuucuacu

SEQ ID NO: 1650161 - RNA, 22 nt, Human
gaaauaagccagacaucaacag

SEQ ID NO: 1650162 - RNA, 17 nt, Human
cauuguuggcuguuccu

SEQ ID NO: 1650163 - RNA, 21 nt, Human
cucuacauaaaauacaaaaac

SEQ ID NO: 1650164 - RNA, 14 nt, Human
agagguccacaaca

SEQ ID NO: 1650165 - RNA, 16 nt, Human
agugucaaugcagccc

SEQ ID NO: 1650166 - RNA, 22 nt, Human
ccagcuggccuugugaggagcu

SEQ ID NO: 1650167 - RNA, 14 nt, Human
auuuucuauaauuu

SEQ ID NO: 1650168 - RNA, 16 nt, Human
uaucuuccuauaauuu

SEQ ID NO: 1650169 - RNA, 17 nt, Human
cucagucucccucccuu

SEQ ID NO: 1650170 - RNA, 15 nt, Human
gaccacugcagaaga

SEQ ID NO: 1650171 - RNA, 14 nt, Human
aagagugaaggauu

SEQ ID NO: 1650172 - RNA, 22 nt, Human
aaagacagugaaagaaaauaac

SEQ ID NO: 1650173 - RNA, 15 nt, Human
ucccuuuguccacaa

SEQ ID NO: 1650174 - RNA, 19 nt, Human
agacagugaaagaaaauaa

SEQ ID NO: 1650175 - RNA, 18 nt, Human
acuguuaucuucacuuuu

SEQ ID NO: 1650176 - RNA, 16 nt, Human
gacuauuauauuucca

SEQ ID NO: 1650177 - RNA, 16 nt, Human
uuugcuguuauuuuau

SEQ ID NO: 1650178 - RNA, 14 nt, Human
ccaaauauaaauaa

SEQ ID NO: 1650179 - RNA, 18 nt, Human
uucagcagagaaguuuuc

SEQ ID NO: 1650180 - RNA, 19 nt, Human
guuguauuauuuuuuaaaa

SEQ ID NO: 1650181 - RNA, 22 nt, Human
ggcuaagcuucacuguaaaaua

SEQ ID NO: 1650182 - RNA, 12 nt, Human
agggcaagagag

SEQ ID NO: 1650183 - RNA, 18 nt, Human
cuuuccacagaagcucca

SEQ ID NO: 1650184 - RNA, 13 nt, Human
uaauuuuuauauu

SEQ ID NO: 1650185 - RNA, 14 nt, Human
auuaagaaaggaag

SEQ ID NO: 1650186 - RNA, 14 nt, Human
aaaagaaagaaaau

SEQ ID NO: 1650187 - RNA, 18 nt, Human
ugaagagugugaggaaaa

SEQ ID NO: 1650188 - RNA, 17 nt, Human
gccugagcgacagugag

SEQ ID NO: 1650189 - RNA, 17 nt, Human
cuacacuccagugagac

SEQ ID NO: 1650190 - RNA, 22 nt, Human
caagcucuaucaccaaggagcc

SEQ ID NO: 1650191 - RNA, 15 nt, Human
gcuaauaucuuaucu

SEQ ID NO: 1650192 - RNA, 18 nt, Human
uuaggaggacaaaaggaa

SEQ ID NO: 1650193 - RNA, 12 nt, Human
aucauuuacuuu

SEQ ID NO: 1650194 - RNA, 20 nt, Human
caaauauaaauaaaaauaau

SEQ ID NO: 1650195 - RNA, 18 nt, Human
gccugggcaacaugguga

SEQ ID NO: 1650196 - RNA, 22 nt, Human
uuaccucugccucagaaaacaa

SEQ ID NO: 1650197 - RNA, 16 nt, Human
aacagauuucaaaaaa

SEQ ID NO: 1650198 - RNA, 17 nt, Human
cagugaaagaaaauaac

SEQ ID NO: 1650199 - RNA, 15 nt, Human
aucuuauaauuuaaa

SEQ ID NO: 1650200 - RNA, 15 nt, Human
ccucagucucccucc

SEQ ID NO: 1650201 - RNA, 21 nt, Human
auuuguauaaaauaauuuuua

SEQ ID NO: 1650202 - RNA, 22 nt, Human
ugguagcuaaauauauauuuua

SEQ ID NO: 1650203 - RNA, 16 nt, Human
cuuauaauuuaaaaua

SEQ ID NO: 1650204 - RNA, 19 nt, Human
agaaaauaacaauaaaaga

SEQ ID NO: 1650205 - RNA, 19 nt, Human
uguucaugcccauaccccu

SEQ ID NO: 1650206 - RNA, 12 nt, Human
uauuuuaauguu

SEQ ID NO: 1650207 - RNA, 21 nt, Human
cgaaguauccuucagccugaa

SEQ ID NO: 1650208 - RNA, 15 nt, Human
uuccaagaaauauuc

SEQ ID NO: 1650209 - RNA, 14 nt, Human
cuaaacauaugaau

SEQ ID NO: 1650210 - RNA, 19 nt, Human
ccccugagcuugcagagau

SEQ ID NO: 1650211 - RNA, 15 nt, Human
cagaauucauucacu

SEQ ID NO: 1650212 - RNA, 11 nt, Human
aauaaauaaau

SEQ ID NO: 1650213 - RNA, 20 nt, Human
aaagacaaggaaaaaauaac

SEQ ID NO: 1650214 - RNA, 15 nt, Human
cugcagauaaacagu

SEQ ID NO: 1650215 - RNA, 16 nt, Human
cugagcauuuaauaug

SEQ ID NO: 1650216 - RNA, 13 nt, Human
ggacaaaaggaau

SEQ ID NO: 1650217 - RNA, 13 nt, Human
auaacuggaaacu

SEQ ID NO: 1650218 - RNA, 18 nt, Human
ccacuuggucugugagau

SEQ ID NO: 1650219 - RNA, 23 nt, Human
cuggggcuuuaacuccugcuaga

SEQ ID NO: 1650220 - RNA, 16 nt, Human
caauaacgauaaaaga

SEQ ID NO: 1650221 - RNA, 20 nt, Human
cucccugccccccagcccuc

SEQ ID NO: 1650222 - RNA, 16 nt, Human
ggaugccccguccccc

SEQ ID NO: 1650223 - RNA, 22 nt, Human
gaugggaacaaggaaggaaaga

SEQ ID NO: 1650224 - RNA, 15 nt, Human
aacugaaacaaaauu

SEQ ID NO: 1650225 - RNA, 16 nt, Human
guucugcacacagcac

SEQ ID NO: 1650226 - RNA, 18 nt, Human
cccaggcugagccucagu

SEQ ID NO: 1650227 - RNA, 21 nt, Human
guuuguuuauuuguuuuucca

SEQ ID NO: 1650228 - RNA, 17 nt, Human
aaauaacaauaaaagac

SEQ ID NO: 1650229 - RNA, 19 nt, Human
agaugcuagaacucccuuu

SEQ ID NO: 1650230 - RNA, 15 nt, Human
ugagcgcccacuaga

SEQ ID NO: 1650231 - RNA, 21 nt, Human
uucagcucagcuaaugaagug

SEQ ID NO: 1650232 - RNA, 18 nt, Human
aguccauugggcaggcag

SEQ ID NO: 1650233 - RNA, 17 nt, Human
uaagaaauaggaaauau

SEQ ID NO: 1650234 - RNA, 16 nt, Human
uuuuagugaaauauua

SEQ ID NO: 1650235 - RNA, 14 nt, Human
ugacacuuaaaaau

SEQ ID NO: 1650236 - RNA, 16 nt, Human
cacuuaaaaaugguuu

SEQ ID NO: 1650237 - RNA, 12 nt, Human
aguuauaaaaau

SEQ ID NO: 1650238 - RNA, 17 nt, Human
aaagacaaggaaaaaau

SEQ ID NO: 1650239 - RNA, 14 nt, Human
ccaugaccaacauc

SEQ ID NO: 1650240 - RNA, 19 nt, Human
uucccuugaugaagaaguu

SEQ ID NO: 1650241 - RNA, 15 nt, Human
aaggaaaaaauaaca

SEQ ID NO: 1650242 - RNA, 14 nt, Human
acauauauaacaau

SEQ ID NO: 1650243 - RNA, 18 nt, Human
uaugaggcuacagaacua

SEQ ID NO: 1650244 - RNA, 22 nt, Human
aucucuucuggguuccuuccuc

SEQ ID NO: 1650245 - RNA, 21 nt, Human
aauauauuuccuuauucagaa

SEQ ID NO: 1650246 - RNA, 21 nt, Human
cacuaucuggguuuugggggg

SEQ ID NO: 1650247 - RNA, 19 nt, Human
aaaggaaggaagggacaca

SEQ ID NO: 1650248 - RNA, 23 nt, Human
uuucccaucucagguguguugca

SEQ ID NO: 1650249 - RNA, 15 nt, Human
agaugggcauggugg

SEQ ID NO: 1650250 - RNA, 12 nt, Human
auucugaaagca

SEQ ID NO: 1650251 - RNA, 23 nt, Human
ucuaccaaaaaucucaauauuuc

SEQ ID NO: 1650252 - RNA, 23 nt, Human
ucuccauguacuggcaagaccug

SEQ ID NO: 1650253 - RNA, 19 nt, Human
auuuacagagacagaaagc

SEQ ID NO: 1650254 - RNA, 13 nt, Human
cauuuguauaaaa

SEQ ID NO: 1650255 - RNA, 21 nt, Human
guauacugugugcuaaaacaa

SEQ ID NO: 1650256 - RNA, 18 nt, Human
uuauuacuguaagaaaau

SEQ ID NO: 1650257 - RNA, 14 nt, Human
gaaugauuaugaau

SEQ ID NO: 1650258 - RNA, 23 nt, Human
gggagccugaucaccugcccugc

SEQ ID NO: 1650259 - RNA, 14 nt, Human
ugaggcaggaggau

SEQ ID NO: 1650260 - RNA, 21 nt, Human
aaugaauggcuaagcaaaaug

SEQ ID NO: 1650261 - RNA, 22 nt, Human
aggaugccccgucccccucugg

SEQ ID NO: 1650262 - RNA, 17 nt, Human
aggccaggcacaguggc

SEQ ID NO: 1650263 - RNA, 22 nt, Human
uuuauggcacuaguauuucuau

SEQ ID NO: 1650264 - RNA, 15 nt, Human
ugcuugucccugugg

SEQ ID NO: 1650265 - RNA, 15 nt, Human
auaauuuugugaagc

SEQ ID NO: 1650266 - RNA, 18 nt, Human
ugugaccacugcagaaga

SEQ ID NO: 1650267 - RNA, 13 nt, Human
cagaaacuccugu

SEQ ID NO: 1650268 - RNA, 12 nt, Human
caaccugccagc

SEQ ID NO: 1650269 - RNA, 13 nt, Human
aaagaaaggagau

SEQ ID NO: 1650270 - RNA, 14 nt, Human
auauauuuuagaua

SEQ ID NO: 1650271 - RNA, 19 nt, Human
agaucuacaugucuagaga

SEQ ID NO: 1650272 - RNA, 17 nt, Human
acuuccagauccuggaa

SEQ ID NO: 1650273 - RNA, 15 nt, Human
gaauaaccaacaccc

SEQ ID NO: 1650274 - RNA, 14 nt, Human
cugucucaguccau

SEQ ID NO: 1650275 - RNA, 21 nt, Human
caaggagaggcaaagaaagga

SEQ ID NO: 1650276 - RNA, 22 nt, Human
caaauuuacagagacagaaagc

SEQ ID NO: 1650277 - RNA, 15 nt, Human
aagaagugaaaaucu

SEQ ID NO: 1650278 - RNA, 15 nt, Human
aaaacaggcaaauuc

SEQ ID NO: 1650279 - RNA, 20 nt, Human
auuuucaguuauuauauuua

SEQ ID NO: 1650280 - RNA, 16 nt, Human
aauuucuucaacuccc

SEQ ID NO: 1650281 - RNA, 18 nt, Human
cuuuuaaagaaacaaaaa

SEQ ID NO: 1650282 - RNA, 21 nt, Human
gcuggccaccugcugagcccc

SEQ ID NO: 1650283 - RNA, 15 nt, Human
ggaaauauuuuaaug

SEQ ID NO: 1650284 - RNA, 23 nt, Human
cucauguccacugguucuucuug

SEQ ID NO: 1650285 - RNA, 14 nt, Human
uucacauuuaaaua

SEQ ID NO: 1650286 - RNA, 21 nt, Human
gaagugaaaaucuacacucca

SEQ ID NO: 1650287 - RNA, 22 nt, Human
agacucgggauuaguacacacu

SEQ ID NO: 1650288 - RNA, 16 nt, Human
uuccuuacucuugauu

SEQ ID NO: 1650289 - RNA, 13 nt, Human
cguuaauguaaag

SEQ ID NO: 1650290 - RNA, 14 nt, Human
uggccaccugcuga

SEQ ID NO: 1650291 - RNA, 21 nt, Human
gaaaacaauaacgauaaaaga

SEQ ID NO: 1650292 - RNA, 20 nt, Human
uacaucccuuaccugggaaa

SEQ ID NO: 1650293 - RNA, 18 nt, Human
ccaagccuggcaagggaa

SEQ ID NO: 1650294 - RNA, 23 nt, Human
uuguaacaagccuccuuuuaaag

SEQ ID NO: 1650295 - RNA, 15 nt, Human
ugcaauuccacuuau

SEQ ID NO: 1650296 - RNA, 18 nt, Human
ucucagguguguugcagu

SEQ ID NO: 1650297 - RNA, 14 nt, Human
cugguggcucugug

SEQ ID NO: 1650298 - RNA, 10 nt, Human
agcuuugagg

SEQ ID NO: 1650299 - RNA, 22 nt, Human
auacuuuggccauuacccccag

SEQ ID NO: 1650300 - RNA, 16 nt, Human
caugucuagagaacac

SEQ ID NO: 1650301 - RNA, 23 nt, Human
caggaaucacuggcuguuaaucu

SEQ ID NO: 1650302 - RNA, 17 nt, Human
aaccuucugaggagcug

SEQ ID NO: 1650303 - RNA, 12 nt, Human
cacaacacacag

SEQ ID NO: 1650304 - RNA, 16 nt, Human
gaauauaaauuuauca

SEQ ID NO: 1650305 - RNA, 16 nt, Human
uaaaggaauuuaaaaa

SEQ ID NO: 1650306 - RNA, 23 nt, Human
acgaggauugggaaaaaguaauu

SEQ ID NO: 1650307 - RNA, 14 nt, Human
gcuggagcucugcc

SEQ ID NO: 1650308 - RNA, 20 nt, Human
ccagcuggccgggagccuga

SEQ ID NO: 1650309 - RNA, 20 nt, Human
aauaucuuuuuuuuaauaaa

SEQ ID NO: 1650310 - RNA, 21 nt, Human
aggaagggacacauaucaaac

SEQ ID NO: 1650311 - RNA, 13 nt, Human
cguugagccacca

SEQ ID NO: 1650312 - RNA, 23 nt, Human
auuauauggcuugaguuuaaauu

SEQ ID NO: 1650313 - RNA, 17 nt, Human
agaaaugaaagcaggga

SEQ ID NO: 1650314 - RNA, 19 nt, Human
acucugucucaguccauga

SEQ ID NO: 1650315 - RNA, 15 nt, Human
ccaucucaggugugu

SEQ ID NO: 1650316 - RNA, 15 nt, Human
ccagauccuggaaau

SEQ ID NO: 1650317 - RNA, 21 nt, Human
gacagaaagcagaacagugau

SEQ ID NO: 1650318 - RNA, 17 nt, Human
agugagacagcucugca

SEQ ID NO: 1650319 - RNA, 21 nt, Human
gcacuguggguagacacacau

SEQ ID NO: 1650320 - RNA, 20 nt, Human
uggaauaauccuaaacauau

SEQ ID NO: 1650321 - RNA, 17 nt, Human
uuucccuccuuggagac

SEQ ID NO: 1650322 - RNA, 17 nt, Human
aaagaaacauuugguaa

SEQ ID NO: 1650323 - RNA, 21 nt, Human
gccugaucaccugcccugcug

SEQ ID NO: 1650324 - RNA, 14 nt, Human
agggcuaauaucuu

SEQ ID NO: 1650325 - RNA, 17 nt, Human
gucaaagcugaaaugga

SEQ ID NO: 1650326 - RNA, 21 nt, Human
augaugcuuugagaacauacu

SEQ ID NO: 1650327 - RNA, 16 nt, Human
ccuggugggcagagag

SEQ ID NO: 1650328 - RNA, 22 nt, Human
uuguaacaagccuccuuuuaaa

SEQ ID NO: 1650329 - RNA, 12 nt, Human
acacuuaaaaau

SEQ ID NO: 1650330 - RNA, 14 nt, Human
cagugaaagaaaau

SEQ ID NO: 1650331 - RNA, 23 nt, Human
cuucaacucccugccccccagcc

SEQ ID NO: 1650332 - RNA, 22 nt, Human
uguaacugucuucuagcaguga

SEQ ID NO: 1650333 - RNA, 16 nt, Human
caggaaguagaggagg

SEQ ID NO: 1650334 - RNA, 14 nt, Human
guaacuaauuuuaa

SEQ ID NO: 1650335 - RNA, 16 nt, Human
uauaucaauuuaaaaa

SEQ ID NO: 1650336 - RNA, 17 nt, Human
cuauccuacuuccccuu

SEQ ID NO: 1650337 - RNA, 17 nt, Human
gaaguauaggccaggca

SEQ ID NO: 1650338 - RNA, 14 nt, Human
aggggcagcagugc

SEQ ID NO: 1650339 - RNA, 19 nt, Human
ccagaucuaugccacaaga

SEQ ID NO: 1650340 - RNA, 16 nt, Human
ccuaagugcagccccg

SEQ ID NO: 1650341 - RNA, 16 nt, Human
auaaugaauacuuuau

SEQ ID NO: 1650342 - RNA, 20 nt, Human
aaucuuucacaggggacagg

SEQ ID NO: 1650343 - RNA, 19 nt, Human
uuacagaaagauuugaugu

SEQ ID NO: 1650344 - RNA, 15 nt, Human
auaaaguguuugaaa

SEQ ID NO: 1650345 - RNA, 13 nt, Human
acagcccuucuuu

SEQ ID NO: 1650346 - RNA, 19 nt, Human
ccagccagggcaagagagc

SEQ ID NO: 1650347 - RNA, 15 nt, Human
agacaaggaaaaaau

SEQ ID NO: 1650348 - RNA, 21 nt, Human
caaagcccagcuugaaaccuu

SEQ ID NO: 1650349 - RNA, 16 nt, Human
aggccaugggacaggg

SEQ ID NO: 1650350 - RNA, 17 nt, Human
acaaaaggaauguguaa

SEQ ID NO: 1650351 - RNA, 16 nt, Human
agaauauauuuccuua

SEQ ID NO: 1650352 - RNA, 17 nt, Human
ucuuauaauuuaaaaua

SEQ ID NO: 1650353 - RNA, 22 nt, Human
agacucugucucaguccaugaa

SEQ ID NO: 1650354 - RNA, 14 nt, Human
ugcuguauuuuaaa

SEQ ID NO: 1650355 - RNA, 21 nt, Human
cccacuggacucaccuccccc

SEQ ID NO: 1650356 - RNA, 16 nt, Human
aauauaaauaaaaaua

SEQ ID NO: 1650357 - RNA, 15 nt, Human
uuagugaaauauuau

SEQ ID NO: 1650358 - RNA, 12 nt, Human
ucugcacacagc

SEQ ID NO: 1650359 - RNA, 16 nt, Human
cuuggagacagggccc

SEQ ID NO: 1650360 - RNA, 20 nt, Human
uuucuuccuggauuccucac

SEQ ID NO: 1650361 - RNA, 15 nt, Human
uuaaguauuuuauua

SEQ ID NO: 1650362 - RNA, 17 nt, Human
cguaaucguguccccua

SEQ ID NO: 1650363 - RNA, 17 nt, Human
ucuuuaucuuuuuagua

SEQ ID NO: 1650364 - RNA, 14 nt, Human
auaaaauaauuuuu

SEQ ID NO: 1650365 - RNA, 17 nt, Human
aaucuuauaauuuaaaa

SEQ ID NO: 1650366 - RNA, 22 nt, Human
gucacaggaaguagaggaggcc

SEQ ID NO: 1650367 - RNA, 14 nt, Human
cuuuuaguuuuuaa

SEQ ID NO: 1650368 - RNA, 18 nt, Human
uagaauauauuuccuuau

SEQ ID NO: 1650369 - RNA, 15 nt, Human
auauaucauagcaaa

SEQ ID NO: 1650370 - RNA, 21 nt, Human
gaaaaguauguuagugcaaau

SEQ ID NO: 1650371 - RNA, 14 nt, Human
uaaaauagugaaua

SEQ ID NO: 1650372 - RNA, 15 nt, Human
cugcuacuaucuguu

SEQ ID NO: 1650373 - RNA, 16 nt, Human
gagaacacugugcucu

SEQ ID NO: 1650374 - RNA, 19 nt, Human
gccuggucaacauagugag

SEQ ID NO: 1650375 - RNA, 18 nt, Human
caagcuaugugagcucac

SEQ ID NO: 1650376 - RNA, 16 nt, Human
guugagguaccuccaa

SEQ ID NO: 1650377 - RNA, 14 nt, Human
cuauuauauuucca

SEQ ID NO: 1650378 - RNA, 20 nt, Human
agcuuauugucuagugaaac

SEQ ID NO: 1650379 - RNA, 16 nt, Human
cagggacuugaaccca

SEQ ID NO: 1650380 - RNA, 15 nt, Human
agccugaaagaggaa

SEQ ID NO: 1650381 - RNA, 17 nt, Human
ggaacauuuauguuccu

SEQ ID NO: 1650382 - RNA, 17 nt, Human
agaacucccuuucaaca

SEQ ID NO: 1650383 - RNA, 13 nt, Human
aaguucaaaacuu

SEQ ID NO: 1650384 - RNA, 20 nt, Human
aagucaucugaugagaacaa

SEQ ID NO: 1650385 - RNA, 22 nt, Human
gaauaaccaacacccugagguu

SEQ ID NO: 1650386 - RNA, 15 nt, Human
augucuagagaacac

SEQ ID NO: 1650387 - RNA, 16 nt, Human
augggaacaaggaagg

SEQ ID NO: 1650388 - RNA, 15 nt, Human
aaucagagauaaagc

SEQ ID NO: 1650389 - RNA, 23 nt, Human
agcagcccuuagcccuuccccuc

SEQ ID NO: 1650390 - RNA, 21 nt, Human
aagacucgggauuaguacaca

SEQ ID NO: 1650391 - RNA, 21 nt, Human
uggggaauauguuagagaauu

SEQ ID NO: 1650392 - RNA, 16 nt, Human
auaucauagcaaauaa

SEQ ID NO: 1650393 - RNA, 18 nt, Human
ugaagaagcuagaaaaca

SEQ ID NO: 1650394 - RNA, 20 nt, Human
ucaaaacuucagacauagaa

SEQ ID NO: 1650395 - RNA, 23 nt, Human
uaagaaauaggaaauauuuuaau

SEQ ID NO: 1650396 - RNA, 18 nt, Human
uuauguuccuuuuaaaga

SEQ ID NO: 1650397 - RNA, 19 nt, Human
cccauggcacucuauguuc

SEQ ID NO: 1650398 - RNA, 18 nt, Human
acugugugcuaaaacaag

SEQ ID NO: 1650399 - RNA, 14 nt, Human
gccucagucucccu

SEQ ID NO: 1650400 - RNA, 13 nt, Human
acuuauuggaaug

SEQ ID NO: 1650401 - RNA, 17 nt, Human
caucgcagacacaugug

SEQ ID NO: 1650402 - RNA, 16 nt, Human
ucugcagauaaacagu

SEQ ID NO: 1650403 - RNA, 16 nt, Human
ccaccugcugagcccc

SEQ ID NO: 1650404 - RNA, 15 nt, Human
ucaaaggacaccauu

SEQ ID NO: 1650405 - RNA, 22 nt, Human
agccaaacauccuacaagacac

SEQ ID NO: 1650406 - RNA, 21 nt, Human
ccauccugccccugagcccau

SEQ ID NO: 1650407 - RNA, 22 nt, Human
gaugguucccuugaugaagaag

SEQ ID NO: 1650408 - RNA, 20 nt, Human
cagugaaagaaaauaacgau

SEQ ID NO: 1650409 - RNA, 16 nt, Human
acaccaaccuucugag

SEQ ID NO: 1650410 - RNA, 15 nt, Human
uacagaacuaaaaau

SEQ ID NO: 1650411 - RNA, 15 nt, Human
auacguuaggaggac

SEQ ID NO: 1650412 - RNA, 19 nt, Human
auagcuacuaauuuuaaaa

SEQ ID NO: 1650413 - RNA, 22 nt, Human
ucauucccguugaacgucacau

SEQ ID NO: 1650414 - RNA, 22 nt, Human
aggcuccacuuggucugugaga

SEQ ID NO: 1650415 - RNA, 18 nt, Human
gaauaauccuaaacauau

SEQ ID NO: 1650416 - RNA, 13 nt, Human
uucaaaaaaaaac

SEQ ID NO: 1650417 - RNA, 22 nt, Human
acacugucucuaccaaaaaaag

SEQ ID NO: 1650418 - RNA, 16 nt, Human
uagagaauuuccuuac

SEQ ID NO: 1650419 - RNA, 15 nt, Human
cuacaagacacagug

SEQ ID NO: 1650420 - RNA, 19 nt, Human
auuuucaguuauuauauuu

SEQ ID NO: 1650421 - RNA, 14 nt, Human
ucaauaaauaaaua

SEQ ID NO: 1650422 - RNA, 14 nt, Human
aaaggaauuuaaaa

SEQ ID NO: 1650423 - RNA, 17 nt, Human
aguuuauauagaaaugu

SEQ ID NO: 1650424 - RNA, 19 nt, Human
gcuggccuugugaggagcu

SEQ ID NO: 1650425 - RNA, 15 nt, Human
ucgaggcuacaguga

SEQ ID NO: 1650426 - RNA, 18 nt, Human
ggccacaucugagccccg

SEQ ID NO: 1650427 - RNA, 15 nt, Human
aagccuccuuuuaaa

SEQ ID NO: 1650428 - RNA, 21 nt, Human
aaaagguauuuuaaucaccaa

SEQ ID NO: 1650429 - RNA, 22 nt, Human
aagacccaaaaggcagaagcaa

SEQ ID NO: 1650430 - RNA, 14 nt, Human
ugagacucugucuc

SEQ ID NO: 1650431 - RNA, 20 nt, Human
caagccuccuuuuaaaguaa

SEQ ID NO: 1650432 - RNA, 12 nt, Human
gaagaccucauu

SEQ ID NO: 1650433 - RNA, 21 nt, Human
cuaccaaaaaucucaauauuu

SEQ ID NO: 1650434 - RNA, 20 nt, Human
acaugagguacugagaguga

SEQ ID NO: 1650435 - RNA, 13 nt, Human
uuauucacaagac

SEQ ID NO: 1650436 - RNA, 13 nt, Human
aggaaaaaauaac

SEQ ID NO: 1650437 - RNA, 21 nt, Human
ugucucuaccaaaaaaaggaa

SEQ ID NO: 1650438 - RNA, 12 nt, Human
cucauggaauug

SEQ ID NO: 1650439 - RNA, 18 nt, Human
guuuaugguuguauuauu

SEQ ID NO: 1650440 - RNA, 14 nt, Human
uaaauuuaucauuu

SEQ ID NO: 1650441 - RNA, 22 nt, Human
gugugaccacugcagaagacag

SEQ ID NO: 1650442 - RNA, 18 nt, Human
uaguaucaaaagaaagaa

SEQ ID NO: 1650443 - RNA, 19 nt, Human
cugacugcuaguuuauaua

SEQ ID NO: 1650444 - RNA, 19 nt, Human
auuuccuuauucagaauuu

SEQ ID NO: 1650445 - RNA, 21 nt, Human
augcuacaggauuugaaauug

SEQ ID NO: 1650446 - RNA, 20 nt, Human
caaacauccuacaagacaca

SEQ ID NO: 1650447 - RNA, 16 nt, Human
ugacuauuauauuucc

SEQ ID NO: 1650448 - RNA, 14 nt, Human
aaacugaaacaaaa

SEQ ID NO: 1650449 - RNA, 19 nt, Human
aaauaugccccauucaaca

SEQ ID NO: 1650450 - RNA, 17 nt, Human
ucuauguagaauauauu

SEQ ID NO: 1650451 - RNA, 16 nt, Human
ggaguuucucuagaag

SEQ ID NO: 1650452 - RNA, 22 nt, Human
cuucagccugaaagaggaauga

SEQ ID NO: 1650453 - RNA, 23 nt, Human
ggagcaucuccucaacucugagu

SEQ ID NO: 1650454 - RNA, 16 nt, Human
uacaaaugggaaacaa

SEQ ID NO: 1650455 - RNA, 15 nt, Human
uagagaauuuccuua

SEQ ID NO: 1650456 - RNA, 22 nt, Human
agcuaaugaaguguuuagcaua

SEQ ID NO: 1650457 - RNA, 20 nt, Human
uauuuauuacuguaagaaaa

SEQ ID NO: 1650458 - RNA, 18 nt, Human
ugaacuugguuuuaauua

SEQ ID NO: 1650459 - RNA, 18 nt, Human
cuuucacauuuaaauaaa

SEQ ID NO: 1650460 - RNA, 21 nt, Human
aauucauucacucaacaaaca

SEQ ID NO: 1650461 - RNA, 18 nt, Human
ucucuaggaaauauuuau

SEQ ID NO: 1650462 - RNA, 16 nt, Human
ucucuaccaaaaaaag

SEQ ID NO: 1650463 - RNA, 13 nt, Human
acaagagcuuaac

SEQ ID NO: 1650464 - RNA, 17 nt, Human
caagacccaaaaggcag

SEQ ID NO: 1650465 - RNA, 18 nt, Human
guauuauuuuuuaaaaaa

SEQ ID NO: 1650466 - RNA, 18 nt, Human
uguauucuuuuaguuuuu

SEQ ID NO: 1650467 - RNA, 19 nt, Human
ggagcuggaaacacauguu

SEQ ID NO: 1650468 - RNA, 17 nt, Human
gugggauacuauuuaau

SEQ ID NO: 1650469 - RNA, 22 nt, Human
gcuaaaacaagcacuaaacaaa

SEQ ID NO: 1650470 - RNA, 14 nt, Human
gaaagcagaacagu

SEQ ID NO: 1650471 - RNA, 16 nt, Human
uguucuaagaagugaa

SEQ ID NO: 1650472 - RNA, 23 nt, Human
uccaaacugacucuuaagaagac

SEQ ID NO: 1650473 - RNA, 14 nt, Human
aucuucagaaaacc

SEQ ID NO: 1650474 - RNA, 17 nt, Human
ucuggaggucucugaac

SEQ ID NO: 1650475 - RNA, 21 nt, Human
aauuaaguuuuuuuuuaaaaa

SEQ ID NO: 1650476 - RNA, 23 nt, Human
ugcagagguccacaacacacaga

SEQ ID NO: 1650477 - RNA, 16 nt, Human
ccacaagaacccccuu

SEQ ID NO: 1650478 - RNA, 22 nt, Human
aaaggaauguguaagucuuuaa

SEQ ID NO: 1650479 - RNA, 15 nt, Human
aaucucaauauuuca

SEQ ID NO: 1650480 - RNA, 22 nt, Human
cugggacaggggagaaccuagg

SEQ ID NO: 1650481 - RNA, 18 nt, Human
ugugcuggccaccugcug

SEQ ID NO: 1650482 - RNA, 18 nt, Human
cuaccaaaaaaaggaagg

SEQ ID NO: 1650483 - RNA, 11 nt, Human
ugggggcagca

SEQ ID NO: 1650484 - RNA, 19 nt, Human
aagcauuccaacuaucuca

SEQ ID NO: 1650485 - RNA, 15 nt, Human
gucucuacauaaaau

SEQ ID NO: 1650486 - RNA, 16 nt, Human
uucucuaggaaauauu

SEQ ID NO: 1650487 - RNA, 19 nt, Human
ugcacacagcacgggggcc

SEQ ID NO: 1650488 - RNA, 12 nt, Human
cuacagugagcc

SEQ ID NO: 1650489 - RNA, 14 nt, Human
ucuucagaaaaccu

SEQ ID NO: 1650490 - RNA, 19 nt, Human
gauaaagcuuaggucaaag

SEQ ID NO: 1650491 - RNA, 17 nt, Human
agacagugaaagaaaau

SEQ ID NO: 1650492 - RNA, 18 nt, Human
aaagagugaaggauuuau

SEQ ID NO: 1650493 - RNA, 15 nt, Human
ucuaugaaauauuau

SEQ ID NO: 1650494 - RNA, 19 nt, Human
aaugaauggcuaagcaaaa

SEQ ID NO: 1650495 - RNA, 23 nt, Human
ucaauaucuuuuuuuuaauaaac

SEQ ID NO: 1650496 - RNA, 15 nt, Human
cgagacccugucuca

SEQ ID NO: 1650497 - RNA, 13 nt, Human
uacuuuauuuucu

SEQ ID NO: 1650498 - RNA, 19 nt, Human
ggaaaaaauaacaaugaaa

SEQ ID NO: 1650499 - RNA, 18 nt, Human
ccacaucugagccccgaa

SEQ ID NO: 1650500 - RNA, 20 nt, Human
caucccuagaaagccaugug

SEQ ID NO: 1650501 - RNA, 15 nt, Human
gcacuacuguacucc

SEQ ID NO: 1650502 - RNA, 18 nt, Human
uuacaaaugggaaacaaa

SEQ ID NO: 1650503 - RNA, 20 nt, Human
auauguuagagaauuuccuu

SEQ ID NO: 1650504 - RNA, 16 nt, Human
ugacaagcucacagac

SEQ ID NO: 1650505 - RNA, 12 nt, Human
aagagcuuaaca

SEQ ID NO: 1650506 - RNA, 14 nt, Human
uuucuguuaaaaua

SEQ ID NO: 1650507 - RNA, 18 nt, Human
caaacuuuacagaaagau

SEQ ID NO: 1650508 - RNA, 20 nt, Human
uuguaggugacuauuauauu

SEQ ID NO: 1650509 - RNA, 22 nt, Human
cgaggugggcagaucacuugag

SEQ ID NO: 1650510 - RNA, 12 nt, Human
guauaggccagg

SEQ ID NO: 1650511 - RNA, 16 nt, Human
uuguaaaggaauuuaa

SEQ ID NO: 1650512 - RNA, 22 nt, Human
aaauguugacaugggacauuug

SEQ ID NO: 1650513 - RNA, 15 nt, Human
uggaaacgaagcacc

SEQ ID NO: 1650514 - RNA, 14 nt, Human
uaaauaaaaauaau

SEQ ID NO: 1650515 - RNA, 19 nt, Human
cccugcaaagcccagcuug

SEQ ID NO: 1650516 - RNA, 23 nt, Human
ggauguggggaaguuaggaacug

SEQ ID NO: 1650517 - RNA, 18 nt, Human
uggagggaagccuugggg

SEQ ID NO: 1650518 - RNA, 13 nt, Human
aguguuugaaagc

SEQ ID NO: 1650519 - RNA, 20 nt, Human
aguuuuuuuuuaaaaaagaa

SEQ ID NO: 1650520 - RNA, 13 nt, Human
uaaaaguuuaagu

SEQ ID NO: 1650521 - RNA, 19 nt, Human
ucucaaggagaggcaaaga

SEQ ID NO: 1650522 - RNA, 14 nt, Human
ucagucucccuccc

SEQ ID NO: 1650523 - RNA, 19 nt, Human
cucugccucagaaaacaag

SEQ ID NO: 1650524 - RNA, 17 nt, Human
guggggcuaaggcagga

SEQ ID NO: 1650525 - RNA, 19 nt, Human
ucaguuauuauauuuacaa

SEQ ID NO: 1650526 - RNA, 19 nt, Human
uauauuuccaagaaauauu

SEQ ID NO: 1650527 - RNA, 22 nt, Human
uguugcccacagcuguaugauu

SEQ ID NO: 1650528 - RNA, 16 nt, Human
uggcaagcucuaucac

SEQ ID NO: 1650529 - RNA, 19 nt, Human
caguccauugggcaggcag

SEQ ID NO: 1650530 - RNA, 17 nt, Human
ucgcagacacaugugcu

SEQ ID NO: 1650531 - RNA, 13 nt, Human
uuuaaaaaaaaac

SEQ ID NO: 1650532 - RNA, 19 nt, Human
cuagucuguuuucccuccu

SEQ ID NO: 1650533 - RNA, 14 nt, Human
caauugacuauagu

SEQ ID NO: 1650534 - RNA, 13 nt, Human
aaauaaaaauaau

SEQ ID NO: 1650535 - RNA, 21 nt, Human
aaauaauuuuuauauuugaaa

SEQ ID NO: 1650536 - RNA, 21 nt, Human
ugagcucagcccuggugggca

SEQ ID NO: 1650537 - RNA, 13 nt, Human
uuuaaaaauccua

SEQ ID NO: 1650538 - RNA, 13 nt, Human
uaccccuggccaa

SEQ ID NO: 1650539 - RNA, 19 nt, Human
acucugcaagaagaaauca

SEQ ID NO: 1650540 - RNA, 13 nt, Human
agcuaaauauaua

SEQ ID NO: 1650541 - RNA, 12 nt, Human
ugagagacacac

SEQ ID NO: 1650542 - RNA, 15 nt, Human
gucccaggcugagcc

SEQ ID NO: 1650543 - RNA, 11 nt, Human
caacucccugc

SEQ ID NO: 1650544 - RNA, 13 nt, Human
auugucuagugaa

SEQ ID NO: 1650545 - RNA, 15 nt, Human
aguuuauauagaaau

SEQ ID NO: 1650546 - RNA, 16 nt, Human
agagguccacaacaca

SEQ ID NO: 1650547 - RNA, 20 nt, Human
caaacugccaucauuuacuu

SEQ ID NO: 1650548 - RNA, 12 nt, Human
auagcaaauaag

SEQ ID NO: 1650549 - RNA, 21 nt, Human
aagauauuaacugagaaggcu

SEQ ID NO: 1650550 - RNA, 14 nt, Human
uugcuggagcucug

SEQ ID NO: 1650551 - RNA, 21 nt, Human
aaacgaggauugggaaaaagu

SEQ ID NO: 1650552 - RNA, 13 nt, Human
agacacugucucu

SEQ ID NO: 1650553 - RNA, 14 nt, Human
cagccaccagucca

SEQ ID NO: 1650554 - RNA, 16 nt, Human
aggguguguaaguaga

SEQ ID NO: 1650555 - RNA, 12 nt, Human
gcuaaggcagga

SEQ ID NO: 1650556 - RNA, 16 nt, Human
uauguucuaagaagug

SEQ ID NO: 1650557 - RNA, 23 nt, Human
caggcacaguggcucacaccugu

SEQ ID NO: 1650558 - RNA, 20 nt, Human
uuauucacuguauguccuug

SEQ ID NO: 1650559 - RNA, 20 nt, Human
uaugaaaaggcuaagcuuca

SEQ ID NO: 1650560 - RNA, 16 nt, Human
cccacuggacucaccu

SEQ ID NO: 1650561 - RNA, 14 nt, Human
auaaauaaauaaaa

SEQ ID NO: 1650562 - RNA, 13 nt, Human
cccuccuuaucaa

SEQ ID NO: 1650563 - RNA, 14 nt, Human
cucaccagucccuc

SEQ ID NO: 1650564 - RNA, 21 nt, Human
agcccuucuuuccacagaagc

SEQ ID NO: 1650565 - RNA, 18 nt, Human
aaaaguucugcagauaaa

SEQ ID NO: 1650566 - RNA, 22 nt, Human
caccucccccaucucuucuggg

SEQ ID NO: 1650567 - RNA, 19 nt, Human
acagugauuaccagggacu

SEQ ID NO: 1650568 - RNA, 21 nt, Human
cccccucuggcuccagcuggc

SEQ ID NO: 1650569 - RNA, 14 nt, Human
ugacuauuauauuu

SEQ ID NO: 1650570 - RNA, 15 nt, Human
uccuacaagacacag

SEQ ID NO: 1650571 - RNA, 18 nt, Human
gagcgacagugagacucu

SEQ ID NO: 1650572 - RNA, 16 nt, Human
ucuuauaauuuaaaau

SEQ ID NO: 1650573 - RNA, 22 nt, Human
gaaaggaaguauaggccaggca

SEQ ID NO: 1650574 - RNA, 12 nt, Human
aauaaaguacaa

SEQ ID NO: 1650575 - RNA, 21 nt, Human
uguccucaugagggcuggaug

SEQ ID NO: 1650576 - RNA, 16 nt, Human
ugagcucagcccuggu

SEQ ID NO: 1650577 - RNA, 14 nt, Human
cucaacaaacauaa

SEQ ID NO: 1650578 - RNA, 22 nt, Human
gacacaugugcuggccaccugc

SEQ ID NO: 1650579 - RNA, 12 nt, Human
cccucugcagcu

SEQ ID NO: 1650580 - RNA, 21 nt, Human
auuccuuuuucucuccucucc

SEQ ID NO: 1650581 - RNA, 13 nt, Human
ugagcgacaguga

SEQ ID NO: 1650582 - RNA, 17 nt, Human
cgauaaaagacagugaa

SEQ ID NO: 1650583 - RNA, 18 nt, Human
aagaaauaggaaauauuu

SEQ ID NO: 1650584 - RNA, 23 nt, Human
cacagauuugagcucagcccugg

SEQ ID NO: 1650585 - RNA, 13 nt, Human
agagauaaagcuu

SEQ ID NO: 1650586 - RNA, 16 nt, Human
gacaaggaaaaaauaa

SEQ ID NO: 1650587 - RNA, 14 nt, Human
ugaggcuacagaac

SEQ ID NO: 1650588 - RNA, 14 nt, Human
uguauucuuuuagu

SEQ ID NO: 1650589 - RNA, 19 nt, Human
uuccucccuucucuucaca

SEQ ID NO: 1650590 - RNA, 20 nt, Human
aauuaaguuuuuuuuuaaaa

SEQ ID NO: 1650591 - RNA, 15 nt, Human
acucaccucccccau

SEQ ID NO: 1650592 - RNA, 13 nt, Human
gcucucuggccuu

SEQ ID NO: 1650593 - RNA, 18 nt, Human
cugaugggcaaaaaacca

SEQ ID NO: 1650594 - RNA, 14 nt, Human
ugguauguuuucag

SEQ ID NO: 1650595 - RNA, 21 nt, Human
ugcccauccugccccugagcc

SEQ ID NO: 1650596 - RNA, 22 nt, Human
aaagagugaaggauuuauguuu

SEQ ID NO: 1650597 - RNA, 17 nt, Human
ccaaggaugccccgucc

SEQ ID NO: 1650598 - RNA, 21 nt, Human
acugccaaaacaucaaccugc

SEQ ID NO: 1650599 - RNA, 20 nt, Human
auguuucuuggggaauaugu

SEQ ID NO: 1650600 - RNA, 14 nt, Human
uugauggaaauaca

SEQ ID NO: 1650601 - RNA, 11 nt, Human
uuauauuuauu

SEQ ID NO: 1650602 - RNA, 20 nt, Human
uuuuaaagaaacaaaaauca

SEQ ID NO: 1650603 - RNA, 19 nt, Human
agccugaucaccugcccug

SEQ ID NO: 1650604 - RNA, 15 nt, Human
augucugaaauggaa

SEQ ID NO: 1650605 - RNA, 12 nt, Human
guaaaggcaaac

SEQ ID NO: 1650606 - RNA, 23 nt, Human
uuuauaugcuucuguuuuauaau

SEQ ID NO: 1650607 - RNA, 14 nt, Human
gagagugaacaaau

SEQ ID NO: 1650608 - RNA, 19 nt, Human
gagcucaccagucccuccc

SEQ ID NO: 1650609 - RNA, 17 nt, Human
aaaauuagaaauguaau

SEQ ID NO: 1650610 - RNA, 17 nt, Human
ucagacauagaauuaac

SEQ ID NO: 1650611 - RNA, 15 nt, Human
augguuguauuauuu

SEQ ID NO: 1650612 - RNA, 23 nt, Human
agcaugucgucaaagcugaaaug

SEQ ID NO: 1650613 - RNA, 14 nt, Human
aaauaaaaacaaag

SEQ ID NO: 1650614 - RNA, 20 nt, Human
ccugccuaagugcagccccg

SEQ ID NO: 1650615 - RNA, 20 nt, Human
guauuauuuuuuaaaaaaau

SEQ ID NO: 1650616 - RNA, 10 nt, Human
auguuuucag

SEQ ID NO: 1650617 - RNA, 15 nt, Human
acaggguuuauguuu

SEQ ID NO: 1650618 - RNA, 18 nt, Human
ucaggaaagagagcacca

SEQ ID NO: 1650619 - RNA, 18 nt, Human
gaaauacguuaggaggac

SEQ ID NO: 1650620 - RNA, 15 nt, Human
gaagauguagaggag

SEQ ID NO: 1650621 - RNA, 18 nt, Human
aauuuuagacauucuuua

SEQ ID NO: 1650622 - RNA, 19 nt, Human
cggccuccauccugaggcu

SEQ ID NO: 1650623 - RNA, 18 nt, Human
aaggagaggcaaagaaag

SEQ ID NO: 1650624 - RNA, 23 nt, Human
auuuauguuccuuuuaaagaaac

SEQ ID NO: 1650625 - RNA, 22 nt, Human
accuuaucuauguagaauauau

SEQ ID NO: 1650626 - RNA, 21 nt, Human
ggaagacaagaaggaaagauu

SEQ ID NO: 1650627 - RNA, 16 nt, Human
gcagugucugcuggag

SEQ ID NO: 1650628 - RNA, 18 nt, Human
cugcucaauaaaguacaa

SEQ ID NO: 1650629 - RNA, 22 nt, Human
aaguggaacgagacaagcagcc

SEQ ID NO: 1650630 - RNA, 20 nt, Human
auaacaaugcuguauuuuaa

SEQ ID NO: 1650631 - RNA, 13 nt, Human
acuauuauauuuc

SEQ ID NO: 1650632 - RNA, 21 nt, Human
gauguggggaaguuaggaacu

SEQ ID NO: 1650633 - RNA, 22 nt, Human
cuuaucuauguagaauauauuu

SEQ ID NO: 1650634 - RNA, 13 nt, Human
caugguggugugu

SEQ ID NO: 1650635 - RNA, 16 nt, Human
auccaaugaaaugagu

SEQ ID NO: 1650636 - RNA, 19 nt, Human
guggauuuaauguggaaau

SEQ ID NO: 1650637 - RNA, 18 nt, Human
uaauuauguucuaagugc

SEQ ID NO: 1650638 - RNA, 18 nt, Human
ugcccauaccccuggcca

SEQ ID NO: 1650639 - RNA, 22 nt, Human
agacccacuggacucaccuccc

SEQ ID NO: 1650640 - RNA, 13 nt, Human
aagcuucuguucc

SEQ ID NO: 1650641 - RNA, 14 nt, Human
cccugccucaagcu

SEQ ID NO: 1650642 - RNA, 19 nt, Human
ucagguguguugcaguguc

SEQ ID NO: 1650643 - RNA, 21 nt, Human
gugcucuauuaccauuaugga

SEQ ID NO: 1650644 - RNA, 12 nt, Human
cauuauauuuau

SEQ ID NO: 1650645 - RNA, 19 nt, Human
agucaaauugugugaaagg

SEQ ID NO: 1650646 - RNA, 24 nt, Human
uggccgggagccugaucaccugcc

SEQ ID NO: 1650647 - RNA, 17 nt, Human
uccucacuuugaagagu

SEQ ID NO: 1650648 - RNA, 18 nt, Human
uggcuguuaaucuuucaa

SEQ ID NO: 1650649 - RNA, 20 nt, Human
aggugggcagaucacuugag

SEQ ID NO: 1650650 - RNA, 13 nt, Human
caacucccugccc

SEQ ID NO: 1650651 - RNA, 16 nt, Human
auugucuagugaaacu

SEQ ID NO: 1650652 - RNA, 20 nt, Human
uguaauaggcguaacuaauu

SEQ ID NO: 1650653 - RNA, 14 nt, Human
uugaaauuguauua

SEQ ID NO: 1650654 - RNA, 13 nt, Human
ccaaggaugcccc

SEQ ID NO: 1650655 - RNA, 18 nt, Human
aagggaauuucuucaacu

SEQ ID NO: 1650656 - RNA, 15 nt, Human
ugcagccaccagucc

SEQ ID NO: 1650657 - RNA, 15 nt, Human
aucaauuuaaaaaaa

SEQ ID NO: 1650658 - RNA, 23 nt, Human
ucccuagaaagccaugugcagcc

SEQ ID NO: 1650659 - RNA, 18 nt, Human
aggaaguauaggccaggc

SEQ ID NO: 1650660 - RNA, 22 nt, Human
aauuguaggugacuauuauauu

SEQ ID NO: 1650661 - RNA, 13 nt, Human
uauuuaauuauuu

SEQ ID NO: 1650662 - RNA, 23 nt, Human
cuagucuguuuucccuccuugga

SEQ ID NO: 1650663 - RNA, 16 nt, Human
ggcugagccucagucu

SEQ ID NO: 1650664 - RNA, 14 nt, Human
uuuuauaagaaaua

SEQ ID NO: 1650665 - RNA, 22 nt, Human
aaacguauucaaacaauuugaa

SEQ ID NO: 1650666 - RNA, 23 nt, Human
uuauagcuacuaauuuuaaaaug

SEQ ID NO: 1650667 - RNA, 14 nt, Human
gcugguggcucugu

SEQ ID NO: 1650668 - RNA, 16 nt, Human
cauuucuaaagccauu

SEQ ID NO: 1650669 - RNA, 22 nt, Human
auaucaaacugaaacaaaauua

SEQ ID NO: 1650670 - RNA, 21 nt, Human
gcaaaauuuuuucucuaggaa

SEQ ID NO: 1650671 - RNA, 16 nt, Human
ucaucaaugaaugaau

SEQ ID NO: 1650672 - RNA, 13 nt, Human
uuuugaaucauca

SEQ ID NO: 1650673 - RNA, 19 nt, Human
auuagaaauguaauuaugu

SEQ ID NO: 1650674 - RNA, 16 nt, Human
gucucaauaaauaaau

SEQ ID NO: 1650675 - RNA, 20 nt, Human
auucccagccagcacagccu

SEQ ID NO: 1650676 - RNA, 14 nt, Human
auguagaauauauu

SEQ ID NO: 1650677 - RNA, 21 nt, Human
cuguguccucaugagggcugg

SEQ ID NO: 1650678 - RNA, 20 nt, Human
uggccacacaggaucuuuug

SEQ ID NO: 1650679 - RNA, 23 nt, Human
auuuuauagcuacuaauuuuaaa

SEQ ID NO: 1650680 - RNA, 21 nt, Human
ccggccuuugcaccuccaugg

SEQ ID NO: 1650681 - RNA, 21 nt, Human
ucacagaaugacugacaaaga

SEQ ID NO: 1650682 - RNA, 16 nt, Human
acaaggaugaauuaag

SEQ ID NO: 1650683 - RNA, 22 nt, Human
uuugaugcuacaggauuugaaa

SEQ ID NO: 1650684 - RNA, 18 nt, Human
ucuucaacucccugcccc

SEQ ID NO: 1650685 - RNA, 17 nt, Human
ccacugcagaagacagu

SEQ ID NO: 1650686 - RNA, 17 nt, Human
caccucccccaucucuu

SEQ ID NO: 1650687 - RNA, 21 nt, Human
uccagccuucucucaaggaga

SEQ ID NO: 1650688 - RNA, 20 nt, Human
auaucauagcaaauaaguca

SEQ ID NO: 1650689 - RNA, 22 nt, Human
auauaaauaaaaauaauccuca

SEQ ID NO: 1650690 - RNA, 16 nt, Human
auccuugaagauuuac

SEQ ID NO: 1650691 - RNA, 14 nt, Human
agacacugucucua

SEQ ID NO: 1650692 - RNA, 15 nt, Human
agggcucacagaauu

SEQ ID NO: 1650693 - RNA, 16 nt, Human
gaagauguagaggaga

SEQ ID NO: 1650694 - RNA, 13 nt, Human
ugaaauuguauua

SEQ ID NO: 1650695 - RNA, 20 nt, Human
gcccacucugcaagaagaaa

SEQ ID NO: 1650696 - RNA, 17 nt, Human
uaacgauaaaagacagu

SEQ ID NO: 1650697 - RNA, 20 nt, Human
agagacacacugaagaagca

SEQ ID NO: 1650698 - RNA, 23 nt, Human
gggaaacaaaaggauaaugaaua

SEQ ID NO: 1650699 - RNA, 16 nt, Human
ugacacuuaaaaaugg

SEQ ID NO: 1650700 - RNA, 19 nt, Human
gcuccagugauaagagaug

SEQ ID NO: 1650701 - RNA, 20 nt, Human
agaggagaaacuggaacucu

SEQ ID NO: 1650702 - RNA, 14 nt, Human
cgugcuugucccug

SEQ ID NO: 1650703 - RNA, 17 nt, Human
gccccccagcccuccuu

SEQ ID NO: 1650704 - RNA, 11 nt, Human
caauaaaagac

SEQ ID NO: 1650705 - RNA, 19 nt, Human
aaugagcacgcauggaaaa

SEQ ID NO: 1650706 - RNA, 19 nt, Human
acugccaucauuuacuuuu

SEQ ID NO: 1650707 - RNA, 13 nt, Human
uaaacauguuuau

SEQ ID NO: 1650708 - RNA, 21 nt, Human
uaaaagacagugaaagaaaau

SEQ ID NO: 1650709 - RNA, 15 nt, Human
uuaauuuguaguguu

SEQ ID NO: 1650710 - RNA, 16 nt, Human
cacuggacucaccucc

SEQ ID NO: 1650711 - RNA, 21 nt, Human
cuggaaacacauguuccccuu

SEQ ID NO: 1650712 - RNA, 23 nt, Human
aauaauccucaguuuuugugaaa

SEQ ID NO: 1650713 - RNA, 13 nt, Human
uuaaauuguaaua

SEQ ID NO: 1650714 - RNA, 17 nt, Human
uucugagcauuuaauau

SEQ ID NO: 1650715 - RNA, 13 nt, Human
aaaggaaggaagg

SEQ ID NO: 1650716 - RNA, 16 nt, Human
aggaggacaaaaggaa

SEQ ID NO: 1650717 - RNA, 16 nt, Human
gccaaggaugccccgu

SEQ ID NO: 1650718 - RNA, 22 nt, Human
aagagccuuuuuuugaaaaaaa

SEQ ID NO: 1650719 - RNA, 13 nt, Human
guuuaaguucuau

SEQ ID NO: 1650720 - RNA, 15 nt, Human
ggccauuacccccag

SEQ ID NO: 1650721 - RNA, 18 nt, Human
aaggaugccccguccccc

SEQ ID NO: 1650722 - RNA, 21 nt, Human
uuguuuuucagcguuaaugua

SEQ ID NO: 1650723 - RNA, 13 nt, Human
uaaauaaauaaau

SEQ ID NO: 1650724 - RNA, 14 nt, Human
acuuggucugugag

SEQ ID NO: 1650725 - RNA, 20 nt, Human
uaauaaguugcauagguuua

SEQ ID NO: 1650726 - RNA, 19 nt, Human
cuggacucaccucccccau

SEQ ID NO: 1650727 - RNA, 18 nt, Human
uguugcagugucugcugg

SEQ ID NO: 1650728 - RNA, 16 nt, Human
uauaugucacuuugcu

SEQ ID NO: 1650729 - RNA, 18 nt, Human
ccucaagcuaugugagcu

SEQ ID NO: 1650730 - RNA, 22 nt, Human
aauuuaaaaaaaaaccugagcc

SEQ ID NO: 1650731 - RNA, 14 nt, Human
cagauuugagcuca

SEQ ID NO: 1650732 - RNA, 13 nt, Human
acuaauuuuaaaa

SEQ ID NO: 1650733 - RNA, 16 nt, Human
auacuauuuaauuauu

SEQ ID NO: 1650734 - RNA, 17 nt, Human
cuggagggaagccuugg

SEQ ID NO: 1650735 - RNA, 18 nt, Human
gcaggaggaucacuugag

SEQ ID NO: 1650736 - RNA, 15 nt, Human
ugccccccagcccuc

SEQ ID NO: 1650737 - RNA, 21 nt, Human
uuggaaggcugaggcaggagg

SEQ ID NO: 1650738 - RNA, 14 nt, Human
uucuaugaaauauu

SEQ ID NO: 1650739 - RNA, 17 nt, Human
uaauuccacagcugcuc

SEQ ID NO: 1650740 - RNA, 17 nt, Human
gaaugagagacacacug

SEQ ID NO: 1650741 - RNA, 15 nt, Human
aucaaaggacaccau

SEQ ID NO: 1650742 - RNA, 18 nt, Human
gucuucuagcagugagcc

SEQ ID NO: 1650743 - RNA, 20 nt, Human
aguuguuucuacuacaugga

SEQ ID NO: 1650744 - RNA, 15 nt, Human
ccucauguccacugg

SEQ ID NO: 1650745 - RNA, 17 nt, Human
uugcaguuuuuuccuag

SEQ ID NO: 1650746 - RNA, 19 nt, Human
agaucacuugagcucagga

SEQ ID NO: 1650747 - RNA, 13 nt, Human
aacucuauaaugu

SEQ ID NO: 1650748 - RNA, 18 nt, Human
acauuugcucauggaauu

SEQ ID NO: 1650749 - RNA, 15 nt, Human
cgggagccugaucac

SEQ ID NO: 1650750 - RNA, 16 nt, Human
auuucaaaaaaaaacc

SEQ ID NO: 1650751 - RNA, 19 nt, Human
gcugaugggcaaaaaacca

SEQ ID NO: 1650752 - RNA, 16 nt, Human
cagcuuuccucaaaac

SEQ ID NO: 1650753 - RNA, 22 nt, Human
gauaaaagacagugaaagaaaa

SEQ ID NO: 1650754 - RNA, 20 nt, Human
ugagcgcccacuagacccac

SEQ ID NO: 1650755 - RNA, 22 nt, Human
aacugcccacucugcaagaaga

SEQ ID NO: 1650756 - RNA, 21 nt, Human
auuuuccugaaaacccuugcc

SEQ ID NO: 1650757 - RNA, 17 nt, Human
acucugcaagaagaaau

SEQ ID NO: 1650758 - RNA, 17 nt, Human
ucuauaauguguucauu

SEQ ID NO: 1650759 - RNA, 18 nt, Human
acugacucuuaagaagac

SEQ ID NO: 1650760 - RNA, 14 nt, Human
guccacaaguaaaa

SEQ ID NO: 1650761 - RNA, 19 nt, Human
uaccuccaaggaccggccu

SEQ ID NO: 1650762 - RNA, 16 nt, Human
cugcugagucccaggc

SEQ ID NO: 1650763 - RNA, 17 nt, Human
auuuuaauaauguuuca

SEQ ID NO: 1650764 - RNA, 21 nt, Human
ugcucaauaaaguacaagagc

SEQ ID NO: 1650765 - RNA, 21 nt, Human
gccuuuucccaacuccagaaa

SEQ ID NO: 1650766 - RNA, 11 nt, Human
gaguuucucua

SEQ ID NO: 1650767 - RNA, 15 nt, Human
acugaagaagcacca

SEQ ID NO: 1650768 - RNA, 18 nt, Human
ggccuugugaggagcugg

SEQ ID NO: 1650769 - RNA, 22 nt, Human
aaauaacaaugaaaguugauaa

SEQ ID NO: 1650770 - RNA, 19 nt, Human
acccccagcuuugaggaaa

SEQ ID NO: 1650771 - RNA, 16 nt, Human
cugagccucagucucc

SEQ ID NO: 1650772 - RNA, 19 nt, Human
auaaaagacagugaaagaa

SEQ ID NO: 1650773 - RNA, 15 nt, Human
agcagugccaaaaua

SEQ ID NO: 1650774 - RNA, 20 nt, Human
cuuauucacaagacccaaaa

SEQ ID NO: 1650775 - RNA, 12 nt, Human
gaauuggagcuc

SEQ ID NO: 1650776 - RNA, 20 nt, Human
gcagagaugaggccgccaug

SEQ ID NO: 1650777 - RNA, 16 nt, Human
ugaaguccaagcauuu

SEQ ID NO: 1650778 - RNA, 18 nt, Human
aaaaucuuauaauuuaaa

SEQ ID NO: 1650779 - RNA, 16 nt, Human
uggggauagugaggca

SEQ ID NO: 1650780 - RNA, 12 nt, Human
ccccuugccaua

SEQ ID NO: 1650781 - RNA, 21 nt, Human
cccccauuguggucacaggaa

SEQ ID NO: 1650782 - RNA, 14 nt, Human
ccucagucucccuc

SEQ ID NO: 1650783 - RNA, 17 nt, Human
agcgacagugagacucu

SEQ ID NO: 1650784 - RNA, 19 nt, Human
ccaccugccuauauuuuuu

SEQ ID NO: 1650785 - RNA, 16 nt, Human
cugucucuaccaaaaa

SEQ ID NO: 1650786 - RNA, 22 nt, Human
uuuccaagcaaguauuagaaua

SEQ ID NO: 1650787 - RNA, 16 nt, Human
uaggaaauauuuuaau

SEQ ID NO: 1650788 - RNA, 16 nt, Human
aacaauuugaauauaa

SEQ ID NO: 1650789 - RNA, 20 nt, Human
acuucuuaggguuaugauua

SEQ ID NO: 1650790 - RNA, 19 nt, Human
cagauccccaagccuggca

SEQ ID NO: 1650791 - RNA, 17 nt, Human
ucugugagaugcuagaa

SEQ ID NO: 1650792 - RNA, 18 nt, Human
caaggcuagaaccaccug

SEQ ID NO: 1650793 - RNA, 19 nt, Human
caaggaugccccguccccc

SEQ ID NO: 1650794 - RNA, 20 nt, Human
uaaaagacagugaaagaaaa

SEQ ID NO: 1650795 - RNA, 17 nt, Human
uaucuuuuuuuuaauaa

SEQ ID NO: 1650796 - RNA, 14 nt, Human
gugagcuacaaaug

SEQ ID NO: 1650797 - RNA, 13 nt, Human
aagaaaauaacga

SEQ ID NO: 1650798 - RNA, 14 nt, Human
gaaacgaagcacca

SEQ ID NO: 1650799 - RNA, 19 nt, Human
ugcuauuugcuguuauuuu

SEQ ID NO: 1650800 - RNA, 20 nt, Human
auacugugugcuaaaacaag

SEQ ID NO: 1650801 - RNA, 21 nt, Human
uguauaaaauaauuuuuauau

SEQ ID NO: 1650802 - RNA, 15 nt, Human
aaauaauuuuuauau

SEQ ID NO: 1650803 - RNA, 22 nt, Human
cugaggcuccacuuggucugug

SEQ ID NO: 1650804 - RNA, 19 nt, Human
uccuauaauuuuagacauu

SEQ ID NO: 1650805 - RNA, 17 nt, Human
gucucagcuucacccug

SEQ ID NO: 1650806 - RNA, 12 nt, Human
augaccaacauc

SEQ ID NO: 1650807 - RNA, 14 nt, Human
auacaaaaaaaaaa

SEQ ID NO: 1650808 - RNA, 15 nt, Human
uacuaauuuuaaaau

SEQ ID NO: 1650809 - RNA, 21 nt, Human
ucccuggggcuuuaacuccug

SEQ ID NO: 1650810 - RNA, 16 nt, Human
caaguaaaaggaaaug

SEQ ID NO: 1650811 - RNA, 13 nt, Human
auaaaaauauaua

SEQ ID NO: 1650812 - RNA, 21 nt, Human
uaguauuucuaugaaauauua

SEQ ID NO: 1650813 - RNA, 14 nt, Human
aaugauuaugaauu

SEQ ID NO: 1650814 - RNA, 20 nt, Human
ggaaggcugaggcaggagga

SEQ ID NO: 1650815 - RNA, 15 nt, Human
aaauauaaucagaga

SEQ ID NO: 1650816 - RNA, 21 nt, Human
guccccuauccuacuuccccu

SEQ ID NO: 1650817 - RNA, 17 nt, Human
ugaaauauuauuuuaua

SEQ ID NO: 1650818 - RNA, 21 nt, Human
acaagaaggaaagauuuuguu

SEQ ID NO: 1650819 - RNA, 15 nt, Human
aauaaauaaauaaaa

SEQ ID NO: 1650820 - RNA, 13 nt, Human
acaucaggaaaga

SEQ ID NO: 1650821 - RNA, 18 nt, Human
gcuacagugagccaagag

SEQ ID NO: 1650822 - RNA, 13 nt, Human
uucuauaauuuaa

SEQ ID NO: 1650823 - RNA, 19 nt, Human
uuuauaucaauuuaaaaaa

SEQ ID NO: 1650824 - RNA, 12 nt, Human
auuuaucauuua

SEQ ID NO: 1650825 - RNA, 15 nt, Human
cagucucccucccuu

SEQ ID NO: 1650826 - RNA, 12 nt, Human
cuacauaaaaua

SEQ ID NO: 1650827 - RNA, 19 nt, Human
guacaagagcuuaacagug

SEQ ID NO: 1650828 - RNA, 14 nt, Human
agucugacuguuuc

SEQ ID NO: 1650829 - RNA, 14 nt, Human
acccugaggugagc

SEQ ID NO: 1650830 - RNA, 16 nt, Human
uaccccuggccaagga

SEQ ID NO: 1650831 - RNA, 23 nt, Human
uuagaugcaguucugaagaagau

SEQ ID NO: 1650832 - RNA, 19 nt, Human
cccugccccccagcccucc

SEQ ID NO: 1650833 - RNA, 16 nt, Human
ucuuggucucaguguc

SEQ ID NO: 1650834 - RNA, 20 nt, Human
gaaggcugaggcaggaggau

SEQ ID NO: 1650835 - RNA, 23 nt, Human
uagauguauagguugaugguggu

SEQ ID NO: 1650836 - RNA, 17 nt, Human
ugguucccuugaugaag

SEQ ID NO: 1650837 - RNA, 15 nt, Human
caaaaaaaggaagga

SEQ ID NO: 1650838 - RNA, 19 nt, Human
aaaagacagugaaagaaaa

SEQ ID NO: 1650839 - RNA, 12 nt, Human
cagauuuuccug

SEQ ID NO: 1650840 - RNA, 20 nt, Human
acagcccuucuuuccacaga

SEQ ID NO: 1650841 - RNA, 16 nt, Human
auuugaugcuacagga

SEQ ID NO: 1650842 - RNA, 21 nt, Human
cuggguuuuggggggacgcua

SEQ ID NO: 1650843 - RNA, 18 nt, Human
cauguuccccuugggggu

SEQ ID NO: 1650844 - RNA, 16 nt, Human
aagcauuuagauguau

SEQ ID NO: 1650845 - RNA, 12 nt, Human
aucguguccccu

SEQ ID NO: 1650846 - RNA, 15 nt, Human
cccugccccccagcc

SEQ ID NO: 1650847 - RNA, 16 nt, Human
aaaaugugauauguac

SEQ ID NO: 1650848 - RNA, 23 nt, Human
aaguauccuucagccugaaagag

SEQ ID NO: 1650849 - RNA, 20 nt, Human
ccaaguaaauguuuguccuu

SEQ ID NO: 1650850 - RNA, 15 nt, Human
gugaccacugcagaa

SEQ ID NO: 1650851 - RNA, 15 nt, Human
ucccccaucucuucu

SEQ ID NO: 1650852 - RNA, 22 nt, Human
uauuccuuuuucucuccucucc

SEQ ID NO: 1650853 - RNA, 15 nt, Human
ggccuccauccugag

SEQ ID NO: 1650854 - RNA, 14 nt, Human
uaaggauucugaga

SEQ ID NO: 1650855 - RNA, 18 nt, Human
ggaaguauaggccaggca

SEQ ID NO: 1650856 - RNA, 20 nt, Human
uggggcuaaggcaggaggau

SEQ ID NO: 1650857 - RNA, 21 nt, Human
ugccuaggcauagcccugccu

SEQ ID NO: 1650858 - RNA, 21 nt, Human
cuaagcuucacuguaaaauaa

SEQ ID NO: 1650859 - RNA, 20 nt, Human
caaaguugauuaagaaagga

SEQ ID NO: 1650860 - RNA, 23 nt, Human
gucucagcuucacccugagguga

SEQ ID NO: 1650861 - RNA, 18 nt, Human
uggucaauuuuguuaugu

SEQ ID NO: 1650862 - RNA, 23 nt, Human
gaaugagagacacacugaagaag

SEQ ID NO: 1650863 - RNA, 19 nt, Human
acagucaccucauggaauu

SEQ ID NO: 1650864 - RNA, 17 nt, Human
ggagcucguggaacagu

SEQ ID NO: 1650865 - RNA, 16 nt, Human
agaacuaaaaauuaaa

SEQ ID NO: 1650866 - RNA, 14 nt, Human
cauuuaguuauaaa

SEQ ID NO: 1650867 - RNA, 19 nt, Human
cauggccacaucugagccc

SEQ ID NO: 1650868 - RNA, 22 nt, Human
uguauacugugugcuaaaacaa

SEQ ID NO: 1650869 - RNA, 11 nt, Human
aaaaaaaaacc

SEQ ID NO: 1650870 - RNA, 15 nt, Human
auguuagagaauuuc

SEQ ID NO: 1650871 - RNA, 19 nt, Human
ucaguccaugaagauguag

SEQ ID NO: 1650872 - RNA, 22 nt, Human
ugauaguuguaccgcaauguga

SEQ ID NO: 1650873 - RNA, 17 nt, Salmonella enterica enterica serovar Typhi
uuuugccgagcaggacg

SEQ ID NO: 1650874 - RNA, 19 nt, Salmonella enterica enterica serovar Typhi
uuuugaguuugucauccag

SEQ ID NO: 1650875 - RNA, 16 nt, Salmonella enterica enterica serovar Typhi
uuuugcagaauugaua

SEQ ID NO: 1650876 - RNA, 13 nt, Salmonella enterica enterica serovar Typhi
uuuucaccauaau

SEQ ID NO: 1650877 - RNA, 14 nt, Salmonella enterica enterica serovar Typhi
uuuguccgcugcug

SEQ ID NO: 1650878 - RNA, 17 nt, Salmonella enterica enterica serovar Typhi
uuuuaauguccagcagu

SEQ ID NO: 1650879 - RNA, 17 nt, Salmonella enterica enterica serovar Typhi
uuugucgucaugcgcca

SEQ ID NO: 1650880 - RNA, 23 nt, Salmonella enterica enterica serovar Typhi
uuuuaccucacggugacgcguca

SEQ ID NO: 1650881 - RNA, 19 nt, Salmonella enterica enterica serovar Typhi
uuuuaccgcccgcgccagu

SEQ ID NO: 1650882 - RNA, 16 nt, Salmonella enterica enterica serovar Typhi
uuugccaaacugcugg

SEQ ID NO: 1650883 - RNA, 21 nt, Salmonella enterica enterica serovar Typhi
uuugcaucgugauagacggcu

SEQ ID NO: 1650884 - RNA, 12 nt, Salmonella enterica enterica serovar Typhi
uuugcagauccu

SEQ ID NO: 1650885 - RNA, 22 nt, Salmonella enterica enterica serovar Typhi
uuucggcaaagcacugcugcug

SEQ ID NO: 1650886 - RNA, 19 nt, Salmonella enterica enterica serovar Typhi
uuucguacauguccagauc

SEQ ID NO: 1650887 - RNA, 17 nt, Salmonella enterica enterica serovar Typhi
uuucguacauguccaga

SEQ ID NO: 1650888 - RNA, 13 nt, Salmonella enterica enterica serovar Typhi
uuucgccagcaac

SEQ ID NO: 1650889 - RNA, 13 nt, Salmonella enterica enterica serovar Typhi
uuucgcccacauc

SEQ ID NO: 1650890 - RNA, 18 nt, Salmonella enterica enterica serovar Typhi
uuuccgcuagggcaucag

SEQ ID NO: 1650891 - RNA, 17 nt, Salmonella enterica enterica serovar Typhi
uuucauuggucaguaag

SEQ ID NO: 1650892 - RNA, 20 nt, Salmonella enterica enterica serovar Typhi
uuucgaagccgaccaccauc

SEQ ID NO: 1650893 - RNA, 13 nt, Salmonella enterica enterica serovar Typhi
uuuccugcaacau

SEQ ID NO: 1650894 - RNA, 22 nt, Salmonella enterica enterica serovar Typhi
uuuccuguguuacgccaauaau

SEQ ID NO: 1650895 - RNA, 21 nt, Salmonella enterica enterica serovar Typhi
uuuccuuucugcgccagcggc

SEQ ID NO: 1650896 - RNA, 22 nt, Salmonella enterica enterica serovar Typhi
uuucaaccgcgccaaagauaag

SEQ ID NO: 1650897 - RNA, 17 nt, Salmonella enterica enterica serovar Typhi
uuucaaccacggauaag

SEQ ID NO: 1650898 - RNA, 12 nt, Salmonella enterica enterica serovar Typhi
uuucaacggauu

SEQ ID NO: 1650899 - RNA, 21 nt, Salmonella enterica enterica serovar Typhi
uuucaagcaauaccggguuaa

SEQ ID NO: 1650900 - RNA, 22 nt, Salmonella enterica enterica serovar Typhi
uuuauugccuaagauggcgccu

SEQ ID NO: 1650901 - RNA, 20 nt, Salmonella enterica enterica serovar Typhi
uuuaacaaaucgacagccag

SEQ ID NO: 1650902 - RNA, 22 nt, Salmonella enterica enterica serovar Typhi
uugucaugcuaaaacagauaac

SEQ ID NO: 1650903 - RNA, 18 nt, Salmonella enterica enterica serovar Typhi
uugucuuuuggcugcgcg

SEQ ID NO: 1650904 - RNA, 21 nt, Salmonella enterica enterica serovar Typhi
uugucuucaccuugcugcgca

SEQ ID NO: 1650905 - RNA, 13 nt, Salmonella enterica enterica serovar Typhi
uugucuucgaugc

SEQ ID NO: 1650906 - RNA, 13 nt, Salmonella enterica enterica serovar Typhi
uugugauaauacu

SEQ ID NO: 1650907 - RNA, 22 nt, Salmonella enterica enterica serovar Typhi
uugugccugcugcggauaacgu

SEQ ID NO: 1650908 - RNA, 14 nt, Salmonella enterica enterica serovar Typhi
uugugguugguagc

SEQ ID NO: 1650909 - RNA, 14 nt, Salmonella enterica enterica serovar Typhi
uuguuucuuaaccc

SEQ ID NO: 1650910 - RNA, 19 nt, Salmonella enterica enterica serovar Typhi
uuggccuaacagucgcgcc

SEQ ID NO: 1650911 - RNA, 16 nt, Salmonella enterica enterica serovar Typhi
uugcggaucgaucucg

SEQ ID NO: 1650912 - RNA, 16 nt, Salmonella enterica enterica serovar Typhi
uugcgcuccggcgcug

SEQ ID NO: 1650913 - RNA, 12 nt, Salmonella enterica enterica serovar Typhi
uugcgcugcgca

SEQ ID NO: 1650914 - RNA, 20 nt, Salmonella enterica enterica serovar Typhi
uugcgccaccuuaaucgacu

SEQ ID NO: 1650915 - RNA, 21 nt, Salmonella enterica enterica serovar Typhi
uugcgcagcaacgucucgaca

SEQ ID NO: 1650916 - RNA, 21 nt, Salmonella enterica enterica serovar Typhi
uugcgccgugccuggcgcugg

SEQ ID NO: 1650917 - RNA, 14 nt, Salmonella enterica enterica serovar Typhi
uugcgccgucacac

SEQ ID NO: 1650918 - RNA, 14 nt, Salmonella enterica enterica serovar Typhi
uugcgcuaaaaucc

SEQ ID NO: 1650919 - RNA, 12 nt, Salmonella enterica enterica serovar Typhi
uugccgccauca

SEQ ID NO: 1650920 - RNA, 23 nt, Salmonella enterica enterica serovar Typhi
uugccgccuugguugccgcauaa

SEQ ID NO: 1650921 - RNA, 23 nt, Salmonella enterica enterica serovar Typhi
uugccgucaaacgcuaucaccgc

SEQ ID NO: 1650922 - RNA, 21 nt, Salmonella enterica enterica serovar Typhi
uugccgucacagagagcguau

SEQ ID NO: 1650923 - RNA, 17 nt, Salmonella enterica enterica serovar Typhi
uugccuucgauuaacgc

SEQ ID NO: 1650924 - RNA, 17 nt, Salmonella enterica enterica serovar Typhi
uugcuucgauggccuca

SEQ ID NO: 1650925 - RNA, 16 nt, Salmonella enterica enterica serovar Typhi
uugcuuuuucggcaau

SEQ ID NO: 1650926 - RNA, 20 nt, Salmonella enterica enterica serovar Typhi
uugcuuauuagaggcguaag

SEQ ID NO: 1650927 - RNA, 18 nt, Salmonella enterica enterica serovar Typhi
uugcuuauccggccuaca

SEQ ID NO: 1650928 - RNA, 14 nt, Salmonella enterica enterica serovar Typhi
uugcuggcgugaac

SEQ ID NO: 1650929 - RNA, 20 nt, Salmonella enterica enterica serovar Typhi
uugcuggcgugaaccgguaa

SEQ ID NO: 1650930 - RNA, 14 nt, Salmonella enterica enterica serovar Typhi
uugcucugccagcg

SEQ ID NO: 1650931 - RNA, 22 nt, Salmonella enterica enterica serovar Typhi
uugcugacagcaucgauuccgc

SEQ ID NO: 1650932 - RNA, 15 nt, Salmonella enterica enterica serovar Typhi
uugcugauaaucaau

SEQ ID NO: 1650933 - RNA, 23 nt, Salmonella enterica enterica serovar Typhi
uugcugauuaaucccgaaucacu

SEQ ID NO: 1650934 - RNA, 20 nt, Salmonella enterica enterica serovar Typhi
uuggcaaaaaaggccagacu

SEQ ID NO: 1650935 - RNA, 13 nt, Salmonella enterica enterica serovar Typhi
uuggacggcauca

SEQ ID NO: 1650936 - RNA, 13 nt, Salmonella enterica enterica serovar Typhi
uuggaucggcaaa

SEQ ID NO: 1650937 - RNA, 18 nt, Salmonella enterica enterica serovar Typhi
uuggccgauggucgcgcc

SEQ ID NO: 1650938 - RNA, 17 nt, Salmonella enterica enterica serovar Typhi
uugccagcgcauccacc

SEQ ID NO: 1650939 - RNA, 20 nt, Salmonella enterica enterica serovar Typhi
uugccacuggcuuuccugau

SEQ ID NO: 1650940 - RNA, 20 nt, Salmonella enterica enterica serovar Typhi
uugccagagagaugccgccg

SEQ ID NO: 1650941 - RNA, 17 nt, Salmonella enterica enterica serovar Typhi
uugccaugugccgcgaa

SEQ ID NO: 1650942 - RNA, 15 nt, Salmonella enterica enterica serovar Typhi
uugccaugguucaca

SEQ ID NO: 1650943 - RNA, 16 nt, Salmonella enterica enterica serovar Typhi
uugccauacgcccacg

SEQ ID NO: 1650944 - RNA, 15 nt, Salmonella enterica enterica serovar Typhi
uugccauauugccgc

SEQ ID NO: 1650945 - RNA, 17 nt, Salmonella enterica enterica serovar Typhi
uugcccgguggcgcugc

SEQ ID NO: 1650946 - RNA, 13 nt, Salmonella enterica enterica serovar Typhi
uugccauucgcca

SEQ ID NO: 1650947 - RNA, 16 nt, Salmonella enterica enterica serovar Typhi
uugcauuucgaccgca

SEQ ID NO: 1650948 - RNA, 22 nt, Salmonella enterica enterica serovar Typhi
uugcaugguagucguuauaauc

SEQ ID NO: 1650949 - RNA, 12 nt, Salmonella enterica enterica serovar Typhi
uugaugccgacc

SEQ ID NO: 1650950 - RNA, 23 nt, Salmonella enterica enterica serovar Typhi
uugauaucgcugugguuuauccg

SEQ ID NO: 1650951 - RNA, 16 nt, Salmonella enterica enterica serovar Typhi
uugauaacggaaucac

SEQ ID NO: 1650952 - RNA, 16 nt, Salmonella enterica enterica serovar Typhi
uugaguuuuccgccau

SEQ ID NO: 1650953 - RNA, 21 nt, Salmonella enterica enterica serovar Typhi
uugaccucauccaucagcgcg

SEQ ID NO: 1650954 - RNA, 17 nt, Salmonella enterica enterica serovar Typhi
uugacuuuuacgccacg

SEQ ID NO: 1650955 - RNA, 13 nt, Salmonella enterica enterica serovar Typhi
uugagcaauaucg

SEQ ID NO: 1650956 - RNA, 16 nt, Salmonella enterica enterica serovar Typhi
uugagcuggauaagcu

SEQ ID NO: 1650957 - RNA, 15 nt, Salmonella enterica enterica serovar Typhi
uugaacauauccgcg

SEQ ID NO: 1650958 - RNA, 20 nt, Salmonella enterica enterica serovar Typhi
uuccucgauaucuucauagc

SEQ ID NO: 1650959 - RNA, 20 nt, Salmonella enterica enterica serovar Typhi
uugaacagcgucauccagug

SEQ ID NO: 1650960 - RNA, 20 nt, Salmonella enterica enterica serovar Typhi
uuccgguuaauacgccggug

SEQ ID NO: 1650961 - RNA, 12 nt, Salmonella enterica enterica serovar Typhi
uuccucccggug

SEQ ID NO: 1650962 - RNA, 14 nt, Salmonella enterica enterica serovar Typhi
uuccucagaauccg

SEQ ID NO: 1650963 - RNA, 13 nt, Salmonella enterica enterica serovar Typhi
uugaaguuaucca

SEQ ID NO: 1650964 - RNA, 13 nt, Salmonella enterica enterica serovar Typhi
uugaauuugacga

SEQ ID NO: 1650965 - RNA, 21 nt, Salmonella enterica enterica serovar Typhi
uugaauaaugcccguugacga

SEQ ID NO: 1650966 - RNA, 13 nt, Salmonella enterica enterica serovar Typhi
uggguuccaggcg

SEQ ID NO: 1650967 - RNA, 16 nt, Salmonella enterica enterica serovar Typhi
ugggaauuagcgaauc

SEQ ID NO: 1650968 - RNA, 17 nt, Salmonella enterica enterica serovar Typhi
uggcugccaucggcauu

SEQ ID NO: 1650969 - RNA, 19 nt, Salmonella enterica enterica serovar Typhi
uggcugagaaucaccuggc

SEQ ID NO: 1650970 - RNA, 14 nt, Salmonella enterica enterica serovar Typhi
uggcguuaccggca

SEQ ID NO: 1650971 - RNA, 20 nt, Salmonella enterica enterica serovar Typhi
uggcgucuguccggcgcuca

SEQ ID NO: 1650972 - RNA, 18 nt, Salmonella enterica enterica serovar Typhi
uggcgucagaccggcaau

SEQ ID NO: 1650973 - RNA, 14 nt, Salmonella enterica enterica serovar Typhi
uggcguaaacgcca

SEQ ID NO: 1650974 - RNA, 20 nt, Salmonella enterica enterica serovar Typhi
uggcguacgguuggaucggc

SEQ ID NO: 1650975 - RNA, 14 nt, Salmonella enterica enterica serovar Typhi
uggcgcauuccaga

SEQ ID NO: 1650976 - RNA, 22 nt, Salmonella enterica enterica serovar Typhi
uggcgccaaaaccgcucacggu

SEQ ID NO: 1650977 - RNA, 23 nt, Salmonella enterica enterica serovar Typhi
uggcgaaccacggcuucagcggc

SEQ ID NO: 1650978 - RNA, 22 nt, Salmonella enterica enterica serovar Typhi
uggcggacccaaaagaaguggc

SEQ ID NO: 1650979 - RNA, 15 nt, Salmonella enterica enterica serovar Typhi
uggcggaauaucgcg

SEQ ID NO: 1650980 - RNA, 21 nt, Salmonella enterica enterica serovar Typhi
uggcgcuguucuugcugcugc

SEQ ID NO: 1650981 - RNA, 17 nt, Salmonella enterica enterica serovar Typhi
uggcgcuuaauacgcga

SEQ ID NO: 1650982 - RNA, 16 nt, Salmonella enterica enterica serovar Typhi
uggcgcuuuuccagca

SEQ ID NO: 1650983 - RNA, 15 nt, Salmonella enterica enterica serovar Typhi
uggcgcgcuugcauu

SEQ ID NO: 1650984 - RNA, 16 nt, Salmonella enterica enterica serovar Typhi
uggcgcugccggaaag

SEQ ID NO: 1650985 - RNA, 14 nt, Salmonella enterica enterica serovar Typhi
uggcgaaacgccug

SEQ ID NO: 1650986 - RNA, 21 nt, Salmonella enterica enterica serovar Typhi
uggcgaaacuccuccgggaaa

SEQ ID NO: 1650987 - RNA, 16 nt, Salmonella enterica enterica serovar Typhi
uggccgacggcauaac

SEQ ID NO: 1650988 - RNA, 18 nt, Salmonella enterica enterica serovar Typhi
uggccgagaguccagcgc

SEQ ID NO: 1650989 - RNA, 19 nt, Salmonella enterica enterica serovar Typhi
uggaagugcguuaacccgc

SEQ ID NO: 1650990 - RNA, 19 nt, Salmonella enterica enterica serovar Typhi
uggaaguaugccucgcgca

SEQ ID NO: 1650991 - RNA, 21 nt, Salmonella enterica enterica serovar Typhi
uggaacuuuaucgcgcggcga

SEQ ID NO: 1650992 - RNA, 14 nt, Salmonella enterica enterica serovar Typhi
uggaaccaggcgcg

SEQ ID NO: 1650993 - RNA, 20 nt, Salmonella enterica enterica serovar Typhi
uggacgugccuuccaucggc

SEQ ID NO: 1650994 - RNA, 16 nt, Salmonella enterica enterica serovar Typhi
uggacagauuuccacg

SEQ ID NO: 1650995 - RNA, 14 nt, Salmonella enterica enterica serovar Typhi
uggaauuuuuccag

SEQ ID NO: 1650996 - RNA, 17 nt, Salmonella enterica enterica serovar Typhi
uggacaaggaucguuac

SEQ ID NO: 1650997 - RNA, 20 nt, Salmonella enterica enterica serovar Typhi
uggaccgcagcuuauuccag

SEQ ID NO: 1650998 - RNA, 15 nt, Salmonella enterica enterica serovar Typhi
uggauauccagcaua

SEQ ID NO: 1650999 - RNA, 14 nt, Salmonella enterica enterica serovar Typhi
uggauaccgcacug

SEQ ID NO: 1651000 - RNA, 23 nt, Salmonella enterica enterica serovar Typhi
uggauagagucgauagaucgcca

SEQ ID NO: 1651001 - RNA, 17 nt, Salmonella enterica enterica serovar Typhi
uggauagucaggcgaug

SEQ ID NO: 1651002 - RNA, 22 nt, Salmonella enterica enterica serovar Typhi
uggaguacgggcagauggucgc

SEQ ID NO: 1651003 - RNA, 13 nt, Salmonella enterica enterica serovar Typhi
uggauaaggcgug

SEQ ID NO: 1651004 - RNA, 15 nt, Salmonella enterica enterica serovar Typhi
uggauaaaucgguca

SEQ ID NO: 1651005 - RNA, 15 nt, Salmonella enterica enterica serovar Typhi
uggaguuaucauuau

SEQ ID NO: 1651006 - RNA, 15 nt, Salmonella enterica enterica serovar Typhi
uggauucucgcgccg

SEQ ID NO: 1651007 - RNA, 13 nt, Salmonella enterica enterica serovar Typhi
uggauuuauggcg

SEQ ID NO: 1651008 - RNA, 21 nt, Salmonella enterica enterica serovar Typhi
uggaugucggcguaaauccag

SEQ ID NO: 1651009 - RNA, 15 nt, Salmonella enterica enterica serovar Typhi
uggauuuauggcguc

SEQ ID NO: 1651010 - RNA, 14 nt, Salmonella enterica enterica serovar Typhi
uggaucgcuccauu

SEQ ID NO: 1651011 - RNA, 15 nt, Salmonella enterica enterica serovar Typhi
uggaucucgucgccg

SEQ ID NO: 1651012 - RNA, 22 nt, Salmonella enterica enterica serovar Typhi
uggcagaacggcgacggcuuca

SEQ ID NO: 1651013 - RNA, 16 nt, Salmonella enterica enterica serovar Typhi
uggcagaguccagcgg

SEQ ID NO: 1651014 - RNA, 15 nt, Salmonella enterica enterica serovar Typhi
uggcaaucauaccgu

SEQ ID NO: 1651015 - RNA, 19 nt, Salmonella enterica enterica serovar Typhi
uggcaauguugagcaucgc

SEQ ID NO: 1651016 - RNA, 16 nt, Salmonella enterica enterica serovar Typhi
uggcaauggcggcgga

SEQ ID NO: 1651017 - RNA, 12 nt, Salmonella enterica enterica serovar Typhi
uggcagggcuga

SEQ ID NO: 1651018 - RNA, 15 nt, Salmonella enterica enterica serovar Typhi
uggccaccuuuacgg

SEQ ID NO: 1651019 - RNA, 16 nt, Salmonella enterica enterica serovar Typhi
uggcauuuugcggcgu

SEQ ID NO: 1651020 - RNA, 13 nt, Salmonella enterica enterica serovar Typhi
uggcauuggcauc

SEQ ID NO: 1651021 - RNA, 14 nt, Salmonella enterica enterica serovar Typhi
uggccagcacaaua

SEQ ID NO: 1651022 - RNA, 21 nt, Salmonella enterica enterica serovar Typhi
uggccacggagugcgcggcga

SEQ ID NO: 1651023 - RNA, 17 nt, Salmonella enterica enterica serovar Typhi
uggccagcaccagcauu

SEQ ID NO: 1651024 - RNA, 18 nt, Salmonella enterica enterica serovar Typhi
uggccagcauggcgguca

SEQ ID NO: 1651025 - RNA, 13 nt, Salmonella enterica enterica serovar Typhi
uggccagcauggc

SEQ ID NO: 1651026 - RNA, 18 nt, Salmonella enterica enterica serovar Typhi
uggccaucuuccagcauc

SEQ ID NO: 1651027 - RNA, 19 nt, Salmonella enterica enterica serovar Typhi
uggcccgcccagcaugggc

SEQ ID NO: 1651028 - RNA, 14 nt, Salmonella enterica enterica serovar Typhi
ugucgcuggauagc

SEQ ID NO: 1651029 - RNA, 23 nt, Salmonella enterica enterica serovar Typhi
ugugaccagcaguuccggcguaa

SEQ ID NO: 1651030 - RNA, 21 nt, Salmonella enterica enterica serovar Typhi
ugugauaaggcuaaucgcauu

SEQ ID NO: 1651031 - RNA, 22 nt, Salmonella enterica enterica serovar Typhi
ugucgcgaaagcacucggcgcc

SEQ ID NO: 1651032 - RNA, 14 nt, Salmonella enterica enterica serovar Typhi
uguguaccagcagc

SEQ ID NO: 1651033 - RNA, 21 nt, Salmonella enterica enterica serovar Typhi
uguguaucgcccugccagcuc

SEQ ID NO: 1651034 - RNA, 15 nt, Salmonella enterica enterica serovar Typhi
ugugugaccagcagu

SEQ ID NO: 1651035 - RNA, 16 nt, Salmonella enterica enterica serovar Typhi
ugugguccaaucguau

SEQ ID NO: 1651036 - RNA, 15 nt, Salmonella enterica enterica serovar Typhi
ugugcacagguaaac

SEQ ID NO: 1651037 - RNA, 12 nt, Salmonella enterica enterica serovar Typhi
ugugcaggagca

SEQ ID NO: 1651038 - RNA, 20 nt, Salmonella enterica enterica serovar Typhi
uguucagguacagguaauga

SEQ ID NO: 1651039 - RNA, 14 nt, Salmonella enterica enterica serovar Typhi
uguucagcgcagaa

SEQ ID NO: 1651040 - RNA, 15 nt, Salmonella enterica enterica serovar Typhi
uguucacauccagcc

SEQ ID NO: 1651041 - RNA, 12 nt, Salmonella enterica enterica serovar Typhi
uguucagccagc

SEQ ID NO: 1651042 - RNA, 16 nt, Salmonella enterica enterica serovar Typhi
uguucaagcugguuaa

SEQ ID NO: 1651043 - RNA, 24 nt, Salmonella enterica enterica serovar Typhi
uguucaaagccgccauccggccug

SEQ ID NO: 1651044 - RNA, 15 nt, Salmonella enterica enterica serovar Typhi
uguuauggcaggcga

SEQ ID NO: 1651045 - RNA, 15 nt, Salmonella enterica enterica serovar Typhi
uguuaaaaccggcug

SEQ ID NO: 1651046 - RNA, 18 nt, Salmonella enterica enterica serovar Typhi
uguguuuggccgccggaa

SEQ ID NO: 1651047 - RNA, 14 nt, Salmonella enterica enterica serovar Typhi
uguuaaaaccggcu

SEQ ID NO: 1651048 - RNA, 14 nt, Salmonella enterica enterica serovar Typhi
uguucgauccggcg

SEQ ID NO: 1651049 - RNA, 12 nt, Salmonella enterica enterica serovar Typhi
uguccagcagug

SEQ ID NO: 1651050 - RNA, 18 nt, Salmonella enterica enterica serovar Typhi
uguccacggggcggcaau

SEQ ID NO: 1651051 - RNA, 21 nt, Salmonella enterica enterica serovar Typhi
ugucaucaaaaucaucgccac

SEQ ID NO: 1651052 - RNA, 15 nt, Salmonella enterica enterica serovar Typhi
uguccggcgcguuca

SEQ ID NO: 1651053 - RNA, 19 nt, Salmonella enterica enterica serovar Typhi
uguccggcgcguucaugcg

SEQ ID NO: 1651054 - RNA, 15 nt, Salmonella enterica enterica serovar Typhi
ugucaggaugcugau

SEQ ID NO: 1651055 - RNA, 20 nt, Salmonella enterica enterica serovar Typhi
uguaggccgggcaagcgaag

SEQ ID NO: 1651056 - RNA, 18 nt, Salmonella enterica enterica serovar Typhi
ugucaccaucaucgauau

SEQ ID NO: 1651057 - RNA, 15 nt, Salmonella enterica enterica serovar Typhi
uguacguauuuacaa

SEQ ID NO: 1651058 - RNA, 17 nt, Salmonella enterica enterica serovar Typhi
uguagcgccaaccggcu

SEQ ID NO: 1651059 - RNA, 15 nt, Salmonella enterica enterica serovar Typhi
uguaauaaccguggc

SEQ ID NO: 1651060 - RNA, 23 nt, Salmonella enterica enterica serovar Typhi
uguaauaccacugcccgccgcca

SEQ ID NO: 1651061 - RNA, 17 nt, Salmonella enterica enterica serovar Typhi
uguaccagcagcgccag

SEQ ID NO: 1651062 - RNA, 11 nt, Salmonella enterica enterica serovar Typhi
uguaccaggcc

SEQ ID NO: 1651063 - RNA, 21 nt, Salmonella enterica enterica serovar Typhi
uguaccucuacauaacgaaug

SEQ ID NO: 1651064 - RNA, 14 nt, Salmonella enterica enterica serovar Typhi
ugguucugccagaa

SEQ ID NO: 1651065 - RNA, 17 nt, Salmonella enterica enterica serovar Typhi
ugguugucagaucgccc

SEQ ID NO: 1651066 - RNA, 23 nt, Salmonella enterica enterica serovar Typhi
ugguuuuagcuuaucccauugcg

SEQ ID NO: 1651067 - RNA, 13 nt, Salmonella enterica enterica serovar Typhi
ugguaaaccgugc

SEQ ID NO: 1651068 - RNA, 19 nt, Salmonella enterica enterica serovar Typhi
ugguaacgccgugacggcg

SEQ ID NO: 1651069 - RNA, 15 nt, Salmonella enterica enterica serovar Typhi
ugguaacugcggcua

SEQ ID NO: 1651070 - RNA, 15 nt, Salmonella enterica enterica serovar Typhi
ugguaaaggcguaga

SEQ ID NO: 1651071 - RNA, 19 nt, Salmonella enterica enterica serovar Typhi
ugguggggccuaaugagcc

SEQ ID NO: 1651072 - RNA, 16 nt, Salmonella enterica enterica serovar Typhi
ugguggauauccagca

SEQ ID NO: 1651073 - RNA, 18 nt, Salmonella enterica enterica serovar Typhi
ugguggauauccagcaua

SEQ ID NO: 1651074 - RNA, 16 nt, Salmonella enterica enterica serovar Typhi
uuacagauauccaccg

SEQ ID NO: 1651075 - RNA, 14 nt, Salmonella enterica enterica serovar Typhi
uuacaucagauaaa

SEQ ID NO: 1651076 - RNA, 15 nt, Salmonella enterica enterica serovar Typhi
uuaccagcaucaaua

SEQ ID NO: 1651077 - RNA, 18 nt, Salmonella enterica enterica serovar Typhi
uuaccagccgcgcccuaa

SEQ ID NO: 1651078 - RNA, 13 nt, Salmonella enterica enterica serovar Typhi
uuacccggccagu

SEQ ID NO: 1651079 - RNA, 20 nt, Salmonella enterica enterica serovar Typhi
uuacccggcguauugguaca

SEQ ID NO: 1651080 - RNA, 21 nt, Salmonella enterica enterica serovar Typhi
uuacccacaucaaucaccuga

SEQ ID NO: 1651081 - RNA, 22 nt, Salmonella enterica enterica serovar Typhi
uuacccagcaauaguggacaca

SEQ ID NO: 1651082 - RNA, 23 nt, Salmonella enterica enterica serovar Typhi
uuacccuuacggccacugguuug

SEQ ID NO: 1651083 - RNA, 18 nt, Salmonella enterica enterica serovar Typhi
uuacccuucaugcagccc

SEQ ID NO: 1651084 - RNA, 14 nt, Salmonella enterica enterica serovar Typhi
uuacugugccgccg

SEQ ID NO: 1651085 - RNA, 20 nt, Salmonella enterica enterica serovar Typhi
uuacugcgccagccugcugg

SEQ ID NO: 1651086 - RNA, 17 nt, Salmonella enterica enterica serovar Typhi
uuacugugccgccggug

SEQ ID NO: 1651087 - RNA, 18 nt, Salmonella enterica enterica serovar Typhi
uuaccgccgguuuauccc

SEQ ID NO: 1651088 - RNA, 20 nt, Salmonella enterica enterica serovar Typhi
uuaccgccagauggcgucac

SEQ ID NO: 1651089 - RNA, 14 nt, Salmonella enterica enterica serovar Typhi
uuaccgcaucgccc

SEQ ID NO: 1651090 - RNA, 16 nt, Salmonella enterica enterica serovar Typhi
uuagaaaguggcauau

SEQ ID NO: 1651091 - RNA, 19 nt, Salmonella enterica enterica serovar Typhi
uuagagaguaaaaccggca

SEQ ID NO: 1651092 - RNA, 13 nt, Salmonella enterica enterica serovar Typhi
uuagacaagcagu

SEQ ID NO: 1651093 - RNA, 19 nt, Salmonella enterica enterica serovar Typhi
uuaggccaaacuuacgcag

SEQ ID NO: 1651094 - RNA, 15 nt, Salmonella enterica enterica serovar Typhi
uuagggcgcggcugg

SEQ ID NO: 1651095 - RNA, 17 nt, Salmonella enterica enterica serovar Typhi
uuaguaauaaagcguag

SEQ ID NO: 1651096 - RNA, 20 nt, Salmonella enterica enterica serovar Typhi
uuaguccgucggggauggcg

SEQ ID NO: 1651097 - RNA, 19 nt, Salmonella enterica enterica serovar Typhi
uuaguaccgaacagccagg

SEQ ID NO: 1651098 - RNA, 21 nt, Salmonella enterica enterica serovar Typhi
uuauaucaggcaaaaaucguc

SEQ ID NO: 1651099 - RNA, 21 nt, Salmonella enterica enterica serovar Typhi
uuauaugcguguagcagauag

SEQ ID NO: 1651100 - RNA, 13 nt, Salmonella enterica enterica serovar Typhi
uuaucaugcgcca

SEQ ID NO: 1651101 - RNA, 14 nt, Salmonella enterica enterica serovar Typhi
uuaucaggcgaccc

SEQ ID NO: 1651102 - RNA, 21 nt, Salmonella enterica enterica serovar Typhi
uuaucacccacaggagccagu

SEQ ID NO: 1651103 - RNA, 21 nt, Salmonella enterica enterica serovar Typhi
uguuuuauugcuucagccaga

SEQ ID NO: 1651104 - RNA, 15 nt, Salmonella enterica enterica serovar Typhi
uguuuuccagcguaa

SEQ ID NO: 1651105 - RNA, 21 nt, Salmonella enterica enterica serovar Typhi
uuaacaaacgccaggcgcugc

SEQ ID NO: 1651106 - RNA, 18 nt, Salmonella enterica enterica serovar Typhi
uuaacagaauugcgccac

SEQ ID NO: 1651107 - RNA, 21 nt, Salmonella enterica enterica serovar Typhi
uguugcgggccagcagccagg

SEQ ID NO: 1651108 - RNA, 14 nt, Salmonella enterica enterica serovar Typhi
uguuucaccguggc

SEQ ID NO: 1651109 - RNA, 18 nt, Salmonella enterica enterica serovar Typhi
uguuggucacgauccgca

SEQ ID NO: 1651110 - RNA, 16 nt, Salmonella enterica enterica serovar Typhi
uuaacuucuccgccau

SEQ ID NO: 1651111 - RNA, 13 nt, Salmonella enterica enterica serovar Typhi
uuaacccugccgu

SEQ ID NO: 1651112 - RNA, 19 nt, Salmonella enterica enterica serovar Typhi
uuaacguaggccggauaag

SEQ ID NO: 1651113 - RNA, 18 nt, Salmonella enterica enterica serovar Typhi
uuaacucuuugagcgccc

SEQ ID NO: 1651114 - RNA, 14 nt, Salmonella enterica enterica serovar Typhi
uuaaucugucgaug

SEQ ID NO: 1651115 - RNA, 14 nt, Salmonella enterica enterica serovar Typhi
uuaaugaaaucguc

SEQ ID NO: 1651116 - RNA, 16 nt, Salmonella enterica enterica serovar Typhi
uuaaucaccagcgcau

SEQ ID NO: 1651117 - RNA, 16 nt, Salmonella enterica enterica serovar Typhi
uuaaugauuugcuuua

SEQ ID NO: 1651118 - RNA, 15 nt, Salmonella enterica enterica serovar Typhi
uuacaaccgcaccgg

SEQ ID NO: 1651119 - RNA, 19 nt, Salmonella enterica enterica serovar Typhi
uuacaagaauaugcagugc

SEQ ID NO: 1651120 - RNA, 17 nt, Salmonella enterica enterica serovar Typhi
uucccgccagcugcgcg

SEQ ID NO: 1651121 - RNA, 16 nt, Salmonella enterica enterica serovar Typhi
uucccgauuccguguc

SEQ ID NO: 1651122 - RNA, 21 nt, Salmonella enterica enterica serovar Typhi
uucccgacuuuacaccccacu

SEQ ID NO: 1651123 - RNA, 21 nt, Salmonella enterica enterica serovar Typhi
uucccgaaaggaagcgggcca

SEQ ID NO: 1651124 - RNA, 16 nt, Salmonella enterica enterica serovar Typhi
uucccggcuaaccugu

SEQ ID NO: 1651125 - RNA, 23 nt, Salmonella enterica enterica serovar Typhi
uucccggaucggucuggcgcaua

SEQ ID NO: 1651126 - RNA, 13 nt, Salmonella enterica enterica serovar Typhi
uucccgcuggcug

SEQ ID NO: 1651127 - RNA, 19 nt, Salmonella enterica enterica serovar Typhi
uuccagcccguagauaagc

SEQ ID NO: 1651128 - RNA, 15 nt, Salmonella enterica enterica serovar Typhi
uuccccugccagacg

SEQ ID NO: 1651129 - RNA, 14 nt, Salmonella enterica enterica serovar Typhi
uuccaggccgccag

SEQ ID NO: 1651130 - RNA, 17 nt, Salmonella enterica enterica serovar Typhi
uuccggcggucagccag

SEQ ID NO: 1651131 - RNA, 17 nt, Salmonella enterica enterica serovar Typhi
uuccggcgugauaaaac

SEQ ID NO: 1651132 - RNA, 15 nt, Salmonella enterica enterica serovar Typhi
uuccggguccagacg

SEQ ID NO: 1651133 - RNA, 13 nt, Salmonella enterica enterica serovar Typhi
uuccggaugcggg

SEQ ID NO: 1651134 - RNA, 18 nt, Salmonella enterica enterica serovar Typhi
uuccagcagcgcaucaug

SEQ ID NO: 1651135 - RNA, 16 nt, Salmonella enterica enterica serovar Typhi
uuccagcagccagccg

SEQ ID NO: 1651136 - RNA, 19 nt, Salmonella enterica enterica serovar Typhi
uuccagauagcgcugcgcc

SEQ ID NO: 1651137 - RNA, 20 nt, Salmonella enterica enterica serovar Typhi
uuccacugcggcauuacgcg

SEQ ID NO: 1651138 - RNA, 16 nt, Salmonella enterica enterica serovar Typhi
uuccacugcggcauua

SEQ ID NO: 1651139 - RNA, 22 nt, Salmonella enterica enterica serovar Typhi
uuccacugagcuucaccgccag

SEQ ID NO: 1651140 - RNA, 19 nt, Salmonella enterica enterica serovar Typhi
uuccacacggcauucacgu

SEQ ID NO: 1651141 - RNA, 22 nt, Salmonella enterica enterica serovar Typhi
uuccacgauauuaauucccgcc

SEQ ID NO: 1651142 - RNA, 21 nt, Salmonella enterica enterica serovar Typhi
uuccacgcugacugcauaaug

SEQ ID NO: 1651143 - RNA, 21 nt, Salmonella enterica enterica serovar Typhi
uucaucauacugaagauaaac

SEQ ID NO: 1651144 - RNA, 22 nt, Salmonella enterica enterica serovar Typhi
uucaucaggcaauaaacaucag

SEQ ID NO: 1651145 - RNA, 12 nt, Salmonella enterica enterica serovar Typhi
uucauccacgcc

SEQ ID NO: 1651146 - RNA, 17 nt, Salmonella enterica enterica serovar Typhi
uucaaccacggauaagc

SEQ ID NO: 1651147 - RNA, 22 nt, Salmonella enterica enterica serovar Typhi
uucacaaacaauuucccccacu

SEQ ID NO: 1651148 - RNA, 16 nt, Salmonella enterica enterica serovar Typhi
uucacaaccuccacgc

SEQ ID NO: 1651149 - RNA, 14 nt, Salmonella enterica enterica serovar Typhi
uucaacgcgaccgg

SEQ ID NO: 1651150 - RNA, 13 nt, Salmonella enterica enterica serovar Typhi
uuaugaucgccca

SEQ ID NO: 1651151 - RNA, 15 nt, Salmonella enterica enterica serovar Typhi
uuaugcauugccaug

SEQ ID NO: 1651152 - RNA, 14 nt, Salmonella enterica enterica serovar Typhi
uuaugcugccagcg

SEQ ID NO: 1651153 - RNA, 16 nt, Salmonella enterica enterica serovar Typhi
uuaugggaggauacug

SEQ ID NO: 1651154 - RNA, 17 nt, Salmonella enterica enterica serovar Typhi
uuauguuugcugauaag

SEQ ID NO: 1651155 - RNA, 12 nt, Salmonella enterica enterica serovar Typhi
uuauuaacccuu

SEQ ID NO: 1651156 - RNA, 22 nt, Salmonella enterica enterica serovar Typhi
uuauuacgcgcucucauaagcc

SEQ ID NO: 1651157 - RNA, 17 nt, Salmonella enterica enterica serovar Typhi
uuauguaccgucaucgc

SEQ ID NO: 1651158 - RNA, 18 nt, Salmonella enterica enterica serovar Typhi
uuauguaggccugauaag

SEQ ID NO: 1651159 - RNA, 19 nt, Salmonella enterica enterica serovar Typhi
uuauguagccagccauggc

SEQ ID NO: 1651160 - RNA, 16 nt, Salmonella enterica enterica serovar Typhi
uucaccccagcgguaa

SEQ ID NO: 1651161 - RNA, 22 nt, Salmonella enterica enterica serovar Typhi
uucacuaaaaacaggcugcgua

SEQ ID NO: 1651162 - RNA, 16 nt, Salmonella enterica enterica serovar Typhi
uucacccacugcacau

SEQ ID NO: 1651163 - RNA, 19 nt, Salmonella enterica enterica serovar Typhi
uucacaccguuauccggca

SEQ ID NO: 1651164 - RNA, 14 nt, Salmonella enterica enterica serovar Typhi
uucacaucgccagu

SEQ ID NO: 1651165 - RNA, 12 nt, Salmonella enterica enterica serovar Typhi
uucagugacgcg

SEQ ID NO: 1651166 - RNA, 21 nt, Salmonella enterica enterica serovar Typhi
uucagaauaauguugguauau

SEQ ID NO: 1651167 - RNA, 22 nt, Salmonella enterica enterica serovar Typhi
uucagggauacgaucguauccc

SEQ ID NO: 1651168 - RNA, 14 nt, Salmonella enterica enterica serovar Typhi
ucggcuuuaucgcc

SEQ ID NO: 1651169 - RNA, 20 nt, Salmonella enterica enterica serovar Typhi
ucgggauguggugcggcuua

SEQ ID NO: 1651170 - RNA, 18 nt, Salmonella enterica enterica serovar Typhi
ucgggcaaaaugcgucgg

SEQ ID NO: 1651171 - RNA, 20 nt, Salmonella enterica enterica serovar Typhi
ucgggaugguuaaauucaua

SEQ ID NO: 1651172 - RNA, 23 nt, Salmonella enterica enterica serovar Typhi
ucgggauugccgccgcgcuggug

SEQ ID NO: 1651173 - RNA, 19 nt, Salmonella enterica enterica serovar Typhi
ucgggagcagugauuaugc

SEQ ID NO: 1651174 - RNA, 22 nt, Salmonella enterica enterica serovar Typhi
ucggcggcccacucauccagca

SEQ ID NO: 1651175 - RNA, 20 nt, Salmonella enterica enterica serovar Typhi
ucggcgucugaugaauacgc

SEQ ID NO: 1651176 - RNA, 18 nt, Salmonella enterica enterica serovar Typhi
ucggcgucugcgcgcugg

SEQ ID NO: 1651177 - RNA, 18 nt, Salmonella enterica enterica serovar Typhi
ucggcgauuuccagcgcc

SEQ ID NO: 1651178 - RNA, 22 nt, Salmonella enterica enterica serovar Typhi
ucggcgcaaccauuaccgcuaa

SEQ ID NO: 1651179 - RNA, 12 nt, Salmonella enterica enterica serovar Typhi
ucggcgcgcugg

SEQ ID NO: 1651180 - RNA, 22 nt, Salmonella enterica enterica serovar Typhi
ucggcgacguccguuagcuggc

SEQ ID NO: 1651181 - RNA, 20 nt, Salmonella enterica enterica serovar Typhi
ucggcgacuggaacaggcca

SEQ ID NO: 1651182 - RNA, 16 nt, Salmonella enterica enterica serovar Typhi
ucgcucaugcgcgucc

SEQ ID NO: 1651183 - RNA, 17 nt, Salmonella enterica enterica serovar Typhi
ucgcugauacgcuggca

SEQ ID NO: 1651184 - RNA, 19 nt, Salmonella enterica enterica serovar Typhi
ucgcuaucuuugagcagau

SEQ ID NO: 1651185 - RNA, 13 nt, Salmonella enterica enterica serovar Typhi
ucgcuauccagca

SEQ ID NO: 1651186 - RNA, 16 nt, Salmonella enterica enterica serovar Typhi
ucgcucaacuccugca

SEQ ID NO: 1651187 - RNA, 18 nt, Salmonella enterica enterica serovar Typhi
ucgcucaggagcgccuga

SEQ ID NO: 1651188 - RNA, 13 nt, Salmonella enterica enterica serovar Typhi
ucgcgcuuauccg

SEQ ID NO: 1651189 - RNA, 15 nt, Salmonella enterica enterica serovar Typhi
ucgcuacugcaucug

SEQ ID NO: 1651190 - RNA, 21 nt, Salmonella enterica enterica serovar Typhi
ucggcauacaccgccagcguc

SEQ ID NO: 1651191 - RNA, 21 nt, Salmonella enterica enterica serovar Typhi
ucggcaucgggauuuacaacc

SEQ ID NO: 1651192 - RNA, 20 nt, Salmonella enterica enterica serovar Typhi
ucggccagcgaaaaccagcg

SEQ ID NO: 1651193 - RNA, 15 nt, Salmonella enterica enterica serovar Typhi
ucggccagcgccagc

SEQ ID NO: 1651194 - RNA, 18 nt, Salmonella enterica enterica serovar Typhi
ucgucaggcggcugcgca

SEQ ID NO: 1651195 - RNA, 15 nt, Salmonella enterica enterica serovar Typhi
ucgucaggcggcugc

SEQ ID NO: 1651196 - RNA, 23 nt, Salmonella enterica enterica serovar Typhi
ucgguuucgcggcguucauggca

SEQ ID NO: 1651197 - RNA, 21 nt, Salmonella enterica enterica serovar Typhi
ucguagcgaauaaucccggcg

SEQ ID NO: 1651198 - RNA, 17 nt, Salmonella enterica enterica serovar Typhi
ucgguggaaaccgcaga

SEQ ID NO: 1651199 - RNA, 19 nt, Salmonella enterica enterica serovar Typhi
ucgguaguguuaucgccga

SEQ ID NO: 1651200 - RNA, 22 nt, Salmonella enterica enterica serovar Typhi
ucggucaucagggcguaagcgc

SEQ ID NO: 1651201 - RNA, 19 nt, Salmonella enterica enterica serovar Typhi
ucgggccagcucuuuucug

SEQ ID NO: 1651202 - RNA, 16 nt, Salmonella enterica enterica serovar Typhi
ucgggcagacuuucug

SEQ ID NO: 1651203 - RNA, 20 nt, Salmonella enterica enterica serovar Typhi
ucgguaagucugauaacggc

SEQ ID NO: 1651204 - RNA, 15 nt, Salmonella enterica enterica serovar Typhi
ucgguaaugggcgau

SEQ ID NO: 1651205 - RNA, 21 nt, Salmonella enterica enterica serovar Typhi
ucggguucacuuuaccaggca

SEQ ID NO: 1651206 - RNA, 16 nt, Salmonella enterica enterica serovar Typhi
ucgucgggauaagcga

SEQ ID NO: 1651207 - RNA, 20 nt, Salmonella enterica enterica serovar Typhi
ucgucuuccggauaacgcgc

SEQ ID NO: 1651208 - RNA, 22 nt, Salmonella enterica enterica serovar Typhi
ucgugaaucaucaucauccgcg

SEQ ID NO: 1651209 - RNA, 19 nt, Salmonella enterica enterica serovar Typhi
ucuaucagguaucccgcca

SEQ ID NO: 1651210 - RNA, 14 nt, Salmonella enterica enterica serovar Typhi
ucuaucaccgccuc

SEQ ID NO: 1651211 - RNA, 16 nt, Salmonella enterica enterica serovar Typhi
ucucaugcaacuggca

SEQ ID NO: 1651212 - RNA, 13 nt, Salmonella enterica enterica serovar Typhi
ucucauccgccaa

SEQ ID NO: 1651213 - RNA, 12 nt, Salmonella enterica enterica serovar Typhi
ucucauccagcu

SEQ ID NO: 1651214 - RNA, 14 nt, Salmonella enterica enterica serovar Typhi
ucguuguccggcug

SEQ ID NO: 1651215 - RNA, 13 nt, Salmonella enterica enterica serovar Typhi
ucguuugcgcgca

SEQ ID NO: 1651216 - RNA, 22 nt, Salmonella enterica enterica serovar Typhi
ucguuugcgcgcacguugggca

SEQ ID NO: 1651217 - RNA, 14 nt, Salmonella enterica enterica serovar Typhi
ucguuuccagcgaa

SEQ ID NO: 1651218 - RNA, 17 nt, Salmonella enterica enterica serovar Typhi
ucguuugcgcuacgcug

SEQ ID NO: 1651219 - RNA, 12 nt, Salmonella enterica enterica serovar Typhi
ucguugcgcgca

SEQ ID NO: 1651220 - RNA, 22 nt, Salmonella enterica enterica serovar Typhi
ucgccuggugugaacaucacgu

SEQ ID NO: 1651221 - RNA, 19 nt, Salmonella enterica enterica serovar Typhi
ucgcgcagcgugaaacgcc

SEQ ID NO: 1651222 - RNA, 13 nt, Salmonella enterica enterica serovar Typhi
ucgcgcugcgcag

SEQ ID NO: 1651223 - RNA, 20 nt, Salmonella enterica enterica serovar Typhi
ucgccggcagacgauagcgg

SEQ ID NO: 1651224 - RNA, 19 nt, Salmonella enterica enterica serovar Typhi
ucgccgccgccgcgaccgc

SEQ ID NO: 1651225 - RNA, 19 nt, Salmonella enterica enterica serovar Typhi
ucgccgggcuauccggcug

SEQ ID NO: 1651226 - RNA, 14 nt, Salmonella enterica enterica serovar Typhi
ucgccggggcgcug

SEQ ID NO: 1651227 - RNA, 22 nt, Salmonella enterica enterica serovar Typhi
ucgccguuaacuggcgcaucug

SEQ ID NO: 1651228 - RNA, 13 nt, Salmonella enterica enterica serovar Typhi
ucgccuaaaugac

SEQ ID NO: 1651229 - RNA, 14 nt, Salmonella enterica enterica serovar Typhi
ucgccccaaucgcc

SEQ ID NO: 1651230 - RNA, 19 nt, Salmonella enterica enterica serovar Typhi
ucgccagucgcagcaaacg

SEQ ID NO: 1651231 - RNA, 13 nt, Salmonella enterica enterica serovar Typhi
ucgccccagcaua

SEQ ID NO: 1651232 - RNA, 21 nt, Salmonella enterica enterica serovar Typhi
ucgccccguaaaccaauacgc

SEQ ID NO: 1651233 - RNA, 21 nt, Salmonella enterica enterica serovar Typhi
ucgccagcgucucagcaggcg

SEQ ID NO: 1651234 - RNA, 13 nt, Salmonella enterica enterica serovar Typhi
ucgccgcaucggc

SEQ ID NO: 1651235 - RNA, 14 nt, Salmonella enterica enterica serovar Typhi
ucgccgccauccgg

SEQ ID NO: 1651236 - RNA, 16 nt, Salmonella enterica enterica serovar Typhi
ucgcccucgccagcaa

SEQ ID NO: 1651237 - RNA, 16 nt, Salmonella enterica enterica serovar Typhi
ucgcagcggcugcgcc

SEQ ID NO: 1651238 - RNA, 19 nt, Salmonella enterica enterica serovar Typhi
ucgcaggaugcgcugcgcg

SEQ ID NO: 1651239 - RNA, 23 nt, Salmonella enterica enterica serovar Typhi
ucgcaguuaugcgcaucaccguu

SEQ ID NO: 1651240 - RNA, 18 nt, Salmonella enterica enterica serovar Typhi
ucgcauugguaucggcag

SEQ ID NO: 1651241 - RNA, 15 nt, Salmonella enterica enterica serovar Typhi
ucgccacagcggaau

SEQ ID NO: 1651242 - RNA, 13 nt, Salmonella enterica enterica serovar Typhi
ucgccaccaggcu

SEQ ID NO: 1651243 - RNA, 20 nt, Salmonella enterica enterica serovar Typhi
ucgccaacuuuuugcgcaau

SEQ ID NO: 1651244 - RNA, 13 nt, Salmonella enterica enterica serovar Typhi
ucgccagcaacag

SEQ ID NO: 1651245 - RNA, 18 nt, Salmonella enterica enterica serovar Typhi
ucgccacucuggcgacgc

SEQ ID NO: 1651246 - RNA, 19 nt, Salmonella enterica enterica serovar Typhi
ucgccaccgcuacaaucca

SEQ ID NO: 1651247 - RNA, 15 nt, Salmonella enterica enterica serovar Typhi
ucgagaagccaucaa

SEQ ID NO: 1651248 - RNA, 19 nt, Salmonella enterica enterica serovar Typhi
ucgagauuuuucugcgcca

SEQ ID NO: 1651249 - RNA, 22 nt, Salmonella enterica enterica serovar Typhi
ucgacgucaacgguaaaauggc

SEQ ID NO: 1651250 - RNA, 23 nt, Salmonella enterica enterica serovar Typhi
ucgacguucagcauauccagcgc

SEQ ID NO: 1651251 - RNA, 15 nt, Salmonella enterica enterica serovar Typhi
uccgguaaucgacgg

SEQ ID NO: 1651252 - RNA, 22 nt, Salmonella enterica enterica serovar Typhi
ucgaggaacuguucagccagca

SEQ ID NO: 1651253 - RNA, 17 nt, Salmonella enterica enterica serovar Typhi
ucgaucagcgcguagau

SEQ ID NO: 1651254 - RNA, 11 nt, Salmonella enterica enterica serovar Typhi
ucgaucaccca

SEQ ID NO: 1651255 - RNA, 19 nt, Salmonella enterica enterica serovar Typhi
ucgaucacccacaucagcg

SEQ ID NO: 1651256 - RNA, 19 nt, Salmonella enterica enterica serovar Typhi
ucgauagcgccgcaucgau

SEQ ID NO: 1651257 - RNA, 17 nt, Salmonella enterica enterica serovar Typhi
ucgauauacuccgcgac

SEQ ID NO: 1651258 - RNA, 13 nt, Salmonella enterica enterica serovar Typhi
ucgauagcaggca

SEQ ID NO: 1651259 - RNA, 16 nt, Salmonella enterica enterica serovar Typhi
ucgauagcgccgcauc

SEQ ID NO: 1651260 - RNA, 14 nt, Salmonella enterica enterica serovar Typhi
ucgagugaaccgga

SEQ ID NO: 1651261 - RNA, 19 nt, Salmonella enterica enterica serovar Typhi
ucgagugucaauaagccag

SEQ ID NO: 1651262 - RNA, 16 nt, Salmonella enterica enterica serovar Typhi
ucgauaagccagcgau

SEQ ID NO: 1651263 - RNA, 16 nt, Salmonella enterica enterica serovar Typhi
ucgauaaccaccagcg

SEQ ID NO: 1651264 - RNA, 21 nt, Salmonella enterica enterica serovar Typhi
ucgaucucggccacguccguu

SEQ ID NO: 1651265 - RNA, 17 nt, Salmonella enterica enterica serovar Typhi
ucgaugauauccagcac

SEQ ID NO: 1651266 - RNA, 15 nt, Salmonella enterica enterica serovar Typhi
ucgauccccaacgac

SEQ ID NO: 1651267 - RNA, 20 nt, Salmonella enterica enterica serovar Typhi
ucgcaaacccacccgguaau

SEQ ID NO: 1651268 - RNA, 21 nt, Salmonella enterica enterica serovar Typhi
ucgaugcuggugaagacgcug

SEQ ID NO: 1651269 - RNA, 15 nt, Salmonella enterica enterica serovar Typhi
ugccggacgccacca

SEQ ID NO: 1651270 - RNA, 15 nt, Salmonella enterica enterica serovar Typhi
ugccggacugauacc

SEQ ID NO: 1651271 - RNA, 20 nt, Salmonella enterica enterica serovar Typhi
ugccgcuuuugccgcgacuu

SEQ ID NO: 1651272 - RNA, 23 nt, Salmonella enterica enterica serovar Typhi
ugccggaaagacggcagcgccau

SEQ ID NO: 1651273 - RNA, 22 nt, Salmonella enterica enterica serovar Typhi
ugccgccuccagcauacugaug

SEQ ID NO: 1651274 - RNA, 18 nt, Salmonella enterica enterica serovar Typhi
ugccgccgacaaccagcg

SEQ ID NO: 1651275 - RNA, 20 nt, Salmonella enterica enterica serovar Typhi
ugccgauuccaugcccaguu

SEQ ID NO: 1651276 - RNA, 19 nt, Salmonella enterica enterica serovar Typhi
ugccgcaaaugaccagauc

SEQ ID NO: 1651277 - RNA, 18 nt, Salmonella enterica enterica serovar Typhi
ugccgaucaccagcgcau

SEQ ID NO: 1651278 - RNA, 15 nt, Salmonella enterica enterica serovar Typhi
ugccgacuggcguga

SEQ ID NO: 1651279 - RNA, 17 nt, Salmonella enterica enterica serovar Typhi
ugcccggcggcgcgaug

SEQ ID NO: 1651280 - RNA, 23 nt, Salmonella enterica enterica serovar Typhi
ugcccggauacgggaucgauaau

SEQ ID NO: 1651281 - RNA, 15 nt, Salmonella enterica enterica serovar Typhi
ugcaugagcacgcgg

SEQ ID NO: 1651282 - RNA, 20 nt, Salmonella enterica enterica serovar Typhi
ugcauacguuucaccagcac

SEQ ID NO: 1651283 - RNA, 18 nt, Salmonella enterica enterica serovar Typhi
ugcaucgugagcgcguca

SEQ ID NO: 1651284 - RNA, 21 nt, Salmonella enterica enterica serovar Typhi
ugcauccgggguucgaauccc

SEQ ID NO: 1651285 - RNA, 17 nt, Salmonella enterica enterica serovar Typhi
ugcagugaaccaucggc

SEQ ID NO: 1651286 - RNA, 16 nt, Salmonella enterica enterica serovar Typhi
ugcauagccccagcgc

SEQ ID NO: 1651287 - RNA, 21 nt, Salmonella enterica enterica serovar Typhi
ugcaguucuguaggccggaua

SEQ ID NO: 1651288 - RNA, 17 nt, Salmonella enterica enterica serovar Typhi
ugcacgccacauugacc

SEQ ID NO: 1651289 - RNA, 18 nt, Salmonella enterica enterica serovar Typhi
ugcccaucgcaacgccgg

SEQ ID NO: 1651290 - RNA, 23 nt, Salmonella enterica enterica serovar Typhi
ugcccaucgcgccaugauucauc

SEQ ID NO: 1651291 - RNA, 11 nt, Salmonella enterica enterica serovar Typhi
ugcccagguua

SEQ ID NO: 1651292 - RNA, 19 nt, Salmonella enterica enterica serovar Typhi
ugccagcagaugaacggca

SEQ ID NO: 1651293 - RNA, 21 nt, Salmonella enterica enterica serovar Typhi
ugcggauuaucguccggcauc

SEQ ID NO: 1651294 - RNA, 20 nt, Salmonella enterica enterica serovar Typhi
ugcgcguuuagcgccagcag

SEQ ID NO: 1651295 - RNA, 17 nt, Salmonella enterica enterica serovar Typhi
ugcgcucucauagccga

SEQ ID NO: 1651296 - RNA, 16 nt, Salmonella enterica enterica serovar Typhi
ugcggcaucgaacggg

SEQ ID NO: 1651297 - RNA, 18 nt, Salmonella enterica enterica serovar Typhi
ugcggcauuagcaugggc

SEQ ID NO: 1651298 - RNA, 15 nt, Salmonella enterica enterica serovar Typhi
ugcggccauccugcg

SEQ ID NO: 1651299 - RNA, 15 nt, Salmonella enterica enterica serovar Typhi
ugcgccggcugcgcu

SEQ ID NO: 1651300 - RNA, 13 nt, Salmonella enterica enterica serovar Typhi
ugcgccagcguaa

SEQ ID NO: 1651301 - RNA, 20 nt, Salmonella enterica enterica serovar Typhi
ugcgccgcaucuuuugccgc

SEQ ID NO: 1651302 - RNA, 23 nt, Salmonella enterica enterica serovar Typhi
ugcgccgccauccggccuguaag

SEQ ID NO: 1651303 - RNA, 20 nt, Salmonella enterica enterica serovar Typhi
ugcgccuuauccggcgugua

SEQ ID NO: 1651304 - RNA, 18 nt, Salmonella enterica enterica serovar Typhi
ugcgccugucuccagcgc

SEQ ID NO: 1651305 - RNA, 23 nt, Salmonella enterica enterica serovar Typhi
ugcgccuguuagggcgcggcugg

SEQ ID NO: 1651306 - RNA, 16 nt, Salmonella enterica enterica serovar Typhi
ugcgccuguugacgcg

SEQ ID NO: 1651307 - RNA, 15 nt, Salmonella enterica enterica serovar Typhi
ugcgcggauaccggc

SEQ ID NO: 1651308 - RNA, 19 nt, Salmonella enterica enterica serovar Typhi
ugcgcggcaauuuccgcug

SEQ ID NO: 1651309 - RNA, 18 nt, Salmonella enterica enterica serovar Typhi
ugccucgcgcaccauaau

SEQ ID NO: 1651310 - RNA, 15 nt, Salmonella enterica enterica serovar Typhi
ugccugacgccugaa

SEQ ID NO: 1651311 - RNA, 22 nt, Salmonella enterica enterica serovar Typhi
ugccugcgcuuacggccaugga

SEQ ID NO: 1651312 - RNA, 14 nt, Salmonella enterica enterica serovar Typhi
ugccugaucgccac

SEQ ID NO: 1651313 - RNA, 21 nt, Salmonella enterica enterica serovar Typhi
ugccugaguucuccgcugacg

SEQ ID NO: 1651314 - RNA, 17 nt, Salmonella enterica enterica serovar Typhi
ugccugauuucccaguu

SEQ ID NO: 1651315 - RNA, 21 nt, Salmonella enterica enterica serovar Typhi
ugccgucgccggaaugcgaau

SEQ ID NO: 1651316 - RNA, 17 nt, Salmonella enterica enterica serovar Typhi
ugccguaaggcgauuca

SEQ ID NO: 1651317 - RNA, 12 nt, Salmonella enterica enterica serovar Typhi
ugccgggcgcug

SEQ ID NO: 1651318 - RNA, 21 nt, Salmonella enterica enterica serovar Typhi
ugccgggcauaaacuaauccc

SEQ ID NO: 1651319 - RNA, 18 nt, Salmonella enterica enterica serovar Typhi
ugcgcauccucuuuccgu

SEQ ID NO: 1651320 - RNA, 21 nt, Salmonella enterica enterica serovar Typhi
ugcgcaacaugccugauggcg

SEQ ID NO: 1651321 - RNA, 22 nt, Salmonella enterica enterica serovar Typhi
ugcgacgcgcucaccuccgcca

SEQ ID NO: 1651322 - RNA, 13 nt, Salmonella enterica enterica serovar Typhi
ugccugugccagc

SEQ ID NO: 1651323 - RNA, 21 nt, Salmonella enterica enterica serovar Typhi
ugccuggcaacaugaccagcg

SEQ ID NO: 1651324 - RNA, 18 nt, Salmonella enterica enterica serovar Typhi
ugcgacaacaaugaaacg

SEQ ID NO: 1651325 - RNA, 17 nt, Salmonella enterica enterica serovar Typhi
ugagcugacugacguga

SEQ ID NO: 1651326 - RNA, 11 nt, Salmonella enterica enterica serovar Typhi
ugagggcgaua

SEQ ID NO: 1651327 - RNA, 16 nt, Salmonella enterica enterica serovar Typhi
ugaggcugaagcgcga

SEQ ID NO: 1651328 - RNA, 16 nt, Salmonella enterica enterica serovar Typhi
ugagcgcuugcugcgu

SEQ ID NO: 1651329 - RNA, 18 nt, Salmonella enterica enterica serovar Typhi
ugagcgcuugcugcguaa

SEQ ID NO: 1651330 - RNA, 16 nt, Salmonella enterica enterica serovar Typhi
ugagcgucaggccauc

SEQ ID NO: 1651331 - RNA, 22 nt, Salmonella enterica enterica serovar Typhi
ugagcguuagcgccauccggca

SEQ ID NO: 1651332 - RNA, 15 nt, Salmonella enterica enterica serovar Typhi
ugagcauugcgcuca

SEQ ID NO: 1651333 - RNA, 13 nt, Salmonella enterica enterica serovar Typhi
ugagcacgcggaa

SEQ ID NO: 1651334 - RNA, 11 nt, Salmonella enterica enterica serovar Typhi
ugacgcugccc

SEQ ID NO: 1651335 - RNA, 18 nt, Salmonella enterica enterica serovar Typhi
ugacgcuucgcuuauccg

SEQ ID NO: 1651336 - RNA, 16 nt, Salmonella enterica enterica serovar Typhi
ugacgcugaugaaaac

SEQ ID NO: 1651337 - RNA, 19 nt, Salmonella enterica enterica serovar Typhi
ugacgcuaacgcuuauccg

SEQ ID NO: 1651338 - RNA, 17 nt, Salmonella enterica enterica serovar Typhi
ugacgggcgaucgacua

SEQ ID NO: 1651339 - RNA, 21 nt, Salmonella enterica enterica serovar Typhi
ugauuccuggcuugccagaua

SEQ ID NO: 1651340 - RNA, 18 nt, Salmonella enterica enterica serovar Typhi
ugauucugugaugaugcg

SEQ ID NO: 1651341 - RNA, 15 nt, Salmonella enterica enterica serovar Typhi
ugcaaauaccacauc

SEQ ID NO: 1651342 - RNA, 18 nt, Salmonella enterica enterica serovar Typhi
ugaugcguauccagcgcg

SEQ ID NO: 1651343 - RNA, 20 nt, Salmonella enterica enterica serovar Typhi
ugaugcuguaggccggguaa

SEQ ID NO: 1651344 - RNA, 13 nt, Salmonella enterica enterica serovar Typhi
ugauuaaagccac

SEQ ID NO: 1651345 - RNA, 14 nt, Salmonella enterica enterica serovar Typhi
ugauuacagccggu

SEQ ID NO: 1651346 - RNA, 14 nt, Salmonella enterica enterica serovar Typhi
ugcaauuccggcga

SEQ ID NO: 1651347 - RNA, 23 nt, Salmonella enterica enterica serovar Typhi
ugcacaaaacccgcagccggaua

SEQ ID NO: 1651348 - RNA, 13 nt, Salmonella enterica enterica serovar Typhi
ugcaaauccgcca

SEQ ID NO: 1651349 - RNA, 17 nt, Salmonella enterica enterica serovar Typhi
ugcaacugcgcggcaau

SEQ ID NO: 1651350 - RNA, 15 nt, Salmonella enterica enterica serovar Typhi
ugcaauaucgcggca

SEQ ID NO: 1651351 - RNA, 20 nt, Salmonella enterica enterica serovar Typhi
ugcaauuguuccugcgucgg

SEQ ID NO: 1651352 - RNA, 24 nt, Salmonella enterica enterica serovar Typhi
ugcacaacacgcuuuucagcgcca

SEQ ID NO: 1651353 - RNA, 22 nt, Salmonella enterica enterica serovar Typhi
ugcacaauacgccgagcaucgc

SEQ ID NO: 1651354 - RNA, 22 nt, Salmonella enterica enterica serovar Typhi
ugauaaacgcaaugucaucagg

SEQ ID NO: 1651355 - RNA, 18 nt, Salmonella enterica enterica serovar Typhi
ugauaaaaaacaguacgg

SEQ ID NO: 1651356 - RNA, 22 nt, Salmonella enterica enterica serovar Typhi
ugauaaaacauuccaucgccau

SEQ ID NO: 1651357 - RNA, 18 nt, Salmonella enterica enterica serovar Typhi
ugauccaccaccagcauc

SEQ ID NO: 1651358 - RNA, 14 nt, Salmonella enterica enterica serovar Typhi
ugauccgaugcgcu

SEQ ID NO: 1651359 - RNA, 19 nt, Salmonella enterica enterica serovar Typhi
ugauccuguaacgcauaag

SEQ ID NO: 1651360 - RNA, 21 nt, Salmonella enterica enterica serovar Typhi
ugaucgaaaaugcgcaugaug

SEQ ID NO: 1651361 - RNA, 17 nt, Salmonella enterica enterica serovar Typhi
ugaucgcuggugcccgg

SEQ ID NO: 1651362 - RNA, 17 nt, Salmonella enterica enterica serovar Typhi
ugaucgccaaagcguaa

SEQ ID NO: 1651363 - RNA, 13 nt, Salmonella enterica enterica serovar Typhi
ugaucugcgcaac

SEQ ID NO: 1651364 - RNA, 18 nt, Salmonella enterica enterica serovar Typhi
ugaugcgcggaauagcgg

SEQ ID NO: 1651365 - RNA, 16 nt, Salmonella enterica enterica serovar Typhi
ugaucucuugcauaau

SEQ ID NO: 1651366 - RNA, 20 nt, Salmonella enterica enterica serovar Typhi
ugaucuucauaaauagccag

SEQ ID NO: 1651367 - RNA, 13 nt, Salmonella enterica enterica serovar Typhi
ugaccuacaggcc

SEQ ID NO: 1651368 - RNA, 13 nt, Salmonella enterica enterica serovar Typhi
ugaccugcggcgc

SEQ ID NO: 1651369 - RNA, 19 nt, Salmonella enterica enterica serovar Typhi
ugacauuugcaucaaacuu

SEQ ID NO: 1651370 - RNA, 22 nt, Salmonella enterica enterica serovar Typhi
ugacaauuuccagaugcggcgc

SEQ ID NO: 1651371 - RNA, 18 nt, Salmonella enterica enterica serovar Typhi
ugacagcaucgauuccgc

SEQ ID NO: 1651372 - RNA, 15 nt, Salmonella enterica enterica serovar Typhi
ugaccgaaaucuucg

SEQ ID NO: 1651373 - RNA, 16 nt, Salmonella enterica enterica serovar Typhi
ugaccaugcauauaag

SEQ ID NO: 1651374 - RNA, 15 nt, Salmonella enterica enterica serovar Typhi
ugaccacggcgucaa

SEQ ID NO: 1651375 - RNA, 14 nt, Salmonella enterica enterica serovar Typhi
ugaccaucgccagc

SEQ ID NO: 1651376 - RNA, 14 nt, Salmonella enterica enterica serovar Typhi
ugaaaucgguaauc

SEQ ID NO: 1651377 - RNA, 15 nt, Salmonella enterica enterica serovar Typhi
ugaaaucgucgccaa

SEQ ID NO: 1651378 - RNA, 20 nt, Salmonella enterica enterica serovar Typhi
ugaaccgucgccuccagcga

SEQ ID NO: 1651379 - RNA, 14 nt, Salmonella enterica enterica serovar Typhi
ugaacgaagcauuu

SEQ ID NO: 1651380 - RNA, 19 nt, Salmonella enterica enterica serovar Typhi
ugaaccagcaucccacgaa

SEQ ID NO: 1651381 - RNA, 17 nt, Salmonella enterica enterica serovar Typhi
ucuuucaauaauggcgc

SEQ ID NO: 1651382 - RNA, 18 nt, Salmonella enterica enterica serovar Typhi
ucuuugagcaucaaacuu

SEQ ID NO: 1651383 - RNA, 23 nt, Salmonella enterica enterica serovar Typhi
ucucccgacaccagccguucacc

SEQ ID NO: 1651384 - RNA, 15 nt, Salmonella enterica enterica serovar Typhi
ucuccaguaucagcg

SEQ ID NO: 1651385 - RNA, 14 nt, Salmonella enterica enterica serovar Typhi
ugaaacucacugaa

SEQ ID NO: 1651386 - RNA, 12 nt, Salmonella enterica enterica serovar Typhi
ugaaagcgcaaa

SEQ ID NO: 1651387 - RNA, 16 nt, Salmonella enterica enterica serovar Typhi
ugaaugccggauggcg

SEQ ID NO: 1651388 - RNA, 22 nt, Salmonella enterica enterica serovar Typhi
ugaaucccuguucaaaagccug

SEQ ID NO: 1651389 - RNA, 15 nt, Salmonella enterica enterica serovar Typhi
ugaauccaggccaga

SEQ ID NO: 1651390 - RNA, 20 nt, Salmonella enterica enterica serovar Typhi
ugaaucaucaucauccgcgc

SEQ ID NO: 1651391 - RNA, 21 nt, Salmonella enterica enterica serovar Typhi
ugaauagccagcccccugcca

SEQ ID NO: 1651392 - RNA, 16 nt, Salmonella enterica enterica serovar Typhi
ugaauaccaaagcccg

SEQ ID NO: 1651393 - RNA, 14 nt, Salmonella enterica enterica serovar Typhi
ugacaaugacgcaa

SEQ ID NO: 1651394 - RNA, 20 nt, Salmonella enterica enterica serovar Typhi
ugaaugcucucauauuccag

SEQ ID NO: 1651395 - RNA, 18 nt, Salmonella enterica enterica serovar Typhi
ugaauugauuagcuuuaa

SEQ ID NO: 1651396 - RNA, 16 nt, Salmonella enterica enterica serovar Typhi
ugaaguuauccagcgc

SEQ ID NO: 1651397 - RNA, 13 nt, Salmonella enterica enterica serovar Typhi
ugaauaaauccuu

SEQ ID NO: 1651398 - RNA, 20 nt, Salmonella enterica enterica serovar Typhi
ugaagcuguuuugucggcca

SEQ ID NO: 1651399 - RNA, 22 nt, Salmonella enterica enterica serovar Typhi
uaugccugauggcgcuacgcuu

SEQ ID NO: 1651400 - RNA, 21 nt, Salmonella enterica enterica serovar Typhi
uaugccggauaguuacccggc

SEQ ID NO: 1651401 - RNA, 14 nt, Salmonella enterica enterica serovar Typhi
uaugcaaaacguag

SEQ ID NO: 1651402 - RNA, 20 nt, Salmonella enterica enterica serovar Typhi
uaugcacaggcggcgguuca

SEQ ID NO: 1651403 - RNA, 12 nt, Salmonella enterica enterica serovar Typhi
uaucuugcuuua

SEQ ID NO: 1651404 - RNA, 14 nt, Salmonella enterica enterica serovar Typhi
uaucuuccagcgcg

SEQ ID NO: 1651405 - RNA, 22 nt, Salmonella enterica enterica serovar Typhi
uaucuuccggcaucacaucgcc

SEQ ID NO: 1651406 - RNA, 23 nt, Salmonella enterica enterica serovar Typhi
uaucuuccggugugaccagcgcg

SEQ ID NO: 1651407 - RNA, 23 nt, Salmonella enterica enterica serovar Typhi
uaucugccgcgcccgccaucgcc

SEQ ID NO: 1651408 - RNA, 17 nt, Salmonella enterica enterica serovar Typhi
uaucgcuuuaaucaguu

SEQ ID NO: 1651409 - RNA, 10 nt, Salmonella enterica enterica serovar Typhi
uaucgcuauc

SEQ ID NO: 1651410 - RNA, 23 nt, Salmonella enterica enterica serovar Typhi
uaucgcucgucgcgacguccgcc

SEQ ID NO: 1651411 - RNA, 15 nt, Salmonella enterica enterica serovar Typhi
uaucgcccagauggc

SEQ ID NO: 1651412 - RNA, 21 nt, Salmonella enterica enterica serovar Typhi
uaucgccgaaagcgaucacau

SEQ ID NO: 1651413 - RNA, 14 nt, Salmonella enterica enterica serovar Typhi
uaucgccgaucaca

SEQ ID NO: 1651414 - RNA, 21 nt, Salmonella enterica enterica serovar Typhi
uaucgccgcccguuuccgcua

SEQ ID NO: 1651415 - RNA, 15 nt, Salmonella enterica enterica serovar Typhi
uaucgccuggagcug

SEQ ID NO: 1651416 - RNA, 13 nt, Salmonella enterica enterica serovar Typhi
uaucgagauaaug

SEQ ID NO: 1651417 - RNA, 22 nt, Salmonella enterica enterica serovar Typhi
uaucgauggcagucgcaucaug

SEQ ID NO: 1651418 - RNA, 21 nt, Salmonella enterica enterica serovar Typhi
uagcggcgccuuguccggcgu

SEQ ID NO: 1651419 - RNA, 15 nt, Salmonella enterica enterica serovar Typhi
uagcgccaucaggca

SEQ ID NO: 1651420 - RNA, 15 nt, Salmonella enterica enterica serovar Typhi
uagcgguacgcaagc

SEQ ID NO: 1651421 - RNA, 21 nt, Salmonella enterica enterica serovar Typhi
uagcgggcuguuuuccagcgg

SEQ ID NO: 1651422 - RNA, 17 nt, Salmonella enterica enterica serovar Typhi
uauccuggccugauaag

SEQ ID NO: 1651423 - RNA, 14 nt, Salmonella enterica enterica serovar Typhi
uauugcauggcaau

SEQ ID NO: 1651424 - RNA, 18 nt, Salmonella enterica enterica serovar Typhi
uauuagccaaagcgguaa

SEQ ID NO: 1651425 - RNA, 21 nt, Salmonella enterica enterica serovar Typhi
uaugcgucaaaguugcaucaa

SEQ ID NO: 1651426 - RNA, 15 nt, Salmonella enterica enterica serovar Typhi
uaugcgcauagauau

SEQ ID NO: 1651427 - RNA, 12 nt, Salmonella enterica enterica serovar Typhi
uaugcgccaacu

SEQ ID NO: 1651428 - RNA, 20 nt, Salmonella enterica enterica serovar Typhi
uaugccggaugacgcuaacg

SEQ ID NO: 1651429 - RNA, 19 nt, Salmonella enterica enterica serovar Typhi
uaugcgcaugggcauaauc

SEQ ID NO: 1651430 - RNA, 16 nt, Salmonella enterica enterica serovar Typhi
uauuacaagcaguuaa

SEQ ID NO: 1651431 - RNA, 16 nt, Salmonella enterica enterica serovar Typhi
uauuacaugccguuaa

SEQ ID NO: 1651432 - RNA, 23 nt, Salmonella enterica enterica serovar Typhi
uauuucagaccgugcuuuugcag

SEQ ID NO: 1651433 - RNA, 15 nt, Salmonella enterica enterica serovar Typhi
uauuuaccgccgcuu

SEQ ID NO: 1651434 - RNA, 12 nt, Salmonella enterica enterica serovar Typhi
uauugccauaaa

SEQ ID NO: 1651435 - RNA, 20 nt, Salmonella enterica enterica serovar Typhi
ucaacgcaggcuggagagcg

SEQ ID NO: 1651436 - RNA, 18 nt, Salmonella enterica enterica serovar Typhi
ucaacacuuagaacgcgg

SEQ ID NO: 1651437 - RNA, 13 nt, Salmonella enterica enterica serovar Typhi
ucaacacgcgcac

SEQ ID NO: 1651438 - RNA, 21 nt, Salmonella enterica enterica serovar Typhi
ucaacaucagcgcuaccagcg

SEQ ID NO: 1651439 - RNA, 23 nt, Salmonella enterica enterica serovar Typhi
ucaacauacgccgccagccacug

SEQ ID NO: 1651440 - RNA, 15 nt, Salmonella enterica enterica serovar Typhi
ucaacaucaucggau

SEQ ID NO: 1651441 - RNA, 18 nt, Salmonella enterica enterica serovar Typhi
ucaacagcggcggcaguu

SEQ ID NO: 1651442 - RNA, 14 nt, Salmonella enterica enterica serovar Typhi
ucaacaaucguuaa

SEQ ID NO: 1651443 - RNA, 17 nt, Salmonella enterica enterica serovar Typhi
ucaacaaauuccggcac

SEQ ID NO: 1651444 - RNA, 19 nt, Salmonella enterica enterica serovar Typhi
ucaaacgccgauggcgcca

SEQ ID NO: 1651445 - RNA, 23 nt, Salmonella enterica enterica serovar Typhi
ucaaacaggcggcuguugguuua

SEQ ID NO: 1651446 - RNA, 13 nt, Salmonella enterica enterica serovar Typhi
ucaaaccacgcug

SEQ ID NO: 1651447 - RNA, 14 nt, Salmonella enterica enterica serovar Typhi
ucaaaaucgcgccc

SEQ ID NO: 1651448 - RNA, 16 nt, Salmonella enterica enterica serovar Typhi
ucaaaaucaucgccac

SEQ ID NO: 1651449 - RNA, 16 nt, Salmonella enterica enterica serovar Typhi
ucaaacacgaccagcg

SEQ ID NO: 1651450 - RNA, 18 nt, Salmonella enterica enterica serovar Typhi
ucaaagccacacugcauc

SEQ ID NO: 1651451 - RNA, 16 nt, Salmonella enterica enterica serovar Typhi
ucaaagaccuccgccc

SEQ ID NO: 1651452 - RNA, 21 nt, Salmonella enterica enterica serovar Typhi
ucaaacuccccugucguuaau

SEQ ID NO: 1651453 - RNA, 15 nt, Salmonella enterica enterica serovar Typhi
ucaacggcaaaucgc

SEQ ID NO: 1651454 - RNA, 22 nt, Salmonella enterica enterica serovar Typhi
ucaacguccccguuugcagucc

SEQ ID NO: 1651455 - RNA, 23 nt, Salmonella enterica enterica serovar Typhi
ucaagcgguuugaaaauggcguu

SEQ ID NO: 1651456 - RNA, 17 nt, Salmonella enterica enterica serovar Typhi
ucaagcuuuuugcgcca

SEQ ID NO: 1651457 - RNA, 16 nt, Salmonella enterica enterica serovar Typhi
ucaagcuuugcguaaa

SEQ ID NO: 1651458 - RNA, 16 nt, Salmonella enterica enterica serovar Typhi
ucaagaguaggccgga

SEQ ID NO: 1651459 - RNA, 20 nt, Salmonella enterica enterica serovar Typhi
ucaagauaaaaagacagaua

SEQ ID NO: 1651460 - RNA, 21 nt, Salmonella enterica enterica serovar Typhi
ucaauacgcgacagcgcgcca

SEQ ID NO: 1651461 - RNA, 15 nt, Salmonella enterica enterica serovar Typhi
ucaauacgcauaaug

SEQ ID NO: 1651462 - RNA, 19 nt, Salmonella enterica enterica serovar Typhi
ucaauauucacuucgccca

SEQ ID NO: 1651463 - RNA, 16 nt, Salmonella enterica enterica serovar Typhi
ucaauauuaucguaau

SEQ ID NO: 1651464 - RNA, 13 nt, Salmonella enterica enterica serovar Typhi
ucaauauccugcg

SEQ ID NO: 1651465 - RNA, 15 nt, Salmonella enterica enterica serovar Typhi
ucaaugcacgccaca

SEQ ID NO: 1651466 - RNA, 24 nt, Salmonella enterica enterica serovar Typhi
ucaaugcccaggcgccgcucauca

SEQ ID NO: 1651467 - RNA, 13 nt, Salmonella enterica enterica serovar Typhi
ucaaucgccaguu

SEQ ID NO: 1651468 - RNA, 18 nt, Salmonella enterica enterica serovar Typhi
ucaaucgucagacggaca

SEQ ID NO: 1651469 - RNA, 15 nt, Salmonella enterica enterica serovar Typhi
ucagauauuccagcg

SEQ ID NO: 1651470 - RNA, 21 nt, Salmonella enterica enterica serovar Typhi
ucagauguccaccgauuucau

SEQ ID NO: 1651471 - RNA, 19 nt, Salmonella enterica enterica serovar Typhi
ucagauugaucaucaccga

SEQ ID NO: 1651472 - RNA, 21 nt, Salmonella enterica enterica serovar Typhi
ucagauggugauagcgcgcca

SEQ ID NO: 1651473 - RNA, 15 nt, Salmonella enterica enterica serovar Typhi
ucagcaccuccagcg

SEQ ID NO: 1651474 - RNA, 16 nt, Salmonella enterica enterica serovar Typhi
ucagcagcgaauagcg

SEQ ID NO: 1651475 - RNA, 17 nt, Salmonella enterica enterica serovar Typhi
ucagcagaggaaaacgu

SEQ ID NO: 1651476 - RNA, 23 nt, Salmonella enterica enterica serovar Typhi
ucagcauuacccccgccauaaug

SEQ ID NO: 1651477 - RNA, 20 nt, Salmonella enterica enterica serovar Typhi
ucagcaggcggcuucgcauc

SEQ ID NO: 1651478 - RNA, 14 nt, Salmonella enterica enterica serovar Typhi
ucagccaggucugc

SEQ ID NO: 1651479 - RNA, 15 nt, Salmonella enterica enterica serovar Typhi
ucacuaacgcggcau

SEQ ID NO: 1651480 - RNA, 19 nt, Salmonella enterica enterica serovar Typhi
ucacguugacgcaaacugc

SEQ ID NO: 1651481 - RNA, 22 nt, Salmonella enterica enterica serovar Typhi
ucacuaggcguuagaauaacgu

SEQ ID NO: 1651482 - RNA, 19 nt, Salmonella enterica enterica serovar Typhi
ucagaaccucaucccggcu

SEQ ID NO: 1651483 - RNA, 14 nt, Salmonella enterica enterica serovar Typhi
ucacuuuuaccggc

SEQ ID NO: 1651484 - RNA, 19 nt, Salmonella enterica enterica serovar Typhi
ucagaaaaaccuccggcua

SEQ ID NO: 1651485 - RNA, 23 nt, Salmonella enterica enterica serovar Typhi
ucagaaacaacacaaaucgggcg

SEQ ID NO: 1651486 - RNA, 15 nt, Salmonella enterica enterica serovar Typhi
ucagaacugauaguu

SEQ ID NO: 1651487 - RNA, 16 nt, Salmonella enterica enterica serovar Typhi
ucagaaccugcgauac

SEQ ID NO: 1651488 - RNA, 20 nt, Salmonella enterica enterica serovar Typhi
ucagaauacagaauccggcg

SEQ ID NO: 1651489 - RNA, 13 nt, Salmonella enterica enterica serovar Typhi
ucaccgucggacu

SEQ ID NO: 1651490 - RNA, 18 nt, Salmonella enterica enterica serovar Typhi
ucacgcgcaaagcugcgg

SEQ ID NO: 1651491 - RNA, 14 nt, Salmonella enterica enterica serovar Typhi
ucaccugcaucacg

SEQ ID NO: 1651492 - RNA, 18 nt, Salmonella enterica enterica serovar Typhi
ucacgccgauaaugcguu

SEQ ID NO: 1651493 - RNA, 18 nt, Salmonella enterica enterica serovar Typhi
ucacacuacacgaauacc

SEQ ID NO: 1651494 - RNA, 21 nt, Salmonella enterica enterica serovar Typhi
ucacacugcgccgccagcgac

SEQ ID NO: 1651495 - RNA, 14 nt, Salmonella enterica enterica serovar Typhi
ucacaucgccaguu

SEQ ID NO: 1651496 - RNA, 15 nt, Salmonella enterica enterica serovar Typhi
ucaccaccugcuguu

SEQ ID NO: 1651497 - RNA, 20 nt, Salmonella enterica enterica serovar Typhi
ucacaaaggccagcagcagc

SEQ ID NO: 1651498 - RNA, 22 nt, Salmonella enterica enterica serovar Typhi
ucacaauguuuuuguaccaggc

SEQ ID NO: 1651499 - RNA, 20 nt, Salmonella enterica enterica serovar Typhi
ucacaaauuugaauaaaacg

SEQ ID NO: 1651500 - RNA, 22 nt, Salmonella enterica enterica serovar Typhi
ucacaaacaccaccaguaaccg

SEQ ID NO: 1651501 - RNA, 17 nt, Salmonella enterica enterica serovar Typhi
ucaauuccuggaacuga

SEQ ID NO: 1651502 - RNA, 14 nt, Salmonella enterica enterica serovar Typhi
ucaauuccacaggc

SEQ ID NO: 1651503 - RNA, 17 nt, Salmonella enterica enterica serovar Typhi
ucaaugccgucggcaau

SEQ ID NO: 1651504 - RNA, 23 nt, Salmonella enterica enterica serovar Typhi
ucaccaggucaaaauuaaucgcc

SEQ ID NO: 1651505 - RNA, 16 nt, Salmonella enterica enterica serovar Typhi
ucacccauuuuauccu

SEQ ID NO: 1651506 - RNA, 17 nt, Salmonella enterica enterica serovar Typhi
ucaccaucauaaagccg

SEQ ID NO: 1651507 - RNA, 16 nt, Salmonella enterica enterica serovar Typhi
ucaccauucccagcgc

SEQ ID NO: 1651508 - RNA, 20 nt, Salmonella enterica enterica serovar Typhi
ucacccagacugugauggcg

SEQ ID NO: 1651509 - RNA, 15 nt, Salmonella enterica enterica serovar Typhi
ucaccgccucaucgg

SEQ ID NO: 1651510 - RNA, 19 nt, Salmonella enterica enterica serovar Typhi
ucacccgcauaugcggcga

SEQ ID NO: 1651511 - RNA, 16 nt, Salmonella enterica enterica serovar Typhi
ucauagcggcuaccgc

SEQ ID NO: 1651512 - RNA, 22 nt, Salmonella enterica enterica serovar Typhi
ucauagcggcuaccgcguaaug

SEQ ID NO: 1651513 - RNA, 18 nt, Salmonella enterica enterica serovar Typhi
ucauacggauauuacgcu

SEQ ID NO: 1651514 - RNA, 14 nt, Salmonella enterica enterica serovar Typhi
ucauacaccgcauc

SEQ ID NO: 1651515 - RNA, 19 nt, Salmonella enterica enterica serovar Typhi
ucauaccggauauggcaaa

SEQ ID NO: 1651516 - RNA, 22 nt, Salmonella enterica enterica serovar Typhi
ucauagacugcgcuuaacgcuu

SEQ ID NO: 1651517 - RNA, 18 nt, Salmonella enterica enterica serovar Typhi
ucauagccgacccgcauc

SEQ ID NO: 1651518 - RNA, 20 nt, Salmonella enterica enterica serovar Typhi
ucauagccgcuuuccgccgc

SEQ ID NO: 1651519 - RNA, 22 nt, Salmonella enterica enterica serovar Typhi
ucauacugaagauaaacagcag

SEQ ID NO: 1651520 - RNA, 20 nt, Salmonella enterica enterica serovar Typhi
ucauagacgcgguuaucucu

SEQ ID NO: 1651521 - RNA, 17 nt, Salmonella enterica enterica serovar Typhi
ucaguaaaucccgcauc

SEQ ID NO: 1651522 - RNA, 16 nt, Salmonella enterica enterica serovar Typhi
ucagguuuucuaucgc

SEQ ID NO: 1651523 - RNA, 16 nt, Salmonella enterica enterica serovar Typhi
ucaguaugaugaccug

SEQ ID NO: 1651524 - RNA, 15 nt, Salmonella enterica enterica serovar Typhi
ucagcgaccaguugu

SEQ ID NO: 1651525 - RNA, 23 nt, Salmonella enterica enterica serovar Typhi
ucagccuugaccgccugaucguu

SEQ ID NO: 1651526 - RNA, 22 nt, Salmonella enterica enterica serovar Typhi
ucaggcguagagaggcauccgc

SEQ ID NO: 1651527 - RNA, 14 nt, Salmonella enterica enterica serovar Typhi
ucaugaaccacgcc

SEQ ID NO: 1651528 - RNA, 16 nt, Salmonella enterica enterica serovar Typhi
ucaucugaugauuaau

SEQ ID NO: 1651529 - RNA, 20 nt, Salmonella enterica enterica serovar Typhi
ucaucucccccgcauuucau

SEQ ID NO: 1651530 - RNA, 23 nt, Salmonella enterica enterica serovar Typhi
ucaucuucagcaacugcugcgcg

SEQ ID NO: 1651531 - RNA, 15 nt, Salmonella enterica enterica serovar Typhi
ucaugcguaaaucgc

SEQ ID NO: 1651532 - RNA, 20 nt, Salmonella enterica enterica serovar Typhi
ucaugcugcguacaaucgcg

SEQ ID NO: 1651533 - RNA, 21 nt, Salmonella enterica enterica serovar Typhi
ucauuaauuuacugauaaagg

SEQ ID NO: 1651534 - RNA, 23 nt, Salmonella enterica enterica serovar Typhi
ucauguugccggauagcucgcug

SEQ ID NO: 1651535 - RNA, 17 nt, Salmonella enterica enterica serovar Typhi
ucaucgauuuccugaug

SEQ ID NO: 1651536 - RNA, 14 nt, Salmonella enterica enterica serovar Typhi
ucaucaaaaugcac

SEQ ID NO: 1651537 - RNA, 18 nt, Salmonella enterica enterica serovar Typhi
ucauaugugccgauggcg

SEQ ID NO: 1651538 - RNA, 17 nt, Salmonella enterica enterica serovar Typhi
ucauccccagcaucaug

SEQ ID NO: 1651539 - RNA, 21 nt, Salmonella enterica enterica serovar Typhi
ucauccggcguugcgccgcca

SEQ ID NO: 1651540 - RNA, 18 nt, Salmonella enterica enterica serovar Typhi
ucauccggguuaaaccag

SEQ ID NO: 1651541 - RNA, 21 nt, Salmonella enterica enterica serovar Typhi
ucauccgguucauaauccgga

SEQ ID NO: 1651542 - RNA, 16 nt, Salmonella enterica enterica serovar Typhi
ucauccugcaggcggc

SEQ ID NO: 1651543 - RNA, 21 nt, Salmonella enterica enterica serovar Typhi
uccagacccagacggcgauac

SEQ ID NO: 1651544 - RNA, 14 nt, Salmonella enterica enterica serovar Typhi
uccagaccaagauc

SEQ ID NO: 1651545 - RNA, 20 nt, Salmonella enterica enterica serovar Typhi
uccagaauguuccugcaaua

SEQ ID NO: 1651546 - RNA, 20 nt, Salmonella enterica enterica serovar Typhi
uccagcacgcgcugcgccgc

SEQ ID NO: 1651547 - RNA, 13 nt, Salmonella enterica enterica serovar Typhi
uccagaccggcgc

SEQ ID NO: 1651548 - RNA, 21 nt, Salmonella enterica enterica serovar Typhi
uccaccccuugcgcguuucug

SEQ ID NO: 1651549 - RNA, 15 nt, Salmonella enterica enterica serovar Typhi
uccacgcacgccggc

SEQ ID NO: 1651550 - RNA, 13 nt, Salmonella enterica enterica serovar Typhi
uccacgacauccg

SEQ ID NO: 1651551 - RNA, 17 nt, Salmonella enterica enterica serovar Typhi
ucauuaggcguaauuau

SEQ ID NO: 1651552 - RNA, 23 nt, Salmonella enterica enterica serovar Typhi
ucauuaggcguaauuauuacaga

SEQ ID NO: 1651553 - RNA, 18 nt, Salmonella enterica enterica serovar Typhi
ucauuaccuuuuccggcg

SEQ ID NO: 1651554 - RNA, 13 nt, Salmonella enterica enterica serovar Typhi
uccacaaccggcu

SEQ ID NO: 1651555 - RNA, 16 nt, Salmonella enterica enterica serovar Typhi
uccaaugcggcaucuc

SEQ ID NO: 1651556 - RNA, 13 nt, Salmonella enterica enterica serovar Typhi
uccaaguauugau

SEQ ID NO: 1651557 - RNA, 14 nt, Salmonella enterica enterica serovar Typhi
uccaguaacgcguc

SEQ ID NO: 1651558 - RNA, 22 nt, Salmonella enterica enterica serovar Typhi
uccagguuucuggcaacagcca

SEQ ID NO: 1651559 - RNA, 15 nt, Salmonella enterica enterica serovar Typhi
uccaguagcagcgau

SEQ ID NO: 1651560 - RNA, 20 nt, Salmonella enterica enterica serovar Typhi
uccaguucguucugcgucgc

SEQ ID NO: 1651561 - RNA, 16 nt, Salmonella enterica enterica serovar Typhi
uccaguucgagccgga

SEQ ID NO: 1651562 - RNA, 13 nt, Salmonella enterica enterica serovar Typhi
uccaguuaccgcc

SEQ ID NO: 1651563 - RNA, 16 nt, Salmonella enterica enterica serovar Typhi
uccgacaugacgucgc

SEQ ID NO: 1651564 - RNA, 15 nt, Salmonella enterica enterica serovar Typhi
ucccguagcgucaac

SEQ ID NO: 1651565 - RNA, 18 nt, Salmonella enterica enterica serovar Typhi
ucccggcuuaaauggcgc

SEQ ID NO: 1651566 - RNA, 13 nt, Salmonella enterica enterica serovar Typhi
uccgccaccauga

SEQ ID NO: 1651567 - RNA, 19 nt, Salmonella enterica enterica serovar Typhi
uccgcaaagcccaucagcg

SEQ ID NO: 1651568 - RNA, 22 nt, Salmonella enterica enterica serovar Typhi
uccgcaagacacgcuuccagau

SEQ ID NO: 1651569 - RNA, 16 nt, Salmonella enterica enterica serovar Typhi
uccgccaccgcgcgca

SEQ ID NO: 1651570 - RNA, 20 nt, Salmonella enterica enterica serovar Typhi
uccgccaggcggguggugag

SEQ ID NO: 1651571 - RNA, 23 nt, Salmonella enterica enterica serovar Typhi
uccgcccaagaacaugacggcag

SEQ ID NO: 1651572 - RNA, 15 nt, Salmonella enterica enterica serovar Typhi
uccgccugaaucgcc

SEQ ID NO: 1651573 - RNA, 16 nt, Salmonella enterica enterica serovar Typhi
uccgcgcaauaugcgg

SEQ ID NO: 1651574 - RNA, 19 nt, Salmonella enterica enterica serovar Typhi
uccgcgcaauaugcggcgc

SEQ ID NO: 1651575 - RNA, 16 nt, Salmonella enterica enterica serovar Typhi
uccgcgcaaucgccga

SEQ ID NO: 1651576 - RNA, 14 nt, Salmonella enterica enterica serovar Typhi
uccggcgauagcgg

SEQ ID NO: 1651577 - RNA, 14 nt, Salmonella enterica enterica serovar Typhi
uccggcuaugccgg

SEQ ID NO: 1651578 - RNA, 12 nt, Salmonella enterica enterica serovar Typhi
uccggcguuucg

SEQ ID NO: 1651579 - RNA, 12 nt, Salmonella enterica enterica serovar Typhi
uccggaucgccg

SEQ ID NO: 1651580 - RNA, 15 nt, Salmonella enterica enterica serovar Typhi
uccggccuacucuug

SEQ ID NO: 1651581 - RNA, 18 nt, Salmonella enterica enterica serovar Typhi
uccgcguuuaucgcauac

SEQ ID NO: 1651582 - RNA, 23 nt, Salmonella enterica enterica serovar Typhi
uccgcgcgcuuuuuuggcguaga

SEQ ID NO: 1651583 - RNA, 15 nt, Salmonella enterica enterica serovar Typhi
uccgcgcucauacga

SEQ ID NO: 1651584 - RNA, 12 nt, Salmonella enterica enterica serovar Typhi
uccgcgcugaug

SEQ ID NO: 1651585 - RNA, 19 nt, Salmonella enterica enterica serovar Typhi
uccccagcuaaaaacgcca

SEQ ID NO: 1651586 - RNA, 21 nt, Salmonella enterica enterica serovar Typhi
uccccagaaugauaaugccgc

SEQ ID NO: 1651587 - RNA, 18 nt, Salmonella enterica enterica serovar Typhi
uccccacaaucccgccag

SEQ ID NO: 1651588 - RNA, 15 nt, Salmonella enterica enterica serovar Typhi
uccccaccgcugaug

SEQ ID NO: 1651589 - RNA, 19 nt, Salmonella enterica enterica serovar Typhi
ucccauucacguagcggcg

SEQ ID NO: 1651590 - RNA, 14 nt, Salmonella enterica enterica serovar Typhi
ucccauguugcgcc

SEQ ID NO: 1651591 - RNA, 22 nt, Salmonella enterica enterica serovar Typhi
ucccauacugcccagccgccag

SEQ ID NO: 1651592 - RNA, 19 nt, Salmonella enterica enterica serovar Typhi
ucccaucaauaagcgaauu

SEQ ID NO: 1651593 - RNA, 17 nt, Salmonella enterica enterica serovar Typhi
ucccaacaaugccacgc

SEQ ID NO: 1651594 - RNA, 13 nt, Salmonella enterica enterica serovar Typhi
uccaucagccagg

SEQ ID NO: 1651595 - RNA, 15 nt, Salmonella enterica enterica serovar Typhi
ucccagaugcgccag

SEQ ID NO: 1651596 - RNA, 22 nt, Salmonella enterica enterica serovar Typhi
uccccgccgcugaggauggcgc

SEQ ID NO: 1651597 - RNA, 22 nt, Salmonella enterica enterica serovar Typhi
uccccgcugucgggagccucuu

SEQ ID NO: 1651598 - RNA, 23 nt, Salmonella enterica enterica serovar Typhi
uccccaucugaacucuuccagau

SEQ ID NO: 1651599 - RNA, 23 nt, Salmonella enterica enterica serovar Typhi
uccccgacggccucuucacgcag

SEQ ID NO: 1651600 - RNA, 20 nt, Salmonella enterica enterica serovar Typhi
uccccgacaaaaccguucug

SEQ ID NO: 1651601 - RNA, 14 nt, Salmonella enterica enterica serovar Typhi
ucccgcugcggcgu

SEQ ID NO: 1651602 - RNA, 15 nt, Salmonella enterica enterica serovar Typhi
ucccgcugcggcgug

SEQ ID NO: 1651603 - RNA, 19 nt, Salmonella enterica enterica serovar Typhi
ucccgaucuucaucguuac

SEQ ID NO: 1651604 - RNA, 22 nt, Salmonella enterica enterica serovar Typhi
guugcuauugauauuacccaac

SEQ ID NO: 1651605 - RNA, 22 nt, Salmonella enterica enterica serovar Typhi
guuggucacaaaggccagcagc

SEQ ID NO: 1651606 - RNA, 21 nt, Salmonella enterica enterica serovar Typhi
guuuaacugaacuuccguaaa

SEQ ID NO: 1651607 - RNA, 16 nt, Salmonella enterica enterica serovar Typhi
guuuaaguaagguaaa

SEQ ID NO: 1651608 - RNA, 14 nt, Salmonella enterica enterica serovar Typhi
guuguuccagcagc

SEQ ID NO: 1651609 - RNA, 21 nt, Salmonella enterica enterica serovar Typhi
guugcguuggaagugcguuaa

SEQ ID NO: 1651610 - RNA, 17 nt, Salmonella enterica enterica serovar Typhi
guugcgucagcguaccg

SEQ ID NO: 1651611 - RNA, 19 nt, Salmonella enterica enterica serovar Typhi
guugcgggccagcagccag

SEQ ID NO: 1651612 - RNA, 18 nt, Salmonella enterica enterica serovar Typhi
guugcccgguggcgcugc

SEQ ID NO: 1651613 - RNA, 23 nt, Salmonella enterica enterica serovar Typhi
guugcccugcuugucgaucauca

SEQ ID NO: 1651614 - RNA, 23 nt, Salmonella enterica enterica serovar Typhi
guucgcuuucauacgacgacggu

SEQ ID NO: 1651615 - RNA, 13 nt, Salmonella enterica enterica serovar Typhi
guucgcguacgca

SEQ ID NO: 1651616 - RNA, 17 nt, Salmonella enterica enterica serovar Typhi
guucgcggggguuauuc

SEQ ID NO: 1651617 - RNA, 19 nt, Salmonella enterica enterica serovar Typhi
guucgcgaauuucacgcag

SEQ ID NO: 1651618 - RNA, 16 nt, Salmonella enterica enterica serovar Typhi
guucuucgccguuauc

SEQ ID NO: 1651619 - RNA, 16 nt, Salmonella enterica enterica serovar Typhi
guuccugagcagacau

SEQ ID NO: 1651620 - RNA, 20 nt, Salmonella enterica enterica serovar Typhi
guucgacaauguccgccaga

SEQ ID NO: 1651621 - RNA, 11 nt, Salmonella enterica enterica serovar Typhi
guucgacggcu

SEQ ID NO: 1651622 - RNA, 12 nt, Salmonella enterica enterica serovar Typhi
guucgauagcgu

SEQ ID NO: 1651623 - RNA, 19 nt, Salmonella enterica enterica serovar Typhi
guucgcauauucugcgaaa

SEQ ID NO: 1651624 - RNA, 15 nt, Salmonella enterica enterica serovar Typhi
guucccggcaacagu

SEQ ID NO: 1651625 - RNA, 22 nt, Salmonella enterica enterica serovar Typhi
guuccauuccagaaucuggccg

SEQ ID NO: 1651626 - RNA, 15 nt, Salmonella enterica enterica serovar Typhi
guucccgagcggcca

SEQ ID NO: 1651627 - RNA, 21 nt, Salmonella enterica enterica serovar Typhi
guuccucguccugauccggcu

SEQ ID NO: 1651628 - RNA, 19 nt, Salmonella enterica enterica serovar Typhi
guuccggcggucagccagc

SEQ ID NO: 1651629 - RNA, 18 nt, Salmonella enterica enterica serovar Typhi
guuccggcggucagccag

SEQ ID NO: 1651630 - RNA, 23 nt, Salmonella enterica enterica serovar Typhi
guucaaugagcguccagucgggc

SEQ ID NO: 1651631 - RNA, 15 nt, Salmonella enterica enterica serovar Typhi
guucaaaucgaugcc

SEQ ID NO: 1651632 - RNA, 15 nt, Salmonella enterica enterica serovar Typhi
guucaaacaucagcg

SEQ ID NO: 1651633 - RNA, 23 nt, Salmonella enterica enterica serovar Typhi
guucaaaaaugauguguuucagc

SEQ ID NO: 1651634 - RNA, 18 nt, Salmonella enterica enterica serovar Typhi
guuauuugugauuuucug

SEQ ID NO: 1651635 - RNA, 23 nt, Salmonella enterica enterica serovar Typhi
guucaacggcaaaucgcgguaaa

SEQ ID NO: 1651636 - RNA, 22 nt, Salmonella enterica enterica serovar Typhi
guucaaauucuucccggcggaa

SEQ ID NO: 1651637 - RNA, 17 nt, Salmonella enterica enterica serovar Typhi
guuaucgcgcacgcgcc

SEQ ID NO: 1651638 - RNA, 20 nt, Salmonella enterica enterica serovar Typhi
guuaucucgccaggaaccgc

SEQ ID NO: 1651639 - RNA, 17 nt, Salmonella enterica enterica serovar Typhi
guuauguguuucuacgc

SEQ ID NO: 1651640 - RNA, 13 nt, Salmonella enterica enterica serovar Typhi
guuacgggaacag

SEQ ID NO: 1651641 - RNA, 23 nt, Salmonella enterica enterica serovar Typhi
guuacgggaacagaauuaccugg

SEQ ID NO: 1651642 - RNA, 23 nt, Salmonella enterica enterica serovar Typhi
guuagccacaaugacaugucgga

SEQ ID NO: 1651643 - RNA, 15 nt, Salmonella enterica enterica serovar Typhi
guuacuggcgaccgg

SEQ ID NO: 1651644 - RNA, 14 nt, Salmonella enterica enterica serovar Typhi
guuagggcgcggcu

SEQ ID NO: 1651645 - RNA, 20 nt, Salmonella enterica enterica serovar Typhi
guuagcucaacgcaucgcug

SEQ ID NO: 1651646 - RNA, 21 nt, Salmonella enterica enterica serovar Typhi
guuagcuguauccacccgguu

SEQ ID NO: 1651647 - RNA, 20 nt, Salmonella enterica enterica serovar Typhi
guuagccggaagauccuguu

SEQ ID NO: 1651648 - RNA, 19 nt, Salmonella enterica enterica serovar Typhi
guuagcgucauccggcaua

SEQ ID NO: 1651649 - RNA, 17 nt, Salmonella enterica enterica serovar Typhi
guuaccguaagcgggau

SEQ ID NO: 1651650 - RNA, 20 nt, Salmonella enterica enterica serovar Typhi
guuaccguauucugcgguau

SEQ ID NO: 1651651 - RNA, 19 nt, Salmonella enterica enterica serovar Typhi
guuacgcauuucaagcagg

SEQ ID NO: 1651652 - RNA, 24 nt, Salmonella enterica enterica serovar Typhi
guuaccgggcaaacggcacuacag

SEQ ID NO: 1651653 - RNA, 23 nt, Salmonella enterica enterica serovar Typhi
guuaacccacaacgcgccaaccg

SEQ ID NO: 1651654 - RNA, 19 nt, Salmonella enterica enterica serovar Typhi
guuaauccagagcggauaa

SEQ ID NO: 1651655 - RNA, 16 nt, Salmonella enterica enterica serovar Typhi
guuaauucuggcaaua

SEQ ID NO: 1651656 - RNA, 17 nt, Salmonella enterica enterica serovar Typhi
guuaauuucaucgccgc

SEQ ID NO: 1651657 - RNA, 18 nt, Salmonella enterica enterica serovar Typhi
guucagauaggcgcgaaa

SEQ ID NO: 1651658 - RNA, 20 nt, Salmonella enterica enterica serovar Typhi
guucagcaacgugaacugcg

SEQ ID NO: 1651659 - RNA, 20 nt, Salmonella enterica enterica serovar Typhi
guucacgccgccauccggca

SEQ ID NO: 1651660 - RNA, 16 nt, Salmonella enterica enterica serovar Typhi
guucagucagcgcgag

SEQ ID NO: 1651661 - RNA, 17 nt, Salmonella enterica enterica serovar Typhi
guucagguuggcgacau

SEQ ID NO: 1651662 - RNA, 14 nt, Salmonella enterica enterica serovar Typhi
guucaggcggcaaa

SEQ ID NO: 1651663 - RNA, 14 nt, Salmonella enterica enterica serovar Typhi
guucauaauccgga

SEQ ID NO: 1651664 - RNA, 17 nt, Salmonella enterica enterica serovar Typhi
guucauaucgauaccga

SEQ ID NO: 1651665 - RNA, 21 nt, Salmonella enterica enterica serovar Typhi
guucauucccgccaauaacca

SEQ ID NO: 1651666 - RNA, 23 nt, Salmonella enterica enterica serovar Typhi
guucaucucuucccgucgcagca

SEQ ID NO: 1651667 - RNA, 15 nt, Salmonella enterica enterica serovar Typhi
guucaucuaucgcca

SEQ ID NO: 1651668 - RNA, 16 nt, Salmonella enterica enterica serovar Typhi
guucaucuaucgccag

SEQ ID NO: 1651669 - RNA, 17 nt, Salmonella enterica enterica serovar Typhi
gugcguggcccgcacug

SEQ ID NO: 1651670 - RNA, 16 nt, Salmonella enterica enterica serovar Typhi
guggugcggcuuaucg

SEQ ID NO: 1651671 - RNA, 13 nt, Salmonella enterica enterica serovar Typhi
gugguuuauccgc

SEQ ID NO: 1651672 - RNA, 12 nt, Salmonella enterica enterica serovar Typhi
guguaauaaccg

SEQ ID NO: 1651673 - RNA, 13 nt, Salmonella enterica enterica serovar Typhi
guguaaacgccag

SEQ ID NO: 1651674 - RNA, 14 nt, Salmonella enterica enterica serovar Typhi
guguaccagcagcg

SEQ ID NO: 1651675 - RNA, 19 nt, Salmonella enterica enterica serovar Typhi
guguccggguucagcgaca

SEQ ID NO: 1651676 - RNA, 13 nt, Salmonella enterica enterica serovar Typhi
gugugaucgccgc

SEQ ID NO: 1651677 - RNA, 19 nt, Salmonella enterica enterica serovar Typhi
gugucguuucauccugaca

SEQ ID NO: 1651678 - RNA, 21 nt, Salmonella enterica enterica serovar Typhi
gugugccugcgcuuacggcca

SEQ ID NO: 1651679 - RNA, 16 nt, Salmonella enterica enterica serovar Typhi
gugugcggaugcgcca

SEQ ID NO: 1651680 - RNA, 19 nt, Salmonella enterica enterica serovar Typhi
guguguaccagcagcgcca

SEQ ID NO: 1651681 - RNA, 22 nt, Salmonella enterica enterica serovar Typhi
guguuaucgcuaucaagcugau

SEQ ID NO: 1651682 - RNA, 15 nt, Salmonella enterica enterica serovar Typhi
guguguacaaccauc

SEQ ID NO: 1651683 - RNA, 15 nt, Salmonella enterica enterica serovar Typhi
guuaacuucggcaaa

SEQ ID NO: 1651684 - RNA, 17 nt, Salmonella enterica enterica serovar Typhi
guuaacuucuccgccau

SEQ ID NO: 1651685 - RNA, 17 nt, Salmonella enterica enterica serovar Typhi
guuaauccaaauccgca

SEQ ID NO: 1651686 - RNA, 19 nt, Salmonella enterica enterica serovar Typhi
guuaauauccuucagcguu

SEQ ID NO: 1651687 - RNA, 18 nt, Salmonella enterica enterica serovar Typhi
guuaacagaaugcugaac

SEQ ID NO: 1651688 - RNA, 19 nt, Salmonella enterica enterica serovar Typhi
guuaacguaaagccaucca

SEQ ID NO: 1651689 - RNA, 14 nt, Salmonella enterica enterica serovar Typhi
guuaacccggcauu

SEQ ID NO: 1651690 - RNA, 19 nt, Salmonella enterica enterica serovar Typhi
guuaacgcagcaucgccau

SEQ ID NO: 1651691 - RNA, 20 nt, Salmonella enterica enterica serovar Typhi
guuaacaucaucaggccuga

SEQ ID NO: 1651692 - RNA, 19 nt, Salmonella enterica enterica serovar Typhi
guuaacccacaacgcgcca

SEQ ID NO: 1651693 - RNA, 17 nt, Salmonella enterica enterica serovar Typhi
guuaaccgucuggcugc

SEQ ID NO: 1651694 - RNA, 13 nt, Salmonella enterica enterica serovar Typhi
guguuucagcagc

SEQ ID NO: 1651695 - RNA, 18 nt, Salmonella enterica enterica serovar Typhi
guguuguaaaacgcgccc

SEQ ID NO: 1651696 - RNA, 15 nt, Salmonella enterica enterica serovar Typhi
uaccaucaccugcug

SEQ ID NO: 1651697 - RNA, 15 nt, Salmonella enterica enterica serovar Typhi
uaccaguaaugacgc

SEQ ID NO: 1651698 - RNA, 23 nt, Salmonella enterica enterica serovar Typhi
uacccccgccauaaugcacaaua

SEQ ID NO: 1651699 - RNA, 14 nt, Salmonella enterica enterica serovar Typhi
uacccauaucgcgg

SEQ ID NO: 1651700 - RNA, 23 nt, Salmonella enterica enterica serovar Typhi
uacccagcgucccggcgucuacc

SEQ ID NO: 1651701 - RNA, 18 nt, Salmonella enterica enterica serovar Typhi
uacccaguaccauaccgg

SEQ ID NO: 1651702 - RNA, 16 nt, Salmonella enterica enterica serovar Typhi
uacccucugcaccaga

SEQ ID NO: 1651703 - RNA, 13 nt, Salmonella enterica enterica serovar Typhi
uacccucaacgcg

SEQ ID NO: 1651704 - RNA, 14 nt, Salmonella enterica enterica serovar Typhi
uacccuucaugcag

SEQ ID NO: 1651705 - RNA, 17 nt, Salmonella enterica enterica serovar Typhi
uaccgaaaucgguacgc

SEQ ID NO: 1651706 - RNA, 16 nt, Salmonella enterica enterica serovar Typhi
uaccacagaaaucgcc

SEQ ID NO: 1651707 - RNA, 19 nt, Salmonella enterica enterica serovar Typhi
uaccacgcacaugggcguc

SEQ ID NO: 1651708 - RNA, 16 nt, Salmonella enterica enterica serovar Typhi
uaccacgcagcggcau

SEQ ID NO: 1651709 - RNA, 17 nt, Salmonella enterica enterica serovar Typhi
uaccagcagcgccagcg

SEQ ID NO: 1651710 - RNA, 22 nt, Salmonella enterica enterica serovar Typhi
uaccagccgagugcuuauguag

SEQ ID NO: 1651711 - RNA, 20 nt, Salmonella enterica enterica serovar Typhi
uaccaggcggcuuuuucauc

SEQ ID NO: 1651712 - RNA, 14 nt, Salmonella enterica enterica serovar Typhi
uacagguguuaauc

SEQ ID NO: 1651713 - RNA, 13 nt, Salmonella enterica enterica serovar Typhi
uaccgcgccagcg

SEQ ID NO: 1651714 - RNA, 17 nt, Salmonella enterica enterica serovar Typhi
uaccgcguuuaacgcag

SEQ ID NO: 1651715 - RNA, 17 nt, Salmonella enterica enterica serovar Typhi
uaccgcguuugcgcaac

SEQ ID NO: 1651716 - RNA, 15 nt, Salmonella enterica enterica serovar Typhi
uaccgcgcgaaccau

SEQ ID NO: 1651717 - RNA, 12 nt, Salmonella enterica enterica serovar Typhi
uaccggcaacgc

SEQ ID NO: 1651718 - RNA, 22 nt, Salmonella enterica enterica serovar Typhi
uaccggcuaucagccgccggug

SEQ ID NO: 1651719 - RNA, 16 nt, Salmonella enterica enterica serovar Typhi
uaccggcauuacccag

SEQ ID NO: 1651720 - RNA, 18 nt, Salmonella enterica enterica serovar Typhi
uaccggcgaaauagcguu

SEQ ID NO: 1651721 - RNA, 18 nt, Salmonella enterica enterica serovar Typhi
uaccgccacuuugcuuug

SEQ ID NO: 1651722 - RNA, 16 nt, Salmonella enterica enterica serovar Typhi
uaccgccauccggcau

SEQ ID NO: 1651723 - RNA, 17 nt, Salmonella enterica enterica serovar Typhi
uaccgccaucaaacgca

SEQ ID NO: 1651724 - RNA, 13 nt, Salmonella enterica enterica serovar Typhi
uaccgccgguaau

SEQ ID NO: 1651725 - RNA, 18 nt, Salmonella enterica enterica serovar Typhi
uaccgccgcaaccggagu

SEQ ID NO: 1651726 - RNA, 21 nt, Salmonella enterica enterica serovar Typhi
uaccguauugccagaucuguu

SEQ ID NO: 1651727 - RNA, 20 nt, Salmonella enterica enterica serovar Typhi
uaccgucagauucugcggua

SEQ ID NO: 1651728 - RNA, 17 nt, Salmonella enterica enterica serovar Typhi
uaccguaaaaugcuggu

SEQ ID NO: 1651729 - RNA, 15 nt, Salmonella enterica enterica serovar Typhi
uaccguaaccgcagc

SEQ ID NO: 1651730 - RNA, 20 nt, Salmonella enterica enterica serovar Typhi
uaccgugcaaaaucacgcgg

SEQ ID NO: 1651731 - RNA, 21 nt, Salmonella enterica enterica serovar Typhi
uaccgugcaaaaucacgcggc

SEQ ID NO: 1651732 - RNA, 18 nt, Salmonella enterica enterica serovar Typhi
uacgcccucaucggcaaa

SEQ ID NO: 1651733 - RNA, 17 nt, Salmonella enterica enterica serovar Typhi
uacgcacgccagauaaa

SEQ ID NO: 1651734 - RNA, 22 nt, Salmonella enterica enterica serovar Typhi
uacgcauaaugcgccccgcaac

SEQ ID NO: 1651735 - RNA, 22 nt, Salmonella enterica enterica serovar Typhi
uacgcaccagcucuacaucgcc

SEQ ID NO: 1651736 - RNA, 16 nt, Salmonella enterica enterica serovar Typhi
uacgcaaaucaccguc

SEQ ID NO: 1651737 - RNA, 17 nt, Salmonella enterica enterica serovar Typhi
uacgauuucauuacgcc

SEQ ID NO: 1651738 - RNA, 17 nt, Salmonella enterica enterica serovar Typhi
uacugcuuuaauaccgg

SEQ ID NO: 1651739 - RNA, 20 nt, Salmonella enterica enterica serovar Typhi
uacugcgcucuaucaccgcc

SEQ ID NO: 1651740 - RNA, 20 nt, Salmonella enterica enterica serovar Typhi
uacugccgccgugggauugc

SEQ ID NO: 1651741 - RNA, 17 nt, Salmonella enterica enterica serovar Typhi
uacugcaacgccagaug

SEQ ID NO: 1651742 - RNA, 14 nt, Salmonella enterica enterica serovar Typhi
uacugauauugcaa

SEQ ID NO: 1651743 - RNA, 20 nt, Salmonella enterica enterica serovar Typhi
uacuauucggcgcuucgcag

SEQ ID NO: 1651744 - RNA, 19 nt, Salmonella enterica enterica serovar Typhi
uacgccguccggcgaacaa

SEQ ID NO: 1651745 - RNA, 16 nt, Salmonella enterica enterica serovar Typhi
uacuuuccauauacuc

SEQ ID NO: 1651746 - RNA, 16 nt, Salmonella enterica enterica serovar Typhi
uacuuguugagugaau

SEQ ID NO: 1651747 - RNA, 17 nt, Salmonella enterica enterica serovar Typhi
uagagaguaaaaccggc

SEQ ID NO: 1651748 - RNA, 16 nt, Salmonella enterica enterica serovar Typhi
uagacaauugcugcgu

SEQ ID NO: 1651749 - RNA, 15 nt, Salmonella enterica enterica serovar Typhi
uagcagaccgguacg

SEQ ID NO: 1651750 - RNA, 16 nt, Salmonella enterica enterica serovar Typhi
uagcaccagaccgaca

SEQ ID NO: 1651751 - RNA, 21 nt, Salmonella enterica enterica serovar Typhi
uagcacccuucgcuauccauc

SEQ ID NO: 1651752 - RNA, 14 nt, Salmonella enterica enterica serovar Typhi
uagcacuacggcaa

SEQ ID NO: 1651753 - RNA, 14 nt, Salmonella enterica enterica serovar Typhi
uagcaaucucgcca

SEQ ID NO: 1651754 - RNA, 19 nt, Salmonella enterica enterica serovar Typhi
uagccacuuaccaaucgcg

SEQ ID NO: 1651755 - RNA, 18 nt, Salmonella enterica enterica serovar Typhi
uagccacagauuaugcag

SEQ ID NO: 1651756 - RNA, 18 nt, Salmonella enterica enterica serovar Typhi
uagccacagcgcgcgaca

SEQ ID NO: 1651757 - RNA, 17 nt, Salmonella enterica enterica serovar Typhi
uagccagcgauccugcg

SEQ ID NO: 1651758 - RNA, 11 nt, Salmonella enterica enterica serovar Typhi
uagcauucgcg

SEQ ID NO: 1651759 - RNA, 15 nt, Salmonella enterica enterica serovar Typhi
uagcaucucuucgac

SEQ ID NO: 1651760 - RNA, 16 nt, Salmonella enterica enterica serovar Typhi
uagcaucucuucgaca

SEQ ID NO: 1651761 - RNA, 12 nt, Salmonella enterica enterica serovar Typhi
uagcauccagca

SEQ ID NO: 1651762 - RNA, 16 nt, Salmonella enterica enterica serovar Typhi
uagcccguuaugccau

SEQ ID NO: 1651763 - RNA, 15 nt, Salmonella enterica enterica serovar Typhi
uagcccguacgaucu

SEQ ID NO: 1651764 - RNA, 20 nt, Salmonella enterica enterica serovar Typhi
uagcccagcgccgcaucgcg

SEQ ID NO: 1651765 - RNA, 13 nt, Salmonella enterica enterica serovar Typhi
uagccccgucaug

SEQ ID NO: 1651766 - RNA, 17 nt, Salmonella enterica enterica serovar Typhi
uagcccauauuggcaau

SEQ ID NO: 1651767 - RNA, 20 nt, Salmonella enterica enterica serovar Typhi
uagcgcauuuuuaucaggcc

SEQ ID NO: 1651768 - RNA, 21 nt, Salmonella enterica enterica serovar Typhi
uagcgagucccuaauagcgcc

SEQ ID NO: 1651769 - RNA, 18 nt, Salmonella enterica enterica serovar Typhi
uaaucgccagcagcgcga

SEQ ID NO: 1651770 - RNA, 18 nt, Salmonella enterica enterica serovar Typhi
uaaucgauaagccagcga

SEQ ID NO: 1651771 - RNA, 19 nt, Salmonella enterica enterica serovar Typhi
uaaucgauaagccagcgau

SEQ ID NO: 1651772 - RNA, 22 nt, Salmonella enterica enterica serovar Typhi
uaaucaugaacguuaucggcau

SEQ ID NO: 1651773 - RNA, 15 nt, Salmonella enterica enterica serovar Typhi
uaauccggcaacugc

SEQ ID NO: 1651774 - RNA, 14 nt, Salmonella enterica enterica serovar Typhi
uaagcgcuagcgcc

SEQ ID NO: 1651775 - RNA, 13 nt, Salmonella enterica enterica serovar Typhi
uaaguagccguca

SEQ ID NO: 1651776 - RNA, 13 nt, Salmonella enterica enterica serovar Typhi
uaagcguagcgcc

SEQ ID NO: 1651777 - RNA, 22 nt, Salmonella enterica enterica serovar Typhi
uaagcgucugcaaugguaaaac

SEQ ID NO: 1651778 - RNA, 16 nt, Salmonella enterica enterica serovar Typhi
uaagcgccgucauccg

SEQ ID NO: 1651779 - RNA, 22 nt, Salmonella enterica enterica serovar Typhi
uaagcgcaauauuguuaaccag

SEQ ID NO: 1651780 - RNA, 14 nt, Salmonella enterica enterica serovar Typhi
uaagcgcagcguca

SEQ ID NO: 1651781 - RNA, 20 nt, Salmonella enterica enterica serovar Typhi
uaagcgaaccuuaagcgcga

SEQ ID NO: 1651782 - RNA, 17 nt, Salmonella enterica enterica serovar Typhi
uaagcgaauccagcgcc

SEQ ID NO: 1651783 - RNA, 22 nt, Salmonella enterica enterica serovar Typhi
uaagccggcaggcagcgccagc

SEQ ID NO: 1651784 - RNA, 23 nt, Salmonella enterica enterica serovar Typhi
uaagccggcaggcagcgccagcg

SEQ ID NO: 1651785 - RNA, 13 nt, Salmonella enterica enterica serovar Typhi
uaaguaugccgca

SEQ ID NO: 1651786 - RNA, 19 nt, Salmonella enterica enterica serovar Typhi
uaagccggcaggcagcgcc

SEQ ID NO: 1651787 - RNA, 20 nt, Salmonella enterica enterica serovar Typhi
uaagccggcaggcagcgcca

SEQ ID NO: 1651788 - RNA, 20 nt, Salmonella enterica enterica serovar Typhi
uaagccaguucucaaucgcc

SEQ ID NO: 1651789 - RNA, 18 nt, Salmonella enterica enterica serovar Typhi
uaacuuaaacgccggauu

SEQ ID NO: 1651790 - RNA, 15 nt, Salmonella enterica enterica serovar Typhi
uaacugcaaacgcgg

SEQ ID NO: 1651791 - RNA, 20 nt, Salmonella enterica enterica serovar Typhi
uaacgcgaauccgccauagc

SEQ ID NO: 1651792 - RNA, 13 nt, Salmonella enterica enterica serovar Typhi
uaacugacagacu

SEQ ID NO: 1651793 - RNA, 18 nt, Salmonella enterica enterica serovar Typhi
uacaaucgucuucagcaa

SEQ ID NO: 1651794 - RNA, 16 nt, Salmonella enterica enterica serovar Typhi
uaauuuugccaucgcg

SEQ ID NO: 1651795 - RNA, 22 nt, Salmonella enterica enterica serovar Typhi
uacagaugccuuguaagccgga

SEQ ID NO: 1651796 - RNA, 15 nt, Salmonella enterica enterica serovar Typhi
uacagcagcgacgca

SEQ ID NO: 1651797 - RNA, 13 nt, Salmonella enterica enterica serovar Typhi
uacaccagacgau

SEQ ID NO: 1651798 - RNA, 22 nt, Salmonella enterica enterica serovar Typhi
uacagaugccguccauccggcg

SEQ ID NO: 1651799 - RNA, 15 nt, Salmonella enterica enterica serovar Typhi
uaauuugcgccaucg

SEQ ID NO: 1651800 - RNA, 20 nt, Salmonella enterica enterica serovar Typhi
uaaugcccggcgcggcauca

SEQ ID NO: 1651801 - RNA, 18 nt, Salmonella enterica enterica serovar Typhi
uaaugcacaauacgccga

SEQ ID NO: 1651802 - RNA, 13 nt, Salmonella enterica enterica serovar Typhi
uaauuaaccgcgc

SEQ ID NO: 1651803 - RNA, 13 nt, Salmonella enterica enterica serovar Typhi
uaacgcaucgcgg

SEQ ID NO: 1651804 - RNA, 15 nt, Salmonella enterica enterica serovar Typhi
uaacguuuuacgcug

SEQ ID NO: 1651805 - RNA, 15 nt, Salmonella enterica enterica serovar Typhi
uaacgccgcauagcg

SEQ ID NO: 1651806 - RNA, 15 nt, Salmonella enterica enterica serovar Typhi
uaacgcaucgcggau

SEQ ID NO: 1651807 - RNA, 15 nt, Salmonella enterica enterica serovar Typhi
uaaccaccuguucgc

SEQ ID NO: 1651808 - RNA, 22 nt, Salmonella enterica enterica serovar Typhi
uaacccacaagaaaugcaggcg

SEQ ID NO: 1651809 - RNA, 14 nt, Salmonella enterica enterica serovar Typhi
uaaccaucacgauc

SEQ ID NO: 1651810 - RNA, 18 nt, Salmonella enterica enterica serovar Typhi
uaaccauucccgauaaug

SEQ ID NO: 1651811 - RNA, 18 nt, Salmonella enterica enterica serovar Typhi
uaacauuugccgggccaa

SEQ ID NO: 1651812 - RNA, 22 nt, Salmonella enterica enterica serovar Typhi
uaacaacccgacgacguucgau

SEQ ID NO: 1651813 - RNA, 21 nt, Salmonella enterica enterica serovar Typhi
uaaauacuuuuuuagcgcaca

SEQ ID NO: 1651814 - RNA, 21 nt, Salmonella enterica enterica serovar Typhi
uaaauagcgcuggcgccgcaa

SEQ ID NO: 1651815 - RNA, 20 nt, Salmonella enterica enterica serovar Typhi
uaaauaggagaugcacggau

SEQ ID NO: 1651816 - RNA, 18 nt, Salmonella enterica enterica serovar Typhi
uaaaguccugcgucgcuu

SEQ ID NO: 1651817 - RNA, 16 nt, Salmonella enterica enterica serovar Typhi
uaaaaauauccgccau

SEQ ID NO: 1651818 - RNA, 14 nt, Salmonella enterica enterica serovar Typhi
guuucaccguuuuc

SEQ ID NO: 1651819 - RNA, 21 nt, Salmonella enterica enterica serovar Typhi
guuucaguucggagaucagcg

SEQ ID NO: 1651820 - RNA, 22 nt, Salmonella enterica enterica serovar Typhi
guuuauugaaauuaaucaggca

SEQ ID NO: 1651821 - RNA, 17 nt, Salmonella enterica enterica serovar Typhi
guuuaauuccaucggca

SEQ ID NO: 1651822 - RNA, 19 nt, Salmonella enterica enterica serovar Typhi
guuuauccggcacgguaaa

SEQ ID NO: 1651823 - RNA, 22 nt, Salmonella enterica enterica serovar Typhi
guuuauuuaacguguuacguuu

SEQ ID NO: 1651824 - RNA, 15 nt, Salmonella enterica enterica serovar Typhi
guuucaacuuccacc

SEQ ID NO: 1651825 - RNA, 19 nt, Salmonella enterica enterica serovar Typhi
guuucaagcaguuccagca

SEQ ID NO: 1651826 - RNA, 18 nt, Salmonella enterica enterica serovar Typhi
uaaaccccgauaaaccag

SEQ ID NO: 1651827 - RNA, 12 nt, Salmonella enterica enterica serovar Typhi
uaaacaggcagg

SEQ ID NO: 1651828 - RNA, 17 nt, Salmonella enterica enterica serovar Typhi
uaaacagcagcgcggca

SEQ ID NO: 1651829 - RNA, 17 nt, Salmonella enterica enterica serovar Typhi
uaaaccaccggauggcg

SEQ ID NO: 1651830 - RNA, 21 nt, Salmonella enterica enterica serovar Typhi
uaaagacgugccggaagcgau

SEQ ID NO: 1651831 - RNA, 19 nt, Salmonella enterica enterica serovar Typhi
gggauuuccuggcaguuca

SEQ ID NO: 1651832 - RNA, 21 nt, Salmonella enterica enterica serovar Typhi
gggauuucuucccuugccgcc

SEQ ID NO: 1651833 - RNA, 12 nt, Salmonella enterica enterica serovar Typhi
gggacuggauga

SEQ ID NO: 1651834 - RNA, 11 nt, Salmonella enterica enterica serovar Typhi
ggcuuuccagc

SEQ ID NO: 1651835 - RNA, 14 nt, Salmonella enterica enterica serovar Typhi
ggcuuuguaucagc

SEQ ID NO: 1651836 - RNA, 19 nt, Salmonella enterica enterica serovar Typhi
ggcuuuacgaccgcagaaa

SEQ ID NO: 1651837 - RNA, 22 nt, Salmonella enterica enterica serovar Typhi
gggaaacgcuauuuaacccugg

SEQ ID NO: 1651838 - RNA, 16 nt, Salmonella enterica enterica serovar Typhi
ggcuuuuuuucaacug

SEQ ID NO: 1651839 - RNA, 18 nt, Salmonella enterica enterica serovar Typhi
ggcuuuuuucuccaguug

SEQ ID NO: 1651840 - RNA, 17 nt, Salmonella enterica enterica serovar Typhi
gggaaaccauguugauc

SEQ ID NO: 1651841 - RNA, 20 nt, Salmonella enterica enterica serovar Typhi
ggcuugaucgcgcagcaaau

SEQ ID NO: 1651842 - RNA, 20 nt, Salmonella enterica enterica serovar Typhi
ggcuugaguuuuccgccauu

SEQ ID NO: 1651843 - RNA, 22 nt, Salmonella enterica enterica serovar Typhi
ggcuugguugacgugaaccguc

SEQ ID NO: 1651844 - RNA, 17 nt, Salmonella enterica enterica serovar Typhi
ggcuguaccuuaaccgg

SEQ ID NO: 1651845 - RNA, 16 nt, Salmonella enterica enterica serovar Typhi
ggcuguaccuuaaccg

SEQ ID NO: 1651846 - RNA, 18 nt, Salmonella enterica enterica serovar Typhi
gggcgacaccgcaaaccg

SEQ ID NO: 1651847 - RNA, 18 nt, Salmonella enterica enterica serovar Typhi
ggcuagcgccuuauccgg

SEQ ID NO: 1651848 - RNA, 20 nt, Salmonella enterica enterica serovar Typhi
ggcguuuucauuagccgcca

SEQ ID NO: 1651849 - RNA, 22 nt, Salmonella enterica enterica serovar Typhi
ggcuauuccacccgaccauuuu

SEQ ID NO: 1651850 - RNA, 18 nt, Salmonella enterica enterica serovar Typhi
ggcucaaaguuaccggca

SEQ ID NO: 1651851 - RNA, 12 nt, Salmonella enterica enterica serovar Typhi
ggcguucucccg

SEQ ID NO: 1651852 - RNA, 17 nt, Salmonella enterica enterica serovar Typhi
ggcguuccuuaucagca

SEQ ID NO: 1651853 - RNA, 19 nt, Salmonella enterica enterica serovar Typhi
ggcgucgcggcaauagcga

SEQ ID NO: 1651854 - RNA, 22 nt, Salmonella enterica enterica serovar Typhi
ggcgucuaccuggguagcgcca

SEQ ID NO: 1651855 - RNA, 15 nt, Salmonella enterica enterica serovar Typhi
ggcggucgggaacgc

SEQ ID NO: 1651856 - RNA, 17 nt, Salmonella enterica enterica serovar Typhi
ggcucccacucuuccag

SEQ ID NO: 1651857 - RNA, 22 nt, Salmonella enterica enterica serovar Typhi
ggcugacugaauuuucagccau

SEQ ID NO: 1651858 - RNA, 15 nt, Salmonella enterica enterica serovar Typhi
ggcugagaaucaccu

SEQ ID NO: 1651859 - RNA, 15 nt, Salmonella enterica enterica serovar Typhi
ggcugccacacguca

SEQ ID NO: 1651860 - RNA, 14 nt, Salmonella enterica enterica serovar Typhi
ggcugccaucaggc

SEQ ID NO: 1651861 - RNA, 22 nt, Salmonella enterica enterica serovar Typhi
ggcugcgauaaugaagcauaaa

SEQ ID NO: 1651862 - RNA, 11 nt, Salmonella enterica enterica serovar Typhi
ggcugcguaac

SEQ ID NO: 1651863 - RNA, 20 nt, Salmonella enterica enterica serovar Typhi
ggcugcgccuuaucaagccu

SEQ ID NO: 1651864 - RNA, 18 nt, Salmonella enterica enterica serovar Typhi
ggcuggagagcaacgcca

SEQ ID NO: 1651865 - RNA, 18 nt, Salmonella enterica enterica serovar Typhi
ggcgccgaagcaggcgga

SEQ ID NO: 1651866 - RNA, 15 nt, Salmonella enterica enterica serovar Typhi
ggcgcaaaucgccau

SEQ ID NO: 1651867 - RNA, 21 nt, Salmonella enterica enterica serovar Typhi
ggcgauuacaacgcgaugguc

SEQ ID NO: 1651868 - RNA, 16 nt, Salmonella enterica enterica serovar Typhi
ggcgauguucuugccg

SEQ ID NO: 1651869 - RNA, 17 nt, Salmonella enterica enterica serovar Typhi
ggcgacaaacagcgccc

SEQ ID NO: 1651870 - RNA, 16 nt, Salmonella enterica enterica serovar Typhi
ggcgaauuaaucgucg

SEQ ID NO: 1651871 - RNA, 18 nt, Salmonella enterica enterica serovar Typhi
ggcgcaucuggucauggc

SEQ ID NO: 1651872 - RNA, 22 nt, Salmonella enterica enterica serovar Typhi
ggcgcaguccagaugcgccaga

SEQ ID NO: 1651873 - RNA, 18 nt, Salmonella enterica enterica serovar Typhi
ggcgcaguucgccgccag

SEQ ID NO: 1651874 - RNA, 21 nt, Salmonella enterica enterica serovar Typhi
ggcgcaguuuacgcagcgccu

SEQ ID NO: 1651875 - RNA, 14 nt, Salmonella enterica enterica serovar Typhi
ggcgcauaucgccc

SEQ ID NO: 1651876 - RNA, 23 nt, Salmonella enterica enterica serovar Typhi
ggcgccagagagcguuucuacgc

SEQ ID NO: 1651877 - RNA, 22 nt, Salmonella enterica enterica serovar Typhi
ggcgccacccaacaucauguua

SEQ ID NO: 1651878 - RNA, 20 nt, Salmonella enterica enterica serovar Typhi
ggcgccaaucaccgccagca

SEQ ID NO: 1651879 - RNA, 14 nt, Salmonella enterica enterica serovar Typhi
ggcgccaucgccuc

SEQ ID NO: 1651880 - RNA, 21 nt, Salmonella enterica enterica serovar Typhi
ggcgccauuggcucggcguca

SEQ ID NO: 1651881 - RNA, 20 nt, Salmonella enterica enterica serovar Typhi
ggcggcuggcgccuuaccgg

SEQ ID NO: 1651882 - RNA, 20 nt, Salmonella enterica enterica serovar Typhi
ggcggcugcgccuuauccgg

SEQ ID NO: 1651883 - RNA, 18 nt, Salmonella enterica enterica serovar Typhi
ggcgggugcgcagcccca

SEQ ID NO: 1651884 - RNA, 14 nt, Salmonella enterica enterica serovar Typhi
ggcgguauuauccg

SEQ ID NO: 1651885 - RNA, 13 nt, Salmonella enterica enterica serovar Typhi
ggcggucagccag

SEQ ID NO: 1651886 - RNA, 15 nt, Salmonella enterica enterica serovar Typhi
ggcgguauuauccgc

SEQ ID NO: 1651887 - RNA, 22 nt, Salmonella enterica enterica serovar Typhi
ggcggaugaaacaguccggcga

SEQ ID NO: 1651888 - RNA, 18 nt, Salmonella enterica enterica serovar Typhi
ggcgcucacgcugacagg

SEQ ID NO: 1651889 - RNA, 19 nt, Salmonella enterica enterica serovar Typhi
ggcgcugcgcuuaucaggc

SEQ ID NO: 1651890 - RNA, 18 nt, Salmonella enterica enterica serovar Typhi
ggcgcugcgcuuaucagg

SEQ ID NO: 1651891 - RNA, 22 nt, Salmonella enterica enterica serovar Typhi
ggcgcugcgcuuaucaggccua

SEQ ID NO: 1651892 - RNA, 18 nt, Salmonella enterica enterica serovar Typhi
ggcgcuccugucaggcga

SEQ ID NO: 1651893 - RNA, 14 nt, Salmonella enterica enterica serovar Typhi
ggcgcuuccugcag

SEQ ID NO: 1651894 - RNA, 14 nt, Salmonella enterica enterica serovar Typhi
ggcgcuuaucgccg

SEQ ID NO: 1651895 - RNA, 13 nt, Salmonella enterica enterica serovar Typhi
ggcgcuuuaccgg

SEQ ID NO: 1651896 - RNA, 14 nt, Salmonella enterica enterica serovar Typhi
ggcggauacgcuuc

SEQ ID NO: 1651897 - RNA, 12 nt, Salmonella enterica enterica serovar Typhi
ggcgcguccagc

SEQ ID NO: 1651898 - RNA, 18 nt, Salmonella enterica enterica serovar Typhi
ggcauuuaugccgccauc

SEQ ID NO: 1651899 - RNA, 11 nt, Salmonella enterica enterica serovar Typhi
ggccagcacaa

SEQ ID NO: 1651900 - RNA, 16 nt, Salmonella enterica enterica serovar Typhi
ggccagcuacaccugg

SEQ ID NO: 1651901 - RNA, 16 nt, Salmonella enterica enterica serovar Typhi
ggcaguacgcacguuu

SEQ ID NO: 1651902 - RNA, 18 nt, Salmonella enterica enterica serovar Typhi
ggcaguaauugagcaguc

SEQ ID NO: 1651903 - RNA, 18 nt, Salmonella enterica enterica serovar Typhi
ggcagguaguaaccccag

SEQ ID NO: 1651904 - RNA, 13 nt, Salmonella enterica enterica serovar Typhi
ggcaugaugccac

SEQ ID NO: 1651905 - RNA, 17 nt, Salmonella enterica enterica serovar Typhi
ggcauuggcguuaccgg

SEQ ID NO: 1651906 - RNA, 16 nt, Salmonella enterica enterica serovar Typhi
ggcaggcuuccacgca

SEQ ID NO: 1651907 - RNA, 12 nt, Salmonella enterica enterica serovar Typhi
ggcagcgucagg

SEQ ID NO: 1651908 - RNA, 22 nt, Salmonella enterica enterica serovar Typhi
ggcagaauuaacucaucacagc

SEQ ID NO: 1651909 - RNA, 14 nt, Salmonella enterica enterica serovar Typhi
ggcagaaaaaucag

SEQ ID NO: 1651910 - RNA, 15 nt, Salmonella enterica enterica serovar Typhi
ggcagacaugaccgc

SEQ ID NO: 1651911 - RNA, 15 nt, Salmonella enterica enterica serovar Typhi
ggcacgauaaauugc

SEQ ID NO: 1651912 - RNA, 20 nt, Salmonella enterica enterica serovar Typhi
ggcaaucgcuuccagcgccg

SEQ ID NO: 1651913 - RNA, 21 nt, Salmonella enterica enterica serovar Typhi
ggcaauauccugugucggcag

SEQ ID NO: 1651914 - RNA, 13 nt, Salmonella enterica enterica serovar Typhi
ggcacacagcacu

SEQ ID NO: 1651915 - RNA, 12 nt, Salmonella enterica enterica serovar Typhi
ggcaauuuccgc

SEQ ID NO: 1651916 - RNA, 15 nt, Salmonella enterica enterica serovar Typhi
ggcaauuuccggcga

SEQ ID NO: 1651917 - RNA, 16 nt, Salmonella enterica enterica serovar Typhi
ggcaagcucagcggca

SEQ ID NO: 1651918 - RNA, 14 nt, Salmonella enterica enterica serovar Typhi
ggcaagcgccagca

SEQ ID NO: 1651919 - RNA, 14 nt, Salmonella enterica enterica serovar Typhi
ggcaauagaccagc

SEQ ID NO: 1651920 - RNA, 18 nt, Salmonella enterica enterica serovar Typhi
ggauucgacugcggucgu

SEQ ID NO: 1651921 - RNA, 15 nt, Salmonella enterica enterica serovar Typhi
ggccgccaccgccuc

SEQ ID NO: 1651922 - RNA, 13 nt, Salmonella enterica enterica serovar Typhi
ggccgcagcgcca

SEQ ID NO: 1651923 - RNA, 14 nt, Salmonella enterica enterica serovar Typhi
ggccgacggcauaa

SEQ ID NO: 1651924 - RNA, 13 nt, Salmonella enterica enterica serovar Typhi
ggccgccgcagca

SEQ ID NO: 1651925 - RNA, 16 nt, Salmonella enterica enterica serovar Typhi
ggccgccgcagcagau

SEQ ID NO: 1651926 - RNA, 15 nt, Salmonella enterica enterica serovar Typhi
ggccaggcgaccguc

SEQ ID NO: 1651927 - RNA, 22 nt, Salmonella enterica enterica serovar Typhi
ggccggaugagcguuagcgcca

SEQ ID NO: 1651928 - RNA, 15 nt, Salmonella enterica enterica serovar Typhi
ggccggaugagcguu

SEQ ID NO: 1651929 - RNA, 23 nt, Salmonella enterica enterica serovar Typhi
ggccggaaaggauauaagcgcca

SEQ ID NO: 1651930 - RNA, 21 nt, Salmonella enterica enterica serovar Typhi
ggccgcuuugcgaacagcgca

SEQ ID NO: 1651931 - RNA, 18 nt, Salmonella enterica enterica serovar Typhi
ggcgaacuucauccacgc

SEQ ID NO: 1651932 - RNA, 15 nt, Salmonella enterica enterica serovar Typhi
ggcgaacuccagcgc

SEQ ID NO: 1651933 - RNA, 20 nt, Salmonella enterica enterica serovar Typhi
ggcgaaaaccgagcauccgc

SEQ ID NO: 1651934 - RNA, 13 nt, Salmonella enterica enterica serovar Typhi
ggccugucaggcc

SEQ ID NO: 1651935 - RNA, 13 nt, Salmonella enterica enterica serovar Typhi
ggcgaaauagcgu

SEQ ID NO: 1651936 - RNA, 17 nt, Salmonella enterica enterica serovar Typhi
ggccuuuuuccgucagc

SEQ ID NO: 1651937 - RNA, 21 nt, Salmonella enterica enterica serovar Typhi
ggcgaaagcacuucucgcgca

SEQ ID NO: 1651938 - RNA, 14 nt, Salmonella enterica enterica serovar Typhi
ggccugcagagcgg

SEQ ID NO: 1651939 - RNA, 12 nt, Salmonella enterica enterica serovar Typhi
ggccugcaucaa

SEQ ID NO: 1651940 - RNA, 21 nt, Salmonella enterica enterica serovar Typhi
ggccugcauuugcuggcguga

SEQ ID NO: 1651941 - RNA, 19 nt, Salmonella enterica enterica serovar Typhi
ggucgacagccacacgcca

SEQ ID NO: 1651942 - RNA, 21 nt, Salmonella enterica enterica serovar Typhi
ggucgagcuuuugcugcgcca

SEQ ID NO: 1651943 - RNA, 19 nt, Salmonella enterica enterica serovar Typhi
ggucgcgguggguagcggc

SEQ ID NO: 1651944 - RNA, 19 nt, Salmonella enterica enterica serovar Typhi
ggucauccgcccggcauca

SEQ ID NO: 1651945 - RNA, 19 nt, Salmonella enterica enterica serovar Typhi
ggucauacugugcgugaug

SEQ ID NO: 1651946 - RNA, 20 nt, Salmonella enterica enterica serovar Typhi
ggucauauugccgauaggga

SEQ ID NO: 1651947 - RNA, 15 nt, Salmonella enterica enterica serovar Typhi
ggugauccagcaauc

SEQ ID NO: 1651948 - RNA, 22 nt, Salmonella enterica enterica serovar Typhi
ggugacgaagaucgcguacagc

SEQ ID NO: 1651949 - RNA, 15 nt, Salmonella enterica enterica serovar Typhi
ggucgucuucuugcg

SEQ ID NO: 1651950 - RNA, 12 nt, Salmonella enterica enterica serovar Typhi
gguagucaucgc

SEQ ID NO: 1651951 - RNA, 21 nt, Salmonella enterica enterica serovar Typhi
gguaguccgccagcaccugau

SEQ ID NO: 1651952 - RNA, 23 nt, Salmonella enterica enterica serovar Typhi
gguauaaauuuccgcagccagaa

SEQ ID NO: 1651953 - RNA, 23 nt, Salmonella enterica enterica serovar Typhi
gguacuuuucauccacagcgcca

SEQ ID NO: 1651954 - RNA, 16 nt, Salmonella enterica enterica serovar Typhi
gguacuggagaccggc

SEQ ID NO: 1651955 - RNA, 23 nt, Salmonella enterica enterica serovar Typhi
gguagcccggacaaggcgcgcca

SEQ ID NO: 1651956 - RNA, 19 nt, Salmonella enterica enterica serovar Typhi
gguaccgggcugucaucga

SEQ ID NO: 1651957 - RNA, 20 nt, Salmonella enterica enterica serovar Typhi
ggucacaaaggccagcagca

SEQ ID NO: 1651958 - RNA, 13 nt, Salmonella enterica enterica serovar Typhi
ggucaaucaucag

SEQ ID NO: 1651959 - RNA, 19 nt, Salmonella enterica enterica serovar Typhi
ggucaaaaaagcgacgcug

SEQ ID NO: 1651960 - RNA, 17 nt, Salmonella enterica enterica serovar Typhi
ggucaacgcgccgccaa

SEQ ID NO: 1651961 - RNA, 14 nt, Salmonella enterica enterica serovar Typhi
gguauuacaugccg

SEQ ID NO: 1651962 - RNA, 15 nt, Salmonella enterica enterica serovar Typhi
gguauuuauccagca

SEQ ID NO: 1651963 - RNA, 14 nt, Salmonella enterica enterica serovar Typhi
gguaucccgccagc

SEQ ID NO: 1651964 - RNA, 16 nt, Salmonella enterica enterica serovar Typhi
gguauccagauagcga

SEQ ID NO: 1651965 - RNA, 19 nt, Salmonella enterica enterica serovar Typhi
ggucacgcgaucguagcga

SEQ ID NO: 1651966 - RNA, 13 nt, Salmonella enterica enterica serovar Typhi
ggguuaacgcgcc

SEQ ID NO: 1651967 - RNA, 13 nt, Salmonella enterica enterica serovar Typhi
ggguuauuuccgc

SEQ ID NO: 1651968 - RNA, 16 nt, Salmonella enterica enterica serovar Typhi
gguaaacacgacgcug

SEQ ID NO: 1651969 - RNA, 15 nt, Salmonella enterica enterica serovar Typhi
gguaaacgcgccauc

SEQ ID NO: 1651970 - RNA, 12 nt, Salmonella enterica enterica serovar Typhi
ggguuuuccggu

SEQ ID NO: 1651971 - RNA, 16 nt, Salmonella enterica enterica serovar Typhi
gguaauuugcgccauc

SEQ ID NO: 1651972 - RNA, 20 nt, Salmonella enterica enterica serovar Typhi
gguaauuuugccaucgcgca

SEQ ID NO: 1651973 - RNA, 19 nt, Salmonella enterica enterica serovar Typhi
gguaauucaauuucaauga

SEQ ID NO: 1651974 - RNA, 17 nt, Salmonella enterica enterica serovar Typhi
gguacaggccgccgccu

SEQ ID NO: 1651975 - RNA, 15 nt, Salmonella enterica enterica serovar Typhi
gguaaagccgccauc

SEQ ID NO: 1651976 - RNA, 19 nt, Salmonella enterica enterica serovar Typhi
gguaaggcguagccgccac

SEQ ID NO: 1651977 - RNA, 15 nt, Salmonella enterica enterica serovar Typhi
gguaaucagacuggc

SEQ ID NO: 1651978 - RNA, 17 nt, Salmonella enterica enterica serovar Typhi
gguaauagcccucgccg

SEQ ID NO: 1651979 - RNA, 13 nt, Salmonella enterica enterica serovar Typhi
gggugaugcgcca

SEQ ID NO: 1651980 - RNA, 17 nt, Salmonella enterica enterica serovar Typhi
gggugcaaauccaucuc

SEQ ID NO: 1651981 - RNA, 22 nt, Salmonella enterica enterica serovar Typhi
gggugcaaauccaucucaggcc

SEQ ID NO: 1651982 - RNA, 12 nt, Salmonella enterica enterica serovar Typhi
gggugcgcgucg

SEQ ID NO: 1651983 - RNA, 20 nt, Salmonella enterica enterica serovar Typhi
gggugaugacgcgcaggccg

SEQ ID NO: 1651984 - RNA, 15 nt, Salmonella enterica enterica serovar Typhi
ggguggcgcuagcgc

SEQ ID NO: 1651985 - RNA, 16 nt, Salmonella enterica enterica serovar Typhi
guaccgaacagccagg

SEQ ID NO: 1651986 - RNA, 22 nt, Salmonella enterica enterica serovar Typhi
guaccggcaggacaaucauaau

SEQ ID NO: 1651987 - RNA, 18 nt, Salmonella enterica enterica serovar Typhi
guaccgcuacgcaggcca

SEQ ID NO: 1651988 - RNA, 22 nt, Salmonella enterica enterica serovar Typhi
guacgaucugacugaucgaucc

SEQ ID NO: 1651989 - RNA, 20 nt, Salmonella enterica enterica serovar Typhi
guacgacgccaugccguacc

SEQ ID NO: 1651990 - RNA, 14 nt, Salmonella enterica enterica serovar Typhi
guacgcaagcguaa

SEQ ID NO: 1651991 - RNA, 17 nt, Salmonella enterica enterica serovar Typhi
guacguccauccgccgg

SEQ ID NO: 1651992 - RNA, 15 nt, Salmonella enterica enterica serovar Typhi
guagccccuaucugg

SEQ ID NO: 1651993 - RNA, 12 nt, Salmonella enterica enterica serovar Typhi
guagcagcgcca

SEQ ID NO: 1651994 - RNA, 19 nt, Salmonella enterica enterica serovar Typhi
guagcagacagccgaucag

SEQ ID NO: 1651995 - RNA, 16 nt, Salmonella enterica enterica serovar Typhi
guagcgagaaggcuuu

SEQ ID NO: 1651996 - RNA, 20 nt, Salmonella enterica enterica serovar Typhi
guagccguuuaaaagcggau

SEQ ID NO: 1651997 - RNA, 19 nt, Salmonella enterica enterica serovar Typhi
guagcggauugccgcgcuc

SEQ ID NO: 1651998 - RNA, 15 nt, Salmonella enterica enterica serovar Typhi
guagcggcaacagca

SEQ ID NO: 1651999 - RNA, 13 nt, Salmonella enterica enterica serovar Typhi
guagcgccaucag

SEQ ID NO: 1652000 - RNA, 14 nt, Salmonella enterica enterica serovar Typhi
guagcgccauccgg

SEQ ID NO: 1652001 - RNA, 14 nt, Salmonella enterica enterica serovar Typhi
guagcgcguucagg

SEQ ID NO: 1652002 - RNA, 18 nt, Salmonella enterica enterica serovar Typhi
guagcuugaaagcgcaaa

SEQ ID NO: 1652003 - RNA, 16 nt, Salmonella enterica enterica serovar Typhi
guagcuugaaagcgca

SEQ ID NO: 1652004 - RNA, 18 nt, Salmonella enterica enterica serovar Typhi
guagcuggucgccagcgc

SEQ ID NO: 1652005 - RNA, 16 nt, Salmonella enterica enterica serovar Typhi
guagcugcgccugaaa

SEQ ID NO: 1652006 - RNA, 14 nt, Salmonella enterica enterica serovar Typhi
guaguaaaccgguu

SEQ ID NO: 1652007 - RNA, 17 nt, Salmonella enterica enterica serovar Typhi
guaguggaucagcagau

SEQ ID NO: 1652008 - RNA, 18 nt, Salmonella enterica enterica serovar Typhi
guagugcuucucuucaaa

SEQ ID NO: 1652009 - RNA, 12 nt, Salmonella enterica enterica serovar Typhi
guaugauagcga

SEQ ID NO: 1652010 - RNA, 17 nt, Salmonella enterica enterica serovar Typhi
guaugacguggccagca

SEQ ID NO: 1652011 - RNA, 17 nt, Salmonella enterica enterica serovar Typhi
guauccgccaccaugau

SEQ ID NO: 1652012 - RNA, 17 nt, Salmonella enterica enterica serovar Typhi
guauacgccacguuauc

SEQ ID NO: 1652013 - RNA, 12 nt, Salmonella enterica enterica serovar Typhi
guauaaaucacg

SEQ ID NO: 1652014 - RNA, 21 nt, Salmonella enterica enterica serovar Typhi
guauaaauuuccgcagccaga

SEQ ID NO: 1652015 - RNA, 13 nt, Salmonella enterica enterica serovar Typhi
guauaacucagcg

SEQ ID NO: 1652016 - RNA, 21 nt, Salmonella enterica enterica serovar Typhi
guauaaaaccccuuguuauuc

SEQ ID NO: 1652017 - RNA, 10 nt, Salmonella enterica enterica serovar Typhi
guauaaagcu

SEQ ID NO: 1652018 - RNA, 23 nt, Salmonella enterica enterica serovar Typhi
guaucauaucaauauguuccggc

SEQ ID NO: 1652019 - RNA, 18 nt, Salmonella enterica enterica serovar Typhi
gucaaacaucgcgcucca

SEQ ID NO: 1652020 - RNA, 16 nt, Salmonella enterica enterica serovar Typhi
gucaacacgcagaccc

SEQ ID NO: 1652021 - RNA, 16 nt, Salmonella enterica enterica serovar Typhi
guaugcagugggccgg

SEQ ID NO: 1652022 - RNA, 15 nt, Salmonella enterica enterica serovar Typhi
guaugcugucgccgg

SEQ ID NO: 1652023 - RNA, 14 nt, Salmonella enterica enterica serovar Typhi
guaugcgauacccc

SEQ ID NO: 1652024 - RNA, 17 nt, Salmonella enterica enterica serovar Typhi
gucacagauccagacau

SEQ ID NO: 1652025 - RNA, 21 nt, Salmonella enterica enterica serovar Typhi
ggugcucucccagcugagcua

SEQ ID NO: 1652026 - RNA, 18 nt, Salmonella enterica enterica serovar Typhi
ggugcugaauauuaucgg

SEQ ID NO: 1652027 - RNA, 20 nt, Salmonella enterica enterica serovar Typhi
ggugcuguagcugcccggau

SEQ ID NO: 1652028 - RNA, 14 nt, Salmonella enterica enterica serovar Typhi
ggugcguucugccg

SEQ ID NO: 1652029 - RNA, 18 nt, Salmonella enterica enterica serovar Typhi
gguuauccaccagcgcca

SEQ ID NO: 1652030 - RNA, 14 nt, Salmonella enterica enterica serovar Typhi
gguuacucuuccac

SEQ ID NO: 1652031 - RNA, 19 nt, Salmonella enterica enterica serovar Typhi
gguuagccagugggcguca

SEQ ID NO: 1652032 - RNA, 16 nt, Salmonella enterica enterica serovar Typhi
gguguuugcggcacac

SEQ ID NO: 1652033 - RNA, 22 nt, Salmonella enterica enterica serovar Typhi
gguuaacgccguuaccagcauc

SEQ ID NO: 1652034 - RNA, 19 nt, Salmonella enterica enterica serovar Typhi
gguuaauaacugcgccauc

SEQ ID NO: 1652035 - RNA, 16 nt, Salmonella enterica enterica serovar Typhi
gguuuuuaagcugccc

SEQ ID NO: 1652036 - RNA, 19 nt, Salmonella enterica enterica serovar Typhi
guaaaggcguagaucucua

SEQ ID NO: 1652037 - RNA, 22 nt, Salmonella enterica enterica serovar Typhi
gguuugccgcauacaucgcaga

SEQ ID NO: 1652038 - RNA, 17 nt, Salmonella enterica enterica serovar Typhi
gguuugcauugccauga

SEQ ID NO: 1652039 - RNA, 18 nt, Salmonella enterica enterica serovar Typhi
gguuugcaggccggauaa

SEQ ID NO: 1652040 - RNA, 15 nt, Salmonella enterica enterica serovar Typhi
guaacgcucuuaccg

SEQ ID NO: 1652041 - RNA, 16 nt, Salmonella enterica enterica serovar Typhi
guaacgccuucgcaaa

SEQ ID NO: 1652042 - RNA, 23 nt, Salmonella enterica enterica serovar Typhi
guaaauugaguggacaucgccau

SEQ ID NO: 1652043 - RNA, 16 nt, Salmonella enterica enterica serovar Typhi
guaaauuuaugguucc

SEQ ID NO: 1652044 - RNA, 13 nt, Salmonella enterica enterica serovar Typhi
guaaauccggcuc

SEQ ID NO: 1652045 - RNA, 17 nt, Salmonella enterica enterica serovar Typhi
guaaaucugccgucauc

SEQ ID NO: 1652046 - RNA, 16 nt, Salmonella enterica enterica serovar Typhi
guaaaugacgccagac

SEQ ID NO: 1652047 - RNA, 17 nt, Salmonella enterica enterica serovar Typhi
guaaauaaucgacgaua

SEQ ID NO: 1652048 - RNA, 16 nt, Salmonella enterica enterica serovar Typhi
guaaaggucgccgcau

SEQ ID NO: 1652049 - RNA, 20 nt, Salmonella enterica enterica serovar Typhi
gguugucaaaaaaucagcaa

SEQ ID NO: 1652050 - RNA, 20 nt, Salmonella enterica enterica serovar Typhi
gguuguaucauguuccggca

SEQ ID NO: 1652051 - RNA, 17 nt, Salmonella enterica enterica serovar Typhi
guaacgggcaucgccgc

SEQ ID NO: 1652052 - RNA, 14 nt, Salmonella enterica enterica serovar Typhi
guaacuucacgcca

SEQ ID NO: 1652053 - RNA, 21 nt, Salmonella enterica enterica serovar Typhi
guaagaagaaccagcgcgaca

SEQ ID NO: 1652054 - RNA, 14 nt, Salmonella enterica enterica serovar Typhi
guaaugacgcggaa

SEQ ID NO: 1652055 - RNA, 18 nt, Salmonella enterica enterica serovar Typhi
guaaugucuggugcagca

SEQ ID NO: 1652056 - RNA, 19 nt, Salmonella enterica enterica serovar Typhi
guaauucagcucgcugccg

SEQ ID NO: 1652057 - RNA, 12 nt, Salmonella enterica enterica serovar Typhi
guaauugacgcg

SEQ ID NO: 1652058 - RNA, 15 nt, Salmonella enterica enterica serovar Typhi
guacacgaaauagcg

SEQ ID NO: 1652059 - RNA, 14 nt, Salmonella enterica enterica serovar Typhi
guacacgcagucca

SEQ ID NO: 1652060 - RNA, 17 nt, Salmonella enterica enterica serovar Typhi
guacacuucauccggcg

SEQ ID NO: 1652061 - RNA, 23 nt, Salmonella enterica enterica serovar Typhi
guacacuucauccggcguugcgc

SEQ ID NO: 1652062 - RNA, 16 nt, Salmonella enterica enterica serovar Typhi
guacauuauugcacau

SEQ ID NO: 1652063 - RNA, 13 nt, Salmonella enterica enterica serovar Typhi
guaccacguuauc

SEQ ID NO: 1652064 - RNA, 15 nt, Salmonella enterica enterica serovar Typhi
gugcaggcugagcgu

SEQ ID NO: 1652065 - RNA, 14 nt, Salmonella enterica enterica serovar Typhi
gugccaauggcgau

SEQ ID NO: 1652066 - RNA, 14 nt, Salmonella enterica enterica serovar Typhi
gugccaaggcaucu

SEQ ID NO: 1652067 - RNA, 23 nt, Salmonella enterica enterica serovar Typhi
gugccgaccagcgguugcauaaa

SEQ ID NO: 1652068 - RNA, 21 nt, Salmonella enterica enterica serovar Typhi
gugcgaguucaagucucgccu

SEQ ID NO: 1652069 - RNA, 13 nt, Salmonella enterica enterica serovar Typhi
gugccgucaucca

SEQ ID NO: 1652070 - RNA, 14 nt, Salmonella enterica enterica serovar Typhi
gugcggcggacgcc

SEQ ID NO: 1652071 - RNA, 19 nt, Salmonella enterica enterica serovar Typhi
gugcgcuguggucgucugg

SEQ ID NO: 1652072 - RNA, 22 nt, Salmonella enterica enterica serovar Typhi
gugacgguaucgugacgcgaau

SEQ ID NO: 1652073 - RNA, 16 nt, Salmonella enterica enterica serovar Typhi
gugacuaaaagacgcc

SEQ ID NO: 1652074 - RNA, 15 nt, Salmonella enterica enterica serovar Typhi
gugagaaacgcgcca

SEQ ID NO: 1652075 - RNA, 21 nt, Salmonella enterica enterica serovar Typhi
gugacgaagaucgcguacagc

SEQ ID NO: 1652076 - RNA, 15 nt, Salmonella enterica enterica serovar Typhi
gugcacuggucaucg

SEQ ID NO: 1652077 - RNA, 21 nt, Salmonella enterica enterica serovar Typhi
gugcagacugcacuuccugcg

SEQ ID NO: 1652078 - RNA, 16 nt, Salmonella enterica enterica serovar Typhi
gugauugcagauaauu

SEQ ID NO: 1652079 - RNA, 19 nt, Salmonella enterica enterica serovar Typhi
gucguacucaccaguccgg

SEQ ID NO: 1652080 - RNA, 16 nt, Salmonella enterica enterica serovar Typhi
gucguaaauuccugca

SEQ ID NO: 1652081 - RNA, 14 nt, Salmonella enterica enterica serovar Typhi
gucgucgaucgcgc

SEQ ID NO: 1652082 - RNA, 14 nt, Salmonella enterica enterica serovar Typhi
gucgucauggcgua

SEQ ID NO: 1652083 - RNA, 21 nt, Salmonella enterica enterica serovar Typhi
gucgucauuugaaucugcggu

SEQ ID NO: 1652084 - RNA, 12 nt, Salmonella enterica enterica serovar Typhi
gucggcagcgag

SEQ ID NO: 1652085 - RNA, 16 nt, Salmonella enterica enterica serovar Typhi
gucgggugcagcguca

SEQ ID NO: 1652086 - RNA, 15 nt, Salmonella enterica enterica serovar Typhi
gucgguaaucgccug

SEQ ID NO: 1652087 - RNA, 17 nt, Salmonella enterica enterica serovar Typhi
gugaauaugacgggcaa

SEQ ID NO: 1652088 - RNA, 17 nt, Salmonella enterica enterica serovar Typhi
gugaauuucugcugcca

SEQ ID NO: 1652089 - RNA, 15 nt, Salmonella enterica enterica serovar Typhi
gugacccgccgccag

SEQ ID NO: 1652090 - RNA, 14 nt, Salmonella enterica enterica serovar Typhi
gugaccccggccuc

SEQ ID NO: 1652091 - RNA, 15 nt, Salmonella enterica enterica serovar Typhi
gugacauuauucacc

SEQ ID NO: 1652092 - RNA, 20 nt, Salmonella enterica enterica serovar Typhi
gugaagcgaucggcgucauu

SEQ ID NO: 1652093 - RNA, 21 nt, Salmonella enterica enterica serovar Typhi
gugaagauuauucucgcacuu

SEQ ID NO: 1652094 - RNA, 14 nt, Salmonella enterica enterica serovar Typhi
gugaagacgcugca

SEQ ID NO: 1652095 - RNA, 15 nt, Salmonella enterica enterica serovar Typhi
gucucuacuacauau

SEQ ID NO: 1652096 - RNA, 17 nt, Salmonella enterica enterica serovar Typhi
gucuggauaccccgcac

SEQ ID NO: 1652097 - RNA, 14 nt, Salmonella enterica enterica serovar Typhi
gucucgacauuagc

SEQ ID NO: 1652098 - RNA, 19 nt, Salmonella enterica enterica serovar Typhi
gucgugugcggaugcgcca

SEQ ID NO: 1652099 - RNA, 21 nt, Salmonella enterica enterica serovar Typhi
gucguuccacacguccauccg

SEQ ID NO: 1652100 - RNA, 19 nt, Salmonella enterica enterica serovar Typhi
gucgugucauagucggcgc

SEQ ID NO: 1652101 - RNA, 19 nt, Salmonella enterica enterica serovar Typhi
gucgugacuaauagccaaa

SEQ ID NO: 1652102 - RNA, 21 nt, Salmonella enterica enterica serovar Typhi
gucgugaaucaucaucauccg

SEQ ID NO: 1652103 - RNA, 23 nt, Salmonella enterica enterica serovar Typhi
gucgucugaaagcgacucaucca

SEQ ID NO: 1652104 - RNA, 17 nt, Salmonella enterica enterica serovar Typhi
guccuugcgaagaccgc

SEQ ID NO: 1652105 - RNA, 16 nt, Salmonella enterica enterica serovar Typhi
guccugucccugccag

SEQ ID NO: 1652106 - RNA, 14 nt, Salmonella enterica enterica serovar Typhi
guccuccaacgugc

SEQ ID NO: 1652107 - RNA, 23 nt, Salmonella enterica enterica serovar Typhi
guccugcaaggcaucgucggcga

SEQ ID NO: 1652108 - RNA, 16 nt, Salmonella enterica enterica serovar Typhi
guccgguugcaguaca

SEQ ID NO: 1652109 - RNA, 12 nt, Salmonella enterica enterica serovar Typhi
guccgguggcga

SEQ ID NO: 1652110 - RNA, 20 nt, Salmonella enterica enterica serovar Typhi
guccggcguuuuagcgccau

SEQ ID NO: 1652111 - RNA, 14 nt, Salmonella enterica enterica serovar Typhi
guccggaucgacgg

SEQ ID NO: 1652112 - RNA, 15 nt, Salmonella enterica enterica serovar Typhi
guccggaucucgcca

SEQ ID NO: 1652113 - RNA, 18 nt, Salmonella enterica enterica serovar Typhi
guccgcuggcguccagcc

SEQ ID NO: 1652114 - RNA, 15 nt, Salmonella enterica enterica serovar Typhi
guccggcaucgugau

SEQ ID NO: 1652115 - RNA, 17 nt, Salmonella enterica enterica serovar Typhi
guccggcccgcuaucac

SEQ ID NO: 1652116 - RNA, 16 nt, Salmonella enterica enterica serovar Typhi
guccgccuuugacgcc

SEQ ID NO: 1652117 - RNA, 12 nt, Salmonella enterica enterica serovar Typhi
gucagaucguau

SEQ ID NO: 1652118 - RNA, 17 nt, Salmonella enterica enterica serovar Typhi
gucagauccuucauuca

SEQ ID NO: 1652119 - RNA, 22 nt, Salmonella enterica enterica serovar Typhi
gucgcucuuuuuuuugcuuaaa

SEQ ID NO: 1652120 - RNA, 20 nt, Salmonella enterica enterica serovar Typhi
gucgcugcgcucaucaggcc

SEQ ID NO: 1652121 - RNA, 15 nt, Salmonella enterica enterica serovar Typhi
gucgcuggcggaauc

SEQ ID NO: 1652122 - RNA, 17 nt, Salmonella enterica enterica serovar Typhi
gucgcuauccagcagua

SEQ ID NO: 1652123 - RNA, 18 nt, Salmonella enterica enterica serovar Typhi
gucgcucagaauagggau

SEQ ID NO: 1652124 - RNA, 14 nt, Salmonella enterica enterica serovar Typhi
gucgcuccggaacg

SEQ ID NO: 1652125 - RNA, 16 nt, Salmonella enterica enterica serovar Typhi
gucgcucuaucgccug

SEQ ID NO: 1652126 - RNA, 19 nt, Salmonella enterica enterica serovar Typhi
gucgcgguacuucugaccc

SEQ ID NO: 1652127 - RNA, 22 nt, Salmonella enterica enterica serovar Typhi
gucgcgccgcguuucucgccgg

SEQ ID NO: 1652128 - RNA, 12 nt, Salmonella enterica enterica serovar Typhi
gucgccggccug

SEQ ID NO: 1652129 - RNA, 18 nt, Salmonella enterica enterica serovar Typhi
gucgccgccaaagcgccc

SEQ ID NO: 1652130 - RNA, 19 nt, Salmonella enterica enterica serovar Typhi
gucgcauccuuaugcagaa

SEQ ID NO: 1652131 - RNA, 12 nt, Salmonella enterica enterica serovar Typhi
gucgccagcaua

SEQ ID NO: 1652132 - RNA, 22 nt, Salmonella enterica enterica serovar Typhi
gucgcauccauauaagcgguau

SEQ ID NO: 1652133 - RNA, 13 nt, Salmonella enterica enterica serovar Typhi
gucgcauccgcgu

SEQ ID NO: 1652134 - RNA, 16 nt, Salmonella enterica enterica serovar Typhi
gucgauagaucgccac

SEQ ID NO: 1652135 - RNA, 17 nt, Salmonella enterica enterica serovar Typhi
gucgacugguaggccug

SEQ ID NO: 1652136 - RNA, 20 nt, Salmonella enterica enterica serovar Typhi
gucgagauacugcaacgcca

SEQ ID NO: 1652137 - RNA, 23 nt, Salmonella enterica enterica serovar Typhi
gucgagaauguggguauccacgc

SEQ ID NO: 1652138 - RNA, 21 nt, Salmonella enterica enterica serovar Typhi
gcgccgaaugcguuuuuucac

SEQ ID NO: 1652139 - RNA, 22 nt, Salmonella enterica enterica serovar Typhi
gcgccgcaaaggaucaucggcc

SEQ ID NO: 1652140 - RNA, 15 nt, Salmonella enterica enterica serovar Typhi
gcgccgcucaucacc

SEQ ID NO: 1652141 - RNA, 22 nt, Salmonella enterica enterica serovar Typhi
gcgccgcuacguaccgcuuccg

SEQ ID NO: 1652142 - RNA, 19 nt, Salmonella enterica enterica serovar Typhi
gcgccgccaacgauacagc

SEQ ID NO: 1652143 - RNA, 21 nt, Salmonella enterica enterica serovar Typhi
gcgccgccaacgauacagcac

SEQ ID NO: 1652144 - RNA, 16 nt, Salmonella enterica enterica serovar Typhi
gcgccgcgccgccgua

SEQ ID NO: 1652145 - RNA, 19 nt, Salmonella enterica enterica serovar Typhi
gcgccgcgcagcaucugau

SEQ ID NO: 1652146 - RNA, 19 nt, Salmonella enterica enterica serovar Typhi
gcgccgcgacaacgccauc

SEQ ID NO: 1652147 - RNA, 15 nt, Salmonella enterica enterica serovar Typhi
gcgccgcgauaaaga

SEQ ID NO: 1652148 - RNA, 15 nt, Salmonella enterica enterica serovar Typhi
gcgccgcgauacgga

SEQ ID NO: 1652149 - RNA, 18 nt, Salmonella enterica enterica serovar Typhi
gcgccgccugcacggcgu

SEQ ID NO: 1652150 - RNA, 22 nt, Salmonella enterica enterica serovar Typhi
gcgcccaaugcuuagucagccu

SEQ ID NO: 1652151 - RNA, 13 nt, Salmonella enterica enterica serovar Typhi
gcgcccagcagca

SEQ ID NO: 1652152 - RNA, 16 nt, Salmonella enterica enterica serovar Typhi
gcgcccagcagcagaa

SEQ ID NO: 1652153 - RNA, 16 nt, Salmonella enterica enterica serovar Typhi
gcgccauugagcauuc

SEQ ID NO: 1652154 - RNA, 15 nt, Salmonella enterica enterica serovar Typhi
gcgccccaguaacgu

SEQ ID NO: 1652155 - RNA, 24 nt, Salmonella enterica enterica serovar Typhi
gcgcccccagcaaaccggcaugaa

SEQ ID NO: 1652156 - RNA, 15 nt, Salmonella enterica enterica serovar Typhi
gcgcccauuccgccu

SEQ ID NO: 1652157 - RNA, 12 nt, Salmonella enterica enterica serovar Typhi
gcgccagcagca

SEQ ID NO: 1652158 - RNA, 12 nt, Salmonella enterica enterica serovar Typhi
gcgccagccguu

SEQ ID NO: 1652159 - RNA, 23 nt, Salmonella enterica enterica serovar Typhi
gcgccagcggauugccauacacg

SEQ ID NO: 1652160 - RNA, 18 nt, Salmonella enterica enterica serovar Typhi
gcgccagagaucgcacua

SEQ ID NO: 1652161 - RNA, 17 nt, Salmonella enterica enterica serovar Typhi
gcgccacuuuuccggca

SEQ ID NO: 1652162 - RNA, 17 nt, Salmonella enterica enterica serovar Typhi
gcgauauccgugccgcc

SEQ ID NO: 1652163 - RNA, 14 nt, Salmonella enterica enterica serovar Typhi
gcgauaucauucuc

SEQ ID NO: 1652164 - RNA, 20 nt, Salmonella enterica enterica serovar Typhi
gcgcagaaucacuucauccg

SEQ ID NO: 1652165 - RNA, 23 nt, Salmonella enterica enterica serovar Typhi
gcgcacuuccucucccacugcga

SEQ ID NO: 1652166 - RNA, 16 nt, Salmonella enterica enterica serovar Typhi
gcgcagcacuucagaa

SEQ ID NO: 1652167 - RNA, 16 nt, Salmonella enterica enterica serovar Typhi
gcgcagcgcaucaggc

SEQ ID NO: 1652168 - RNA, 14 nt, Salmonella enterica enterica serovar Typhi
gcgcagcgccauca

SEQ ID NO: 1652169 - RNA, 17 nt, Salmonella enterica enterica serovar Typhi
gcgcagcgccaucaggc

SEQ ID NO: 1652170 - RNA, 20 nt, Salmonella enterica enterica serovar Typhi
gcgcagcgccaucaggcacg

SEQ ID NO: 1652171 - RNA, 19 nt, Salmonella enterica enterica serovar Typhi
gcgcagcgccaucaggccc

SEQ ID NO: 1652172 - RNA, 13 nt, Salmonella enterica enterica serovar Typhi
gcgcaggccguca

SEQ ID NO: 1652173 - RNA, 15 nt, Salmonella enterica enterica serovar Typhi
gcgcaggucuucguc

SEQ ID NO: 1652174 - RNA, 17 nt, Salmonella enterica enterica serovar Typhi
gcgcauccgucaggccc

SEQ ID NO: 1652175 - RNA, 17 nt, Salmonella enterica enterica serovar Typhi
gcgcauauuccggcgac

SEQ ID NO: 1652176 - RNA, 16 nt, Salmonella enterica enterica serovar Typhi
gcgcauauuccggcga

SEQ ID NO: 1652177 - RNA, 13 nt, Salmonella enterica enterica serovar Typhi
gcgcauacucuuc

SEQ ID NO: 1652178 - RNA, 17 nt, Salmonella enterica enterica serovar Typhi
gcgcauacgucaugccu

SEQ ID NO: 1652179 - RNA, 18 nt, Salmonella enterica enterica serovar Typhi
gcgcauacucuuccguca

SEQ ID NO: 1652180 - RNA, 21 nt, Salmonella enterica enterica serovar Typhi
gcgcauaagccacuucaacca

SEQ ID NO: 1652181 - RNA, 23 nt, Salmonella enterica enterica serovar Typhi
gcgcauaauccggaauaagaaua

SEQ ID NO: 1652182 - RNA, 13 nt, Salmonella enterica enterica serovar Typhi
gcgcggcagaccg

SEQ ID NO: 1652183 - RNA, 20 nt, Salmonella enterica enterica serovar Typhi
gcgcggcaggccuuucggca

SEQ ID NO: 1652184 - RNA, 19 nt, Salmonella enterica enterica serovar Typhi
gcgcguaaguuugcguacu

SEQ ID NO: 1652185 - RNA, 15 nt, Salmonella enterica enterica serovar Typhi
gcgcguaauuccgca

SEQ ID NO: 1652186 - RNA, 12 nt, Salmonella enterica enterica serovar Typhi
gcgcggguugcc

SEQ ID NO: 1652187 - RNA, 13 nt, Salmonella enterica enterica serovar Typhi
gcgcuaaccagcg

SEQ ID NO: 1652188 - RNA, 17 nt, Salmonella enterica enterica serovar Typhi
gcgcguuuuccaucauc

SEQ ID NO: 1652189 - RNA, 14 nt, Salmonella enterica enterica serovar Typhi
gcgcuaagccagcc

SEQ ID NO: 1652190 - RNA, 18 nt, Salmonella enterica enterica serovar Typhi
gcgcucaacacauaacgc

SEQ ID NO: 1652191 - RNA, 20 nt, Salmonella enterica enterica serovar Typhi
gcgcuaaugcuuauccggcc

SEQ ID NO: 1652192 - RNA, 23 nt, Salmonella enterica enterica serovar Typhi
gcgcguuguccaacugucgccau

SEQ ID NO: 1652193 - RNA, 15 nt, Salmonella enterica enterica serovar Typhi
gcgcgucgaccauac

SEQ ID NO: 1652194 - RNA, 13 nt, Salmonella enterica enterica serovar Typhi
gcgcgucgaauga

SEQ ID NO: 1652195 - RNA, 18 nt, Salmonella enterica enterica serovar Typhi
gcgcgucgcauccggcaa

SEQ ID NO: 1652196 - RNA, 22 nt, Salmonella enterica enterica serovar Typhi
gcgcgucgcuguucgccggaug

SEQ ID NO: 1652197 - RNA, 17 nt, Salmonella enterica enterica serovar Typhi
gcgcuucguuuuccgca

SEQ ID NO: 1652198 - RNA, 20 nt, Salmonella enterica enterica serovar Typhi
gcgcuucgcuuaucaggccu

SEQ ID NO: 1652199 - RNA, 17 nt, Salmonella enterica enterica serovar Typhi
gcgcuucugauuauuga

SEQ ID NO: 1652200 - RNA, 23 nt, Salmonella enterica enterica serovar Typhi
gcgcuugcgccgccauccggccu

SEQ ID NO: 1652201 - RNA, 16 nt, Salmonella enterica enterica serovar Typhi
gcgcuuuacaugacgc

SEQ ID NO: 1652202 - RNA, 23 nt, Salmonella enterica enterica serovar Typhi
gcgcuguacgccucuuucagccg

SEQ ID NO: 1652203 - RNA, 14 nt, Salmonella enterica enterica serovar Typhi
gcgcugugacggca

SEQ ID NO: 1652204 - RNA, 19 nt, Salmonella enterica enterica serovar Typhi
gcgcugugcuaucaggccu

SEQ ID NO: 1652205 - RNA, 19 nt, Salmonella enterica enterica serovar Typhi
gcgcuguguccgccugcug

SEQ ID NO: 1652206 - RNA, 14 nt, Salmonella enterica enterica serovar Typhi
gcgcuuaucgccgu

SEQ ID NO: 1652207 - RNA, 22 nt, Salmonella enterica enterica serovar Typhi
gcgcuuaucgccguaaccgccu

SEQ ID NO: 1652208 - RNA, 15 nt, Salmonella enterica enterica serovar Typhi
gcgcuuaucaggccu

SEQ ID NO: 1652209 - RNA, 22 nt, Salmonella enterica enterica serovar Typhi
gcgcuuaucaggccuaccagcc

SEQ ID NO: 1652210 - RNA, 14 nt, Salmonella enterica enterica serovar Typhi
gcgcuuauccggcc

SEQ ID NO: 1652211 - RNA, 19 nt, Salmonella enterica enterica serovar Typhi
gcgcuuacacacccggccu

SEQ ID NO: 1652212 - RNA, 19 nt, Salmonella enterica enterica serovar Typhi
gcgcuuaccgggccuacaa

SEQ ID NO: 1652213 - RNA, 19 nt, Salmonella enterica enterica serovar Typhi
gcgcuuaccgggccuacag

SEQ ID NO: 1652214 - RNA, 22 nt, Salmonella enterica enterica serovar Typhi
gcgcuuagccugaucgaucagc

SEQ ID NO: 1652215 - RNA, 19 nt, Salmonella enterica enterica serovar Typhi
gcgcuuaucaggccuacaa

SEQ ID NO: 1652216 - RNA, 21 nt, Salmonella enterica enterica serovar Typhi
gcgcugcgccagaucaggcgu

SEQ ID NO: 1652217 - RNA, 18 nt, Salmonella enterica enterica serovar Typhi
gcgcugcgcggcgugcag

SEQ ID NO: 1652218 - RNA, 21 nt, Salmonella enterica enterica serovar Typhi
gcgcugccgcuuauccggccu

SEQ ID NO: 1652219 - RNA, 22 nt, Salmonella enterica enterica serovar Typhi
gcgcuccgacugaaccuucacg

SEQ ID NO: 1652220 - RNA, 19 nt, Salmonella enterica enterica serovar Typhi
gcgcugauauuuuuacuga

SEQ ID NO: 1652221 - RNA, 14 nt, Salmonella enterica enterica serovar Typhi
gcgcugaucgccac

SEQ ID NO: 1652222 - RNA, 17 nt, Salmonella enterica enterica serovar Typhi
gcgcugaugugcggccu

SEQ ID NO: 1652223 - RNA, 23 nt, Salmonella enterica enterica serovar Typhi
gcgcgcuuuccacaaucccggca

SEQ ID NO: 1652224 - RNA, 17 nt, Salmonella enterica enterica serovar Typhi
gcgcgcguuaugccgac

SEQ ID NO: 1652225 - RNA, 13 nt, Salmonella enterica enterica serovar Typhi
gcgcgccggugau

SEQ ID NO: 1652226 - RNA, 13 nt, Salmonella enterica enterica serovar Typhi
gcgcgccgacagg

SEQ ID NO: 1652227 - RNA, 13 nt, Salmonella enterica enterica serovar Typhi
gcgccuuccggga

SEQ ID NO: 1652228 - RNA, 14 nt, Salmonella enterica enterica serovar Typhi
gcgccuuccggcca

SEQ ID NO: 1652229 - RNA, 20 nt, Salmonella enterica enterica serovar Typhi
gcgcgacgacgccagccagc

SEQ ID NO: 1652230 - RNA, 23 nt, Salmonella enterica enterica serovar Typhi
gcgcgagccacgcggcaucaggc

SEQ ID NO: 1652231 - RNA, 22 nt, Salmonella enterica enterica serovar Typhi
gcgcgagaacugcugcauccgc

SEQ ID NO: 1652232 - RNA, 23 nt, Salmonella enterica enterica serovar Typhi
gcgccuaccagcgcuauccaggc

SEQ ID NO: 1652233 - RNA, 13 nt, Salmonella enterica enterica serovar Typhi
gcgccuaccgcca

SEQ ID NO: 1652234 - RNA, 14 nt, Salmonella enterica enterica serovar Typhi
gcgccggacagcag

SEQ ID NO: 1652235 - RNA, 23 nt, Salmonella enterica enterica serovar Typhi
gcgccgugucaucauuacaggcg

SEQ ID NO: 1652236 - RNA, 21 nt, Salmonella enterica enterica serovar Typhi
gcgccuguaaacguuccugcc

SEQ ID NO: 1652237 - RNA, 17 nt, Salmonella enterica enterica serovar Typhi
gcgccuguagcguaauu

SEQ ID NO: 1652238 - RNA, 18 nt, Salmonella enterica enterica serovar Typhi
gccgggcagacaucgccg

SEQ ID NO: 1652239 - RNA, 18 nt, Salmonella enterica enterica serovar Typhi
gccgggugacgcuuacgc

SEQ ID NO: 1652240 - RNA, 19 nt, Salmonella enterica enterica serovar Typhi
gccggucaugccaucccgc

SEQ ID NO: 1652241 - RNA, 19 nt, Salmonella enterica enterica serovar Typhi
gccggucguaaugagcacu

SEQ ID NO: 1652242 - RNA, 16 nt, Salmonella enterica enterica serovar Typhi
gccggugccugccgcc

SEQ ID NO: 1652243 - RNA, 19 nt, Salmonella enterica enterica serovar Typhi
gccguaucagcaagcgcca

SEQ ID NO: 1652244 - RNA, 19 nt, Salmonella enterica enterica serovar Typhi
gccgucaaugccuggcaga

SEQ ID NO: 1652245 - RNA, 15 nt, Salmonella enterica enterica serovar Typhi
gccgucacagagagc

SEQ ID NO: 1652246 - RNA, 23 nt, Salmonella enterica enterica serovar Typhi
gccgucaaacaagccgccaacgc

SEQ ID NO: 1652247 - RNA, 17 nt, Salmonella enterica enterica serovar Typhi
gccgucaaacaucgcgc

SEQ ID NO: 1652248 - RNA, 20 nt, Salmonella enterica enterica serovar Typhi
gccgucgacaaagccgacgc

SEQ ID NO: 1652249 - RNA, 16 nt, Salmonella enterica enterica serovar Typhi
gccgucgaugauggcg

SEQ ID NO: 1652250 - RNA, 21 nt, Salmonella enterica enterica serovar Typhi
gccgugaggcugaagcgcgac

SEQ ID NO: 1652251 - RNA, 13 nt, Salmonella enterica enterica serovar Typhi
gccgucgcuauca

SEQ ID NO: 1652252 - RNA, 12 nt, Salmonella enterica enterica serovar Typhi
gccgucggcaga

SEQ ID NO: 1652253 - RNA, 18 nt, Salmonella enterica enterica serovar Typhi
gccgucgugccugacguc

SEQ ID NO: 1652254 - RNA, 22 nt, Salmonella enterica enterica serovar Typhi
gccguugaguuugacugccaga

SEQ ID NO: 1652255 - RNA, 13 nt, Salmonella enterica enterica serovar Typhi
gccguuucaaccc

SEQ ID NO: 1652256 - RNA, 23 nt, Salmonella enterica enterica serovar Typhi
gccuaucaccgcgaugaccauca

SEQ ID NO: 1652257 - RNA, 15 nt, Salmonella enterica enterica serovar Typhi
gccucaaaaccgggc

SEQ ID NO: 1652258 - RNA, 20 nt, Salmonella enterica enterica serovar Typhi
gccuaucagcgauccgccgu

SEQ ID NO: 1652259 - RNA, 14 nt, Salmonella enterica enterica serovar Typhi
gccuaucgccauau

SEQ ID NO: 1652260 - RNA, 20 nt, Salmonella enterica enterica serovar Typhi
gccuaucgccauauacgcca

SEQ ID NO: 1652261 - RNA, 24 nt, Salmonella enterica enterica serovar Typhi
gccguuggcuuuggcucacugcua

SEQ ID NO: 1652262 - RNA, 15 nt, Salmonella enterica enterica serovar Typhi
gccucgcgauccgcc

SEQ ID NO: 1652263 - RNA, 18 nt, Salmonella enterica enterica serovar Typhi
gccucgcaaaacauggcu

SEQ ID NO: 1652264 - RNA, 21 nt, Salmonella enterica enterica serovar Typhi
gccucacccugaaauccggcu

SEQ ID NO: 1652265 - RNA, 21 nt, Salmonella enterica enterica serovar Typhi
gccuccgcuuccugcgccagu

SEQ ID NO: 1652266 - RNA, 18 nt, Salmonella enterica enterica serovar Typhi
gccuccggaucgacagca

SEQ ID NO: 1652267 - RNA, 14 nt, Salmonella enterica enterica serovar Typhi
gccuccggcgguga

SEQ ID NO: 1652268 - RNA, 14 nt, Salmonella enterica enterica serovar Typhi
gccugccugacgcc

SEQ ID NO: 1652269 - RNA, 19 nt, Salmonella enterica enterica serovar Typhi
gccugcccugcggcaggca

SEQ ID NO: 1652270 - RNA, 16 nt, Salmonella enterica enterica serovar Typhi
gccugcgccagcgccg

SEQ ID NO: 1652271 - RNA, 19 nt, Salmonella enterica enterica serovar Typhi
gccuuauuuuucagcgcca

SEQ ID NO: 1652272 - RNA, 14 nt, Salmonella enterica enterica serovar Typhi
gccuucaaucagca

SEQ ID NO: 1652273 - RNA, 12 nt, Salmonella enterica enterica serovar Typhi
gccuuccacggc

SEQ ID NO: 1652274 - RNA, 20 nt, Salmonella enterica enterica serovar Typhi
gccuucagguuuuuaagcug

SEQ ID NO: 1652275 - RNA, 18 nt, Salmonella enterica enterica serovar Typhi
gccuuauccggccuacgu

SEQ ID NO: 1652276 - RNA, 14 nt, Salmonella enterica enterica serovar Typhi
gccuuauccggcgu

SEQ ID NO: 1652277 - RNA, 19 nt, Salmonella enterica enterica serovar Typhi
gccuugaaguuauccagcg

SEQ ID NO: 1652278 - RNA, 22 nt, Salmonella enterica enterica serovar Typhi
gccuugaaguuauccagcgccc

SEQ ID NO: 1652279 - RNA, 15 nt, Salmonella enterica enterica serovar Typhi
gccuucuucaucuuc

SEQ ID NO: 1652280 - RNA, 14 nt, Salmonella enterica enterica serovar Typhi
gccuucuuccguca

SEQ ID NO: 1652281 - RNA, 20 nt, Salmonella enterica enterica serovar Typhi
gccuugauccuguaacgcau

SEQ ID NO: 1652282 - RNA, 13 nt, Salmonella enterica enterica serovar Typhi
gccugucggucuu

SEQ ID NO: 1652283 - RNA, 13 nt, Salmonella enterica enterica serovar Typhi
gccuguccggccu

SEQ ID NO: 1652284 - RNA, 21 nt, Salmonella enterica enterica serovar Typhi
gccuggcgguaugaaagccau

SEQ ID NO: 1652285 - RNA, 18 nt, Salmonella enterica enterica serovar Typhi
gcgaacguuugaccugca

SEQ ID NO: 1652286 - RNA, 12 nt, Salmonella enterica enterica serovar Typhi
gcgaagccacuu

SEQ ID NO: 1652287 - RNA, 11 nt, Salmonella enterica enterica serovar Typhi
gcgaacauugg

SEQ ID NO: 1652288 - RNA, 22 nt, Salmonella enterica enterica serovar Typhi
gcgaaccaccguuuaaucgccc

SEQ ID NO: 1652289 - RNA, 19 nt, Salmonella enterica enterica serovar Typhi
gcgaacaggcucagcgcca

SEQ ID NO: 1652290 - RNA, 22 nt, Salmonella enterica enterica serovar Typhi
gcgaacaggcucagcgccacgc

SEQ ID NO: 1652291 - RNA, 23 nt, Salmonella enterica enterica serovar Typhi
gcgaacagcccgcuauuucucgc

SEQ ID NO: 1652292 - RNA, 14 nt, Salmonella enterica enterica serovar Typhi
gcgaacaggcguaa

SEQ ID NO: 1652293 - RNA, 18 nt, Salmonella enterica enterica serovar Typhi
gcgaaccuuccaucgcau

SEQ ID NO: 1652294 - RNA, 17 nt, Salmonella enterica enterica serovar Typhi
gccuuucagaucggcaa

SEQ ID NO: 1652295 - RNA, 18 nt, Salmonella enterica enterica serovar Typhi
gccuuucggcagcgggau

SEQ ID NO: 1652296 - RNA, 14 nt, Salmonella enterica enterica serovar Typhi
gccuuugccuucgc

SEQ ID NO: 1652297 - RNA, 22 nt, Salmonella enterica enterica serovar Typhi
gccuuucuuauuuuuuucaacg

SEQ ID NO: 1652298 - RNA, 17 nt, Salmonella enterica enterica serovar Typhi
gccuuucaccagcgccu

SEQ ID NO: 1652299 - RNA, 21 nt, Salmonella enterica enterica serovar Typhi
gccuuuaugggcuuugcaagc

SEQ ID NO: 1652300 - RNA, 14 nt, Salmonella enterica enterica serovar Typhi
gccuugccgccagc

SEQ ID NO: 1652301 - RNA, 11 nt, Salmonella enterica enterica serovar Typhi
gccuugccagc

SEQ ID NO: 1652302 - RNA, 18 nt, Salmonella enterica enterica serovar Typhi
gcgaaaagcgugcgccuu

SEQ ID NO: 1652303 - RNA, 15 nt, Salmonella enterica enterica serovar Typhi
gcgaaaacggcguag

SEQ ID NO: 1652304 - RNA, 18 nt, Salmonella enterica enterica serovar Typhi
gccuuuucccccagcauu

SEQ ID NO: 1652305 - RNA, 22 nt, Salmonella enterica enterica serovar Typhi
gccuuuuacaauaaccggcaga

SEQ ID NO: 1652306 - RNA, 12 nt, Salmonella enterica enterica serovar Typhi
gccuuuggccug

SEQ ID NO: 1652307 - RNA, 23 nt, Salmonella enterica enterica serovar Typhi
gcgaaaaauaggauggcgcagca

SEQ ID NO: 1652308 - RNA, 23 nt, Salmonella enterica enterica serovar Typhi
gccuuuuuuauacuccagcagac

SEQ ID NO: 1652309 - RNA, 18 nt, Salmonella enterica enterica serovar Typhi
gccuuuuuucaccugcaa

SEQ ID NO: 1652310 - RNA, 22 nt, Salmonella enterica enterica serovar Typhi
gcgaaaccggccgccaucgcaa

SEQ ID NO: 1652311 - RNA, 14 nt, Salmonella enterica enterica serovar Typhi
gcgaaacggcagcg

SEQ ID NO: 1652312 - RNA, 17 nt, Salmonella enterica enterica serovar Typhi
gcgaaacuccagcgaua

SEQ ID NO: 1652313 - RNA, 23 nt, Salmonella enterica enterica serovar Typhi
gcgaaagcacuucucgcgcauca

SEQ ID NO: 1652314 - RNA, 13 nt, Salmonella enterica enterica serovar Typhi
gcgaacagcgcac

SEQ ID NO: 1652315 - RNA, 19 nt, Salmonella enterica enterica serovar Typhi
gcgaaauauuaucgccauc

SEQ ID NO: 1652316 - RNA, 12 nt, Salmonella enterica enterica serovar Typhi
gcgacgaugcgc

SEQ ID NO: 1652317 - RNA, 20 nt, Salmonella enterica enterica serovar Typhi
gcgacgccaaucggcgucuu

SEQ ID NO: 1652318 - RNA, 14 nt, Salmonella enterica enterica serovar Typhi
gcgacgaucagcgc

SEQ ID NO: 1652319 - RNA, 18 nt, Salmonella enterica enterica serovar Typhi
gcgacgaucagcgccacg

SEQ ID NO: 1652320 - RNA, 15 nt, Salmonella enterica enterica serovar Typhi
gcgacgaucagcgcc

SEQ ID NO: 1652321 - RNA, 15 nt, Salmonella enterica enterica serovar Typhi
gcgacgaaucagcga

SEQ ID NO: 1652322 - RNA, 16 nt, Salmonella enterica enterica serovar Typhi
gcgacgacacggcgca

SEQ ID NO: 1652323 - RNA, 13 nt, Salmonella enterica enterica serovar Typhi
gcgacccagcgca

SEQ ID NO: 1652324 - RNA, 15 nt, Salmonella enterica enterica serovar Typhi
gcgacaguaguauca

SEQ ID NO: 1652325 - RNA, 15 nt, Salmonella enterica enterica serovar Typhi
gcgaagcggcgcuau

SEQ ID NO: 1652326 - RNA, 19 nt, Salmonella enterica enterica serovar Typhi
gcgacaaugcucucuucgc

SEQ ID NO: 1652327 - RNA, 14 nt, Salmonella enterica enterica serovar Typhi
gcgacacaacggca

SEQ ID NO: 1652328 - RNA, 18 nt, Salmonella enterica enterica serovar Typhi
gcgacacaacggcacaac

SEQ ID NO: 1652329 - RNA, 13 nt, Salmonella enterica enterica serovar Typhi
gcgaagcgccauc

SEQ ID NO: 1652330 - RNA, 19 nt, Salmonella enterica enterica serovar Typhi
gcgaagcgccgucggcauc

SEQ ID NO: 1652331 - RNA, 21 nt, Salmonella enterica enterica serovar Typhi
gcgacaggcgcuuaucgccgu

SEQ ID NO: 1652332 - RNA, 23 nt, Salmonella enterica enterica serovar Typhi
gcgaagcggcgcuauccggcauc

SEQ ID NO: 1652333 - RNA, 20 nt, Salmonella enterica enterica serovar Typhi
gcgaggaaaaucgcugcgcc

SEQ ID NO: 1652334 - RNA, 14 nt, Salmonella enterica enterica serovar Typhi
gcgaguagcgcagc

SEQ ID NO: 1652335 - RNA, 20 nt, Salmonella enterica enterica serovar Typhi
gcgagguucccgccgccauu

SEQ ID NO: 1652336 - RNA, 19 nt, Salmonella enterica enterica serovar Typhi
gcgauacucucgcagcgaa

SEQ ID NO: 1652337 - RNA, 15 nt, Salmonella enterica enterica serovar Typhi
gcgauacgcagcacc

SEQ ID NO: 1652338 - RNA, 14 nt, Salmonella enterica enterica serovar Typhi
gcgauaagcgucuu

SEQ ID NO: 1652339 - RNA, 19 nt, Salmonella enterica enterica serovar Typhi
gcgauaaaaccaccuacgc

SEQ ID NO: 1652340 - RNA, 13 nt, Salmonella enterica enterica serovar Typhi
gcgauaaacgauc

SEQ ID NO: 1652341 - RNA, 18 nt, Salmonella enterica enterica serovar Typhi
gcgauaaaaauauccgcc

SEQ ID NO: 1652342 - RNA, 22 nt, Salmonella enterica enterica serovar Typhi
gcgagaaggcuuugccauacgc

SEQ ID NO: 1652343 - RNA, 18 nt, Salmonella enterica enterica serovar Typhi
gcgagaagcugggcguca

SEQ ID NO: 1652344 - RNA, 16 nt, Salmonella enterica enterica serovar Typhi
gcgagaacuuccgcca

SEQ ID NO: 1652345 - RNA, 22 nt, Salmonella enterica enterica serovar Typhi
gcgagaacugcugcauccgcgc

SEQ ID NO: 1652346 - RNA, 16 nt, Salmonella enterica enterica serovar Typhi
gcgagcaggaauagcu

SEQ ID NO: 1652347 - RNA, 22 nt, Salmonella enterica enterica serovar Typhi
gcgacuuuaaacuuauccgcca

SEQ ID NO: 1652348 - RNA, 20 nt, Salmonella enterica enterica serovar Typhi
gcgacuuucacgaaaccggc

SEQ ID NO: 1652349 - RNA, 12 nt, Salmonella enterica enterica serovar Typhi
gcgacuuuggcu

SEQ ID NO: 1652350 - RNA, 17 nt, Salmonella enterica enterica serovar Typhi
gcgacuucauucaggca

SEQ ID NO: 1652351 - RNA, 21 nt, Salmonella enterica enterica serovar Typhi
gcggcauuggcguuaccggca

SEQ ID NO: 1652352 - RNA, 15 nt, Salmonella enterica enterica serovar Typhi
gcggcauuacgcgcc

SEQ ID NO: 1652353 - RNA, 13 nt, Salmonella enterica enterica serovar Typhi
gcggcaucguccg

SEQ ID NO: 1652354 - RNA, 13 nt, Salmonella enterica enterica serovar Typhi
gcggcaucaggca

SEQ ID NO: 1652355 - RNA, 14 nt, Salmonella enterica enterica serovar Typhi
gcggcaucaggcau

SEQ ID NO: 1652356 - RNA, 14 nt, Salmonella enterica enterica serovar Typhi
gcggcaguuccggc

SEQ ID NO: 1652357 - RNA, 15 nt, Salmonella enterica enterica serovar Typhi
gcggcaguuccggcg

SEQ ID NO: 1652358 - RNA, 16 nt, Salmonella enterica enterica serovar Typhi
gcggcaguuccggcgu

SEQ ID NO: 1652359 - RNA, 21 nt, Salmonella enterica enterica serovar Typhi
gcggcaguugaacucgauaac

SEQ ID NO: 1652360 - RNA, 19 nt, Salmonella enterica enterica serovar Typhi
gcggcaucgaacgggcgau

SEQ ID NO: 1652361 - RNA, 20 nt, Salmonella enterica enterica serovar Typhi
gcggcaucauaaaucgacau

SEQ ID NO: 1652362 - RNA, 20 nt, Salmonella enterica enterica serovar Typhi
gcgcuuuuuuuacgccugaa

SEQ ID NO: 1652363 - RNA, 23 nt, Salmonella enterica enterica serovar Typhi
gcggaaaaaagcagcaucccggc

SEQ ID NO: 1652364 - RNA, 17 nt, Salmonella enterica enterica serovar Typhi
gcggaacaccagcgccg

SEQ ID NO: 1652365 - RNA, 19 nt, Salmonella enterica enterica serovar Typhi
gcggccuccuggcuuaccu

SEQ ID NO: 1652366 - RNA, 21 nt, Salmonella enterica enterica serovar Typhi
gcggccuaaaucgcugcugau

SEQ ID NO: 1652367 - RNA, 13 nt, Salmonella enterica enterica serovar Typhi
gcggccuccggau

SEQ ID NO: 1652368 - RNA, 14 nt, Salmonella enterica enterica serovar Typhi
gcggccugcgugcg

SEQ ID NO: 1652369 - RNA, 19 nt, Salmonella enterica enterica serovar Typhi
gcggccuaaaucgcugcug

SEQ ID NO: 1652370 - RNA, 18 nt, Salmonella enterica enterica serovar Typhi
gcgggaaugcgcgcguga

SEQ ID NO: 1652371 - RNA, 21 nt, Salmonella enterica enterica serovar Typhi
gcgggcauacucuccuccaua

SEQ ID NO: 1652372 - RNA, 14 nt, Salmonella enterica enterica serovar Typhi
gcgggaaugcgcgc

SEQ ID NO: 1652373 - RNA, 15 nt, Salmonella enterica enterica serovar Typhi
gcggcguuggcgauu

SEQ ID NO: 1652374 - RNA, 15 nt, Salmonella enterica enterica serovar Typhi
gcggcgcuauccggc

SEQ ID NO: 1652375 - RNA, 16 nt, Salmonella enterica enterica serovar Typhi
gcggcgccaucaccau

SEQ ID NO: 1652376 - RNA, 17 nt, Salmonella enterica enterica serovar Typhi
gcggcgugaccgccuua

SEQ ID NO: 1652377 - RNA, 20 nt, Salmonella enterica enterica serovar Typhi
gcggcgugaugccagccaua

SEQ ID NO: 1652378 - RNA, 21 nt, Salmonella enterica enterica serovar Typhi
gcggcgguaacgccuucgcaa

SEQ ID NO: 1652379 - RNA, 19 nt, Salmonella enterica enterica serovar Typhi
gcggcguacacuucauccg

SEQ ID NO: 1652380 - RNA, 21 nt, Salmonella enterica enterica serovar Typhi
gcggcguacacuucauccggc

SEQ ID NO: 1652381 - RNA, 15 nt, Salmonella enterica enterica serovar Typhi
gcggcguccgccagc

SEQ ID NO: 1652382 - RNA, 20 nt, Salmonella enterica enterica serovar Typhi
gcguucuagcuuaucgccaa

SEQ ID NO: 1652383 - RNA, 19 nt, Salmonella enterica enterica serovar Typhi
gcguugaccagcgacggcg

SEQ ID NO: 1652384 - RNA, 21 nt, Salmonella enterica enterica serovar Typhi
gcguucuuccacuucagcagc

SEQ ID NO: 1652385 - RNA, 23 nt, Salmonella enterica enterica serovar Typhi
gcguuauguuguugagacgguga

SEQ ID NO: 1652386 - RNA, 23 nt, Salmonella enterica enterica serovar Typhi
gcguucaaagaucucgucaaggu

SEQ ID NO: 1652387 - RNA, 24 nt, Salmonella enterica enterica serovar Typhi
gcguucacgccgccauccggcacu

SEQ ID NO: 1652388 - RNA, 14 nt, Salmonella enterica enterica serovar Typhi
gcguucagcgccug

SEQ ID NO: 1652389 - RNA, 23 nt, Salmonella enterica enterica serovar Typhi
gcguucacgccgccauccggcaa

SEQ ID NO: 1652390 - RNA, 22 nt, Salmonella enterica enterica serovar Typhi
gcguucgaccguuuucgccagu

SEQ ID NO: 1652391 - RNA, 16 nt, Salmonella enterica enterica serovar Typhi
gcguuauccgccugcu

SEQ ID NO: 1652392 - RNA, 22 nt, Salmonella enterica enterica serovar Typhi
gcguuaugugaguuagcggcaa

SEQ ID NO: 1652393 - RNA, 13 nt, Salmonella enterica enterica serovar Typhi
gcgugcggcugac

SEQ ID NO: 1652394 - RNA, 20 nt, Salmonella enterica enterica serovar Typhi
gcguggcaucuuaucaggcc

SEQ ID NO: 1652395 - RNA, 21 nt, Salmonella enterica enterica serovar Typhi
gcguuuuuucgguaaucgccu

SEQ ID NO: 1652396 - RNA, 23 nt, Salmonella enterica enterica serovar Typhi
gcguuuuuaucuuuuacgcuguc

SEQ ID NO: 1652397 - RNA, 13 nt, Salmonella enterica enterica serovar Typhi
gcguuuugcgcgu

SEQ ID NO: 1652398 - RNA, 16 nt, Salmonella enterica enterica serovar Typhi
gcuaaaccggcggaau

SEQ ID NO: 1652399 - RNA, 16 nt, Salmonella enterica enterica serovar Typhi
gcuaaaaacagcgcaa

SEQ ID NO: 1652400 - RNA, 16 nt, Salmonella enterica enterica serovar Typhi
gcguuugcgccgccau

SEQ ID NO: 1652401 - RNA, 20 nt, Salmonella enterica enterica serovar Typhi
gcguuugauuugcgcgucgu

SEQ ID NO: 1652402 - RNA, 12 nt, Salmonella enterica enterica serovar Typhi
gcguuucugaac

SEQ ID NO: 1652403 - RNA, 23 nt, Salmonella enterica enterica serovar Typhi
gcuaaagcgacuuauccggccua

SEQ ID NO: 1652404 - RNA, 21 nt, Salmonella enterica enterica serovar Typhi
gcuaacgccugauccggccua

SEQ ID NO: 1652405 - RNA, 12 nt, Salmonella enterica enterica serovar Typhi
gcuaaccggcgg

SEQ ID NO: 1652406 - RNA, 20 nt, Salmonella enterica enterica serovar Typhi
gcuaacgcuuauccggccua

SEQ ID NO: 1652407 - RNA, 15 nt, Salmonella enterica enterica serovar Typhi
gcuaagagugacggu

SEQ ID NO: 1652408 - RNA, 18 nt, Salmonella enterica enterica serovar Typhi
gcuaacgcuuauccggcc

SEQ ID NO: 1652409 - RNA, 20 nt, Salmonella enterica enterica serovar Typhi
gcuaacgcguacccggcuua

SEQ ID NO: 1652410 - RNA, 22 nt, Salmonella enterica enterica serovar Typhi
gcuaacgccugauccggccuac

SEQ ID NO: 1652411 - RNA, 18 nt, Salmonella enterica enterica serovar Typhi
gcguugcuuaucaggccu

SEQ ID NO: 1652412 - RNA, 17 nt, Salmonella enterica enterica serovar Typhi
gcguugcgcccaggcca

SEQ ID NO: 1652413 - RNA, 22 nt, Salmonella enterica enterica serovar Typhi
gcguuuaacugaacaucgccgu

SEQ ID NO: 1652414 - RNA, 20 nt, Salmonella enterica enterica serovar Typhi
gcguuucguaauggccuaca

SEQ ID NO: 1652415 - RNA, 23 nt, Salmonella enterica enterica serovar Typhi
gcguuucccgcgcggaaggcgcc

SEQ ID NO: 1652416 - RNA, 20 nt, Salmonella enterica enterica serovar Typhi
gcguuucaacaaacucagcc

SEQ ID NO: 1652417 - RNA, 17 nt, Salmonella enterica enterica serovar Typhi
gcguuucacaucgccag

SEQ ID NO: 1652418 - RNA, 23 nt, Salmonella enterica enterica serovar Typhi
gcguuucacaucgccaguuauca

SEQ ID NO: 1652419 - RNA, 14 nt, Salmonella enterica enterica serovar Typhi
gcguuuaucaccaa

SEQ ID NO: 1652420 - RNA, 20 nt, Salmonella enterica enterica serovar Typhi
gcguuuauguuugcugauaa

SEQ ID NO: 1652421 - RNA, 14 nt, Salmonella enterica enterica serovar Typhi
gcguuuacuggcga

SEQ ID NO: 1652422 - RNA, 13 nt, Salmonella enterica enterica serovar Typhi
gcguuuagcgcca

SEQ ID NO: 1652423 - RNA, 18 nt, Salmonella enterica enterica serovar Typhi
gcgucgguuauagacgcc

SEQ ID NO: 1652424 - RNA, 23 nt, Salmonella enterica enterica serovar Typhi
gcgucgucauagcguugauaugc

SEQ ID NO: 1652425 - RNA, 15 nt, Salmonella enterica enterica serovar Typhi
gcgucucauccggca

SEQ ID NO: 1652426 - RNA, 19 nt, Salmonella enterica enterica serovar Typhi
gcgucuggguuugcagcag

SEQ ID NO: 1652427 - RNA, 13 nt, Salmonella enterica enterica serovar Typhi
gcgucuuauccgg

SEQ ID NO: 1652428 - RNA, 15 nt, Salmonella enterica enterica serovar Typhi
gcgucuuauccggcc

SEQ ID NO: 1652429 - RNA, 16 nt, Salmonella enterica enterica serovar Typhi
gcgucuuauccggccu

SEQ ID NO: 1652430 - RNA, 15 nt, Salmonella enterica enterica serovar Typhi
gcgugaaccagcauc

SEQ ID NO: 1652431 - RNA, 18 nt, Salmonella enterica enterica serovar Typhi
gcgugccgggcuggcgga

SEQ ID NO: 1652432 - RNA, 17 nt, Salmonella enterica enterica serovar Typhi
gcgugcggacguagggc

SEQ ID NO: 1652433 - RNA, 17 nt, Salmonella enterica enterica serovar Typhi
gcgugaugcgauccagc

SEQ ID NO: 1652434 - RNA, 14 nt, Salmonella enterica enterica serovar Typhi
gcgugaccgguaag

SEQ ID NO: 1652435 - RNA, 13 nt, Salmonella enterica enterica serovar Typhi
gcgugaccgguaa

SEQ ID NO: 1652436 - RNA, 14 nt, Salmonella enterica enterica serovar Typhi
gcgucaaaacuuau

SEQ ID NO: 1652437 - RNA, 18 nt, Salmonella enterica enterica serovar Typhi
gcgucaaaguugcaucaa

SEQ ID NO: 1652438 - RNA, 22 nt, Salmonella enterica enterica serovar Typhi
gcgucaaaaauaaaaaccgccu

SEQ ID NO: 1652439 - RNA, 12 nt, Salmonella enterica enterica serovar Typhi
gcguauuucacc

SEQ ID NO: 1652440 - RNA, 20 nt, Salmonella enterica enterica serovar Typhi
gcgucaacguuuuucagccg

SEQ ID NO: 1652441 - RNA, 13 nt, Salmonella enterica enterica serovar Typhi
gcgucaacgccac

SEQ ID NO: 1652442 - RNA, 20 nt, Salmonella enterica enterica serovar Typhi
gcguaucucauugauggucg

SEQ ID NO: 1652443 - RNA, 23 nt, Salmonella enterica enterica serovar Typhi
gcguauccauucucaucagaccg

SEQ ID NO: 1652444 - RNA, 12 nt, Salmonella enterica enterica serovar Typhi
gcguauccagca

SEQ ID NO: 1652445 - RNA, 22 nt, Salmonella enterica enterica serovar Typhi
gcguagucucccuccugcucca

SEQ ID NO: 1652446 - RNA, 17 nt, Salmonella enterica enterica serovar Typhi
gcguaccgucucggccu

SEQ ID NO: 1652447 - RNA, 13 nt, Salmonella enterica enterica serovar Typhi
gcguacagcgcca

SEQ ID NO: 1652448 - RNA, 15 nt, Salmonella enterica enterica serovar Typhi
gcguacaggcggaaa

SEQ ID NO: 1652449 - RNA, 14 nt, Salmonella enterica enterica serovar Typhi
gcguaccagcguca

SEQ ID NO: 1652450 - RNA, 22 nt, Salmonella enterica enterica serovar Typhi
gcguacaggcggaaaucaacaa

SEQ ID NO: 1652451 - RNA, 16 nt, Salmonella enterica enterica serovar Typhi
gcguacaggcggauga

SEQ ID NO: 1652452 - RNA, 18 nt, Salmonella enterica enterica serovar Typhi
gcguagagaggcauccgc

SEQ ID NO: 1652453 - RNA, 19 nt, Salmonella enterica enterica serovar Typhi
gcguacugcccguggcgga

SEQ ID NO: 1652454 - RNA, 19 nt, Salmonella enterica enterica serovar Typhi
gcguacuaaauaggcggca

SEQ ID NO: 1652455 - RNA, 22 nt, Salmonella enterica enterica serovar Typhi
gcguagcgagucaaaccucacg

SEQ ID NO: 1652456 - RNA, 18 nt, Salmonella enterica enterica serovar Typhi
gcguagcucgcccagcac

SEQ ID NO: 1652457 - RNA, 22 nt, Salmonella enterica enterica serovar Typhi
gcguagcgcccuggucagcauc

SEQ ID NO: 1652458 - RNA, 14 nt, Salmonella enterica enterica serovar Typhi
gcgucauccggcau

SEQ ID NO: 1652459 - RNA, 17 nt, Salmonella enterica enterica serovar Typhi
gcgucaucggcgcgcug

SEQ ID NO: 1652460 - RNA, 17 nt, Salmonella enterica enterica serovar Typhi
gcgucauaaccgcaguc

SEQ ID NO: 1652461 - RNA, 17 nt, Salmonella enterica enterica serovar Typhi
gcgucaucauugcgcca

SEQ ID NO: 1652462 - RNA, 21 nt, Salmonella enterica enterica serovar Typhi
gcgucaucccgguuucccgcg

SEQ ID NO: 1652463 - RNA, 22 nt, Salmonella enterica enterica serovar Typhi
gcguccagcccguccagauaau

SEQ ID NO: 1652464 - RNA, 15 nt, Salmonella enterica enterica serovar Typhi
gcgucaggacggcga

SEQ ID NO: 1652465 - RNA, 16 nt, Salmonella enterica enterica serovar Typhi
gcgucaggccaggguu

SEQ ID NO: 1652466 - RNA, 22 nt, Salmonella enterica enterica serovar Typhi
gcgucagcccaagcugacggau

SEQ ID NO: 1652467 - RNA, 12 nt, Salmonella enterica enterica serovar Typhi
gcgucagcagag

SEQ ID NO: 1652468 - RNA, 22 nt, Salmonella enterica enterica serovar Typhi
gcgucacccgccggcagcagcu

SEQ ID NO: 1652469 - RNA, 16 nt, Salmonella enterica enterica serovar Typhi
gcgucacgaccggcga

SEQ ID NO: 1652470 - RNA, 21 nt, Salmonella enterica enterica serovar Typhi
gcgucacccgccggcagcagc

SEQ ID NO: 1652471 - RNA, 13 nt, Salmonella enterica enterica serovar Typhi
gcgucacaggcuu

SEQ ID NO: 1652472 - RNA, 19 nt, Salmonella enterica enterica serovar Typhi
gcggucgguuuucuucgac

SEQ ID NO: 1652473 - RNA, 19 nt, Salmonella enterica enterica serovar Typhi
gcggucgacagccacacgc

SEQ ID NO: 1652474 - RNA, 15 nt, Salmonella enterica enterica serovar Typhi
gcggucaucgcccau

SEQ ID NO: 1652475 - RNA, 12 nt, Salmonella enterica enterica serovar Typhi
gcggucaggcca

SEQ ID NO: 1652476 - RNA, 21 nt, Salmonella enterica enterica serovar Typhi
gcggucagggugaaucccgcc

SEQ ID NO: 1652477 - RNA, 19 nt, Salmonella enterica enterica serovar Typhi
gcgguccaauaaacgccag

SEQ ID NO: 1652478 - RNA, 23 nt, Salmonella enterica enterica serovar Typhi
gcggugucgauacgauugcgcgu

SEQ ID NO: 1652479 - RNA, 21 nt, Salmonella enterica enterica serovar Typhi
gcguaagguauuuagccguuc

SEQ ID NO: 1652480 - RNA, 14 nt, Salmonella enterica enterica serovar Typhi
gcguaaucuuccac

SEQ ID NO: 1652481 - RNA, 19 nt, Salmonella enterica enterica serovar Typhi
gcggugaggcugacguuac

SEQ ID NO: 1652482 - RNA, 18 nt, Salmonella enterica enterica serovar Typhi
gcuccugcuccugcggcg

SEQ ID NO: 1652483 - RNA, 23 nt, Salmonella enterica enterica serovar Typhi
gcuaaucaccaccucaaacgaug

SEQ ID NO: 1652484 - RNA, 16 nt, Salmonella enterica enterica serovar Typhi
gcuaauccccagcgcu

SEQ ID NO: 1652485 - RNA, 21 nt, Salmonella enterica enterica serovar Typhi
gcuaaugcccggcgcggcauc

SEQ ID NO: 1652486 - RNA, 22 nt, Salmonella enterica enterica serovar Typhi
gcuaauuaaucugucgaugcgg

SEQ ID NO: 1652487 - RNA, 20 nt, Salmonella enterica enterica serovar Typhi
gcuaaugcuuauccggccua

SEQ ID NO: 1652488 - RNA, 13 nt, Salmonella enterica enterica serovar Typhi
gcuacacgcgaau

SEQ ID NO: 1652489 - RNA, 17 nt, Salmonella enterica enterica serovar Typhi
gcuccccaaccgccagc

SEQ ID NO: 1652490 - RNA, 20 nt, Salmonella enterica enterica serovar Typhi
gcuaccacagaaaucgccgg

SEQ ID NO: 1652491 - RNA, 15 nt, Salmonella enterica enterica serovar Typhi
gcucgcaccguaggc

SEQ ID NO: 1652492 - RNA, 16 nt, Salmonella enterica enterica serovar Typhi
gcucgcccaucacuac

SEQ ID NO: 1652493 - RNA, 21 nt, Salmonella enterica enterica serovar Typhi
gcucgcccagcacuaacagca

SEQ ID NO: 1652494 - RNA, 21 nt, Salmonella enterica enterica serovar Typhi
gcucgcgacgcagacccgcaa

SEQ ID NO: 1652495 - RNA, 21 nt, Salmonella enterica enterica serovar Typhi
gcucgcuguagcgccaaccgg

SEQ ID NO: 1652496 - RNA, 21 nt, Salmonella enterica enterica serovar Typhi
gcucgcggaagcgaccggcgu

SEQ ID NO: 1652497 - RNA, 14 nt, Salmonella enterica enterica serovar Typhi
gcucgucggcggaa

SEQ ID NO: 1652498 - RNA, 16 nt, Salmonella enterica enterica serovar Typhi
gcugaccgaaccgcug

SEQ ID NO: 1652499 - RNA, 19 nt, Salmonella enterica enterica serovar Typhi
gcugaccaacgucagcauc

SEQ ID NO: 1652500 - RNA, 12 nt, Salmonella enterica enterica serovar Typhi
gcugacagcauc

SEQ ID NO: 1652501 - RNA, 19 nt, Salmonella enterica enterica serovar Typhi
gcugacaaagguugcgcca

SEQ ID NO: 1652502 - RNA, 18 nt, Salmonella enterica enterica serovar Typhi
gcugacaaucugcuggaa

SEQ ID NO: 1652503 - RNA, 18 nt, Salmonella enterica enterica serovar Typhi
gcugaaugcuucgccacg

SEQ ID NO: 1652504 - RNA, 22 nt, Salmonella enterica enterica serovar Typhi
gcucucgccgcgcuccaucaua

SEQ ID NO: 1652505 - RNA, 20 nt, Salmonella enterica enterica serovar Typhi
gcugcaauagcagaucgcgc

SEQ ID NO: 1652506 - RNA, 19 nt, Salmonella enterica enterica serovar Typhi
gcugcacaaaauacuguuu

SEQ ID NO: 1652507 - RNA, 14 nt, Salmonella enterica enterica serovar Typhi
gcugauacgcacca

SEQ ID NO: 1652508 - RNA, 22 nt, Salmonella enterica enterica serovar Typhi
gcugauacuuauuacgguauca

SEQ ID NO: 1652509 - RNA, 15 nt, Salmonella enterica enterica serovar Typhi
gcugaucaaugcgca

SEQ ID NO: 1652510 - RNA, 16 nt, Salmonella enterica enterica serovar Typhi
gcugaucaaugcgcaa

SEQ ID NO: 1652511 - RNA, 22 nt, Salmonella enterica enterica serovar Typhi
gcugaucuaacgaaaccggcgg

SEQ ID NO: 1652512 - RNA, 13 nt, Salmonella enterica enterica serovar Typhi
gcugaugacgcgc

SEQ ID NO: 1652513 - RNA, 21 nt, Salmonella enterica enterica serovar Typhi
gcugaccgcuuucccggcaug

SEQ ID NO: 1652514 - RNA, 14 nt, Salmonella enterica enterica serovar Typhi
gcugccugccggau

SEQ ID NO: 1652515 - RNA, 18 nt, Salmonella enterica enterica serovar Typhi
gcugccgucccagcggau

SEQ ID NO: 1652516 - RNA, 18 nt, Salmonella enterica enterica serovar Typhi
gcugccagcugcgucagc

SEQ ID NO: 1652517 - RNA, 17 nt, Salmonella enterica enterica serovar Typhi
gcugcgccuuauccggc

SEQ ID NO: 1652518 - RNA, 18 nt, Salmonella enterica enterica serovar Typhi
gcugcgccuuauccggcg

SEQ ID NO: 1652519 - RNA, 19 nt, Salmonella enterica enterica serovar Typhi
gcugcgcaggggcuauuga

SEQ ID NO: 1652520 - RNA, 21 nt, Salmonella enterica enterica serovar Typhi
gcugcgccauauccucgcugg

SEQ ID NO: 1652521 - RNA, 13 nt, Salmonella enterica enterica serovar Typhi
gcugcgccagcgc

SEQ ID NO: 1652522 - RNA, 17 nt, Salmonella enterica enterica serovar Typhi
gcugcgcuucugauuau

SEQ ID NO: 1652523 - RNA, 17 nt, Salmonella enterica enterica serovar Typhi
gcugcgcuuauccgcuc

SEQ ID NO: 1652524 - RNA, 24 nt, Salmonella enterica enterica serovar Typhi
gcugcggacauuaacgccgcguuc

SEQ ID NO: 1652525 - RNA, 21 nt, Salmonella enterica enterica serovar Typhi
gcugcuauguaaaauccggca

SEQ ID NO: 1652526 - RNA, 14 nt, Salmonella enterica enterica serovar Typhi
ggagaacggcacaa

SEQ ID NO: 1652527 - RNA, 13 nt, Salmonella enterica enterica serovar Typhi
ggacugauacagc

SEQ ID NO: 1652528 - RNA, 12 nt, Salmonella enterica enterica serovar Typhi
ggacucaggccu

SEQ ID NO: 1652529 - RNA, 17 nt, Salmonella enterica enterica serovar Typhi
ggacgucaugccgccac

SEQ ID NO: 1652530 - RNA, 18 nt, Salmonella enterica enterica serovar Typhi
ggacgcuccaucacggua

SEQ ID NO: 1652531 - RNA, 13 nt, Salmonella enterica enterica serovar Typhi
ggaauauccgcgc

SEQ ID NO: 1652532 - RNA, 15 nt, Salmonella enterica enterica serovar Typhi
ggaauaucgcggaaa

SEQ ID NO: 1652533 - RNA, 23 nt, Salmonella enterica enterica serovar Typhi
ggaauauucgcuucuucggcagc

SEQ ID NO: 1652534 - RNA, 19 nt, Salmonella enterica enterica serovar Typhi
ggacgcaagagcguccagu

SEQ ID NO: 1652535 - RNA, 15 nt, Salmonella enterica enterica serovar Typhi
ggacgcaucaucuca

SEQ ID NO: 1652536 - RNA, 14 nt, Salmonella enterica enterica serovar Typhi
ggaauaaacgguaa

SEQ ID NO: 1652537 - RNA, 14 nt, Salmonella enterica enterica serovar Typhi
ggaauacauuaacg

SEQ ID NO: 1652538 - RNA, 13 nt, Salmonella enterica enterica serovar Typhi
ggaauaccgucaa

SEQ ID NO: 1652539 - RNA, 15 nt, Salmonella enterica enterica serovar Typhi
ggaagcugcgcagca

SEQ ID NO: 1652540 - RNA, 22 nt, Salmonella enterica enterica serovar Typhi
ggaagucggaaaucuguuccag

SEQ ID NO: 1652541 - RNA, 20 nt, Salmonella enterica enterica serovar Typhi
ggaagcgacgacacggcgca

SEQ ID NO: 1652542 - RNA, 18 nt, Salmonella enterica enterica serovar Typhi
ggaagcgaccggcgucau

SEQ ID NO: 1652543 - RNA, 18 nt, Salmonella enterica enterica serovar Typhi
ggaagauguugccguaac

SEQ ID NO: 1652544 - RNA, 18 nt, Salmonella enterica enterica serovar Typhi
ggaagacuauccagccag

SEQ ID NO: 1652545 - RNA, 22 nt, Salmonella enterica enterica serovar Typhi
ggaacaccagucgaccgcagac

SEQ ID NO: 1652546 - RNA, 21 nt, Salmonella enterica enterica serovar Typhi
ggaaauggcgaacagcccgcu

SEQ ID NO: 1652547 - RNA, 22 nt, Salmonella enterica enterica serovar Typhi
ggaaagucuuaccuguauuaug

SEQ ID NO: 1652548 - RNA, 23 nt, Salmonella enterica enterica serovar Typhi
ggaaaucaaaccaucccagguua

SEQ ID NO: 1652549 - RNA, 15 nt, Salmonella enterica enterica serovar Typhi
ggaacagggccgcau

SEQ ID NO: 1652550 - RNA, 20 nt, Salmonella enterica enterica serovar Typhi
ggaacaucagccagcagcuc

SEQ ID NO: 1652551 - RNA, 16 nt, Salmonella enterica enterica serovar Typhi
ggaacugggugccgug

SEQ ID NO: 1652552 - RNA, 19 nt, Salmonella enterica enterica serovar Typhi
ggaacuggcagcagugaca

SEQ ID NO: 1652553 - RNA, 17 nt, Salmonella enterica enterica serovar Typhi
gcuuucuucuucacgac

SEQ ID NO: 1652554 - RNA, 23 nt, Salmonella enterica enterica serovar Typhi
gcuuuacgaccgcagaaacagau

SEQ ID NO: 1652555 - RNA, 13 nt, Salmonella enterica enterica serovar Typhi
gcuuuaagcgcug

SEQ ID NO: 1652556 - RNA, 19 nt, Salmonella enterica enterica serovar Typhi
gcuucuuaaaauagccauc

SEQ ID NO: 1652557 - RNA, 22 nt, Salmonella enterica enterica serovar Typhi
gcuucuucacuaauuugaugcc

SEQ ID NO: 1652558 - RNA, 19 nt, Salmonella enterica enterica serovar Typhi
gcuucuucuuuagauaauu

SEQ ID NO: 1652559 - RNA, 16 nt, Salmonella enterica enterica serovar Typhi
gcuucuuguucacgug

SEQ ID NO: 1652560 - RNA, 19 nt, Salmonella enterica enterica serovar Typhi
gcuuguucuuuucaauaaa

SEQ ID NO: 1652561 - RNA, 14 nt, Salmonella enterica enterica serovar Typhi
ggaaagggacgaug

SEQ ID NO: 1652562 - RNA, 16 nt, Salmonella enterica enterica serovar Typhi
ggaaacuccagcggca

SEQ ID NO: 1652563 - RNA, 17 nt, Salmonella enterica enterica serovar Typhi
ggaaagcauucgcagca

SEQ ID NO: 1652564 - RNA, 13 nt, Salmonella enterica enterica serovar Typhi
ggaaaccgcagaa

SEQ ID NO: 1652565 - RNA, 11 nt, Salmonella enterica enterica serovar Typhi
gcuuugagcgu

SEQ ID NO: 1652566 - RNA, 18 nt, Salmonella enterica enterica serovar Typhi
gcuuugcuuauccggccu

SEQ ID NO: 1652567 - RNA, 23 nt, Salmonella enterica enterica serovar Typhi
gcuuugauguccggcgcguucau

SEQ ID NO: 1652568 - RNA, 18 nt, Salmonella enterica enterica serovar Typhi
gcuuuggcaaacggcgcc

SEQ ID NO: 1652569 - RNA, 18 nt, Salmonella enterica enterica serovar Typhi
ggaaaauauucagcacau

SEQ ID NO: 1652570 - RNA, 18 nt, Salmonella enterica enterica serovar Typhi
gcuguuacugucggcgau

SEQ ID NO: 1652571 - RNA, 20 nt, Salmonella enterica enterica serovar Typhi
gcuguucaaucacugaugcc

SEQ ID NO: 1652572 - RNA, 16 nt, Salmonella enterica enterica serovar Typhi
gcugugguuuauccgc

SEQ ID NO: 1652573 - RNA, 21 nt, Salmonella enterica enterica serovar Typhi
gcuguuaauuugcaucaggcc

SEQ ID NO: 1652574 - RNA, 20 nt, Salmonella enterica enterica serovar Typhi
gcuguggauuuauggcguca

SEQ ID NO: 1652575 - RNA, 23 nt, Salmonella enterica enterica serovar Typhi
gcuguaauuaaggauugccgccu

SEQ ID NO: 1652576 - RNA, 15 nt, Salmonella enterica enterica serovar Typhi
gcuguaaaccggccc

SEQ ID NO: 1652577 - RNA, 19 nt, Salmonella enterica enterica serovar Typhi
gcuguaacccgccgccauc

SEQ ID NO: 1652578 - RNA, 16 nt, Salmonella enterica enterica serovar Typhi
gcuggucagcgcgcca

SEQ ID NO: 1652579 - RNA, 22 nt, Salmonella enterica enterica serovar Typhi
gcugguuaauaauuuuacccgc

SEQ ID NO: 1652580 - RNA, 22 nt, Salmonella enterica enterica serovar Typhi
gcugguuccccgugcccggcau

SEQ ID NO: 1652581 - RNA, 19 nt, Salmonella enterica enterica serovar Typhi
gcugguuaacgccgccauc

SEQ ID NO: 1652582 - RNA, 12 nt, Salmonella enterica enterica serovar Typhi
gcuggcggcaag

SEQ ID NO: 1652583 - RNA, 17 nt, Salmonella enterica enterica serovar Typhi
gcuggguuaacgcgcca

SEQ ID NO: 1652584 - RNA, 22 nt, Salmonella enterica enterica serovar Typhi
gcuggucaacacgcggucguca

SEQ ID NO: 1652585 - RNA, 22 nt, Salmonella enterica enterica serovar Typhi
gcugguauaggccaggcuauag

SEQ ID NO: 1652586 - RNA, 9 nt, Salmonella enterica enterica serovar Typhi
gcuggcugu

SEQ ID NO: 1652587 - RNA, 13 nt, Salmonella enterica enterica serovar Typhi
gcuuacaggcacg

SEQ ID NO: 1652588 - RNA, 14 nt, Salmonella enterica enterica serovar Typhi
gcuuaccagaccgg

SEQ ID NO: 1652589 - RNA, 14 nt, Salmonella enterica enterica serovar Typhi
gcuuaccaggccua

SEQ ID NO: 1652590 - RNA, 17 nt, Salmonella enterica enterica serovar Typhi
gcuuaccgggccuacag

SEQ ID NO: 1652591 - RNA, 20 nt, Salmonella enterica enterica serovar Typhi
gcuuaauaauaagcggccua

SEQ ID NO: 1652592 - RNA, 21 nt, Salmonella enterica enterica serovar Typhi
gcuuaauaauaagcggccuau

SEQ ID NO: 1652593 - RNA, 21 nt, Salmonella enterica enterica serovar Typhi
gcuuaaugcucugcugugcca

SEQ ID NO: 1652594 - RNA, 18 nt, Salmonella enterica enterica serovar Typhi
gcuuaaagccaauccaga

SEQ ID NO: 1652595 - RNA, 19 nt, Salmonella enterica enterica serovar Typhi
gcuuaaaucgcggcgcuga

SEQ ID NO: 1652596 - RNA, 19 nt, Salmonella enterica enterica serovar Typhi
gcuuaacggcccaggcauc

SEQ ID NO: 1652597 - RNA, 16 nt, Salmonella enterica enterica serovar Typhi
gcuguuuuucaucauc

SEQ ID NO: 1652598 - RNA, 16 nt, Salmonella enterica enterica serovar Typhi
gcuuaaaagcggcaag

SEQ ID NO: 1652599 - RNA, 17 nt, Salmonella enterica enterica serovar Typhi
gcuuaucaggccuacgc

SEQ ID NO: 1652600 - RNA, 23 nt, Salmonella enterica enterica serovar Typhi
gcuuaucaggccuacauccggcu

SEQ ID NO: 1652601 - RNA, 17 nt, Salmonella enterica enterica serovar Typhi
gcuuaucaggccuacau

SEQ ID NO: 1652602 - RNA, 14 nt, Salmonella enterica enterica serovar Typhi
gcuuaucaggccua

SEQ ID NO: 1652603 - RNA, 18 nt, Salmonella enterica enterica serovar Typhi
gcuuauccggccugcaca

SEQ ID NO: 1652604 - RNA, 15 nt, Salmonella enterica enterica serovar Typhi
gcuuaucgauaucug

SEQ ID NO: 1652605 - RNA, 12 nt, Salmonella enterica enterica serovar Typhi
gcuuauccggcc

SEQ ID NO: 1652606 - RNA, 15 nt, Salmonella enterica enterica serovar Typhi
gcuuauccggccuac

SEQ ID NO: 1652607 - RNA, 17 nt, Salmonella enterica enterica serovar Typhi
gcuuauccggccuacag

SEQ ID NO: 1652608 - RNA, 16 nt, Salmonella enterica enterica serovar Typhi
gcuuauccggccuacg

SEQ ID NO: 1652609 - RNA, 17 nt, Salmonella enterica enterica serovar Typhi
gcuuauccggccuacga

SEQ ID NO: 1652610 - RNA, 17 nt, Salmonella enterica enterica serovar Typhi
gcuuauccggccuacgg

SEQ ID NO: 1652611 - RNA, 19 nt, Salmonella enterica enterica serovar Typhi
gcuucaauaagaaacugcu

SEQ ID NO: 1652612 - RNA, 14 nt, Salmonella enterica enterica serovar Typhi
gcuucaccgccaga

SEQ ID NO: 1652613 - RNA, 17 nt, Salmonella enterica enterica serovar Typhi
gcuucacguuuuccagg

SEQ ID NO: 1652614 - RNA, 21 nt, Salmonella enterica enterica serovar Typhi
gcuuccagaauucguacguuu

SEQ ID NO: 1652615 - RNA, 16 nt, Salmonella enterica enterica serovar Typhi
gcuucgguccggcgcu

SEQ ID NO: 1652616 - RNA, 18 nt, Salmonella enterica enterica serovar Typhi
gcuucggacuccugacgc

SEQ ID NO: 1652617 - RNA, 20 nt, Salmonella enterica enterica serovar Typhi
gcuucguggcaaucagcaau

SEQ ID NO: 1652618 - RNA, 16 nt, Salmonella enterica enterica serovar Typhi
gcuucguucuguauca

SEQ ID NO: 1652619 - RNA, 22 nt, Salmonella enterica enterica serovar Typhi
gcuucgucgagcagugauucgc

SEQ ID NO: 1652620 - RNA, 17 nt, Salmonella enterica enterica serovar Typhi
gcuucguuucagauaac

SEQ ID NO: 1652621 - RNA, 19 nt, Salmonella enterica enterica serovar Typhi
gcuucgucaggcggcugcg

SEQ ID NO: 1652622 - RNA, 13 nt, Salmonella enterica enterica serovar Typhi
gcuucuauccacu

SEQ ID NO: 1652623 - RNA, 20 nt, Salmonella enterica enterica serovar Typhi
gcuucgauuuuguuaugcgc

SEQ ID NO: 1652624 - RNA, 23 nt, Salmonella enterica enterica serovar Typhi
gcuuccguuuuguugccgcccgu

SEQ ID NO: 1652625 - RNA, 15 nt, Salmonella enterica enterica serovar Typhi
gcuuccgaccgcagc

SEQ ID NO: 1652626 - RNA, 19 nt, Salmonella enterica enterica serovar Typhi
gcuucccacagucggcgaa

SEQ ID NO: 1652627 - RNA, 15 nt, Salmonella enterica enterica serovar Typhi
uggugcguccgguag

SEQ ID NO: 1652628 - RNA, 13 nt, Salmonella enterica enterica serovar Typhi
ugguuugacgcug

SEQ ID NO: 1652629 - RNA, 19 nt, Salmonella enterica enterica serovar Typhi
ugguuucccugaccaguug

SEQ ID NO: 1652630 - RNA, 19 nt, Salmonella enterica enterica serovar Typhi
ugguuucuagucgccggua

SEQ ID NO: 1652631 - RNA, 14 nt, Salmonella enterica enterica serovar Typhi
ugguuucgcgguga

SEQ ID NO: 1652632 - RNA, 13 nt, Salmonella enterica enterica serovar Typhi
ugguugccgcaua

SEQ ID NO: 1652633 - RNA, 20 nt, Salmonella enterica enterica serovar Typhi
uguaccggcaggugauggcg

SEQ ID NO: 1652634 - RNA, 18 nt, Salmonella enterica enterica serovar Typhi
uguacguaaaaccagcuc

SEQ ID NO: 1652635 - RNA, 18 nt, Salmonella enterica enterica serovar Typhi
uguacggacauugaccgc

SEQ ID NO: 1652636 - RNA, 16 nt, Salmonella enterica enterica serovar Typhi
uguacgaccgucaaac

SEQ ID NO: 1652637 - RNA, 16 nt, Salmonella enterica enterica serovar Typhi
uguaggcacuuuccag

SEQ ID NO: 1652638 - RNA, 20 nt, Salmonella enterica enterica serovar Typhi
uguaggcccgguaagcgcag

SEQ ID NO: 1652639 - RNA, 16 nt, Salmonella enterica enterica serovar Typhi
uguagugcgauaugug

SEQ ID NO: 1652640 - RNA, 23 nt, Salmonella enterica enterica serovar Typhi
aaucaccuuuacuuaauucugcu

SEQ ID NO: 1652641 - RNA, 21 nt, Salmonella enterica enterica serovar Typhi
uguaggcccgguaagcgcuag

SEQ ID NO: 1652642 - RNA, 13 nt, Salmonella enterica enterica serovar Typhi
uguaggccggaua

SEQ ID NO: 1652643 - RNA, 20 nt, Salmonella enterica enterica serovar Typhi
uguaggccggauaagcauua

SEQ ID NO: 1652644 - RNA, 22 nt, Salmonella enterica enterica serovar Typhi
aaucaccuuacgcucgcugaug

SEQ ID NO: 1652645 - RNA, 23 nt, Salmonella enterica enterica serovar Typhi
ugggcgucaucgggcuguuauuc

SEQ ID NO: 1652646 - RNA, 21 nt, Salmonella enterica enterica serovar Typhi
aauauugccauaaauacaauu

SEQ ID NO: 1652647 - RNA, 20 nt, Salmonella enterica enterica serovar Typhi
aauaugcuguuuauggcgcu

SEQ ID NO: 1652648 - RNA, 16 nt, Salmonella enterica enterica serovar Typhi
aauauuaucgccauca

SEQ ID NO: 1652649 - RNA, 18 nt, Salmonella enterica enterica serovar Typhi
uggcuaacccgcugcgcc

SEQ ID NO: 1652650 - RNA, 17 nt, Salmonella enterica enterica serovar Typhi
aauaucgagcggcagua

SEQ ID NO: 1652651 - RNA, 17 nt, Salmonella enterica enterica serovar Typhi
uggcgucgccaaagcag

SEQ ID NO: 1652652 - RNA, 16 nt, Salmonella enterica enterica serovar Typhi
uggcgucagaccggca

SEQ ID NO: 1652653 - RNA, 23 nt, Salmonella enterica enterica serovar Typhi
uggcgguauaacugccuuauccg

SEQ ID NO: 1652654 - RNA, 15 nt, Salmonella enterica enterica serovar Typhi
uggcgguaaucgcgc

SEQ ID NO: 1652655 - RNA, 15 nt, Salmonella enterica enterica serovar Typhi
uggcgggcuuauccc

SEQ ID NO: 1652656 - RNA, 18 nt, Salmonella enterica enterica serovar Typhi
uggcgguaaauacgcggc

SEQ ID NO: 1652657 - RNA, 12 nt, Salmonella enterica enterica serovar Typhi
uggcgcugcgcu

SEQ ID NO: 1652658 - RNA, 20 nt, Salmonella enterica enterica serovar Typhi
uggcgcugcgcuuaccgggc

SEQ ID NO: 1652659 - RNA, 16 nt, Salmonella enterica enterica serovar Typhi
uggcgcuaagacguga

SEQ ID NO: 1652660 - RNA, 21 nt, Salmonella enterica enterica serovar Typhi
uggcgccuuuuggcagcagcg

SEQ ID NO: 1652661 - RNA, 20 nt, Salmonella enterica enterica serovar Typhi
uggcgcgaagugccagguuu

SEQ ID NO: 1652662 - RNA, 17 nt, Salmonella enterica enterica serovar Typhi
uggcgcgaugacucgua

SEQ ID NO: 1652663 - RNA, 18 nt, Salmonella enterica enterica serovar Typhi
uggcgcacaucgugcgcc

SEQ ID NO: 1652664 - RNA, 22 nt, Salmonella enterica enterica serovar Typhi
uggcgaauccuaaacucaacug

SEQ ID NO: 1652665 - RNA, 22 nt, Salmonella enterica enterica serovar Typhi
uggcgaauacuguuccaggcga

SEQ ID NO: 1652666 - RNA, 20 nt, Salmonella enterica enterica serovar Typhi
uggcgauaaaaauauccgcc

SEQ ID NO: 1652667 - RNA, 22 nt, Salmonella enterica enterica serovar Typhi
uggcgaggaacaucagccagca

SEQ ID NO: 1652668 - RNA, 21 nt, Salmonella enterica enterica serovar Typhi
uggcccgauacgcggaucggc

SEQ ID NO: 1652669 - RNA, 21 nt, Salmonella enterica enterica serovar Typhi
uggccauuaucgaucugagcg

SEQ ID NO: 1652670 - RNA, 19 nt, Salmonella enterica enterica serovar Typhi
uggccgcgcaaggcguuca

SEQ ID NO: 1652671 - RNA, 16 nt, Salmonella enterica enterica serovar Typhi
uggccagaaugaucgc

SEQ ID NO: 1652672 - RNA, 24 nt, Salmonella enterica enterica serovar Typhi
uggccauagacuuuggcgcaguca

SEQ ID NO: 1652673 - RNA, 14 nt, Salmonella enterica enterica serovar Typhi
uggccaucuuccag

SEQ ID NO: 1652674 - RNA, 12 nt, Salmonella enterica enterica serovar Typhi
uggccaggcuuu

SEQ ID NO: 1652675 - RNA, 15 nt, Salmonella enterica enterica serovar Typhi
uggccacaucguuac

SEQ ID NO: 1652676 - RNA, 22 nt, Salmonella enterica enterica serovar Typhi
uggaauuugucgucaugcgcca

SEQ ID NO: 1652677 - RNA, 23 nt, Salmonella enterica enterica serovar Typhi
uggacaaaaaaggaaaaugacgc

SEQ ID NO: 1652678 - RNA, 17 nt, Salmonella enterica enterica serovar Typhi
uggcauuuugcggcgug

SEQ ID NO: 1652679 - RNA, 20 nt, Salmonella enterica enterica serovar Typhi
ugccgucguacucaccaguc

SEQ ID NO: 1652680 - RNA, 15 nt, Salmonella enterica enterica serovar Typhi
aauagcauuaagcug

SEQ ID NO: 1652681 - RNA, 18 nt, Salmonella enterica enterica serovar Typhi
ugccgguuuuugaaccau

SEQ ID NO: 1652682 - RNA, 12 nt, Salmonella enterica enterica serovar Typhi
ugccggcguucc

SEQ ID NO: 1652683 - RNA, 13 nt, Salmonella enterica enterica serovar Typhi
ugccggcuuacca

SEQ ID NO: 1652684 - RNA, 21 nt, Salmonella enterica enterica serovar Typhi
ugccggccugauauccacguu

SEQ ID NO: 1652685 - RNA, 17 nt, Salmonella enterica enterica serovar Typhi
ugccggauggcggcgug

SEQ ID NO: 1652686 - RNA, 13 nt, Salmonella enterica enterica serovar Typhi
ugccggauggcgu

SEQ ID NO: 1652687 - RNA, 20 nt, Salmonella enterica enterica serovar Typhi
ugccggaaaucgcggcgaug

SEQ ID NO: 1652688 - RNA, 14 nt, Salmonella enterica enterica serovar Typhi
ugccggacgccacc

SEQ ID NO: 1652689 - RNA, 17 nt, Salmonella enterica enterica serovar Typhi
ugccggauaagcguagc

SEQ ID NO: 1652690 - RNA, 18 nt, Salmonella enterica enterica serovar Typhi
ugccgcugaccgccggaa

SEQ ID NO: 1652691 - RNA, 15 nt, Salmonella enterica enterica serovar Typhi
ugcgaagaccgcauc

SEQ ID NO: 1652692 - RNA, 13 nt, Salmonella enterica enterica serovar Typhi
ugcgaaaagccgg

SEQ ID NO: 1652693 - RNA, 14 nt, Salmonella enterica enterica serovar Typhi
ugccuuuacuguug

SEQ ID NO: 1652694 - RNA, 18 nt, Salmonella enterica enterica serovar Typhi
ugccuucgccgccgcuga

SEQ ID NO: 1652695 - RNA, 22 nt, Salmonella enterica enterica serovar Typhi
ugccuguguucguggacgagca

SEQ ID NO: 1652696 - RNA, 15 nt, Salmonella enterica enterica serovar Typhi
aauagcuggcugucu

SEQ ID NO: 1652697 - RNA, 15 nt, Salmonella enterica enterica serovar Typhi
aauauaaccaauuua

SEQ ID NO: 1652698 - RNA, 13 nt, Salmonella enterica enterica serovar Typhi
ugcgccagcgccg

SEQ ID NO: 1652699 - RNA, 15 nt, Salmonella enterica enterica serovar Typhi
ugcgccagccagcuc

SEQ ID NO: 1652700 - RNA, 19 nt, Salmonella enterica enterica serovar Typhi
ugcgccagaauugccugau

SEQ ID NO: 1652701 - RNA, 21 nt, Salmonella enterica enterica serovar Typhi
ugcgccggcugcgcugccagc

SEQ ID NO: 1652702 - RNA, 11 nt, Salmonella enterica enterica serovar Typhi
ugcgccauccg

SEQ ID NO: 1652703 - RNA, 20 nt, Salmonella enterica enterica serovar Typhi
ugcgccauucuuucgcguaa

SEQ ID NO: 1652704 - RNA, 19 nt, Salmonella enterica enterica serovar Typhi
ugcguaaaauauacagccu

SEQ ID NO: 1652705 - RNA, 17 nt, Salmonella enterica enterica serovar Typhi
ugcgguuaaaccaggcg

SEQ ID NO: 1652706 - RNA, 17 nt, Salmonella enterica enterica serovar Typhi
ugcguaauccggccugg

SEQ ID NO: 1652707 - RNA, 17 nt, Salmonella enterica enterica serovar Typhi
ugcgucgcguaccagcg

SEQ ID NO: 1652708 - RNA, 20 nt, Salmonella enterica enterica serovar Typhi
ugcgucgcgcuuucaaucgu

SEQ ID NO: 1652709 - RNA, 15 nt, Salmonella enterica enterica serovar Typhi
ugcgugaaucccguu

SEQ ID NO: 1652710 - RNA, 18 nt, Salmonella enterica enterica serovar Typhi
ugcgguggcaacgcuggc

SEQ ID NO: 1652711 - RNA, 22 nt, Salmonella enterica enterica serovar Typhi
ugcgggaguggcgaaauuggua

SEQ ID NO: 1652712 - RNA, 19 nt, Salmonella enterica enterica serovar Typhi
ugcgguaguccgccagcac

SEQ ID NO: 1652713 - RNA, 19 nt, Salmonella enterica enterica serovar Typhi
ugcgguagagaacagcauc

SEQ ID NO: 1652714 - RNA, 13 nt, Salmonella enterica enterica serovar Typhi
ugcgguaccgcgu

SEQ ID NO: 1652715 - RNA, 15 nt, Salmonella enterica enterica serovar Typhi
ugcgcuuccagcaug

SEQ ID NO: 1652716 - RNA, 19 nt, Salmonella enterica enterica serovar Typhi
ugcgcuuaucaggccuacg

SEQ ID NO: 1652717 - RNA, 16 nt, Salmonella enterica enterica serovar Typhi
ugcgcuucggccacgg

SEQ ID NO: 1652718 - RNA, 19 nt, Salmonella enterica enterica serovar Typhi
ugcgccgugccuggcgcug

SEQ ID NO: 1652719 - RNA, 18 nt, Salmonella enterica enterica serovar Typhi
ugcgcuuuuagccaguug

SEQ ID NO: 1652720 - RNA, 20 nt, Salmonella enterica enterica serovar Typhi
ugcgcuuuaugcccuucgac

SEQ ID NO: 1652721 - RNA, 13 nt, Salmonella enterica enterica serovar Typhi
ugcggauucagga

SEQ ID NO: 1652722 - RNA, 17 nt, Salmonella enterica enterica serovar Typhi
ugcggauuacgaauacc

SEQ ID NO: 1652723 - RNA, 20 nt, Salmonella enterica enterica serovar Typhi
ugcggcuuugcgccggcagu

SEQ ID NO: 1652724 - RNA, 20 nt, Salmonella enterica enterica serovar Typhi
ugcuuaccaucuggccuacg

SEQ ID NO: 1652725 - RNA, 13 nt, Salmonella enterica enterica serovar Typhi
ugcuucagccaga

SEQ ID NO: 1652726 - RNA, 12 nt, Salmonella enterica enterica serovar Typhi
ugcuucgcgccu

SEQ ID NO: 1652727 - RNA, 14 nt, Salmonella enterica enterica serovar Typhi
ugcuucaugcacaa

SEQ ID NO: 1652728 - RNA, 22 nt, Salmonella enterica enterica serovar Typhi
ugcuucaugcacaaaacccgca

SEQ ID NO: 1652729 - RNA, 20 nt, Salmonella enterica enterica serovar Typhi
ugcuucacguuuuccaggug

SEQ ID NO: 1652730 - RNA, 18 nt, Salmonella enterica enterica serovar Typhi
ugcugcuuuaaccuggcg

SEQ ID NO: 1652731 - RNA, 12 nt, Salmonella enterica enterica serovar Typhi
ugcugugaagua

SEQ ID NO: 1652732 - RNA, 23 nt, Salmonella enterica enterica serovar Typhi
ugcuuucgagcguaggccugaua

SEQ ID NO: 1652733 - RNA, 17 nt, Salmonella enterica enterica serovar Typhi
ugcuucuugaguuggca

SEQ ID NO: 1652734 - RNA, 13 nt, Salmonella enterica enterica serovar Typhi
uggaaaacagcgc

SEQ ID NO: 1652735 - RNA, 15 nt, Salmonella enterica enterica serovar Typhi
uggaaaaaagcgccc

SEQ ID NO: 1652736 - RNA, 14 nt, Salmonella enterica enterica serovar Typhi
uggaaaugcguggc

SEQ ID NO: 1652737 - RNA, 19 nt, Salmonella enterica enterica serovar Typhi
uggaacaggccaaacccug

SEQ ID NO: 1652738 - RNA, 22 nt, Salmonella enterica enterica serovar Typhi
uggaaccaggcgcgaugcgacu

SEQ ID NO: 1652739 - RNA, 21 nt, Salmonella enterica enterica serovar Typhi
ugcuccagaagaucuaaagcc

SEQ ID NO: 1652740 - RNA, 11 nt, Salmonella enterica enterica serovar Typhi
ugcuccagcgu

SEQ ID NO: 1652741 - RNA, 21 nt, Salmonella enterica enterica serovar Typhi
ugcucaugcgagguauacgcc

SEQ ID NO: 1652742 - RNA, 14 nt, Salmonella enterica enterica serovar Typhi
ugcucccccaguug

SEQ ID NO: 1652743 - RNA, 16 nt, Salmonella enterica enterica serovar Typhi
ugcguuacucgauggc

SEQ ID NO: 1652744 - RNA, 19 nt, Salmonella enterica enterica serovar Typhi
aauauagccguggcuggcg

SEQ ID NO: 1652745 - RNA, 18 nt, Salmonella enterica enterica serovar Typhi
aauaucaaucagcaaggc

SEQ ID NO: 1652746 - RNA, 20 nt, Salmonella enterica enterica serovar Typhi
ugcucauaacggcuacgcag

SEQ ID NO: 1652747 - RNA, 14 nt, Salmonella enterica enterica serovar Typhi
ugcuccgggccaug

SEQ ID NO: 1652748 - RNA, 16 nt, Salmonella enterica enterica serovar Typhi
ugcugcacauucaggu

SEQ ID NO: 1652749 - RNA, 19 nt, Salmonella enterica enterica serovar Typhi
ugcugaucuggcugcguaa

SEQ ID NO: 1652750 - RNA, 20 nt, Salmonella enterica enterica serovar Typhi
ugucuucccugaccagcgac

SEQ ID NO: 1652751 - RNA, 12 nt, Salmonella enterica enterica serovar Typhi
ugugaaacgcga

SEQ ID NO: 1652752 - RNA, 19 nt, Salmonella enterica enterica serovar Typhi
ugugcagcaggacgcgcac

SEQ ID NO: 1652753 - RNA, 21 nt, Salmonella enterica enterica serovar Typhi
ugugaccagcaguuccggcgu

SEQ ID NO: 1652754 - RNA, 21 nt, Salmonella enterica enterica serovar Typhi
ugucagaucguaugcgccugu

SEQ ID NO: 1652755 - RNA, 17 nt, Salmonella enterica enterica serovar Typhi
ugucggguggcgcuagc

SEQ ID NO: 1652756 - RNA, 17 nt, Salmonella enterica enterica serovar Typhi
ugucggucaggcugcgg

SEQ ID NO: 1652757 - RNA, 21 nt, Salmonella enterica enterica serovar Typhi
ugucggucggguaagcgcuag

SEQ ID NO: 1652758 - RNA, 18 nt, Salmonella enterica enterica serovar Typhi
ugugcgccagccuuaucc

SEQ ID NO: 1652759 - RNA, 18 nt, Salmonella enterica enterica serovar Typhi
ugugcuaucaggccuaca

SEQ ID NO: 1652760 - RNA, 15 nt, Salmonella enterica enterica serovar Typhi
uguggcugucgaccg

SEQ ID NO: 1652761 - RNA, 16 nt, Salmonella enterica enterica serovar Typhi
uguuaauuucccgcug

SEQ ID NO: 1652762 - RNA, 19 nt, Salmonella enterica enterica serovar Typhi
uuacgcaagagagcaacau

SEQ ID NO: 1652763 - RNA, 20 nt, Salmonella enterica enterica serovar Typhi
uuacgccauaaaaagcguac

SEQ ID NO: 1652764 - RNA, 16 nt, Salmonella enterica enterica serovar Typhi
uuacgguuggccagca

SEQ ID NO: 1652765 - RNA, 18 nt, Salmonella enterica enterica serovar Typhi
uuacgcuuuauucugucg

SEQ ID NO: 1652766 - RNA, 20 nt, Salmonella enterica enterica serovar Typhi
uuagccggacgagcugcgcg

SEQ ID NO: 1652767 - RNA, 16 nt, Salmonella enterica enterica serovar Typhi
uuagccaaagcgguaa

SEQ ID NO: 1652768 - RNA, 15 nt, Salmonella enterica enterica serovar Typhi
uuagccagauggcug

SEQ ID NO: 1652769 - RNA, 19 nt, Salmonella enterica enterica serovar Typhi
uuagcgaacguccagcggc

SEQ ID NO: 1652770 - RNA, 22 nt, Salmonella enterica enterica serovar Typhi
uuagcaaccagcuaaccuguuc

SEQ ID NO: 1652771 - RNA, 23 nt, Salmonella enterica enterica serovar Typhi
uuagcucaacgcaucgcugcgcu

SEQ ID NO: 1652772 - RNA, 14 nt, Salmonella enterica enterica serovar Typhi
uuaggaaacauaag

SEQ ID NO: 1652773 - RNA, 19 nt, Salmonella enterica enterica serovar Typhi
uuaucaggccuacauccgg

SEQ ID NO: 1652774 - RNA, 21 nt, Salmonella enterica enterica serovar Typhi
uuaucaggccuaccaucgcgc

SEQ ID NO: 1652775 - RNA, 13 nt, Salmonella enterica enterica serovar Typhi
uuauccaguaacg

SEQ ID NO: 1652776 - RNA, 17 nt, Salmonella enterica enterica serovar Typhi
uuauccauguuuguuua

SEQ ID NO: 1652777 - RNA, 21 nt, Salmonella enterica enterica serovar Typhi
uuauaaauuuuuuaacagaag

SEQ ID NO: 1652778 - RNA, 19 nt, Salmonella enterica enterica serovar Typhi
uuaucaauaaccgccagca

SEQ ID NO: 1652779 - RNA, 23 nt, Salmonella enterica enterica serovar Typhi
uuaucaccaaguagacagagaag

SEQ ID NO: 1652780 - RNA, 22 nt, Salmonella enterica enterica serovar Typhi
uuauaacccugucugcgcaacg

SEQ ID NO: 1652781 - RNA, 15 nt, Salmonella enterica enterica serovar Typhi
uuaaugcgacgccca

SEQ ID NO: 1652782 - RNA, 23 nt, Salmonella enterica enterica serovar Typhi
uuaaugcgccccugcaggcgauc

SEQ ID NO: 1652783 - RNA, 13 nt, Salmonella enterica enterica serovar Typhi
uuaaugauuugcu

SEQ ID NO: 1652784 - RNA, 13 nt, Salmonella enterica enterica serovar Typhi
uuaccaaucgcgg

SEQ ID NO: 1652785 - RNA, 19 nt, Salmonella enterica enterica serovar Typhi
uuaccagcaucaauagcag

SEQ ID NO: 1652786 - RNA, 14 nt, Salmonella enterica enterica serovar Typhi
uuaccauuacgcua

SEQ ID NO: 1652787 - RNA, 13 nt, Salmonella enterica enterica serovar Typhi
uuacaggcgcauc

SEQ ID NO: 1652788 - RNA, 15 nt, Salmonella enterica enterica serovar Typhi
uuacaucagauaaac

SEQ ID NO: 1652789 - RNA, 21 nt, Salmonella enterica enterica serovar Typhi
uuaaccgucugcucagaaaua

SEQ ID NO: 1652790 - RNA, 23 nt, Salmonella enterica enterica serovar Typhi
uguucuugcugcugcugauggcc

SEQ ID NO: 1652791 - RNA, 15 nt, Salmonella enterica enterica serovar Typhi
uguugaugucacuca

SEQ ID NO: 1652792 - RNA, 18 nt, Salmonella enterica enterica serovar Typhi
uuaaacagcgaucacgcc

SEQ ID NO: 1652793 - RNA, 14 nt, Salmonella enterica enterica serovar Typhi
uuaaaucagauaac

SEQ ID NO: 1652794 - RNA, 16 nt, Salmonella enterica enterica serovar Typhi
uuaaaugcuugcuuua

SEQ ID NO: 1652795 - RNA, 13 nt, Salmonella enterica enterica serovar Typhi
uuaaaugcgccca

SEQ ID NO: 1652796 - RNA, 19 nt, Salmonella enterica enterica serovar Typhi
uucgucaggcggcugcgca

SEQ ID NO: 1652797 - RNA, 21 nt, Salmonella enterica enterica serovar Typhi
uucgucaggcggcugcgcaug

SEQ ID NO: 1652798 - RNA, 21 nt, Salmonella enterica enterica serovar Typhi
uucgucggggauucgccagcg

SEQ ID NO: 1652799 - RNA, 20 nt, Salmonella enterica enterica serovar Typhi
uucucgcaggccaaacagcg

SEQ ID NO: 1652800 - RNA, 18 nt, Salmonella enterica enterica serovar Typhi
uucucgcccgccagaucg

SEQ ID NO: 1652801 - RNA, 13 nt, Salmonella enterica enterica serovar Typhi
uucucgauaucuu

SEQ ID NO: 1652802 - RNA, 12 nt, Salmonella enterica enterica serovar Typhi
uucuccguuguu

SEQ ID NO: 1652803 - RNA, 14 nt, Salmonella enterica enterica serovar Typhi
uucuccugccagcg

SEQ ID NO: 1652804 - RNA, 14 nt, Salmonella enterica enterica serovar Typhi
uucugcuccagacg

SEQ ID NO: 1652805 - RNA, 16 nt, Salmonella enterica enterica serovar Typhi
uucugcgccagcacau

SEQ ID NO: 1652806 - RNA, 17 nt, Salmonella enterica enterica serovar Typhi
uucucccgccagaugca

SEQ ID NO: 1652807 - RNA, 14 nt, Salmonella enterica enterica serovar Typhi
uucuccagcagacg

SEQ ID NO: 1652808 - RNA, 17 nt, Salmonella enterica enterica serovar Typhi
aaucagccgacggcgau

SEQ ID NO: 1652809 - RNA, 16 nt, Salmonella enterica enterica serovar Typhi
aaucacuuuuaccggc

SEQ ID NO: 1652810 - RNA, 18 nt, Salmonella enterica enterica serovar Typhi
aaucagccacggcaacgc

SEQ ID NO: 1652811 - RNA, 23 nt, Salmonella enterica enterica serovar Typhi
aaucagcacauucagcagcgccc

SEQ ID NO: 1652812 - RNA, 13 nt, Salmonella enterica enterica serovar Typhi
aaucacuuccgcc

SEQ ID NO: 1652813 - RNA, 13 nt, Salmonella enterica enterica serovar Typhi
aaucacguaaucg

SEQ ID NO: 1652814 - RNA, 18 nt, Salmonella enterica enterica serovar Typhi
aaucacugccgccacgcc

SEQ ID NO: 1652815 - RNA, 20 nt, Salmonella enterica enterica serovar Typhi
aaucacguuuugcagcgcca

SEQ ID NO: 1652816 - RNA, 14 nt, Salmonella enterica enterica serovar Typhi
uucgcgguaaucgc

SEQ ID NO: 1652817 - RNA, 18 nt, Salmonella enterica enterica serovar Typhi
uucgcggauaacguucuu

SEQ ID NO: 1652818 - RNA, 12 nt, Salmonella enterica enterica serovar Typhi
uucgcgaucucc

SEQ ID NO: 1652819 - RNA, 20 nt, Salmonella enterica enterica serovar Typhi
uuccgccgucgugccugacg

SEQ ID NO: 1652820 - RNA, 17 nt, Salmonella enterica enterica serovar Typhi
uuccgcuggugcguaac

SEQ ID NO: 1652821 - RNA, 18 nt, Salmonella enterica enterica serovar Typhi
uuccgcuuuuccugccag

SEQ ID NO: 1652822 - RNA, 13 nt, Salmonella enterica enterica serovar Typhi
uucgcccagucau

SEQ ID NO: 1652823 - RNA, 23 nt, Salmonella enterica enterica serovar Typhi
uucgccagcccgaucaucuccug

SEQ ID NO: 1652824 - RNA, 13 nt, Salmonella enterica enterica serovar Typhi
uucgccagcggau

SEQ ID NO: 1652825 - RNA, 21 nt, Salmonella enterica enterica serovar Typhi
uucgacaauguccgccagacu

SEQ ID NO: 1652826 - RNA, 21 nt, Salmonella enterica enterica serovar Typhi
uucccacagcuucaggcucau

SEQ ID NO: 1652827 - RNA, 14 nt, Salmonella enterica enterica serovar Typhi
uuccgccaccacgc

SEQ ID NO: 1652828 - RNA, 12 nt, Salmonella enterica enterica serovar Typhi
uucccugaccag

SEQ ID NO: 1652829 - RNA, 22 nt, Salmonella enterica enterica serovar Typhi
uucccugaccuuccauccacau

SEQ ID NO: 1652830 - RNA, 21 nt, Salmonella enterica enterica serovar Typhi
uucccugacgcgcagcgauau

SEQ ID NO: 1652831 - RNA, 18 nt, Salmonella enterica enterica serovar Typhi
uuccaguagucgcgccau

SEQ ID NO: 1652832 - RNA, 13 nt, Salmonella enterica enterica serovar Typhi
uuccauucccgcc

SEQ ID NO: 1652833 - RNA, 16 nt, Salmonella enterica enterica serovar Typhi
uuccaucagccaggcg

SEQ ID NO: 1652834 - RNA, 13 nt, Salmonella enterica enterica serovar Typhi
uuccaccgccaau

SEQ ID NO: 1652835 - RNA, 13 nt, Salmonella enterica enterica serovar Typhi
uucauuacaggug

SEQ ID NO: 1652836 - RNA, 17 nt, Salmonella enterica enterica serovar Typhi
uucauuucuuccagcac

SEQ ID NO: 1652837 - RNA, 17 nt, Salmonella enterica enterica serovar Typhi
uuccacuucagcagcag

SEQ ID NO: 1652838 - RNA, 17 nt, Salmonella enterica enterica serovar Typhi
uuccacucuucgggaau

SEQ ID NO: 1652839 - RNA, 16 nt, Salmonella enterica enterica serovar Typhi
uucacuggcaugcgcc

SEQ ID NO: 1652840 - RNA, 18 nt, Salmonella enterica enterica serovar Typhi
uucagcucgcugccgauc

SEQ ID NO: 1652841 - RNA, 20 nt, Salmonella enterica enterica serovar Typhi
uucacgcuauguuugcugag

SEQ ID NO: 1652842 - RNA, 17 nt, Salmonella enterica enterica serovar Typhi
uucacucuuugccgaug

SEQ ID NO: 1652843 - RNA, 17 nt, Salmonella enterica enterica serovar Typhi
uucaccuuucugccagg

SEQ ID NO: 1652844 - RNA, 18 nt, Salmonella enterica enterica serovar Typhi
uucacgaaaccggcgaug

SEQ ID NO: 1652845 - RNA, 21 nt, Salmonella enterica enterica serovar Typhi
uuauccgccagcgcaacgcgc

SEQ ID NO: 1652846 - RNA, 23 nt, Salmonella enterica enterica serovar Typhi
uucaucccugcgacggcuaccug

SEQ ID NO: 1652847 - RNA, 20 nt, Salmonella enterica enterica serovar Typhi
uucauccaugccaagcggca

SEQ ID NO: 1652848 - RNA, 21 nt, Salmonella enterica enterica serovar Typhi
uucaucgcuuuuaccaggaau

SEQ ID NO: 1652849 - RNA, 14 nt, Salmonella enterica enterica serovar Typhi
uucaucgccgcgac

SEQ ID NO: 1652850 - RNA, 17 nt, Salmonella enterica enterica serovar Typhi
uucaucaaaaugcacau

SEQ ID NO: 1652851 - RNA, 13 nt, Salmonella enterica enterica serovar Typhi
uucaucaaauaag

SEQ ID NO: 1652852 - RNA, 15 nt, Salmonella enterica enterica serovar Typhi
uuugcuuauccggcc

SEQ ID NO: 1652853 - RNA, 21 nt, Salmonella enterica enterica serovar Typhi
uuuggcggcaagaucauccgg

SEQ ID NO: 1652854 - RNA, 22 nt, Salmonella enterica enterica serovar Typhi
uuuguauuaacggcgcugcgcu

SEQ ID NO: 1652855 - RNA, 19 nt, Salmonella enterica enterica serovar Typhi
uuugauccguuucagaaag

SEQ ID NO: 1652856 - RNA, 16 nt, Salmonella enterica enterica serovar Typhi
uuugcaggccggauaa

SEQ ID NO: 1652857 - RNA, 21 nt, Salmonella enterica enterica serovar Typhi
uuugcaccaucaacgccggug

SEQ ID NO: 1652858 - RNA, 14 nt, Salmonella enterica enterica serovar Typhi
uuugccauccggcg

SEQ ID NO: 1652859 - RNA, 15 nt, Salmonella enterica enterica serovar Typhi
uuugcccagcgcugg

SEQ ID NO: 1652860 - RNA, 22 nt, Salmonella enterica enterica serovar Typhi
uuugccccagauacgcacggug

SEQ ID NO: 1652861 - RNA, 20 nt, Salmonella enterica enterica serovar Typhi
uuugccgcugucgccagaau

SEQ ID NO: 1652862 - RNA, 21 nt, Salmonella enterica enterica serovar Typhi
uuugccuuuugacagcacaua

SEQ ID NO: 1652863 - RNA, 14 nt, Salmonella enterica enterica serovar Typhi
uuuccagcagccag

SEQ ID NO: 1652864 - RNA, 20 nt, Salmonella enterica enterica serovar Typhi
uuuacccagcgaaugcugca

SEQ ID NO: 1652865 - RNA, 21 nt, Salmonella enterica enterica serovar Typhi
uuuaccggaucgaucccggca

SEQ ID NO: 1652866 - RNA, 15 nt, Salmonella enterica enterica serovar Typhi
uuuaaaacauaucca

SEQ ID NO: 1652867 - RNA, 22 nt, Salmonella enterica enterica serovar Typhi
uuuaaaccaugcgagaucggca

SEQ ID NO: 1652868 - RNA, 14 nt, Salmonella enterica enterica serovar Typhi
uuucuucuuaacac

SEQ ID NO: 1652869 - RNA, 17 nt, Salmonella enterica enterica serovar Typhi
uuucuggcgaugugccc

SEQ ID NO: 1652870 - RNA, 12 nt, Salmonella enterica enterica serovar Typhi
uuucugcugcca

SEQ ID NO: 1652871 - RNA, 18 nt, Salmonella enterica enterica serovar Typhi
uuuccgcuuuuccugcca

SEQ ID NO: 1652872 - RNA, 19 nt, Salmonella enterica enterica serovar Typhi
uuucgcccggcgccagcuc

SEQ ID NO: 1652873 - RNA, 18 nt, Salmonella enterica enterica serovar Typhi
uuucgccgccauccggca

SEQ ID NO: 1652874 - RNA, 14 nt, Salmonella enterica enterica serovar Typhi
uuucgccguccaga

SEQ ID NO: 1652875 - RNA, 13 nt, Salmonella enterica enterica serovar Typhi
aauguagcgcccu

SEQ ID NO: 1652876 - RNA, 15 nt, Salmonella enterica enterica serovar Typhi
aaugguggucgccau

SEQ ID NO: 1652877 - RNA, 13 nt, Salmonella enterica enterica serovar Typhi
aaugguugcguuu

SEQ ID NO: 1652878 - RNA, 23 nt, Salmonella enterica enterica serovar Typhi
aaugguggucgcggccaccgcca

SEQ ID NO: 1652879 - RNA, 17 nt, Salmonella enterica enterica serovar Typhi
aauggcgugaaucaggc

SEQ ID NO: 1652880 - RNA, 20 nt, Salmonella enterica enterica serovar Typhi
aauggcgacgaucagcgcca

SEQ ID NO: 1652881 - RNA, 11 nt, Salmonella enterica enterica serovar Typhi
aauggccuaca

SEQ ID NO: 1652882 - RNA, 17 nt, Salmonella enterica enterica serovar Typhi
aauggccuugccagcga

SEQ ID NO: 1652883 - RNA, 16 nt, Salmonella enterica enterica serovar Typhi
aaugcgccagcggcca

SEQ ID NO: 1652884 - RNA, 15 nt, Salmonella enterica enterica serovar Typhi
aaugcgcgucaggcc

SEQ ID NO: 1652885 - RNA, 21 nt, Salmonella enterica enterica serovar Typhi
aauggauuuuccguuaagcug

SEQ ID NO: 1652886 - RNA, 17 nt, Salmonella enterica enterica serovar Typhi
aauggccgcagcgccau

SEQ ID NO: 1652887 - RNA, 22 nt, Salmonella enterica enterica serovar Typhi
aaugaucgauaucgauaaucaa

SEQ ID NO: 1652888 - RNA, 22 nt, Salmonella enterica enterica serovar Typhi
aaugaugguagacaggcuggcu

SEQ ID NO: 1652889 - RNA, 23 nt, Salmonella enterica enterica serovar Typhi
aaugacgcgcgagaacugcugca

SEQ ID NO: 1652890 - RNA, 12 nt, Salmonella enterica enterica serovar Typhi
aaugagaccaau

SEQ ID NO: 1652891 - RNA, 15 nt, Salmonella enterica enterica serovar Typhi
aaugauaaugccgcu

SEQ ID NO: 1652892 - RNA, 23 nt, Salmonella enterica enterica serovar Typhi
aaucgggaucagaaauucgcagc

SEQ ID NO: 1652893 - RNA, 14 nt, Salmonella enterica enterica serovar Typhi
aaucggccagcgaa

SEQ ID NO: 1652894 - RNA, 17 nt, Salmonella enterica enterica serovar Typhi
aaucgcgaauaaaugag

SEQ ID NO: 1652895 - RNA, 21 nt, Salmonella enterica enterica serovar Typhi
aaucgccucaaccaacggcgc

SEQ ID NO: 1652896 - RNA, 20 nt, Salmonella enterica enterica serovar Typhi
aaucgccuggcuugccggca

SEQ ID NO: 1652897 - RNA, 20 nt, Salmonella enterica enterica serovar Typhi
uuuuagcaauaacucaauag

SEQ ID NO: 1652898 - RNA, 17 nt, Salmonella enterica enterica serovar Typhi
uuuuagcguuucaucgg

SEQ ID NO: 1652899 - RNA, 17 nt, Salmonella enterica enterica serovar Typhi
aaucgguuaugcgauuu

SEQ ID NO: 1652900 - RNA, 19 nt, Salmonella enterica enterica serovar Typhi
aaucguauucauugccgua

SEQ ID NO: 1652901 - RNA, 14 nt, Salmonella enterica enterica serovar Typhi
aaucgucaucagau

SEQ ID NO: 1652902 - RNA, 15 nt, Salmonella enterica enterica serovar Typhi
aaucgucguuccgcc

SEQ ID NO: 1652903 - RNA, 16 nt, Salmonella enterica enterica serovar Typhi
aaucgucucucauccg

SEQ ID NO: 1652904 - RNA, 18 nt, Salmonella enterica enterica serovar Typhi
aaucuaagagccuguccc

SEQ ID NO: 1652905 - RNA, 11 nt, Salmonella enterica enterica serovar Typhi
aaugacgcccu

SEQ ID NO: 1652906 - RNA, 11 nt, Salmonella enterica enterica serovar Typhi
aaugaccacaa

SEQ ID NO: 1652907 - RNA, 15 nt, Salmonella enterica enterica serovar Typhi
aaugaaaacgaaucg

SEQ ID NO: 1652908 - RNA, 13 nt, Salmonella enterica enterica serovar Typhi
aaucuuugccgca

SEQ ID NO: 1652909 - RNA, 13 nt, Salmonella enterica enterica serovar Typhi
uugaugaaccgcu

SEQ ID NO: 1652910 - RNA, 12 nt, Salmonella enterica enterica serovar Typhi
uucuggcgcuga

SEQ ID NO: 1652911 - RNA, 18 nt, Salmonella enterica enterica serovar Typhi
uucuggcauuggcaucug

SEQ ID NO: 1652912 - RNA, 19 nt, Salmonella enterica enterica serovar Typhi
uucuggcauuggcaucugu

SEQ ID NO: 1652913 - RNA, 21 nt, Salmonella enterica enterica serovar Typhi
uucugugauccguaaucgcuu

SEQ ID NO: 1652914 - RNA, 15 nt, Salmonella enterica enterica serovar Typhi
uucuguaauacgcug

SEQ ID NO: 1652915 - RNA, 16 nt, Salmonella enterica enterica serovar Typhi
uucugucagaaaucug

SEQ ID NO: 1652916 - RNA, 15 nt, Salmonella enterica enterica serovar Typhi
uugcagauaccagcg

SEQ ID NO: 1652917 - RNA, 17 nt, Salmonella enterica enterica serovar Typhi
uugcagcgcggccagcg

SEQ ID NO: 1652918 - RNA, 19 nt, Salmonella enterica enterica serovar Typhi
uugcaaaucuuguaggccg

SEQ ID NO: 1652919 - RNA, 21 nt, Salmonella enterica enterica serovar Typhi
uugcauagaucuuugggccgg

SEQ ID NO: 1652920 - RNA, 20 nt, Salmonella enterica enterica serovar Typhi
uugcagcagcgagauggcuu

SEQ ID NO: 1652921 - RNA, 22 nt, Salmonella enterica enterica serovar Typhi
uugcgccauccuuaauugccgc

SEQ ID NO: 1652922 - RNA, 16 nt, Salmonella enterica enterica serovar Typhi
uugcgcauauuccggc

SEQ ID NO: 1652923 - RNA, 18 nt, Salmonella enterica enterica serovar Typhi
uugcgccacuuuuccggc

SEQ ID NO: 1652924 - RNA, 15 nt, Salmonella enterica enterica serovar Typhi
uugcgccacggaugg

SEQ ID NO: 1652925 - RNA, 12 nt, Salmonella enterica enterica serovar Typhi
uugcgccagacc

SEQ ID NO: 1652926 - RNA, 19 nt, Salmonella enterica enterica serovar Typhi
uugcgcaggguaucaucgc

SEQ ID NO: 1652927 - RNA, 12 nt, Salmonella enterica enterica serovar Typhi
uugccgggcaug

SEQ ID NO: 1652928 - RNA, 13 nt, Salmonella enterica enterica serovar Typhi
uugccggauggcg

SEQ ID NO: 1652929 - RNA, 16 nt, Salmonella enterica enterica serovar Typhi
uugccggauagcucgc

SEQ ID NO: 1652930 - RNA, 23 nt, Salmonella enterica enterica serovar Typhi
uugccgcacgguacuauuaccgc

SEQ ID NO: 1652931 - RNA, 18 nt, Salmonella enterica enterica serovar Typhi
uugccauugcgacgauau

SEQ ID NO: 1652932 - RNA, 15 nt, Salmonella enterica enterica serovar Typhi
uugcccgaugcgccc

SEQ ID NO: 1652933 - RNA, 20 nt, Salmonella enterica enterica serovar Typhi
uugcccgguggcgcugcgcu

SEQ ID NO: 1652934 - RNA, 21 nt, Salmonella enterica enterica serovar Typhi
uugcccguauugaagcgauau

SEQ ID NO: 1652935 - RNA, 18 nt, Salmonella enterica enterica serovar Typhi
uugccagaggcagcacau

SEQ ID NO: 1652936 - RNA, 14 nt, Salmonella enterica enterica serovar Typhi
uugccacuacgcag

SEQ ID NO: 1652937 - RNA, 13 nt, Salmonella enterica enterica serovar Typhi
aaucauaccagcg

SEQ ID NO: 1652938 - RNA, 16 nt, Salmonella enterica enterica serovar Typhi
aaucaucaggcuggcg

SEQ ID NO: 1652939 - RNA, 20 nt, Salmonella enterica enterica serovar Typhi
uugugcugguggugccgacg

SEQ ID NO: 1652940 - RNA, 23 nt, Salmonella enterica enterica serovar Typhi
uugugcauuccaggugucacuca

SEQ ID NO: 1652941 - RNA, 18 nt, Salmonella enterica enterica serovar Typhi
uugugaguaauaaucaca

SEQ ID NO: 1652942 - RNA, 19 nt, Salmonella enterica enterica serovar Typhi
uugucaucaguaugagcga

SEQ ID NO: 1652943 - RNA, 15 nt, Salmonella enterica enterica serovar Typhi
uugucuccucaugcc

SEQ ID NO: 1652944 - RNA, 16 nt, Salmonella enterica enterica serovar Typhi
uugguuucggcguaag

SEQ ID NO: 1652945 - RNA, 14 nt, Salmonella enterica enterica serovar Typhi
aaucgagaucagac

SEQ ID NO: 1652946 - RNA, 18 nt, Salmonella enterica enterica serovar Typhi
aaucgauaagccagcgau

SEQ ID NO: 1652947 - RNA, 19 nt, Salmonella enterica enterica serovar Typhi
uuggcgaucacaauuacgc

SEQ ID NO: 1652948 - RNA, 18 nt, Salmonella enterica enterica serovar Typhi
aauccgcuccacauccug

SEQ ID NO: 1652949 - RNA, 15 nt, Salmonella enterica enterica serovar Typhi
uuggcgcucaauagc

SEQ ID NO: 1652950 - RNA, 19 nt, Salmonella enterica enterica serovar Typhi
uuggcgcgcgguuuauccc

SEQ ID NO: 1652951 - RNA, 17 nt, Salmonella enterica enterica serovar Typhi
uuggcgccaaaaccgcu

SEQ ID NO: 1652952 - RNA, 19 nt, Salmonella enterica enterica serovar Typhi
uuggcaacggcagccagcg

SEQ ID NO: 1652953 - RNA, 15 nt, Salmonella enterica enterica serovar Typhi
uuggcaaucagcggc

SEQ ID NO: 1652954 - RNA, 21 nt, Salmonella enterica enterica serovar Typhi
uuggcaggaggggcagauaaa

SEQ ID NO: 1652955 - RNA, 16 nt, Salmonella enterica enterica serovar Typhi
aauccccgccgccauc

SEQ ID NO: 1652956 - RNA, 16 nt, Salmonella enterica enterica serovar Typhi
aaucccgccgcuggcg

SEQ ID NO: 1652957 - RNA, 15 nt, Salmonella enterica enterica serovar Typhi
aaucccccaacguca

SEQ ID NO: 1652958 - RNA, 15 nt, Salmonella enterica enterica serovar Typhi
aaucccauuagccac

SEQ ID NO: 1652959 - RNA, 22 nt, Salmonella enterica enterica serovar Typhi
aauccauaccugacgcacaggc

SEQ ID NO: 1652960 - RNA, 23 nt, Salmonella enterica enterica serovar Typhi
acgcuuccagaugaagcgcaucg

SEQ ID NO: 1652961 - RNA, 18 nt, Salmonella enterica enterica serovar Typhi
acgcuuaucaggccuaca

SEQ ID NO: 1652962 - RNA, 19 nt, Salmonella enterica enterica serovar Typhi
acgcuuaucagcccuacaa

SEQ ID NO: 1652963 - RNA, 11 nt, Salmonella enterica enterica serovar Typhi
acgcuuauccu

SEQ ID NO: 1652964 - RNA, 22 nt, Salmonella enterica enterica serovar Typhi
acggcacuacagcccuuucagg

SEQ ID NO: 1652965 - RNA, 19 nt, Salmonella enterica enterica serovar Typhi
acggcaccggaaccggcau

SEQ ID NO: 1652966 - RNA, 17 nt, Salmonella enterica enterica serovar Typhi
acggaucaugguugaaa

SEQ ID NO: 1652967 - RNA, 15 nt, Salmonella enterica enterica serovar Typhi
acgcgcuagcuucag

SEQ ID NO: 1652968 - RNA, 16 nt, Salmonella enterica enterica serovar Typhi
acgcggauguugcugu

SEQ ID NO: 1652969 - RNA, 13 nt, Salmonella enterica enterica serovar Typhi
acgcuggccgcaa

SEQ ID NO: 1652970 - RNA, 20 nt, Salmonella enterica enterica serovar Typhi
acggcagcguauacgccgga

SEQ ID NO: 1652971 - RNA, 14 nt, Salmonella enterica enterica serovar Typhi
acggcagccagcgu

SEQ ID NO: 1652972 - RNA, 16 nt, Salmonella enterica enterica serovar Typhi
acggcagccacgccga

SEQ ID NO: 1652973 - RNA, 20 nt, Salmonella enterica enterica serovar Typhi
acggcauagcuguuccgcaa

SEQ ID NO: 1652974 - RNA, 13 nt, Salmonella enterica enterica serovar Typhi
acggcaucaggaa

SEQ ID NO: 1652975 - RNA, 14 nt, Salmonella enterica enterica serovar Typhi
acggcccguaaacg

SEQ ID NO: 1652976 - RNA, 14 nt, Salmonella enterica enterica serovar Typhi
acggcccguaaaca

SEQ ID NO: 1652977 - RNA, 15 nt, Salmonella enterica enterica serovar Typhi
acggcgcuaagcgcc

SEQ ID NO: 1652978 - RNA, 15 nt, Salmonella enterica enterica serovar Typhi
acggcgauaccagua

SEQ ID NO: 1652979 - RNA, 18 nt, Salmonella enterica enterica serovar Typhi
acggcgcaggcaaaucaa

SEQ ID NO: 1652980 - RNA, 16 nt, Salmonella enterica enterica serovar Typhi
acggccugcgcggcga

SEQ ID NO: 1652981 - RNA, 16 nt, Salmonella enterica enterica serovar Typhi
acggccugcgcuggaa

SEQ ID NO: 1652982 - RNA, 19 nt, Salmonella enterica enterica serovar Typhi
acgggcauuguuaauccag

SEQ ID NO: 1652983 - RNA, 15 nt, Salmonella enterica enterica serovar Typhi
acgggaaguaaggca

SEQ ID NO: 1652984 - RNA, 15 nt, Salmonella enterica enterica serovar Typhi
acggcggucgccgca

SEQ ID NO: 1652985 - RNA, 21 nt, Salmonella enterica enterica serovar Typhi
acgguagacuggguaagcgca

SEQ ID NO: 1652986 - RNA, 15 nt, Salmonella enterica enterica serovar Typhi
acgguaaaacacgcc

SEQ ID NO: 1652987 - RNA, 22 nt, Salmonella enterica enterica serovar Typhi
acgggcggugugauuaauccaa

SEQ ID NO: 1652988 - RNA, 16 nt, Salmonella enterica enterica serovar Typhi
acgggcuaucaauaug

SEQ ID NO: 1652989 - RNA, 14 nt, Salmonella enterica enterica serovar Typhi
acgggcgcggcaua

SEQ ID NO: 1652990 - RNA, 15 nt, Salmonella enterica enterica serovar Typhi
acgggcgcgacaaua

SEQ ID NO: 1652991 - RNA, 22 nt, Salmonella enterica enterica serovar Typhi
acguccagacucugcgcguaaa

SEQ ID NO: 1652992 - RNA, 20 nt, Salmonella enterica enterica serovar Typhi
acguccauaccgguugcgcg

SEQ ID NO: 1652993 - RNA, 12 nt, Salmonella enterica enterica serovar Typhi
acguccauccgc

SEQ ID NO: 1652994 - RNA, 20 nt, Salmonella enterica enterica serovar Typhi
acgguaggccggguaggaca

SEQ ID NO: 1652995 - RNA, 12 nt, Salmonella enterica enterica serovar Typhi
acgguaucagcg

SEQ ID NO: 1652996 - RNA, 20 nt, Salmonella enterica enterica serovar Typhi
acguaggccgaauaagacgc

SEQ ID NO: 1652997 - RNA, 17 nt, Salmonella enterica enterica serovar Typhi
acguagucguccgcgcc

SEQ ID NO: 1652998 - RNA, 19 nt, Salmonella enterica enterica serovar Typhi
acgugcgguauaucacgcc

SEQ ID NO: 1652999 - RNA, 17 nt, Salmonella enterica enterica serovar Typhi
acguucagcauauccag

SEQ ID NO: 1653000 - RNA, 23 nt, Salmonella enterica enterica serovar Typhi
acguucggcaaaacgccgcagaa

SEQ ID NO: 1653001 - RNA, 20 nt, Salmonella enterica enterica serovar Typhi
acguucgcggguaacgucga

SEQ ID NO: 1653002 - RNA, 14 nt, Salmonella enterica enterica serovar Typhi
acguuccccagcac

SEQ ID NO: 1653003 - RNA, 15 nt, Salmonella enterica enterica serovar Typhi
acgucgucaccacgg

SEQ ID NO: 1653004 - RNA, 16 nt, Salmonella enterica enterica serovar Typhi
acgucgucccaggcca

SEQ ID NO: 1653005 - RNA, 22 nt, Salmonella enterica enterica serovar Typhi
acguuucucaugcguaaaucgc

SEQ ID NO: 1653006 - RNA, 19 nt, Salmonella enterica enterica serovar Typhi
acguuggugcguccgguag

SEQ ID NO: 1653007 - RNA, 18 nt, Salmonella enterica enterica serovar Typhi
acguuggggauaaccaga

SEQ ID NO: 1653008 - RNA, 17 nt, Salmonella enterica enterica serovar Typhi
acguuguccagcggcca

SEQ ID NO: 1653009 - RNA, 22 nt, Salmonella enterica enterica serovar Typhi
acguucuaucagguaucccgcc

SEQ ID NO: 1653010 - RNA, 15 nt, Salmonella enterica enterica serovar Typhi
acguugcuggcgcgc

SEQ ID NO: 1653011 - RNA, 21 nt, Salmonella enterica enterica serovar Typhi
acguuucucgcgaccagagac

SEQ ID NO: 1653012 - RNA, 20 nt, Salmonella enterica enterica serovar Typhi
acguuuuccugcgcuugcau

SEQ ID NO: 1653013 - RNA, 16 nt, Salmonella enterica enterica serovar Typhi
acguuuuuucgcacgc

SEQ ID NO: 1653014 - RNA, 23 nt, Salmonella enterica enterica serovar Typhi
acuacggcaaacacaaucacgcc

SEQ ID NO: 1653015 - RNA, 16 nt, Salmonella enterica enterica serovar Typhi
acuaacccggcgaccg

SEQ ID NO: 1653016 - RNA, 22 nt, Salmonella enterica enterica serovar Typhi
acuaacgauguaaaaccuggca

SEQ ID NO: 1653017 - RNA, 19 nt, Salmonella enterica enterica serovar Typhi
acucuuuuccccgacggcc

SEQ ID NO: 1653018 - RNA, 15 nt, Salmonella enterica enterica serovar Typhi
acucuuccugcugcg

SEQ ID NO: 1653019 - RNA, 20 nt, Salmonella enterica enterica serovar Typhi
acugcgaaaucaccgacagg

SEQ ID NO: 1653020 - RNA, 14 nt, Salmonella enterica enterica serovar Typhi
acugccgccgucau

SEQ ID NO: 1653021 - RNA, 20 nt, Salmonella enterica enterica serovar Typhi
acugcgaaggcuacugcguc

SEQ ID NO: 1653022 - RNA, 18 nt, Salmonella enterica enterica serovar Typhi
acugcgccgccagcgaca

SEQ ID NO: 1653023 - RNA, 17 nt, Salmonella enterica enterica serovar Typhi
acugauuaaucugccga

SEQ ID NO: 1653024 - RNA, 13 nt, Salmonella enterica enterica serovar Typhi
acugaugacgcga

SEQ ID NO: 1653025 - RNA, 17 nt, Salmonella enterica enterica serovar Typhi
acugaugcuggcgccau

SEQ ID NO: 1653026 - RNA, 15 nt, Salmonella enterica enterica serovar Typhi
acuccgcgcuggcaa

SEQ ID NO: 1653027 - RNA, 19 nt, Salmonella enterica enterica serovar Typhi
acuccggugcccauuccgc

SEQ ID NO: 1653028 - RNA, 16 nt, Salmonella enterica enterica serovar Typhi
acuccuuaggccguca

SEQ ID NO: 1653029 - RNA, 19 nt, Salmonella enterica enterica serovar Typhi
acucgccaugccaucggcc

SEQ ID NO: 1653030 - RNA, 14 nt, Salmonella enterica enterica serovar Typhi
acuccagcagacgc

SEQ ID NO: 1653031 - RNA, 12 nt, Salmonella enterica enterica serovar Typhi
acuccagacgau

SEQ ID NO: 1653032 - RNA, 21 nt, Salmonella enterica enterica serovar Typhi
acuccagugcagaaaguguga

SEQ ID NO: 1653033 - RNA, 22 nt, Salmonella enterica enterica serovar Typhi
acuauauguccuuuacugcgcc

SEQ ID NO: 1653034 - RNA, 21 nt, Salmonella enterica enterica serovar Typhi
acucauuaccggcugccgaua

SEQ ID NO: 1653035 - RNA, 17 nt, Salmonella enterica enterica serovar Typhi
acuccaaaaauaaacac

SEQ ID NO: 1653036 - RNA, 18 nt, Salmonella enterica enterica serovar Typhi
accugaggaaaaagcgca

SEQ ID NO: 1653037 - RNA, 14 nt, Salmonella enterica enterica serovar Typhi
accugauagcgggu

SEQ ID NO: 1653038 - RNA, 16 nt, Salmonella enterica enterica serovar Typhi
accugauagcggguaa

SEQ ID NO: 1653039 - RNA, 20 nt, Salmonella enterica enterica serovar Typhi
accugcaaacguagcgcguc

SEQ ID NO: 1653040 - RNA, 18 nt, Salmonella enterica enterica serovar Typhi
accugauugauacgcgcc

SEQ ID NO: 1653041 - RNA, 21 nt, Salmonella enterica enterica serovar Typhi
accugcagggugaagauggcg

SEQ ID NO: 1653042 - RNA, 23 nt, Salmonella enterica enterica serovar Typhi
accugcagggugaagauggcgcc

SEQ ID NO: 1653043 - RNA, 19 nt, Salmonella enterica enterica serovar Typhi
accugcccuuucagagcgu

SEQ ID NO: 1653044 - RNA, 22 nt, Salmonella enterica enterica serovar Typhi
accugccugucacgcagggggu

SEQ ID NO: 1653045 - RNA, 22 nt, Salmonella enterica enterica serovar Typhi
accucuugcuggguuaacgcgc

SEQ ID NO: 1653046 - RNA, 13 nt, Salmonella enterica enterica serovar Typhi
accucguucggcg

SEQ ID NO: 1653047 - RNA, 18 nt, Salmonella enterica enterica serovar Typhi
accucgcgcuuauccgca

SEQ ID NO: 1653048 - RNA, 19 nt, Salmonella enterica enterica serovar Typhi
accgguacgcaacgcuucu

SEQ ID NO: 1653049 - RNA, 15 nt, Salmonella enterica enterica serovar Typhi
accuauccgguugac

SEQ ID NO: 1653050 - RNA, 15 nt, Salmonella enterica enterica serovar Typhi
accucgccagucagg

SEQ ID NO: 1653051 - RNA, 18 nt, Salmonella enterica enterica serovar Typhi
accuccugcaaucguucu

SEQ ID NO: 1653052 - RNA, 15 nt, Salmonella enterica enterica serovar Typhi
accuccugcaucgac

SEQ ID NO: 1653053 - RNA, 19 nt, Salmonella enterica enterica serovar Typhi
accuccagcacgcgcugcg

SEQ ID NO: 1653054 - RNA, 11 nt, Salmonella enterica enterica serovar Typhi
accuccgccac

SEQ ID NO: 1653055 - RNA, 17 nt, Salmonella enterica enterica serovar Typhi
accuuaucgcagucagc

SEQ ID NO: 1653056 - RNA, 17 nt, Salmonella enterica enterica serovar Typhi
accuucacccccaucgc

SEQ ID NO: 1653057 - RNA, 18 nt, Salmonella enterica enterica serovar Typhi
accuguucaugccagauu

SEQ ID NO: 1653058 - RNA, 14 nt, Salmonella enterica enterica serovar Typhi
accugguaagcgca

SEQ ID NO: 1653059 - RNA, 16 nt, Salmonella enterica enterica serovar Typhi
accugggaaucgugca

SEQ ID NO: 1653060 - RNA, 17 nt, Salmonella enterica enterica serovar Typhi
accugcuggcggcguaa

SEQ ID NO: 1653061 - RNA, 16 nt, Salmonella enterica enterica serovar Typhi
accugcuggcggcgua

SEQ ID NO: 1653062 - RNA, 22 nt, Salmonella enterica enterica serovar Typhi
accuggaauagcgugggcagac

SEQ ID NO: 1653063 - RNA, 20 nt, Salmonella enterica enterica serovar Typhi
accugcgcgacggcggcguc

SEQ ID NO: 1653064 - RNA, 13 nt, Salmonella enterica enterica serovar Typhi
accugcgcugacg

SEQ ID NO: 1653065 - RNA, 21 nt, Salmonella enterica enterica serovar Typhi
acgaccugguggcgaacaaua

SEQ ID NO: 1653066 - RNA, 17 nt, Salmonella enterica enterica serovar Typhi
acgaccggucagccggu

SEQ ID NO: 1653067 - RNA, 17 nt, Salmonella enterica enterica serovar Typhi
acgaaucucgcugccgg

SEQ ID NO: 1653068 - RNA, 12 nt, Salmonella enterica enterica serovar Typhi
acgaaucaggau

SEQ ID NO: 1653069 - RNA, 19 nt, Salmonella enterica enterica serovar Typhi
acgaauuuacucgccaaua

SEQ ID NO: 1653070 - RNA, 15 nt, Salmonella enterica enterica serovar Typhi
acgaccauaaauagc

SEQ ID NO: 1653071 - RNA, 23 nt, Salmonella enterica enterica serovar Typhi
acgacccuuuuuugguuauccag

SEQ ID NO: 1653072 - RNA, 12 nt, Salmonella enterica enterica serovar Typhi
acgcgcggcguc

SEQ ID NO: 1653073 - RNA, 17 nt, Salmonella enterica enterica serovar Typhi
acgcgccaucagacucu

SEQ ID NO: 1653074 - RNA, 22 nt, Salmonella enterica enterica serovar Typhi
acgcgcauccugcauaauccaa

SEQ ID NO: 1653075 - RNA, 19 nt, Salmonella enterica enterica serovar Typhi
acgcgcauuaauaugcgca

SEQ ID NO: 1653076 - RNA, 14 nt, Salmonella enterica enterica serovar Typhi
acgcgcauacucau

SEQ ID NO: 1653077 - RNA, 15 nt, Salmonella enterica enterica serovar Typhi
acgcgccacgcgcca

SEQ ID NO: 1653078 - RNA, 21 nt, Salmonella enterica enterica serovar Typhi
acgccguuuguuuauugccgc

SEQ ID NO: 1653079 - RNA, 13 nt, Salmonella enterica enterica serovar Typhi
acgccuaaaugaa

SEQ ID NO: 1653080 - RNA, 21 nt, Salmonella enterica enterica serovar Typhi
acgccuuauccggccuacaga

SEQ ID NO: 1653081 - RNA, 21 nt, Salmonella enterica enterica serovar Typhi
acgccuuauccgaccuacaga

SEQ ID NO: 1653082 - RNA, 21 nt, Salmonella enterica enterica serovar Typhi
acgccuuacccgaccuacauc

SEQ ID NO: 1653083 - RNA, 20 nt, Salmonella enterica enterica serovar Typhi
acgcgaugcaaccccugacg

SEQ ID NO: 1653084 - RNA, 18 nt, Salmonella enterica enterica serovar Typhi
acgcgaucgcgauucgcc

SEQ ID NO: 1653085 - RNA, 18 nt, Salmonella enterica enterica serovar Typhi
acgcgauauguuugcgcg

SEQ ID NO: 1653086 - RNA, 15 nt, Salmonella enterica enterica serovar Typhi
acgcgauagcgcagc

SEQ ID NO: 1653087 - RNA, 13 nt, Salmonella enterica enterica serovar Typhi
acgccuucaguca

SEQ ID NO: 1653088 - RNA, 17 nt, Salmonella enterica enterica serovar Typhi
acgccggaccagacgac

SEQ ID NO: 1653089 - RNA, 17 nt, Salmonella enterica enterica serovar Typhi
acgccggagaccggcga

SEQ ID NO: 1653090 - RNA, 14 nt, Salmonella enterica enterica serovar Typhi
acgccggaugcgag

SEQ ID NO: 1653091 - RNA, 16 nt, Salmonella enterica enterica serovar Typhi
acgccgccgcaggcca

SEQ ID NO: 1653092 - RNA, 19 nt, Salmonella enterica enterica serovar Typhi
acgccgcuaucgaccagca

SEQ ID NO: 1653093 - RNA, 18 nt, Salmonella enterica enterica serovar Typhi
acgccgccauccgacaac

SEQ ID NO: 1653094 - RNA, 17 nt, Salmonella enterica enterica serovar Typhi
acgccgccauccggcac

SEQ ID NO: 1653095 - RNA, 17 nt, Salmonella enterica enterica serovar Typhi
acgccgacgcauccgcc

SEQ ID NO: 1653096 - RNA, 19 nt, Salmonella enterica enterica serovar Typhi
acgccgacucacgcagcgc

SEQ ID NO: 1653097 - RNA, 17 nt, Salmonella enterica enterica serovar Typhi
acgauguaaaaccuggc

SEQ ID NO: 1653098 - RNA, 15 nt, Salmonella enterica enterica serovar Typhi
acgaucuggucgcca

SEQ ID NO: 1653099 - RNA, 22 nt, Salmonella enterica enterica serovar Typhi
acgcagauaucuuccagcgcgu

SEQ ID NO: 1653100 - RNA, 20 nt, Salmonella enterica enterica serovar Typhi
acgcagcgccuucgcuucga

SEQ ID NO: 1653101 - RNA, 15 nt, Salmonella enterica enterica serovar Typhi
acgcagcgcgcguag

SEQ ID NO: 1653102 - RNA, 18 nt, Salmonella enterica enterica serovar Typhi
acgcagcaucucaauauc

SEQ ID NO: 1653103 - RNA, 16 nt, Salmonella enterica enterica serovar Typhi
acgcagcauuucgucg

SEQ ID NO: 1653104 - RNA, 21 nt, Salmonella enterica enterica serovar Typhi
acgccauucggcguaucggaa

SEQ ID NO: 1653105 - RNA, 20 nt, Salmonella enterica enterica serovar Typhi
acgccauuccuuuaaauauc

SEQ ID NO: 1653106 - RNA, 18 nt, Salmonella enterica enterica serovar Typhi
acgccauggccgcagccc

SEQ ID NO: 1653107 - RNA, 21 nt, Salmonella enterica enterica serovar Typhi
acgccagguagccgacggcca

SEQ ID NO: 1653108 - RNA, 16 nt, Salmonella enterica enterica serovar Typhi
acgcccacgcggcgug

SEQ ID NO: 1653109 - RNA, 22 nt, Salmonella enterica enterica serovar Typhi
acgcccgccguaacgcgcaucu

SEQ ID NO: 1653110 - RNA, 22 nt, Salmonella enterica enterica serovar Typhi
acgcccgcuuucaccaucgcga

SEQ ID NO: 1653111 - RNA, 17 nt, Salmonella enterica enterica serovar Typhi
acgccaccgccgccacc

SEQ ID NO: 1653112 - RNA, 17 nt, Salmonella enterica enterica serovar Typhi
acgccaccgggccguca

SEQ ID NO: 1653113 - RNA, 16 nt, Salmonella enterica enterica serovar Typhi
acgccaggcagaacgc

SEQ ID NO: 1653114 - RNA, 20 nt, Salmonella enterica enterica serovar Typhi
acgccacaaacugcgcuagc

SEQ ID NO: 1653115 - RNA, 13 nt, Salmonella enterica enterica serovar Typhi
acgcauccagcgu

SEQ ID NO: 1653116 - RNA, 23 nt, Salmonella enterica enterica serovar Typhi
acgcauaguccugccgacaggca

SEQ ID NO: 1653117 - RNA, 15 nt, Salmonella enterica enterica serovar Typhi
acgcauaccagccau

SEQ ID NO: 1653118 - RNA, 20 nt, Salmonella enterica enterica serovar Typhi
acagcaccaucaugcaagag

SEQ ID NO: 1653119 - RNA, 24 nt, Salmonella enterica enterica serovar Typhi
acagccaaucauaaacgccugacg

SEQ ID NO: 1653120 - RNA, 23 nt, Salmonella enterica enterica serovar Typhi
acagcacguuaccggcgguugag

SEQ ID NO: 1653121 - RNA, 13 nt, Salmonella enterica enterica serovar Typhi
acagcgcgcgaca

SEQ ID NO: 1653122 - RNA, 16 nt, Salmonella enterica enterica serovar Typhi
acagcgccggcagcag

SEQ ID NO: 1653123 - RNA, 12 nt, Salmonella enterica enterica serovar Typhi
acagcgccauca

SEQ ID NO: 1653124 - RNA, 16 nt, Salmonella enterica enterica serovar Typhi
acagcccgauaaacaa

SEQ ID NO: 1653125 - RNA, 18 nt, Salmonella enterica enterica serovar Typhi
acagcccgccagcaccag

SEQ ID NO: 1653126 - RNA, 21 nt, Salmonella enterica enterica serovar Typhi
acagccccccuuugcauuacg

SEQ ID NO: 1653127 - RNA, 15 nt, Salmonella enterica enterica serovar Typhi
acacagcgucgcgcg

SEQ ID NO: 1653128 - RNA, 22 nt, Salmonella enterica enterica serovar Typhi
acacaggggccacaggcggcau

SEQ ID NO: 1653129 - RNA, 19 nt, Salmonella enterica enterica serovar Typhi
acacccggcuuuugcuuuc

SEQ ID NO: 1653130 - RNA, 13 nt, Salmonella enterica enterica serovar Typhi
acaccgccagcgu

SEQ ID NO: 1653131 - RNA, 16 nt, Salmonella enterica enterica serovar Typhi
acaccgcauggcuggc

SEQ ID NO: 1653132 - RNA, 21 nt, Salmonella enterica enterica serovar Typhi
acacgcuuccagaugaagcgc

SEQ ID NO: 1653133 - RNA, 16 nt, Salmonella enterica enterica serovar Typhi
acacgcuuauccugcc

SEQ ID NO: 1653134 - RNA, 14 nt, Salmonella enterica enterica serovar Typhi
acacgcgaauagcc

SEQ ID NO: 1653135 - RNA, 16 nt, Salmonella enterica enterica serovar Typhi
acaaagcccaccgcga

SEQ ID NO: 1653136 - RNA, 22 nt, Salmonella enterica enterica serovar Typhi
acaaagagcuccccacgaaagu

SEQ ID NO: 1653137 - RNA, 19 nt, Salmonella enterica enterica serovar Typhi
acaaaucuguuaucuggau

SEQ ID NO: 1653138 - RNA, 19 nt, Salmonella enterica enterica serovar Typhi
acaaaucgacagccagcau

SEQ ID NO: 1653139 - RNA, 16 nt, Salmonella enterica enterica serovar Typhi
acaaaugacgucagca

SEQ ID NO: 1653140 - RNA, 21 nt, Salmonella enterica enterica serovar Typhi
acaacccacauuggccccugg

SEQ ID NO: 1653141 - RNA, 20 nt, Salmonella enterica enterica serovar Typhi
acaaccugcgcgacggcggc

SEQ ID NO: 1653142 - RNA, 16 nt, Salmonella enterica enterica serovar Typhi
acaacaucccagaaaa

SEQ ID NO: 1653143 - RNA, 12 nt, Salmonella enterica enterica serovar Typhi
acaaccagcgaa

SEQ ID NO: 1653144 - RNA, 17 nt, Salmonella enterica enterica serovar Typhi
aauguuaauaagcagaa

SEQ ID NO: 1653145 - RNA, 22 nt, Salmonella enterica enterica serovar Typhi
aauguuuggauuucgucgcuaa

SEQ ID NO: 1653146 - RNA, 12 nt, Salmonella enterica enterica serovar Typhi
aauuuuuccagc

SEQ ID NO: 1653147 - RNA, 14 nt, Salmonella enterica enterica serovar Typhi
acaaaaccgcuaau

SEQ ID NO: 1653148 - RNA, 15 nt, Salmonella enterica enterica serovar Typhi
aauuuuugaucugcu

SEQ ID NO: 1653149 - RNA, 16 nt, Salmonella enterica enterica serovar Typhi
acaagaauuuaucgca

SEQ ID NO: 1653150 - RNA, 16 nt, Salmonella enterica enterica serovar Typhi
acaaguagccugccag

SEQ ID NO: 1653151 - RNA, 15 nt, Salmonella enterica enterica serovar Typhi
acaaggauauccgcc

SEQ ID NO: 1653152 - RNA, 22 nt, Salmonella enterica enterica serovar Typhi
acaaggcgguacgccgccaucc

SEQ ID NO: 1653153 - RNA, 19 nt, Salmonella enterica enterica serovar Typhi
acaacgcuccagcaguucu

SEQ ID NO: 1653154 - RNA, 20 nt, Salmonella enterica enterica serovar Typhi
acacaauauugcugugcuau

SEQ ID NO: 1653155 - RNA, 15 nt, Salmonella enterica enterica serovar Typhi
acacaauagcaaucu

SEQ ID NO: 1653156 - RNA, 15 nt, Salmonella enterica enterica serovar Typhi
acaauuuaucagaca

SEQ ID NO: 1653157 - RNA, 22 nt, Salmonella enterica enterica serovar Typhi
acaauuucccccacuucugaca

SEQ ID NO: 1653158 - RNA, 22 nt, Salmonella enterica enterica serovar Typhi
acaauggcaggcagcagauaau

SEQ ID NO: 1653159 - RNA, 23 nt, Salmonella enterica enterica serovar Typhi
acaaucaaauggcuggcgcuauu

SEQ ID NO: 1653160 - RNA, 20 nt, Salmonella enterica enterica serovar Typhi
acaaucccggcaacugcgcc

SEQ ID NO: 1653161 - RNA, 18 nt, Salmonella enterica enterica serovar Typhi
acaaucgcguuuuccagc

SEQ ID NO: 1653162 - RNA, 14 nt, Salmonella enterica enterica serovar Typhi
acaaucccgccaga

SEQ ID NO: 1653163 - RNA, 14 nt, Salmonella enterica enterica serovar Typhi
acaaguuuauccgg

SEQ ID NO: 1653164 - RNA, 14 nt, Salmonella enterica enterica serovar Typhi
acaauaaccggcag

SEQ ID NO: 1653165 - RNA, 21 nt, Salmonella enterica enterica serovar Typhi
acaauagcgcuaaacagcgcc

SEQ ID NO: 1653166 - RNA, 15 nt, Salmonella enterica enterica serovar Typhi
accaacggcgcuggc

SEQ ID NO: 1653167 - RNA, 20 nt, Salmonella enterica enterica serovar Typhi
accaacgucgugccagugau

SEQ ID NO: 1653168 - RNA, 21 nt, Salmonella enterica enterica serovar Typhi
accaaguuuggcaaucaaauc

SEQ ID NO: 1653169 - RNA, 21 nt, Salmonella enterica enterica serovar Typhi
accaaagccaggccgccagca

SEQ ID NO: 1653170 - RNA, 21 nt, Salmonella enterica enterica serovar Typhi
accaacaaacgcgacaacgcc

SEQ ID NO: 1653171 - RNA, 18 nt, Salmonella enterica enterica serovar Typhi
accaacccagccugcgau

SEQ ID NO: 1653172 - RNA, 22 nt, Salmonella enterica enterica serovar Typhi
acauugagcgucaggccaucgc

SEQ ID NO: 1653173 - RNA, 15 nt, Salmonella enterica enterica serovar Typhi
acauugccggcauca

SEQ ID NO: 1653174 - RNA, 18 nt, Salmonella enterica enterica serovar Typhi
acaugaccagcgcaaaca

SEQ ID NO: 1653175 - RNA, 22 nt, Salmonella enterica enterica serovar Typhi
acaugacauccaugauaaucag

SEQ ID NO: 1653176 - RNA, 17 nt, Salmonella enterica enterica serovar Typhi
acaucuucuacaugccc

SEQ ID NO: 1653177 - RNA, 20 nt, Salmonella enterica enterica serovar Typhi
acauagccucaagagaugca

SEQ ID NO: 1653178 - RNA, 22 nt, Salmonella enterica enterica serovar Typhi
acauacuguuaugggucgcuuc

SEQ ID NO: 1653179 - RNA, 17 nt, Salmonella enterica enterica serovar Typhi
acauacaccggcgccag

SEQ ID NO: 1653180 - RNA, 12 nt, Salmonella enterica enterica serovar Typhi
acauauccaguu

SEQ ID NO: 1653181 - RNA, 16 nt, Salmonella enterica enterica serovar Typhi
acauagcuaccgcgcg

SEQ ID NO: 1653182 - RNA, 22 nt, Salmonella enterica enterica serovar Typhi
acaucccgauaauggcgccgau

SEQ ID NO: 1653183 - RNA, 24 nt, Salmonella enterica enterica serovar Typhi
acaucgucuuuuaccgcgucgcua

SEQ ID NO: 1653184 - RNA, 22 nt, Salmonella enterica enterica serovar Typhi
acauaaacagcgugaacacgcc

SEQ ID NO: 1653185 - RNA, 13 nt, Salmonella enterica enterica serovar Typhi
acagugcgccaua

SEQ ID NO: 1653186 - RNA, 20 nt, Salmonella enterica enterica serovar Typhi
acagugacccgccgccagca

SEQ ID NO: 1653187 - RNA, 16 nt, Salmonella enterica enterica serovar Typhi
acagcguacaggcgga

SEQ ID NO: 1653188 - RNA, 17 nt, Salmonella enterica enterica serovar Typhi
acagcguaaugcgccag

SEQ ID NO: 1653189 - RNA, 12 nt, Salmonella enterica enterica serovar Typhi
acaguacgcccg

SEQ ID NO: 1653190 - RNA, 14 nt, Salmonella enterica enterica serovar Typhi
acagcgucauccag

SEQ ID NO: 1653191 - RNA, 23 nt, Salmonella enterica enterica serovar Typhi
accacucuuuggacggcaucagg

SEQ ID NO: 1653192 - RNA, 23 nt, Salmonella enterica enterica serovar Typhi
accacuggaauaguuacggacau

SEQ ID NO: 1653193 - RNA, 21 nt, Salmonella enterica enterica serovar Typhi
accacuucaacgccgcgcuuc

SEQ ID NO: 1653194 - RNA, 14 nt, Salmonella enterica enterica serovar Typhi
accacuucacuauc

SEQ ID NO: 1653195 - RNA, 15 nt, Salmonella enterica enterica serovar Typhi
accagcagaugcagu

SEQ ID NO: 1653196 - RNA, 17 nt, Salmonella enterica enterica serovar Typhi
accagaaacaacacgau

SEQ ID NO: 1653197 - RNA, 17 nt, Salmonella enterica enterica serovar Typhi
accagcgaaaugacggc

SEQ ID NO: 1653198 - RNA, 23 nt, Salmonella enterica enterica serovar Typhi
accagcaggugcggauaguccug

SEQ ID NO: 1653199 - RNA, 20 nt, Salmonella enterica enterica serovar Typhi
accacaucagaccgccaagc

SEQ ID NO: 1653200 - RNA, 18 nt, Salmonella enterica enterica serovar Typhi
accacaugaccagcgccg

SEQ ID NO: 1653201 - RNA, 18 nt, Salmonella enterica enterica serovar Typhi
accaccaguacauggcuc

SEQ ID NO: 1653202 - RNA, 16 nt, Salmonella enterica enterica serovar Typhi
accaccggauggcgac

SEQ ID NO: 1653203 - RNA, 13 nt, Salmonella enterica enterica serovar Typhi
accacgguauuaa

SEQ ID NO: 1653204 - RNA, 16 nt, Salmonella enterica enterica serovar Typhi
accggaugauggccug

SEQ ID NO: 1653205 - RNA, 20 nt, Salmonella enterica enterica serovar Typhi
accggaucaauaugccagau

SEQ ID NO: 1653206 - RNA, 14 nt, Salmonella enterica enterica serovar Typhi
accgcugacugaac

SEQ ID NO: 1653207 - RNA, 17 nt, Salmonella enterica enterica serovar Typhi
accgcuuuaugcgcuuc

SEQ ID NO: 1653208 - RNA, 23 nt, Salmonella enterica enterica serovar Typhi
accgcuuuucgguuacguucggc

SEQ ID NO: 1653209 - RNA, 17 nt, Salmonella enterica enterica serovar Typhi
accgcguuugcgcaaca

SEQ ID NO: 1653210 - RNA, 24 nt, Salmonella enterica enterica serovar Typhi
accgcguuuaacgcagcgcgcgua

SEQ ID NO: 1653211 - RNA, 17 nt, Salmonella enterica enterica serovar Typhi
accgcguuugcgucguu

SEQ ID NO: 1653212 - RNA, 20 nt, Salmonella enterica enterica serovar Typhi
accgcuccgcgcauccggca

SEQ ID NO: 1653213 - RNA, 19 nt, Salmonella enterica enterica serovar Typhi
accgcgcgcccgacgcgcc

SEQ ID NO: 1653214 - RNA, 13 nt, Salmonella enterica enterica serovar Typhi
accgcgcggcguu

SEQ ID NO: 1653215 - RNA, 21 nt, Salmonella enterica enterica serovar Typhi
accgcgcuccuggaaccagug

SEQ ID NO: 1653216 - RNA, 15 nt, Salmonella enterica enterica serovar Typhi
accgcgcggcguucu

SEQ ID NO: 1653217 - RNA, 14 nt, Salmonella enterica enterica serovar Typhi
accggccugccuau

SEQ ID NO: 1653218 - RNA, 17 nt, Salmonella enterica enterica serovar Typhi
accggcacaccggccau

SEQ ID NO: 1653219 - RNA, 21 nt, Salmonella enterica enterica serovar Typhi
accggcacgguuaaugaaauc

SEQ ID NO: 1653220 - RNA, 19 nt, Salmonella enterica enterica serovar Typhi
accggcgacgugacgcgcc

SEQ ID NO: 1653221 - RNA, 17 nt, Salmonella enterica enterica serovar Typhi
accggcucgucguugaa

SEQ ID NO: 1653222 - RNA, 20 nt, Salmonella enterica enterica serovar Typhi
accgggcugcagcccuuacg

SEQ ID NO: 1653223 - RNA, 21 nt, Salmonella enterica enterica serovar Typhi
accgggcucacgcuggugcuu

SEQ ID NO: 1653224 - RNA, 16 nt, Salmonella enterica enterica serovar Typhi
accgguaaugauacca

SEQ ID NO: 1653225 - RNA, 12 nt, Salmonella enterica enterica serovar Typhi
accgccgacagu

SEQ ID NO: 1653226 - RNA, 15 nt, Salmonella enterica enterica serovar Typhi
accgccagccauggc

SEQ ID NO: 1653227 - RNA, 22 nt, Salmonella enterica enterica serovar Typhi
accgccagauggaaaccggcgu

SEQ ID NO: 1653228 - RNA, 18 nt, Salmonella enterica enterica serovar Typhi
accgcagaaacagauagu

SEQ ID NO: 1653229 - RNA, 21 nt, Salmonella enterica enterica serovar Typhi
accgcaucaaugcccagcgca

SEQ ID NO: 1653230 - RNA, 22 nt, Salmonella enterica enterica serovar Typhi
accgcgccacggccaacgcgcc

SEQ ID NO: 1653231 - RNA, 18 nt, Salmonella enterica enterica serovar Typhi
accgcgcaguucaauauu

SEQ ID NO: 1653232 - RNA, 16 nt, Salmonella enterica enterica serovar Typhi
accgccugcguuugcg

SEQ ID NO: 1653233 - RNA, 18 nt, Salmonella enterica enterica serovar Typhi
accgccuuauccggccua

SEQ ID NO: 1653234 - RNA, 12 nt, Salmonella enterica enterica serovar Typhi
acccuugcggcu

SEQ ID NO: 1653235 - RNA, 20 nt, Salmonella enterica enterica serovar Typhi
accgaaaucgguacgcgucu

SEQ ID NO: 1653236 - RNA, 21 nt, Salmonella enterica enterica serovar Typhi
accgacaauauucgccgcgau

SEQ ID NO: 1653237 - RNA, 13 nt, Salmonella enterica enterica serovar Typhi
accccugacgggc

SEQ ID NO: 1653238 - RNA, 16 nt, Salmonella enterica enterica serovar Typhi
acccgcgggcggcguu

SEQ ID NO: 1653239 - RNA, 22 nt, Salmonella enterica enterica serovar Typhi
acccgcuacgcgugaugugccg

SEQ ID NO: 1653240 - RNA, 17 nt, Salmonella enterica enterica serovar Typhi
acccgcgugcggacgua

SEQ ID NO: 1653241 - RNA, 13 nt, Salmonella enterica enterica serovar Typhi
acccggauauccg

SEQ ID NO: 1653242 - RNA, 22 nt, Salmonella enterica enterica serovar Typhi
acccggcaaaggaauuacgggc

SEQ ID NO: 1653243 - RNA, 14 nt, Salmonella enterica enterica serovar Typhi
acccauagcagcuc

SEQ ID NO: 1653244 - RNA, 19 nt, Salmonella enterica enterica serovar Typhi
acccagcgcgaauuugccc

SEQ ID NO: 1653245 - RNA, 12 nt, Salmonella enterica enterica serovar Typhi
acccagcccaau

SEQ ID NO: 1653246 - RNA, 18 nt, Salmonella enterica enterica serovar Typhi
acccacuguaucgacaua

SEQ ID NO: 1653247 - RNA, 23 nt, Salmonella enterica enterica serovar Typhi
acccagacaaaauucagacucaa

SEQ ID NO: 1653248 - RNA, 16 nt, Salmonella enterica enterica serovar Typhi
acccacgccggaaauc

SEQ ID NO: 1653249 - RNA, 13 nt, Salmonella enterica enterica serovar Typhi
accaggccagcgu

SEQ ID NO: 1653250 - RNA, 19 nt, Salmonella enterica enterica serovar Typhi
accccggucacaucguuau

SEQ ID NO: 1653251 - RNA, 23 nt, Salmonella enterica enterica serovar Typhi
accccgccagcagguuaaacaga

SEQ ID NO: 1653252 - RNA, 20 nt, Salmonella enterica enterica serovar Typhi
accccauuaugugcgacgua

SEQ ID NO: 1653253 - RNA, 14 nt, Salmonella enterica enterica serovar Typhi
acccccgcaacggc

SEQ ID NO: 1653254 - RNA, 16 nt, Salmonella enterica enterica serovar Typhi
accccaaucuugcgua

SEQ ID NO: 1653255 - RNA, 15 nt, Salmonella enterica enterica serovar Typhi
accccacccacugau

SEQ ID NO: 1653256 - RNA, 22 nt, Salmonella enterica enterica serovar Typhi
accccaguaauccggcaacugc

SEQ ID NO: 1653257 - RNA, 15 nt, Salmonella enterica enterica serovar Typhi
accccaucccggcaa

SEQ ID NO: 1653258 - RNA, 16 nt, Salmonella enterica enterica serovar Typhi
ucggccauauccagcc

SEQ ID NO: 1653259 - RNA, 18 nt, Salmonella enterica enterica serovar Typhi
ucggcagcaauacgcccg

SEQ ID NO: 1653260 - RNA, 18 nt, Salmonella enterica enterica serovar Typhi
ucggcaauuuccggcgac

SEQ ID NO: 1653261 - RNA, 19 nt, Salmonella enterica enterica serovar Typhi
ucggcaauaaacucccgca

SEQ ID NO: 1653262 - RNA, 15 nt, Salmonella enterica enterica serovar Typhi
ucggagaaauagacg

SEQ ID NO: 1653263 - RNA, 13 nt, Salmonella enterica enterica serovar Typhi
ucggacucaucgg

SEQ ID NO: 1653264 - RNA, 23 nt, Salmonella enterica enterica serovar Typhi
ucggcgaccagcagcgcggcgua

SEQ ID NO: 1653265 - RNA, 18 nt, Salmonella enterica enterica serovar Typhi
aauaccgugcacgcugcg

SEQ ID NO: 1653266 - RNA, 19 nt, Salmonella enterica enterica serovar Typhi
aauacccaggccaucagaa

SEQ ID NO: 1653267 - RNA, 20 nt, Salmonella enterica enterica serovar Typhi
ucgcggguaaacucacccag

SEQ ID NO: 1653268 - RNA, 19 nt, Salmonella enterica enterica serovar Typhi
ucgcgcccuccuccagcgu

SEQ ID NO: 1653269 - RNA, 16 nt, Salmonella enterica enterica serovar Typhi
ucgcggucggcgcagu

SEQ ID NO: 1653270 - RNA, 17 nt, Salmonella enterica enterica serovar Typhi
ucgcgguggguagcggc

SEQ ID NO: 1653271 - RNA, 24 nt, Salmonella enterica enterica serovar Typhi
ucgcguacaggauguccaggcgac

SEQ ID NO: 1653272 - RNA, 19 nt, Salmonella enterica enterica serovar Typhi
ucgcgguuucguggcgcug

SEQ ID NO: 1653273 - RNA, 17 nt, Salmonella enterica enterica serovar Typhi
ucgcuaugaaaacgcag

SEQ ID NO: 1653274 - RNA, 17 nt, Salmonella enterica enterica serovar Typhi
ucgcucuauauccugcc

SEQ ID NO: 1653275 - RNA, 15 nt, Salmonella enterica enterica serovar Typhi
ucgcucuuccaguug

SEQ ID NO: 1653276 - RNA, 21 nt, Salmonella enterica enterica serovar Typhi
ucgcucucgugccaguaacgu

SEQ ID NO: 1653277 - RNA, 14 nt, Salmonella enterica enterica serovar Typhi
ucgcucgcggcaga

SEQ ID NO: 1653278 - RNA, 20 nt, Salmonella enterica enterica serovar Typhi
ucgcuaacccaggccggaug

SEQ ID NO: 1653279 - RNA, 19 nt, Salmonella enterica enterica serovar Typhi
ucgcuuaucuggccuacgg

SEQ ID NO: 1653280 - RNA, 21 nt, Salmonella enterica enterica serovar Typhi
ucgcuucaaucgugguuggca

SEQ ID NO: 1653281 - RNA, 19 nt, Salmonella enterica enterica serovar Typhi
ucgcuuuuugcgccagcgc

SEQ ID NO: 1653282 - RNA, 17 nt, Salmonella enterica enterica serovar Typhi
ucggaccuccgcguacc

SEQ ID NO: 1653283 - RNA, 13 nt, Salmonella enterica enterica serovar Typhi
ucgcuuaccgggc

SEQ ID NO: 1653284 - RNA, 13 nt, Salmonella enterica enterica serovar Typhi
ucgcuuaccaggc

SEQ ID NO: 1653285 - RNA, 15 nt, Salmonella enterica enterica serovar Typhi
ucgccaaugccgcag

SEQ ID NO: 1653286 - RNA, 18 nt, Salmonella enterica enterica serovar Typhi
ucgccaccgcgcgcuuaa

SEQ ID NO: 1653287 - RNA, 16 nt, Salmonella enterica enterica serovar Typhi
ucgccacgacgcuggu

SEQ ID NO: 1653288 - RNA, 21 nt, Salmonella enterica enterica serovar Typhi
ucgcauucauaucgccugcgg

SEQ ID NO: 1653289 - RNA, 16 nt, Salmonella enterica enterica serovar Typhi
ucgccaaagcguaaac

SEQ ID NO: 1653290 - RNA, 16 nt, Salmonella enterica enterica serovar Typhi
ucgccaagaucgccaa

SEQ ID NO: 1653291 - RNA, 20 nt, Salmonella enterica enterica serovar Typhi
ucgcauucuucagcgcgucc

SEQ ID NO: 1653292 - RNA, 23 nt, Salmonella enterica enterica serovar Typhi
ucgcauucauaucgccugcggca

SEQ ID NO: 1653293 - RNA, 21 nt, Salmonella enterica enterica serovar Typhi
ucgcauuuuuaagcuggcgaa

SEQ ID NO: 1653294 - RNA, 16 nt, Salmonella enterica enterica serovar Typhi
ucgccaaaauggcgaa

SEQ ID NO: 1653295 - RNA, 21 nt, Salmonella enterica enterica serovar Typhi
ucgcagccacccuggcauaug

SEQ ID NO: 1653296 - RNA, 13 nt, Salmonella enterica enterica serovar Typhi
ucgcccugcggua

SEQ ID NO: 1653297 - RNA, 14 nt, Salmonella enterica enterica serovar Typhi
ucgcccugauggcg

SEQ ID NO: 1653298 - RNA, 21 nt, Salmonella enterica enterica serovar Typhi
ucgcccgcaaccacggcgcag

SEQ ID NO: 1653299 - RNA, 13 nt, Salmonella enterica enterica serovar Typhi
ucgccagcacguu

SEQ ID NO: 1653300 - RNA, 21 nt, Salmonella enterica enterica serovar Typhi
ucgccagcuucucaaaaucgc

SEQ ID NO: 1653301 - RNA, 19 nt, Salmonella enterica enterica serovar Typhi
ucgccauugcaauaccggc

SEQ ID NO: 1653302 - RNA, 22 nt, Salmonella enterica enterica serovar Typhi
ucgcccaccgcauagacgugcg

SEQ ID NO: 1653303 - RNA, 13 nt, Salmonella enterica enterica serovar Typhi
ucgccucccgcac

SEQ ID NO: 1653304 - RNA, 14 nt, Salmonella enterica enterica serovar Typhi
ucgccuccagcgau

SEQ ID NO: 1653305 - RNA, 20 nt, Salmonella enterica enterica serovar Typhi
ucgccguuaacuggcgcauc

SEQ ID NO: 1653306 - RNA, 18 nt, Salmonella enterica enterica serovar Typhi
ucgccguuaacuggcgca

SEQ ID NO: 1653307 - RNA, 22 nt, Salmonella enterica enterica serovar Typhi
ucgccguuaaaccguuaugaau

SEQ ID NO: 1653308 - RNA, 20 nt, Salmonella enterica enterica serovar Typhi
ucgccggaaagaaacgccgc

SEQ ID NO: 1653309 - RNA, 19 nt, Salmonella enterica enterica serovar Typhi
ucgccgccaucggcgcgua

SEQ ID NO: 1653310 - RNA, 17 nt, Salmonella enterica enterica serovar Typhi
ucgcgccagcgaccacc

SEQ ID NO: 1653311 - RNA, 18 nt, Salmonella enterica enterica serovar Typhi
ucgcgccauuugccagau

SEQ ID NO: 1653312 - RNA, 22 nt, Salmonella enterica enterica serovar Typhi
ucgcgcauugcgauaugcuguu

SEQ ID NO: 1653313 - RNA, 13 nt, Salmonella enterica enterica serovar Typhi
ucgcgccagcgac

SEQ ID NO: 1653314 - RNA, 14 nt, Salmonella enterica enterica serovar Typhi
ucgccuguacgcgc

SEQ ID NO: 1653315 - RNA, 15 nt, Salmonella enterica enterica serovar Typhi
ucgccuuccagcgac

SEQ ID NO: 1653316 - RNA, 18 nt, Salmonella enterica enterica serovar Typhi
ucgccugaucgcgcagac

SEQ ID NO: 1653317 - RNA, 13 nt, Salmonella enterica enterica serovar Typhi
ucgccugcaacgc

SEQ ID NO: 1653318 - RNA, 14 nt, Salmonella enterica enterica serovar Typhi
ucgccucuacgggc

SEQ ID NO: 1653319 - RNA, 19 nt, Salmonella enterica enterica serovar Typhi
ucgagcuuuugcugcgcca

SEQ ID NO: 1653320 - RNA, 23 nt, Salmonella enterica enterica serovar Typhi
ucgauccgguuacucgcaucgaa

SEQ ID NO: 1653321 - RNA, 20 nt, Salmonella enterica enterica serovar Typhi
ucgauccgcaucagcaacgc

SEQ ID NO: 1653322 - RNA, 17 nt, Salmonella enterica enterica serovar Typhi
ucgauccccucuuccau

SEQ ID NO: 1653323 - RNA, 14 nt, Salmonella enterica enterica serovar Typhi
ucgauaaccgccga

SEQ ID NO: 1653324 - RNA, 21 nt, Salmonella enterica enterica serovar Typhi
ucgauaaagcgguuaucggca

SEQ ID NO: 1653325 - RNA, 20 nt, Salmonella enterica enterica serovar Typhi
ucgaguucuucacgcugaug

SEQ ID NO: 1653326 - RNA, 14 nt, Salmonella enterica enterica serovar Typhi
ucgauaaacucaug

SEQ ID NO: 1653327 - RNA, 20 nt, Salmonella enterica enterica serovar Typhi
ucgacguugaucgccaucgc

SEQ ID NO: 1653328 - RNA, 14 nt, Salmonella enterica enterica serovar Typhi
uccggucaucgcgg

SEQ ID NO: 1653329 - RNA, 14 nt, Salmonella enterica enterica serovar Typhi
uccgguaucgccgg

SEQ ID NO: 1653330 - RNA, 14 nt, Salmonella enterica enterica serovar Typhi
uccggucugcgcgc

SEQ ID NO: 1653331 - RNA, 22 nt, Salmonella enterica enterica serovar Typhi
uccguaggcggcuaccgccgua

SEQ ID NO: 1653332 - RNA, 22 nt, Salmonella enterica enterica serovar Typhi
uccgguuuuacuauugccgaua

SEQ ID NO: 1653333 - RNA, 22 nt, Salmonella enterica enterica serovar Typhi
uccguagcggauugccgcgcuc

SEQ ID NO: 1653334 - RNA, 21 nt, Salmonella enterica enterica serovar Typhi
uccugccgaugccgccgcaac

SEQ ID NO: 1653335 - RNA, 14 nt, Salmonella enterica enterica serovar Typhi
uccugcgccggacg

SEQ ID NO: 1653336 - RNA, 17 nt, Salmonella enterica enterica serovar Typhi
uccugcgcggauaccgg

SEQ ID NO: 1653337 - RNA, 19 nt, Salmonella enterica enterica serovar Typhi
uccugcaaauagcgcugau

SEQ ID NO: 1653338 - RNA, 23 nt, Salmonella enterica enterica serovar Typhi
uccugaccgggcucacgcuggug

SEQ ID NO: 1653339 - RNA, 17 nt, Salmonella enterica enterica serovar Typhi
ucgaacagcggcaggcg

SEQ ID NO: 1653340 - RNA, 23 nt, Salmonella enterica enterica serovar Typhi
ucgacaugggcgggauccugcaa

SEQ ID NO: 1653341 - RNA, 14 nt, Salmonella enterica enterica serovar Typhi
ucgacaugcguacc

SEQ ID NO: 1653342 - RNA, 15 nt, Salmonella enterica enterica serovar Typhi
uccuggcuugccaga

SEQ ID NO: 1653343 - RNA, 14 nt, Salmonella enterica enterica serovar Typhi
uccuugcagccaga

SEQ ID NO: 1653344 - RNA, 23 nt, Salmonella enterica enterica serovar Typhi
uccuggugcgacaccacgcaggc

SEQ ID NO: 1653345 - RNA, 22 nt, Salmonella enterica enterica serovar Typhi
uccuuguuuuaacggaaucaga

SEQ ID NO: 1653346 - RNA, 15 nt, Salmonella enterica enterica serovar Typhi
uccuuuuuccgccac

SEQ ID NO: 1653347 - RNA, 22 nt, Salmonella enterica enterica serovar Typhi
ucccugagacaggccagaauuc

SEQ ID NO: 1653348 - RNA, 19 nt, Salmonella enterica enterica serovar Typhi
ucccgucauugcgcgcaug

SEQ ID NO: 1653349 - RNA, 15 nt, Salmonella enterica enterica serovar Typhi
ucccgcuggcuggcg

SEQ ID NO: 1653350 - RNA, 22 nt, Salmonella enterica enterica serovar Typhi
ucccgcugugauccauguugcc

SEQ ID NO: 1653351 - RNA, 17 nt, Salmonella enterica enterica serovar Typhi
uccccgcgcaauugcgg

SEQ ID NO: 1653352 - RNA, 11 nt, Salmonella enterica enterica serovar Typhi
uccccggcaac

SEQ ID NO: 1653353 - RNA, 22 nt, Salmonella enterica enterica serovar Typhi
ucccgcgacgucaauaaagccg

SEQ ID NO: 1653354 - RNA, 17 nt, Salmonella enterica enterica serovar Typhi
ucccgccucggucagua

SEQ ID NO: 1653355 - RNA, 17 nt, Salmonella enterica enterica serovar Typhi
uccccagaaugauaaug

SEQ ID NO: 1653356 - RNA, 15 nt, Salmonella enterica enterica serovar Typhi
uccccauaucccgaa

SEQ ID NO: 1653357 - RNA, 13 nt, Salmonella enterica enterica serovar Typhi
uccccaucgcgac

SEQ ID NO: 1653358 - RNA, 19 nt, Salmonella enterica enterica serovar Typhi
uccccaucaggaacaggcg

SEQ ID NO: 1653359 - RNA, 18 nt, Salmonella enterica enterica serovar Typhi
uccccauguugaacggca

SEQ ID NO: 1653360 - RNA, 18 nt, Salmonella enterica enterica serovar Typhi
ucccaugaaacucgacac

SEQ ID NO: 1653361 - RNA, 17 nt, Salmonella enterica enterica serovar Typhi
ucccaucguaacgccgu

SEQ ID NO: 1653362 - RNA, 13 nt, Salmonella enterica enterica serovar Typhi
ucccaucgcgcca

SEQ ID NO: 1653363 - RNA, 19 nt, Salmonella enterica enterica serovar Typhi
ucccagguuucaaugccgc

SEQ ID NO: 1653364 - RNA, 21 nt, Salmonella enterica enterica serovar Typhi
ucccagcaugagugauagcgc

SEQ ID NO: 1653365 - RNA, 18 nt, Salmonella enterica enterica serovar Typhi
ucccaggccggcauaaug

SEQ ID NO: 1653366 - RNA, 17 nt, Salmonella enterica enterica serovar Typhi
ucccacgggcgcaccau

SEQ ID NO: 1653367 - RNA, 21 nt, Salmonella enterica enterica serovar Typhi
uccggcaagucagaccagucg

SEQ ID NO: 1653368 - RNA, 19 nt, Salmonella enterica enterica serovar Typhi
uccggcaccucguccagau

SEQ ID NO: 1653369 - RNA, 17 nt, Salmonella enterica enterica serovar Typhi
uccggcacuacagcguu

SEQ ID NO: 1653370 - RNA, 23 nt, Salmonella enterica enterica serovar Typhi
uccggcacgauaaauugccugau

SEQ ID NO: 1653371 - RNA, 15 nt, Salmonella enterica enterica serovar Typhi
uccgcugaaauagcc

SEQ ID NO: 1653372 - RNA, 16 nt, Salmonella enterica enterica serovar Typhi
uccgcguuuaucgcau

SEQ ID NO: 1653373 - RNA, 18 nt, Salmonella enterica enterica serovar Typhi
uccggccugcaaaccgcc

SEQ ID NO: 1653374 - RNA, 23 nt, Salmonella enterica enterica serovar Typhi
uccggccuaccugagaugaaauc

SEQ ID NO: 1653375 - RNA, 18 nt, Salmonella enterica enterica serovar Typhi
uccggccuguaaggucuc

SEQ ID NO: 1653376 - RNA, 23 nt, Salmonella enterica enterica serovar Typhi
uccggcggugcagguugccugau

SEQ ID NO: 1653377 - RNA, 22 nt, Salmonella enterica enterica serovar Typhi
uccggcgcguucaugcgaaugc

SEQ ID NO: 1653378 - RNA, 18 nt, Salmonella enterica enterica serovar Typhi
uccggcgcuggcgcuggc

SEQ ID NO: 1653379 - RNA, 21 nt, Salmonella enterica enterica serovar Typhi
uccggcggcaaggucugcgcc

SEQ ID NO: 1653380 - RNA, 16 nt, Salmonella enterica enterica serovar Typhi
uccggggaucguucug

SEQ ID NO: 1653381 - RNA, 19 nt, Salmonella enterica enterica serovar Typhi
uccggggucucuacgcggc

SEQ ID NO: 1653382 - RNA, 14 nt, Salmonella enterica enterica serovar Typhi
uccgacaaccggcu

SEQ ID NO: 1653383 - RNA, 14 nt, Salmonella enterica enterica serovar Typhi
uccgcguagcccag

SEQ ID NO: 1653384 - RNA, 18 nt, Salmonella enterica enterica serovar Typhi
uccgcgguacgaaucgcc

SEQ ID NO: 1653385 - RNA, 17 nt, Salmonella enterica enterica serovar Typhi
uccgccuuugacgccgg

SEQ ID NO: 1653386 - RNA, 14 nt, Salmonella enterica enterica serovar Typhi
ucgggaacgcuguc

SEQ ID NO: 1653387 - RNA, 23 nt, Salmonella enterica enterica serovar Typhi
ucggcgcgaaacaggucggcaug

SEQ ID NO: 1653388 - RNA, 13 nt, Salmonella enterica enterica serovar Typhi
ucggcgcgcuggc

SEQ ID NO: 1653389 - RNA, 20 nt, Salmonella enterica enterica serovar Typhi
ucgggcaacugauaugacgu

SEQ ID NO: 1653390 - RNA, 22 nt, Salmonella enterica enterica serovar Typhi
ucgggcaauccauuaauggcgc

SEQ ID NO: 1653391 - RNA, 19 nt, Salmonella enterica enterica serovar Typhi
ucgggcagggaugacagaa

SEQ ID NO: 1653392 - RNA, 19 nt, Salmonella enterica enterica serovar Typhi
ucgggcaggcuuccacgca

SEQ ID NO: 1653393 - RNA, 21 nt, Salmonella enterica enterica serovar Typhi
ucggguacggaauaucccgca

SEQ ID NO: 1653394 - RNA, 16 nt, Salmonella enterica enterica serovar Typhi
ucggggucuuccagca

SEQ ID NO: 1653395 - RNA, 12 nt, Salmonella enterica enterica serovar Typhi
ucgucccagcgc

SEQ ID NO: 1653396 - RNA, 21 nt, Salmonella enterica enterica serovar Typhi
ucgucaaacucuuccgggcug

SEQ ID NO: 1653397 - RNA, 19 nt, Salmonella enterica enterica serovar Typhi
ucguauuggggaucgggca

SEQ ID NO: 1653398 - RNA, 21 nt, Salmonella enterica enterica serovar Typhi
ucgucaaaaccaaacagcgac

SEQ ID NO: 1653399 - RNA, 12 nt, Salmonella enterica enterica serovar Typhi
ucgguuuauccc

SEQ ID NO: 1653400 - RNA, 23 nt, Salmonella enterica enterica serovar Typhi
ucgguugauguaugaacugcauc

SEQ ID NO: 1653401 - RNA, 15 nt, Salmonella enterica enterica serovar Typhi
ucgguuaauugccgg

SEQ ID NO: 1653402 - RNA, 14 nt, Salmonella enterica enterica serovar Typhi
ucgugauagacggc

SEQ ID NO: 1653403 - RNA, 21 nt, Salmonella enterica enterica serovar Typhi
ucgucuggaguacgggcagau

SEQ ID NO: 1653404 - RNA, 15 nt, Salmonella enterica enterica serovar Typhi
ucgucgggauaagcg

SEQ ID NO: 1653405 - RNA, 19 nt, Salmonella enterica enterica serovar Typhi
ucugccaguuaucgguaau

SEQ ID NO: 1653406 - RNA, 22 nt, Salmonella enterica enterica serovar Typhi
ucugcaaugguaaaacgcuggc

SEQ ID NO: 1653407 - RNA, 22 nt, Salmonella enterica enterica serovar Typhi
ucugcagcgagcgcauacgcug

SEQ ID NO: 1653408 - RNA, 14 nt, Salmonella enterica enterica serovar Typhi
ucugcaggucacga

SEQ ID NO: 1653409 - RNA, 14 nt, Salmonella enterica enterica serovar Typhi
ucucuuccgcgguc

SEQ ID NO: 1653410 - RNA, 14 nt, Salmonella enterica enterica serovar Typhi
ucucuugccagcgc

SEQ ID NO: 1653411 - RNA, 21 nt, Salmonella enterica enterica serovar Typhi
ucucuucaugcauaaccgcgc

SEQ ID NO: 1653412 - RNA, 18 nt, Salmonella enterica enterica serovar Typhi
ucugauacugcuccggcg

SEQ ID NO: 1653413 - RNA, 16 nt, Salmonella enterica enterica serovar Typhi
ucugacauucagcgcu

SEQ ID NO: 1653414 - RNA, 14 nt, Salmonella enterica enterica serovar Typhi
ucucucauccgcca

SEQ ID NO: 1653415 - RNA, 15 nt, Salmonella enterica enterica serovar Typhi
ucucugacaggaaug

SEQ ID NO: 1653416 - RNA, 19 nt, Salmonella enterica enterica serovar Typhi
ucucuguccggaauaacuc

SEQ ID NO: 1653417 - RNA, 18 nt, Salmonella enterica enterica serovar Typhi
ucucauuuucuuuacgcu

SEQ ID NO: 1653418 - RNA, 16 nt, Salmonella enterica enterica serovar Typhi
ucucaggacgccagug

SEQ ID NO: 1653419 - RNA, 17 nt, Salmonella enterica enterica serovar Typhi
ucucccaggccgccacc

SEQ ID NO: 1653420 - RNA, 22 nt, Salmonella enterica enterica serovar Typhi
ucucgccauaauuguucagcua

SEQ ID NO: 1653421 - RNA, 12 nt, Salmonella enterica enterica serovar Typhi
ucucgcaggcca

SEQ ID NO: 1653422 - RNA, 15 nt, Salmonella enterica enterica serovar Typhi
ucuccgguaaucacc

SEQ ID NO: 1653423 - RNA, 16 nt, Salmonella enterica enterica serovar Typhi
ugaaauucgacgggac

SEQ ID NO: 1653424 - RNA, 13 nt, Salmonella enterica enterica serovar Typhi
ugaaaucacgcca

SEQ ID NO: 1653425 - RNA, 12 nt, Salmonella enterica enterica serovar Typhi
ugaacaggcagc

SEQ ID NO: 1653426 - RNA, 15 nt, Salmonella enterica enterica serovar Typhi
ugaacauaaagucag

SEQ ID NO: 1653427 - RNA, 14 nt, Salmonella enterica enterica serovar Typhi
ugaacaucuuccag

SEQ ID NO: 1653428 - RNA, 21 nt, Salmonella enterica enterica serovar Typhi
ugaacgauguaucgcgcggau

SEQ ID NO: 1653429 - RNA, 20 nt, Salmonella enterica enterica serovar Typhi
ugaacgagucuuaccagguc

SEQ ID NO: 1653430 - RNA, 20 nt, Salmonella enterica enterica serovar Typhi
ugaaauaauagauugcgcca

SEQ ID NO: 1653431 - RNA, 18 nt, Salmonella enterica enterica serovar Typhi
ugaaauacagccagguug

SEQ ID NO: 1653432 - RNA, 12 nt, Salmonella enterica enterica serovar Typhi
ugaaacucgcca

SEQ ID NO: 1653433 - RNA, 17 nt, Salmonella enterica enterica serovar Typhi
ugaaacguguuuauccc

SEQ ID NO: 1653434 - RNA, 15 nt, Salmonella enterica enterica serovar Typhi
ucuuugaccagcgac

SEQ ID NO: 1653435 - RNA, 22 nt, Salmonella enterica enterica serovar Typhi
ucuuucccggcaauuaccgcca

SEQ ID NO: 1653436 - RNA, 14 nt, Salmonella enterica enterica serovar Typhi
ucuuucaacuuccg

SEQ ID NO: 1653437 - RNA, 14 nt, Salmonella enterica enterica serovar Typhi
ucuuccagcaucag

SEQ ID NO: 1653438 - RNA, 21 nt, Salmonella enterica enterica serovar Typhi
ucuucauaaauagccagcauc

SEQ ID NO: 1653439 - RNA, 14 nt, Salmonella enterica enterica serovar Typhi
ucuucacgacgcuc

SEQ ID NO: 1653440 - RNA, 15 nt, Salmonella enterica enterica serovar Typhi
ucuucguguaacgca

SEQ ID NO: 1653441 - RNA, 21 nt, Salmonella enterica enterica serovar Typhi
ucuuauccgcuuuuaaacggc

SEQ ID NO: 1653442 - RNA, 14 nt, Salmonella enterica enterica serovar Typhi
ucuuauccggccug

SEQ ID NO: 1653443 - RNA, 21 nt, Salmonella enterica enterica serovar Typhi
ucuuaccggugcgauucagcg

SEQ ID NO: 1653444 - RNA, 15 nt, Salmonella enterica enterica serovar Typhi
ucugcugauaauacu

SEQ ID NO: 1653445 - RNA, 15 nt, Salmonella enterica enterica serovar Typhi
ugccagaauacaccg

SEQ ID NO: 1653446 - RNA, 14 nt, Salmonella enterica enterica serovar Typhi
ugcaguuccgcaau

SEQ ID NO: 1653447 - RNA, 18 nt, Salmonella enterica enterica serovar Typhi
ugcauaaaggaguaacag

SEQ ID NO: 1653448 - RNA, 20 nt, Salmonella enterica enterica serovar Typhi
ugcauaaagauuggcaucug

SEQ ID NO: 1653449 - RNA, 16 nt, Salmonella enterica enterica serovar Typhi
ugcauaaugccggauc

SEQ ID NO: 1653450 - RNA, 14 nt, Salmonella enterica enterica serovar Typhi
ugccauugcgacga

SEQ ID NO: 1653451 - RNA, 22 nt, Salmonella enterica enterica serovar Typhi
ugcccagcgcgaccugcauccc

SEQ ID NO: 1653452 - RNA, 20 nt, Salmonella enterica enterica serovar Typhi
ugccagcggccagggcguca

SEQ ID NO: 1653453 - RNA, 17 nt, Salmonella enterica enterica serovar Typhi
ugccaucuccugcgaua

SEQ ID NO: 1653454 - RNA, 14 nt, Salmonella enterica enterica serovar Typhi
ugccaucggccagc

SEQ ID NO: 1653455 - RNA, 15 nt, Salmonella enterica enterica serovar Typhi
ugcccgguggcgcug

SEQ ID NO: 1653456 - RNA, 16 nt, Salmonella enterica enterica serovar Typhi
ugcccgguggcgcugc

SEQ ID NO: 1653457 - RNA, 16 nt, Salmonella enterica enterica serovar Typhi
ugcccgauggcgcugc

SEQ ID NO: 1653458 - RNA, 18 nt, Salmonella enterica enterica serovar Typhi
ugcccaucauucaacgca

SEQ ID NO: 1653459 - RNA, 22 nt, Salmonella enterica enterica serovar Typhi
ugcccaucugacgugcgauagc

SEQ ID NO: 1653460 - RNA, 19 nt, Salmonella enterica enterica serovar Typhi
ugauggcguagcgccauca

SEQ ID NO: 1653461 - RNA, 21 nt, Salmonella enterica enterica serovar Typhi
ugauggcuggcgucgccaaag

SEQ ID NO: 1653462 - RNA, 13 nt, Salmonella enterica enterica serovar Typhi
ugauggcgcgcca

SEQ ID NO: 1653463 - RNA, 19 nt, Salmonella enterica enterica serovar Typhi
ugcacauucagguggcuga

SEQ ID NO: 1653464 - RNA, 14 nt, Salmonella enterica enterica serovar Typhi
ugauguccagcgcg

SEQ ID NO: 1653465 - RNA, 17 nt, Salmonella enterica enterica serovar Typhi
ugcacgguugaagcgac

SEQ ID NO: 1653466 - RNA, 18 nt, Salmonella enterica enterica serovar Typhi
ugcagcaaauaaucguag

SEQ ID NO: 1653467 - RNA, 14 nt, Salmonella enterica enterica serovar Typhi
ugcagauaccagcg

SEQ ID NO: 1653468 - RNA, 14 nt, Salmonella enterica enterica serovar Typhi
ugcagcgccaucca

SEQ ID NO: 1653469 - RNA, 22 nt, Salmonella enterica enterica serovar Typhi
ugcagcgcguccaauagccccu

SEQ ID NO: 1653470 - RNA, 18 nt, Salmonella enterica enterica serovar Typhi
ugcagcgugaaaagcuua

SEQ ID NO: 1653471 - RNA, 18 nt, Salmonella enterica enterica serovar Typhi
ugcaggaaaaacuguccc

SEQ ID NO: 1653472 - RNA, 21 nt, Salmonella enterica enterica serovar Typhi
ugacgggcauuguuaauccag

SEQ ID NO: 1653473 - RNA, 15 nt, Salmonella enterica enterica serovar Typhi
ugacggccaccagcg

SEQ ID NO: 1653474 - RNA, 18 nt, Salmonella enterica enterica serovar Typhi
ugacgcuggaaguaugcc

SEQ ID NO: 1653475 - RNA, 16 nt, Salmonella enterica enterica serovar Typhi
ugacgcuuugcauuau

SEQ ID NO: 1653476 - RNA, 22 nt, Salmonella enterica enterica serovar Typhi
ugacggaggcgggcgcgcaguu

SEQ ID NO: 1653477 - RNA, 12 nt, Salmonella enterica enterica serovar Typhi
ugacgcgcauac

SEQ ID NO: 1653478 - RNA, 22 nt, Salmonella enterica enterica serovar Typhi
ugacgcgccagcggauugccau

SEQ ID NO: 1653479 - RNA, 16 nt, Salmonella enterica enterica serovar Typhi
ugacgaggccuguccc

SEQ ID NO: 1653480 - RNA, 16 nt, Salmonella enterica enterica serovar Typhi
ugacgcacaggcgcgg

SEQ ID NO: 1653481 - RNA, 19 nt, Salmonella enterica enterica serovar Typhi
ugacgcaugauauaaaaug

SEQ ID NO: 1653482 - RNA, 14 nt, Salmonella enterica enterica serovar Typhi
ugacgccaggcaga

SEQ ID NO: 1653483 - RNA, 15 nt, Salmonella enterica enterica serovar Typhi
ugaccugaaaucgcg

SEQ ID NO: 1653484 - RNA, 17 nt, Salmonella enterica enterica serovar Typhi
ugaccgauuuguggcgu

SEQ ID NO: 1653485 - RNA, 19 nt, Salmonella enterica enterica serovar Typhi
ugaccgauuuguggcguua

SEQ ID NO: 1653486 - RNA, 15 nt, Salmonella enterica enterica serovar Typhi
ugaccgaagcaggcg

SEQ ID NO: 1653487 - RNA, 12 nt, Salmonella enterica enterica serovar Typhi
ugaucugcacaa

SEQ ID NO: 1653488 - RNA, 17 nt, Salmonella enterica enterica serovar Typhi
ugaucgucgcgaucgcg

SEQ ID NO: 1653489 - RNA, 13 nt, Salmonella enterica enterica serovar Typhi
ugaucggcuggcg

SEQ ID NO: 1653490 - RNA, 17 nt, Salmonella enterica enterica serovar Typhi
ugaucguaggcggcgga

SEQ ID NO: 1653491 - RNA, 13 nt, Salmonella enterica enterica serovar Typhi
ugaugacgcgcag

SEQ ID NO: 1653492 - RNA, 13 nt, Salmonella enterica enterica serovar Typhi
ugaucgcgcagac

SEQ ID NO: 1653493 - RNA, 23 nt, Salmonella enterica enterica serovar Typhi
ugaucgcggucgcguuauagccg

SEQ ID NO: 1653494 - RNA, 23 nt, Salmonella enterica enterica serovar Typhi
ugagcgcgccaugagacgcguaa

SEQ ID NO: 1653495 - RNA, 18 nt, Salmonella enterica enterica serovar Typhi
ugagcgcauuugcggcgu

SEQ ID NO: 1653496 - RNA, 18 nt, Salmonella enterica enterica serovar Typhi
ugacguuaacgcagcauc

SEQ ID NO: 1653497 - RNA, 21 nt, Salmonella enterica enterica serovar Typhi
ugacucacauaacaaaaccag

SEQ ID NO: 1653498 - RNA, 18 nt, Salmonella enterica enterica serovar Typhi
ugagcgaaacuccagcga

SEQ ID NO: 1653499 - RNA, 17 nt, Salmonella enterica enterica serovar Typhi
ugaggccguuauuguca

SEQ ID NO: 1653500 - RNA, 18 nt, Salmonella enterica enterica serovar Typhi
ugaggcgcugcgacgcgg

SEQ ID NO: 1653501 - RNA, 22 nt, Salmonella enterica enterica serovar Typhi
ugaguucaauaugugcaucggc

SEQ ID NO: 1653502 - RNA, 20 nt, Salmonella enterica enterica serovar Typhi
ugaguuuuccgccauuggcg

SEQ ID NO: 1653503 - RNA, 16 nt, Salmonella enterica enterica serovar Typhi
ugauaaagcuuucauc

SEQ ID NO: 1653504 - RNA, 18 nt, Salmonella enterica enterica serovar Typhi
ugauaaaacgcaggcagu

SEQ ID NO: 1653505 - RNA, 19 nt, Salmonella enterica enterica serovar Typhi
ugauacaugcuacaggcaa

SEQ ID NO: 1653506 - RNA, 15 nt, Salmonella enterica enterica serovar Typhi
ugauaccccagcgau

SEQ ID NO: 1653507 - RNA, 15 nt, Salmonella enterica enterica serovar Typhi
ugauaaucaauggcc

SEQ ID NO: 1653508 - RNA, 22 nt, Salmonella enterica enterica serovar Typhi
ugauaauaugcucaacuuccag

SEQ ID NO: 1653509 - RNA, 16 nt, Salmonella enterica enterica serovar Typhi
uaucgcuuggcguuaa

SEQ ID NO: 1653510 - RNA, 17 nt, Salmonella enterica enterica serovar Typhi
uaucggaaguauacauc

SEQ ID NO: 1653511 - RNA, 20 nt, Salmonella enterica enterica serovar Typhi
uaugccgccauccggcaaac

SEQ ID NO: 1653512 - RNA, 19 nt, Salmonella enterica enterica serovar Typhi
uaugcgccuucuucgcaau

SEQ ID NO: 1653513 - RNA, 18 nt, Salmonella enterica enterica serovar Typhi
uaugcgauuucgucaaac

SEQ ID NO: 1653514 - RNA, 18 nt, Salmonella enterica enterica serovar Typhi
uaugcugcucgaagauga

SEQ ID NO: 1653515 - RNA, 15 nt, Salmonella enterica enterica serovar Typhi
uaucgaaggucaggc

SEQ ID NO: 1653516 - RNA, 16 nt, Salmonella enterica enterica serovar Typhi
uaucgaaggucaggcc

SEQ ID NO: 1653517 - RNA, 14 nt, Salmonella enterica enterica serovar Typhi
uaucgccauuauuc

SEQ ID NO: 1653518 - RNA, 17 nt, Salmonella enterica enterica serovar Typhi
uaucgccaagcgguaag

SEQ ID NO: 1653519 - RNA, 17 nt, Salmonella enterica enterica serovar Typhi
uaucgcugucggucaga

SEQ ID NO: 1653520 - RNA, 20 nt, Salmonella enterica enterica serovar Typhi
uaucgccgaaagcgaucaca

SEQ ID NO: 1653521 - RNA, 19 nt, Salmonella enterica enterica serovar Typhi
uaucgccguucaaacggua

SEQ ID NO: 1653522 - RNA, 20 nt, Salmonella enterica enterica serovar Typhi
uauuccuuguccgaugcaga

SEQ ID NO: 1653523 - RNA, 14 nt, Salmonella enterica enterica serovar Typhi
uauucaucgauacg

SEQ ID NO: 1653524 - RNA, 16 nt, Salmonella enterica enterica serovar Typhi
uauucauuucaaugua

SEQ ID NO: 1653525 - RNA, 11 nt, Salmonella enterica enterica serovar Typhi
uauucccggcc

SEQ ID NO: 1653526 - RNA, 19 nt, Salmonella enterica enterica serovar Typhi
uauuccaguuaucacggua

SEQ ID NO: 1653527 - RNA, 13 nt, Salmonella enterica enterica serovar Typhi
uauuccgcaaacg

SEQ ID NO: 1653528 - RNA, 16 nt, Salmonella enterica enterica serovar Typhi
uauuccggcgacgcuu

SEQ ID NO: 1653529 - RNA, 19 nt, Salmonella enterica enterica serovar Typhi
uauucacuuuccgaaucag

SEQ ID NO: 1653530 - RNA, 15 nt, Salmonella enterica enterica serovar Typhi
uaugugacaaucacu

SEQ ID NO: 1653531 - RNA, 21 nt, Salmonella enterica enterica serovar Typhi
uaugugccgaugaacgacgcu

SEQ ID NO: 1653532 - RNA, 14 nt, Salmonella enterica enterica serovar Typhi
uauuuuccaucacg

SEQ ID NO: 1653533 - RNA, 14 nt, Salmonella enterica enterica serovar Typhi
uauuucgccuauca

SEQ ID NO: 1653534 - RNA, 21 nt, Salmonella enterica enterica serovar Typhi
uauugauaccuuuaaccucuu

SEQ ID NO: 1653535 - RNA, 16 nt, Salmonella enterica enterica serovar Typhi
uauuuauaucaggcaa

SEQ ID NO: 1653536 - RNA, 11 nt, Salmonella enterica enterica serovar Typhi
uauuuaccgcu

SEQ ID NO: 1653537 - RNA, 17 nt, Salmonella enterica enterica serovar Typhi
uauuuuuucaggaaguu

SEQ ID NO: 1653538 - RNA, 14 nt, Salmonella enterica enterica serovar Typhi
ucaacacauuccau

SEQ ID NO: 1653539 - RNA, 16 nt, Salmonella enterica enterica serovar Typhi
ucaacagacauauccc

SEQ ID NO: 1653540 - RNA, 14 nt, Salmonella enterica enterica serovar Typhi
ucaacagcaaaacg

SEQ ID NO: 1653541 - RNA, 16 nt, Salmonella enterica enterica serovar Typhi
ucaaccaaugcaacgc

SEQ ID NO: 1653542 - RNA, 19 nt, Salmonella enterica enterica serovar Typhi
ucaaccaccaaaaagccac

SEQ ID NO: 1653543 - RNA, 17 nt, Salmonella enterica enterica serovar Typhi
ucaacagggguuccggc

SEQ ID NO: 1653544 - RNA, 19 nt, Salmonella enterica enterica serovar Typhi
ucaacagggguuccggcaa

SEQ ID NO: 1653545 - RNA, 21 nt, Salmonella enterica enterica serovar Typhi
ucaacauacgccgccagccac

SEQ ID NO: 1653546 - RNA, 22 nt, Salmonella enterica enterica serovar Typhi
ucaacaucagcgcuaccagcgc

SEQ ID NO: 1653547 - RNA, 19 nt, Salmonella enterica enterica serovar Typhi
ucaacaucauuaagccggg

SEQ ID NO: 1653548 - RNA, 24 nt, Salmonella enterica enterica serovar Typhi
uagucaggaucgcuggcgcguuca

SEQ ID NO: 1653549 - RNA, 16 nt, Salmonella enterica enterica serovar Typhi
uagucauauuaucgcg

SEQ ID NO: 1653550 - RNA, 22 nt, Salmonella enterica enterica serovar Typhi
uagucaggaucgcuggcgcguu

SEQ ID NO: 1653551 - RNA, 16 nt, Salmonella enterica enterica serovar Typhi
uagucgauccccaacg

SEQ ID NO: 1653552 - RNA, 22 nt, Salmonella enterica enterica serovar Typhi
uaguccuuaccccugcggcuga

SEQ ID NO: 1653553 - RNA, 13 nt, Salmonella enterica enterica serovar Typhi
uagucguugcgcc

SEQ ID NO: 1653554 - RNA, 22 nt, Salmonella enterica enterica serovar Typhi
uaguugucggcggucgcggcaa

SEQ ID NO: 1653555 - RNA, 20 nt, Salmonella enterica enterica serovar Typhi
uaggucggauaaggcguuua

SEQ ID NO: 1653556 - RNA, 15 nt, Salmonella enterica enterica serovar Typhi
uagcuuagcugcgca

SEQ ID NO: 1653557 - RNA, 18 nt, Salmonella enterica enterica serovar Typhi
uagcuuaucgggccuacc

SEQ ID NO: 1653558 - RNA, 18 nt, Salmonella enterica enterica serovar Typhi
uagguucguagcgcaaau

SEQ ID NO: 1653559 - RNA, 14 nt, Salmonella enterica enterica serovar Typhi
uauccacagcgaau

SEQ ID NO: 1653560 - RNA, 12 nt, Salmonella enterica enterica serovar Typhi
uaucauuuccac

SEQ ID NO: 1653561 - RNA, 13 nt, Salmonella enterica enterica serovar Typhi
uaucauuuccaca

SEQ ID NO: 1653562 - RNA, 20 nt, Salmonella enterica enterica serovar Typhi
uaucaugaaugccccagcgc

SEQ ID NO: 1653563 - RNA, 12 nt, Salmonella enterica enterica serovar Typhi
uauccuuaucag

SEQ ID NO: 1653564 - RNA, 15 nt, Salmonella enterica enterica serovar Typhi
uauccuggcagucca

SEQ ID NO: 1653565 - RNA, 18 nt, Salmonella enterica enterica serovar Typhi
uauccagaaucacaucgu

SEQ ID NO: 1653566 - RNA, 18 nt, Salmonella enterica enterica serovar Typhi
uaucaaaaaaaaccagau

SEQ ID NO: 1653567 - RNA, 23 nt, Salmonella enterica enterica serovar Typhi
uaucaaacugaaaaucaaauaag

SEQ ID NO: 1653568 - RNA, 19 nt, Salmonella enterica enterica serovar Typhi
uaucaauguauuguucaug

SEQ ID NO: 1653569 - RNA, 18 nt, Salmonella enterica enterica serovar Typhi
uaucacacauaucgccag

SEQ ID NO: 1653570 - RNA, 16 nt, Salmonella enterica enterica serovar Typhi
uauaaggucgauaucg

SEQ ID NO: 1653571 - RNA, 15 nt, Salmonella enterica enterica serovar Typhi
uauaggcauguuccu

SEQ ID NO: 1653572 - RNA, 20 nt, Salmonella enterica enterica serovar Typhi
uauaggccugauaaacguag

SEQ ID NO: 1653573 - RNA, 21 nt, Salmonella enterica enterica serovar Typhi
uauauaacauauagcagcagu

SEQ ID NO: 1653574 - RNA, 20 nt, Salmonella enterica enterica serovar Typhi
uacuucacaaucagcgcaau

SEQ ID NO: 1653575 - RNA, 13 nt, Salmonella enterica enterica serovar Typhi
uacuuaccggcgc

SEQ ID NO: 1653576 - RNA, 17 nt, Salmonella enterica enterica serovar Typhi
uacuauuuuucacccua

SEQ ID NO: 1653577 - RNA, 22 nt, Salmonella enterica enterica serovar Typhi
uacgcuuuauucugucgccacc

SEQ ID NO: 1653578 - RNA, 21 nt, Salmonella enterica enterica serovar Typhi
uacggcaaacacaaucacgcc

SEQ ID NO: 1653579 - RNA, 15 nt, Salmonella enterica enterica serovar Typhi
uacggcaaacgcugg

SEQ ID NO: 1653580 - RNA, 19 nt, Salmonella enterica enterica serovar Typhi
uacgcuuaucaggccuaca

SEQ ID NO: 1653581 - RNA, 19 nt, Salmonella enterica enterica serovar Typhi
uacgcuuuauucugucgcc

SEQ ID NO: 1653582 - RNA, 17 nt, Salmonella enterica enterica serovar Typhi
uacgcuucguugccccg

SEQ ID NO: 1653583 - RNA, 18 nt, Salmonella enterica enterica serovar Typhi
uagaaugcuucuucgcca

SEQ ID NO: 1653584 - RNA, 13 nt, Salmonella enterica enterica serovar Typhi
uagaacgcggaag

SEQ ID NO: 1653585 - RNA, 22 nt, Salmonella enterica enterica serovar Typhi
uagaaauugcagggugcagcaa

SEQ ID NO: 1653586 - RNA, 15 nt, Salmonella enterica enterica serovar Typhi
uagagagggccgcaa

SEQ ID NO: 1653587 - RNA, 15 nt, Salmonella enterica enterica serovar Typhi
uagagcaucgcggca

SEQ ID NO: 1653588 - RNA, 18 nt, Salmonella enterica enterica serovar Typhi
uagcgaucgagauaagau

SEQ ID NO: 1653589 - RNA, 13 nt, Salmonella enterica enterica serovar Typhi
uagcgaucgcgcc

SEQ ID NO: 1653590 - RNA, 20 nt, Salmonella enterica enterica serovar Typhi
uagcgcagucaagcuugccg

SEQ ID NO: 1653591 - RNA, 13 nt, Salmonella enterica enterica serovar Typhi
uagcgucccggca

SEQ ID NO: 1653592 - RNA, 19 nt, Salmonella enterica enterica serovar Typhi
uagcguauaguacgauagc

SEQ ID NO: 1653593 - RNA, 13 nt, Salmonella enterica enterica serovar Typhi
uagcgucaacgcu

SEQ ID NO: 1653594 - RNA, 16 nt, Salmonella enterica enterica serovar Typhi
uagcgguaagagcguu

SEQ ID NO: 1653595 - RNA, 13 nt, Salmonella enterica enterica serovar Typhi
uagcggcgcagac

SEQ ID NO: 1653596 - RNA, 22 nt, Salmonella enterica enterica serovar Typhi
uagcgcgaaugauuuuacgguc

SEQ ID NO: 1653597 - RNA, 18 nt, Salmonella enterica enterica serovar Typhi
uagcgcgcccaugccgcc

SEQ ID NO: 1653598 - RNA, 16 nt, Salmonella enterica enterica serovar Typhi
uagcgccuaugcuguc

SEQ ID NO: 1653599 - RNA, 16 nt, Salmonella enterica enterica serovar Typhi
uagccacucacggcaa

SEQ ID NO: 1653600 - RNA, 15 nt, Salmonella enterica enterica serovar Typhi
uagccacagcgguua

SEQ ID NO: 1653601 - RNA, 21 nt, Salmonella enterica enterica serovar Typhi
uagccagccaaacaauauccc

SEQ ID NO: 1653602 - RNA, 14 nt, Salmonella enterica enterica serovar Typhi
uagccagccauggc

SEQ ID NO: 1653603 - RNA, 13 nt, Salmonella enterica enterica serovar Typhi
uagcccacaggua

SEQ ID NO: 1653604 - RNA, 19 nt, Salmonella enterica enterica serovar Typhi
uagcccgcuucacgcgcgg

SEQ ID NO: 1653605 - RNA, 17 nt, Salmonella enterica enterica serovar Typhi
uagccccagcgcaaacg

SEQ ID NO: 1653606 - RNA, 14 nt, Salmonella enterica enterica serovar Typhi
uagcauugccguca

SEQ ID NO: 1653607 - RNA, 20 nt, Salmonella enterica enterica serovar Typhi
uagcaucccgcaggcggcga

SEQ ID NO: 1653608 - RNA, 20 nt, Salmonella enterica enterica serovar Typhi
uagcaucgacccuugcgacc

SEQ ID NO: 1653609 - RNA, 12 nt, Salmonella enterica enterica serovar Typhi
uagaugcgucgc

SEQ ID NO: 1653610 - RNA, 13 nt, Salmonella enterica enterica serovar Typhi
uaccucgccgacg

SEQ ID NO: 1653611 - RNA, 23 nt, Salmonella enterica enterica serovar Typhi
uaccguuugucuucugccagcaa

SEQ ID NO: 1653612 - RNA, 18 nt, Salmonella enterica enterica serovar Typhi
uaccuacaccaacggcga

SEQ ID NO: 1653613 - RNA, 19 nt, Salmonella enterica enterica serovar Typhi
uacgcugcuauccggcaac

SEQ ID NO: 1653614 - RNA, 14 nt, Salmonella enterica enterica serovar Typhi
uacgcuuacccggc

SEQ ID NO: 1653615 - RNA, 23 nt, Salmonella enterica enterica serovar Typhi
uacgcuuauagguguaaaccguu

SEQ ID NO: 1653616 - RNA, 16 nt, Salmonella enterica enterica serovar Typhi
uacgccguuccagccg

SEQ ID NO: 1653617 - RNA, 14 nt, Salmonella enterica enterica serovar Typhi
uacgcccacgcggc

SEQ ID NO: 1653618 - RNA, 13 nt, Salmonella enterica enterica serovar Typhi
uaccggcaaccgg

SEQ ID NO: 1653619 - RNA, 14 nt, Salmonella enterica enterica serovar Typhi
uaccgcuuuaucau

SEQ ID NO: 1653620 - RNA, 23 nt, Salmonella enterica enterica serovar Typhi
uaccgcuuaacagcguacaggcg

SEQ ID NO: 1653621 - RNA, 13 nt, Salmonella enterica enterica serovar Typhi
uaccgccaaucaa

SEQ ID NO: 1653622 - RNA, 19 nt, Salmonella enterica enterica serovar Typhi
uaccguaaauuuguuuauc

SEQ ID NO: 1653623 - RNA, 17 nt, Salmonella enterica enterica serovar Typhi
uaccgucgccgacaacg

SEQ ID NO: 1653624 - RNA, 14 nt, Salmonella enterica enterica serovar Typhi
uaccagugcagaug

SEQ ID NO: 1653625 - RNA, 19 nt, Salmonella enterica enterica serovar Typhi
uacccacuucuuccagcgu

SEQ ID NO: 1653626 - RNA, 19 nt, Salmonella enterica enterica serovar Typhi
uacccaccguaucgacaua

SEQ ID NO: 1653627 - RNA, 22 nt, Salmonella enterica enterica serovar Typhi
uacccaguagcagacagccgau

SEQ ID NO: 1653628 - RNA, 13 nt, Salmonella enterica enterica serovar Typhi
uaccauaucgccg

SEQ ID NO: 1653629 - RNA, 22 nt, Salmonella enterica enterica serovar Typhi
uaccaucuggccuacgcgcuca

SEQ ID NO: 1653630 - RNA, 17 nt, Salmonella enterica enterica serovar Typhi
uacccgcccagaucagg

SEQ ID NO: 1653631 - RNA, 13 nt, Salmonella enterica enterica serovar Typhi
uacccgguaauac

SEQ ID NO: 1653632 - RNA, 15 nt, Salmonella enterica enterica serovar Typhi
uacccuuuacacguu

SEQ ID NO: 1653633 - RNA, 22 nt, Salmonella enterica enterica serovar Typhi
uaccgaaggcgcuuuuggcguc

SEQ ID NO: 1653634 - RNA, 21 nt, Salmonella enterica enterica serovar Typhi
uaccgcaauaaacacgauggc

SEQ ID NO: 1653635 - RNA, 14 nt, Salmonella enterica enterica serovar Typhi
uaccgauagcgcgg

SEQ ID NO: 1653636 - RNA, 19 nt, Salmonella enterica enterica serovar Typhi
uaccgauaauuaagccggu

SEQ ID NO: 1653637 - RNA, 21 nt, Salmonella enterica enterica serovar Typhi
ucagggacgauaggcgcguca

SEQ ID NO: 1653638 - RNA, 17 nt, Salmonella enterica enterica serovar Typhi
ucagggcggaacagcgg

SEQ ID NO: 1653639 - RNA, 21 nt, Salmonella enterica enterica serovar Typhi
ucaggccgccgcaaaagccgg

SEQ ID NO: 1653640 - RNA, 17 nt, Salmonella enterica enterica serovar Typhi
ucaggccuaccaucgcg

SEQ ID NO: 1653641 - RNA, 12 nt, Salmonella enterica enterica serovar Typhi
ucaggcgugaug

SEQ ID NO: 1653642 - RNA, 16 nt, Salmonella enterica enterica serovar Typhi
ucaggcgcgcgcugug

SEQ ID NO: 1653643 - RNA, 16 nt, Salmonella enterica enterica serovar Typhi
ucaggcgcauaucgcc

SEQ ID NO: 1653644 - RNA, 16 nt, Salmonella enterica enterica serovar Typhi
ucagucagucccgggc

SEQ ID NO: 1653645 - RNA, 17 nt, Salmonella enterica enterica serovar Typhi
ucaguaugaugaccugg

SEQ ID NO: 1653646 - RNA, 21 nt, Salmonella enterica enterica serovar Typhi
ucaguaagcguaccauuccau

SEQ ID NO: 1653647 - RNA, 13 nt, Salmonella enterica enterica serovar Typhi
ucaguaagcguac

SEQ ID NO: 1653648 - RNA, 23 nt, Salmonella enterica enterica serovar Typhi
ucaguaaaagcccgcccagcauu

SEQ ID NO: 1653649 - RNA, 21 nt, Salmonella enterica enterica serovar Typhi
ucaguggaaaacagcauaaua

SEQ ID NO: 1653650 - RNA, 13 nt, Salmonella enterica enterica serovar Typhi
ucaguuccgccag

SEQ ID NO: 1653651 - RNA, 22 nt, Salmonella enterica enterica serovar Typhi
ucaguucgccacgaucggcaau

SEQ ID NO: 1653652 - RNA, 17 nt, Salmonella enterica enterica serovar Typhi
ucauauugcccaucgcg

SEQ ID NO: 1653653 - RNA, 13 nt, Salmonella enterica enterica serovar Typhi
ucaucaaguaccg

SEQ ID NO: 1653654 - RNA, 18 nt, Salmonella enterica enterica serovar Typhi
ucaucacgaucgagucag

SEQ ID NO: 1653655 - RNA, 19 nt, Salmonella enterica enterica serovar Typhi
ucauccgcccggcaucaag

SEQ ID NO: 1653656 - RNA, 19 nt, Salmonella enterica enterica serovar Typhi
ucauccgcgcuuuaugcag

SEQ ID NO: 1653657 - RNA, 11 nt, Salmonella enterica enterica serovar Typhi
ucaucgcgcca

SEQ ID NO: 1653658 - RNA, 15 nt, Salmonella enterica enterica serovar Typhi
ucauccggcaagcgc

SEQ ID NO: 1653659 - RNA, 17 nt, Salmonella enterica enterica serovar Typhi
ucaucgcuugcccagca

SEQ ID NO: 1653660 - RNA, 16 nt, Salmonella enterica enterica serovar Typhi
uccaacuguacgccac

SEQ ID NO: 1653661 - RNA, 23 nt, Salmonella enterica enterica serovar Typhi
uccaacagaaggcuucacgccac

SEQ ID NO: 1653662 - RNA, 12 nt, Salmonella enterica enterica serovar Typhi
ucauggcguaaa

SEQ ID NO: 1653663 - RNA, 16 nt, Salmonella enterica enterica serovar Typhi
ucaugcccggcaaacg

SEQ ID NO: 1653664 - RNA, 17 nt, Salmonella enterica enterica serovar Typhi
ucaugcgaaugcaaccg

SEQ ID NO: 1653665 - RNA, 18 nt, Salmonella enterica enterica serovar Typhi
ucaugaucgauccgcauc

SEQ ID NO: 1653666 - RNA, 15 nt, Salmonella enterica enterica serovar Typhi
ucaugcccggcaaac

SEQ ID NO: 1653667 - RNA, 20 nt, Salmonella enterica enterica serovar Typhi
uccaccuuaucaagcgauac

SEQ ID NO: 1653668 - RNA, 22 nt, Salmonella enterica enterica serovar Typhi
uccaccacguuaccgcgcaguu

SEQ ID NO: 1653669 - RNA, 20 nt, Salmonella enterica enterica serovar Typhi
uccagcuguuuaagcgccuc

SEQ ID NO: 1653670 - RNA, 12 nt, Salmonella enterica enterica serovar Typhi
uccagcgcgucc

SEQ ID NO: 1653671 - RNA, 17 nt, Salmonella enterica enterica serovar Typhi
uccagcgcgccgucauc

SEQ ID NO: 1653672 - RNA, 16 nt, Salmonella enterica enterica serovar Typhi
uccaggccaagcgccu

SEQ ID NO: 1653673 - RNA, 17 nt, Salmonella enterica enterica serovar Typhi
uccagccagcguuucug

SEQ ID NO: 1653674 - RNA, 20 nt, Salmonella enterica enterica serovar Typhi
uccagcagguaacguuucag

SEQ ID NO: 1653675 - RNA, 21 nt, Salmonella enterica enterica serovar Typhi
uccacgucauaacgcgcauuc

SEQ ID NO: 1653676 - RNA, 10 nt, Salmonella enterica enterica serovar Typhi
uccacgguuc

SEQ ID NO: 1653677 - RNA, 19 nt, Salmonella enterica enterica serovar Typhi
uccacgucgcacgccauca

SEQ ID NO: 1653678 - RNA, 14 nt, Salmonella enterica enterica serovar Typhi
uccacgcagacgcc

SEQ ID NO: 1653679 - RNA, 17 nt, Salmonella enterica enterica serovar Typhi
ucaaccacucgcguacc

SEQ ID NO: 1653680 - RNA, 16 nt, Salmonella enterica enterica serovar Typhi
ucaacgccaagcgcgg

SEQ ID NO: 1653681 - RNA, 18 nt, Salmonella enterica enterica serovar Typhi
ucaacgcgaccggauaac

SEQ ID NO: 1653682 - RNA, 19 nt, Salmonella enterica enterica serovar Typhi
ucaccauuacuaacacguu

SEQ ID NO: 1653683 - RNA, 18 nt, Salmonella enterica enterica serovar Typhi
ucaccaguagcgcgacgc

SEQ ID NO: 1653684 - RNA, 23 nt, Salmonella enterica enterica serovar Typhi
ucaccacgccuaaugaagcgcgu

SEQ ID NO: 1653685 - RNA, 17 nt, Salmonella enterica enterica serovar Typhi
ucaccaccgcaggcagc

SEQ ID NO: 1653686 - RNA, 13 nt, Salmonella enterica enterica serovar Typhi
ucaccuccgccac

SEQ ID NO: 1653687 - RNA, 17 nt, Salmonella enterica enterica serovar Typhi
ucaccucaucaacgcca

SEQ ID NO: 1653688 - RNA, 12 nt, Salmonella enterica enterica serovar Typhi
ucaccuccgcca

SEQ ID NO: 1653689 - RNA, 13 nt, Salmonella enterica enterica serovar Typhi
ucaccgggcgcug

SEQ ID NO: 1653690 - RNA, 22 nt, Salmonella enterica enterica serovar Typhi
ucacccagacugugauggcggu

SEQ ID NO: 1653691 - RNA, 19 nt, Salmonella enterica enterica serovar Typhi
ucacccaggcgaugcgcgg

SEQ ID NO: 1653692 - RNA, 22 nt, Salmonella enterica enterica serovar Typhi
ucacccacaucagcggcacaua

SEQ ID NO: 1653693 - RNA, 16 nt, Salmonella enterica enterica serovar Typhi
ucacccggauacgcgg

SEQ ID NO: 1653694 - RNA, 15 nt, Salmonella enterica enterica serovar Typhi
ucacccugcaacauu

SEQ ID NO: 1653695 - RNA, 22 nt, Salmonella enterica enterica serovar Typhi
ucagcagaguguccauaaagug

SEQ ID NO: 1653696 - RNA, 19 nt, Salmonella enterica enterica serovar Typhi
ucagcagccgggccagacg

SEQ ID NO: 1653697 - RNA, 17 nt, Salmonella enterica enterica serovar Typhi
ucagcgcggcagccgga

SEQ ID NO: 1653698 - RNA, 21 nt, Salmonella enterica enterica serovar Typhi
ucagcgaucugucgccgcgua

SEQ ID NO: 1653699 - RNA, 22 nt, Salmonella enterica enterica serovar Typhi
ucagcgauauuacuuuccagca

SEQ ID NO: 1653700 - RNA, 20 nt, Salmonella enterica enterica serovar Typhi
ucagcgccaccacaaacgcc

SEQ ID NO: 1653701 - RNA, 18 nt, Salmonella enterica enterica serovar Typhi
ucagcgcccgauaaaucg

SEQ ID NO: 1653702 - RNA, 12 nt, Salmonella enterica enterica serovar Typhi
ucacugccgccc

SEQ ID NO: 1653703 - RNA, 21 nt, Salmonella enterica enterica serovar Typhi
ucagacauauacucuucgcca

SEQ ID NO: 1653704 - RNA, 21 nt, Salmonella enterica enterica serovar Typhi
ucagacaaguagccugccagc

SEQ ID NO: 1653705 - RNA, 21 nt, Salmonella enterica enterica serovar Typhi
ucagacagaucgguuuauccc

SEQ ID NO: 1653706 - RNA, 21 nt, Salmonella enterica enterica serovar Typhi
ucagacgccgcgcugcggcgu

SEQ ID NO: 1653707 - RNA, 20 nt, Salmonella enterica enterica serovar Typhi
ucagaccggcaaucaauaca

SEQ ID NO: 1653708 - RNA, 21 nt, Salmonella enterica enterica serovar Typhi
ucagaccgugcuuuugcagau

SEQ ID NO: 1653709 - RNA, 18 nt, Salmonella enterica enterica serovar Typhi
ucagaccgagacccagcg

SEQ ID NO: 1653710 - RNA, 19 nt, Salmonella enterica enterica serovar Typhi
ucagcaagaaguuccgcuu

SEQ ID NO: 1653711 - RNA, 22 nt, Salmonella enterica enterica serovar Typhi
ucagcaaaauaccggcagcggu

SEQ ID NO: 1653712 - RNA, 15 nt, Salmonella enterica enterica serovar Typhi
ucagcaaaaucacgc

SEQ ID NO: 1653713 - RNA, 22 nt, Salmonella enterica enterica serovar Typhi
ucagcacaucagccguaucuuc

SEQ ID NO: 1653714 - RNA, 21 nt, Salmonella enterica enterica serovar Typhi
ucagcaauuucucgcccgcca

SEQ ID NO: 1653715 - RNA, 20 nt, Salmonella enterica enterica serovar Typhi
ucacguccugguuaccgcgc

SEQ ID NO: 1653716 - RNA, 18 nt, Salmonella enterica enterica serovar Typhi
ucacgcggauugccgccc

SEQ ID NO: 1653717 - RNA, 12 nt, Salmonella enterica enterica serovar Typhi
ucacgcgcagac

SEQ ID NO: 1653718 - RNA, 23 nt, Salmonella enterica enterica serovar Typhi
ucacgcgcgcgaaacgcacccgc

SEQ ID NO: 1653719 - RNA, 23 nt, Salmonella enterica enterica serovar Typhi
gugauccaccaccagcaucacgu

SEQ ID NO: 1653720 - RNA, 13 nt, Salmonella enterica enterica serovar Typhi
gugauccguaauc

SEQ ID NO: 1653721 - RNA, 23 nt, Salmonella enterica enterica serovar Typhi
gugauaucgguaagcgccugcug

SEQ ID NO: 1653722 - RNA, 13 nt, Salmonella enterica enterica serovar Typhi
gugaucugcgccg

SEQ ID NO: 1653723 - RNA, 14 nt, Salmonella enterica enterica serovar Typhi
gugauggcggucaa

SEQ ID NO: 1653724 - RNA, 16 nt, Salmonella enterica enterica serovar Typhi
gugauuaacagcgcca

SEQ ID NO: 1653725 - RNA, 23 nt, Salmonella enterica enterica serovar Typhi
gugauuaacagcgccaucaggaa

SEQ ID NO: 1653726 - RNA, 19 nt, Salmonella enterica enterica serovar Typhi
gugauuucaugcggugcau

SEQ ID NO: 1653727 - RNA, 18 nt, Salmonella enterica enterica serovar Typhi
gugcaguauugcaccagg

SEQ ID NO: 1653728 - RNA, 22 nt, Salmonella enterica enterica serovar Typhi
aagugccagggcggaagcagau

SEQ ID NO: 1653729 - RNA, 17 nt, Salmonella enterica enterica serovar Typhi
gugccugacagcaauga

SEQ ID NO: 1653730 - RNA, 23 nt, Salmonella enterica enterica serovar Typhi
gugccgaaaucaucaauggcgau

SEQ ID NO: 1653731 - RNA, 13 nt, Salmonella enterica enterica serovar Typhi
gugcgcauccgga

SEQ ID NO: 1653732 - RNA, 22 nt, Salmonella enterica enterica serovar Typhi
gugcuauacaguaaaacgccaa

SEQ ID NO: 1653733 - RNA, 18 nt, Salmonella enterica enterica serovar Typhi
gugcuaucaggccuacaa

SEQ ID NO: 1653734 - RNA, 15 nt, Salmonella enterica enterica serovar Typhi
gugcguucuuccacu

SEQ ID NO: 1653735 - RNA, 19 nt, Salmonella enterica enterica serovar Typhi
guggcgcugucgcuuaccg

SEQ ID NO: 1653736 - RNA, 19 nt, Salmonella enterica enterica serovar Typhi
guggcgcggacgcuuaccg

SEQ ID NO: 1653737 - RNA, 20 nt, Salmonella enterica enterica serovar Typhi
guggcgcuggccgaauagcu

SEQ ID NO: 1653738 - RNA, 18 nt, Salmonella enterica enterica serovar Typhi
guggcgcugcgcuuaccg

SEQ ID NO: 1653739 - RNA, 21 nt, Salmonella enterica enterica serovar Typhi
guggcugaggccgcucgccau

SEQ ID NO: 1653740 - RNA, 23 nt, Salmonella enterica enterica serovar Typhi
gugggauugcaguagaucgacau

SEQ ID NO: 1653741 - RNA, 15 nt, Salmonella enterica enterica serovar Typhi
guggcgguaccggca

SEQ ID NO: 1653742 - RNA, 18 nt, Salmonella enterica enterica serovar Typhi
guggcgcugugcuuaccg

SEQ ID NO: 1653743 - RNA, 21 nt, Salmonella enterica enterica serovar Typhi
guggcgaaauugguagacgca

SEQ ID NO: 1653744 - RNA, 15 nt, Salmonella enterica enterica serovar Typhi
guggccgcgcaaggc

SEQ ID NO: 1653745 - RNA, 21 nt, Salmonella enterica enterica serovar Typhi
guggccagcaugcccgccagc

SEQ ID NO: 1653746 - RNA, 22 nt, Salmonella enterica enterica serovar Typhi
guggccaggaauaaaggucaca

SEQ ID NO: 1653747 - RNA, 13 nt, Salmonella enterica enterica serovar Typhi
gugcuggcgcuga

SEQ ID NO: 1653748 - RNA, 22 nt, Salmonella enterica enterica serovar Typhi
gugucuucccugaccagcgacg

SEQ ID NO: 1653749 - RNA, 17 nt, Salmonella enterica enterica serovar Typhi
guguucaugcagccaua

SEQ ID NO: 1653750 - RNA, 16 nt, Salmonella enterica enterica serovar Typhi
guggugcgcauccgga

SEQ ID NO: 1653751 - RNA, 23 nt, Salmonella enterica enterica serovar Typhi
guggugcgcauccggaaucgccg

SEQ ID NO: 1653752 - RNA, 18 nt, Salmonella enterica enterica serovar Typhi
guguaccagcagcgccag

SEQ ID NO: 1653753 - RNA, 20 nt, Salmonella enterica enterica serovar Typhi
guguaaucgcgguagcgcac

SEQ ID NO: 1653754 - RNA, 16 nt, Salmonella enterica enterica serovar Typhi
guggugagcucaucca

SEQ ID NO: 1653755 - RNA, 24 nt, Salmonella enterica enterica serovar Typhi
guuacgcgcugcaaauacugcuuu

SEQ ID NO: 1653756 - RNA, 21 nt, Salmonella enterica enterica serovar Typhi
aaguguguaccagcagcgcca

SEQ ID NO: 1653757 - RNA, 19 nt, Salmonella enterica enterica serovar Typhi
guuacccagccugauggcg

SEQ ID NO: 1653758 - RNA, 14 nt, Salmonella enterica enterica serovar Typhi
guuaccccaucauu

SEQ ID NO: 1653759 - RNA, 16 nt, Salmonella enterica enterica serovar Typhi
guuaccccgcagcgaa

SEQ ID NO: 1653760 - RNA, 16 nt, Salmonella enterica enterica serovar Typhi
guuaccggcuccggca

SEQ ID NO: 1653761 - RNA, 13 nt, Salmonella enterica enterica serovar Typhi
aaguucagggcga

SEQ ID NO: 1653762 - RNA, 21 nt, Salmonella enterica enterica serovar Typhi
guuaaucacuuuuaccggcgu

SEQ ID NO: 1653763 - RNA, 19 nt, Salmonella enterica enterica serovar Typhi
guuaagaggauugcguaau

SEQ ID NO: 1653764 - RNA, 19 nt, Salmonella enterica enterica serovar Typhi
guuaacgccguuaccagca

SEQ ID NO: 1653765 - RNA, 19 nt, Salmonella enterica enterica serovar Typhi
guuaaggggcaggcgucaa

SEQ ID NO: 1653766 - RNA, 17 nt, Salmonella enterica enterica serovar Typhi
guuaauaccagcgccaa

SEQ ID NO: 1653767 - RNA, 12 nt, Salmonella enterica enterica serovar Typhi
guuaauacgccg

SEQ ID NO: 1653768 - RNA, 19 nt, Salmonella enterica enterica serovar Typhi
guuaacaucaucaggccug

SEQ ID NO: 1653769 - RNA, 21 nt, Salmonella enterica enterica serovar Typhi
guuaaauccucccaucgagcc

SEQ ID NO: 1653770 - RNA, 23 nt, Salmonella enterica enterica serovar Typhi
guuaacagacccgcuuucgcgua

SEQ ID NO: 1653771 - RNA, 16 nt, Salmonella enterica enterica serovar Typhi
guugaauauuggcauc

SEQ ID NO: 1653772 - RNA, 18 nt, Salmonella enterica enterica serovar Typhi
guucugaggcuauuguca

SEQ ID NO: 1653773 - RNA, 21 nt, Salmonella enterica enterica serovar Typhi
guucuaucagguaucccgcca

SEQ ID NO: 1653774 - RNA, 18 nt, Salmonella enterica enterica serovar Typhi
guucgguaucgcgccagg

SEQ ID NO: 1653775 - RNA, 14 nt, Salmonella enterica enterica serovar Typhi
guucguagcccaua

SEQ ID NO: 1653776 - RNA, 22 nt, Salmonella enterica enterica serovar Typhi
guucgcguauuggcgcgaucag

SEQ ID NO: 1653777 - RNA, 20 nt, Salmonella enterica enterica serovar Typhi
guucgccgggaugcuuuccg

SEQ ID NO: 1653778 - RNA, 15 nt, Salmonella enterica enterica serovar Typhi
guucgccgcgcgcau

SEQ ID NO: 1653779 - RNA, 15 nt, Salmonella enterica enterica serovar Typhi
guucgauaaucccgg

SEQ ID NO: 1653780 - RNA, 15 nt, Salmonella enterica enterica serovar Typhi
guucgagggcgauuu

SEQ ID NO: 1653781 - RNA, 14 nt, Salmonella enterica enterica serovar Typhi
guucgacggagauu

SEQ ID NO: 1653782 - RNA, 21 nt, Salmonella enterica enterica serovar Typhi
guugcgcaagcacugaaugcu

SEQ ID NO: 1653783 - RNA, 17 nt, Salmonella enterica enterica serovar Typhi
guugcgacuguucauca

SEQ ID NO: 1653784 - RNA, 19 nt, Salmonella enterica enterica serovar Typhi
guugccguguccuuguccg

SEQ ID NO: 1653785 - RNA, 22 nt, Salmonella enterica enterica serovar Typhi
guugccgcccguuuuuuccagc

SEQ ID NO: 1653786 - RNA, 21 nt, Salmonella enterica enterica serovar Typhi
guugagcgcuugcugcguaaa

SEQ ID NO: 1653787 - RNA, 17 nt, Salmonella enterica enterica serovar Typhi
guuguuccgcgcugaug

SEQ ID NO: 1653788 - RNA, 15 nt, Salmonella enterica enterica serovar Typhi
guuguuccagcagcu

SEQ ID NO: 1653789 - RNA, 14 nt, Salmonella enterica enterica serovar Typhi
guuuaaauccagcg

SEQ ID NO: 1653790 - RNA, 18 nt, Salmonella enterica enterica serovar Typhi
guuguuucugccuuuaac

SEQ ID NO: 1653791 - RNA, 14 nt, Salmonella enterica enterica serovar Typhi
guuuaaucacgcca

SEQ ID NO: 1653792 - RNA, 14 nt, Salmonella enterica enterica serovar Typhi
guuuauguuugcug

SEQ ID NO: 1653793 - RNA, 17 nt, Salmonella enterica enterica serovar Typhi
guuuagcuguucaauca

SEQ ID NO: 1653794 - RNA, 14 nt, Salmonella enterica enterica serovar Typhi
guuuauccacaggc

SEQ ID NO: 1653795 - RNA, 12 nt, Salmonella enterica enterica serovar Typhi
guuuauccggca

SEQ ID NO: 1653796 - RNA, 14 nt, Salmonella enterica enterica serovar Typhi
guuuagcgccagca

SEQ ID NO: 1653797 - RNA, 16 nt, Salmonella enterica enterica serovar Typhi
guuuacgcugcuaucc

SEQ ID NO: 1653798 - RNA, 19 nt, Salmonella enterica enterica serovar Typhi
guuuacgagugcguucuuc

SEQ ID NO: 1653799 - RNA, 14 nt, Salmonella enterica enterica serovar Typhi
uaagccaccagauc

SEQ ID NO: 1653800 - RNA, 19 nt, Salmonella enterica enterica serovar Typhi
uaagcggcaagccgaucag

SEQ ID NO: 1653801 - RNA, 16 nt, Salmonella enterica enterica serovar Typhi
uaagauagcaggcgau

SEQ ID NO: 1653802 - RNA, 18 nt, Salmonella enterica enterica serovar Typhi
uaagaucggguggccuaa

SEQ ID NO: 1653803 - RNA, 18 nt, Salmonella enterica enterica serovar Typhi
uaagcaacguuuccgcua

SEQ ID NO: 1653804 - RNA, 22 nt, Salmonella enterica enterica serovar Typhi
uaagaagucugugagaaaagcg

SEQ ID NO: 1653805 - RNA, 19 nt, Salmonella enterica enterica serovar Typhi
uaagaccgguacgcaacgc

SEQ ID NO: 1653806 - RNA, 18 nt, Salmonella enterica enterica serovar Typhi
uaaccugguaugauaucg

SEQ ID NO: 1653807 - RNA, 17 nt, Salmonella enterica enterica serovar Typhi
uaacgaauuaagcggau

SEQ ID NO: 1653808 - RNA, 19 nt, Salmonella enterica enterica serovar Typhi
uaauaacgaacugauggcg

SEQ ID NO: 1653809 - RNA, 16 nt, Salmonella enterica enterica serovar Typhi
uaauaagacgccaguu

SEQ ID NO: 1653810 - RNA, 15 nt, Salmonella enterica enterica serovar Typhi
uaauaccacgauggu

SEQ ID NO: 1653811 - RNA, 21 nt, Salmonella enterica enterica serovar Typhi
uaauaccgugcaggacagaca

SEQ ID NO: 1653812 - RNA, 23 nt, Salmonella enterica enterica serovar Typhi
uaagcuggcgaacguuacccggc

SEQ ID NO: 1653813 - RNA, 18 nt, Salmonella enterica enterica serovar Typhi
uaagcguggcgcaaccga

SEQ ID NO: 1653814 - RNA, 13 nt, Salmonella enterica enterica serovar Typhi
uaagcgucagccc

SEQ ID NO: 1653815 - RNA, 15 nt, Salmonella enterica enterica serovar Typhi
uaagcgucgccagaa

SEQ ID NO: 1653816 - RNA, 13 nt, Salmonella enterica enterica serovar Typhi
uaagcggccuaua

SEQ ID NO: 1653817 - RNA, 22 nt, Salmonella enterica enterica serovar Typhi
uaagcggguauacuuaacccug

SEQ ID NO: 1653818 - RNA, 14 nt, Salmonella enterica enterica serovar Typhi
uaauuugaaucgcc

SEQ ID NO: 1653819 - RNA, 18 nt, Salmonella enterica enterica serovar Typhi
uaaugguggcaaccugac

SEQ ID NO: 1653820 - RNA, 17 nt, Salmonella enterica enterica serovar Typhi
uaauggcuuucaccguc

SEQ ID NO: 1653821 - RNA, 12 nt, Salmonella enterica enterica serovar Typhi
uaauggcgucaa

SEQ ID NO: 1653822 - RNA, 15 nt, Salmonella enterica enterica serovar Typhi
uaaugcccgauggcg

SEQ ID NO: 1653823 - RNA, 22 nt, Salmonella enterica enterica serovar Typhi
uaaugcgccccggcggcguaca

SEQ ID NO: 1653824 - RNA, 20 nt, Salmonella enterica enterica serovar Typhi
uaaugcucuuaaaaugaucg

SEQ ID NO: 1653825 - RNA, 21 nt, Salmonella enterica enterica serovar Typhi
uaaugcaauaaacuaaguaag

SEQ ID NO: 1653826 - RNA, 21 nt, Salmonella enterica enterica serovar Typhi
uaaugcaauauuacaaagcag

SEQ ID NO: 1653827 - RNA, 16 nt, Salmonella enterica enterica serovar Typhi
uaaugauuguccagcc

SEQ ID NO: 1653828 - RNA, 21 nt, Salmonella enterica enterica serovar Typhi
uaaucgccauugcaauaccgg

SEQ ID NO: 1653829 - RNA, 15 nt, Salmonella enterica enterica serovar Typhi
uaaucgauaagccag

SEQ ID NO: 1653830 - RNA, 11 nt, Salmonella enterica enterica serovar Typhi
uaauccagcgu

SEQ ID NO: 1653831 - RNA, 11 nt, Salmonella enterica enterica serovar Typhi
uaaucuuccac

SEQ ID NO: 1653832 - RNA, 22 nt, Salmonella enterica enterica serovar Typhi
uaaucguauucauugccguaaa

SEQ ID NO: 1653833 - RNA, 22 nt, Salmonella enterica enterica serovar Typhi
uaaucugaauaccuugauaacu

SEQ ID NO: 1653834 - RNA, 21 nt, Salmonella enterica enterica serovar Typhi
uaaucggccaggauggcccgg

SEQ ID NO: 1653835 - RNA, 13 nt, Salmonella enterica enterica serovar Typhi
uaaucgcgcgcuu

SEQ ID NO: 1653836 - RNA, 17 nt, Salmonella enterica enterica serovar Typhi
uaaucggcaggccaacg

SEQ ID NO: 1653837 - RNA, 16 nt, Salmonella enterica enterica serovar Typhi
uaacacggcuggcaau

SEQ ID NO: 1653838 - RNA, 22 nt, Salmonella enterica enterica serovar Typhi
uaaccgucuggcugccaucggc

SEQ ID NO: 1653839 - RNA, 15 nt, Salmonella enterica enterica serovar Typhi
uaaaugggcaggaga

SEQ ID NO: 1653840 - RNA, 14 nt, Salmonella enterica enterica serovar Typhi
uaacaaaugaagca

SEQ ID NO: 1653841 - RNA, 14 nt, Salmonella enterica enterica serovar Typhi
uaaauccggcgcuu

SEQ ID NO: 1653842 - RNA, 16 nt, Salmonella enterica enterica serovar Typhi
uaaaucagcgcggcaa

SEQ ID NO: 1653843 - RNA, 13 nt, Salmonella enterica enterica serovar Typhi
uaaauaauucacg

SEQ ID NO: 1653844 - RNA, 20 nt, Salmonella enterica enterica serovar Typhi
uaaacugcgcgauaucugcc

SEQ ID NO: 1653845 - RNA, 15 nt, Salmonella enterica enterica serovar Typhi
uaaacagcgccgcga

SEQ ID NO: 1653846 - RNA, 23 nt, Salmonella enterica enterica serovar Typhi
uaaacacgccgcgcuggauagcg

SEQ ID NO: 1653847 - RNA, 18 nt, Salmonella enterica enterica serovar Typhi
uaaacugcgcgauaucug

SEQ ID NO: 1653848 - RNA, 20 nt, Salmonella enterica enterica serovar Typhi
uaaacgguucagucagcgcg

SEQ ID NO: 1653849 - RNA, 18 nt, Salmonella enterica enterica serovar Typhi
uaaagcguugcaggcgau

SEQ ID NO: 1653850 - RNA, 19 nt, Salmonella enterica enterica serovar Typhi
uaaagcguugcaggcgauu

SEQ ID NO: 1653851 - RNA, 13 nt, Salmonella enterica enterica serovar Typhi
uaaagcgaauacu

SEQ ID NO: 1653852 - RNA, 16 nt, Salmonella enterica enterica serovar Typhi
uaaagcgccacaacgu

SEQ ID NO: 1653853 - RNA, 22 nt, Salmonella enterica enterica serovar Typhi
uaaagcgcuggcggcgacgaua

SEQ ID NO: 1653854 - RNA, 16 nt, Salmonella enterica enterica serovar Typhi
uaaagcguaucgccca

SEQ ID NO: 1653855 - RNA, 13 nt, Salmonella enterica enterica serovar Typhi
uaaagucaugacg

SEQ ID NO: 1653856 - RNA, 18 nt, Salmonella enterica enterica serovar Typhi
guuucaguaaaucccgca

SEQ ID NO: 1653857 - RNA, 16 nt, Salmonella enterica enterica serovar Typhi
guuucaguagcgguac

SEQ ID NO: 1653858 - RNA, 14 nt, Salmonella enterica enterica serovar Typhi
guuuccagccaguc

SEQ ID NO: 1653859 - RNA, 14 nt, Salmonella enterica enterica serovar Typhi
uaaaacgccauugu

SEQ ID NO: 1653860 - RNA, 17 nt, Salmonella enterica enterica serovar Typhi
uaaaauugcucagccaa

SEQ ID NO: 1653861 - RNA, 14 nt, Salmonella enterica enterica serovar Typhi
uaaaagacgccaug

SEQ ID NO: 1653862 - RNA, 16 nt, Salmonella enterica enterica serovar Typhi
uaaaagcggauaagau

SEQ ID NO: 1653863 - RNA, 17 nt, Salmonella enterica enterica serovar Typhi
agccgguuuauccgcaa

SEQ ID NO: 1653864 - RNA, 18 nt, Salmonella enterica enterica serovar Typhi
agccgguuuauccgcaac

SEQ ID NO: 1653865 - RNA, 13 nt, Salmonella enterica enterica serovar Typhi
agcgaacugauaa

SEQ ID NO: 1653866 - RNA, 17 nt, Salmonella enterica enterica serovar Typhi
agcgaccuuaccggcga

SEQ ID NO: 1653867 - RNA, 17 nt, Salmonella enterica enterica serovar Typhi
agcgaacguccagcggc

SEQ ID NO: 1653868 - RNA, 18 nt, Salmonella enterica enterica serovar Typhi
agcgacuuauccggccua

SEQ ID NO: 1653869 - RNA, 11 nt, Salmonella enterica enterica serovar Typhi
agcgacgcccu

SEQ ID NO: 1653870 - RNA, 21 nt, Salmonella enterica enterica serovar Typhi
agcgacgucccgucagggcga

SEQ ID NO: 1653871 - RNA, 20 nt, Salmonella enterica enterica serovar Typhi
agccgguaaucacugccgcc

SEQ ID NO: 1653872 - RNA, 21 nt, Salmonella enterica enterica serovar Typhi
agccgaaacuuauacugauaa

SEQ ID NO: 1653873 - RNA, 20 nt, Salmonella enterica enterica serovar Typhi
agccgagacuaucgauagcg

SEQ ID NO: 1653874 - RNA, 15 nt, Salmonella enterica enterica serovar Typhi
agccgacuauuccgc

SEQ ID NO: 1653875 - RNA, 23 nt, Salmonella enterica enterica serovar Typhi
agccgcaaucagcguuucgccgu

SEQ ID NO: 1653876 - RNA, 14 nt, Salmonella enterica enterica serovar Typhi
agccgagcgguaag

SEQ ID NO: 1653877 - RNA, 23 nt, Salmonella enterica enterica serovar Typhi
agccaccggcagggccaguucug

SEQ ID NO: 1653878 - RNA, 19 nt, Salmonella enterica enterica serovar Typhi
agccgcuuacucagccaga

SEQ ID NO: 1653879 - RNA, 21 nt, Salmonella enterica enterica serovar Typhi
agccgcuccggguuuucaaua

SEQ ID NO: 1653880 - RNA, 21 nt, Salmonella enterica enterica serovar Typhi
agccgccguagaacgggccga

SEQ ID NO: 1653881 - RNA, 23 nt, Salmonella enterica enterica serovar Typhi
agccgccguguugugugccgcgc

SEQ ID NO: 1653882 - RNA, 17 nt, Salmonella enterica enterica serovar Typhi
agccgccacccggcuuu

SEQ ID NO: 1653883 - RNA, 19 nt, Salmonella enterica enterica serovar Typhi
agcgcaaacggaucuucca

SEQ ID NO: 1653884 - RNA, 15 nt, Salmonella enterica enterica serovar Typhi
agcgccagcuccaua

SEQ ID NO: 1653885 - RNA, 13 nt, Salmonella enterica enterica serovar Typhi
agcgcccggugau

SEQ ID NO: 1653886 - RNA, 16 nt, Salmonella enterica enterica serovar Typhi
agcgcccuggucagca

SEQ ID NO: 1653887 - RNA, 17 nt, Salmonella enterica enterica serovar Typhi
agcgccauuaacgccau

SEQ ID NO: 1653888 - RNA, 15 nt, Salmonella enterica enterica serovar Typhi
agcgccauccggcaa

SEQ ID NO: 1653889 - RNA, 14 nt, Salmonella enterica enterica serovar Typhi
agcgccaugaagau

SEQ ID NO: 1653890 - RNA, 19 nt, Salmonella enterica enterica serovar Typhi
agcgccuucaggcaucaga

SEQ ID NO: 1653891 - RNA, 17 nt, Salmonella enterica enterica serovar Typhi
agcgcgccgcagcgccg

SEQ ID NO: 1653892 - RNA, 18 nt, Salmonella enterica enterica serovar Typhi
agcgcgccgcagcgccga

SEQ ID NO: 1653893 - RNA, 15 nt, Salmonella enterica enterica serovar Typhi
agcgccuuugcgaau

SEQ ID NO: 1653894 - RNA, 22 nt, Salmonella enterica enterica serovar Typhi
agcgcgccaugagacgcguaaa

SEQ ID NO: 1653895 - RNA, 15 nt, Salmonella enterica enterica serovar Typhi
agcgcugcggcuaca

SEQ ID NO: 1653896 - RNA, 17 nt, Salmonella enterica enterica serovar Typhi
agcgcgggccugccugu

SEQ ID NO: 1653897 - RNA, 15 nt, Salmonella enterica enterica serovar Typhi
agcguaccagcguca

SEQ ID NO: 1653898 - RNA, 18 nt, Salmonella enterica enterica serovar Typhi
agcguauugagcuggaua

SEQ ID NO: 1653899 - RNA, 21 nt, Salmonella enterica enterica serovar Typhi
agcguaauccucgacgcauca

SEQ ID NO: 1653900 - RNA, 12 nt, Salmonella enterica enterica serovar Typhi
agcguaccagcg

SEQ ID NO: 1653901 - RNA, 16 nt, Salmonella enterica enterica serovar Typhi
agcgucauuaaaaugc

SEQ ID NO: 1653902 - RNA, 13 nt, Salmonella enterica enterica serovar Typhi
agcguccacgcca

SEQ ID NO: 1653903 - RNA, 15 nt, Salmonella enterica enterica serovar Typhi
agcgucauccggcaa

SEQ ID NO: 1653904 - RNA, 20 nt, Salmonella enterica enterica serovar Typhi
agcgucauccggcaaucaga

SEQ ID NO: 1653905 - RNA, 12 nt, Salmonella enterica enterica serovar Typhi
agcgucagccca

SEQ ID NO: 1653906 - RNA, 21 nt, Salmonella enterica enterica serovar Typhi
agcgguccaauaaacgccagg

SEQ ID NO: 1653907 - RNA, 18 nt, Salmonella enterica enterica serovar Typhi
agcgguaguuaagcguca

SEQ ID NO: 1653908 - RNA, 18 nt, Salmonella enterica enterica serovar Typhi
agcgguauaucuguaaca

SEQ ID NO: 1653909 - RNA, 20 nt, Salmonella enterica enterica serovar Typhi
agcggccagggcgucaauaa

SEQ ID NO: 1653910 - RNA, 19 nt, Salmonella enterica enterica serovar Typhi
agcggcgcgcgguuaugcg

SEQ ID NO: 1653911 - RNA, 15 nt, Salmonella enterica enterica serovar Typhi
agcggacacccgcag

SEQ ID NO: 1653912 - RNA, 20 nt, Salmonella enterica enterica serovar Typhi
agcggacacccgcagccaga

SEQ ID NO: 1653913 - RNA, 21 nt, Salmonella enterica enterica serovar Typhi
agcggauaagauagcaggcga

SEQ ID NO: 1653914 - RNA, 21 nt, Salmonella enterica enterica serovar Typhi
agcggacggcuaauaugccag

SEQ ID NO: 1653915 - RNA, 23 nt, Salmonella enterica enterica serovar Typhi
agcggacgggcggugccgguaau

SEQ ID NO: 1653916 - RNA, 21 nt, Salmonella enterica enterica serovar Typhi
agcaaggcauuggacggaauc

SEQ ID NO: 1653917 - RNA, 17 nt, Salmonella enterica enterica serovar Typhi
agcaauacaauuauugc

SEQ ID NO: 1653918 - RNA, 17 nt, Salmonella enterica enterica serovar Typhi
agcaaacuggcgcguac

SEQ ID NO: 1653919 - RNA, 19 nt, Salmonella enterica enterica serovar Typhi
agcacauucgauaaccgcc

SEQ ID NO: 1653920 - RNA, 21 nt, Salmonella enterica enterica serovar Typhi
agcaauagguuugaccagaua

SEQ ID NO: 1653921 - RNA, 13 nt, Salmonella enterica enterica serovar Typhi
agcacaccauuuc

SEQ ID NO: 1653922 - RNA, 14 nt, Salmonella enterica enterica serovar Typhi
agauuggccgucac

SEQ ID NO: 1653923 - RNA, 16 nt, Salmonella enterica enterica serovar Typhi
agauuggcaucugcaa

SEQ ID NO: 1653924 - RNA, 15 nt, Salmonella enterica enterica serovar Typhi
agauuucgcgucagg

SEQ ID NO: 1653925 - RNA, 20 nt, Salmonella enterica enterica serovar Typhi
agauuguggaacuuuaucgc

SEQ ID NO: 1653926 - RNA, 14 nt, Salmonella enterica enterica serovar Typhi
agaucauuuacggc

SEQ ID NO: 1653927 - RNA, 15 nt, Salmonella enterica enterica serovar Typhi
agaucaggcgucagc

SEQ ID NO: 1653928 - RNA, 22 nt, Salmonella enterica enterica serovar Typhi
agcacuuccggaucgcuaucuu

SEQ ID NO: 1653929 - RNA, 22 nt, Salmonella enterica enterica serovar Typhi
agcagaauauugcugauaauca

SEQ ID NO: 1653930 - RNA, 16 nt, Salmonella enterica enterica serovar Typhi
agcagaagacggaaac

SEQ ID NO: 1653931 - RNA, 15 nt, Salmonella enterica enterica serovar Typhi
agcacgaggguaaug

SEQ ID NO: 1653932 - RNA, 19 nt, Salmonella enterica enterica serovar Typhi
agcacgcccauauccagcu

SEQ ID NO: 1653933 - RNA, 18 nt, Salmonella enterica enterica serovar Typhi
agcaccucaauaugaaau

SEQ ID NO: 1653934 - RNA, 15 nt, Salmonella enterica enterica serovar Typhi
agcauaucgauagca

SEQ ID NO: 1653935 - RNA, 23 nt, Salmonella enterica enterica serovar Typhi
agcauuucggcguguaacugcaa

SEQ ID NO: 1653936 - RNA, 15 nt, Salmonella enterica enterica serovar Typhi
agcauugggccgaua

SEQ ID NO: 1653937 - RNA, 16 nt, Salmonella enterica enterica serovar Typhi
agcaucuuaugcgcaa

SEQ ID NO: 1653938 - RNA, 13 nt, Salmonella enterica enterica serovar Typhi
agcaucgccauca

SEQ ID NO: 1653939 - RNA, 20 nt, Salmonella enterica enterica serovar Typhi
agcaucgccgguagcuucag

SEQ ID NO: 1653940 - RNA, 20 nt, Salmonella enterica enterica serovar Typhi
agcagcgaggugauaaucag

SEQ ID NO: 1653941 - RNA, 16 nt, Salmonella enterica enterica serovar Typhi
agcagaugaacggcaa

SEQ ID NO: 1653942 - RNA, 18 nt, Salmonella enterica enterica serovar Typhi
agcagcguuuugcgcgua

SEQ ID NO: 1653943 - RNA, 18 nt, Salmonella enterica enterica serovar Typhi
agacgauaaccggacgau

SEQ ID NO: 1653944 - RNA, 22 nt, Salmonella enterica enterica serovar Typhi
agacgaugaauuccugcggcgg

SEQ ID NO: 1653945 - RNA, 17 nt, Salmonella enterica enterica serovar Typhi
agacgccgcgcugcggc

SEQ ID NO: 1653946 - RNA, 19 nt, Salmonella enterica enterica serovar Typhi
agaccauucaaccagccga

SEQ ID NO: 1653947 - RNA, 15 nt, Salmonella enterica enterica serovar Typhi
agaccggcaucucau

SEQ ID NO: 1653948 - RNA, 20 nt, Salmonella enterica enterica serovar Typhi
agaccggcgaaaucgugcgc

SEQ ID NO: 1653949 - RNA, 23 nt, Salmonella enterica enterica serovar Typhi
agaccggagcgugcuucaacggu

SEQ ID NO: 1653950 - RNA, 23 nt, Salmonella enterica enterica serovar Typhi
agaccgggcugcacgccaucggc

SEQ ID NO: 1653951 - RNA, 16 nt, Salmonella enterica enterica serovar Typhi
agaccgugaauaagau

SEQ ID NO: 1653952 - RNA, 17 nt, Salmonella enterica enterica serovar Typhi
agagcgccugcaggcga

SEQ ID NO: 1653953 - RNA, 22 nt, Salmonella enterica enterica serovar Typhi
agauaaaacugcugacaaucag

SEQ ID NO: 1653954 - RNA, 18 nt, Salmonella enterica enterica serovar Typhi
agauagcuuccaugccga

SEQ ID NO: 1653955 - RNA, 21 nt, Salmonella enterica enterica serovar Typhi
agacuuuggauaaagccaaug

SEQ ID NO: 1653956 - RNA, 14 nt, Salmonella enterica enterica serovar Typhi
agacugcccggcau

SEQ ID NO: 1653957 - RNA, 20 nt, Salmonella enterica enterica serovar Typhi
agacgcucguauccgagcgu

SEQ ID NO: 1653958 - RNA, 23 nt, Salmonella enterica enterica serovar Typhi
agaauuccgaugaaaaacuggaa

SEQ ID NO: 1653959 - RNA, 13 nt, Salmonella enterica enterica serovar Typhi
agaauuaucugaa

SEQ ID NO: 1653960 - RNA, 14 nt, Salmonella enterica enterica serovar Typhi
agaaugucgccaua

SEQ ID NO: 1653961 - RNA, 12 nt, Salmonella enterica enterica serovar Typhi
agaauuuaucgc

SEQ ID NO: 1653962 - RNA, 24 nt, Salmonella enterica enterica serovar Typhi
agacagaaucaggccauuaccgcc

SEQ ID NO: 1653963 - RNA, 14 nt, Salmonella enterica enterica serovar Typhi
agacaggacgccag

SEQ ID NO: 1653964 - RNA, 20 nt, Salmonella enterica enterica serovar Typhi
agacagcuuagauucaacca

SEQ ID NO: 1653965 - RNA, 17 nt, Salmonella enterica enterica serovar Typhi
agacagccucucccgaa

SEQ ID NO: 1653966 - RNA, 14 nt, Salmonella enterica enterica serovar Typhi
agacauccagcauu

SEQ ID NO: 1653967 - RNA, 23 nt, Salmonella enterica enterica serovar Typhi
agacaucgauuagaccguaaauc

SEQ ID NO: 1653968 - RNA, 22 nt, Salmonella enterica enterica serovar Typhi
agacaugaccgcacagcagaca

SEQ ID NO: 1653969 - RNA, 16 nt, Salmonella enterica enterica serovar Typhi
agaaguagcagagaaa

SEQ ID NO: 1653970 - RNA, 14 nt, Salmonella enterica enterica serovar Typhi
agaagugccaguaa

SEQ ID NO: 1653971 - RNA, 17 nt, Salmonella enterica enterica serovar Typhi
agaauauuuuucucagc

SEQ ID NO: 1653972 - RNA, 23 nt, Salmonella enterica enterica serovar Typhi
agaauauuuuucucagccagauc

SEQ ID NO: 1653973 - RNA, 19 nt, Salmonella enterica enterica serovar Typhi
agaaucacgccgaugacca

SEQ ID NO: 1653974 - RNA, 14 nt, Salmonella enterica enterica serovar Typhi
agaacuuccgccac

SEQ ID NO: 1653975 - RNA, 16 nt, Salmonella enterica enterica serovar Typhi
agaagaauaagccgga

SEQ ID NO: 1653976 - RNA, 23 nt, Salmonella enterica enterica serovar Typhi
agaaccguugcgcccaucaucau

SEQ ID NO: 1653977 - RNA, 15 nt, Salmonella enterica enterica serovar Typhi
agaaauccgcgaaua

SEQ ID NO: 1653978 - RNA, 14 nt, Salmonella enterica enterica serovar Typhi
acugcugcgcgugc

SEQ ID NO: 1653979 - RNA, 22 nt, Salmonella enterica enterica serovar Typhi
agugggcgucaaaaucccggcu

SEQ ID NO: 1653980 - RNA, 19 nt, Salmonella enterica enterica serovar Typhi
aguguuaaucucacgcuca

SEQ ID NO: 1653981 - RNA, 20 nt, Salmonella enterica enterica serovar Typhi
aguguguaccagcagcgcca

SEQ ID NO: 1653982 - RNA, 15 nt, Salmonella enterica enterica serovar Typhi
aguuacgcacgccag

SEQ ID NO: 1653983 - RNA, 16 nt, Salmonella enterica enterica serovar Typhi
aguuagcuaucgcgcc

SEQ ID NO: 1653984 - RNA, 24 nt, Salmonella enterica enterica serovar Typhi
aguuacggacaugcgacgugucgc

SEQ ID NO: 1653985 - RNA, 16 nt, Salmonella enterica enterica serovar Typhi
aguuacguugcggcgu

SEQ ID NO: 1653986 - RNA, 12 nt, Salmonella enterica enterica serovar Typhi
aguuaucacguu

SEQ ID NO: 1653987 - RNA, 16 nt, Salmonella enterica enterica serovar Typhi
aguucagacaccacgc

SEQ ID NO: 1653988 - RNA, 22 nt, Salmonella enterica enterica serovar Typhi
aguucgcccgguaaacgcgcca

SEQ ID NO: 1653989 - RNA, 15 nt, Salmonella enterica enterica serovar Typhi
aguuucaucagcaca

SEQ ID NO: 1653990 - RNA, 17 nt, Salmonella enterica enterica serovar Typhi
agugcgcauacuaccgc

SEQ ID NO: 1653991 - RNA, 22 nt, Salmonella enterica enterica serovar Typhi
aguggagaggccaccagcgcca

SEQ ID NO: 1653992 - RNA, 22 nt, Salmonella enterica enterica serovar Typhi
agugcuguuccacgggaucguu

SEQ ID NO: 1653993 - RNA, 19 nt, Salmonella enterica enterica serovar Typhi
agugcuugcauuuuacgua

SEQ ID NO: 1653994 - RNA, 19 nt, Salmonella enterica enterica serovar Typhi
agugacccgccgccagcac

SEQ ID NO: 1653995 - RNA, 13 nt, Salmonella enterica enterica serovar Typhi
agugaccagcauc

SEQ ID NO: 1653996 - RNA, 15 nt, Salmonella enterica enterica serovar Typhi
agugaguaacguuaa

SEQ ID NO: 1653997 - RNA, 12 nt, Salmonella enterica enterica serovar Typhi
agugcaacggcu

SEQ ID NO: 1653998 - RNA, 20 nt, Salmonella enterica enterica serovar Typhi
agugccaagcaacacggcga

SEQ ID NO: 1653999 - RNA, 23 nt, Salmonella enterica enterica serovar Typhi
agugcccguuugcgagacggcga

SEQ ID NO: 1654000 - RNA, 13 nt, Salmonella enterica enterica serovar Typhi
agucgucauggcg

SEQ ID NO: 1654001 - RNA, 22 nt, Salmonella enterica enterica serovar Typhi
agucgugucauagucggcgcca

SEQ ID NO: 1654002 - RNA, 12 nt, Salmonella enterica enterica serovar Typhi
agucgggcgugc

SEQ ID NO: 1654003 - RNA, 14 nt, Salmonella enterica enterica serovar Typhi
agucgguaagucug

SEQ ID NO: 1654004 - RNA, 21 nt, Salmonella enterica enterica serovar Typhi
agucgcgccgugcccagcauc

SEQ ID NO: 1654005 - RNA, 18 nt, Salmonella enterica enterica serovar Typhi
agucggcgaacuucgcgg

SEQ ID NO: 1654006 - RNA, 19 nt, Salmonella enterica enterica serovar Typhi
agucggcgaacuucgcggu

SEQ ID NO: 1654007 - RNA, 17 nt, Salmonella enterica enterica serovar Typhi
agucgccagaugucggc

SEQ ID NO: 1654008 - RNA, 13 nt, Salmonella enterica enterica serovar Typhi
aguccauauccgu

SEQ ID NO: 1654009 - RNA, 19 nt, Salmonella enterica enterica serovar Typhi
aguccagcauccaugccag

SEQ ID NO: 1654010 - RNA, 17 nt, Salmonella enterica enterica serovar Typhi
agucagcguuacuggcg

SEQ ID NO: 1654011 - RNA, 14 nt, Salmonella enterica enterica serovar Typhi
aguccggauggcag

SEQ ID NO: 1654012 - RNA, 12 nt, Salmonella enterica enterica serovar Typhi
agucccagcguu

SEQ ID NO: 1654013 - RNA, 16 nt, Salmonella enterica enterica serovar Typhi
aguccaugaugaagau

SEQ ID NO: 1654014 - RNA, 15 nt, Salmonella enterica enterica serovar Typhi
agucaaagguaauau

SEQ ID NO: 1654015 - RNA, 22 nt, Salmonella enterica enterica serovar Typhi
agucaagcuugccgcuaucgag

SEQ ID NO: 1654016 - RNA, 16 nt, Salmonella enterica enterica serovar Typhi
agucacuccaggcguu

SEQ ID NO: 1654017 - RNA, 15 nt, Salmonella enterica enterica serovar Typhi
aguauuggcugccga

SEQ ID NO: 1654018 - RNA, 15 nt, Salmonella enterica enterica serovar Typhi
aguagguauccagca

SEQ ID NO: 1654019 - RNA, 17 nt, Salmonella enterica enterica serovar Typhi
aguacuauuuucgccga

SEQ ID NO: 1654020 - RNA, 20 nt, Salmonella enterica enterica serovar Typhi
aguacggcgcgaaucccgcg

SEQ ID NO: 1654021 - RNA, 19 nt, Salmonella enterica enterica serovar Typhi
aguacgggcagauggucgc

SEQ ID NO: 1654022 - RNA, 18 nt, Salmonella enterica enterica serovar Typhi
auacgcugcgucaggcga

SEQ ID NO: 1654023 - RNA, 17 nt, Salmonella enterica enterica serovar Typhi
auacggaaggauagccg

SEQ ID NO: 1654024 - RNA, 16 nt, Salmonella enterica enterica serovar Typhi
auacggaugccgauuu

SEQ ID NO: 1654025 - RNA, 20 nt, Salmonella enterica enterica serovar Typhi
auacggcggcaaugccgccg

SEQ ID NO: 1654026 - RNA, 18 nt, Salmonella enterica enterica serovar Typhi
auacgcgacggcguaagc

SEQ ID NO: 1654027 - RNA, 20 nt, Salmonella enterica enterica serovar Typhi
auaccguggucuccgccugg

SEQ ID NO: 1654028 - RNA, 20 nt, Salmonella enterica enterica serovar Typhi
auaccuaacucuuccgcaau

SEQ ID NO: 1654029 - RNA, 21 nt, Salmonella enterica enterica serovar Typhi
auacgacaucgccaaccgcga

SEQ ID NO: 1654030 - RNA, 12 nt, Salmonella enterica enterica serovar Typhi
auaccugaaaga

SEQ ID NO: 1654031 - RNA, 15 nt, Salmonella enterica enterica serovar Typhi
auaccugucggcaaa

SEQ ID NO: 1654032 - RNA, 15 nt, Salmonella enterica enterica serovar Typhi
auaccagggcgauuc

SEQ ID NO: 1654033 - RNA, 12 nt, Salmonella enterica enterica serovar Typhi
auaccaggcacu

SEQ ID NO: 1654034 - RNA, 15 nt, Salmonella enterica enterica serovar Typhi
auacacgcgacaaug

SEQ ID NO: 1654035 - RNA, 13 nt, Salmonella enterica enterica serovar Typhi
auacauuaacgcu

SEQ ID NO: 1654036 - RNA, 17 nt, Salmonella enterica enterica serovar Typhi
auaccaccugccaaagc

SEQ ID NO: 1654037 - RNA, 20 nt, Salmonella enterica enterica serovar Typhi
auaccacaacagaaucgcga

SEQ ID NO: 1654038 - RNA, 15 nt, Salmonella enterica enterica serovar Typhi
auacaccggcgccag

SEQ ID NO: 1654039 - RNA, 17 nt, Salmonella enterica enterica serovar Typhi
auaauauguuuauuugc

SEQ ID NO: 1654040 - RNA, 23 nt, Salmonella enterica enterica serovar Typhi
auaagguguuuacgccgccaucc

SEQ ID NO: 1654041 - RNA, 15 nt, Salmonella enterica enterica serovar Typhi
auaagaucuuccggc

SEQ ID NO: 1654042 - RNA, 22 nt, Salmonella enterica enterica serovar Typhi
auaagacgcgaagcggcgcuau

SEQ ID NO: 1654043 - RNA, 18 nt, Salmonella enterica enterica serovar Typhi
auaagagaaaauaccgcu

SEQ ID NO: 1654044 - RNA, 14 nt, Salmonella enterica enterica serovar Typhi
auaauaaacgcgcc

SEQ ID NO: 1654045 - RNA, 20 nt, Salmonella enterica enterica serovar Typhi
auaagguaaagccgccaucc

SEQ ID NO: 1654046 - RNA, 20 nt, Salmonella enterica enterica serovar Typhi
aguuugcguacucagcagac

SEQ ID NO: 1654047 - RNA, 14 nt, Salmonella enterica enterica serovar Typhi
auaaccaucggacg

SEQ ID NO: 1654048 - RNA, 19 nt, Salmonella enterica enterica serovar Typhi
auaacgccgauaaccagcg

SEQ ID NO: 1654049 - RNA, 18 nt, Salmonella enterica enterica serovar Typhi
auaacgcaacgucagcga

SEQ ID NO: 1654050 - RNA, 16 nt, Salmonella enterica enterica serovar Typhi
auaacgucagccggga

SEQ ID NO: 1654051 - RNA, 13 nt, Salmonella enterica enterica serovar Typhi
auaacgaaccauc

SEQ ID NO: 1654052 - RNA, 16 nt, Salmonella enterica enterica serovar Typhi
auagaccacgccauca

SEQ ID NO: 1654053 - RNA, 23 nt, Salmonella enterica enterica serovar Typhi
auagcgccagacagauaacacca

SEQ ID NO: 1654054 - RNA, 14 nt, Salmonella enterica enterica serovar Typhi
auagcgccgcaucg

SEQ ID NO: 1654055 - RNA, 16 nt, Salmonella enterica enterica serovar Typhi
auagcgccgcaucgau

SEQ ID NO: 1654056 - RNA, 22 nt, Salmonella enterica enterica serovar Typhi
auagaccagcggcccgcgcuga

SEQ ID NO: 1654057 - RNA, 18 nt, Salmonella enterica enterica serovar Typhi
auagcgguucaaucacgc

SEQ ID NO: 1654058 - RNA, 18 nt, Salmonella enterica enterica serovar Typhi
auagcuacgaccggucag

SEQ ID NO: 1654059 - RNA, 22 nt, Salmonella enterica enterica serovar Typhi
auagcgcuacauccgccagccg

SEQ ID NO: 1654060 - RNA, 14 nt, Salmonella enterica enterica serovar Typhi
auagcgggugauua

SEQ ID NO: 1654061 - RNA, 15 nt, Salmonella enterica enterica serovar Typhi
auagcuauggucacu

SEQ ID NO: 1654062 - RNA, 20 nt, Salmonella enterica enterica serovar Typhi
auagcuucaaugauccacgg

SEQ ID NO: 1654063 - RNA, 23 nt, Salmonella enterica enterica serovar Typhi
auagcuuuuggcguaauggcggg

SEQ ID NO: 1654064 - RNA, 19 nt, Salmonella enterica enterica serovar Typhi
auauaaaaauagcuggcug

SEQ ID NO: 1654065 - RNA, 17 nt, Salmonella enterica enterica serovar Typhi
auaguggcgucgccaua

SEQ ID NO: 1654066 - RNA, 15 nt, Salmonella enterica enterica serovar Typhi
auaucugcgccgcca

SEQ ID NO: 1654067 - RNA, 14 nt, Salmonella enterica enterica serovar Typhi
auaucguugccgcc

SEQ ID NO: 1654068 - RNA, 15 nt, Salmonella enterica enterica serovar Typhi
auaucguugccgccg

SEQ ID NO: 1654069 - RNA, 15 nt, Salmonella enterica enterica serovar Typhi
auaucuuuauucgcu

SEQ ID NO: 1654070 - RNA, 19 nt, Salmonella enterica enterica serovar Typhi
auaucuuucaguucgccgg

SEQ ID NO: 1654071 - RNA, 20 nt, Salmonella enterica enterica serovar Typhi
auaugaauaauuucggcggc

SEQ ID NO: 1654072 - RNA, 16 nt, Salmonella enterica enterica serovar Typhi
auaugaaaucgccugu

SEQ ID NO: 1654073 - RNA, 11 nt, Salmonella enterica enterica serovar Typhi
auauuccuggc

SEQ ID NO: 1654074 - RNA, 13 nt, Salmonella enterica enterica serovar Typhi
auaucgaugccag

SEQ ID NO: 1654075 - RNA, 13 nt, Salmonella enterica enterica serovar Typhi
auaucgcgauaaa

SEQ ID NO: 1654076 - RNA, 18 nt, Salmonella enterica enterica serovar Typhi
auaucgcuaaaccaaacu

SEQ ID NO: 1654077 - RNA, 21 nt, Salmonella enterica enterica serovar Typhi
auauauccgcuauuaccagua

SEQ ID NO: 1654078 - RNA, 12 nt, Salmonella enterica enterica serovar Typhi
auauaugaaauc

SEQ ID NO: 1654079 - RNA, 22 nt, Salmonella enterica enterica serovar Typhi
auaucaacccaguuuuuauccu

SEQ ID NO: 1654080 - RNA, 15 nt, Salmonella enterica enterica serovar Typhi
auauccguagcggau

SEQ ID NO: 1654081 - RNA, 16 nt, Salmonella enterica enterica serovar Typhi
agcuuucuguuaucag

SEQ ID NO: 1654082 - RNA, 17 nt, Salmonella enterica enterica serovar Typhi
aggaaaacgcuuuccag

SEQ ID NO: 1654083 - RNA, 18 nt, Salmonella enterica enterica serovar Typhi
aggacaaccccuacgcag

SEQ ID NO: 1654084 - RNA, 15 nt, Salmonella enterica enterica serovar Typhi
aggaaggcgugcagc

SEQ ID NO: 1654085 - RNA, 20 nt, Salmonella enterica enterica serovar Typhi
aggaauacaaaaaagccgau

SEQ ID NO: 1654086 - RNA, 16 nt, Salmonella enterica enterica serovar Typhi
aggaaauucugacgca

SEQ ID NO: 1654087 - RNA, 17 nt, Salmonella enterica enterica serovar Typhi
aggaaaugccgggcaaa

SEQ ID NO: 1654088 - RNA, 12 nt, Salmonella enterica enterica serovar Typhi
aggaaauucaga

SEQ ID NO: 1654089 - RNA, 21 nt, Salmonella enterica enterica serovar Typhi
aggaaccgguagccaggcgcg

SEQ ID NO: 1654090 - RNA, 18 nt, Salmonella enterica enterica serovar Typhi
agcgucucagcaggcggc

SEQ ID NO: 1654091 - RNA, 12 nt, Salmonella enterica enterica serovar Typhi
agcugcgucagc

SEQ ID NO: 1654092 - RNA, 15 nt, Salmonella enterica enterica serovar Typhi
agcuggccaaucagc

SEQ ID NO: 1654093 - RNA, 22 nt, Salmonella enterica enterica serovar Typhi
agcuuaaugauaauuguuaauu

SEQ ID NO: 1654094 - RNA, 18 nt, Salmonella enterica enterica serovar Typhi
agcuuaucgccaaagaua

SEQ ID NO: 1654095 - RNA, 23 nt, Salmonella enterica enterica serovar Typhi
agcuuccagcaaaccuuccgcca

SEQ ID NO: 1654096 - RNA, 13 nt, Salmonella enterica enterica serovar Typhi
agcuucaugcugg

SEQ ID NO: 1654097 - RNA, 23 nt, Salmonella enterica enterica serovar Typhi
aggccagaugguaagcauagcgc

SEQ ID NO: 1654098 - RNA, 22 nt, Salmonella enterica enterica serovar Typhi
aggcaaauucuguugccggaaa

SEQ ID NO: 1654099 - RNA, 20 nt, Salmonella enterica enterica serovar Typhi
aggcaaaaaucgucaucaga

SEQ ID NO: 1654100 - RNA, 16 nt, Salmonella enterica enterica serovar Typhi
aggcaaucgcuuccag

SEQ ID NO: 1654101 - RNA, 22 nt, Salmonella enterica enterica serovar Typhi
aggcaaucuuuaacgcuggcag

SEQ ID NO: 1654102 - RNA, 19 nt, Salmonella enterica enterica serovar Typhi
aggcagcacaaucagcgcg

SEQ ID NO: 1654103 - RNA, 16 nt, Salmonella enterica enterica serovar Typhi
aggcagcaaugugcgc

SEQ ID NO: 1654104 - RNA, 23 nt, Salmonella enterica enterica serovar Typhi
aggaucaaaaucgcgccccacgg

SEQ ID NO: 1654105 - RNA, 16 nt, Salmonella enterica enterica serovar Typhi
aggagccaccggcagg

SEQ ID NO: 1654106 - RNA, 17 nt, Salmonella enterica enterica serovar Typhi
aggauaaaauccugcac

SEQ ID NO: 1654107 - RNA, 21 nt, Salmonella enterica enterica serovar Typhi
aggauagcgaccagcgucagc

SEQ ID NO: 1654108 - RNA, 19 nt, Salmonella enterica enterica serovar Typhi
aggauagugauauagcgcc

SEQ ID NO: 1654109 - RNA, 15 nt, Salmonella enterica enterica serovar Typhi
aggauacagccgacu

SEQ ID NO: 1654110 - RNA, 23 nt, Salmonella enterica enterica serovar Typhi
aggauaauaguguuagcgucagu

SEQ ID NO: 1654111 - RNA, 19 nt, Salmonella enterica enterica serovar Typhi
aggacauucaguacgcuuu

SEQ ID NO: 1654112 - RNA, 21 nt, Salmonella enterica enterica serovar Typhi
agggccgcaaacgguucgcgg

SEQ ID NO: 1654113 - RNA, 16 nt, Salmonella enterica enterica serovar Typhi
agggcgagcguagcga

SEQ ID NO: 1654114 - RNA, 18 nt, Salmonella enterica enterica serovar Typhi
agggcgauucccgaucuu

SEQ ID NO: 1654115 - RNA, 16 nt, Salmonella enterica enterica serovar Typhi
agggcgugaaccagca

SEQ ID NO: 1654116 - RNA, 18 nt, Salmonella enterica enterica serovar Typhi
agguaucauaugugccga

SEQ ID NO: 1654117 - RNA, 14 nt, Salmonella enterica enterica serovar Typhi
agguaugcuucagc

SEQ ID NO: 1654118 - RNA, 20 nt, Salmonella enterica enterica serovar Typhi
agguauccugaaccagcggc

SEQ ID NO: 1654119 - RNA, 14 nt, Salmonella enterica enterica serovar Typhi
agguauccagcaga

SEQ ID NO: 1654120 - RNA, 20 nt, Salmonella enterica enterica serovar Typhi
agguccagggaaaaauagcg

SEQ ID NO: 1654121 - RNA, 13 nt, Salmonella enterica enterica serovar Typhi
agggucagcagga

SEQ ID NO: 1654122 - RNA, 21 nt, Salmonella enterica enterica serovar Typhi
aggguuauuuccgcuggccgg

SEQ ID NO: 1654123 - RNA, 23 nt, Salmonella enterica enterica serovar Typhi
agggugauuucgcccgcauucgc

SEQ ID NO: 1654124 - RNA, 15 nt, Salmonella enterica enterica serovar Typhi
aggggcauuuuccgg

SEQ ID NO: 1654125 - RNA, 18 nt, Salmonella enterica enterica serovar Typhi
aggcgcgcagcugccaca

SEQ ID NO: 1654126 - RNA, 13 nt, Salmonella enterica enterica serovar Typhi
aggcggcggugau

SEQ ID NO: 1654127 - RNA, 21 nt, Salmonella enterica enterica serovar Typhi
aggcgguuggcuauacgcggc

SEQ ID NO: 1654128 - RNA, 16 nt, Salmonella enterica enterica serovar Typhi
aggcguaaaaaggcgc

SEQ ID NO: 1654129 - RNA, 16 nt, Salmonella enterica enterica serovar Typhi
aggcuccgagacucaa

SEQ ID NO: 1654130 - RNA, 16 nt, Salmonella enterica enterica serovar Typhi
aggcucaucagcgcca

SEQ ID NO: 1654131 - RNA, 22 nt, Salmonella enterica enterica serovar Typhi
aggcgaccguuccguccgucag

SEQ ID NO: 1654132 - RNA, 17 nt, Salmonella enterica enterica serovar Typhi
aggcgaacuacaggcga

SEQ ID NO: 1654133 - RNA, 17 nt, Salmonella enterica enterica serovar Typhi
aggcgacgcgauagcgc

SEQ ID NO: 1654134 - RNA, 23 nt, Salmonella enterica enterica serovar Typhi
aggcgacuaccguucacggcgau

SEQ ID NO: 1654135 - RNA, 17 nt, Salmonella enterica enterica serovar Typhi
aggcgacucauuacgcc

SEQ ID NO: 1654136 - RNA, 20 nt, Salmonella enterica enterica serovar Typhi
aggccugauaagcgcagcgc

SEQ ID NO: 1654137 - RNA, 12 nt, Salmonella enterica enterica serovar Typhi
cacaguacgccc

SEQ ID NO: 1654138 - RNA, 16 nt, Salmonella enterica enterica serovar Typhi
cacaggcugcggcacg

SEQ ID NO: 1654139 - RNA, 18 nt, Salmonella enterica enterica serovar Typhi
cacagguaaacgcauagg

SEQ ID NO: 1654140 - RNA, 23 nt, Salmonella enterica enterica serovar Typhi
cacagcguaggccaggcauccgg

SEQ ID NO: 1654141 - RNA, 17 nt, Salmonella enterica enterica serovar Typhi
cacaggagccaguuuuc

SEQ ID NO: 1654142 - RNA, 21 nt, Salmonella enterica enterica serovar Typhi
cacaucaaagccccauaaccg

SEQ ID NO: 1654143 - RNA, 20 nt, Salmonella enterica enterica serovar Typhi
cacauaacugagacucagca

SEQ ID NO: 1654144 - RNA, 15 nt, Salmonella enterica enterica serovar Typhi
cacaucuacucauau

SEQ ID NO: 1654145 - RNA, 16 nt, Salmonella enterica enterica serovar Typhi
cacaucguuacccauu

SEQ ID NO: 1654146 - RNA, 22 nt, Salmonella enterica enterica serovar Typhi
caccacaaagcgguaaaucgca

SEQ ID NO: 1654147 - RNA, 15 nt, Salmonella enterica enterica serovar Typhi
cacauuucaaacguu

SEQ ID NO: 1654148 - RNA, 19 nt, Salmonella enterica enterica serovar Typhi
caccaacgccgcuuuaccg

SEQ ID NO: 1654149 - RNA, 16 nt, Salmonella enterica enterica serovar Typhi
cacaacacggcggcua

SEQ ID NO: 1654150 - RNA, 22 nt, Salmonella enterica enterica serovar Typhi
cacaaacgccgucacaaagccc

SEQ ID NO: 1654151 - RNA, 18 nt, Salmonella enterica enterica serovar Typhi
cacaccacgugcggacgu

SEQ ID NO: 1654152 - RNA, 16 nt, Salmonella enterica enterica serovar Typhi
cacaccauuucacaaa

SEQ ID NO: 1654153 - RNA, 20 nt, Salmonella enterica enterica serovar Typhi
cacagccaucuucugcguca

SEQ ID NO: 1654154 - RNA, 17 nt, Salmonella enterica enterica serovar Typhi
cacagccaaaauaugcu

SEQ ID NO: 1654155 - RNA, 18 nt, Salmonella enterica enterica serovar Typhi
cacagccaguggcgaaac

SEQ ID NO: 1654156 - RNA, 15 nt, Salmonella enterica enterica serovar Typhi
cacagaaucgcugug

SEQ ID NO: 1654157 - RNA, 20 nt, Salmonella enterica enterica serovar Typhi
cacagagaucgugcauccgg

SEQ ID NO: 1654158 - RNA, 16 nt, Salmonella enterica enterica serovar Typhi
cacagacagaugcagg

SEQ ID NO: 1654159 - RNA, 15 nt, Salmonella enterica enterica serovar Typhi
caaugaaccagccca

SEQ ID NO: 1654160 - RNA, 13 nt, Salmonella enterica enterica serovar Typhi
caaugauccggac

SEQ ID NO: 1654161 - RNA, 14 nt, Salmonella enterica enterica serovar Typhi
caaugaucagcgac

SEQ ID NO: 1654162 - RNA, 19 nt, Salmonella enterica enterica serovar Typhi
caaugagacaacggcgacc

SEQ ID NO: 1654163 - RNA, 21 nt, Salmonella enterica enterica serovar Typhi
caaugacgcuucguuccgcga

SEQ ID NO: 1654164 - RNA, 15 nt, Salmonella enterica enterica serovar Typhi
caauuccgccauaac

SEQ ID NO: 1654165 - RNA, 20 nt, Salmonella enterica enterica serovar Typhi
caaugcuggcaggcgcgacc

SEQ ID NO: 1654166 - RNA, 19 nt, Salmonella enterica enterica serovar Typhi
caauggccgcagcgccaua

SEQ ID NO: 1654167 - RNA, 14 nt, Salmonella enterica enterica serovar Typhi
caccacgucauccg

SEQ ID NO: 1654168 - RNA, 23 nt, Salmonella enterica enterica serovar Typhi
caccacuggcagcgccugacggc

SEQ ID NO: 1654169 - RNA, 18 nt, Salmonella enterica enterica serovar Typhi
caccagucgaccgcagac

SEQ ID NO: 1654170 - RNA, 23 nt, Salmonella enterica enterica serovar Typhi
caccaucacuaccauuuccggcg

SEQ ID NO: 1654171 - RNA, 23 nt, Salmonella enterica enterica serovar Typhi
cacccgggaaaaaugacgccggg

SEQ ID NO: 1654172 - RNA, 15 nt, Salmonella enterica enterica serovar Typhi
caccauguugcgcag

SEQ ID NO: 1654173 - RNA, 20 nt, Salmonella enterica enterica serovar Typhi
cacccgaacaacaauacgcg

SEQ ID NO: 1654174 - RNA, 17 nt, Salmonella enterica enterica serovar Typhi
caccgcaucggcaucaa

SEQ ID NO: 1654175 - RNA, 16 nt, Salmonella enterica enterica serovar Typhi
caccgcauagacgugc

SEQ ID NO: 1654176 - RNA, 17 nt, Salmonella enterica enterica serovar Typhi
caccgcgaauauacgca

SEQ ID NO: 1654177 - RNA, 13 nt, Salmonella enterica enterica serovar Typhi
caccgccagccau

SEQ ID NO: 1654178 - RNA, 17 nt, Salmonella enterica enterica serovar Typhi
caacgcgcaucaacgcc

SEQ ID NO: 1654179 - RNA, 18 nt, Salmonella enterica enterica serovar Typhi
caacgccgcuuuaccgcc

SEQ ID NO: 1654180 - RNA, 20 nt, Salmonella enterica enterica serovar Typhi
caaccgagcagcuuggcggc

SEQ ID NO: 1654181 - RNA, 16 nt, Salmonella enterica enterica serovar Typhi
caacgaaaaucauccg

SEQ ID NO: 1654182 - RNA, 11 nt, Salmonella enterica enterica serovar Typhi
caacgaccaga

SEQ ID NO: 1654183 - RNA, 17 nt, Salmonella enterica enterica serovar Typhi
caacgaccagugaacgu

SEQ ID NO: 1654184 - RNA, 15 nt, Salmonella enterica enterica serovar Typhi
caacagcucgccaug

SEQ ID NO: 1654185 - RNA, 16 nt, Salmonella enterica enterica serovar Typhi
caacagcucgccaugc

SEQ ID NO: 1654186 - RNA, 21 nt, Salmonella enterica enterica serovar Typhi
caacagcgaccacgccaccgc

SEQ ID NO: 1654187 - RNA, 21 nt, Salmonella enterica enterica serovar Typhi
caaauaagguggcuaacccgc

SEQ ID NO: 1654188 - RNA, 18 nt, Salmonella enterica enterica serovar Typhi
caaccacggauaagccag

SEQ ID NO: 1654189 - RNA, 21 nt, Salmonella enterica enterica serovar Typhi
caacaucagcgcuaccagcgc

SEQ ID NO: 1654190 - RNA, 23 nt, Salmonella enterica enterica serovar Typhi
caacuuguuuccuguucggggaa

SEQ ID NO: 1654191 - RNA, 15 nt, Salmonella enterica enterica serovar Typhi
caagaauacccuuua

SEQ ID NO: 1654192 - RNA, 15 nt, Salmonella enterica enterica serovar Typhi
caagaaucacgccga

SEQ ID NO: 1654193 - RNA, 17 nt, Salmonella enterica enterica serovar Typhi
caagacccgaaccugcg

SEQ ID NO: 1654194 - RNA, 20 nt, Salmonella enterica enterica serovar Typhi
caagacacagcgucgcgcga

SEQ ID NO: 1654195 - RNA, 15 nt, Salmonella enterica enterica serovar Typhi
caacuggcgccggag

SEQ ID NO: 1654196 - RNA, 19 nt, Salmonella enterica enterica serovar Typhi
caacucugugcguucgcga

SEQ ID NO: 1654197 - RNA, 20 nt, Salmonella enterica enterica serovar Typhi
caacucugugcguucgcgaa

SEQ ID NO: 1654198 - RNA, 21 nt, Salmonella enterica enterica serovar Typhi
caacucuuuacccagcgggug

SEQ ID NO: 1654199 - RNA, 16 nt, Salmonella enterica enterica serovar Typhi
caacggcccgaagggu

SEQ ID NO: 1654200 - RNA, 19 nt, Salmonella enterica enterica serovar Typhi
caagcccgguaaaauagcc

SEQ ID NO: 1654201 - RNA, 18 nt, Salmonella enterica enterica serovar Typhi
caagcggcaucucgccaa

SEQ ID NO: 1654202 - RNA, 20 nt, Salmonella enterica enterica serovar Typhi
caagcgcggcgaaauaggcc

SEQ ID NO: 1654203 - RNA, 18 nt, Salmonella enterica enterica serovar Typhi
caaggcaucgucggcgau

SEQ ID NO: 1654204 - RNA, 20 nt, Salmonella enterica enterica serovar Typhi
caagcaccuuauccggccua

SEQ ID NO: 1654205 - RNA, 18 nt, Salmonella enterica enterica serovar Typhi
caagcaccuuauccggcc

SEQ ID NO: 1654206 - RNA, 15 nt, Salmonella enterica enterica serovar Typhi
caagccauugcgcgc

SEQ ID NO: 1654207 - RNA, 22 nt, Salmonella enterica enterica serovar Typhi
caagcauaaaaaacaucaugcc

SEQ ID NO: 1654208 - RNA, 20 nt, Salmonella enterica enterica serovar Typhi
caagcaggcgaucggcguga

SEQ ID NO: 1654209 - RNA, 21 nt, Salmonella enterica enterica serovar Typhi
caagcauaaaccggcggccua

SEQ ID NO: 1654210 - RNA, 21 nt, Salmonella enterica enterica serovar Typhi
caaacacuaccgggcagcauc

SEQ ID NO: 1654211 - RNA, 14 nt, Salmonella enterica enterica serovar Typhi
caaacacgaccagc

SEQ ID NO: 1654212 - RNA, 19 nt, Salmonella enterica enterica serovar Typhi
caaacaccugaaccagcgc

SEQ ID NO: 1654213 - RNA, 19 nt, Salmonella enterica enterica serovar Typhi
caaaaucuuuccagcucca

SEQ ID NO: 1654214 - RNA, 19 nt, Salmonella enterica enterica serovar Typhi
caaaaucgcccaggccuga

SEQ ID NO: 1654215 - RNA, 22 nt, Salmonella enterica enterica serovar Typhi
caaaauaugggauuugaugccc

SEQ ID NO: 1654216 - RNA, 23 nt, Salmonella enterica enterica serovar Typhi
caaaagcugugacgacguaacgg

SEQ ID NO: 1654217 - RNA, 17 nt, Salmonella enterica enterica serovar Typhi
caaaaggauacagcgcc

SEQ ID NO: 1654218 - RNA, 21 nt, Salmonella enterica enterica serovar Typhi
caaaaaugauguguuucagca

SEQ ID NO: 1654219 - RNA, 16 nt, Salmonella enterica enterica serovar Typhi
caaacggaauagcgcc

SEQ ID NO: 1654220 - RNA, 17 nt, Salmonella enterica enterica serovar Typhi
caaagcccaucagcgcc

SEQ ID NO: 1654221 - RNA, 13 nt, Salmonella enterica enterica serovar Typhi
caaagccaggccg

SEQ ID NO: 1654222 - RNA, 15 nt, Salmonella enterica enterica serovar Typhi
caaagcagcugcugg

SEQ ID NO: 1654223 - RNA, 14 nt, Salmonella enterica enterica serovar Typhi
caaaccaaacugau

SEQ ID NO: 1654224 - RNA, 16 nt, Salmonella enterica enterica serovar Typhi
caaacgccgugaacgc

SEQ ID NO: 1654225 - RNA, 14 nt, Salmonella enterica enterica serovar Typhi
caaacgcgacaacg

SEQ ID NO: 1654226 - RNA, 22 nt, Salmonella enterica enterica serovar Typhi
caaaaaaaaucccgccagcggc

SEQ ID NO: 1654227 - RNA, 14 nt, Salmonella enterica enterica serovar Typhi
auuuuucagauaac

SEQ ID NO: 1654228 - RNA, 13 nt, Salmonella enterica enterica serovar Typhi
caaaaaaucagca

SEQ ID NO: 1654229 - RNA, 15 nt, Salmonella enterica enterica serovar Typhi
caaaaauuugcgcga

SEQ ID NO: 1654230 - RNA, 16 nt, Salmonella enterica enterica serovar Typhi
caaaaaucagcccgga

SEQ ID NO: 1654231 - RNA, 21 nt, Salmonella enterica enterica serovar Typhi
auuuuggggaaaauaccggua

SEQ ID NO: 1654232 - RNA, 22 nt, Salmonella enterica enterica serovar Typhi
auuuuuagcgugccgacguuca

SEQ ID NO: 1654233 - RNA, 16 nt, Salmonella enterica enterica serovar Typhi
auuuuuauauuccgca

SEQ ID NO: 1654234 - RNA, 19 nt, Salmonella enterica enterica serovar Typhi
auuuucggcaucagcagga

SEQ ID NO: 1654235 - RNA, 15 nt, Salmonella enterica enterica serovar Typhi
auuuuccccagaauc

SEQ ID NO: 1654236 - RNA, 16 nt, Salmonella enterica enterica serovar Typhi
auuuuccaggccgcca

SEQ ID NO: 1654237 - RNA, 14 nt, Salmonella enterica enterica serovar Typhi
auuuucaguuuuac

SEQ ID NO: 1654238 - RNA, 17 nt, Salmonella enterica enterica serovar Typhi
auuugcgucguuaacug

SEQ ID NO: 1654239 - RNA, 16 nt, Salmonella enterica enterica serovar Typhi
auuuguuaguccgccu

SEQ ID NO: 1654240 - RNA, 15 nt, Salmonella enterica enterica serovar Typhi
auuuguuucaucgcc

SEQ ID NO: 1654241 - RNA, 15 nt, Salmonella enterica enterica serovar Typhi
auuucucgccgccau

SEQ ID NO: 1654242 - RNA, 15 nt, Salmonella enterica enterica serovar Typhi
auuucuccugcgcca

SEQ ID NO: 1654243 - RNA, 13 nt, Salmonella enterica enterica serovar Typhi
auuucugcugcca

SEQ ID NO: 1654244 - RNA, 14 nt, Salmonella enterica enterica serovar Typhi
auuucuuccagcac

SEQ ID NO: 1654245 - RNA, 17 nt, Salmonella enterica enterica serovar Typhi
auuucuugcaauagcgc

SEQ ID NO: 1654246 - RNA, 19 nt, Salmonella enterica enterica serovar Typhi
auuucuuugguuucgcggu

SEQ ID NO: 1654247 - RNA, 20 nt, Salmonella enterica enterica serovar Typhi
auuuccuguguuacgccaau

SEQ ID NO: 1654248 - RNA, 13 nt, Salmonella enterica enterica serovar Typhi
auuucgaucggcc

SEQ ID NO: 1654249 - RNA, 22 nt, Salmonella enterica enterica serovar Typhi
auuucgaucuguuuaaguacgc

SEQ ID NO: 1654250 - RNA, 17 nt, Salmonella enterica enterica serovar Typhi
auuucgaugaugaccga

SEQ ID NO: 1654251 - RNA, 15 nt, Salmonella enterica enterica serovar Typhi
auuucguagccgcgc

SEQ ID NO: 1654252 - RNA, 14 nt, Salmonella enterica enterica serovar Typhi
auuucgucaucgcu

SEQ ID NO: 1654253 - RNA, 15 nt, Salmonella enterica enterica serovar Typhi
auuucgcguucgcuu

SEQ ID NO: 1654254 - RNA, 13 nt, Salmonella enterica enterica serovar Typhi
auuucggcaauga

SEQ ID NO: 1654255 - RNA, 16 nt, Salmonella enterica enterica serovar Typhi
auuucacgcagcacgu

SEQ ID NO: 1654256 - RNA, 21 nt, Salmonella enterica enterica serovar Typhi
auuucaccgggccaaugccgc

SEQ ID NO: 1654257 - RNA, 14 nt, Salmonella enterica enterica serovar Typhi
auuuaucagacaau

SEQ ID NO: 1654258 - RNA, 13 nt, Salmonella enterica enterica serovar Typhi
auuuaugccgcca

SEQ ID NO: 1654259 - RNA, 16 nt, Salmonella enterica enterica serovar Typhi
auuuaugccgccaucc

SEQ ID NO: 1654260 - RNA, 18 nt, Salmonella enterica enterica serovar Typhi
auuuccgcagccagaauc

SEQ ID NO: 1654261 - RNA, 14 nt, Salmonella enterica enterica serovar Typhi
auuuccgccgccag

SEQ ID NO: 1654262 - RNA, 17 nt, Salmonella enterica enterica serovar Typhi
auuuccgcgcaaucgcc

SEQ ID NO: 1654263 - RNA, 13 nt, Salmonella enterica enterica serovar Typhi
auuuccggcgcau

SEQ ID NO: 1654264 - RNA, 16 nt, Salmonella enterica enterica serovar Typhi
auuuccgcuucgcggg

SEQ ID NO: 1654265 - RNA, 15 nt, Salmonella enterica enterica serovar Typhi
auuucagcacgcuua

SEQ ID NO: 1654266 - RNA, 23 nt, Salmonella enterica enterica serovar Typhi
auuucacuggccguuuucccggc

SEQ ID NO: 1654267 - RNA, 21 nt, Salmonella enterica enterica serovar Typhi
auuucagugaaucgacggcaa

SEQ ID NO: 1654268 - RNA, 14 nt, Salmonella enterica enterica serovar Typhi
auuuccagcgggcg

SEQ ID NO: 1654269 - RNA, 14 nt, Salmonella enterica enterica serovar Typhi
auuucauucagacc

SEQ ID NO: 1654270 - RNA, 16 nt, Salmonella enterica enterica serovar Typhi
auucccccauccgcgc

SEQ ID NO: 1654271 - RNA, 13 nt, Salmonella enterica enterica serovar Typhi
auucccagcgccc

SEQ ID NO: 1654272 - RNA, 17 nt, Salmonella enterica enterica serovar Typhi
auuuagagugauccacc

SEQ ID NO: 1654273 - RNA, 17 nt, Salmonella enterica enterica serovar Typhi
auuuacugugauccacc

SEQ ID NO: 1654274 - RNA, 19 nt, Salmonella enterica enterica serovar Typhi
auuuauccacgccgcuauc

SEQ ID NO: 1654275 - RNA, 16 nt, Salmonella enterica enterica serovar Typhi
aucccagggcggcguc

SEQ ID NO: 1654276 - RNA, 22 nt, Salmonella enterica enterica serovar Typhi
aucccaaucaggcuugagcgau

SEQ ID NO: 1654277 - RNA, 15 nt, Salmonella enterica enterica serovar Typhi
aucccaccggaaaug

SEQ ID NO: 1654278 - RNA, 20 nt, Salmonella enterica enterica serovar Typhi
auccccccuuuuuugcuggc

SEQ ID NO: 1654279 - RNA, 17 nt, Salmonella enterica enterica serovar Typhi
auccccagucuuccugc

SEQ ID NO: 1654280 - RNA, 19 nt, Salmonella enterica enterica serovar Typhi
aucccaguugaucggccag

SEQ ID NO: 1654281 - RNA, 16 nt, Salmonella enterica enterica serovar Typhi
auccccaccgcugaug

SEQ ID NO: 1654282 - RNA, 18 nt, Salmonella enterica enterica serovar Typhi
auccaguauuuuuaucgu

SEQ ID NO: 1654283 - RNA, 18 nt, Salmonella enterica enterica serovar Typhi
auccauuaaaugcgccag

SEQ ID NO: 1654284 - RNA, 13 nt, Salmonella enterica enterica serovar Typhi
auccaucagccag

SEQ ID NO: 1654285 - RNA, 18 nt, Salmonella enterica enterica serovar Typhi
auccacugagcgcgccau

SEQ ID NO: 1654286 - RNA, 23 nt, Salmonella enterica enterica serovar Typhi
auccagaaggcaaaaugccagcc

SEQ ID NO: 1654287 - RNA, 23 nt, Salmonella enterica enterica serovar Typhi
auccagaaccguugcgcccauca

SEQ ID NO: 1654288 - RNA, 18 nt, Salmonella enterica enterica serovar Typhi
auccagcucuuucaaucc

SEQ ID NO: 1654289 - RNA, 17 nt, Salmonella enterica enterica serovar Typhi
auccaggucuuccgccg

SEQ ID NO: 1654290 - RNA, 17 nt, Salmonella enterica enterica serovar Typhi
auccagcgucgccagca

SEQ ID NO: 1654291 - RNA, 18 nt, Salmonella enterica enterica serovar Typhi
auccagcguagcggugua

SEQ ID NO: 1654292 - RNA, 16 nt, Salmonella enterica enterica serovar Typhi
auccagcgcucaauca

SEQ ID NO: 1654293 - RNA, 21 nt, Salmonella enterica enterica serovar Typhi
auccggccuacagguugucgc

SEQ ID NO: 1654294 - RNA, 11 nt, Salmonella enterica enterica serovar Typhi
auccggcauuu

SEQ ID NO: 1654295 - RNA, 23 nt, Salmonella enterica enterica serovar Typhi
auccggccugcaggcaacguuac

SEQ ID NO: 1654296 - RNA, 17 nt, Salmonella enterica enterica serovar Typhi
auccggccugcggugua

SEQ ID NO: 1654297 - RNA, 15 nt, Salmonella enterica enterica serovar Typhi
auccguacuuucuac

SEQ ID NO: 1654298 - RNA, 20 nt, Salmonella enterica enterica serovar Typhi
auccguagcggauugccgcg

SEQ ID NO: 1654299 - RNA, 23 nt, Salmonella enterica enterica serovar Typhi
auccguacauaacagcagcagac

SEQ ID NO: 1654300 - RNA, 19 nt, Salmonella enterica enterica serovar Typhi
auccgcgccggguuuggcg

SEQ ID NO: 1654301 - RNA, 21 nt, Salmonella enterica enterica serovar Typhi
aucccggagagagcaacuggc

SEQ ID NO: 1654302 - RNA, 16 nt, Salmonella enterica enterica serovar Typhi
aucccugaucggccag

SEQ ID NO: 1654303 - RNA, 12 nt, Salmonella enterica enterica serovar Typhi
aucccguagcgu

SEQ ID NO: 1654304 - RNA, 22 nt, Salmonella enterica enterica serovar Typhi
auccccgccgagaaaauaccgc

SEQ ID NO: 1654305 - RNA, 17 nt, Salmonella enterica enterica serovar Typhi
auccccguuuucgccgg

SEQ ID NO: 1654306 - RNA, 21 nt, Salmonella enterica enterica serovar Typhi
auccccucuuccaucagccag

SEQ ID NO: 1654307 - RNA, 18 nt, Salmonella enterica enterica serovar Typhi
aucccgaacaugccgccg

SEQ ID NO: 1654308 - RNA, 18 nt, Salmonella enterica enterica serovar Typhi
aucccgccgcauccuuau

SEQ ID NO: 1654309 - RNA, 19 nt, Salmonella enterica enterica serovar Typhi
auauugccauucgccagcc

SEQ ID NO: 1654310 - RNA, 21 nt, Salmonella enterica enterica serovar Typhi
auauugcccaucgcgccauga

SEQ ID NO: 1654311 - RNA, 21 nt, Salmonella enterica enterica serovar Typhi
auauugaccgcuuuuuccagc

SEQ ID NO: 1654312 - RNA, 21 nt, Salmonella enterica enterica serovar Typhi
auauugcgaauaaaacugccg

SEQ ID NO: 1654313 - RNA, 20 nt, Salmonella enterica enterica serovar Typhi
aucagcuuuucaugacgcga

SEQ ID NO: 1654314 - RNA, 16 nt, Salmonella enterica enterica serovar Typhi
aucagcuuugcggcca

SEQ ID NO: 1654315 - RNA, 17 nt, Salmonella enterica enterica serovar Typhi
aucaggccuacauccgg

SEQ ID NO: 1654316 - RNA, 20 nt, Salmonella enterica enterica serovar Typhi
aucaggccgacaaaugacgu

SEQ ID NO: 1654317 - RNA, 21 nt, Salmonella enterica enterica serovar Typhi
aucaggcaaaaaucgucauca

SEQ ID NO: 1654318 - RNA, 19 nt, Salmonella enterica enterica serovar Typhi
aucaggcuuugcgccaucg

SEQ ID NO: 1654319 - RNA, 16 nt, Salmonella enterica enterica serovar Typhi
aucaggccugccugau

SEQ ID NO: 1654320 - RNA, 12 nt, Salmonella enterica enterica serovar Typhi
aucaggcguaga

SEQ ID NO: 1654321 - RNA, 21 nt, Salmonella enterica enterica serovar Typhi
aucaggccugccugaucgcca

SEQ ID NO: 1654322 - RNA, 21 nt, Salmonella enterica enterica serovar Typhi
aucaggccugugguaugugcc

SEQ ID NO: 1654323 - RNA, 14 nt, Salmonella enterica enterica serovar Typhi
aucaguaacacaau

SEQ ID NO: 1654324 - RNA, 14 nt, Salmonella enterica enterica serovar Typhi
aucagucgcagcgg

SEQ ID NO: 1654325 - RNA, 20 nt, Salmonella enterica enterica serovar Typhi
aucagguaucccgccagcgg

SEQ ID NO: 1654326 - RNA, 21 nt, Salmonella enterica enterica serovar Typhi
aucaggggcgaacccaucagg

SEQ ID NO: 1654327 - RNA, 19 nt, Salmonella enterica enterica serovar Typhi
aucaucaccguuuuccagg

SEQ ID NO: 1654328 - RNA, 20 nt, Salmonella enterica enterica serovar Typhi
aucauaguuuuuccccauca

SEQ ID NO: 1654329 - RNA, 22 nt, Salmonella enterica enterica serovar Typhi
aucauaagggagcugacugcaa

SEQ ID NO: 1654330 - RNA, 20 nt, Salmonella enterica enterica serovar Typhi
aucauacugaagauaaacag

SEQ ID NO: 1654331 - RNA, 22 nt, Salmonella enterica enterica serovar Typhi
aucaguccccagcguaccacgc

SEQ ID NO: 1654332 - RNA, 14 nt, Salmonella enterica enterica serovar Typhi
auccaccuuauccu

SEQ ID NO: 1654333 - RNA, 15 nt, Salmonella enterica enterica serovar Typhi
auccacgccuggcag

SEQ ID NO: 1654334 - RNA, 13 nt, Salmonella enterica enterica serovar Typhi
auccacagcgcca

SEQ ID NO: 1654335 - RNA, 17 nt, Salmonella enterica enterica serovar Typhi
auccacagguuaucgcc

SEQ ID NO: 1654336 - RNA, 14 nt, Salmonella enterica enterica serovar Typhi
aucauucgcgucau

SEQ ID NO: 1654337 - RNA, 21 nt, Salmonella enterica enterica serovar Typhi
aucauuuggaggccggauaag

SEQ ID NO: 1654338 - RNA, 15 nt, Salmonella enterica enterica serovar Typhi
aucauugcgccaaga

SEQ ID NO: 1654339 - RNA, 21 nt, Salmonella enterica enterica serovar Typhi
aucauugccuguaucgcuauc

SEQ ID NO: 1654340 - RNA, 14 nt, Salmonella enterica enterica serovar Typhi
aucauugcgccaag

SEQ ID NO: 1654341 - RNA, 16 nt, Salmonella enterica enterica serovar Typhi
aucaugcagccggcga

SEQ ID NO: 1654342 - RNA, 18 nt, Salmonella enterica enterica serovar Typhi
aucaugcccacaggcagg

SEQ ID NO: 1654343 - RNA, 21 nt, Salmonella enterica enterica serovar Typhi
aucaugcguccgcccagaaag

SEQ ID NO: 1654344 - RNA, 13 nt, Salmonella enterica enterica serovar Typhi
aucaugcccggca

SEQ ID NO: 1654345 - RNA, 14 nt, Salmonella enterica enterica serovar Typhi
aucaugaaaaacag

SEQ ID NO: 1654346 - RNA, 15 nt, Salmonella enterica enterica serovar Typhi
aucaucuuuuaccgc

SEQ ID NO: 1654347 - RNA, 19 nt, Salmonella enterica enterica serovar Typhi
aucaucguaaaaucaacag

SEQ ID NO: 1654348 - RNA, 16 nt, Salmonella enterica enterica serovar Typhi
aucaucucauaaaccg

SEQ ID NO: 1654349 - RNA, 19 nt, Salmonella enterica enterica serovar Typhi
aucaucucccaggccgcca

SEQ ID NO: 1654350 - RNA, 16 nt, Salmonella enterica enterica serovar Typhi
aucaucggcacagcca

SEQ ID NO: 1654351 - RNA, 13 nt, Salmonella enterica enterica serovar Typhi
aucaucgcuauca

SEQ ID NO: 1654352 - RNA, 16 nt, Salmonella enterica enterica serovar Typhi
aucaucgcgaucgcca

SEQ ID NO: 1654353 - RNA, 14 nt, Salmonella enterica enterica serovar Typhi
aucauccccggcag

SEQ ID NO: 1654354 - RNA, 15 nt, Salmonella enterica enterica serovar Typhi
aucaucagaacgccu

SEQ ID NO: 1654355 - RNA, 15 nt, Salmonella enterica enterica serovar Typhi
aucaucagaccgaua

SEQ ID NO: 1654356 - RNA, 19 nt, Salmonella enterica enterica serovar Typhi
aucaucaucggcacagcca

SEQ ID NO: 1654357 - RNA, 21 nt, Salmonella enterica enterica serovar Typhi
aucaucauggcugauggcgaa

SEQ ID NO: 1654358 - RNA, 21 nt, Salmonella enterica enterica serovar Typhi
aucaucaucucugucgaccau

SEQ ID NO: 1654359 - RNA, 16 nt, Salmonella enterica enterica serovar Typhi
aucguccggcaucgug

SEQ ID NO: 1654360 - RNA, 13 nt, Salmonella enterica enterica serovar Typhi
aucguaugcgccu

SEQ ID NO: 1654361 - RNA, 22 nt, Salmonella enterica enterica serovar Typhi
aucgucggacaacguaccggca

SEQ ID NO: 1654362 - RNA, 19 nt, Salmonella enterica enterica serovar Typhi
aucgucgcgguugccguca

SEQ ID NO: 1654363 - RNA, 14 nt, Salmonella enterica enterica serovar Typhi
aucguuauccagca

SEQ ID NO: 1654364 - RNA, 20 nt, Salmonella enterica enterica serovar Typhi
aucguuaucauuaucgccaa

SEQ ID NO: 1654365 - RNA, 18 nt, Salmonella enterica enterica serovar Typhi
aucguuauccagcagcca

SEQ ID NO: 1654366 - RNA, 17 nt, Salmonella enterica enterica serovar Typhi
aucuccagaccgcugcg

SEQ ID NO: 1654367 - RNA, 22 nt, Salmonella enterica enterica serovar Typhi
aucucguuuuacgccuucggcg

SEQ ID NO: 1654368 - RNA, 14 nt, Salmonella enterica enterica serovar Typhi
aucucuuuauugcu

SEQ ID NO: 1654369 - RNA, 16 nt, Salmonella enterica enterica serovar Typhi
aucggcauacagcgau

SEQ ID NO: 1654370 - RNA, 17 nt, Salmonella enterica enterica serovar Typhi
aucggcaugauggcgaa

SEQ ID NO: 1654371 - RNA, 22 nt, Salmonella enterica enterica serovar Typhi
aucggacgguuuugcgccaucc

SEQ ID NO: 1654372 - RNA, 20 nt, Salmonella enterica enterica serovar Typhi
aucgggcgggcauuauacgc

SEQ ID NO: 1654373 - RNA, 16 nt, Salmonella enterica enterica serovar Typhi
aucgggaaucaucgag

SEQ ID NO: 1654374 - RNA, 21 nt, Salmonella enterica enterica serovar Typhi
aucggcuuugacguaauaccg

SEQ ID NO: 1654375 - RNA, 19 nt, Salmonella enterica enterica serovar Typhi
aucgguuugagcaccacgc

SEQ ID NO: 1654376 - RNA, 14 nt, Salmonella enterica enterica serovar Typhi
aucgguuucgcggc

SEQ ID NO: 1654377 - RNA, 17 nt, Salmonella enterica enterica serovar Typhi
aucgggcuuccagcguu

SEQ ID NO: 1654378 - RNA, 20 nt, Salmonella enterica enterica serovar Typhi
aucgguaaaggucgccgcau

SEQ ID NO: 1654379 - RNA, 21 nt, Salmonella enterica enterica serovar Typhi
aucgauggcagucgcaucaug

SEQ ID NO: 1654380 - RNA, 15 nt, Salmonella enterica enterica serovar Typhi
aucgauaaagaacgc

SEQ ID NO: 1654381 - RNA, 14 nt, Salmonella enterica enterica serovar Typhi
aucgauauaucgcg

SEQ ID NO: 1654382 - RNA, 19 nt, Salmonella enterica enterica serovar Typhi
aucgauauaucgcgucauc

SEQ ID NO: 1654383 - RNA, 17 nt, Salmonella enterica enterica serovar Typhi
aucgccagcagggucag

SEQ ID NO: 1654384 - RNA, 14 nt, Salmonella enterica enterica serovar Typhi
aucgccaucgcgaa

SEQ ID NO: 1654385 - RNA, 18 nt, Salmonella enterica enterica serovar Typhi
aucgccaucauagcccau

SEQ ID NO: 1654386 - RNA, 14 nt, Salmonella enterica enterica serovar Typhi
aucgccauccugca

SEQ ID NO: 1654387 - RNA, 20 nt, Salmonella enterica enterica serovar Typhi
aucgcagagcguaauuccgc

SEQ ID NO: 1654388 - RNA, 21 nt, Salmonella enterica enterica serovar Typhi
aucgcagucagccuugaccgc

SEQ ID NO: 1654389 - RNA, 18 nt, Salmonella enterica enterica serovar Typhi
aucgcaugacuacgaauc

SEQ ID NO: 1654390 - RNA, 24 nt, Salmonella enterica enterica serovar Typhi
aucgccaaacgccaucacuucgcg

SEQ ID NO: 1654391 - RNA, 22 nt, Salmonella enterica enterica serovar Typhi
aucgccuccagacuggcgaccg

SEQ ID NO: 1654392 - RNA, 17 nt, Salmonella enterica enterica serovar Typhi
aucgccgaaagcgauca

SEQ ID NO: 1654393 - RNA, 16 nt, Salmonella enterica enterica serovar Typhi
aucgccugaugaccgc

SEQ ID NO: 1654394 - RNA, 15 nt, Salmonella enterica enterica serovar Typhi
aucgcguacagcgcc

SEQ ID NO: 1654395 - RNA, 15 nt, Salmonella enterica enterica serovar Typhi
aucgcggucagcggc

SEQ ID NO: 1654396 - RNA, 21 nt, Salmonella enterica enterica serovar Typhi
aucgcgauaucaacccaguuu

SEQ ID NO: 1654397 - RNA, 13 nt, Salmonella enterica enterica serovar Typhi
aucgcggcgcuga

SEQ ID NO: 1654398 - RNA, 16 nt, Salmonella enterica enterica serovar Typhi
aucgcuugguauggcg

SEQ ID NO: 1654399 - RNA, 18 nt, Salmonella enterica enterica serovar Typhi
aucgcuucuauuaccgca

SEQ ID NO: 1654400 - RNA, 24 nt, Salmonella enterica enterica serovar Typhi
aucgcuuauuuucgucguuucuac

SEQ ID NO: 1654401 - RNA, 15 nt, Salmonella enterica enterica serovar Typhi
aucgcgucgccauca

SEQ ID NO: 1654402 - RNA, 22 nt, Salmonella enterica enterica serovar Typhi
aucgcgucguucacgucgcgaa

SEQ ID NO: 1654403 - RNA, 13 nt, Salmonella enterica enterica serovar Typhi
auggcuuagcgcc

SEQ ID NO: 1654404 - RNA, 15 nt, Salmonella enterica enterica serovar Typhi
auguaccgucaucgc

SEQ ID NO: 1654405 - RNA, 14 nt, Salmonella enterica enterica serovar Typhi
auggccgcagcgcc

SEQ ID NO: 1654406 - RNA, 18 nt, Salmonella enterica enterica serovar Typhi
auggcgcagcauacgcug

SEQ ID NO: 1654407 - RNA, 14 nt, Salmonella enterica enterica serovar Typhi
auggcgauuaacgc

SEQ ID NO: 1654408 - RNA, 24 nt, Salmonella enterica enterica serovar Typhi
auggcggcgaaaugccuuauccgg

SEQ ID NO: 1654409 - RNA, 19 nt, Salmonella enterica enterica serovar Typhi
auggcggucaacgcggcua

SEQ ID NO: 1654410 - RNA, 23 nt, Salmonella enterica enterica serovar Typhi
auggcggcgaaaugccuuauccg

SEQ ID NO: 1654411 - RNA, 19 nt, Salmonella enterica enterica serovar Typhi
auggcggcuaacgccugau

SEQ ID NO: 1654412 - RNA, 21 nt, Salmonella enterica enterica serovar Typhi
auggcgcgaagugccagguuu

SEQ ID NO: 1654413 - RNA, 22 nt, Salmonella enterica enterica serovar Typhi
auggcgcgacgcuuaucagccc

SEQ ID NO: 1654414 - RNA, 22 nt, Salmonella enterica enterica serovar Typhi
auggcgcugcgcuuaucaggcc

SEQ ID NO: 1654415 - RNA, 19 nt, Salmonella enterica enterica serovar Typhi
auggcggauuccaguagcg

SEQ ID NO: 1654416 - RNA, 21 nt, Salmonella enterica enterica serovar Typhi
auggcggcgucgccuguccgg

SEQ ID NO: 1654417 - RNA, 16 nt, Salmonella enterica enterica serovar Typhi
auuaucguaugcagcg

SEQ ID NO: 1654418 - RNA, 14 nt, Salmonella enterica enterica serovar Typhi
auuaucgcuccgga

SEQ ID NO: 1654419 - RNA, 22 nt, Salmonella enterica enterica serovar Typhi
auuauccacaaacuccagacga

SEQ ID NO: 1654420 - RNA, 12 nt, Salmonella enterica enterica serovar Typhi
auuccagccagg

SEQ ID NO: 1654421 - RNA, 19 nt, Salmonella enterica enterica serovar Typhi
auuccaguagcgcgcccau

SEQ ID NO: 1654422 - RNA, 21 nt, Salmonella enterica enterica serovar Typhi
auuccagccgguguuaaccag

SEQ ID NO: 1654423 - RNA, 21 nt, Salmonella enterica enterica serovar Typhi
auuccaguccuuucgacgcau

SEQ ID NO: 1654424 - RNA, 11 nt, Salmonella enterica enterica serovar Typhi
auuacgcgccu

SEQ ID NO: 1654425 - RNA, 19 nt, Salmonella enterica enterica serovar Typhi
auuacggcgaaugcgguaa

SEQ ID NO: 1654426 - RNA, 18 nt, Salmonella enterica enterica serovar Typhi
auuagacaagcaguucug

SEQ ID NO: 1654427 - RNA, 14 nt, Salmonella enterica enterica serovar Typhi
auuagcauccagca

SEQ ID NO: 1654428 - RNA, 18 nt, Salmonella enterica enterica serovar Typhi
auuagagccgauauccgg

SEQ ID NO: 1654429 - RNA, 20 nt, Salmonella enterica enterica serovar Typhi
auuaggcuuuucauucagcg

SEQ ID NO: 1654430 - RNA, 15 nt, Salmonella enterica enterica serovar Typhi
auuagccgccauccg

SEQ ID NO: 1654431 - RNA, 23 nt, Salmonella enterica enterica serovar Typhi
auuaguccgucggggauggcgga

SEQ ID NO: 1654432 - RNA, 16 nt, Salmonella enterica enterica serovar Typhi
auuaucaauagcuuca

SEQ ID NO: 1654433 - RNA, 18 nt, Salmonella enterica enterica serovar Typhi
auuaacccacaugccggu

SEQ ID NO: 1654434 - RNA, 19 nt, Salmonella enterica enterica serovar Typhi
auuaacgucacgauggcga

SEQ ID NO: 1654435 - RNA, 12 nt, Salmonella enterica enterica serovar Typhi
auuaacgcgaaa

SEQ ID NO: 1654436 - RNA, 23 nt, Salmonella enterica enterica serovar Typhi
auuaacgcggugacuuuggccgg

SEQ ID NO: 1654437 - RNA, 23 nt, Salmonella enterica enterica serovar Typhi
auuaagcaggccgauauugcggc

SEQ ID NO: 1654438 - RNA, 17 nt, Salmonella enterica enterica serovar Typhi
auuaagcgaauccagcg

SEQ ID NO: 1654439 - RNA, 17 nt, Salmonella enterica enterica serovar Typhi
auuaagccauauggcau

SEQ ID NO: 1654440 - RNA, 16 nt, Salmonella enterica enterica serovar Typhi
auguuuaaaagcgccu

SEQ ID NO: 1654441 - RNA, 14 nt, Salmonella enterica enterica serovar Typhi
auguuuaccaucgc

SEQ ID NO: 1654442 - RNA, 14 nt, Salmonella enterica enterica serovar Typhi
auguuuuaccagua

SEQ ID NO: 1654443 - RNA, 13 nt, Salmonella enterica enterica serovar Typhi
auuacagccgcga

SEQ ID NO: 1654444 - RNA, 17 nt, Salmonella enterica enterica serovar Typhi
auuacagauauccaccg

SEQ ID NO: 1654445 - RNA, 16 nt, Salmonella enterica enterica serovar Typhi
auuaccaguacggaaa

SEQ ID NO: 1654446 - RNA, 20 nt, Salmonella enterica enterica serovar Typhi
auuacgcccauuaugccgca

SEQ ID NO: 1654447 - RNA, 14 nt, Salmonella enterica enterica serovar Typhi
auuaauggcgcaau

SEQ ID NO: 1654448 - RNA, 16 nt, Salmonella enterica enterica serovar Typhi
auuaaugucguccaug

SEQ ID NO: 1654449 - RNA, 16 nt, Salmonella enterica enterica serovar Typhi
auuaauuuacugauaa

SEQ ID NO: 1654450 - RNA, 23 nt, Salmonella enterica enterica serovar Typhi
auuaauaaccccagcugcggcau

SEQ ID NO: 1654451 - RNA, 12 nt, Salmonella enterica enterica serovar Typhi
auuaauccugcg

SEQ ID NO: 1654452 - RNA, 14 nt, Salmonella enterica enterica serovar Typhi
auuaaucgccagca

SEQ ID NO: 1654453 - RNA, 18 nt, Salmonella enterica enterica serovar Typhi
auuaaucugucgaugcgg

SEQ ID NO: 1654454 - RNA, 17 nt, Salmonella enterica enterica serovar Typhi
auuaaucuuauccagcg

SEQ ID NO: 1654455 - RNA, 20 nt, Salmonella enterica enterica serovar Typhi
augcacgcuuuuuugcuggc

SEQ ID NO: 1654456 - RNA, 20 nt, Salmonella enterica enterica serovar Typhi
augcaaaaaagcccauccgu

SEQ ID NO: 1654457 - RNA, 17 nt, Salmonella enterica enterica serovar Typhi
augcaaucucuuccgcc

SEQ ID NO: 1654458 - RNA, 23 nt, Salmonella enterica enterica serovar Typhi
augcaaucucuuccgcccagaua

SEQ ID NO: 1654459 - RNA, 22 nt, Salmonella enterica enterica serovar Typhi
augcccaccgcgcgcgcggcau

SEQ ID NO: 1654460 - RNA, 23 nt, Salmonella enterica enterica serovar Typhi
augcccagcgccgucauaccgcc

SEQ ID NO: 1654461 - RNA, 17 nt, Salmonella enterica enterica serovar Typhi
augcccgauggcgcugc

SEQ ID NO: 1654462 - RNA, 16 nt, Salmonella enterica enterica serovar Typhi
aucugcgcauuaacgc

SEQ ID NO: 1654463 - RNA, 15 nt, Salmonella enterica enterica serovar Typhi
augacggcaggggcg

SEQ ID NO: 1654464 - RNA, 20 nt, Salmonella enterica enterica serovar Typhi
aucugccgcgcccgccaucg

SEQ ID NO: 1654465 - RNA, 12 nt, Salmonella enterica enterica serovar Typhi
aucugccgucau

SEQ ID NO: 1654466 - RNA, 14 nt, Salmonella enterica enterica serovar Typhi
aucugaugccugaa

SEQ ID NO: 1654467 - RNA, 19 nt, Salmonella enterica enterica serovar Typhi
aucugacggauacguucgc

SEQ ID NO: 1654468 - RNA, 13 nt, Salmonella enterica enterica serovar Typhi
augaugagcgcca

SEQ ID NO: 1654469 - RNA, 15 nt, Salmonella enterica enterica serovar Typhi
augaugagcgccaua

SEQ ID NO: 1654470 - RNA, 18 nt, Salmonella enterica enterica serovar Typhi
augaucguuuccagcauc

SEQ ID NO: 1654471 - RNA, 19 nt, Salmonella enterica enterica serovar Typhi
augaugcauuugauuuguu

SEQ ID NO: 1654472 - RNA, 20 nt, Salmonella enterica enterica serovar Typhi
augaggcgcagccgccaucc

SEQ ID NO: 1654473 - RNA, 18 nt, Salmonella enterica enterica serovar Typhi
augaucgucaggcgccag

SEQ ID NO: 1654474 - RNA, 18 nt, Salmonella enterica enterica serovar Typhi
augcguguagcagauaga

SEQ ID NO: 1654475 - RNA, 14 nt, Salmonella enterica enterica serovar Typhi
augcuaucgcggau

SEQ ID NO: 1654476 - RNA, 16 nt, Salmonella enterica enterica serovar Typhi
augcuauaugcaggca

SEQ ID NO: 1654477 - RNA, 17 nt, Salmonella enterica enterica serovar Typhi
augcuauccgccgccag

SEQ ID NO: 1654478 - RNA, 17 nt, Salmonella enterica enterica serovar Typhi
augcguugucgcugauu

SEQ ID NO: 1654479 - RNA, 18 nt, Salmonella enterica enterica serovar Typhi
augcguuauagacagcgg

SEQ ID NO: 1654480 - RNA, 21 nt, Salmonella enterica enterica serovar Typhi
augcggaaaccaguucacgcg

SEQ ID NO: 1654481 - RNA, 16 nt, Salmonella enterica enterica serovar Typhi
augcgcguuuagcgcc

SEQ ID NO: 1654482 - RNA, 16 nt, Salmonella enterica enterica serovar Typhi
augcgcguugccgcca

SEQ ID NO: 1654483 - RNA, 17 nt, Salmonella enterica enterica serovar Typhi
augcgcguuuagcgcca

SEQ ID NO: 1654484 - RNA, 22 nt, Salmonella enterica enterica serovar Typhi
augcgcguuuagcgccagcagc

SEQ ID NO: 1654485 - RNA, 22 nt, Salmonella enterica enterica serovar Typhi
augcgcgcgcguuaugccgaca

SEQ ID NO: 1654486 - RNA, 16 nt, Salmonella enterica enterica serovar Typhi
augcgcguaauuugcg

SEQ ID NO: 1654487 - RNA, 18 nt, Salmonella enterica enterica serovar Typhi
augcgcguagcccacagg

SEQ ID NO: 1654488 - RNA, 13 nt, Salmonella enterica enterica serovar Typhi
augccuucgccgc

SEQ ID NO: 1654489 - RNA, 13 nt, Salmonella enterica enterica serovar Typhi
augcgacuuauca

SEQ ID NO: 1654490 - RNA, 17 nt, Salmonella enterica enterica serovar Typhi
augcgacugaaaaucaa

SEQ ID NO: 1654491 - RNA, 14 nt, Salmonella enterica enterica serovar Typhi
augcgaauccggcg

SEQ ID NO: 1654492 - RNA, 15 nt, Salmonella enterica enterica serovar Typhi
augccgaccagcguc

SEQ ID NO: 1654493 - RNA, 16 nt, Salmonella enterica enterica serovar Typhi
augccgaucaccagcg

SEQ ID NO: 1654494 - RNA, 13 nt, Salmonella enterica enterica serovar Typhi
augccgccauccg

SEQ ID NO: 1654495 - RNA, 21 nt, Salmonella enterica enterica serovar Typhi
augccgcgucaggagcgggua

SEQ ID NO: 1654496 - RNA, 19 nt, Salmonella enterica enterica serovar Typhi
augccgccgacaaccagcg

SEQ ID NO: 1654497 - RNA, 16 nt, Salmonella enterica enterica serovar Typhi
augccgccgauaccgc

SEQ ID NO: 1654498 - RNA, 13 nt, Salmonella enterica enterica serovar Typhi
augccgccgccag

SEQ ID NO: 1654499 - RNA, 16 nt, Salmonella enterica enterica serovar Typhi
augccguagcggccau

SEQ ID NO: 1654500 - RNA, 19 nt, Salmonella enterica enterica serovar Typhi
augccguccauccggcgua

SEQ ID NO: 1654501 - RNA, 19 nt, Salmonella enterica enterica serovar Typhi
augccguaaguuuugcucc

SEQ ID NO: 1654502 - RNA, 15 nt, Salmonella enterica enterica serovar Typhi
augccggacgccacc

SEQ ID NO: 1654503 - RNA, 23 nt, Salmonella enterica enterica serovar Typhi
cccgucaugcuucaccucagcaa

SEQ ID NO: 1654504 - RNA, 20 nt, Salmonella enterica enterica serovar Typhi
cccgucaccagaauaaugcc

SEQ ID NO: 1654505 - RNA, 16 nt, Salmonella enterica enterica serovar Typhi
cccguaucacugauau

SEQ ID NO: 1654506 - RNA, 17 nt, Salmonella enterica enterica serovar Typhi
cccgucgcgaucacaga

SEQ ID NO: 1654507 - RNA, 17 nt, Salmonella enterica enterica serovar Typhi
cccggguaaugcugcag

SEQ ID NO: 1654508 - RNA, 23 nt, Salmonella enterica enterica serovar Typhi
cccguagauaagcgccacgucgg

SEQ ID NO: 1654509 - RNA, 18 nt, Salmonella enterica enterica serovar Typhi
cccguaaugcccaggcgg

SEQ ID NO: 1654510 - RNA, 15 nt, Salmonella enterica enterica serovar Typhi
cccguacaaggucgg

SEQ ID NO: 1654511 - RNA, 21 nt, Salmonella enterica enterica serovar Typhi
cccggcgcgcacgcgggccaa

SEQ ID NO: 1654512 - RNA, 19 nt, Salmonella enterica enterica serovar Typhi
cccggcuuuaugaugguga

SEQ ID NO: 1654513 - RNA, 18 nt, Salmonella enterica enterica serovar Typhi
cccguuccucguccugau

SEQ ID NO: 1654514 - RNA, 23 nt, Salmonella enterica enterica serovar Typhi
cccguggugggguucccgagcga

SEQ ID NO: 1654515 - RNA, 23 nt, Salmonella enterica enterica serovar Typhi
cccguggugggguucccgagcgg

SEQ ID NO: 1654516 - RNA, 22 nt, Salmonella enterica enterica serovar Typhi
cccguuaaauaccagcaccuga

SEQ ID NO: 1654517 - RNA, 12 nt, Salmonella enterica enterica serovar Typhi
cccguuauucau

SEQ ID NO: 1654518 - RNA, 15 nt, Salmonella enterica enterica serovar Typhi
cccgugagcuacagc

SEQ ID NO: 1654519 - RNA, 19 nt, Salmonella enterica enterica serovar Typhi
cccgugcgcgucgccugaa

SEQ ID NO: 1654520 - RNA, 22 nt, Salmonella enterica enterica serovar Typhi
cccugccguuugcgccagcccg

SEQ ID NO: 1654521 - RNA, 23 nt, Salmonella enterica enterica serovar Typhi
cccugaaauaacagacuccgucu

SEQ ID NO: 1654522 - RNA, 21 nt, Salmonella enterica enterica serovar Typhi
ccgaaaugaccaccgcaucgg

SEQ ID NO: 1654523 - RNA, 18 nt, Salmonella enterica enterica serovar Typhi
cccuggccugcucaucag

SEQ ID NO: 1654524 - RNA, 12 nt, Salmonella enterica enterica serovar Typhi
ccgaaucaggcg

SEQ ID NO: 1654525 - RNA, 18 nt, Salmonella enterica enterica serovar Typhi
cccgauucugccaguuca

SEQ ID NO: 1654526 - RNA, 20 nt, Salmonella enterica enterica serovar Typhi
cccgauuuugucggaauuuc

SEQ ID NO: 1654527 - RNA, 21 nt, Salmonella enterica enterica serovar Typhi
cccgcaaacuaauggcgcagc

SEQ ID NO: 1654528 - RNA, 13 nt, Salmonella enterica enterica serovar Typhi
cccgauaaccgcg

SEQ ID NO: 1654529 - RNA, 11 nt, Salmonella enterica enterica serovar Typhi
cccgauacccu

SEQ ID NO: 1654530 - RNA, 23 nt, Salmonella enterica enterica serovar Typhi
cccgauaaaaucaucgcgcugau

SEQ ID NO: 1654531 - RNA, 18 nt, Salmonella enterica enterica serovar Typhi
cccgaucuucaucguuac

SEQ ID NO: 1654532 - RNA, 13 nt, Salmonella enterica enterica serovar Typhi
cccgauacgcgga

SEQ ID NO: 1654533 - RNA, 15 nt, Salmonella enterica enterica serovar Typhi
cccgauaccgccagc

SEQ ID NO: 1654534 - RNA, 12 nt, Salmonella enterica enterica serovar Typhi
cccgauacgcgg

SEQ ID NO: 1654535 - RNA, 13 nt, Salmonella enterica enterica serovar Typhi
cccgccagaugca

SEQ ID NO: 1654536 - RNA, 17 nt, Salmonella enterica enterica serovar Typhi
cccgcauacaggaagcc

SEQ ID NO: 1654537 - RNA, 13 nt, Salmonella enterica enterica serovar Typhi
cccgccgcuggcg

SEQ ID NO: 1654538 - RNA, 21 nt, Salmonella enterica enterica serovar Typhi
ccccuuacuaagccaguucuc

SEQ ID NO: 1654539 - RNA, 21 nt, Salmonella enterica enterica serovar Typhi
ccccugcuggcgaaccaccag

SEQ ID NO: 1654540 - RNA, 18 nt, Salmonella enterica enterica serovar Typhi
ccccguugcucauguuau

SEQ ID NO: 1654541 - RNA, 17 nt, Salmonella enterica enterica serovar Typhi
cccauuaauaucagccc

SEQ ID NO: 1654542 - RNA, 15 nt, Salmonella enterica enterica serovar Typhi
cccauggaugcgccg

SEQ ID NO: 1654543 - RNA, 18 nt, Salmonella enterica enterica serovar Typhi
cccgacaccagccguuca

SEQ ID NO: 1654544 - RNA, 17 nt, Salmonella enterica enterica serovar Typhi
cccgaacaugccgccga

SEQ ID NO: 1654545 - RNA, 12 nt, Salmonella enterica enterica serovar Typhi
cccgaaccugcg

SEQ ID NO: 1654546 - RNA, 15 nt, Salmonella enterica enterica serovar Typhi
cccgacucugacgcc

SEQ ID NO: 1654547 - RNA, 21 nt, Salmonella enterica enterica serovar Typhi
cccacuccggcgugaacgccu

SEQ ID NO: 1654548 - RNA, 13 nt, Salmonella enterica enterica serovar Typhi
cccagaaucaccc

SEQ ID NO: 1654549 - RNA, 16 nt, Salmonella enterica enterica serovar Typhi
cccacauuacgcccau

SEQ ID NO: 1654550 - RNA, 16 nt, Salmonella enterica enterica serovar Typhi
cccacuuucaccuccg

SEQ ID NO: 1654551 - RNA, 15 nt, Salmonella enterica enterica serovar Typhi
cccagaauccgcgca

SEQ ID NO: 1654552 - RNA, 20 nt, Salmonella enterica enterica serovar Typhi
cccaugagcgaaacuccagc

SEQ ID NO: 1654553 - RNA, 21 nt, Salmonella enterica enterica serovar Typhi
cccaugaugggcaagcguagu

SEQ ID NO: 1654554 - RNA, 20 nt, Salmonella enterica enterica serovar Typhi
cccaucuaaccgggccugau

SEQ ID NO: 1654555 - RNA, 19 nt, Salmonella enterica enterica serovar Typhi
cccauacccagguuugcgc

SEQ ID NO: 1654556 - RNA, 21 nt, Salmonella enterica enterica serovar Typhi
cccaguugguuguagcacagc

SEQ ID NO: 1654557 - RNA, 21 nt, Salmonella enterica enterica serovar Typhi
cccaguuucaucaucgccgau

SEQ ID NO: 1654558 - RNA, 15 nt, Salmonella enterica enterica serovar Typhi
cccauacugcccagc

SEQ ID NO: 1654559 - RNA, 20 nt, Salmonella enterica enterica serovar Typhi
cccaggguuuagccccagac

SEQ ID NO: 1654560 - RNA, 21 nt, Salmonella enterica enterica serovar Typhi
cccagcgccggauaauccaga

SEQ ID NO: 1654561 - RNA, 13 nt, Salmonella enterica enterica serovar Typhi
cccaggccggcau

SEQ ID NO: 1654562 - RNA, 22 nt, Salmonella enterica enterica serovar Typhi
ccaucgggccgcucagcaucgc

SEQ ID NO: 1654563 - RNA, 13 nt, Salmonella enterica enterica serovar Typhi
ccaucaggcaugc

SEQ ID NO: 1654564 - RNA, 19 nt, Salmonella enterica enterica serovar Typhi
ccaucagcgucagcagagu

SEQ ID NO: 1654565 - RNA, 17 nt, Salmonella enterica enterica serovar Typhi
ccaucggcgggcguauc

SEQ ID NO: 1654566 - RNA, 17 nt, Salmonella enterica enterica serovar Typhi
ccaucacauguagcgcg

SEQ ID NO: 1654567 - RNA, 18 nt, Salmonella enterica enterica serovar Typhi
ccaucacgaucgcgguuc

SEQ ID NO: 1654568 - RNA, 19 nt, Salmonella enterica enterica serovar Typhi
ccaucagcaucccaccgga

SEQ ID NO: 1654569 - RNA, 18 nt, Salmonella enterica enterica serovar Typhi
ccaucacuuccauccaug

SEQ ID NO: 1654570 - RNA, 18 nt, Salmonella enterica enterica serovar Typhi
ccaucucacgcauggcgu

SEQ ID NO: 1654571 - RNA, 13 nt, Salmonella enterica enterica serovar Typhi
cccaaucagacgc

SEQ ID NO: 1654572 - RNA, 17 nt, Salmonella enterica enterica serovar Typhi
cccacaagaaaugcagg

SEQ ID NO: 1654573 - RNA, 17 nt, Salmonella enterica enterica serovar Typhi
cccacaaucccgccaga

SEQ ID NO: 1654574 - RNA, 18 nt, Salmonella enterica enterica serovar Typhi
cccacaacgcgccaaccg

SEQ ID NO: 1654575 - RNA, 15 nt, Salmonella enterica enterica serovar Typhi
cccacaaccgacgca

SEQ ID NO: 1654576 - RNA, 19 nt, Salmonella enterica enterica serovar Typhi
ccauguuuaccaucgcguu

SEQ ID NO: 1654577 - RNA, 22 nt, Salmonella enterica enterica serovar Typhi
ccauugcuaggaacagugacaa

SEQ ID NO: 1654578 - RNA, 15 nt, Salmonella enterica enterica serovar Typhi
ccauuugcauccgua

SEQ ID NO: 1654579 - RNA, 20 nt, Salmonella enterica enterica serovar Typhi
ccaugugacggcauguccgg

SEQ ID NO: 1654580 - RNA, 15 nt, Salmonella enterica enterica serovar Typhi
ccauguacuccugau

SEQ ID NO: 1654581 - RNA, 18 nt, Salmonella enterica enterica serovar Typhi
ccagguggcaauauccug

SEQ ID NO: 1654582 - RNA, 21 nt, Salmonella enterica enterica serovar Typhi
ccaggugcguggcccgcacug

SEQ ID NO: 1654583 - RNA, 13 nt, Salmonella enterica enterica serovar Typhi
ccaguagcagaca

SEQ ID NO: 1654584 - RNA, 17 nt, Salmonella enterica enterica serovar Typhi
ccaguacggcgcgaauc

SEQ ID NO: 1654585 - RNA, 13 nt, Salmonella enterica enterica serovar Typhi
ccaguagcagcga

SEQ ID NO: 1654586 - RNA, 22 nt, Salmonella enterica enterica serovar Typhi
ccaguaccgucauuuccggcgc

SEQ ID NO: 1654587 - RNA, 23 nt, Salmonella enterica enterica serovar Typhi
ccauaaaaacaauaaauaacgug

SEQ ID NO: 1654588 - RNA, 22 nt, Salmonella enterica enterica serovar Typhi
ccaguuuuugcgccagcgcaag

SEQ ID NO: 1654589 - RNA, 17 nt, Salmonella enterica enterica serovar Typhi
ccaguucgucuuccgga

SEQ ID NO: 1654590 - RNA, 14 nt, Salmonella enterica enterica serovar Typhi
ccaguuuacgcgua

SEQ ID NO: 1654591 - RNA, 19 nt, Salmonella enterica enterica serovar Typhi
ccaguuucuucggcuucac

SEQ ID NO: 1654592 - RNA, 19 nt, Salmonella enterica enterica serovar Typhi
ccaucaauaagcgaauugc

SEQ ID NO: 1654593 - RNA, 17 nt, Salmonella enterica enterica serovar Typhi
ccauauuuuuucaggaa

SEQ ID NO: 1654594 - RNA, 20 nt, Salmonella enterica enterica serovar Typhi
ccauauucuuugcgccuuau

SEQ ID NO: 1654595 - RNA, 24 nt, Salmonella enterica enterica serovar Typhi
ccagucauccgguucauaauccgg

SEQ ID NO: 1654596 - RNA, 17 nt, Salmonella enterica enterica serovar Typhi
ccaguaucgcgccgcca

SEQ ID NO: 1654597 - RNA, 13 nt, Salmonella enterica enterica serovar Typhi
ccagucauccggu

SEQ ID NO: 1654598 - RNA, 14 nt, Salmonella enterica enterica serovar Typhi
ccaguucauuaaca

SEQ ID NO: 1654599 - RNA, 20 nt, Salmonella enterica enterica serovar Typhi
ccagugcgaugggcuucaga

SEQ ID NO: 1654600 - RNA, 19 nt, Salmonella enterica enterica serovar Typhi
ccaggccggauaaggcgcu

SEQ ID NO: 1654601 - RNA, 18 nt, Salmonella enterica enterica serovar Typhi
ccaggcgcgaaucgacaa

SEQ ID NO: 1654602 - RNA, 17 nt, Salmonella enterica enterica serovar Typhi
ccaggcguuuaugagau

SEQ ID NO: 1654603 - RNA, 23 nt, Salmonella enterica enterica serovar Typhi
ccaggccaugcgccgcgucagca

SEQ ID NO: 1654604 - RNA, 14 nt, Salmonella enterica enterica serovar Typhi
ccaggcaaaacagu

SEQ ID NO: 1654605 - RNA, 19 nt, Salmonella enterica enterica serovar Typhi
ccaggcaaagccccaguca

SEQ ID NO: 1654606 - RNA, 16 nt, Salmonella enterica enterica serovar Typhi
ccaggcaaagcucaac

SEQ ID NO: 1654607 - RNA, 20 nt, Salmonella enterica enterica serovar Typhi
ccaggcauccuugccgguca

SEQ ID NO: 1654608 - RNA, 14 nt, Salmonella enterica enterica serovar Typhi
ccagacgcgcagca

SEQ ID NO: 1654609 - RNA, 18 nt, Salmonella enterica enterica serovar Typhi
ccagacgaccguaauagc

SEQ ID NO: 1654610 - RNA, 13 nt, Salmonella enterica enterica serovar Typhi
ccagaccggcgac

SEQ ID NO: 1654611 - RNA, 14 nt, Salmonella enterica enterica serovar Typhi
ccagacccgggacu

SEQ ID NO: 1654612 - RNA, 17 nt, Salmonella enterica enterica serovar Typhi
ccacugcgccauuaacg

SEQ ID NO: 1654613 - RNA, 13 nt, Salmonella enterica enterica serovar Typhi
ccagacaggacgc

SEQ ID NO: 1654614 - RNA, 19 nt, Salmonella enterica enterica serovar Typhi
ccagauacccuuuaucgcg

SEQ ID NO: 1654615 - RNA, 18 nt, Salmonella enterica enterica serovar Typhi
ccagauaaugaucaacgc

SEQ ID NO: 1654616 - RNA, 15 nt, Salmonella enterica enterica serovar Typhi
ccagauacacgccuu

SEQ ID NO: 1654617 - RNA, 14 nt, Salmonella enterica enterica serovar Typhi
ccagauaaaucagc

SEQ ID NO: 1654618 - RNA, 22 nt, Salmonella enterica enterica serovar Typhi
ccagauaugaucgaaaaugcgc

SEQ ID NO: 1654619 - RNA, 15 nt, Salmonella enterica enterica serovar Typhi
ccagauaucccgcca

SEQ ID NO: 1654620 - RNA, 13 nt, Salmonella enterica enterica serovar Typhi
ccagauagcgcug

SEQ ID NO: 1654621 - RNA, 14 nt, Salmonella enterica enterica serovar Typhi
ccagauagcgcugc

SEQ ID NO: 1654622 - RNA, 18 nt, Salmonella enterica enterica serovar Typhi
ccagauagcgcugcgcca

SEQ ID NO: 1654623 - RNA, 16 nt, Salmonella enterica enterica serovar Typhi
ccagaucgauauccgu

SEQ ID NO: 1654624 - RNA, 17 nt, Salmonella enterica enterica serovar Typhi
ccagaucgauauccgug

SEQ ID NO: 1654625 - RNA, 13 nt, Salmonella enterica enterica serovar Typhi
ccagaucggcaua

SEQ ID NO: 1654626 - RNA, 12 nt, Salmonella enterica enterica serovar Typhi
ccagaugcgcca

SEQ ID NO: 1654627 - RNA, 19 nt, Salmonella enterica enterica serovar Typhi
ccacguucuuccagaacgc

SEQ ID NO: 1654628 - RNA, 14 nt, Salmonella enterica enterica serovar Typhi
ccacguuaccgcgc

SEQ ID NO: 1654629 - RNA, 19 nt, Salmonella enterica enterica serovar Typhi
ccacgcgcgucaggacggc

SEQ ID NO: 1654630 - RNA, 14 nt, Salmonella enterica enterica serovar Typhi
ccacgcgacgccag

SEQ ID NO: 1654631 - RNA, 13 nt, Salmonella enterica enterica serovar Typhi
ccacgcggcgugc

SEQ ID NO: 1654632 - RNA, 23 nt, Salmonella enterica enterica serovar Typhi
ccacgcgggcgguauuauccgcc

SEQ ID NO: 1654633 - RNA, 22 nt, Salmonella enterica enterica serovar Typhi
ccacgauacgccccugcuggcg

SEQ ID NO: 1654634 - RNA, 15 nt, Salmonella enterica enterica serovar Typhi
ccacgccguccggag

SEQ ID NO: 1654635 - RNA, 19 nt, Salmonella enterica enterica serovar Typhi
ccacgcccuucacgccgaa

SEQ ID NO: 1654636 - RNA, 23 nt, Salmonella enterica enterica serovar Typhi
ccaccaugauuagaaacccauau

SEQ ID NO: 1654637 - RNA, 17 nt, Salmonella enterica enterica serovar Typhi
ccaccucaaucaccguu

SEQ ID NO: 1654638 - RNA, 17 nt, Salmonella enterica enterica serovar Typhi
ccaccguuuaaucgccc

SEQ ID NO: 1654639 - RNA, 18 nt, Salmonella enterica enterica serovar Typhi
ccaccucaagguagcgug

SEQ ID NO: 1654640 - RNA, 22 nt, Salmonella enterica enterica serovar Typhi
ccacgaacgauauaaaaaccga

SEQ ID NO: 1654641 - RNA, 21 nt, Salmonella enterica enterica serovar Typhi
ccagccgagcgguaagagcca

SEQ ID NO: 1654642 - RNA, 17 nt, Salmonella enterica enterica serovar Typhi
ccagccgaucagcgcca

SEQ ID NO: 1654643 - RNA, 21 nt, Salmonella enterica enterica serovar Typhi
ccagccauaaauauuggcggc

SEQ ID NO: 1654644 - RNA, 20 nt, Salmonella enterica enterica serovar Typhi
ccagccauggcccaaaaggu

SEQ ID NO: 1654645 - RNA, 13 nt, Salmonella enterica enterica serovar Typhi
ccagccacgcgug

SEQ ID NO: 1654646 - RNA, 18 nt, Salmonella enterica enterica serovar Typhi
ccagcagcgcgaucgccc

SEQ ID NO: 1654647 - RNA, 17 nt, Salmonella enterica enterica serovar Typhi
ccagcaguucuacgcug

SEQ ID NO: 1654648 - RNA, 16 nt, Salmonella enterica enterica serovar Typhi
ccagcaguuccggcgu

SEQ ID NO: 1654649 - RNA, 13 nt, Salmonella enterica enterica serovar Typhi
ccagcaucacgug

SEQ ID NO: 1654650 - RNA, 19 nt, Salmonella enterica enterica serovar Typhi
ccagcaucagaauaaugcu

SEQ ID NO: 1654651 - RNA, 15 nt, Salmonella enterica enterica serovar Typhi
ccagcauauuaacag

SEQ ID NO: 1654652 - RNA, 14 nt, Salmonella enterica enterica serovar Typhi
ccagcauaaugagc

SEQ ID NO: 1654653 - RNA, 14 nt, Salmonella enterica enterica serovar Typhi
ccagcauacgucug

SEQ ID NO: 1654654 - RNA, 15 nt, Salmonella enterica enterica serovar Typhi
ccagcaguugccaua

SEQ ID NO: 1654655 - RNA, 12 nt, Salmonella enterica enterica serovar Typhi
ccagcagcgcca

SEQ ID NO: 1654656 - RNA, 13 nt, Salmonella enterica enterica serovar Typhi
ccagcagcgccag

SEQ ID NO: 1654657 - RNA, 20 nt, Salmonella enterica enterica serovar Typhi
ccagcacuaacagcagcagc

SEQ ID NO: 1654658 - RNA, 14 nt, Salmonella enterica enterica serovar Typhi
ccagcacuaacagc

SEQ ID NO: 1654659 - RNA, 12 nt, Salmonella enterica enterica serovar Typhi
ccagaugguaag

SEQ ID NO: 1654660 - RNA, 16 nt, Salmonella enterica enterica serovar Typhi
ccagaugucgcggaua

SEQ ID NO: 1654661 - RNA, 23 nt, Salmonella enterica enterica serovar Typhi
ccagcgggccgacgauaaacaga

SEQ ID NO: 1654662 - RNA, 14 nt, Salmonella enterica enterica serovar Typhi
ccagcgcgccgcca

SEQ ID NO: 1654663 - RNA, 23 nt, Salmonella enterica enterica serovar Typhi
ccagcgucuccagacaauccgcg

SEQ ID NO: 1654664 - RNA, 19 nt, Salmonella enterica enterica serovar Typhi
ccagcguaugauagcgagc

SEQ ID NO: 1654665 - RNA, 20 nt, Salmonella enterica enterica serovar Typhi
ccagcguaccacgccgcaca

SEQ ID NO: 1654666 - RNA, 19 nt, Salmonella enterica enterica serovar Typhi
ccagcgguguuugccagac

SEQ ID NO: 1654667 - RNA, 21 nt, Salmonella enterica enterica serovar Typhi
ccagccgauuucauaccacug

SEQ ID NO: 1654668 - RNA, 14 nt, Salmonella enterica enterica serovar Typhi
ccagcgccgccaga

SEQ ID NO: 1654669 - RNA, 12 nt, Salmonella enterica enterica serovar Typhi
ccagcgccggau

SEQ ID NO: 1654670 - RNA, 14 nt, Salmonella enterica enterica serovar Typhi
ccagcgccgcgcga

SEQ ID NO: 1654671 - RNA, 20 nt, Salmonella enterica enterica serovar Typhi
ccagcgccgcggccuccgga

SEQ ID NO: 1654672 - RNA, 18 nt, Salmonella enterica enterica serovar Typhi
ccagcgcccuauccagcg

SEQ ID NO: 1654673 - RNA, 13 nt, Salmonella enterica enterica serovar Typhi
ccagcgcccuauc

SEQ ID NO: 1654674 - RNA, 17 nt, Salmonella enterica enterica serovar Typhi
caucguccggcgaaaac

SEQ ID NO: 1654675 - RNA, 19 nt, Salmonella enterica enterica serovar Typhi
caucguugagaaaaccaua

SEQ ID NO: 1654676 - RNA, 15 nt, Salmonella enterica enterica serovar Typhi
caucguguagcguga

SEQ ID NO: 1654677 - RNA, 13 nt, Salmonella enterica enterica serovar Typhi
caucgugauaaac

SEQ ID NO: 1654678 - RNA, 17 nt, Salmonella enterica enterica serovar Typhi
cauccgggccgcuagcu

SEQ ID NO: 1654679 - RNA, 18 nt, Salmonella enterica enterica serovar Typhi
cauccgccaaaacaucuu

SEQ ID NO: 1654680 - RNA, 15 nt, Salmonella enterica enterica serovar Typhi
caucgguaagcgcaa

SEQ ID NO: 1654681 - RNA, 16 nt, Salmonella enterica enterica serovar Typhi
caucuccugcgauagc

SEQ ID NO: 1654682 - RNA, 23 nt, Salmonella enterica enterica serovar Typhi
caucugcauaauggcgacggcca

SEQ ID NO: 1654683 - RNA, 14 nt, Salmonella enterica enterica serovar Typhi
caucucuuugcccg

SEQ ID NO: 1654684 - RNA, 23 nt, Salmonella enterica enterica serovar Typhi
caucuuccucacagccuugccag

SEQ ID NO: 1654685 - RNA, 15 nt, Salmonella enterica enterica serovar Typhi
caucuguucaacuuu

SEQ ID NO: 1654686 - RNA, 23 nt, Salmonella enterica enterica serovar Typhi
caucuuaccggugcgauucagcg

SEQ ID NO: 1654687 - RNA, 13 nt, Salmonella enterica enterica serovar Typhi
caucuugcguuau

SEQ ID NO: 1654688 - RNA, 15 nt, Salmonella enterica enterica serovar Typhi
caucuuuuacaggcc

SEQ ID NO: 1654689 - RNA, 14 nt, Salmonella enterica enterica serovar Typhi
caugaauuucucgc

SEQ ID NO: 1654690 - RNA, 15 nt, Salmonella enterica enterica serovar Typhi
caugaccauucacac

SEQ ID NO: 1654691 - RNA, 20 nt, Salmonella enterica enterica serovar Typhi
caugaaccuggcgugcgauu

SEQ ID NO: 1654692 - RNA, 19 nt, Salmonella enterica enterica serovar Typhi
caugaugccacgagaaauc

SEQ ID NO: 1654693 - RNA, 17 nt, Salmonella enterica enterica serovar Typhi
caugauacccagcgucc

SEQ ID NO: 1654694 - RNA, 15 nt, Salmonella enterica enterica serovar Typhi
caugauaucgccaau

SEQ ID NO: 1654695 - RNA, 17 nt, Salmonella enterica enterica serovar Typhi
caugaccugggcgccag

SEQ ID NO: 1654696 - RNA, 22 nt, Salmonella enterica enterica serovar Typhi
caugacgucguuguccggcuga

SEQ ID NO: 1654697 - RNA, 20 nt, Salmonella enterica enterica serovar Typhi
caugacuuuuuucaaccuca

SEQ ID NO: 1654698 - RNA, 15 nt, Salmonella enterica enterica serovar Typhi
caugccguaccguug

SEQ ID NO: 1654699 - RNA, 23 nt, Salmonella enterica enterica serovar Typhi
caugccaucauuaauuuacugau

SEQ ID NO: 1654700 - RNA, 21 nt, Salmonella enterica enterica serovar Typhi
caugcgcggcggguugaugau

SEQ ID NO: 1654701 - RNA, 16 nt, Salmonella enterica enterica serovar Typhi
cauggcggcgacaaug

SEQ ID NO: 1654702 - RNA, 17 nt, Salmonella enterica enterica serovar Typhi
cauggcccuuuugcccg

SEQ ID NO: 1654703 - RNA, 17 nt, Salmonella enterica enterica serovar Typhi
cauggcggucgccauau

SEQ ID NO: 1654704 - RNA, 15 nt, Salmonella enterica enterica serovar Typhi
caugguacucaacau

SEQ ID NO: 1654705 - RNA, 15 nt, Salmonella enterica enterica serovar Typhi
ccaacugcgccugaa

SEQ ID NO: 1654706 - RNA, 18 nt, Salmonella enterica enterica serovar Typhi
ccaagaccgccuaacagc

SEQ ID NO: 1654707 - RNA, 22 nt, Salmonella enterica enterica serovar Typhi
ccaagcggcaacucugugcguu

SEQ ID NO: 1654708 - RNA, 14 nt, Salmonella enterica enterica serovar Typhi
ccaauaaacgccag

SEQ ID NO: 1654709 - RNA, 23 nt, Salmonella enterica enterica serovar Typhi
ccaauacccagcgccaacgccac

SEQ ID NO: 1654710 - RNA, 15 nt, Salmonella enterica enterica serovar Typhi
ccaacgccggcaaca

SEQ ID NO: 1654711 - RNA, 16 nt, Salmonella enterica enterica serovar Typhi
ccaacgcgcuaccgug

SEQ ID NO: 1654712 - RNA, 21 nt, Salmonella enterica enterica serovar Typhi
ccaauaccggcguaauugcgc

SEQ ID NO: 1654713 - RNA, 23 nt, Salmonella enterica enterica serovar Typhi
ccaauacgccagccuaucgccau

SEQ ID NO: 1654714 - RNA, 14 nt, Salmonella enterica enterica serovar Typhi
ccacaccggcgcau

SEQ ID NO: 1654715 - RNA, 17 nt, Salmonella enterica enterica serovar Typhi
ccacauacugaaauuuc

SEQ ID NO: 1654716 - RNA, 18 nt, Salmonella enterica enterica serovar Typhi
ccacaucgcgacgggaua

SEQ ID NO: 1654717 - RNA, 12 nt, Salmonella enterica enterica serovar Typhi
ccacauccagcg

SEQ ID NO: 1654718 - RNA, 14 nt, Salmonella enterica enterica serovar Typhi
ccacaucagaccgc

SEQ ID NO: 1654719 - RNA, 17 nt, Salmonella enterica enterica serovar Typhi
ccacaugaccagcgccg

SEQ ID NO: 1654720 - RNA, 20 nt, Salmonella enterica enterica serovar Typhi
ccaccaaagccaggccgcca

SEQ ID NO: 1654721 - RNA, 22 nt, Salmonella enterica enterica serovar Typhi
ccaccagaauaaaggccgggaa

SEQ ID NO: 1654722 - RNA, 17 nt, Salmonella enterica enterica serovar Typhi
ccaccauaggccagcgu

SEQ ID NO: 1654723 - RNA, 21 nt, Salmonella enterica enterica serovar Typhi
cauucugcaggcgggugcgca

SEQ ID NO: 1654724 - RNA, 18 nt, Salmonella enterica enterica serovar Typhi
cauucuccgggauagcaa

SEQ ID NO: 1654725 - RNA, 19 nt, Salmonella enterica enterica serovar Typhi
cauucauuuuaucgauaau

SEQ ID NO: 1654726 - RNA, 18 nt, Salmonella enterica enterica serovar Typhi
cauuccauuuuucgaucu

SEQ ID NO: 1654727 - RNA, 20 nt, Salmonella enterica enterica serovar Typhi
cauucauaucgccugcggca

SEQ ID NO: 1654728 - RNA, 17 nt, Salmonella enterica enterica serovar Typhi
cauucagggaaucagcg

SEQ ID NO: 1654729 - RNA, 23 nt, Salmonella enterica enterica serovar Typhi
cauucuuuugcccgguggcgcug

SEQ ID NO: 1654730 - RNA, 19 nt, Salmonella enterica enterica serovar Typhi
cauugccguuaacugcugc

SEQ ID NO: 1654731 - RNA, 13 nt, Salmonella enterica enterica serovar Typhi
cauugccgccagu

SEQ ID NO: 1654732 - RNA, 20 nt, Salmonella enterica enterica serovar Typhi
cauugcugccuuauccggcc

SEQ ID NO: 1654733 - RNA, 17 nt, Salmonella enterica enterica serovar Typhi
cauuggcaaaccccugc

SEQ ID NO: 1654734 - RNA, 17 nt, Salmonella enterica enterica serovar Typhi
cauuggggaaccuggca

SEQ ID NO: 1654735 - RNA, 16 nt, Salmonella enterica enterica serovar Typhi
ccaaaccugccacagg

SEQ ID NO: 1654736 - RNA, 13 nt, Salmonella enterica enterica serovar Typhi
cauuuucaauguc

SEQ ID NO: 1654737 - RNA, 18 nt, Salmonella enterica enterica serovar Typhi
cauuuuccacaauaccgu

SEQ ID NO: 1654738 - RNA, 20 nt, Salmonella enterica enterica serovar Typhi
cauuuuggggaaaauaccgg

SEQ ID NO: 1654739 - RNA, 19 nt, Salmonella enterica enterica serovar Typhi
cauuuugaguugccgaucg

SEQ ID NO: 1654740 - RNA, 23 nt, Salmonella enterica enterica serovar Typhi
cauuguacuuuuaaaucaucagg

SEQ ID NO: 1654741 - RNA, 17 nt, Salmonella enterica enterica serovar Typhi
ccaaaguuaaucagcgc

SEQ ID NO: 1654742 - RNA, 13 nt, Salmonella enterica enterica serovar Typhi
ccaaauagcgcca

SEQ ID NO: 1654743 - RNA, 21 nt, Salmonella enterica enterica serovar Typhi
ccaaccggccccaucgccgua

SEQ ID NO: 1654744 - RNA, 21 nt, Salmonella enterica enterica serovar Typhi
ccaacgaaacucagcggccca

SEQ ID NO: 1654745 - RNA, 12 nt, Salmonella enterica enterica serovar Typhi
cagcgucgcuga

SEQ ID NO: 1654746 - RNA, 19 nt, Salmonella enterica enterica serovar Typhi
cagcgucucagcaggcggc

SEQ ID NO: 1654747 - RNA, 22 nt, Salmonella enterica enterica serovar Typhi
cagcgucuccagacaauccgcg

SEQ ID NO: 1654748 - RNA, 14 nt, Salmonella enterica enterica serovar Typhi
cagcucaaccgcgc

SEQ ID NO: 1654749 - RNA, 22 nt, Salmonella enterica enterica serovar Typhi
cagcucaaccgcgcggcguucu

SEQ ID NO: 1654750 - RNA, 18 nt, Salmonella enterica enterica serovar Typhi
cagcuaucgcagcucggu

SEQ ID NO: 1654751 - RNA, 19 nt, Salmonella enterica enterica serovar Typhi
cagcggcgccaucaccauc

SEQ ID NO: 1654752 - RNA, 14 nt, Salmonella enterica enterica serovar Typhi
cagcggccagggca

SEQ ID NO: 1654753 - RNA, 13 nt, Salmonella enterica enterica serovar Typhi
cagcggccaugac

SEQ ID NO: 1654754 - RNA, 22 nt, Salmonella enterica enterica serovar Typhi
cagcggacacccgcagccagaa

SEQ ID NO: 1654755 - RNA, 14 nt, Salmonella enterica enterica serovar Typhi
cagcggagcgaaga

SEQ ID NO: 1654756 - RNA, 22 nt, Salmonella enterica enterica serovar Typhi
cagcgcugcuguaacagacgca

SEQ ID NO: 1654757 - RNA, 19 nt, Salmonella enterica enterica serovar Typhi
cagcgcuccccacauauuc

SEQ ID NO: 1654758 - RNA, 15 nt, Salmonella enterica enterica serovar Typhi
cagcgcuccgacaaa

SEQ ID NO: 1654759 - RNA, 14 nt, Salmonella enterica enterica serovar Typhi
cagcgcuaucaggc

SEQ ID NO: 1654760 - RNA, 15 nt, Salmonella enterica enterica serovar Typhi
cagcgcuauccggcc

SEQ ID NO: 1654761 - RNA, 16 nt, Salmonella enterica enterica serovar Typhi
cagcgcgucgaccaua

SEQ ID NO: 1654762 - RNA, 19 nt, Salmonella enterica enterica serovar Typhi
cagcgcggaagccacguuc

SEQ ID NO: 1654763 - RNA, 17 nt, Salmonella enterica enterica serovar Typhi
cagcgcgcgcgcaaagc

SEQ ID NO: 1654764 - RNA, 16 nt, Salmonella enterica enterica serovar Typhi
cagcgcggcagccgga

SEQ ID NO: 1654765 - RNA, 18 nt, Salmonella enterica enterica serovar Typhi
cagcgcgccgccaacgcc

SEQ ID NO: 1654766 - RNA, 21 nt, Salmonella enterica enterica serovar Typhi
cagcuucacgcgcuguaacuu

SEQ ID NO: 1654767 - RNA, 21 nt, Salmonella enterica enterica serovar Typhi
cagcuugguagcgcaacuggu

SEQ ID NO: 1654768 - RNA, 13 nt, Salmonella enterica enterica serovar Typhi
cagcuuaucugac

SEQ ID NO: 1654769 - RNA, 14 nt, Salmonella enterica enterica serovar Typhi
cagcuuaucgggau

SEQ ID NO: 1654770 - RNA, 17 nt, Salmonella enterica enterica serovar Typhi
cagcugggccugcuccg

SEQ ID NO: 1654771 - RNA, 16 nt, Salmonella enterica enterica serovar Typhi
caggacuaacgccggu

SEQ ID NO: 1654772 - RNA, 20 nt, Salmonella enterica enterica serovar Typhi
caggacgcacccuguucauc

SEQ ID NO: 1654773 - RNA, 21 nt, Salmonella enterica enterica serovar Typhi
caggaucagauauuccagcga

SEQ ID NO: 1654774 - RNA, 21 nt, Salmonella enterica enterica serovar Typhi
caggagcauuggaaauucagg

SEQ ID NO: 1654775 - RNA, 21 nt, Salmonella enterica enterica serovar Typhi
caggagccaguuuucgacaua

SEQ ID NO: 1654776 - RNA, 19 nt, Salmonella enterica enterica serovar Typhi
caggagcauuggaaauuca

SEQ ID NO: 1654777 - RNA, 16 nt, Salmonella enterica enterica serovar Typhi
caggacugacugcugu

SEQ ID NO: 1654778 - RNA, 21 nt, Salmonella enterica enterica serovar Typhi
caggcacugaauuuacgccgu

SEQ ID NO: 1654779 - RNA, 22 nt, Salmonella enterica enterica serovar Typhi
caggaucgccgccgcgagcagc

SEQ ID NO: 1654780 - RNA, 17 nt, Salmonella enterica enterica serovar Typhi
caggaugccguugacca

SEQ ID NO: 1654781 - RNA, 21 nt, Salmonella enterica enterica serovar Typhi
caggaugccaaccaccgcgga

SEQ ID NO: 1654782 - RNA, 16 nt, Salmonella enterica enterica serovar Typhi
caggaugauguucauc

SEQ ID NO: 1654783 - RNA, 21 nt, Salmonella enterica enterica serovar Typhi
caggccugcauuugcuggcgu

SEQ ID NO: 1654784 - RNA, 20 nt, Salmonella enterica enterica serovar Typhi
caggccuacacucugcgcgc

SEQ ID NO: 1654785 - RNA, 16 nt, Salmonella enterica enterica serovar Typhi
caggccuacauccggc

SEQ ID NO: 1654786 - RNA, 21 nt, Salmonella enterica enterica serovar Typhi
caggcgauugccgguccguuc

SEQ ID NO: 1654787 - RNA, 16 nt, Salmonella enterica enterica serovar Typhi
caggcauucagcgggu

SEQ ID NO: 1654788 - RNA, 21 nt, Salmonella enterica enterica serovar Typhi
caggcaguuuauccggcgcca

SEQ ID NO: 1654789 - RNA, 13 nt, Salmonella enterica enterica serovar Typhi
caggcagggcgau

SEQ ID NO: 1654790 - RNA, 19 nt, Salmonella enterica enterica serovar Typhi
caggccaaacccugcgccg

SEQ ID NO: 1654791 - RNA, 22 nt, Salmonella enterica enterica serovar Typhi
caggccaaacccugcgccgcaa

SEQ ID NO: 1654792 - RNA, 17 nt, Salmonella enterica enterica serovar Typhi
caggcaucgacgccagc

SEQ ID NO: 1654793 - RNA, 15 nt, Salmonella enterica enterica serovar Typhi
caggccaucauaccg

SEQ ID NO: 1654794 - RNA, 14 nt, Salmonella enterica enterica serovar Typhi
caggccaugcgccg

SEQ ID NO: 1654795 - RNA, 19 nt, Salmonella enterica enterica serovar Typhi
caguacgaucaugagucgc

SEQ ID NO: 1654796 - RNA, 21 nt, Salmonella enterica enterica serovar Typhi
caguacgcguucuacgguauc

SEQ ID NO: 1654797 - RNA, 17 nt, Salmonella enterica enterica serovar Typhi
caguacgcgcgcggcgu

SEQ ID NO: 1654798 - RNA, 13 nt, Salmonella enterica enterica serovar Typhi
caguacggcgcac

SEQ ID NO: 1654799 - RNA, 13 nt, Salmonella enterica enterica serovar Typhi
caguacggucagg

SEQ ID NO: 1654800 - RNA, 17 nt, Salmonella enterica enterica serovar Typhi
caguagauggcgcuaaa

SEQ ID NO: 1654801 - RNA, 18 nt, Salmonella enterica enterica serovar Typhi
caguagcagacagccgau

SEQ ID NO: 1654802 - RNA, 19 nt, Salmonella enterica enterica serovar Typhi
caguagaucgacauaagag

SEQ ID NO: 1654803 - RNA, 20 nt, Salmonella enterica enterica serovar Typhi
caguagaucgacauaagagu

SEQ ID NO: 1654804 - RNA, 13 nt, Salmonella enterica enterica serovar Typhi
cagucaucgcgcc

SEQ ID NO: 1654805 - RNA, 14 nt, Salmonella enterica enterica serovar Typhi
cagucaugaaaucg

SEQ ID NO: 1654806 - RNA, 19 nt, Salmonella enterica enterica serovar Typhi
cagguaucccgccagcggc

SEQ ID NO: 1654807 - RNA, 22 nt, Salmonella enterica enterica serovar Typhi
cagguauggugcucaggaucaa

SEQ ID NO: 1654808 - RNA, 21 nt, Salmonella enterica enterica serovar Typhi
caggucaaaauuaaucgccag

SEQ ID NO: 1654809 - RNA, 20 nt, Salmonella enterica enterica serovar Typhi
cagggcuuuuuucucgcgcu

SEQ ID NO: 1654810 - RNA, 18 nt, Salmonella enterica enterica serovar Typhi
cagggggaguccauuucc

SEQ ID NO: 1654811 - RNA, 14 nt, Salmonella enterica enterica serovar Typhi
cagggcgauaucca

SEQ ID NO: 1654812 - RNA, 17 nt, Salmonella enterica enterica serovar Typhi
caggguuuucuaccgca

SEQ ID NO: 1654813 - RNA, 23 nt, Salmonella enterica enterica serovar Typhi
caggguuugcgcagacugcgcca

SEQ ID NO: 1654814 - RNA, 22 nt, Salmonella enterica enterica serovar Typhi
cagguaacugcacaagccccac

SEQ ID NO: 1654815 - RNA, 13 nt, Salmonella enterica enterica serovar Typhi
cagguaaaccggu

SEQ ID NO: 1654816 - RNA, 21 nt, Salmonella enterica enterica serovar Typhi
cagggucaggaacugcggcca

SEQ ID NO: 1654817 - RNA, 21 nt, Salmonella enterica enterica serovar Typhi
caggguaugucgguagcgcca

SEQ ID NO: 1654818 - RNA, 22 nt, Salmonella enterica enterica serovar Typhi
caggguaugucgguagcgccag

SEQ ID NO: 1654819 - RNA, 16 nt, Salmonella enterica enterica serovar Typhi
cauaucgccagccaug

SEQ ID NO: 1654820 - RNA, 22 nt, Salmonella enterica enterica serovar Typhi
cauaucuauauuuuuauaucug

SEQ ID NO: 1654821 - RNA, 14 nt, Salmonella enterica enterica serovar Typhi
cauaucaaucaacg

SEQ ID NO: 1654822 - RNA, 14 nt, Salmonella enterica enterica serovar Typhi
cauaugugccgaug

SEQ ID NO: 1654823 - RNA, 16 nt, Salmonella enterica enterica serovar Typhi
cauauucugcgaaagc

SEQ ID NO: 1654824 - RNA, 14 nt, Salmonella enterica enterica serovar Typhi
caucacaucgccgu

SEQ ID NO: 1654825 - RNA, 20 nt, Salmonella enterica enterica serovar Typhi
caucacaucguaaaucagcg

SEQ ID NO: 1654826 - RNA, 21 nt, Salmonella enterica enterica serovar Typhi
caucaauuuugcgccuaccgc

SEQ ID NO: 1654827 - RNA, 17 nt, Salmonella enterica enterica serovar Typhi
caucacaaaccagacgc

SEQ ID NO: 1654828 - RNA, 21 nt, Salmonella enterica enterica serovar Typhi
caucacuaccgccgcggauac

SEQ ID NO: 1654829 - RNA, 14 nt, Salmonella enterica enterica serovar Typhi
caucacucauaaug

SEQ ID NO: 1654830 - RNA, 15 nt, Salmonella enterica enterica serovar Typhi
caucacccggcgaga

SEQ ID NO: 1654831 - RNA, 22 nt, Salmonella enterica enterica serovar Typhi
caucaccauaccgacgaccaua

SEQ ID NO: 1654832 - RNA, 14 nt, Salmonella enterica enterica serovar Typhi
caucaucaggccug

SEQ ID NO: 1654833 - RNA, 16 nt, Salmonella enterica enterica serovar Typhi
caucauagugcgcgcg

SEQ ID NO: 1654834 - RNA, 22 nt, Salmonella enterica enterica serovar Typhi
caucauccccggcaggcucacc

SEQ ID NO: 1654835 - RNA, 23 nt, Salmonella enterica enterica serovar Typhi
caucaucgcuggugugcagccag

SEQ ID NO: 1654836 - RNA, 22 nt, Salmonella enterica enterica serovar Typhi
caucaugaugaucuucagcccg

SEQ ID NO: 1654837 - RNA, 16 nt, Salmonella enterica enterica serovar Typhi
caucagaccgauaaau

SEQ ID NO: 1654838 - RNA, 16 nt, Salmonella enterica enterica serovar Typhi
caucaggcuggcguua

SEQ ID NO: 1654839 - RNA, 19 nt, Salmonella enterica enterica serovar Typhi
caucagauaaacagguaaa

SEQ ID NO: 1654840 - RNA, 13 nt, Salmonella enterica enterica serovar Typhi
cauccaacugcgc

SEQ ID NO: 1654841 - RNA, 15 nt, Salmonella enterica enterica serovar Typhi
cauccaacugcgccu

SEQ ID NO: 1654842 - RNA, 13 nt, Salmonella enterica enterica serovar Typhi
cauccacagcgcc

SEQ ID NO: 1654843 - RNA, 22 nt, Salmonella enterica enterica serovar Typhi
caucccgguuugggcgcgaaac

SEQ ID NO: 1654844 - RNA, 14 nt, Salmonella enterica enterica serovar Typhi
caucccguagcguc

SEQ ID NO: 1654845 - RNA, 15 nt, Salmonella enterica enterica serovar Typhi
caucccggcgacagc

SEQ ID NO: 1654846 - RNA, 17 nt, Salmonella enterica enterica serovar Typhi
cauccgacagggcguga

SEQ ID NO: 1654847 - RNA, 23 nt, Salmonella enterica enterica serovar Typhi
cauaagagauggaaugagcaucu

SEQ ID NO: 1654848 - RNA, 20 nt, Salmonella enterica enterica serovar Typhi
cauaccacaacagaaucgcg

SEQ ID NO: 1654849 - RNA, 17 nt, Salmonella enterica enterica serovar Typhi
cauaccacgcagcggca

SEQ ID NO: 1654850 - RNA, 12 nt, Salmonella enterica enterica serovar Typhi
cauaccagcgaa

SEQ ID NO: 1654851 - RNA, 17 nt, Salmonella enterica enterica serovar Typhi
cauaaauugcagcgacc

SEQ ID NO: 1654852 - RNA, 17 nt, Salmonella enterica enterica serovar Typhi
cauaacgaaauccgcgc

SEQ ID NO: 1654853 - RNA, 18 nt, Salmonella enterica enterica serovar Typhi
cauaacgcacgcuaaagc

SEQ ID NO: 1654854 - RNA, 22 nt, Salmonella enterica enterica serovar Typhi
caguuucuucggcuucaccgau

SEQ ID NO: 1654855 - RNA, 20 nt, Salmonella enterica enterica serovar Typhi
caguuugcguucacagcacc

SEQ ID NO: 1654856 - RNA, 15 nt, Salmonella enterica enterica serovar Typhi
cauaaauugcagcga

SEQ ID NO: 1654857 - RNA, 18 nt, Salmonella enterica enterica serovar Typhi
caguugguuagaauaccu

SEQ ID NO: 1654858 - RNA, 13 nt, Salmonella enterica enterica serovar Typhi
cauacuaccgcug

SEQ ID NO: 1654859 - RNA, 18 nt, Salmonella enterica enterica serovar Typhi
cauacuguuuaucagacc

SEQ ID NO: 1654860 - RNA, 19 nt, Salmonella enterica enterica serovar Typhi
cauacccggcucccauuug

SEQ ID NO: 1654861 - RNA, 21 nt, Salmonella enterica enterica serovar Typhi
cauaccgcuuaacagcguaca

SEQ ID NO: 1654862 - RNA, 22 nt, Salmonella enterica enterica serovar Typhi
cauacgguuguugauuaagcac

SEQ ID NO: 1654863 - RNA, 17 nt, Salmonella enterica enterica serovar Typhi
cauaggccggcgaagau

SEQ ID NO: 1654864 - RNA, 21 nt, Salmonella enterica enterica serovar Typhi
cauaggcguugauggcguaau

SEQ ID NO: 1654865 - RNA, 22 nt, Salmonella enterica enterica serovar Typhi
cauaguauugacgguuacgcaa

SEQ ID NO: 1654866 - RNA, 17 nt, Salmonella enterica enterica serovar Typhi
cagugccugguggcgac

SEQ ID NO: 1654867 - RNA, 21 nt, Salmonella enterica enterica serovar Typhi
cagugcgaugcgaccgcgcca

SEQ ID NO: 1654868 - RNA, 13 nt, Salmonella enterica enterica serovar Typhi
cagucgcagccac

SEQ ID NO: 1654869 - RNA, 15 nt, Salmonella enterica enterica serovar Typhi
caguguaaacgccag

SEQ ID NO: 1654870 - RNA, 13 nt, Salmonella enterica enterica serovar Typhi
caguucaaucagg

SEQ ID NO: 1654871 - RNA, 23 nt, Salmonella enterica enterica serovar Typhi
caguuccaccguaugugcgccgu

SEQ ID NO: 1654872 - RNA, 22 nt, Salmonella enterica enterica serovar Typhi
cagugggcgucaaaaucccggc

SEQ ID NO: 1654873 - RNA, 17 nt, Salmonella enterica enterica serovar Typhi
caguggucaggcgacca

SEQ ID NO: 1654874 - RNA, 13 nt, Salmonella enterica enterica serovar Typhi
caguugcagcacc

SEQ ID NO: 1654875 - RNA, 19 nt, Salmonella enterica enterica serovar Typhi
caguuggcguaccaucagc

SEQ ID NO: 1654876 - RNA, 16 nt, Salmonella enterica enterica serovar Typhi
caguugcggcaucaga

SEQ ID NO: 1654877 - RNA, 20 nt, Salmonella enterica enterica serovar Typhi
cacggcguguugaaauccuc

SEQ ID NO: 1654878 - RNA, 14 nt, Salmonella enterica enterica serovar Typhi
cacgguucacauuc

SEQ ID NO: 1654879 - RNA, 23 nt, Salmonella enterica enterica serovar Typhi
cacgguuaucuggcgcaaccggc

SEQ ID NO: 1654880 - RNA, 13 nt, Salmonella enterica enterica serovar Typhi
cacggcgauaaau

SEQ ID NO: 1654881 - RNA, 15 nt, Salmonella enterica enterica serovar Typhi
cacggcggccauuac

SEQ ID NO: 1654882 - RNA, 22 nt, Salmonella enterica enterica serovar Typhi
cacggcgcucaggaucgccgga

SEQ ID NO: 1654883 - RNA, 14 nt, Salmonella enterica enterica serovar Typhi
cacgcgcgucagga

SEQ ID NO: 1654884 - RNA, 15 nt, Salmonella enterica enterica serovar Typhi
cacggaugaucuuca

SEQ ID NO: 1654885 - RNA, 14 nt, Salmonella enterica enterica serovar Typhi
cacggcaacgccgu

SEQ ID NO: 1654886 - RNA, 14 nt, Salmonella enterica enterica serovar Typhi
cacgcgcgcgaaac

SEQ ID NO: 1654887 - RNA, 20 nt, Salmonella enterica enterica serovar Typhi
cacgcgcgcugcgccuggaa

SEQ ID NO: 1654888 - RNA, 15 nt, Salmonella enterica enterica serovar Typhi
cacuucauccggcgu

SEQ ID NO: 1654889 - RNA, 13 nt, Salmonella enterica enterica serovar Typhi
cacuucauccgga

SEQ ID NO: 1654890 - RNA, 21 nt, Salmonella enterica enterica serovar Typhi
cacuggcauuuugcggcgugg

SEQ ID NO: 1654891 - RNA, 21 nt, Salmonella enterica enterica serovar Typhi
cacuggaauaguuacggacau

SEQ ID NO: 1654892 - RNA, 13 nt, Salmonella enterica enterica serovar Typhi
cacugcugaaagc

SEQ ID NO: 1654893 - RNA, 23 nt, Salmonella enterica enterica serovar Typhi
cacuggcagccucguccugcaau

SEQ ID NO: 1654894 - RNA, 14 nt, Salmonella enterica enterica serovar Typhi
cacuuuuccggcac

SEQ ID NO: 1654895 - RNA, 14 nt, Salmonella enterica enterica serovar Typhi
cagaacaacgggaa

SEQ ID NO: 1654896 - RNA, 18 nt, Salmonella enterica enterica serovar Typhi
cagaagguuauucgccuu

SEQ ID NO: 1654897 - RNA, 15 nt, Salmonella enterica enterica serovar Typhi
cagaaggcuaacagc

SEQ ID NO: 1654898 - RNA, 15 nt, Salmonella enterica enterica serovar Typhi
cacugauagccgcca

SEQ ID NO: 1654899 - RNA, 18 nt, Salmonella enterica enterica serovar Typhi
cacugcguaaaaucgcag

SEQ ID NO: 1654900 - RNA, 22 nt, Salmonella enterica enterica serovar Typhi
cacugcccuggaagaacuggau

SEQ ID NO: 1654901 - RNA, 20 nt, Salmonella enterica enterica serovar Typhi
cacugaauuacugcguaaac

SEQ ID NO: 1654902 - RNA, 14 nt, Salmonella enterica enterica serovar Typhi
cacgaagcggguuu

SEQ ID NO: 1654903 - RNA, 13 nt, Salmonella enterica enterica serovar Typhi
cacgacauccgga

SEQ ID NO: 1654904 - RNA, 20 nt, Salmonella enterica enterica serovar Typhi
caccuuuuuauuuacugccg

SEQ ID NO: 1654905 - RNA, 12 nt, Salmonella enterica enterica serovar Typhi
caccuugcugcg

SEQ ID NO: 1654906 - RNA, 19 nt, Salmonella enterica enterica serovar Typhi
caccuguuucugcuggccu

SEQ ID NO: 1654907 - RNA, 14 nt, Salmonella enterica enterica serovar Typhi
caccuuaaccgucu

SEQ ID NO: 1654908 - RNA, 23 nt, Salmonella enterica enterica serovar Typhi
caccugguaagcgccaagcggca

SEQ ID NO: 1654909 - RNA, 18 nt, Salmonella enterica enterica serovar Typhi
caccucuuccccggucag

SEQ ID NO: 1654910 - RNA, 20 nt, Salmonella enterica enterica serovar Typhi
caccucgguauguccugccg

SEQ ID NO: 1654911 - RNA, 19 nt, Salmonella enterica enterica serovar Typhi
cacgccgcuaucgaccagc

SEQ ID NO: 1654912 - RNA, 18 nt, Salmonella enterica enterica serovar Typhi
cacgccgccauccggcaa

SEQ ID NO: 1654913 - RNA, 14 nt, Salmonella enterica enterica serovar Typhi
cacgccgccaaagc

SEQ ID NO: 1654914 - RNA, 19 nt, Salmonella enterica enterica serovar Typhi
cacgccagggagggccaac

SEQ ID NO: 1654915 - RNA, 19 nt, Salmonella enterica enterica serovar Typhi
cacgccagauaaaucagcc

SEQ ID NO: 1654916 - RNA, 16 nt, Salmonella enterica enterica serovar Typhi
cacgccaucagggacg

SEQ ID NO: 1654917 - RNA, 23 nt, Salmonella enterica enterica serovar Typhi
cacgcaucgggucgcgcgccgca

SEQ ID NO: 1654918 - RNA, 21 nt, Salmonella enterica enterica serovar Typhi
cacgccacaguauuccggcau

SEQ ID NO: 1654919 - RNA, 13 nt, Salmonella enterica enterica serovar Typhi
cacgcacgccggc

SEQ ID NO: 1654920 - RNA, 12 nt, Salmonella enterica enterica serovar Typhi
cacgcagacgcc

SEQ ID NO: 1654921 - RNA, 17 nt, Salmonella enterica enterica serovar Typhi
cacgcagugcgaugcga

SEQ ID NO: 1654922 - RNA, 15 nt, Salmonella enterica enterica serovar Typhi
cacgacuuucaccag

SEQ ID NO: 1654923 - RNA, 21 nt, Salmonella enterica enterica serovar Typhi
cacgauacgccccugcuggcg

SEQ ID NO: 1654924 - RNA, 16 nt, Salmonella enterica enterica serovar Typhi
cacgauagacagcacc

SEQ ID NO: 1654925 - RNA, 17 nt, Salmonella enterica enterica serovar Typhi
cacgauagacagcacca

SEQ ID NO: 1654926 - RNA, 18 nt, Salmonella enterica enterica serovar Typhi
cacgauaaauugccugau

SEQ ID NO: 1654927 - RNA, 14 nt, Salmonella enterica enterica serovar Typhi
cacgaucgccuaau

SEQ ID NO: 1654928 - RNA, 14 nt, Salmonella enterica enterica serovar Typhi
cacgcaacaggccg

SEQ ID NO: 1654929 - RNA, 13 nt, Salmonella enterica enterica serovar Typhi
cacgcaaaccgcu

SEQ ID NO: 1654930 - RNA, 21 nt, Salmonella enterica enterica serovar Typhi
cagauaguuagcuaucgcgcc

SEQ ID NO: 1654931 - RNA, 16 nt, Salmonella enterica enterica serovar Typhi
cagauauugccgacca

SEQ ID NO: 1654932 - RNA, 18 nt, Salmonella enterica enterica serovar Typhi
cagauauuccagcgacau

SEQ ID NO: 1654933 - RNA, 16 nt, Salmonella enterica enterica serovar Typhi
cagauguccaccgauu

SEQ ID NO: 1654934 - RNA, 16 nt, Salmonella enterica enterica serovar Typhi
cagauguaccagcggc

SEQ ID NO: 1654935 - RNA, 18 nt, Salmonella enterica enterica serovar Typhi
cagauguccaccgauuuc

SEQ ID NO: 1654936 - RNA, 20 nt, Salmonella enterica enterica serovar Typhi
cagauguuuacgcugcuccg

SEQ ID NO: 1654937 - RNA, 19 nt, Salmonella enterica enterica serovar Typhi
cagauguggcggcccgugg

SEQ ID NO: 1654938 - RNA, 14 nt, Salmonella enterica enterica serovar Typhi
cagauucagauggc

SEQ ID NO: 1654939 - RNA, 21 nt, Salmonella enterica enterica serovar Typhi
cagauuaucggccagcgccag

SEQ ID NO: 1654940 - RNA, 20 nt, Salmonella enterica enterica serovar Typhi
cagaugggccauuuacgcca

SEQ ID NO: 1654941 - RNA, 19 nt, Salmonella enterica enterica serovar Typhi
cagauggugauagcgcgcc

SEQ ID NO: 1654942 - RNA, 15 nt, Salmonella enterica enterica serovar Typhi
cagaauuuguuuaug

SEQ ID NO: 1654943 - RNA, 18 nt, Salmonella enterica enterica serovar Typhi
cagauaauagcugcggcu

SEQ ID NO: 1654944 - RNA, 21 nt, Salmonella enterica enterica serovar Typhi
cagauacgccuuuacgucgcc

SEQ ID NO: 1654945 - RNA, 17 nt, Salmonella enterica enterica serovar Typhi
cagauagcguaaccggu

SEQ ID NO: 1654946 - RNA, 19 nt, Salmonella enterica enterica serovar Typhi
cagauagcccgccagcacc

SEQ ID NO: 1654947 - RNA, 12 nt, Salmonella enterica enterica serovar Typhi
cagaauacggcc

SEQ ID NO: 1654948 - RNA, 14 nt, Salmonella enterica enterica serovar Typhi
cagaauaugccagg

SEQ ID NO: 1654949 - RNA, 21 nt, Salmonella enterica enterica serovar Typhi
cagaauauugcugauaaucaa

SEQ ID NO: 1654950 - RNA, 22 nt, Salmonella enterica enterica serovar Typhi
cagaaucaguaacacaaucagg

SEQ ID NO: 1654951 - RNA, 23 nt, Salmonella enterica enterica serovar Typhi
cagaaucccgccuugcggcgcca

SEQ ID NO: 1654952 - RNA, 15 nt, Salmonella enterica enterica serovar Typhi
cagaaucgccagcau

SEQ ID NO: 1654953 - RNA, 22 nt, Salmonella enterica enterica serovar Typhi
cagaaucccacggagaaaagcg

SEQ ID NO: 1654954 - RNA, 22 nt, Salmonella enterica enterica serovar Typhi
cagauugauacggguaaucaga

SEQ ID NO: 1654955 - RNA, 16 nt, Salmonella enterica enterica serovar Typhi
cagcacauucagcagc

SEQ ID NO: 1654956 - RNA, 14 nt, Salmonella enterica enterica serovar Typhi
cagcacaaucagcg

SEQ ID NO: 1654957 - RNA, 20 nt, Salmonella enterica enterica serovar Typhi
cagcaaugauaacggcgcca

SEQ ID NO: 1654958 - RNA, 20 nt, Salmonella enterica enterica serovar Typhi
cagcacauucgauaaccgcc

SEQ ID NO: 1654959 - RNA, 16 nt, Salmonella enterica enterica serovar Typhi
cagcaccacgcccgga

SEQ ID NO: 1654960 - RNA, 12 nt, Salmonella enterica enterica serovar Typhi
cagcaccagcau

SEQ ID NO: 1654961 - RNA, 13 nt, Salmonella enterica enterica serovar Typhi
cagcacccaggca

SEQ ID NO: 1654962 - RNA, 15 nt, Salmonella enterica enterica serovar Typhi
cagcaccgccgcgau

SEQ ID NO: 1654963 - RNA, 16 nt, Salmonella enterica enterica serovar Typhi
cagcaccuccagcgcc

SEQ ID NO: 1654964 - RNA, 19 nt, Salmonella enterica enterica serovar Typhi
cagcacgacagagaucagg

SEQ ID NO: 1654965 - RNA, 15 nt, Salmonella enterica enterica serovar Typhi
cagcacgacagagau

SEQ ID NO: 1654966 - RNA, 13 nt, Salmonella enterica enterica serovar Typhi
cagcagcugcugu

SEQ ID NO: 1654967 - RNA, 13 nt, Salmonella enterica enterica serovar Typhi
cagcagcagcucg

SEQ ID NO: 1654968 - RNA, 14 nt, Salmonella enterica enterica serovar Typhi
cagcagcgcauagg

SEQ ID NO: 1654969 - RNA, 15 nt, Salmonella enterica enterica serovar Typhi
cagcagcgcaucaug

SEQ ID NO: 1654970 - RNA, 17 nt, Salmonella enterica enterica serovar Typhi
cagcacgcgcugcgccg

SEQ ID NO: 1654971 - RNA, 19 nt, Salmonella enterica enterica serovar Typhi
cagcagaauaacaucuucc

SEQ ID NO: 1654972 - RNA, 16 nt, Salmonella enterica enterica serovar Typhi
cagcagcagaaucagg

SEQ ID NO: 1654973 - RNA, 15 nt, Salmonella enterica enterica serovar Typhi
cagccagacgccagc

SEQ ID NO: 1654974 - RNA, 17 nt, Salmonella enterica enterica serovar Typhi
cagccaacccacgcgcc

SEQ ID NO: 1654975 - RNA, 15 nt, Salmonella enterica enterica serovar Typhi
cagccaaacugcugu

SEQ ID NO: 1654976 - RNA, 13 nt, Salmonella enterica enterica serovar Typhi
cagccaaacugcu

SEQ ID NO: 1654977 - RNA, 17 nt, Salmonella enterica enterica serovar Typhi
cagccaaagucuggcca

SEQ ID NO: 1654978 - RNA, 22 nt, Salmonella enterica enterica serovar Typhi
cagccaaagucuggccaccgau

SEQ ID NO: 1654979 - RNA, 17 nt, Salmonella enterica enterica serovar Typhi
cagccaaauagcgccag

SEQ ID NO: 1654980 - RNA, 19 nt, Salmonella enterica enterica serovar Typhi
cagccaaauagcgccagac

SEQ ID NO: 1654981 - RNA, 22 nt, Salmonella enterica enterica serovar Typhi
cagcaggacaaccccuacgcag

SEQ ID NO: 1654982 - RNA, 13 nt, Salmonella enterica enterica serovar Typhi
cagcauacgucug

SEQ ID NO: 1654983 - RNA, 16 nt, Salmonella enterica enterica serovar Typhi
cagcauccaugccagc

SEQ ID NO: 1654984 - RNA, 19 nt, Salmonella enterica enterica serovar Typhi
cagcaucccgcuggcgcca

SEQ ID NO: 1654985 - RNA, 15 nt, Salmonella enterica enterica serovar Typhi
cagcaucccggcaaa

SEQ ID NO: 1654986 - RNA, 12 nt, Salmonella enterica enterica serovar Typhi
cagcaucaaccc

SEQ ID NO: 1654987 - RNA, 21 nt, Salmonella enterica enterica serovar Typhi
cagcauauuuuccggcgucug

SEQ ID NO: 1654988 - RNA, 16 nt, Salmonella enterica enterica serovar Typhi
cagcauauccagcgcc

SEQ ID NO: 1654989 - RNA, 15 nt, Salmonella enterica enterica serovar Typhi
cagccauucaccacu

SEQ ID NO: 1654990 - RNA, 16 nt, Salmonella enterica enterica serovar Typhi
cagccaggccagcgcu

SEQ ID NO: 1654991 - RNA, 21 nt, Salmonella enterica enterica serovar Typhi
cagccagcauuuccagcuggu

SEQ ID NO: 1654992 - RNA, 19 nt, Salmonella enterica enterica serovar Typhi
cagcccguagauaagcgcc

SEQ ID NO: 1654993 - RNA, 20 nt, Salmonella enterica enterica serovar Typhi
cagcccucgguacugcgggu

SEQ ID NO: 1654994 - RNA, 22 nt, Salmonella enterica enterica serovar Typhi
cagcccucaacauugccggcau

SEQ ID NO: 1654995 - RNA, 19 nt, Salmonella enterica enterica serovar Typhi
cagcccguucugugcgccg

SEQ ID NO: 1654996 - RNA, 21 nt, Salmonella enterica enterica serovar Typhi
cagccggaaaagcgcuggcug

SEQ ID NO: 1654997 - RNA, 16 nt, Salmonella enterica enterica serovar Typhi
cagccgcucugcuguu

SEQ ID NO: 1654998 - RNA, 18 nt, Salmonella enterica enterica serovar Typhi
cagccggauagacaugac

SEQ ID NO: 1654999 - RNA, 16 nt, Salmonella enterica enterica serovar Typhi
cagccgucaugauguu

SEQ ID NO: 1655000 - RNA, 19 nt, Salmonella enterica enterica serovar Typhi
cagccucgcgcauccgggc

SEQ ID NO: 1655001 - RNA, 14 nt, Salmonella enterica enterica serovar Typhi
cagcgaauagcggc

SEQ ID NO: 1655002 - RNA, 22 nt, Salmonella enterica enterica serovar Typhi
cagccuggagagcagcgccagc

SEQ ID NO: 1655003 - RNA, 15 nt, Salmonella enterica enterica serovar Typhi
cagccugccgcaucu

SEQ ID NO: 1655004 - RNA, 20 nt, Salmonella enterica enterica serovar Typhi
cagcgacgaugaaauaaacg

SEQ ID NO: 1655005 - RNA, 16 nt, Salmonella enterica enterica serovar Typhi
cagcgaccuccgcgca

SEQ ID NO: 1655006 - RNA, 22 nt, Salmonella enterica enterica serovar Typhi
cagcgacucauucagcaacugc

SEQ ID NO: 1655007 - RNA, 17 nt, Salmonella enterica enterica serovar Typhi
cgcaccguugccauacg

SEQ ID NO: 1655008 - RNA, 16 nt, Salmonella enterica enterica serovar Typhi
cgcacgaccugaagcg

SEQ ID NO: 1655009 - RNA, 22 nt, Salmonella enterica enterica serovar Typhi
cgcaagcacugaaugcugacgc

SEQ ID NO: 1655010 - RNA, 17 nt, Salmonella enterica enterica serovar Typhi
cgcacgccugggcgaua

SEQ ID NO: 1655011 - RNA, 12 nt, Salmonella enterica enterica serovar Typhi
cgcacgccagau

SEQ ID NO: 1655012 - RNA, 18 nt, Salmonella enterica enterica serovar Typhi
cgcacugauagccgccag

SEQ ID NO: 1655013 - RNA, 17 nt, Salmonella enterica enterica serovar Typhi
cgcacuacggcaaacgc

SEQ ID NO: 1655014 - RNA, 21 nt, Salmonella enterica enterica serovar Typhi
cgcacuacggcaaacgcuggu

SEQ ID NO: 1655015 - RNA, 23 nt, Salmonella enterica enterica serovar Typhi
cgcacguuuugguccaugccggc

SEQ ID NO: 1655016 - RNA, 16 nt, Salmonella enterica enterica serovar Typhi
cgcagaagcagaccga

SEQ ID NO: 1655017 - RNA, 18 nt, Salmonella enterica enterica serovar Typhi
cgcagcagagaucaggag

SEQ ID NO: 1655018 - RNA, 18 nt, Salmonella enterica enterica serovar Typhi
cgcagcacuucagaacgg

SEQ ID NO: 1655019 - RNA, 16 nt, Salmonella enterica enterica serovar Typhi
cgcagcgaaaauccag

SEQ ID NO: 1655020 - RNA, 13 nt, Salmonella enterica enterica serovar Typhi
cgcaggccggaua

SEQ ID NO: 1655021 - RNA, 14 nt, Salmonella enterica enterica serovar Typhi
cgcaggccaucaua

SEQ ID NO: 1655022 - RNA, 16 nt, Salmonella enterica enterica serovar Typhi
cgcaggcuaacgcgcc

SEQ ID NO: 1655023 - RNA, 13 nt, Salmonella enterica enterica serovar Typhi
cgcaggagagcca

SEQ ID NO: 1655024 - RNA, 19 nt, Salmonella enterica enterica serovar Typhi
cgcaggaugcgcugcgcgc

SEQ ID NO: 1655025 - RNA, 15 nt, Salmonella enterica enterica serovar Typhi
cgcaggcaacggccc

SEQ ID NO: 1655026 - RNA, 14 nt, Salmonella enterica enterica serovar Typhi
cgcagcgccauccg

SEQ ID NO: 1655027 - RNA, 20 nt, Salmonella enterica enterica serovar Typhi
cgcagcgccgacguuaucgc

SEQ ID NO: 1655028 - RNA, 15 nt, Salmonella enterica enterica serovar Typhi
cgccacaaacugcgc

SEQ ID NO: 1655029 - RNA, 13 nt, Salmonella enterica enterica serovar Typhi
cgccaagcggcaa

SEQ ID NO: 1655030 - RNA, 19 nt, Salmonella enterica enterica serovar Typhi
cgccaaugguuaacgccgu

SEQ ID NO: 1655031 - RNA, 11 nt, Salmonella enterica enterica serovar Typhi
cgccaaugaac

SEQ ID NO: 1655032 - RNA, 15 nt, Salmonella enterica enterica serovar Typhi
cgcauuucguggcgg

SEQ ID NO: 1655033 - RNA, 19 nt, Salmonella enterica enterica serovar Typhi
cgcauuucaagcaggcgau

SEQ ID NO: 1655034 - RNA, 17 nt, Salmonella enterica enterica serovar Typhi
cgcauuucaagcaggcg

SEQ ID NO: 1655035 - RNA, 18 nt, Salmonella enterica enterica serovar Typhi
cgcauugcgccccagcac

SEQ ID NO: 1655036 - RNA, 21 nt, Salmonella enterica enterica serovar Typhi
cgccaagaaggguauccagcg

SEQ ID NO: 1655037 - RNA, 17 nt, Salmonella enterica enterica serovar Typhi
cgccaccauguugcgca

SEQ ID NO: 1655038 - RNA, 19 nt, Salmonella enterica enterica serovar Typhi
cgccaccaucgucgccaga

SEQ ID NO: 1655039 - RNA, 19 nt, Salmonella enterica enterica serovar Typhi
cgccacaguauuccggcau

SEQ ID NO: 1655040 - RNA, 16 nt, Salmonella enterica enterica serovar Typhi
cgccaccacucggcga

SEQ ID NO: 1655041 - RNA, 16 nt, Salmonella enterica enterica serovar Typhi
cgcauugccacagccu

SEQ ID NO: 1655042 - RNA, 14 nt, Salmonella enterica enterica serovar Typhi
cgcaugguaaacgc

SEQ ID NO: 1655043 - RNA, 21 nt, Salmonella enterica enterica serovar Typhi
cgcauggacaaggaucguuac

SEQ ID NO: 1655044 - RNA, 15 nt, Salmonella enterica enterica serovar Typhi
cgcauggcagggcga

SEQ ID NO: 1655045 - RNA, 15 nt, Salmonella enterica enterica serovar Typhi
cgcauggcguugcug

SEQ ID NO: 1655046 - RNA, 16 nt, Salmonella enterica enterica serovar Typhi
cgcaucugacaucaga

SEQ ID NO: 1655047 - RNA, 19 nt, Salmonella enterica enterica serovar Typhi
cgcaugacuacgaaucgcg

SEQ ID NO: 1655048 - RNA, 17 nt, Salmonella enterica enterica serovar Typhi
cgcaucucccugccagu

SEQ ID NO: 1655049 - RNA, 15 nt, Salmonella enterica enterica serovar Typhi
cgcaucgggaaacgg

SEQ ID NO: 1655050 - RNA, 21 nt, Salmonella enterica enterica serovar Typhi
cgcaucgaagagcauaugcgc

SEQ ID NO: 1655051 - RNA, 15 nt, Salmonella enterica enterica serovar Typhi
cgcauccggaaucgc

SEQ ID NO: 1655052 - RNA, 22 nt, Salmonella enterica enterica serovar Typhi
cgcaguaaucaccgucuccggc

SEQ ID NO: 1655053 - RNA, 16 nt, Salmonella enterica enterica serovar Typhi
cgccagcuuucggcga

SEQ ID NO: 1655054 - RNA, 14 nt, Salmonella enterica enterica serovar Typhi
cgccagcggcguuu

SEQ ID NO: 1655055 - RNA, 14 nt, Salmonella enterica enterica serovar Typhi
cgccagcggcgcca

SEQ ID NO: 1655056 - RNA, 18 nt, Salmonella enterica enterica serovar Typhi
cgccagcgucucagcagg

SEQ ID NO: 1655057 - RNA, 17 nt, Salmonella enterica enterica serovar Typhi
cgccagcggccagcgua

SEQ ID NO: 1655058 - RNA, 13 nt, Salmonella enterica enterica serovar Typhi
cgccagcgccaca

SEQ ID NO: 1655059 - RNA, 23 nt, Salmonella enterica enterica serovar Typhi
cgccagcccgacuaccggcacca

SEQ ID NO: 1655060 - RNA, 18 nt, Salmonella enterica enterica serovar Typhi
cgccagccgaucaucgua

SEQ ID NO: 1655061 - RNA, 22 nt, Salmonella enterica enterica serovar Typhi
cgccagauccggcagcgggcaa

SEQ ID NO: 1655062 - RNA, 23 nt, Salmonella enterica enterica serovar Typhi
cgccagauuaucggccagcgcca

SEQ ID NO: 1655063 - RNA, 17 nt, Salmonella enterica enterica serovar Typhi
cgccagcagcagcgcaa

SEQ ID NO: 1655064 - RNA, 15 nt, Salmonella enterica enterica serovar Typhi
cgccagauggcguca

SEQ ID NO: 1655065 - RNA, 17 nt, Salmonella enterica enterica serovar Typhi
cgccacgccgcuccaca

SEQ ID NO: 1655066 - RNA, 14 nt, Salmonella enterica enterica serovar Typhi
cgccacuuccagcg

SEQ ID NO: 1655067 - RNA, 17 nt, Salmonella enterica enterica serovar Typhi
cgccagauaaaucagcc

SEQ ID NO: 1655068 - RNA, 21 nt, Salmonella enterica enterica serovar Typhi
cgccagauaaucgccgccagc

SEQ ID NO: 1655069 - RNA, 14 nt, Salmonella enterica enterica serovar Typhi
cgccagauaaagcg

SEQ ID NO: 1655070 - RNA, 13 nt, Salmonella enterica enterica serovar Typhi
cgccaccgccagc

SEQ ID NO: 1655071 - RNA, 16 nt, Salmonella enterica enterica serovar Typhi
cgccaccgccagccau

SEQ ID NO: 1655072 - RNA, 21 nt, Salmonella enterica enterica serovar Typhi
cgauaaaaacccaccagcgcc

SEQ ID NO: 1655073 - RNA, 20 nt, Salmonella enterica enterica serovar Typhi
cgauaaaaaacgcccagauc

SEQ ID NO: 1655074 - RNA, 20 nt, Salmonella enterica enterica serovar Typhi
cgauacagacgccaacgcgc

SEQ ID NO: 1655075 - RNA, 19 nt, Salmonella enterica enterica serovar Typhi
cgauacgcggaucggcaca

SEQ ID NO: 1655076 - RNA, 22 nt, Salmonella enterica enterica serovar Typhi
cgauacgcagcaccgccgcgau

SEQ ID NO: 1655077 - RNA, 21 nt, Salmonella enterica enterica serovar Typhi
cgauacgacugacuucaucaa

SEQ ID NO: 1655078 - RNA, 21 nt, Salmonella enterica enterica serovar Typhi
cgaucacccacaucagcggca

SEQ ID NO: 1655079 - RNA, 18 nt, Salmonella enterica enterica serovar Typhi
cgauacuccauugucggc

SEQ ID NO: 1655080 - RNA, 12 nt, Salmonella enterica enterica serovar Typhi
cgauagacagca

SEQ ID NO: 1655081 - RNA, 18 nt, Salmonella enterica enterica serovar Typhi
cgauauuacuuuccagca

SEQ ID NO: 1655082 - RNA, 14 nt, Salmonella enterica enterica serovar Typhi
cgaucagcgccacc

SEQ ID NO: 1655083 - RNA, 21 nt, Salmonella enterica enterica serovar Typhi
cgaucacuucgacaugcguac

SEQ ID NO: 1655084 - RNA, 18 nt, Salmonella enterica enterica serovar Typhi
cgaucagacgcugguugu

SEQ ID NO: 1655085 - RNA, 15 nt, Salmonella enterica enterica serovar Typhi
cgaguggaaucagcc

SEQ ID NO: 1655086 - RNA, 20 nt, Salmonella enterica enterica serovar Typhi
cgagucgaucgucgggauaa

SEQ ID NO: 1655087 - RNA, 17 nt, Salmonella enterica enterica serovar Typhi
cgaguagcugagcguca

SEQ ID NO: 1655088 - RNA, 21 nt, Salmonella enterica enterica serovar Typhi
cgcaaaugauaauaugcucaa

SEQ ID NO: 1655089 - RNA, 19 nt, Salmonella enterica enterica serovar Typhi
cgcaaauucgucgccgcca

SEQ ID NO: 1655090 - RNA, 16 nt, Salmonella enterica enterica serovar Typhi
cgcaaaucaccgucga

SEQ ID NO: 1655091 - RNA, 17 nt, Salmonella enterica enterica serovar Typhi
cgcaaaugaccagauca

SEQ ID NO: 1655092 - RNA, 18 nt, Salmonella enterica enterica serovar Typhi
cgcaacagcuugcgccca

SEQ ID NO: 1655093 - RNA, 14 nt, Salmonella enterica enterica serovar Typhi
cgcaacgcgcauca

SEQ ID NO: 1655094 - RNA, 15 nt, Salmonella enterica enterica serovar Typhi
cgauguuugccacgc

SEQ ID NO: 1655095 - RNA, 14 nt, Salmonella enterica enterica serovar Typhi
cgauguuuugccga

SEQ ID NO: 1655096 - RNA, 16 nt, Salmonella enterica enterica serovar Typhi
cgauguucuugccgcc

SEQ ID NO: 1655097 - RNA, 21 nt, Salmonella enterica enterica serovar Typhi
cgauguucgucccugcaacgc

SEQ ID NO: 1655098 - RNA, 22 nt, Salmonella enterica enterica serovar Typhi
cgauuagcuggcugcgcgggag

SEQ ID NO: 1655099 - RNA, 18 nt, Salmonella enterica enterica serovar Typhi
cgauuacgccagacagca

SEQ ID NO: 1655100 - RNA, 13 nt, Salmonella enterica enterica serovar Typhi
cgauucugccagu

SEQ ID NO: 1655101 - RNA, 12 nt, Salmonella enterica enterica serovar Typhi
cgauugaucgga

SEQ ID NO: 1655102 - RNA, 14 nt, Salmonella enterica enterica serovar Typhi
cgauuuccagcgaa

SEQ ID NO: 1655103 - RNA, 19 nt, Salmonella enterica enterica serovar Typhi
cgauuuauccaccgccaga

SEQ ID NO: 1655104 - RNA, 22 nt, Salmonella enterica enterica serovar Typhi
cgauggcaaauaauaccacgau

SEQ ID NO: 1655105 - RNA, 13 nt, Salmonella enterica enterica serovar Typhi
cgauggcgcuacg

SEQ ID NO: 1655106 - RNA, 21 nt, Salmonella enterica enterica serovar Typhi
cgaugguguuggcaaucagcg

SEQ ID NO: 1655107 - RNA, 16 nt, Salmonella enterica enterica serovar Typhi
cgauguaguugccgcc

SEQ ID NO: 1655108 - RNA, 17 nt, Salmonella enterica enterica serovar Typhi
cgauguaguugccgccc

SEQ ID NO: 1655109 - RNA, 19 nt, Salmonella enterica enterica serovar Typhi
cgaugcgcgagccguaaac

SEQ ID NO: 1655110 - RNA, 23 nt, Salmonella enterica enterica serovar Typhi
cgaugcacaacacgcuuuucagc

SEQ ID NO: 1655111 - RNA, 13 nt, Salmonella enterica enterica serovar Typhi
cgaugcagccugg

SEQ ID NO: 1655112 - RNA, 17 nt, Salmonella enterica enterica serovar Typhi
cgaugccgccgacaacc

SEQ ID NO: 1655113 - RNA, 16 nt, Salmonella enterica enterica serovar Typhi
cgaugccgccgcaacg

SEQ ID NO: 1655114 - RNA, 13 nt, Salmonella enterica enterica serovar Typhi
cgaugaccaucaa

SEQ ID NO: 1655115 - RNA, 23 nt, Salmonella enterica enterica serovar Typhi
cgaucuguguacuuuuaacgccc

SEQ ID NO: 1655116 - RNA, 10 nt, Salmonella enterica enterica serovar Typhi
cgaucgccac

SEQ ID NO: 1655117 - RNA, 18 nt, Salmonella enterica enterica serovar Typhi
cgaucguccgccuccggc

SEQ ID NO: 1655118 - RNA, 16 nt, Salmonella enterica enterica serovar Typhi
cgaucucccagccggg

SEQ ID NO: 1655119 - RNA, 18 nt, Salmonella enterica enterica serovar Typhi
cgacgaauggcggcguuu

SEQ ID NO: 1655120 - RNA, 15 nt, Salmonella enterica enterica serovar Typhi
cgacgaaucagcgau

SEQ ID NO: 1655121 - RNA, 20 nt, Salmonella enterica enterica serovar Typhi
cgaccuggcgcucaaucaga

SEQ ID NO: 1655122 - RNA, 19 nt, Salmonella enterica enterica serovar Typhi
cgaccuggcggucggcuuu

SEQ ID NO: 1655123 - RNA, 19 nt, Salmonella enterica enterica serovar Typhi
cgacgcgcacccggcaacg

SEQ ID NO: 1655124 - RNA, 14 nt, Salmonella enterica enterica serovar Typhi
cgacgccagcgggu

SEQ ID NO: 1655125 - RNA, 16 nt, Salmonella enterica enterica serovar Typhi
cgacgccgauaaagcc

SEQ ID NO: 1655126 - RNA, 18 nt, Salmonella enterica enterica serovar Typhi
cgacgcccaaccaguggc

SEQ ID NO: 1655127 - RNA, 13 nt, Salmonella enterica enterica serovar Typhi
cgacgccaggcgg

SEQ ID NO: 1655128 - RNA, 13 nt, Salmonella enterica enterica serovar Typhi
cgaccgccagcag

SEQ ID NO: 1655129 - RNA, 16 nt, Salmonella enterica enterica serovar Typhi
cgaccggucagccggu

SEQ ID NO: 1655130 - RNA, 11 nt, Salmonella enterica enterica serovar Typhi
cgaccggcagc

SEQ ID NO: 1655131 - RNA, 21 nt, Salmonella enterica enterica serovar Typhi
cgacaugcagaucgcgggcaa

SEQ ID NO: 1655132 - RNA, 14 nt, Salmonella enterica enterica serovar Typhi
cgaccgacgcguuu

SEQ ID NO: 1655133 - RNA, 13 nt, Salmonella enterica enterica serovar Typhi
cgagaucaggccg

SEQ ID NO: 1655134 - RNA, 13 nt, Salmonella enterica enterica serovar Typhi
cgagauaaccggg

SEQ ID NO: 1655135 - RNA, 11 nt, Salmonella enterica enterica serovar Typhi
cgagcagccaa

SEQ ID NO: 1655136 - RNA, 12 nt, Salmonella enterica enterica serovar Typhi
cgagcgccugau

SEQ ID NO: 1655137 - RNA, 22 nt, Salmonella enterica enterica serovar Typhi
cgagcgccguuaaacugcgcga

SEQ ID NO: 1655138 - RNA, 24 nt, Salmonella enterica enterica serovar Typhi
cgacuuuccgccaccagauaguca

SEQ ID NO: 1655139 - RNA, 18 nt, Salmonella enterica enterica serovar Typhi
cgacuuucuucggauuau

SEQ ID NO: 1655140 - RNA, 14 nt, Salmonella enterica enterica serovar Typhi
cgagaaagcguugc

SEQ ID NO: 1655141 - RNA, 18 nt, Salmonella enterica enterica serovar Typhi
cgagaaaauaccgcacau

SEQ ID NO: 1655142 - RNA, 16 nt, Salmonella enterica enterica serovar Typhi
cgagaagcccagcuca

SEQ ID NO: 1655143 - RNA, 15 nt, Salmonella enterica enterica serovar Typhi
cgagaaacaccagaa

SEQ ID NO: 1655144 - RNA, 21 nt, Salmonella enterica enterica serovar Typhi
cgacuauuccgcaaacgccgu

SEQ ID NO: 1655145 - RNA, 18 nt, Salmonella enterica enterica serovar Typhi
cgacuaccgccgauaaac

SEQ ID NO: 1655146 - RNA, 14 nt, Salmonella enterica enterica serovar Typhi
cgacuacgguaaac

SEQ ID NO: 1655147 - RNA, 14 nt, Salmonella enterica enterica serovar Typhi
cgacucauucagca

SEQ ID NO: 1655148 - RNA, 21 nt, Salmonella enterica enterica serovar Typhi
cgacgggauuaaaugacgccc

SEQ ID NO: 1655149 - RNA, 13 nt, Salmonella enterica enterica serovar Typhi
ccugccugacgcc

SEQ ID NO: 1655150 - RNA, 21 nt, Salmonella enterica enterica serovar Typhi
ccugccgggguaucauaaaag

SEQ ID NO: 1655151 - RNA, 17 nt, Salmonella enterica enterica serovar Typhi
ccugccgcgaucgcggc

SEQ ID NO: 1655152 - RNA, 14 nt, Salmonella enterica enterica serovar Typhi
ccuggcuucaaccu

SEQ ID NO: 1655153 - RNA, 16 nt, Salmonella enterica enterica serovar Typhi
ccuguagcagcgccag

SEQ ID NO: 1655154 - RNA, 18 nt, Salmonella enterica enterica serovar Typhi
ccuguaaaaaauccagcg

SEQ ID NO: 1655155 - RNA, 12 nt, Salmonella enterica enterica serovar Typhi
ccugguuaccgc

SEQ ID NO: 1655156 - RNA, 13 nt, Salmonella enterica enterica serovar Typhi
ccuggucgauaau

SEQ ID NO: 1655157 - RNA, 22 nt, Salmonella enterica enterica serovar Typhi
ccuggguauuuuuuagcgccaa

SEQ ID NO: 1655158 - RNA, 15 nt, Salmonella enterica enterica serovar Typhi
ccugguaagcgcaau

SEQ ID NO: 1655159 - RNA, 15 nt, Salmonella enterica enterica serovar Typhi
ccugggaaucgugca

SEQ ID NO: 1655160 - RNA, 23 nt, Salmonella enterica enterica serovar Typhi
cgaaaggaagcgggccaguauua

SEQ ID NO: 1655161 - RNA, 16 nt, Salmonella enterica enterica serovar Typhi
cgaaagucaucugcca

SEQ ID NO: 1655162 - RNA, 11 nt, Salmonella enterica enterica serovar Typhi
cgaaauagcgu

SEQ ID NO: 1655163 - RNA, 18 nt, Salmonella enterica enterica serovar Typhi
cgaaacaaucaccugaug

SEQ ID NO: 1655164 - RNA, 14 nt, Salmonella enterica enterica serovar Typhi
cgaaaccacagcgg

SEQ ID NO: 1655165 - RNA, 19 nt, Salmonella enterica enterica serovar Typhi
cgaaacaggucggcaugca

SEQ ID NO: 1655166 - RNA, 13 nt, Salmonella enterica enterica serovar Typhi
cgaaacggcagcg

SEQ ID NO: 1655167 - RNA, 13 nt, Salmonella enterica enterica serovar Typhi
ccuuuaucgcgca

SEQ ID NO: 1655168 - RNA, 22 nt, Salmonella enterica enterica serovar Typhi
ccuuugaaaaucacaucgccgg

SEQ ID NO: 1655169 - RNA, 17 nt, Salmonella enterica enterica serovar Typhi
ccugucaguacgucgca

SEQ ID NO: 1655170 - RNA, 18 nt, Salmonella enterica enterica serovar Typhi
ccugucaggcgagcgccu

SEQ ID NO: 1655171 - RNA, 15 nt, Salmonella enterica enterica serovar Typhi
ccuguaucgcuaucc

SEQ ID NO: 1655172 - RNA, 16 nt, Salmonella enterica enterica serovar Typhi
ccuucacgaucgagcc

SEQ ID NO: 1655173 - RNA, 17 nt, Salmonella enterica enterica serovar Typhi
ccuucgaugagcgcgaa

SEQ ID NO: 1655174 - RNA, 18 nt, Salmonella enterica enterica serovar Typhi
ccuucguuauaaggccug

SEQ ID NO: 1655175 - RNA, 22 nt, Salmonella enterica enterica serovar Typhi
cgacacagcguuuaacugaaca

SEQ ID NO: 1655176 - RNA, 21 nt, Salmonella enterica enterica serovar Typhi
cgacacauccugcgggaugcg

SEQ ID NO: 1655177 - RNA, 18 nt, Salmonella enterica enterica serovar Typhi
cgacacauuucagcgcag

SEQ ID NO: 1655178 - RNA, 17 nt, Salmonella enterica enterica serovar Typhi
cgacaauuucaccuuug

SEQ ID NO: 1655179 - RNA, 15 nt, Salmonella enterica enterica serovar Typhi
cgacaauguccgcca

SEQ ID NO: 1655180 - RNA, 16 nt, Salmonella enterica enterica serovar Typhi
cgacaaucucaccggc

SEQ ID NO: 1655181 - RNA, 15 nt, Salmonella enterica enterica serovar Typhi
cgacaaugaucagac

SEQ ID NO: 1655182 - RNA, 19 nt, Salmonella enterica enterica serovar Typhi
cgacaauauucgccgcgau

SEQ ID NO: 1655183 - RNA, 21 nt, Salmonella enterica enterica serovar Typhi
cgacaggguuugccagcacca

SEQ ID NO: 1655184 - RNA, 21 nt, Salmonella enterica enterica serovar Typhi
cgacagccagcauuuccagcu

SEQ ID NO: 1655185 - RNA, 16 nt, Salmonella enterica enterica serovar Typhi
cgacaggcugccgaca

SEQ ID NO: 1655186 - RNA, 13 nt, Salmonella enterica enterica serovar Typhi
cgacaucacgcaa

SEQ ID NO: 1655187 - RNA, 19 nt, Salmonella enterica enterica serovar Typhi
cgacaucagccagccgcca

SEQ ID NO: 1655188 - RNA, 16 nt, Salmonella enterica enterica serovar Typhi
cgaaucacauccgcca

SEQ ID NO: 1655189 - RNA, 18 nt, Salmonella enterica enterica serovar Typhi
cgaauagugauaccaguc

SEQ ID NO: 1655190 - RNA, 19 nt, Salmonella enterica enterica serovar Typhi
cgaaucagcgauugcgcca

SEQ ID NO: 1655191 - RNA, 22 nt, Salmonella enterica enterica serovar Typhi
cgaauagcgcgcuaaacgugac

SEQ ID NO: 1655192 - RNA, 13 nt, Salmonella enterica enterica serovar Typhi
cgaauagcgccag

SEQ ID NO: 1655193 - RNA, 19 nt, Salmonella enterica enterica serovar Typhi
cgaauaccgugcacgcugc

SEQ ID NO: 1655194 - RNA, 22 nt, Salmonella enterica enterica serovar Typhi
cgaauaccgugcacgcugcgca

SEQ ID NO: 1655195 - RNA, 22 nt, Salmonella enterica enterica serovar Typhi
cgaaggcuuuugcuacgucgcc

SEQ ID NO: 1655196 - RNA, 15 nt, Salmonella enterica enterica serovar Typhi
cgaauaaaauucagc

SEQ ID NO: 1655197 - RNA, 14 nt, Salmonella enterica enterica serovar Typhi
cgaauaaaacugcc

SEQ ID NO: 1655198 - RNA, 17 nt, Salmonella enterica enterica serovar Typhi
cgaauuugccccagaua

SEQ ID NO: 1655199 - RNA, 21 nt, Salmonella enterica enterica serovar Typhi
cgaauuucggcaaugacggua

SEQ ID NO: 1655200 - RNA, 19 nt, Salmonella enterica enterica serovar Typhi
cgacaaaaagcgcgccgaa

SEQ ID NO: 1655201 - RNA, 13 nt, Salmonella enterica enterica serovar Typhi
cgacaaacagcgc

SEQ ID NO: 1655202 - RNA, 14 nt, Salmonella enterica enterica serovar Typhi
cgacaacaagucca

SEQ ID NO: 1655203 - RNA, 12 nt, Salmonella enterica enterica serovar Typhi
cgaauuccgccu

SEQ ID NO: 1655204 - RNA, 15 nt, Salmonella enterica enterica serovar Typhi
cgaaugucauccgga

SEQ ID NO: 1655205 - RNA, 18 nt, Salmonella enterica enterica serovar Typhi
cgaaauuggccaucaggu

SEQ ID NO: 1655206 - RNA, 14 nt, Salmonella enterica enterica serovar Typhi
cgaaaucguccguu

SEQ ID NO: 1655207 - RNA, 15 nt, Salmonella enterica enterica serovar Typhi
cgaacucuuccacca

SEQ ID NO: 1655208 - RNA, 22 nt, Salmonella enterica enterica serovar Typhi
cgaacguuuuuucgcacgccuc

SEQ ID NO: 1655209 - RNA, 20 nt, Salmonella enterica enterica serovar Typhi
cgaaggauaauccgguguuu

SEQ ID NO: 1655210 - RNA, 17 nt, Salmonella enterica enterica serovar Typhi
cgaaggcaucuucagac

SEQ ID NO: 1655211 - RNA, 17 nt, Salmonella enterica enterica serovar Typhi
cgaagcgaauagcguau

SEQ ID NO: 1655212 - RNA, 19 nt, Salmonella enterica enterica serovar Typhi
cgaagcggcaguugaacuc

SEQ ID NO: 1655213 - RNA, 13 nt, Salmonella enterica enterica serovar Typhi
cgaacugauggcg

SEQ ID NO: 1655214 - RNA, 21 nt, Salmonella enterica enterica serovar Typhi
cgaagaacauaaacagcguga

SEQ ID NO: 1655215 - RNA, 13 nt, Salmonella enterica enterica serovar Typhi
cgaacugaauagu

SEQ ID NO: 1655216 - RNA, 22 nt, Salmonella enterica enterica serovar Typhi
cgaagaccgcaucacggcagca

SEQ ID NO: 1655217 - RNA, 23 nt, Salmonella enterica enterica serovar Typhi
cgaagcccaugauggugaacaga

SEQ ID NO: 1655218 - RNA, 23 nt, Salmonella enterica enterica serovar Typhi
ccgcgauagguugaauaaccaua

SEQ ID NO: 1655219 - RNA, 19 nt, Salmonella enterica enterica serovar Typhi
ccgcgauagaccacgccau

SEQ ID NO: 1655220 - RNA, 16 nt, Salmonella enterica enterica serovar Typhi
ccgcgaccacgcauac

SEQ ID NO: 1655221 - RNA, 18 nt, Salmonella enterica enterica serovar Typhi
ccgcgcagugcagcggau

SEQ ID NO: 1655222 - RNA, 15 nt, Salmonella enterica enterica serovar Typhi
ccgcgcauggccaua

SEQ ID NO: 1655223 - RNA, 14 nt, Salmonella enterica enterica serovar Typhi
ccgcgcauguaacc

SEQ ID NO: 1655224 - RNA, 21 nt, Salmonella enterica enterica serovar Typhi
ccgcgauguuugcucgccaua

SEQ ID NO: 1655225 - RNA, 18 nt, Salmonella enterica enterica serovar Typhi
ccgccugcgguaaucgcc

SEQ ID NO: 1655226 - RNA, 17 nt, Salmonella enterica enterica serovar Typhi
ccgccuuugacgccggg

SEQ ID NO: 1655227 - RNA, 19 nt, Salmonella enterica enterica serovar Typhi
ccgccuagcgucccggcaa

SEQ ID NO: 1655228 - RNA, 13 nt, Salmonella enterica enterica serovar Typhi
ccgcccugacgcc

SEQ ID NO: 1655229 - RNA, 18 nt, Salmonella enterica enterica serovar Typhi
ccgcccguccgcuaaucu

SEQ ID NO: 1655230 - RNA, 13 nt, Salmonella enterica enterica serovar Typhi
ccgcccguuuccg

SEQ ID NO: 1655231 - RNA, 12 nt, Salmonella enterica enterica serovar Typhi
ccgccauccggc

SEQ ID NO: 1655232 - RNA, 23 nt, Salmonella enterica enterica serovar Typhi
ccgccaucaguaaaggaugccac

SEQ ID NO: 1655233 - RNA, 14 nt, Salmonella enterica enterica serovar Typhi
ccgccauccggcaa

SEQ ID NO: 1655234 - RNA, 13 nt, Salmonella enterica enterica serovar Typhi
ccgccgcaaaagc

SEQ ID NO: 1655235 - RNA, 14 nt, Salmonella enterica enterica serovar Typhi
ccgccggcagcagc

SEQ ID NO: 1655236 - RNA, 12 nt, Salmonella enterica enterica serovar Typhi
ccgccggcagca

SEQ ID NO: 1655237 - RNA, 15 nt, Salmonella enterica enterica serovar Typhi
ccgcguagcguuauc

SEQ ID NO: 1655238 - RNA, 18 nt, Salmonella enterica enterica serovar Typhi
ccgcgucacgaccggcga

SEQ ID NO: 1655239 - RNA, 16 nt, Salmonella enterica enterica serovar Typhi
ccgcugcuucacggaa

SEQ ID NO: 1655240 - RNA, 15 nt, Salmonella enterica enterica serovar Typhi
ccgcucucuucguga

SEQ ID NO: 1655241 - RNA, 23 nt, Salmonella enterica enterica serovar Typhi
ccgcugaaccugauuauucagua

SEQ ID NO: 1655242 - RNA, 13 nt, Salmonella enterica enterica serovar Typhi
ccgcguuuaucgc

SEQ ID NO: 1655243 - RNA, 17 nt, Salmonella enterica enterica serovar Typhi
ccgcuccgggccgauac

SEQ ID NO: 1655244 - RNA, 19 nt, Salmonella enterica enterica serovar Typhi
ccgcgccuucgcggugauc

SEQ ID NO: 1655245 - RNA, 16 nt, Salmonella enterica enterica serovar Typhi
ccgcgcgcgcggcauc

SEQ ID NO: 1655246 - RNA, 15 nt, Salmonella enterica enterica serovar Typhi
ccgcggauagacgau

SEQ ID NO: 1655247 - RNA, 17 nt, Salmonella enterica enterica serovar Typhi
ccgcgcucuccggcaca

SEQ ID NO: 1655248 - RNA, 20 nt, Salmonella enterica enterica serovar Typhi
ccgcgcucauacgaucgcgc

SEQ ID NO: 1655249 - RNA, 14 nt, Salmonella enterica enterica serovar Typhi
ccgacgcucaaccg

SEQ ID NO: 1655250 - RNA, 22 nt, Salmonella enterica enterica serovar Typhi
ccgacaagguauaucaacccgc

SEQ ID NO: 1655251 - RNA, 14 nt, Salmonella enterica enterica serovar Typhi
ccgacgcacgugua

SEQ ID NO: 1655252 - RNA, 21 nt, Salmonella enterica enterica serovar Typhi
ccgacgccuguucgagguuca

SEQ ID NO: 1655253 - RNA, 17 nt, Salmonella enterica enterica serovar Typhi
ccgacucacgcagcgcu

SEQ ID NO: 1655254 - RNA, 15 nt, Salmonella enterica enterica serovar Typhi
ccgauaagcgcugua

SEQ ID NO: 1655255 - RNA, 13 nt, Salmonella enterica enterica serovar Typhi
ccgauaaaccagg

SEQ ID NO: 1655256 - RNA, 19 nt, Salmonella enterica enterica serovar Typhi
ccgagucgaucgucgggau

SEQ ID NO: 1655257 - RNA, 16 nt, Salmonella enterica enterica serovar Typhi
ccgaguuccggauacu

SEQ ID NO: 1655258 - RNA, 14 nt, Salmonella enterica enterica serovar Typhi
ccgaguagcugagc

SEQ ID NO: 1655259 - RNA, 19 nt, Salmonella enterica enterica serovar Typhi
ccgaggcuuaauacggcaa

SEQ ID NO: 1655260 - RNA, 11 nt, Salmonella enterica enterica serovar Typhi
ccgagcgcugg

SEQ ID NO: 1655261 - RNA, 22 nt, Salmonella enterica enterica serovar Typhi
ccgagcauccgcgcaauaugcg

SEQ ID NO: 1655262 - RNA, 14 nt, Salmonella enterica enterica serovar Typhi
ccgagcauccgcgc

SEQ ID NO: 1655263 - RNA, 17 nt, Salmonella enterica enterica serovar Typhi
ccgcaggacagcgacau

SEQ ID NO: 1655264 - RNA, 18 nt, Salmonella enterica enterica serovar Typhi
ccgcagugaagaauggcg

SEQ ID NO: 1655265 - RNA, 17 nt, Salmonella enterica enterica serovar Typhi
ccgcaucacccgcauau

SEQ ID NO: 1655266 - RNA, 13 nt, Salmonella enterica enterica serovar Typhi
ccgcauccccaua

SEQ ID NO: 1655267 - RNA, 18 nt, Salmonella enterica enterica serovar Typhi
ccgcauauauugcgcuuc

SEQ ID NO: 1655268 - RNA, 13 nt, Salmonella enterica enterica serovar Typhi
ccgcaucgccaua

SEQ ID NO: 1655269 - RNA, 14 nt, Salmonella enterica enterica serovar Typhi
ccgcaucgaccaua

SEQ ID NO: 1655270 - RNA, 19 nt, Salmonella enterica enterica serovar Typhi
ccgccagcaccagcagcgc

SEQ ID NO: 1655271 - RNA, 23 nt, Salmonella enterica enterica serovar Typhi
ccgccagccccaccguccacauc

SEQ ID NO: 1655272 - RNA, 17 nt, Salmonella enterica enterica serovar Typhi
ccgccaucaacgaccau

SEQ ID NO: 1655273 - RNA, 13 nt, Salmonella enterica enterica serovar Typhi
ccgcauuuucagc

SEQ ID NO: 1655274 - RNA, 18 nt, Salmonella enterica enterica serovar Typhi
ccgcauugguuucgccua

SEQ ID NO: 1655275 - RNA, 16 nt, Salmonella enterica enterica serovar Typhi
ccgcauucuugccgca

SEQ ID NO: 1655276 - RNA, 14 nt, Salmonella enterica enterica serovar Typhi
ccgcacagaaucgc

SEQ ID NO: 1655277 - RNA, 23 nt, Salmonella enterica enterica serovar Typhi
ccgcacaggcgacgaaccgcgua

SEQ ID NO: 1655278 - RNA, 13 nt, Salmonella enterica enterica serovar Typhi
ccgcacagcacau

SEQ ID NO: 1655279 - RNA, 23 nt, Salmonella enterica enterica serovar Typhi
ccgaucaucguaccaauacccag

SEQ ID NO: 1655280 - RNA, 17 nt, Salmonella enterica enterica serovar Typhi
ccgaucaggccgcagac

SEQ ID NO: 1655281 - RNA, 22 nt, Salmonella enterica enterica serovar Typhi
ccgaucacggcgaaucgccugu

SEQ ID NO: 1655282 - RNA, 19 nt, Salmonella enterica enterica serovar Typhi
ccgauagcgccgcgcuauc

SEQ ID NO: 1655283 - RNA, 20 nt, Salmonella enterica enterica serovar Typhi
ccgauagcuaucacacauau

SEQ ID NO: 1655284 - RNA, 22 nt, Salmonella enterica enterica serovar Typhi
ccgauagcugaagugcggauag

SEQ ID NO: 1655285 - RNA, 22 nt, Salmonella enterica enterica serovar Typhi
ccgauagagacugccgccguca

SEQ ID NO: 1655286 - RNA, 17 nt, Salmonella enterica enterica serovar Typhi
ccgauagcggcgcagac

SEQ ID NO: 1655287 - RNA, 21 nt, Salmonella enterica enterica serovar Typhi
ccgauaguguaaacgcgccau

SEQ ID NO: 1655288 - RNA, 21 nt, Salmonella enterica enterica serovar Typhi
ccgauauauugccggccugau

SEQ ID NO: 1655289 - RNA, 18 nt, Salmonella enterica enterica serovar Typhi
ccugaacgccuaccgcuu

SEQ ID NO: 1655290 - RNA, 12 nt, Salmonella enterica enterica serovar Typhi
ccugaaacgcgg

SEQ ID NO: 1655291 - RNA, 20 nt, Salmonella enterica enterica serovar Typhi
ccugaaaggucgcgauccgc

SEQ ID NO: 1655292 - RNA, 16 nt, Salmonella enterica enterica serovar Typhi
ccugaaccagcgccgu

SEQ ID NO: 1655293 - RNA, 14 nt, Salmonella enterica enterica serovar Typhi
ccucuuucgccauu

SEQ ID NO: 1655294 - RNA, 20 nt, Salmonella enterica enterica serovar Typhi
ccucuuauccggcugccguu

SEQ ID NO: 1655295 - RNA, 19 nt, Salmonella enterica enterica serovar Typhi
ccucgcgauccgccagcgu

SEQ ID NO: 1655296 - RNA, 16 nt, Salmonella enterica enterica serovar Typhi
ccucgcgcggcgguuc

SEQ ID NO: 1655297 - RNA, 17 nt, Salmonella enterica enterica serovar Typhi
ccucgcggguggccugc

SEQ ID NO: 1655298 - RNA, 17 nt, Salmonella enterica enterica serovar Typhi
ccugaaugcucucauau

SEQ ID NO: 1655299 - RNA, 18 nt, Salmonella enterica enterica serovar Typhi
ccugaauauuagaguggc

SEQ ID NO: 1655300 - RNA, 22 nt, Salmonella enterica enterica serovar Typhi
ccugacagcgcgcgaauaucgc

SEQ ID NO: 1655301 - RNA, 20 nt, Salmonella enterica enterica serovar Typhi
ccugaccgauauagccacuc

SEQ ID NO: 1655302 - RNA, 19 nt, Salmonella enterica enterica serovar Typhi
ccugauaagcguagcgcca

SEQ ID NO: 1655303 - RNA, 20 nt, Salmonella enterica enterica serovar Typhi
ccugauaagcguagcgccau

SEQ ID NO: 1655304 - RNA, 22 nt, Salmonella enterica enterica serovar Typhi
ccugauaagguaaagccgccau

SEQ ID NO: 1655305 - RNA, 20 nt, Salmonella enterica enterica serovar Typhi
ccugauaagcgaagcgccau

SEQ ID NO: 1655306 - RNA, 20 nt, Salmonella enterica enterica serovar Typhi
ccugauaagcauagcgccau

SEQ ID NO: 1655307 - RNA, 19 nt, Salmonella enterica enterica serovar Typhi
ccugauaagcgcagcgcca

SEQ ID NO: 1655308 - RNA, 19 nt, Salmonella enterica enterica serovar Typhi
ccugauagcacagcgcuau

SEQ ID NO: 1655309 - RNA, 15 nt, Salmonella enterica enterica serovar Typhi
ccugauagcgcugug

SEQ ID NO: 1655310 - RNA, 12 nt, Salmonella enterica enterica serovar Typhi
ccugaucgccaa

SEQ ID NO: 1655311 - RNA, 16 nt, Salmonella enterica enterica serovar Typhi
ccugaugauagcgcca

SEQ ID NO: 1655312 - RNA, 22 nt, Salmonella enterica enterica serovar Typhi
ccugauggcgacguuagcgcau

SEQ ID NO: 1655313 - RNA, 17 nt, Salmonella enterica enterica serovar Typhi
ccugauggcgcgccacu

SEQ ID NO: 1655314 - RNA, 19 nt, Salmonella enterica enterica serovar Typhi
ccugauggcgcuacgccau

SEQ ID NO: 1655315 - RNA, 17 nt, Salmonella enterica enterica serovar Typhi
ccugaugcccauacggc

SEQ ID NO: 1655316 - RNA, 17 nt, Salmonella enterica enterica serovar Typhi
ccugaugauagcgccau

SEQ ID NO: 1655317 - RNA, 20 nt, Salmonella enterica enterica serovar Typhi
ccugaugauggaaaacgcgc

SEQ ID NO: 1655318 - RNA, 24 nt, Salmonella enterica enterica serovar Typhi
ccugaugcgcguuuagcgccagca

SEQ ID NO: 1655319 - RNA, 22 nt, Salmonella enterica enterica serovar Typhi
ccugaugcgcguuuagcgccag

SEQ ID NO: 1655320 - RNA, 21 nt, Salmonella enterica enterica serovar Typhi
ccugccccgcucgaaaccauc

SEQ ID NO: 1655321 - RNA, 14 nt, Salmonella enterica enterica serovar Typhi
ccugcauuauccac

SEQ ID NO: 1655322 - RNA, 14 nt, Salmonella enterica enterica serovar Typhi
ccugcagcgccaga

SEQ ID NO: 1655323 - RNA, 22 nt, Salmonella enterica enterica serovar Typhi
ccugcacuuccagccacggcgu

SEQ ID NO: 1655324 - RNA, 21 nt, Salmonella enterica enterica serovar Typhi
ccugcaaaauaccgcccaucg

SEQ ID NO: 1655325 - RNA, 19 nt, Salmonella enterica enterica serovar Typhi
ccugaugcugcgcauccgc

SEQ ID NO: 1655326 - RNA, 13 nt, Salmonella enterica enterica serovar Typhi
ccuacgcgcaugu

SEQ ID NO: 1655327 - RNA, 14 nt, Salmonella enterica enterica serovar Typhi
ccuaccaucgcgcg

SEQ ID NO: 1655328 - RNA, 16 nt, Salmonella enterica enterica serovar Typhi
ccuacgcgcucacggc

SEQ ID NO: 1655329 - RNA, 13 nt, Salmonella enterica enterica serovar Typhi
ccguucgcgguaa

SEQ ID NO: 1655330 - RNA, 17 nt, Salmonella enterica enterica serovar Typhi
ccguucaucggcauaca

SEQ ID NO: 1655331 - RNA, 14 nt, Salmonella enterica enterica serovar Typhi
ccguuccgccagau

SEQ ID NO: 1655332 - RNA, 23 nt, Salmonella enterica enterica serovar Typhi
ccguuccauuccagaaucuggcc

SEQ ID NO: 1655333 - RNA, 22 nt, Salmonella enterica enterica serovar Typhi
ccuaucaggaucaaaaucgcgc

SEQ ID NO: 1655334 - RNA, 14 nt, Salmonella enterica enterica serovar Typhi
ccuauaaugcgcca

SEQ ID NO: 1655335 - RNA, 20 nt, Salmonella enterica enterica serovar Typhi
ccucauacagcccgcgcaga

SEQ ID NO: 1655336 - RNA, 13 nt, Salmonella enterica enterica serovar Typhi
ccucgcacuggcg

SEQ ID NO: 1655337 - RNA, 19 nt, Salmonella enterica enterica serovar Typhi
ccuccggcgacugaaugcc

SEQ ID NO: 1655338 - RNA, 15 nt, Salmonella enterica enterica serovar Typhi
ccuccguaugaccgc

SEQ ID NO: 1655339 - RNA, 20 nt, Salmonella enterica enterica serovar Typhi
ccuccugccaggcgcuaucu

SEQ ID NO: 1655340 - RNA, 15 nt, Salmonella enterica enterica serovar Typhi
ccuccuggcguuauc

SEQ ID NO: 1655341 - RNA, 23 nt, Salmonella enterica enterica serovar Typhi
ccguuaaauaccagcaccugaau

SEQ ID NO: 1655342 - RNA, 18 nt, Salmonella enterica enterica serovar Typhi
ccguuaaucuggccuacg

SEQ ID NO: 1655343 - RNA, 14 nt, Salmonella enterica enterica serovar Typhi
ccguuauccggcaa

SEQ ID NO: 1655344 - RNA, 21 nt, Salmonella enterica enterica serovar Typhi
ccguuaugaaucgcgugcgcu

SEQ ID NO: 1655345 - RNA, 14 nt, Salmonella enterica enterica serovar Typhi
ccguucacggcgau

SEQ ID NO: 1655346 - RNA, 13 nt, Salmonella enterica enterica serovar Typhi
ccgugaauagagc

SEQ ID NO: 1655347 - RNA, 18 nt, Salmonella enterica enterica serovar Typhi
ccgugaauguccugcggc

SEQ ID NO: 1655348 - RNA, 16 nt, Salmonella enterica enterica serovar Typhi
ccgugaccgcguuauc

SEQ ID NO: 1655349 - RNA, 13 nt, Salmonella enterica enterica serovar Typhi
ccgugaauuccgg

SEQ ID NO: 1655350 - RNA, 16 nt, Salmonella enterica enterica serovar Typhi
ccgugccguguaaggc

SEQ ID NO: 1655351 - RNA, 14 nt, Salmonella enterica enterica serovar Typhi
ccguaauagcaaua

SEQ ID NO: 1655352 - RNA, 22 nt, Salmonella enterica enterica serovar Typhi
ccgguuuuacuauugccgauaa

SEQ ID NO: 1655353 - RNA, 21 nt, Salmonella enterica enterica serovar Typhi
ccgguuugucauucgccucaa

SEQ ID NO: 1655354 - RNA, 14 nt, Salmonella enterica enterica serovar Typhi
ccgguuuauccccg

SEQ ID NO: 1655355 - RNA, 18 nt, Salmonella enterica enterica serovar Typhi
ccguacguauuaucccgc

SEQ ID NO: 1655356 - RNA, 21 nt, Salmonella enterica enterica serovar Typhi
ccguaccagccguagcugcug

SEQ ID NO: 1655357 - RNA, 20 nt, Salmonella enterica enterica serovar Typhi
ccguauguaaacgcauuaau

SEQ ID NO: 1655358 - RNA, 15 nt, Salmonella enterica enterica serovar Typhi
ccguauucaggcgau

SEQ ID NO: 1655359 - RNA, 17 nt, Salmonella enterica enterica serovar Typhi
ccgucaaaaugaucaga

SEQ ID NO: 1655360 - RNA, 18 nt, Salmonella enterica enterica serovar Typhi
ccgucaaugccuggcaga

SEQ ID NO: 1655361 - RNA, 19 nt, Salmonella enterica enterica serovar Typhi
ccgucauucgagucaugaa

SEQ ID NO: 1655362 - RNA, 14 nt, Salmonella enterica enterica serovar Typhi
ccgucaucgacuuc

SEQ ID NO: 1655363 - RNA, 20 nt, Salmonella enterica enterica serovar Typhi
ccgucauccagcagcagagc

SEQ ID NO: 1655364 - RNA, 13 nt, Salmonella enterica enterica serovar Typhi
ccgucauggugau

SEQ ID NO: 1655365 - RNA, 17 nt, Salmonella enterica enterica serovar Typhi
ccggugucaaagcgcca

SEQ ID NO: 1655366 - RNA, 22 nt, Salmonella enterica enterica serovar Typhi
ccgguugcugauaacgugcgcg

SEQ ID NO: 1655367 - RNA, 21 nt, Salmonella enterica enterica serovar Typhi
ccgggcgagauuacugcgugc

SEQ ID NO: 1655368 - RNA, 21 nt, Salmonella enterica enterica serovar Typhi
ccgggcgauaaaccagcccca

SEQ ID NO: 1655369 - RNA, 16 nt, Salmonella enterica enterica serovar Typhi
ccgggccgccgauacu

SEQ ID NO: 1655370 - RNA, 18 nt, Salmonella enterica enterica serovar Typhi
ccgggcuggcaaacaggc

SEQ ID NO: 1655371 - RNA, 15 nt, Salmonella enterica enterica serovar Typhi
ccgggcugcacgcca

SEQ ID NO: 1655372 - RNA, 12 nt, Salmonella enterica enterica serovar Typhi
ccgggcggcgca

SEQ ID NO: 1655373 - RNA, 13 nt, Salmonella enterica enterica serovar Typhi
ccggguaggacau

SEQ ID NO: 1655374 - RNA, 13 nt, Salmonella enterica enterica serovar Typhi
ccggggcgcuggc

SEQ ID NO: 1655375 - RNA, 17 nt, Salmonella enterica enterica serovar Typhi
ccggcguuuuagcgcca

SEQ ID NO: 1655376 - RNA, 12 nt, Salmonella enterica enterica serovar Typhi
ccggcuucagca

SEQ ID NO: 1655377 - RNA, 20 nt, Salmonella enterica enterica serovar Typhi
ccgggaaaagcgguaucacg

SEQ ID NO: 1655378 - RNA, 17 nt, Salmonella enterica enterica serovar Typhi
ccggcuucuccaccaua

SEQ ID NO: 1655379 - RNA, 22 nt, Salmonella enterica enterica serovar Typhi
ccgggaaagcggaucggaacgc

SEQ ID NO: 1655380 - RNA, 18 nt, Salmonella enterica enterica serovar Typhi
ccggcgccgaucaucccg

SEQ ID NO: 1655381 - RNA, 14 nt, Salmonella enterica enterica serovar Typhi
ccggcggccuacca

SEQ ID NO: 1655382 - RNA, 12 nt, Salmonella enterica enterica serovar Typhi
ccggcgugcgcu

SEQ ID NO: 1655383 - RNA, 21 nt, Salmonella enterica enterica serovar Typhi
ccggccuacacguaacccugu

SEQ ID NO: 1655384 - RNA, 11 nt, Salmonella enterica enterica serovar Typhi
ccggccuacgu

SEQ ID NO: 1655385 - RNA, 19 nt, Salmonella enterica enterica serovar Typhi
ccggcgcagcaucugcggc

SEQ ID NO: 1655386 - RNA, 14 nt, Salmonella enterica enterica serovar Typhi
ccggcgcagcgccc

SEQ ID NO: 1655387 - RNA, 14 nt, Salmonella enterica enterica serovar Typhi
ccggcgccagaagc

SEQ ID NO: 1655388 - RNA, 15 nt, Salmonella enterica enterica serovar Typhi
ccggcccccggccau

SEQ ID NO: 1655389 - RNA, 22 nt, Salmonella enterica enterica serovar Typhi
ccggccauagcgugaggucauu

SEQ ID NO: 1655390 - RNA, 19 nt, Salmonella enterica enterica serovar Typhi
ccggcauuucaccgucaau

SEQ ID NO: 1655391 - RNA, 16 nt, Salmonella enterica enterica serovar Typhi
ccggccacagcgccag

SEQ ID NO: 1655392 - RNA, 20 nt, Salmonella enterica enterica serovar Typhi
ccgcuggcggaaauaaacac

SEQ ID NO: 1655393 - RNA, 15 nt, Salmonella enterica enterica serovar Typhi
ccggaagagcgcaga

SEQ ID NO: 1655394 - RNA, 13 nt, Salmonella enterica enterica serovar Typhi
ccggaauacacaa

SEQ ID NO: 1655395 - RNA, 16 nt, Salmonella enterica enterica serovar Typhi
cgcgccuaccagcgcu

SEQ ID NO: 1655396 - RNA, 14 nt, Salmonella enterica enterica serovar Typhi
cgcgccuaccgcca

SEQ ID NO: 1655397 - RNA, 12 nt, Salmonella enterica enterica serovar Typhi
cgcgcggcguuc

SEQ ID NO: 1655398 - RNA, 14 nt, Salmonella enterica enterica serovar Typhi
cgcgcuuaaucgag

SEQ ID NO: 1655399 - RNA, 19 nt, Salmonella enterica enterica serovar Typhi
cgcgcuggaucagauuccc

SEQ ID NO: 1655400 - RNA, 14 nt, Salmonella enterica enterica serovar Typhi
cgcgcugcgccgca

SEQ ID NO: 1655401 - RNA, 19 nt, Salmonella enterica enterica serovar Typhi
cgcgcuuuucgccagcgca

SEQ ID NO: 1655402 - RNA, 13 nt, Salmonella enterica enterica serovar Typhi
cgcgcugccgccc

SEQ ID NO: 1655403 - RNA, 14 nt, Salmonella enterica enterica serovar Typhi
cgcgcgucagcacg

SEQ ID NO: 1655404 - RNA, 16 nt, Salmonella enterica enterica serovar Typhi
cgcgcucgccagcgcu

SEQ ID NO: 1655405 - RNA, 17 nt, Salmonella enterica enterica serovar Typhi
cgcggcaauuuccgcug

SEQ ID NO: 1655406 - RNA, 13 nt, Salmonella enterica enterica serovar Typhi
cgcggcaaugagc

SEQ ID NO: 1655407 - RNA, 23 nt, Salmonella enterica enterica serovar Typhi
cgcggaccguguucaugcagcca

SEQ ID NO: 1655408 - RNA, 13 nt, Salmonella enterica enterica serovar Typhi
cgcggcaucaggc

SEQ ID NO: 1655409 - RNA, 20 nt, Salmonella enterica enterica serovar Typhi
cgcggcgaaccggcaucggc

SEQ ID NO: 1655410 - RNA, 21 nt, Salmonella enterica enterica serovar Typhi
cgcggcgaaauaggccgcgau

SEQ ID NO: 1655411 - RNA, 16 nt, Salmonella enterica enterica serovar Typhi
cgcggcgaaccggcau

SEQ ID NO: 1655412 - RNA, 21 nt, Salmonella enterica enterica serovar Typhi
cgcggccagcaucguaccgug

SEQ ID NO: 1655413 - RNA, 14 nt, Salmonella enterica enterica serovar Typhi
cgcggccugcgugc

SEQ ID NO: 1655414 - RNA, 23 nt, Salmonella enterica enterica serovar Typhi
cgcgcaggucuucgucagcgcau

SEQ ID NO: 1655415 - RNA, 13 nt, Salmonella enterica enterica serovar Typhi
cgcgcaggcggaa

SEQ ID NO: 1655416 - RNA, 12 nt, Salmonella enterica enterica serovar Typhi
cgcgcauccggg

SEQ ID NO: 1655417 - RNA, 15 nt, Salmonella enterica enterica serovar Typhi
cgcgcaguuuuuauc

SEQ ID NO: 1655418 - RNA, 19 nt, Salmonella enterica enterica serovar Typhi
cgcgcauagcuggcguagc

SEQ ID NO: 1655419 - RNA, 20 nt, Salmonella enterica enterica serovar Typhi
cgcgcagcaucugauagccc

SEQ ID NO: 1655420 - RNA, 20 nt, Salmonella enterica enterica serovar Typhi
cgcgcagcgauauagcgcau

SEQ ID NO: 1655421 - RNA, 18 nt, Salmonella enterica enterica serovar Typhi
cgcgcagaaucagcgugc

SEQ ID NO: 1655422 - RNA, 21 nt, Salmonella enterica enterica serovar Typhi
cgcgcagaaucacuucauccg

SEQ ID NO: 1655423 - RNA, 21 nt, Salmonella enterica enterica serovar Typhi
cgcgcagagauagccagcgau

SEQ ID NO: 1655424 - RNA, 19 nt, Salmonella enterica enterica serovar Typhi
cgcgcacagggugaaauca

SEQ ID NO: 1655425 - RNA, 18 nt, Salmonella enterica enterica serovar Typhi
cgcgccaaaguuaaucag

SEQ ID NO: 1655426 - RNA, 16 nt, Salmonella enterica enterica serovar Typhi
cgcgccaaaccguuca

SEQ ID NO: 1655427 - RNA, 19 nt, Salmonella enterica enterica serovar Typhi
cgcgccaaaagaggcagca

SEQ ID NO: 1655428 - RNA, 18 nt, Salmonella enterica enterica serovar Typhi
cgcgcauggcagggcgau

SEQ ID NO: 1655429 - RNA, 12 nt, Salmonella enterica enterica serovar Typhi
cgcgccacgcau

SEQ ID NO: 1655430 - RNA, 13 nt, Salmonella enterica enterica serovar Typhi
cgcgccacgcaug

SEQ ID NO: 1655431 - RNA, 14 nt, Salmonella enterica enterica serovar Typhi
cgcgccacgucgga

SEQ ID NO: 1655432 - RNA, 17 nt, Salmonella enterica enterica serovar Typhi
cgcgccacgucggauaa

SEQ ID NO: 1655433 - RNA, 22 nt, Salmonella enterica enterica serovar Typhi
cgcgccaccaucgucgccagac

SEQ ID NO: 1655434 - RNA, 13 nt, Salmonella enterica enterica serovar Typhi
cgcgccagggcgc

SEQ ID NO: 1655435 - RNA, 21 nt, Salmonella enterica enterica serovar Typhi
cgcgccauccggcauuaccgc

SEQ ID NO: 1655436 - RNA, 12 nt, Salmonella enterica enterica serovar Typhi
cgcgccagccaa

SEQ ID NO: 1655437 - RNA, 12 nt, Salmonella enterica enterica serovar Typhi
cgcgccagcgac

SEQ ID NO: 1655438 - RNA, 15 nt, Salmonella enterica enterica serovar Typhi
cgcgccagcaggucg

SEQ ID NO: 1655439 - RNA, 21 nt, Salmonella enterica enterica serovar Typhi
cgcgccagcggauugccauac

SEQ ID NO: 1655440 - RNA, 13 nt, Salmonella enterica enterica serovar Typhi
cgcgccagcgucg

SEQ ID NO: 1655441 - RNA, 12 nt, Salmonella enterica enterica serovar Typhi
cgcgccagcgau

SEQ ID NO: 1655442 - RNA, 13 nt, Salmonella enterica enterica serovar Typhi
cgcgccagcggau

SEQ ID NO: 1655443 - RNA, 16 nt, Salmonella enterica enterica serovar Typhi
cgcgccgccaacgcca

SEQ ID NO: 1655444 - RNA, 17 nt, Salmonella enterica enterica serovar Typhi
cgcgccgccaauaucca

SEQ ID NO: 1655445 - RNA, 23 nt, Salmonella enterica enterica serovar Typhi
cgcgccggaugacggcagcgcgu

SEQ ID NO: 1655446 - RNA, 14 nt, Salmonella enterica enterica serovar Typhi
cgcguagcuggccu

SEQ ID NO: 1655447 - RNA, 12 nt, Salmonella enterica enterica serovar Typhi
cgcguagcagca

SEQ ID NO: 1655448 - RNA, 19 nt, Salmonella enterica enterica serovar Typhi
cgcguagcccagcgccgca

SEQ ID NO: 1655449 - RNA, 17 nt, Salmonella enterica enterica serovar Typhi
cgcguaccucagcaugu

SEQ ID NO: 1655450 - RNA, 17 nt, Salmonella enterica enterica serovar Typhi
cgcguacccggcuuaca

SEQ ID NO: 1655451 - RNA, 13 nt, Salmonella enterica enterica serovar Typhi
cgcguaauuugcg

SEQ ID NO: 1655452 - RNA, 14 nt, Salmonella enterica enterica serovar Typhi
cgcguaaauccaca

SEQ ID NO: 1655453 - RNA, 17 nt, Salmonella enterica enterica serovar Typhi
cgcguaagcuuaauggc

SEQ ID NO: 1655454 - RNA, 19 nt, Salmonella enterica enterica serovar Typhi
cgcgguuuauccccgcugg

SEQ ID NO: 1655455 - RNA, 13 nt, Salmonella enterica enterica serovar Typhi
cgcguaacagcgg

SEQ ID NO: 1655456 - RNA, 21 nt, Salmonella enterica enterica serovar Typhi
cgcguaaccccugcccgcgau

SEQ ID NO: 1655457 - RNA, 17 nt, Salmonella enterica enterica serovar Typhi
cgcguacagcgccauga

SEQ ID NO: 1655458 - RNA, 16 nt, Salmonella enterica enterica serovar Typhi
cgcggucgucaucggc

SEQ ID NO: 1655459 - RNA, 22 nt, Salmonella enterica enterica serovar Typhi
cgcggugaaggcaaaacaccau

SEQ ID NO: 1655460 - RNA, 22 nt, Salmonella enterica enterica serovar Typhi
cgcggugaucccaggccggcau

SEQ ID NO: 1655461 - RNA, 18 nt, Salmonella enterica enterica serovar Typhi
cgcgguuucguggcgcug

SEQ ID NO: 1655462 - RNA, 16 nt, Salmonella enterica enterica serovar Typhi
cgcgguuuacuucuuc

SEQ ID NO: 1655463 - RNA, 16 nt, Salmonella enterica enterica serovar Typhi
cgcggucggcaggcgg

SEQ ID NO: 1655464 - RNA, 14 nt, Salmonella enterica enterica serovar Typhi
cgcgggcuggccgg

SEQ ID NO: 1655465 - RNA, 22 nt, Salmonella enterica enterica serovar Typhi
cgcggcgcgucuucccggcgcu

SEQ ID NO: 1655466 - RNA, 17 nt, Salmonella enterica enterica serovar Typhi
cgcgucagggcgauaau

SEQ ID NO: 1655467 - RNA, 14 nt, Salmonella enterica enterica serovar Typhi
cgcgucagggcgau

SEQ ID NO: 1655468 - RNA, 23 nt, Salmonella enterica enterica serovar Typhi
cgcguccaacuggcuuucaucca

SEQ ID NO: 1655469 - RNA, 12 nt, Salmonella enterica enterica serovar Typhi
cgcgucgccauc

SEQ ID NO: 1655470 - RNA, 15 nt, Salmonella enterica enterica serovar Typhi
cgcgucgcauccggc

SEQ ID NO: 1655471 - RNA, 20 nt, Salmonella enterica enterica serovar Typhi
cgcgucugaguuaaugccau

SEQ ID NO: 1655472 - RNA, 22 nt, Salmonella enterica enterica serovar Typhi
cgcgugaauugcgguuuauccc

SEQ ID NO: 1655473 - RNA, 21 nt, Salmonella enterica enterica serovar Typhi
cgcgucggccggcaccagcca

SEQ ID NO: 1655474 - RNA, 15 nt, Salmonella enterica enterica serovar Typhi
cgcguugccaucggc

SEQ ID NO: 1655475 - RNA, 15 nt, Salmonella enterica enterica serovar Typhi
cgcguucagcgccug

SEQ ID NO: 1655476 - RNA, 14 nt, Salmonella enterica enterica serovar Typhi
cgcguugccgccga

SEQ ID NO: 1655477 - RNA, 15 nt, Salmonella enterica enterica serovar Typhi
cgcguuggcggcuuu

SEQ ID NO: 1655478 - RNA, 14 nt, Salmonella enterica enterica serovar Typhi
cgcguuuagcgcca

SEQ ID NO: 1655479 - RNA, 23 nt, Salmonella enterica enterica serovar Typhi
cgcguuaauauccuucagcguuu

SEQ ID NO: 1655480 - RNA, 22 nt, Salmonella enterica enterica serovar Typhi
cgcuggcaauaaagcagggcgg

SEQ ID NO: 1655481 - RNA, 22 nt, Salmonella enterica enterica serovar Typhi
cgcugcuggcagcgcugaaucg

SEQ ID NO: 1655482 - RNA, 14 nt, Salmonella enterica enterica serovar Typhi
cgcugcuucacgga

SEQ ID NO: 1655483 - RNA, 16 nt, Salmonella enterica enterica serovar Typhi
cgcugcgucaggcgau

SEQ ID NO: 1655484 - RNA, 20 nt, Salmonella enterica enterica serovar Typhi
cgcugcugaccuuaauccag

SEQ ID NO: 1655485 - RNA, 20 nt, Salmonella enterica enterica serovar Typhi
cgcugcgcucaucaggccug

SEQ ID NO: 1655486 - RNA, 15 nt, Salmonella enterica enterica serovar Typhi
cgcugcgcggcgugc

SEQ ID NO: 1655487 - RNA, 16 nt, Salmonella enterica enterica serovar Typhi
cgcugcgcuuauccgg

SEQ ID NO: 1655488 - RNA, 19 nt, Salmonella enterica enterica serovar Typhi
cgcugcgcuuauccggccu

SEQ ID NO: 1655489 - RNA, 18 nt, Salmonella enterica enterica serovar Typhi
cgcugccgucaaugccug

SEQ ID NO: 1655490 - RNA, 12 nt, Salmonella enterica enterica serovar Typhi
cgcugaucgccg

SEQ ID NO: 1655491 - RNA, 16 nt, Salmonella enterica enterica serovar Typhi
cgcugaucgccacgcc

SEQ ID NO: 1655492 - RNA, 18 nt, Salmonella enterica enterica serovar Typhi
cgcucggugacggaaacc

SEQ ID NO: 1655493 - RNA, 20 nt, Salmonella enterica enterica serovar Typhi
cgcucgccagcauacgucug

SEQ ID NO: 1655494 - RNA, 14 nt, Salmonella enterica enterica serovar Typhi
cgcucgccagcccg

SEQ ID NO: 1655495 - RNA, 15 nt, Salmonella enterica enterica serovar Typhi
cgcucugcuguuccu

SEQ ID NO: 1655496 - RNA, 16 nt, Salmonella enterica enterica serovar Typhi
cgcugacggcggcaga

SEQ ID NO: 1655497 - RNA, 14 nt, Salmonella enterica enterica serovar Typhi
cgcugacggcggca

SEQ ID NO: 1655498 - RNA, 21 nt, Salmonella enterica enterica serovar Typhi
cgcugaccuuuuucauccuca

SEQ ID NO: 1655499 - RNA, 19 nt, Salmonella enterica enterica serovar Typhi
cgcugaguacgcaccagcc

SEQ ID NO: 1655500 - RNA, 21 nt, Salmonella enterica enterica serovar Typhi
cgcugaguuucucccgccaga

SEQ ID NO: 1655501 - RNA, 23 nt, Salmonella enterica enterica serovar Typhi
cgcugaguuucucccgccagaug

SEQ ID NO: 1655502 - RNA, 14 nt, Salmonella enterica enterica serovar Typhi
cgcugacugaacuc

SEQ ID NO: 1655503 - RNA, 17 nt, Salmonella enterica enterica serovar Typhi
cgcucauuuuauugaua

SEQ ID NO: 1655504 - RNA, 21 nt, Salmonella enterica enterica serovar Typhi
cgcucaugcgccuggcgguaa

SEQ ID NO: 1655505 - RNA, 20 nt, Salmonella enterica enterica serovar Typhi
cgcuaaacagcaaaucggga

SEQ ID NO: 1655506 - RNA, 14 nt, Salmonella enterica enterica serovar Typhi
cgcguuuugccgcu

SEQ ID NO: 1655507 - RNA, 13 nt, Salmonella enterica enterica serovar Typhi
cgcuccggaacgc

SEQ ID NO: 1655508 - RNA, 14 nt, Salmonella enterica enterica serovar Typhi
cgcucgacguccag

SEQ ID NO: 1655509 - RNA, 15 nt, Salmonella enterica enterica serovar Typhi
cgccccaaagcgcau

SEQ ID NO: 1655510 - RNA, 16 nt, Salmonella enterica enterica serovar Typhi
cgcccauuaugccgca

SEQ ID NO: 1655511 - RNA, 14 nt, Salmonella enterica enterica serovar Typhi
cgcccauuccgccu

SEQ ID NO: 1655512 - RNA, 20 nt, Salmonella enterica enterica serovar Typhi
cgccccccuaccggaaucgc

SEQ ID NO: 1655513 - RNA, 13 nt, Salmonella enterica enterica serovar Typhi
cgcccauaaucac

SEQ ID NO: 1655514 - RNA, 12 nt, Salmonella enterica enterica serovar Typhi
cgcccaucauca

SEQ ID NO: 1655515 - RNA, 14 nt, Salmonella enterica enterica serovar Typhi
cgcccaucccuaau

SEQ ID NO: 1655516 - RNA, 17 nt, Salmonella enterica enterica serovar Typhi
cgcccaucuccagcccg

SEQ ID NO: 1655517 - RNA, 14 nt, Salmonella enterica enterica serovar Typhi
cgcccaucgccaca

SEQ ID NO: 1655518 - RNA, 14 nt, Salmonella enterica enterica serovar Typhi
cgcccauggaugcg

SEQ ID NO: 1655519 - RNA, 20 nt, Salmonella enterica enterica serovar Typhi
cgcccgcuucaucugaggau

SEQ ID NO: 1655520 - RNA, 18 nt, Salmonella enterica enterica serovar Typhi
cgcccagaaagaucagca

SEQ ID NO: 1655521 - RNA, 20 nt, Salmonella enterica enterica serovar Typhi
cgcccagauaaugccgcugg

SEQ ID NO: 1655522 - RNA, 14 nt, Salmonella enterica enterica serovar Typhi
cgcccaggccaugc

SEQ ID NO: 1655523 - RNA, 23 nt, Salmonella enterica enterica serovar Typhi
cgcccagcagcagaaauucggca

SEQ ID NO: 1655524 - RNA, 18 nt, Salmonella enterica enterica serovar Typhi
cgccaugcggcgccauca

SEQ ID NO: 1655525 - RNA, 15 nt, Salmonella enterica enterica serovar Typhi
cgccaggccagaugg

SEQ ID NO: 1655526 - RNA, 19 nt, Salmonella enterica enterica serovar Typhi
cgccaggcaaucagcagcc

SEQ ID NO: 1655527 - RNA, 21 nt, Salmonella enterica enterica serovar Typhi
cgccaggauaauaaugaucgc

SEQ ID NO: 1655528 - RNA, 18 nt, Salmonella enterica enterica serovar Typhi
cgccauuaaaagccagca

SEQ ID NO: 1655529 - RNA, 15 nt, Salmonella enterica enterica serovar Typhi
cgccauuccgcagaa

SEQ ID NO: 1655530 - RNA, 19 nt, Salmonella enterica enterica serovar Typhi
cgccauucucuucuaccac

SEQ ID NO: 1655531 - RNA, 18 nt, Salmonella enterica enterica serovar Typhi
cgcccaacggaugcgcca

SEQ ID NO: 1655532 - RNA, 18 nt, Salmonella enterica enterica serovar Typhi
cgccauuuuucgcccaca

SEQ ID NO: 1655533 - RNA, 16 nt, Salmonella enterica enterica serovar Typhi
cgccauuugccagaua

SEQ ID NO: 1655534 - RNA, 11 nt, Salmonella enterica enterica serovar Typhi
cgcccaaugcc

SEQ ID NO: 1655535 - RNA, 22 nt, Salmonella enterica enterica serovar Typhi
cgcccaacggaugcgccauccc

SEQ ID NO: 1655536 - RNA, 16 nt, Salmonella enterica enterica serovar Typhi
cgcccacaaccgacgc

SEQ ID NO: 1655537 - RNA, 23 nt, Salmonella enterica enterica serovar Typhi
cgccgagacgcugcacacgcugg

SEQ ID NO: 1655538 - RNA, 21 nt, Salmonella enterica enterica serovar Typhi
cgccgagaaaauaccgcacau

SEQ ID NO: 1655539 - RNA, 16 nt, Salmonella enterica enterica serovar Typhi
cgcccgguagcauccg

SEQ ID NO: 1655540 - RNA, 15 nt, Salmonella enterica enterica serovar Typhi
cgcccugcccgccag

SEQ ID NO: 1655541 - RNA, 14 nt, Salmonella enterica enterica serovar Typhi
cgcccugcgccaga

SEQ ID NO: 1655542 - RNA, 18 nt, Salmonella enterica enterica serovar Typhi
cgccgaaagcgaucacau

SEQ ID NO: 1655543 - RNA, 15 nt, Salmonella enterica enterica serovar Typhi
cgccgaagcaggcgg

SEQ ID NO: 1655544 - RNA, 21 nt, Salmonella enterica enterica serovar Typhi
cgccgaagccagcgcagucaa

SEQ ID NO: 1655545 - RNA, 23 nt, Salmonella enterica enterica serovar Typhi
cgccgacaacgcuucuggcguaa

SEQ ID NO: 1655546 - RNA, 14 nt, Salmonella enterica enterica serovar Typhi
cgccgaugccgccg

SEQ ID NO: 1655547 - RNA, 21 nt, Salmonella enterica enterica serovar Typhi
cgccgaugaccaguggcguaa

SEQ ID NO: 1655548 - RNA, 15 nt, Salmonella enterica enterica serovar Typhi
cgccgaucaucccgc

SEQ ID NO: 1655549 - RNA, 15 nt, Salmonella enterica enterica serovar Typhi
cgccgaucagcacca

SEQ ID NO: 1655550 - RNA, 16 nt, Salmonella enterica enterica serovar Typhi
cgccgauggcgccaga

SEQ ID NO: 1655551 - RNA, 15 nt, Salmonella enterica enterica serovar Typhi
cgccgcacguaacgu

SEQ ID NO: 1655552 - RNA, 22 nt, Salmonella enterica enterica serovar Typhi
cgccgcaagcggcaaucgccuc

SEQ ID NO: 1655553 - RNA, 17 nt, Salmonella enterica enterica serovar Typhi
cgccgcaaaacgcguau

SEQ ID NO: 1655554 - RNA, 14 nt, Salmonella enterica enterica serovar Typhi
cgccgcaaucacuu

SEQ ID NO: 1655555 - RNA, 15 nt, Salmonella enterica enterica serovar Typhi
cgccgcccagcgggu

SEQ ID NO: 1655556 - RNA, 20 nt, Salmonella enterica enterica serovar Typhi
cgccgcccccaugccgccug

SEQ ID NO: 1655557 - RNA, 23 nt, Salmonella enterica enterica serovar Typhi
cgccgcccagauguugauacaga

SEQ ID NO: 1655558 - RNA, 15 nt, Salmonella enterica enterica serovar Typhi
cgccgcccacgcugu

SEQ ID NO: 1655559 - RNA, 13 nt, Salmonella enterica enterica serovar Typhi
cgccgccagcuca

SEQ ID NO: 1655560 - RNA, 14 nt, Salmonella enterica enterica serovar Typhi
cgccgccagccaua

SEQ ID NO: 1655561 - RNA, 17 nt, Salmonella enterica enterica serovar Typhi
cgcgaccagcagcauca

SEQ ID NO: 1655562 - RNA, 17 nt, Salmonella enterica enterica serovar Typhi
cgcgaccagcgcgccaa

SEQ ID NO: 1655563 - RNA, 18 nt, Salmonella enterica enterica serovar Typhi
cgcgaccagcgcgccaaa

SEQ ID NO: 1655564 - RNA, 14 nt, Salmonella enterica enterica serovar Typhi
cgcgacaaugccau

SEQ ID NO: 1655565 - RNA, 14 nt, Salmonella enterica enterica serovar Typhi
cgcgacaacgccau

SEQ ID NO: 1655566 - RNA, 15 nt, Salmonella enterica enterica serovar Typhi
cgcgacaacgccgga

SEQ ID NO: 1655567 - RNA, 17 nt, Salmonella enterica enterica serovar Typhi
cgcgaauuugccccaga

SEQ ID NO: 1655568 - RNA, 16 nt, Salmonella enterica enterica serovar Typhi
cgcgacaaggccgaua

SEQ ID NO: 1655569 - RNA, 22 nt, Salmonella enterica enterica serovar Typhi
cgcgaauuccuuuuuccgccac

SEQ ID NO: 1655570 - RNA, 18 nt, Salmonella enterica enterica serovar Typhi
cgcgaaaugucccgauau

SEQ ID NO: 1655571 - RNA, 18 nt, Salmonella enterica enterica serovar Typhi
cgccuugcggcggcguuu

SEQ ID NO: 1655572 - RNA, 18 nt, Salmonella enterica enterica serovar Typhi
cgccuucguuauaaggcc

SEQ ID NO: 1655573 - RNA, 16 nt, Salmonella enterica enterica serovar Typhi
cgccuggcgguaugaa

SEQ ID NO: 1655574 - RNA, 17 nt, Salmonella enterica enterica serovar Typhi
cgccuggcgaaacgccu

SEQ ID NO: 1655575 - RNA, 22 nt, Salmonella enterica enterica serovar Typhi
cgccuggcaucggguugauuac

SEQ ID NO: 1655576 - RNA, 22 nt, Salmonella enterica enterica serovar Typhi
cgccugcgguaaucgccgcgac

SEQ ID NO: 1655577 - RNA, 20 nt, Salmonella enterica enterica serovar Typhi
cgccugcgguuuaaugcuau

SEQ ID NO: 1655578 - RNA, 16 nt, Salmonella enterica enterica serovar Typhi
cgccuggagcugaucg

SEQ ID NO: 1655579 - RNA, 14 nt, Salmonella enterica enterica serovar Typhi
cgccugcggcguaa

SEQ ID NO: 1655580 - RNA, 19 nt, Salmonella enterica enterica serovar Typhi
cgccuuauccggccuacaa

SEQ ID NO: 1655581 - RNA, 20 nt, Salmonella enterica enterica serovar Typhi
cgccuuauccgaccuacaga

SEQ ID NO: 1655582 - RNA, 15 nt, Salmonella enterica enterica serovar Typhi
cgccuguucaacaug

SEQ ID NO: 1655583 - RNA, 23 nt, Salmonella enterica enterica serovar Typhi
cgccuguuagggcgcggcuggua

SEQ ID NO: 1655584 - RNA, 14 nt, Salmonella enterica enterica serovar Typhi
cgccuguugauuac

SEQ ID NO: 1655585 - RNA, 15 nt, Salmonella enterica enterica serovar Typhi
cgccuuaaaccgucg

SEQ ID NO: 1655586 - RNA, 15 nt, Salmonella enterica enterica serovar Typhi
cgccuuaccgcggua

SEQ ID NO: 1655587 - RNA, 21 nt, Salmonella enterica enterica serovar Typhi
cgccuucggccugaaucagca

SEQ ID NO: 1655588 - RNA, 15 nt, Salmonella enterica enterica serovar Typhi
cgccuuccuccagca

SEQ ID NO: 1655589 - RNA, 19 nt, Salmonella enterica enterica serovar Typhi
cgccuuauccggccuacag

SEQ ID NO: 1655590 - RNA, 20 nt, Salmonella enterica enterica serovar Typhi
cgccuuauccggccuacaga

SEQ ID NO: 1655591 - RNA, 20 nt, Salmonella enterica enterica serovar Typhi
cgccuucauauuaaauuccg

SEQ ID NO: 1655592 - RNA, 14 nt, Salmonella enterica enterica serovar Typhi
cgccugauggcgac

SEQ ID NO: 1655593 - RNA, 15 nt, Salmonella enterica enterica serovar Typhi
cgccugauucauucc

SEQ ID NO: 1655594 - RNA, 16 nt, Salmonella enterica enterica serovar Typhi
cgccuccagcgauagu

SEQ ID NO: 1655595 - RNA, 18 nt, Salmonella enterica enterica serovar Typhi
cgccuccaggccggauaa

SEQ ID NO: 1655596 - RNA, 21 nt, Salmonella enterica enterica serovar Typhi
cgccgucgaugauggcggcua

SEQ ID NO: 1655597 - RNA, 18 nt, Salmonella enterica enterica serovar Typhi
cgccgucgcggcuacgga

SEQ ID NO: 1655598 - RNA, 17 nt, Salmonella enterica enterica serovar Typhi
cgccgucguucagccag

SEQ ID NO: 1655599 - RNA, 18 nt, Salmonella enterica enterica serovar Typhi
cgccggccugacgaccgu

SEQ ID NO: 1655600 - RNA, 20 nt, Salmonella enterica enterica serovar Typhi
cgccgcuuuaaucaccaugg

SEQ ID NO: 1655601 - RNA, 18 nt, Salmonella enterica enterica serovar Typhi
cgccggaaacuggcguca

SEQ ID NO: 1655602 - RNA, 15 nt, Salmonella enterica enterica serovar Typhi
cgccggagaucagca

SEQ ID NO: 1655603 - RNA, 15 nt, Salmonella enterica enterica serovar Typhi
cgccgcuuuuuccgc

SEQ ID NO: 1655604 - RNA, 17 nt, Salmonella enterica enterica serovar Typhi
cgccgcuuuuuccgccg

SEQ ID NO: 1655605 - RNA, 20 nt, Salmonella enterica enterica serovar Typhi
cgccgcuuuuuucagcggca

SEQ ID NO: 1655606 - RNA, 18 nt, Salmonella enterica enterica serovar Typhi
cgccggacuguugaugau

SEQ ID NO: 1655607 - RNA, 20 nt, Salmonella enterica enterica serovar Typhi
cgccggauauggcguccggc

SEQ ID NO: 1655608 - RNA, 16 nt, Salmonella enterica enterica serovar Typhi
cgccgccuaucgccag

SEQ ID NO: 1655609 - RNA, 20 nt, Salmonella enterica enterica serovar Typhi
cgccgcgugaauugcgguuu

SEQ ID NO: 1655610 - RNA, 17 nt, Salmonella enterica enterica serovar Typhi
cgccgcguuucucgccg

SEQ ID NO: 1655611 - RNA, 19 nt, Salmonella enterica enterica serovar Typhi
cgccgcguuucucgccggu

SEQ ID NO: 1655612 - RNA, 22 nt, Salmonella enterica enterica serovar Typhi
cgccggggaaaauauuagcggc

SEQ ID NO: 1655613 - RNA, 18 nt, Salmonella enterica enterica serovar Typhi
cgccggcgcuuuguuucc

SEQ ID NO: 1655614 - RNA, 15 nt, Salmonella enterica enterica serovar Typhi
cgccggcgcguaauu

SEQ ID NO: 1655615 - RNA, 17 nt, Salmonella enterica enterica serovar Typhi
cggcgaugguugccagc

SEQ ID NO: 1655616 - RNA, 16 nt, Salmonella enterica enterica serovar Typhi
cggcgauauagcgcug

SEQ ID NO: 1655617 - RNA, 22 nt, Salmonella enterica enterica serovar Typhi
cggcgcagguccauuuuuuauc

SEQ ID NO: 1655618 - RNA, 13 nt, Salmonella enterica enterica serovar Typhi
cggcgagcaguac

SEQ ID NO: 1655619 - RNA, 15 nt, Salmonella enterica enterica serovar Typhi
cggcgagcaguacgc

SEQ ID NO: 1655620 - RNA, 21 nt, Salmonella enterica enterica serovar Typhi
cggcgaccuucacgccgccaa

SEQ ID NO: 1655621 - RNA, 16 nt, Salmonella enterica enterica serovar Typhi
cggccuuuuugcgccg

SEQ ID NO: 1655622 - RNA, 20 nt, Salmonella enterica enterica serovar Typhi
cggcgaaccggcaucggcag

SEQ ID NO: 1655623 - RNA, 17 nt, Salmonella enterica enterica serovar Typhi
cggcgaacguuggcugg

SEQ ID NO: 1655624 - RNA, 18 nt, Salmonella enterica enterica serovar Typhi
cggcgaagauccgcucac

SEQ ID NO: 1655625 - RNA, 22 nt, Salmonella enterica enterica serovar Typhi
cggccugacgaccguugccgau

SEQ ID NO: 1655626 - RNA, 23 nt, Salmonella enterica enterica serovar Typhi
cggccugauaagcauagcgccau

SEQ ID NO: 1655627 - RNA, 20 nt, Salmonella enterica enterica serovar Typhi
cggccugcacaagaaacaug

SEQ ID NO: 1655628 - RNA, 19 nt, Salmonella enterica enterica serovar Typhi
cggccauagcgugagguca

SEQ ID NO: 1655629 - RNA, 18 nt, Salmonella enterica enterica serovar Typhi
cggcccauaaacagguca

SEQ ID NO: 1655630 - RNA, 22 nt, Salmonella enterica enterica serovar Typhi
cggcccgaagggcgagcguagc

SEQ ID NO: 1655631 - RNA, 20 nt, Salmonella enterica enterica serovar Typhi
cggcccgaugccuggauaau

SEQ ID NO: 1655632 - RNA, 17 nt, Salmonella enterica enterica serovar Typhi
cggcccgggcacgaugg

SEQ ID NO: 1655633 - RNA, 20 nt, Salmonella enterica enterica serovar Typhi
cggcccgggagaacgccggg

SEQ ID NO: 1655634 - RNA, 13 nt, Salmonella enterica enterica serovar Typhi
cggccaaauugcu

SEQ ID NO: 1655635 - RNA, 17 nt, Salmonella enterica enterica serovar Typhi
cggcaucccaggcgucc

SEQ ID NO: 1655636 - RNA, 19 nt, Salmonella enterica enterica serovar Typhi
cggcauuggcguuaccggc

SEQ ID NO: 1655637 - RNA, 22 nt, Salmonella enterica enterica serovar Typhi
cggcauuggcguuaccggcagg

SEQ ID NO: 1655638 - RNA, 16 nt, Salmonella enterica enterica serovar Typhi
cggcagcguccgccau

SEQ ID NO: 1655639 - RNA, 17 nt, Salmonella enterica enterica serovar Typhi
cggcagcuucagccagu

SEQ ID NO: 1655640 - RNA, 22 nt, Salmonella enterica enterica serovar Typhi
cggcauaagccaguccugccac

SEQ ID NO: 1655641 - RNA, 17 nt, Salmonella enterica enterica serovar Typhi
cggcauacaccgccagc

SEQ ID NO: 1655642 - RNA, 19 nt, Salmonella enterica enterica serovar Typhi
cggcauacaccgccagcgu

SEQ ID NO: 1655643 - RNA, 12 nt, Salmonella enterica enterica serovar Typhi
cggcauacagcg

SEQ ID NO: 1655644 - RNA, 20 nt, Salmonella enterica enterica serovar Typhi
cggcauauucaggagcaugg

SEQ ID NO: 1655645 - RNA, 19 nt, Salmonella enterica enterica serovar Typhi
cggcaucaagcccauguuc

SEQ ID NO: 1655646 - RNA, 22 nt, Salmonella enterica enterica serovar Typhi
cggcaucacaggcuuauaccga

SEQ ID NO: 1655647 - RNA, 18 nt, Salmonella enterica enterica serovar Typhi
cggcaguugccggaacca

SEQ ID NO: 1655648 - RNA, 15 nt, Salmonella enterica enterica serovar Typhi
cggcaguacacgcau

SEQ ID NO: 1655649 - RNA, 21 nt, Salmonella enterica enterica serovar Typhi
cggcacucaccucuuccgcca

SEQ ID NO: 1655650 - RNA, 18 nt, Salmonella enterica enterica serovar Typhi
cggcaccggaaccggcau

SEQ ID NO: 1655651 - RNA, 19 nt, Salmonella enterica enterica serovar Typhi
cggcaauaugcuguuuaug

SEQ ID NO: 1655652 - RNA, 11 nt, Salmonella enterica enterica serovar Typhi
cggaugcgcgg

SEQ ID NO: 1655653 - RNA, 13 nt, Salmonella enterica enterica serovar Typhi
cggcaacucgccg

SEQ ID NO: 1655654 - RNA, 17 nt, Salmonella enterica enterica serovar Typhi
cggaugcggcuagcgcc

SEQ ID NO: 1655655 - RNA, 16 nt, Salmonella enterica enterica serovar Typhi
cggcaacugcgccaaa

SEQ ID NO: 1655656 - RNA, 17 nt, Salmonella enterica enterica serovar Typhi
cggcaaggucugcgccc

SEQ ID NO: 1655657 - RNA, 15 nt, Salmonella enterica enterica serovar Typhi
cggcaagcuggcgaa

SEQ ID NO: 1655658 - RNA, 14 nt, Salmonella enterica enterica serovar Typhi
cggagagucgacca

SEQ ID NO: 1655659 - RNA, 18 nt, Salmonella enterica enterica serovar Typhi
cggagagcggauaauccg

SEQ ID NO: 1655660 - RNA, 17 nt, Salmonella enterica enterica serovar Typhi
cggagcggcguccgcca

SEQ ID NO: 1655661 - RNA, 14 nt, Salmonella enterica enterica serovar Typhi
cggacucaggccuu

SEQ ID NO: 1655662 - RNA, 21 nt, Salmonella enterica enterica serovar Typhi
cggagagagcaacuggcaaua

SEQ ID NO: 1655663 - RNA, 20 nt, Salmonella enterica enterica serovar Typhi
cggaucgaucucgauauuca

SEQ ID NO: 1655664 - RNA, 21 nt, Salmonella enterica enterica serovar Typhi
cggaucaggcguuagccgcca

SEQ ID NO: 1655665 - RNA, 17 nt, Salmonella enterica enterica serovar Typhi
cggaucggucuggcgca

SEQ ID NO: 1655666 - RNA, 12 nt, Salmonella enterica enterica serovar Typhi
cggaucucgcca

SEQ ID NO: 1655667 - RNA, 13 nt, Salmonella enterica enterica serovar Typhi
cggauaacggcgc

SEQ ID NO: 1655668 - RNA, 17 nt, Salmonella enterica enterica serovar Typhi
cggauaagcgcagcgcc

SEQ ID NO: 1655669 - RNA, 21 nt, Salmonella enterica enterica serovar Typhi
cggauacaagguauccgccau

SEQ ID NO: 1655670 - RNA, 20 nt, Salmonella enterica enterica serovar Typhi
cggauaaggcguuuacgcug

SEQ ID NO: 1655671 - RNA, 20 nt, Salmonella enterica enterica serovar Typhi
cggauaaggcguuuacgccg

SEQ ID NO: 1655672 - RNA, 18 nt, Salmonella enterica enterica serovar Typhi
cggauaagcguagcgcca

SEQ ID NO: 1655673 - RNA, 16 nt, Salmonella enterica enterica serovar Typhi
cggauaagcaacgcgc

SEQ ID NO: 1655674 - RNA, 20 nt, Salmonella enterica enterica serovar Typhi
cggauaaggcgcagccgcca

SEQ ID NO: 1655675 - RNA, 15 nt, Salmonella enterica enterica serovar Typhi
cgcuguaccggcagg

SEQ ID NO: 1655676 - RNA, 14 nt, Salmonella enterica enterica serovar Typhi
cgcuguagcgccaa

SEQ ID NO: 1655677 - RNA, 14 nt, Salmonella enterica enterica serovar Typhi
cggaauuucaggaa

SEQ ID NO: 1655678 - RNA, 17 nt, Salmonella enterica enterica serovar Typhi
cggacacccgcagccag

SEQ ID NO: 1655679 - RNA, 19 nt, Salmonella enterica enterica serovar Typhi
cggacgaacgcuaugcgcc

SEQ ID NO: 1655680 - RNA, 18 nt, Salmonella enterica enterica serovar Typhi
cggacgauaaccaugcuc

SEQ ID NO: 1655681 - RNA, 16 nt, Salmonella enterica enterica serovar Typhi
cggacgccgaugguaa

SEQ ID NO: 1655682 - RNA, 14 nt, Salmonella enterica enterica serovar Typhi
cggacgcagcucau

SEQ ID NO: 1655683 - RNA, 12 nt, Salmonella enterica enterica serovar Typhi
cggaccggcgac

SEQ ID NO: 1655684 - RNA, 23 nt, Salmonella enterica enterica serovar Typhi
cggcugcgcugccagcugcguca

SEQ ID NO: 1655685 - RNA, 15 nt, Salmonella enterica enterica serovar Typhi
cggcugaagcugccg

SEQ ID NO: 1655686 - RNA, 19 nt, Salmonella enterica enterica serovar Typhi
cggcugccauuaucaccau

SEQ ID NO: 1655687 - RNA, 17 nt, Salmonella enterica enterica serovar Typhi
cggcugcaccagcguua

SEQ ID NO: 1655688 - RNA, 18 nt, Salmonella enterica enterica serovar Typhi
cggcucccauuugcgggu

SEQ ID NO: 1655689 - RNA, 14 nt, Salmonella enterica enterica serovar Typhi
cggcuucaaucguc

SEQ ID NO: 1655690 - RNA, 17 nt, Salmonella enterica enterica serovar Typhi
cggcugggcgaggccac

SEQ ID NO: 1655691 - RNA, 20 nt, Salmonella enterica enterica serovar Typhi
cggcugggcgaggccacgca

SEQ ID NO: 1655692 - RNA, 22 nt, Salmonella enterica enterica serovar Typhi
cggcuggguuuccggaucgccg

SEQ ID NO: 1655693 - RNA, 18 nt, Salmonella enterica enterica serovar Typhi
cggcuggcgcaacuggcg

SEQ ID NO: 1655694 - RNA, 14 nt, Salmonella enterica enterica serovar Typhi
cggcuucagcgaca

SEQ ID NO: 1655695 - RNA, 22 nt, Salmonella enterica enterica serovar Typhi
cggcuuucacaccguuauccgg

SEQ ID NO: 1655696 - RNA, 13 nt, Salmonella enterica enterica serovar Typhi
cggcuuuccagcu

SEQ ID NO: 1655697 - RNA, 16 nt, Salmonella enterica enterica serovar Typhi
cggcuugugagcgucg

SEQ ID NO: 1655698 - RNA, 22 nt, Salmonella enterica enterica serovar Typhi
cgggaaagauaauaccucaaau

SEQ ID NO: 1655699 - RNA, 15 nt, Salmonella enterica enterica serovar Typhi
cgggaaaucacguuu

SEQ ID NO: 1655700 - RNA, 17 nt, Salmonella enterica enterica serovar Typhi
cggcuuugcgccggcag

SEQ ID NO: 1655701 - RNA, 19 nt, Salmonella enterica enterica serovar Typhi
cggcuaaacugcgaugcgc

SEQ ID NO: 1655702 - RNA, 21 nt, Salmonella enterica enterica serovar Typhi
cggcuaaaugacgcgcgagaa

SEQ ID NO: 1655703 - RNA, 17 nt, Salmonella enterica enterica serovar Typhi
cggcguuuuagcgccau

SEQ ID NO: 1655704 - RNA, 20 nt, Salmonella enterica enterica serovar Typhi
cggcuauuccucgaucgccu

SEQ ID NO: 1655705 - RNA, 16 nt, Salmonella enterica enterica serovar Typhi
cggcgugucagggcgg

SEQ ID NO: 1655706 - RNA, 18 nt, Salmonella enterica enterica serovar Typhi
cggcguugcgccgccagg

SEQ ID NO: 1655707 - RNA, 13 nt, Salmonella enterica enterica serovar Typhi
cggcgucgccaga

SEQ ID NO: 1655708 - RNA, 16 nt, Salmonella enterica enterica serovar Typhi
cggcgucgccuggugg

SEQ ID NO: 1655709 - RNA, 22 nt, Salmonella enterica enterica serovar Typhi
cggcgucauacugccaaccauu

SEQ ID NO: 1655710 - RNA, 23 nt, Salmonella enterica enterica serovar Typhi
cggcgucaucauugcgccaagac

SEQ ID NO: 1655711 - RNA, 20 nt, Salmonella enterica enterica serovar Typhi
cggcggccaaccccggcaaa

SEQ ID NO: 1655712 - RNA, 11 nt, Salmonella enterica enterica serovar Typhi
cggcggcguuu

SEQ ID NO: 1655713 - RNA, 17 nt, Salmonella enterica enterica serovar Typhi
cggcgcugaugacgcgc

SEQ ID NO: 1655714 - RNA, 22 nt, Salmonella enterica enterica serovar Typhi
cggcgccauaguccauuacgca

SEQ ID NO: 1655715 - RNA, 15 nt, Salmonella enterica enterica serovar Typhi
cggcgccaucaugca

SEQ ID NO: 1655716 - RNA, 14 nt, Salmonella enterica enterica serovar Typhi
cggcgcgucgcugu

SEQ ID NO: 1655717 - RNA, 16 nt, Salmonella enterica enterica serovar Typhi
cggcgcguucgccaaa

SEQ ID NO: 1655718 - RNA, 15 nt, Salmonella enterica enterica serovar Typhi
cggguaaccggagau

SEQ ID NO: 1655719 - RNA, 21 nt, Salmonella enterica enterica serovar Typhi
cggguaaggcguagccgccac

SEQ ID NO: 1655720 - RNA, 12 nt, Salmonella enterica enterica serovar Typhi
cggguaagcgcu

SEQ ID NO: 1655721 - RNA, 20 nt, Salmonella enterica enterica serovar Typhi
cggguaagcgcuagcgccac

SEQ ID NO: 1655722 - RNA, 14 nt, Salmonella enterica enterica serovar Typhi
cggguaaggcaucg

SEQ ID NO: 1655723 - RNA, 22 nt, Salmonella enterica enterica serovar Typhi
cggguaaacucacccaggcgau

SEQ ID NO: 1655724 - RNA, 14 nt, Salmonella enterica enterica serovar Typhi
cgggucggacgagc

SEQ ID NO: 1655725 - RNA, 17 nt, Salmonella enterica enterica serovar Typhi
cgggggcguucgcguuc

SEQ ID NO: 1655726 - RNA, 17 nt, Salmonella enterica enterica serovar Typhi
cggggucuuccagcaga

SEQ ID NO: 1655727 - RNA, 15 nt, Salmonella enterica enterica serovar Typhi
cggguucaucgccac

SEQ ID NO: 1655728 - RNA, 16 nt, Salmonella enterica enterica serovar Typhi
cgguacuggagaccgg

SEQ ID NO: 1655729 - RNA, 17 nt, Salmonella enterica enterica serovar Typhi
cgguacuggugcccgca

SEQ ID NO: 1655730 - RNA, 22 nt, Salmonella enterica enterica serovar Typhi
cgguaguccgccagcaccugau

SEQ ID NO: 1655731 - RNA, 23 nt, Salmonella enterica enterica serovar Typhi
cgguauaaauuuccgcagccaga

SEQ ID NO: 1655732 - RNA, 18 nt, Salmonella enterica enterica serovar Typhi
cgguaucacgcgugcgcg

SEQ ID NO: 1655733 - RNA, 15 nt, Salmonella enterica enterica serovar Typhi
cggucaaucaucaga

SEQ ID NO: 1655734 - RNA, 22 nt, Salmonella enterica enterica serovar Typhi
cgguauuucgcaacgccgccga

SEQ ID NO: 1655735 - RNA, 22 nt, Salmonella enterica enterica serovar Typhi
cgguauugugccgcgccugcca

SEQ ID NO: 1655736 - RNA, 21 nt, Salmonella enterica enterica serovar Typhi
cggucaaaagcugcauccggg

SEQ ID NO: 1655737 - RNA, 15 nt, Salmonella enterica enterica serovar Typhi
cggucaaaagcugca

SEQ ID NO: 1655738 - RNA, 23 nt, Salmonella enterica enterica serovar Typhi
cgggcaaugccaccagcgccaua

SEQ ID NO: 1655739 - RNA, 15 nt, Salmonella enterica enterica serovar Typhi
cgggcaaugccacca

SEQ ID NO: 1655740 - RNA, 21 nt, Salmonella enterica enterica serovar Typhi
cgggcaaugccaccagcgcca

SEQ ID NO: 1655741 - RNA, 22 nt, Salmonella enterica enterica serovar Typhi
cgggcaaugccaccagcgccau

SEQ ID NO: 1655742 - RNA, 20 nt, Salmonella enterica enterica serovar Typhi
cgggcagggcuguacgaccg

SEQ ID NO: 1655743 - RNA, 15 nt, Salmonella enterica enterica serovar Typhi
cgggcaucgccgcaa

SEQ ID NO: 1655744 - RNA, 14 nt, Salmonella enterica enterica serovar Typhi
cgggcauugugccg

SEQ ID NO: 1655745 - RNA, 15 nt, Salmonella enterica enterica serovar Typhi
cgggcauuguuaauc

SEQ ID NO: 1655746 - RNA, 14 nt, Salmonella enterica enterica serovar Typhi
cgggcgaggccucg

SEQ ID NO: 1655747 - RNA, 13 nt, Salmonella enterica enterica serovar Typhi
cgggcgucgaaau

SEQ ID NO: 1655748 - RNA, 13 nt, Salmonella enterica enterica serovar Typhi
cgggcucacgcug

SEQ ID NO: 1655749 - RNA, 14 nt, Salmonella enterica enterica serovar Typhi
cgggcucacgcugg

SEQ ID NO: 1655750 - RNA, 17 nt, Salmonella enterica enterica serovar Typhi
cgggcgcguuaaugcau

SEQ ID NO: 1655751 - RNA, 16 nt, Salmonella enterica enterica serovar Typhi
gaggauaaaaucgcca

SEQ ID NO: 1655752 - RNA, 12 nt, Salmonella enterica enterica serovar Typhi
gaggaucgccgc

SEQ ID NO: 1655753 - RNA, 19 nt, Salmonella enterica enterica serovar Typhi
gaggaacuguucagccagc

SEQ ID NO: 1655754 - RNA, 18 nt, Salmonella enterica enterica serovar Typhi
gagcuuugacgacccgcu

SEQ ID NO: 1655755 - RNA, 17 nt, Salmonella enterica enterica serovar Typhi
gagcugcgauaauccgg

SEQ ID NO: 1655756 - RNA, 14 nt, Salmonella enterica enterica serovar Typhi
gagcugcgcuucga

SEQ ID NO: 1655757 - RNA, 15 nt, Salmonella enterica enterica serovar Typhi
gaggguguucacgcg

SEQ ID NO: 1655758 - RNA, 15 nt, Salmonella enterica enterica serovar Typhi
gagucaaggcaucca

SEQ ID NO: 1655759 - RNA, 14 nt, Salmonella enterica enterica serovar Typhi
gaguaugcggucaa

SEQ ID NO: 1655760 - RNA, 23 nt, Salmonella enterica enterica serovar Typhi
gaguaaaguuauucacguagggu

SEQ ID NO: 1655761 - RNA, 16 nt, Salmonella enterica enterica serovar Typhi
gauaaccuuccggcac

SEQ ID NO: 1655762 - RNA, 16 nt, Salmonella enterica enterica serovar Typhi
gauaaccugcugugac

SEQ ID NO: 1655763 - RNA, 19 nt, Salmonella enterica enterica serovar Typhi
gauaacgaauuaagcggau

SEQ ID NO: 1655764 - RNA, 22 nt, Salmonella enterica enterica serovar Typhi
gauaaccagaaaaccgacagca

SEQ ID NO: 1655765 - RNA, 20 nt, Salmonella enterica enterica serovar Typhi
gauaaccagcgcgccgccaa

SEQ ID NO: 1655766 - RNA, 14 nt, Salmonella enterica enterica serovar Typhi
gauaaucagcagcg

SEQ ID NO: 1655767 - RNA, 12 nt, Salmonella enterica enterica serovar Typhi
gauaauccagcg

SEQ ID NO: 1655768 - RNA, 23 nt, Salmonella enterica enterica serovar Typhi
gauaauguauuaucgaugcgcca

SEQ ID NO: 1655769 - RNA, 19 nt, Salmonella enterica enterica serovar Typhi
gauaagguaaagccgccau

SEQ ID NO: 1655770 - RNA, 22 nt, Salmonella enterica enterica serovar Typhi
gauaagguaaagccgccauccg

SEQ ID NO: 1655771 - RNA, 12 nt, Salmonella enterica enterica serovar Typhi
gauaagccuccg

SEQ ID NO: 1655772 - RNA, 20 nt, Salmonella enterica enterica serovar Typhi
gauaagcgaagcgucauccg

SEQ ID NO: 1655773 - RNA, 18 nt, Salmonella enterica enterica serovar Typhi
gauaagcaagcgccaucg

SEQ ID NO: 1655774 - RNA, 16 nt, Salmonella enterica enterica serovar Typhi
gauaagcauagcgcca

SEQ ID NO: 1655775 - RNA, 20 nt, Salmonella enterica enterica serovar Typhi
gauaagcaacgcgccauccg

SEQ ID NO: 1655776 - RNA, 24 nt, Salmonella enterica enterica serovar Typhi
gauaagcauagcgccaucaggcau

SEQ ID NO: 1655777 - RNA, 16 nt, Salmonella enterica enterica serovar Typhi
gauaagcaacgcgcca

SEQ ID NO: 1655778 - RNA, 22 nt, Salmonella enterica enterica serovar Typhi
gauaagacgcgaagcggcgcua

SEQ ID NO: 1655779 - RNA, 14 nt, Salmonella enterica enterica serovar Typhi
gauaacuuucgggu

SEQ ID NO: 1655780 - RNA, 21 nt, Salmonella enterica enterica serovar Typhi
gauaaggcguucacgccgcca

SEQ ID NO: 1655781 - RNA, 12 nt, Salmonella enterica enterica serovar Typhi
gauaaggcauuc

SEQ ID NO: 1655782 - RNA, 18 nt, Salmonella enterica enterica serovar Typhi
gauaaggcauucacgcca

SEQ ID NO: 1655783 - RNA, 22 nt, Salmonella enterica enterica serovar Typhi
gauaaggccacgccgccauccg

SEQ ID NO: 1655784 - RNA, 21 nt, Salmonella enterica enterica serovar Typhi
gauaagcguuagcgucauccg

SEQ ID NO: 1655785 - RNA, 15 nt, Salmonella enterica enterica serovar Typhi
gauaagcgucagcgu

SEQ ID NO: 1655786 - RNA, 21 nt, Salmonella enterica enterica serovar Typhi
gauaagcggcagcgccauccg

SEQ ID NO: 1655787 - RNA, 20 nt, Salmonella enterica enterica serovar Typhi
gauaagcguagcgccaucag

SEQ ID NO: 1655788 - RNA, 16 nt, Salmonella enterica enterica serovar Typhi
gauaagcgcagcgcca

SEQ ID NO: 1655789 - RNA, 17 nt, Salmonella enterica enterica serovar Typhi
gauaagcgcagcgccau

SEQ ID NO: 1655790 - RNA, 20 nt, Salmonella enterica enterica serovar Typhi
gauaagcgcagcgccauccg

SEQ ID NO: 1655791 - RNA, 21 nt, Salmonella enterica enterica serovar Typhi
gauauccucuuuucgaacgcc

SEQ ID NO: 1655792 - RNA, 19 nt, Salmonella enterica enterica serovar Typhi
gauauccagcaccucauca

SEQ ID NO: 1655793 - RNA, 17 nt, Salmonella enterica enterica serovar Typhi
gauagucauugacagca

SEQ ID NO: 1655794 - RNA, 22 nt, Salmonella enterica enterica serovar Typhi
gauaguacugaccagacagccc

SEQ ID NO: 1655795 - RNA, 19 nt, Salmonella enterica enterica serovar Typhi
gauagcguagcgccauccg

SEQ ID NO: 1655796 - RNA, 15 nt, Salmonella enterica enterica serovar Typhi
gauagcguagcgcca

SEQ ID NO: 1655797 - RNA, 17 nt, Salmonella enterica enterica serovar Typhi
gauacggguaaucagac

SEQ ID NO: 1655798 - RNA, 14 nt, Salmonella enterica enterica serovar Typhi
gauacguuccagca

SEQ ID NO: 1655799 - RNA, 15 nt, Salmonella enterica enterica serovar Typhi
gauacggcuccagca

SEQ ID NO: 1655800 - RNA, 20 nt, Salmonella enterica enterica serovar Typhi
gauacggauagcgucaacgc

SEQ ID NO: 1655801 - RNA, 20 nt, Salmonella enterica enterica serovar Typhi
gauacgcuguaguuccugua

SEQ ID NO: 1655802 - RNA, 20 nt, Salmonella enterica enterica serovar Typhi
gauacgcugcgucaggcgau

SEQ ID NO: 1655803 - RNA, 13 nt, Salmonella enterica enterica serovar Typhi
gauaauuuaucca

SEQ ID NO: 1655804 - RNA, 18 nt, Salmonella enterica enterica serovar Typhi
gauaauuuauccaguaac

SEQ ID NO: 1655805 - RNA, 20 nt, Salmonella enterica enterica serovar Typhi
gaucaacgggguuagcguuu

SEQ ID NO: 1655806 - RNA, 21 nt, Salmonella enterica enterica serovar Typhi
gauaucuucauagcuuagcug

SEQ ID NO: 1655807 - RNA, 18 nt, Salmonella enterica enterica serovar Typhi
gaucaacgccgcgccauc

SEQ ID NO: 1655808 - RNA, 16 nt, Salmonella enterica enterica serovar Typhi
gaucaaacuccgcgcu

SEQ ID NO: 1655809 - RNA, 18 nt, Salmonella enterica enterica serovar Typhi
gagcaucagcgccggauc

SEQ ID NO: 1655810 - RNA, 19 nt, Salmonella enterica enterica serovar Typhi
gagcagugauuaugcuccc

SEQ ID NO: 1655811 - RNA, 22 nt, Salmonella enterica enterica serovar Typhi
gagcaugguccggugcguucug

SEQ ID NO: 1655812 - RNA, 22 nt, Salmonella enterica enterica serovar Typhi
gagccacuauccagucagcguu

SEQ ID NO: 1655813 - RNA, 13 nt, Salmonella enterica enterica serovar Typhi
gacgucgucacca

SEQ ID NO: 1655814 - RNA, 13 nt, Salmonella enterica enterica serovar Typhi
gagcagcgaaaga

SEQ ID NO: 1655815 - RNA, 14 nt, Salmonella enterica enterica serovar Typhi
gagccgccauccgg

SEQ ID NO: 1655816 - RNA, 17 nt, Salmonella enterica enterica serovar Typhi
gagccgauauccggaua

SEQ ID NO: 1655817 - RNA, 23 nt, Salmonella enterica enterica serovar Typhi
gagccggacacugcgagggauuu

SEQ ID NO: 1655818 - RNA, 21 nt, Salmonella enterica enterica serovar Typhi
gagcguuacccagacagcaaa

SEQ ID NO: 1655819 - RNA, 14 nt, Salmonella enterica enterica serovar Typhi
gagcucauccagcg

SEQ ID NO: 1655820 - RNA, 14 nt, Salmonella enterica enterica serovar Typhi
gagcggcacgccga

SEQ ID NO: 1655821 - RNA, 17 nt, Salmonella enterica enterica serovar Typhi
gagcgcgaggcauaccg

SEQ ID NO: 1655822 - RNA, 16 nt, Salmonella enterica enterica serovar Typhi
gagcgccguaccgcgu

SEQ ID NO: 1655823 - RNA, 16 nt, Salmonella enterica enterica serovar Typhi
gagcgcgucagcgccu

SEQ ID NO: 1655824 - RNA, 17 nt, Salmonella enterica enterica serovar Typhi
gagcgacgucccgucag

SEQ ID NO: 1655825 - RNA, 14 nt, Salmonella enterica enterica serovar Typhi
gagcgacagcccgg

SEQ ID NO: 1655826 - RNA, 22 nt, Salmonella enterica enterica serovar Typhi
gagccuuacaggcgcaucagaa

SEQ ID NO: 1655827 - RNA, 19 nt, Salmonella enterica enterica serovar Typhi
gagcgcauccggccagcga

SEQ ID NO: 1655828 - RNA, 16 nt, Salmonella enterica enterica serovar Typhi
gaugacuaaaucagca

SEQ ID NO: 1655829 - RNA, 17 nt, Salmonella enterica enterica serovar Typhi
gaugacucucggccuau

SEQ ID NO: 1655830 - RNA, 17 nt, Salmonella enterica enterica serovar Typhi
gaugacuaaaucagcau

SEQ ID NO: 1655831 - RNA, 13 nt, Salmonella enterica enterica serovar Typhi
gaugaggcgcugc

SEQ ID NO: 1655832 - RNA, 22 nt, Salmonella enterica enterica serovar Typhi
gaugaaaggucgaaaacggcca

SEQ ID NO: 1655833 - RNA, 17 nt, Salmonella enterica enterica serovar Typhi
gaugacggcagcgcguu

SEQ ID NO: 1655834 - RNA, 20 nt, Salmonella enterica enterica serovar Typhi
gaugacgcuucgcuuauccg

SEQ ID NO: 1655835 - RNA, 19 nt, Salmonella enterica enterica serovar Typhi
gaugacggcaggggcguga

SEQ ID NO: 1655836 - RNA, 17 nt, Salmonella enterica enterica serovar Typhi
gaugacggcgcguuauc

SEQ ID NO: 1655837 - RNA, 20 nt, Salmonella enterica enterica serovar Typhi
gaugacgcugcgcuuauccg

SEQ ID NO: 1655838 - RNA, 21 nt, Salmonella enterica enterica serovar Typhi
gaugacgcuaacgcuuauccg

SEQ ID NO: 1655839 - RNA, 14 nt, Salmonella enterica enterica serovar Typhi
gaugauuuucaagc

SEQ ID NO: 1655840 - RNA, 18 nt, Salmonella enterica enterica serovar Typhi
gaugauggaacagacgcc

SEQ ID NO: 1655841 - RNA, 15 nt, Salmonella enterica enterica serovar Typhi
gaugauguucaucgc

SEQ ID NO: 1655842 - RNA, 23 nt, Salmonella enterica enterica serovar Typhi
gaugauguuugugaccccggccu

SEQ ID NO: 1655843 - RNA, 18 nt, Salmonella enterica enterica serovar Typhi
gaucuucguuggcgcugc

SEQ ID NO: 1655844 - RNA, 15 nt, Salmonella enterica enterica serovar Typhi
gaucucauaaacgcc

SEQ ID NO: 1655845 - RNA, 12 nt, Salmonella enterica enterica serovar Typhi
gaucucauacca

SEQ ID NO: 1655846 - RNA, 14 nt, Salmonella enterica enterica serovar Typhi
gaucguuuccagca

SEQ ID NO: 1655847 - RNA, 13 nt, Salmonella enterica enterica serovar Typhi
gaucgcgugucgg

SEQ ID NO: 1655848 - RNA, 13 nt, Salmonella enterica enterica serovar Typhi
gaucgcgcagcag

SEQ ID NO: 1655849 - RNA, 14 nt, Salmonella enterica enterica serovar Typhi
gaucgcgccagccu

SEQ ID NO: 1655850 - RNA, 22 nt, Salmonella enterica enterica serovar Typhi
gaucgcgcugcgcaggcguuuc

SEQ ID NO: 1655851 - RNA, 19 nt, Salmonella enterica enterica serovar Typhi
gaucgcgcugcgcaggcgu

SEQ ID NO: 1655852 - RNA, 12 nt, Salmonella enterica enterica serovar Typhi
gaucgccgguuu

SEQ ID NO: 1655853 - RNA, 14 nt, Salmonella enterica enterica serovar Typhi
gaucgaggucagca

SEQ ID NO: 1655854 - RNA, 20 nt, Salmonella enterica enterica serovar Typhi
gaucacggcgaaucgccugu

SEQ ID NO: 1655855 - RNA, 22 nt, Salmonella enterica enterica serovar Typhi
gauccccaucccaaucaggcuu

SEQ ID NO: 1655856 - RNA, 22 nt, Salmonella enterica enterica serovar Typhi
gaucccaggccggcauaaugau

SEQ ID NO: 1655857 - RNA, 17 nt, Salmonella enterica enterica serovar Typhi
gaucccaggccggcaua

SEQ ID NO: 1655858 - RNA, 13 nt, Salmonella enterica enterica serovar Typhi
gaucgacagcgcg

SEQ ID NO: 1655859 - RNA, 23 nt, Salmonella enterica enterica serovar Typhi
gauccccucuuccaucagccagg

SEQ ID NO: 1655860 - RNA, 11 nt, Salmonella enterica enterica serovar Typhi
gaugccagaug

SEQ ID NO: 1655861 - RNA, 13 nt, Salmonella enterica enterica serovar Typhi
gaugcccauacgg

SEQ ID NO: 1655862 - RNA, 14 nt, Salmonella enterica enterica serovar Typhi
gaugcgccagccag

SEQ ID NO: 1655863 - RNA, 15 nt, Salmonella enterica enterica serovar Typhi
gaugccgucgacgcc

SEQ ID NO: 1655864 - RNA, 22 nt, Salmonella enterica enterica serovar Typhi
gauggcggcuucgccuuauccg

SEQ ID NO: 1655865 - RNA, 23 nt, Salmonella enterica enterica serovar Typhi
gauggcggcuaacgccugauccg

SEQ ID NO: 1655866 - RNA, 21 nt, Salmonella enterica enterica serovar Typhi
gauggcggcugcgccuuauca

SEQ ID NO: 1655867 - RNA, 14 nt, Salmonella enterica enterica serovar Typhi
gauggcggcguaaa

SEQ ID NO: 1655868 - RNA, 19 nt, Salmonella enterica enterica serovar Typhi
gauggcgcuacgcuuaucg

SEQ ID NO: 1655869 - RNA, 20 nt, Salmonella enterica enterica serovar Typhi
gauggcgcuuugcuuauccg

SEQ ID NO: 1655870 - RNA, 19 nt, Salmonella enterica enterica serovar Typhi
gauggcgcugcgcuuauca

SEQ ID NO: 1655871 - RNA, 19 nt, Salmonella enterica enterica serovar Typhi
gauggcgcuucgcuuauca

SEQ ID NO: 1655872 - RNA, 20 nt, Salmonella enterica enterica serovar Typhi
gauggcgcuacgcuuaucag

SEQ ID NO: 1655873 - RNA, 20 nt, Salmonella enterica enterica serovar Typhi
gauggcgcuacgcuuauccg

SEQ ID NO: 1655874 - RNA, 15 nt, Salmonella enterica enterica serovar Typhi
gauggcgcuacguuu

SEQ ID NO: 1655875 - RNA, 18 nt, Salmonella enterica enterica serovar Typhi
gauggcgcuagcuuaucg

SEQ ID NO: 1655876 - RNA, 20 nt, Salmonella enterica enterica serovar Typhi
gaugcgcucacgcuuauccg

SEQ ID NO: 1655877 - RNA, 18 nt, Salmonella enterica enterica serovar Typhi
gaugcgcguuuagcgcca

SEQ ID NO: 1655878 - RNA, 14 nt, Salmonella enterica enterica serovar Typhi
gaugcggacgcuga

SEQ ID NO: 1655879 - RNA, 17 nt, Salmonella enterica enterica serovar Typhi
gaugcguaauccggccu

SEQ ID NO: 1655880 - RNA, 18 nt, Salmonella enterica enterica serovar Typhi
gaugcuguaggccggaug

SEQ ID NO: 1655881 - RNA, 22 nt, Salmonella enterica enterica serovar Typhi
gaugcugguuuuagcuuauccc

SEQ ID NO: 1655882 - RNA, 18 nt, Salmonella enterica enterica serovar Typhi
gcaaaaccagacgccgau

SEQ ID NO: 1655883 - RNA, 20 nt, Salmonella enterica enterica serovar Typhi
gauuggcuguuaguaagcug

SEQ ID NO: 1655884 - RNA, 21 nt, Salmonella enterica enterica serovar Typhi
gauuuggucagucggauaaac

SEQ ID NO: 1655885 - RNA, 19 nt, Salmonella enterica enterica serovar Typhi
gauuuuaucaagucgcguu

SEQ ID NO: 1655886 - RNA, 18 nt, Salmonella enterica enterica serovar Typhi
gauuuguaggccugauaa

SEQ ID NO: 1655887 - RNA, 13 nt, Salmonella enterica enterica serovar Typhi
gauuuuguuaugc

SEQ ID NO: 1655888 - RNA, 21 nt, Salmonella enterica enterica serovar Typhi
gauugagggggaggcggcgag

SEQ ID NO: 1655889 - RNA, 17 nt, Salmonella enterica enterica serovar Typhi
gauuggaucggcgcuga

SEQ ID NO: 1655890 - RNA, 15 nt, Salmonella enterica enterica serovar Typhi
gauuacccguuguua

SEQ ID NO: 1655891 - RNA, 18 nt, Salmonella enterica enterica serovar Typhi
gauucagcgcaggcaguu

SEQ ID NO: 1655892 - RNA, 20 nt, Salmonella enterica enterica serovar Typhi
gauuaauaauugagcgcaaa

SEQ ID NO: 1655893 - RNA, 17 nt, Salmonella enterica enterica serovar Typhi
gauuaagggacgguaaa

SEQ ID NO: 1655894 - RNA, 15 nt, Salmonella enterica enterica serovar Typhi
gaugucgccacgccg

SEQ ID NO: 1655895 - RNA, 20 nt, Salmonella enterica enterica serovar Typhi
gaugucgcuucgcuuaucug

SEQ ID NO: 1655896 - RNA, 14 nt, Salmonella enterica enterica serovar Typhi
gaugucggucauca

SEQ ID NO: 1655897 - RNA, 11 nt, Salmonella enterica enterica serovar Typhi
gaugucauccg

SEQ ID NO: 1655898 - RNA, 12 nt, Salmonella enterica enterica serovar Typhi
gaugucagaucc

SEQ ID NO: 1655899 - RNA, 18 nt, Salmonella enterica enterica serovar Typhi
gaugucaauuacgcacca

SEQ ID NO: 1655900 - RNA, 17 nt, Salmonella enterica enterica serovar Typhi
gauguccgcagccgcau

SEQ ID NO: 1655901 - RNA, 20 nt, Salmonella enterica enterica serovar Typhi
gauguccgccuugaggcguu

SEQ ID NO: 1655902 - RNA, 16 nt, Salmonella enterica enterica serovar Typhi
gaugguguuaccgcca

SEQ ID NO: 1655903 - RNA, 17 nt, Salmonella enterica enterica serovar Typhi
gcagccucguccugcaa

SEQ ID NO: 1655904 - RNA, 14 nt, Salmonella enterica enterica serovar Typhi
gcagcgccaucagg

SEQ ID NO: 1655905 - RNA, 15 nt, Salmonella enterica enterica serovar Typhi
gcagcgccauccggc

SEQ ID NO: 1655906 - RNA, 14 nt, Salmonella enterica enterica serovar Typhi
gcagcggcauuggc

SEQ ID NO: 1655907 - RNA, 21 nt, Salmonella enterica enterica serovar Typhi
gcagcgugguuuccggcagcu

SEQ ID NO: 1655908 - RNA, 21 nt, Salmonella enterica enterica serovar Typhi
gcagcggucaggggucagcgu

SEQ ID NO: 1655909 - RNA, 15 nt, Salmonella enterica enterica serovar Typhi
gcagcguauacgccg

SEQ ID NO: 1655910 - RNA, 15 nt, Salmonella enterica enterica serovar Typhi
gcagcucaagcgccg

SEQ ID NO: 1655911 - RNA, 20 nt, Salmonella enterica enterica serovar Typhi
gcagcucaagcgccgcgaua

SEQ ID NO: 1655912 - RNA, 14 nt, Salmonella enterica enterica serovar Typhi
gcagcucaucaaua

SEQ ID NO: 1655913 - RNA, 16 nt, Salmonella enterica enterica serovar Typhi
gcagcuccgcaauuuc

SEQ ID NO: 1655914 - RNA, 18 nt, Salmonella enterica enterica serovar Typhi
gcagcagaaucaggcaca

SEQ ID NO: 1655915 - RNA, 22 nt, Salmonella enterica enterica serovar Typhi
gcagccagaaaaagggaaaagc

SEQ ID NO: 1655916 - RNA, 17 nt, Salmonella enterica enterica serovar Typhi
gcagaggccugaaugca

SEQ ID NO: 1655917 - RNA, 15 nt, Salmonella enterica enterica serovar Typhi
gcagauaacuuccuu

SEQ ID NO: 1655918 - RNA, 22 nt, Salmonella enterica enterica serovar Typhi
gcagauaucuuccagcgcgucc

SEQ ID NO: 1655919 - RNA, 22 nt, Salmonella enterica enterica serovar Typhi
gcagaucuuuuugcuccugcgc

SEQ ID NO: 1655920 - RNA, 15 nt, Salmonella enterica enterica serovar Typhi
gcagaucugucgcca

SEQ ID NO: 1655921 - RNA, 13 nt, Salmonella enterica enterica serovar Typhi
gcagcaccggcau

SEQ ID NO: 1655922 - RNA, 15 nt, Salmonella enterica enterica serovar Typhi
gcaggacagcgacau

SEQ ID NO: 1655923 - RNA, 15 nt, Salmonella enterica enterica serovar Typhi
gcagcuuaaagccaa

SEQ ID NO: 1655924 - RNA, 17 nt, Salmonella enterica enterica serovar Typhi
gcaggcuggagagcaac

SEQ ID NO: 1655925 - RNA, 20 nt, Salmonella enterica enterica serovar Typhi
gcaggcuuccacgcacgccg

SEQ ID NO: 1655926 - RNA, 17 nt, Salmonella enterica enterica serovar Typhi
gcaggcuuccacgcacg

SEQ ID NO: 1655927 - RNA, 21 nt, Salmonella enterica enterica serovar Typhi
gcaggcgaccucgcagguacg

SEQ ID NO: 1655928 - RNA, 18 nt, Salmonella enterica enterica serovar Typhi
gcaggccuuucggcagcg

SEQ ID NO: 1655929 - RNA, 23 nt, Salmonella enterica enterica serovar Typhi
gcaggcaauauaccgucaguacc

SEQ ID NO: 1655930 - RNA, 21 nt, Salmonella enterica enterica serovar Typhi
gcaucauccccaccgcugaug

SEQ ID NO: 1655931 - RNA, 21 nt, Salmonella enterica enterica serovar Typhi
gcaucaucucccaggccgcca

SEQ ID NO: 1655932 - RNA, 11 nt, Salmonella enterica enterica serovar Typhi
gcaucaucaaa

SEQ ID NO: 1655933 - RNA, 15 nt, Salmonella enterica enterica serovar Typhi
gcaucauauucgcag

SEQ ID NO: 1655934 - RNA, 17 nt, Salmonella enterica enterica serovar Typhi
gcauccagcacgagcgc

SEQ ID NO: 1655935 - RNA, 16 nt, Salmonella enterica enterica serovar Typhi
gcaucagacuguuacg

SEQ ID NO: 1655936 - RNA, 12 nt, Salmonella enterica enterica serovar Typhi
gcauauuaacag

SEQ ID NO: 1655937 - RNA, 22 nt, Salmonella enterica enterica serovar Typhi
gcaucaacguuguccagcggcc

SEQ ID NO: 1655938 - RNA, 14 nt, Salmonella enterica enterica serovar Typhi
gcauauuuagccca

SEQ ID NO: 1655939 - RNA, 17 nt, Salmonella enterica enterica serovar Typhi
gcauaucgauagcaucg

SEQ ID NO: 1655940 - RNA, 12 nt, Salmonella enterica enterica serovar Typhi
gcauaucgccgc

SEQ ID NO: 1655941 - RNA, 12 nt, Salmonella enterica enterica serovar Typhi
gcauaucgccgu

SEQ ID NO: 1655942 - RNA, 23 nt, Salmonella enterica enterica serovar Typhi
gcauacucuuggagagcaucauc

SEQ ID NO: 1655943 - RNA, 15 nt, Salmonella enterica enterica serovar Typhi
gcauacuaccgcugc

SEQ ID NO: 1655944 - RNA, 22 nt, Salmonella enterica enterica serovar Typhi
gcauaguccugccgacaggcag

SEQ ID NO: 1655945 - RNA, 16 nt, Salmonella enterica enterica serovar Typhi
gcauacugcgaugcgc

SEQ ID NO: 1655946 - RNA, 17 nt, Salmonella enterica enterica serovar Typhi
gcauacugcgaugcgcu

SEQ ID NO: 1655947 - RNA, 14 nt, Salmonella enterica enterica serovar Typhi
gcauacguuucacc

SEQ ID NO: 1655948 - RNA, 21 nt, Salmonella enterica enterica serovar Typhi
gcaguucaucuucccgcagau

SEQ ID NO: 1655949 - RNA, 15 nt, Salmonella enterica enterica serovar Typhi
gcagugaccagcauc

SEQ ID NO: 1655950 - RNA, 17 nt, Salmonella enterica enterica serovar Typhi
gcagugaagaauggcgc

SEQ ID NO: 1655951 - RNA, 18 nt, Salmonella enterica enterica serovar Typhi
gcagucguuuacgcgcuu

SEQ ID NO: 1655952 - RNA, 16 nt, Salmonella enterica enterica serovar Typhi
gcagugaaccaucggc

SEQ ID NO: 1655953 - RNA, 17 nt, Salmonella enterica enterica serovar Typhi
gcaguccuugcagccag

SEQ ID NO: 1655954 - RNA, 17 nt, Salmonella enterica enterica serovar Typhi
gcaggggcuccugcgcc

SEQ ID NO: 1655955 - RNA, 18 nt, Salmonella enterica enterica serovar Typhi
gcaggguaucaucgcuua

SEQ ID NO: 1655956 - RNA, 14 nt, Salmonella enterica enterica serovar Typhi
gcaguacgcgcaac

SEQ ID NO: 1655957 - RNA, 12 nt, Salmonella enterica enterica serovar Typhi
gcaccagaccga

SEQ ID NO: 1655958 - RNA, 18 nt, Salmonella enterica enterica serovar Typhi
gcacauucagcagcgccc

SEQ ID NO: 1655959 - RNA, 13 nt, Salmonella enterica enterica serovar Typhi
gcacauucagcag

SEQ ID NO: 1655960 - RNA, 16 nt, Salmonella enterica enterica serovar Typhi
gcacaugacggcugac

SEQ ID NO: 1655961 - RNA, 19 nt, Salmonella enterica enterica serovar Typhi
gcacaugacggcugacgca

SEQ ID NO: 1655962 - RNA, 13 nt, Salmonella enterica enterica serovar Typhi
gcacauuagcaau

SEQ ID NO: 1655963 - RNA, 18 nt, Salmonella enterica enterica serovar Typhi
gcacauguuucagcaccu

SEQ ID NO: 1655964 - RNA, 15 nt, Salmonella enterica enterica serovar Typhi
gcaccagcauuagcg

SEQ ID NO: 1655965 - RNA, 17 nt, Salmonella enterica enterica serovar Typhi
gcaccagcaggugguac

SEQ ID NO: 1655966 - RNA, 16 nt, Salmonella enterica enterica serovar Typhi
gcaccaguuccccaua

SEQ ID NO: 1655967 - RNA, 13 nt, Salmonella enterica enterica serovar Typhi
gcaccaguugcgu

SEQ ID NO: 1655968 - RNA, 18 nt, Salmonella enterica enterica serovar Typhi
gcaccaucuuuuccggca

SEQ ID NO: 1655969 - RNA, 12 nt, Salmonella enterica enterica serovar Typhi
gcacaucagccg

SEQ ID NO: 1655970 - RNA, 16 nt, Salmonella enterica enterica serovar Typhi
gcacacgcagcugaug

SEQ ID NO: 1655971 - RNA, 17 nt, Salmonella enterica enterica serovar Typhi
gcacacuuucaucagcc

SEQ ID NO: 1655972 - RNA, 16 nt, Salmonella enterica enterica serovar Typhi
gcacagccccagcacc

SEQ ID NO: 1655973 - RNA, 23 nt, Salmonella enterica enterica serovar Typhi
gcaauagcgacguuaucucgcca

SEQ ID NO: 1655974 - RNA, 15 nt, Salmonella enterica enterica serovar Typhi
gcaauagcgcgucgu

SEQ ID NO: 1655975 - RNA, 23 nt, Salmonella enterica enterica serovar Typhi
gcaauagguuugaccagauaauc

SEQ ID NO: 1655976 - RNA, 19 nt, Salmonella enterica enterica serovar Typhi
gcaauacuguaagccucgc

SEQ ID NO: 1655977 - RNA, 18 nt, Salmonella enterica enterica serovar Typhi
gcaaucacauacagcacu

SEQ ID NO: 1655978 - RNA, 18 nt, Salmonella enterica enterica serovar Typhi
gcaauauuguuaaccagg

SEQ ID NO: 1655979 - RNA, 15 nt, Salmonella enterica enterica serovar Typhi
gcaaucaccugcauc

SEQ ID NO: 1655980 - RNA, 22 nt, Salmonella enterica enterica serovar Typhi
gcaauauuaaugucaugcgcca

SEQ ID NO: 1655981 - RNA, 15 nt, Salmonella enterica enterica serovar Typhi
gcaaucacgcguuau

SEQ ID NO: 1655982 - RNA, 20 nt, Salmonella enterica enterica serovar Typhi
gcaauauuaaugucaugcgc

SEQ ID NO: 1655983 - RNA, 18 nt, Salmonella enterica enterica serovar Typhi
gcaauaugcggcgccauc

SEQ ID NO: 1655984 - RNA, 13 nt, Salmonella enterica enterica serovar Typhi
gcaauaauccgcu

SEQ ID NO: 1655985 - RNA, 13 nt, Salmonella enterica enterica serovar Typhi
gcaaacgguuaau

SEQ ID NO: 1655986 - RNA, 16 nt, Salmonella enterica enterica serovar Typhi
gcaaacuauguacgcc

SEQ ID NO: 1655987 - RNA, 16 nt, Salmonella enterica enterica serovar Typhi
gcaauaccaauuaccg

SEQ ID NO: 1655988 - RNA, 15 nt, Salmonella enterica enterica serovar Typhi
gcaaaccuuccgcca

SEQ ID NO: 1655989 - RNA, 21 nt, Salmonella enterica enterica serovar Typhi
gcaaacgccgaagccagcgca

SEQ ID NO: 1655990 - RNA, 17 nt, Salmonella enterica enterica serovar Typhi
gcaaaccuaccggcaua

SEQ ID NO: 1655991 - RNA, 15 nt, Salmonella enterica enterica serovar Typhi
gcaaacgacgcugac

SEQ ID NO: 1655992 - RNA, 16 nt, Salmonella enterica enterica serovar Typhi
gcaaacgccugcuccg

SEQ ID NO: 1655993 - RNA, 12 nt, Salmonella enterica enterica serovar Typhi
gcaaacgcggcg

SEQ ID NO: 1655994 - RNA, 17 nt, Salmonella enterica enterica serovar Typhi
gcaaacgcggcgccagc

SEQ ID NO: 1655995 - RNA, 20 nt, Salmonella enterica enterica serovar Typhi
gcaaacggcacuacagcccu

SEQ ID NO: 1655996 - RNA, 13 nt, Salmonella enterica enterica serovar Typhi
gcaaacgcgauac

SEQ ID NO: 1655997 - RNA, 15 nt, Salmonella enterica enterica serovar Typhi
gcaaacggcuggaua

SEQ ID NO: 1655998 - RNA, 24 nt, Salmonella enterica enterica serovar Typhi
gcaaugucaucguuugcgcuacgc

SEQ ID NO: 1655999 - RNA, 16 nt, Salmonella enterica enterica serovar Typhi
gcaauguggacaauca

SEQ ID NO: 1656000 - RNA, 17 nt, Salmonella enterica enterica serovar Typhi
gcaauuuuaacgcaacc

SEQ ID NO: 1656001 - RNA, 23 nt, Salmonella enterica enterica serovar Typhi
gcacaacacgcuuuucagcgcca

SEQ ID NO: 1656002 - RNA, 16 nt, Salmonella enterica enterica serovar Typhi
gcaaugccgccgccag

SEQ ID NO: 1656003 - RNA, 14 nt, Salmonella enterica enterica serovar Typhi
gcaaucgccucauc

SEQ ID NO: 1656004 - RNA, 22 nt, Salmonella enterica enterica serovar Typhi
gcaaucacguuuugcagcgcca

SEQ ID NO: 1656005 - RNA, 16 nt, Salmonella enterica enterica serovar Typhi
gcaaucacuuccgccu

SEQ ID NO: 1656006 - RNA, 19 nt, Salmonella enterica enterica serovar Typhi
gcaaucacuuccgccucgc

SEQ ID NO: 1656007 - RNA, 14 nt, Salmonella enterica enterica serovar Typhi
gcacgccgcguuuu

SEQ ID NO: 1656008 - RNA, 12 nt, Salmonella enterica enterica serovar Typhi
gcacgccagcgc

SEQ ID NO: 1656009 - RNA, 18 nt, Salmonella enterica enterica serovar Typhi
gcacuccccggcuugcgg

SEQ ID NO: 1656010 - RNA, 21 nt, Salmonella enterica enterica serovar Typhi
gcacuccggcucgcacauauc

SEQ ID NO: 1656011 - RNA, 16 nt, Salmonella enterica enterica serovar Typhi
gcacguccagauacgc

SEQ ID NO: 1656012 - RNA, 23 nt, Salmonella enterica enterica serovar Typhi
gcacgcuccugcuccugcggcgu

SEQ ID NO: 1656013 - RNA, 18 nt, Salmonella enterica enterica serovar Typhi
gcaccguaggccugauaa

SEQ ID NO: 1656014 - RNA, 19 nt, Salmonella enterica enterica serovar Typhi
gcaccgucgagaaaccgcu

SEQ ID NO: 1656015 - RNA, 13 nt, Salmonella enterica enterica serovar Typhi
gcaccgccgcauc

SEQ ID NO: 1656016 - RNA, 16 nt, Salmonella enterica enterica serovar Typhi
gcaccgaaacagcacg

SEQ ID NO: 1656017 - RNA, 13 nt, Salmonella enterica enterica serovar Typhi
gccgccugaugcu

SEQ ID NO: 1656018 - RNA, 13 nt, Salmonella enterica enterica serovar Typhi
gccgccugcgcca

SEQ ID NO: 1656019 - RNA, 19 nt, Salmonella enterica enterica serovar Typhi
gccgccugcgccagcgccg

SEQ ID NO: 1656020 - RNA, 16 nt, Salmonella enterica enterica serovar Typhi
gccgcgcccagcgccg

SEQ ID NO: 1656021 - RNA, 11 nt, Salmonella enterica enterica serovar Typhi
gccgccagcgu

SEQ ID NO: 1656022 - RNA, 19 nt, Salmonella enterica enterica serovar Typhi
gccgccagcucaugcgcgg

SEQ ID NO: 1656023 - RNA, 17 nt, Salmonella enterica enterica serovar Typhi
gccgccaucgcugacga

SEQ ID NO: 1656024 - RNA, 12 nt, Salmonella enterica enterica serovar Typhi
gccgccauccgg

SEQ ID NO: 1656025 - RNA, 13 nt, Salmonella enterica enterica serovar Typhi
gccgccauccggc

SEQ ID NO: 1656026 - RNA, 14 nt, Salmonella enterica enterica serovar Typhi
gccgccauccggca

SEQ ID NO: 1656027 - RNA, 16 nt, Salmonella enterica enterica serovar Typhi
gccgccauccggcaaa

SEQ ID NO: 1656028 - RNA, 16 nt, Salmonella enterica enterica serovar Typhi
gccgccauccggcaac

SEQ ID NO: 1656029 - RNA, 16 nt, Salmonella enterica enterica serovar Typhi
gccgccauccggcauu

SEQ ID NO: 1656030 - RNA, 16 nt, Salmonella enterica enterica serovar Typhi
gccgccauccggccug

SEQ ID NO: 1656031 - RNA, 16 nt, Salmonella enterica enterica serovar Typhi
gccgccaucuccggca

SEQ ID NO: 1656032 - RNA, 14 nt, Salmonella enterica enterica serovar Typhi
gccgcuggcgucuu

SEQ ID NO: 1656033 - RNA, 18 nt, Salmonella enterica enterica serovar Typhi
gccgcugggauucggcaa

SEQ ID NO: 1656034 - RNA, 21 nt, Salmonella enterica enterica serovar Typhi
gccgcuuuaaucaccauggcg

SEQ ID NO: 1656035 - RNA, 17 nt, Salmonella enterica enterica serovar Typhi
gccggacuguugaugau

SEQ ID NO: 1656036 - RNA, 15 nt, Salmonella enterica enterica serovar Typhi
gccggagucgacggc

SEQ ID NO: 1656037 - RNA, 21 nt, Salmonella enterica enterica serovar Typhi
gccggacgcggcuuauccggc

SEQ ID NO: 1656038 - RNA, 15 nt, Salmonella enterica enterica serovar Typhi
gccgcuuuaccgccu

SEQ ID NO: 1656039 - RNA, 16 nt, Salmonella enterica enterica serovar Typhi
gccggauaagagaauc

SEQ ID NO: 1656040 - RNA, 14 nt, Salmonella enterica enterica serovar Typhi
gccggauaagcgca

SEQ ID NO: 1656041 - RNA, 16 nt, Salmonella enterica enterica serovar Typhi
gccggauaagcgcagc

SEQ ID NO: 1656042 - RNA, 20 nt, Salmonella enterica enterica serovar Typhi
gccggauaagcgcagcgcca

SEQ ID NO: 1656043 - RNA, 19 nt, Salmonella enterica enterica serovar Typhi
gccggauaagacgcuacgc

SEQ ID NO: 1656044 - RNA, 18 nt, Salmonella enterica enterica serovar Typhi
gccggaucgggcuuccag

SEQ ID NO: 1656045 - RNA, 20 nt, Salmonella enterica enterica serovar Typhi
gccgcucaucaccagcagca

SEQ ID NO: 1656046 - RNA, 13 nt, Salmonella enterica enterica serovar Typhi
gccgacaucacgc

SEQ ID NO: 1656047 - RNA, 20 nt, Salmonella enterica enterica serovar Typhi
gccgacaucgcucccggcac

SEQ ID NO: 1656048 - RNA, 23 nt, Salmonella enterica enterica serovar Typhi
gccgaccccaugacggccugcgc

SEQ ID NO: 1656049 - RNA, 16 nt, Salmonella enterica enterica serovar Typhi
gccgacgaccggcagc

SEQ ID NO: 1656050 - RNA, 12 nt, Salmonella enterica enterica serovar Typhi
gccgacucacgc

SEQ ID NO: 1656051 - RNA, 15 nt, Salmonella enterica enterica serovar Typhi
gccgacucgcgcaau

SEQ ID NO: 1656052 - RNA, 14 nt, Salmonella enterica enterica serovar Typhi
gccgacgcauccgc

SEQ ID NO: 1656053 - RNA, 15 nt, Salmonella enterica enterica serovar Typhi
gccgacgcauccgcc

SEQ ID NO: 1656054 - RNA, 21 nt, Salmonella enterica enterica serovar Typhi
gccgcaauugguaauuaaagg

SEQ ID NO: 1656055 - RNA, 17 nt, Salmonella enterica enterica serovar Typhi
gccgcacaccagcgcau

SEQ ID NO: 1656056 - RNA, 23 nt, Salmonella enterica enterica serovar Typhi
gccgaguccgaggcgaaacggcg

SEQ ID NO: 1656057 - RNA, 14 nt, Salmonella enterica enterica serovar Typhi
gccgauacugccca

SEQ ID NO: 1656058 - RNA, 12 nt, Salmonella enterica enterica serovar Typhi
gccgaucaggcc

SEQ ID NO: 1656059 - RNA, 16 nt, Salmonella enterica enterica serovar Typhi
gccgaucaccagcgca

SEQ ID NO: 1656060 - RNA, 14 nt, Salmonella enterica enterica serovar Typhi
gccgaucaucccgc

SEQ ID NO: 1656061 - RNA, 19 nt, Salmonella enterica enterica serovar Typhi
gcccucuaagcgcucaaau

SEQ ID NO: 1656062 - RNA, 20 nt, Salmonella enterica enterica serovar Typhi
gcccugaaagccgacccgca

SEQ ID NO: 1656063 - RNA, 22 nt, Salmonella enterica enterica serovar Typhi
gcccugcgguagcuccagacag

SEQ ID NO: 1656064 - RNA, 13 nt, Salmonella enterica enterica serovar Typhi
gcccguuccaggc

SEQ ID NO: 1656065 - RNA, 19 nt, Salmonella enterica enterica serovar Typhi
gcccgguggcgccacgcca

SEQ ID NO: 1656066 - RNA, 16 nt, Salmonella enterica enterica serovar Typhi
gcccgccucgcugaua

SEQ ID NO: 1656067 - RNA, 15 nt, Salmonella enterica enterica serovar Typhi
gcccgguuacgcuuc

SEQ ID NO: 1656068 - RNA, 18 nt, Salmonella enterica enterica serovar Typhi
gcccguagauaagcgcca

SEQ ID NO: 1656069 - RNA, 14 nt, Salmonella enterica enterica serovar Typhi
gcccuguuauucag

SEQ ID NO: 1656070 - RNA, 17 nt, Salmonella enterica enterica serovar Typhi
gcccuguccuccauggc

SEQ ID NO: 1656071 - RNA, 23 nt, Salmonella enterica enterica serovar Typhi
gcccuggaggaacagcgccguca

SEQ ID NO: 1656072 - RNA, 20 nt, Salmonella enterica enterica serovar Typhi
gcccuucgaccgucagcagc

SEQ ID NO: 1656073 - RNA, 19 nt, Salmonella enterica enterica serovar Typhi
gcccuucacaaccaucguc

SEQ ID NO: 1656074 - RNA, 23 nt, Salmonella enterica enterica serovar Typhi
gcccuguggaaacuccagcggca

SEQ ID NO: 1656075 - RNA, 17 nt, Salmonella enterica enterica serovar Typhi
gccgaacaguuucucgc

SEQ ID NO: 1656076 - RNA, 19 nt, Salmonella enterica enterica serovar Typhi
gcccuuuuuuguugugaua

SEQ ID NO: 1656077 - RNA, 16 nt, Salmonella enterica enterica serovar Typhi
gccgaacuuacgguaa

SEQ ID NO: 1656078 - RNA, 17 nt, Salmonella enterica enterica serovar Typhi
gccccccuaccggaauc

SEQ ID NO: 1656079 - RNA, 14 nt, Salmonella enterica enterica serovar Typhi
gccccaucacggga

SEQ ID NO: 1656080 - RNA, 17 nt, Salmonella enterica enterica serovar Typhi
gcccccgaucacggcga

SEQ ID NO: 1656081 - RNA, 12 nt, Salmonella enterica enterica serovar Typhi
gccccagacgcc

SEQ ID NO: 1656082 - RNA, 19 nt, Salmonella enterica enterica serovar Typhi
gcccauaccccacgccaua

SEQ ID NO: 1656083 - RNA, 21 nt, Salmonella enterica enterica serovar Typhi
gcccaguuucaucaucgccga

SEQ ID NO: 1656084 - RNA, 18 nt, Salmonella enterica enterica serovar Typhi
gcccaucaucaucggcac

SEQ ID NO: 1656085 - RNA, 21 nt, Salmonella enterica enterica serovar Typhi
gcccaucgccacagcggaaua

SEQ ID NO: 1656086 - RNA, 14 nt, Salmonella enterica enterica serovar Typhi
gcccauauccagcu

SEQ ID NO: 1656087 - RNA, 14 nt, Salmonella enterica enterica serovar Typhi
gcccaucagcgcca

SEQ ID NO: 1656088 - RNA, 12 nt, Salmonella enterica enterica serovar Typhi
gcccgauagcgu

SEQ ID NO: 1656089 - RNA, 19 nt, Salmonella enterica enterica serovar Typhi
gcccgauaagcaagcgcca

SEQ ID NO: 1656090 - RNA, 23 nt, Salmonella enterica enterica serovar Typhi
gccccgguggcgguaccggcauu

SEQ ID NO: 1656091 - RNA, 16 nt, Salmonella enterica enterica serovar Typhi
gccccucuugcagcaa

SEQ ID NO: 1656092 - RNA, 22 nt, Salmonella enterica enterica serovar Typhi
gccauacagguuuuaaucguuu

SEQ ID NO: 1656093 - RNA, 21 nt, Salmonella enterica enterica serovar Typhi
gccaguuuuccgccugaaucg

SEQ ID NO: 1656094 - RNA, 21 nt, Salmonella enterica enterica serovar Typhi
gccauaaaucagauccacgcc

SEQ ID NO: 1656095 - RNA, 13 nt, Salmonella enterica enterica serovar Typhi
gccauccggcaca

SEQ ID NO: 1656096 - RNA, 16 nt, Salmonella enterica enterica serovar Typhi
gccauacuuacugcug

SEQ ID NO: 1656097 - RNA, 15 nt, Salmonella enterica enterica serovar Typhi
gccauccggcgcuga

SEQ ID NO: 1656098 - RNA, 18 nt, Salmonella enterica enterica serovar Typhi
gccauccggcaucucuuc

SEQ ID NO: 1656099 - RNA, 13 nt, Salmonella enterica enterica serovar Typhi
gccauccggcauu

SEQ ID NO: 1656100 - RNA, 16 nt, Salmonella enterica enterica serovar Typhi
gccauccugcgugccg

SEQ ID NO: 1656101 - RNA, 15 nt, Salmonella enterica enterica serovar Typhi
gccaucgacagcgcc

SEQ ID NO: 1656102 - RNA, 22 nt, Salmonella enterica enterica serovar Typhi
gccaucuccaucauuuccggcg

SEQ ID NO: 1656103 - RNA, 17 nt, Salmonella enterica enterica serovar Typhi
gccaucugcuccggcgu

SEQ ID NO: 1656104 - RNA, 17 nt, Salmonella enterica enterica serovar Typhi
gccaucuccaucauuuc

SEQ ID NO: 1656105 - RNA, 14 nt, Salmonella enterica enterica serovar Typhi
gccaucguccagcc

SEQ ID NO: 1656106 - RNA, 16 nt, Salmonella enterica enterica serovar Typhi
gccaucgacagcgcca

SEQ ID NO: 1656107 - RNA, 16 nt, Salmonella enterica enterica serovar Typhi
gccaugaugagcgcca

SEQ ID NO: 1656108 - RNA, 14 nt, Salmonella enterica enterica serovar Typhi
gccagucgcagaug

SEQ ID NO: 1656109 - RNA, 18 nt, Salmonella enterica enterica serovar Typhi
gccaguacagcagcgacg

SEQ ID NO: 1656110 - RNA, 18 nt, Salmonella enterica enterica serovar Typhi
gccaguagauggcgcuaa

SEQ ID NO: 1656111 - RNA, 14 nt, Salmonella enterica enterica serovar Typhi
gccagguugccaga

SEQ ID NO: 1656112 - RNA, 18 nt, Salmonella enterica enterica serovar Typhi
gccaguaacucaucgcca

SEQ ID NO: 1656113 - RNA, 15 nt, Salmonella enterica enterica serovar Typhi
gccaguuuuccgccu

SEQ ID NO: 1656114 - RNA, 19 nt, Salmonella enterica enterica serovar Typhi
gccaguuuacgcguacucg

SEQ ID NO: 1656115 - RNA, 14 nt, Salmonella enterica enterica serovar Typhi
gccaguucacgccg

SEQ ID NO: 1656116 - RNA, 18 nt, Salmonella enterica enterica serovar Typhi
gccaguuagcgaucgcgc

SEQ ID NO: 1656117 - RNA, 21 nt, Salmonella enterica enterica serovar Typhi
gccagucguaguggaucagca

SEQ ID NO: 1656118 - RNA, 17 nt, Salmonella enterica enterica serovar Typhi
gccaugcuauucagcag

SEQ ID NO: 1656119 - RNA, 12 nt, Salmonella enterica enterica serovar Typhi
gcccaccgcaua

SEQ ID NO: 1656120 - RNA, 18 nt, Salmonella enterica enterica serovar Typhi
gcccagcacuaacagcag

SEQ ID NO: 1656121 - RNA, 15 nt, Salmonella enterica enterica serovar Typhi
gcccagcagcugcug

SEQ ID NO: 1656122 - RNA, 14 nt, Salmonella enterica enterica serovar Typhi
gcccagaucaggcc

SEQ ID NO: 1656123 - RNA, 22 nt, Salmonella enterica enterica serovar Typhi
gccacggauggccucugccagu

SEQ ID NO: 1656124 - RNA, 16 nt, Salmonella enterica enterica serovar Typhi
gccacgccgccauccg

SEQ ID NO: 1656125 - RNA, 23 nt, Salmonella enterica enterica serovar Typhi
gccacgccccuaaggcagcaagg

SEQ ID NO: 1656126 - RNA, 14 nt, Salmonella enterica enterica serovar Typhi
gccacggcaacgcc

SEQ ID NO: 1656127 - RNA, 21 nt, Salmonella enterica enterica serovar Typhi
gccacuuaccaaucgcggcga

SEQ ID NO: 1656128 - RNA, 16 nt, Salmonella enterica enterica serovar Typhi
gccagcacggcuucac

SEQ ID NO: 1656129 - RNA, 13 nt, Salmonella enterica enterica serovar Typhi
gccagcagccauu

SEQ ID NO: 1656130 - RNA, 17 nt, Salmonella enterica enterica serovar Typhi
gccagcagcagcgcaau

SEQ ID NO: 1656131 - RNA, 21 nt, Salmonella enterica enterica serovar Typhi
gccagcacgaggguaauggcu

SEQ ID NO: 1656132 - RNA, 17 nt, Salmonella enterica enterica serovar Typhi
gccagcaacguuaaggc

SEQ ID NO: 1656133 - RNA, 18 nt, Salmonella enterica enterica serovar Typhi
gccagauaccgugaugcg

SEQ ID NO: 1656134 - RNA, 22 nt, Salmonella enterica enterica serovar Typhi
gccagauggaaaccggcgucuu

SEQ ID NO: 1656135 - RNA, 23 nt, Salmonella enterica enterica serovar Typhi
gccagauuuuccaggccgccagc

SEQ ID NO: 1656136 - RNA, 15 nt, Salmonella enterica enterica serovar Typhi
gccagauagcgucuu

SEQ ID NO: 1656137 - RNA, 18 nt, Salmonella enterica enterica serovar Typhi
gccagagaucgcacuacc

SEQ ID NO: 1656138 - RNA, 14 nt, Salmonella enterica enterica serovar Typhi
gccacuuccagcgc

SEQ ID NO: 1656139 - RNA, 23 nt, Salmonella enterica enterica serovar Typhi
gccacuuccagcgcgccgucauc

SEQ ID NO: 1656140 - RNA, 15 nt, Salmonella enterica enterica serovar Typhi
gccagcgggcgucga

SEQ ID NO: 1656141 - RNA, 14 nt, Salmonella enterica enterica serovar Typhi
gccagcucaaauga

SEQ ID NO: 1656142 - RNA, 21 nt, Salmonella enterica enterica serovar Typhi
gccagccgauuuuucggcacg

SEQ ID NO: 1656143 - RNA, 16 nt, Salmonella enterica enterica serovar Typhi
gccagccuaucgccau

SEQ ID NO: 1656144 - RNA, 14 nt, Salmonella enterica enterica serovar Typhi
gccagcgccagcgu

SEQ ID NO: 1656145 - RNA, 22 nt, Salmonella enterica enterica serovar Typhi
gccagcagcguuuugcgcguaa

SEQ ID NO: 1656146 - RNA, 13 nt, Salmonella enterica enterica serovar Typhi
gccagcagcgcac

SEQ ID NO: 1656147 - RNA, 13 nt, Salmonella enterica enterica serovar Typhi
gccacaaacugcg

SEQ ID NO: 1656148 - RNA, 15 nt, Salmonella enterica enterica serovar Typhi
gccacaacguugacc

SEQ ID NO: 1656149 - RNA, 20 nt, Salmonella enterica enterica serovar Typhi
gccaaucaccgccagcaacg

SEQ ID NO: 1656150 - RNA, 19 nt, Salmonella enterica enterica serovar Typhi
gccaaugaacucgccucgc

SEQ ID NO: 1656151 - RNA, 13 nt, Salmonella enterica enterica serovar Typhi
gccacaucguuac

SEQ ID NO: 1656152 - RNA, 19 nt, Salmonella enterica enterica serovar Typhi
gccacagccauccgacgcc

SEQ ID NO: 1656153 - RNA, 15 nt, Salmonella enterica enterica serovar Typhi
gccaccacauaccgu

SEQ ID NO: 1656154 - RNA, 15 nt, Salmonella enterica enterica serovar Typhi
gccacagcgccagac

SEQ ID NO: 1656155 - RNA, 18 nt, Salmonella enterica enterica serovar Typhi
gccacaggcggcaugggu

SEQ ID NO: 1656156 - RNA, 21 nt, Salmonella enterica enterica serovar Typhi
gccacaggaaccgguagccag

SEQ ID NO: 1656157 - RNA, 18 nt, Salmonella enterica enterica serovar Typhi
gccacagccauccgacgc

SEQ ID NO: 1656158 - RNA, 21 nt, Salmonella enterica enterica serovar Typhi
gcauccauauaagcgguauuc

SEQ ID NO: 1656159 - RNA, 18 nt, Salmonella enterica enterica serovar Typhi
gccaacuuuuugcgcaau

SEQ ID NO: 1656160 - RNA, 14 nt, Salmonella enterica enterica serovar Typhi
gccaagaucgccaa

SEQ ID NO: 1656161 - RNA, 18 nt, Salmonella enterica enterica serovar Typhi
gcauccuuaugcagaaau

SEQ ID NO: 1656162 - RNA, 21 nt, Salmonella enterica enterica serovar Typhi
gccaagcggcaucucgccaaa

SEQ ID NO: 1656163 - RNA, 22 nt, Salmonella enterica enterica serovar Typhi
gccaagcggcaucucgccaaac

SEQ ID NO: 1656164 - RNA, 16 nt, Salmonella enterica enterica serovar Typhi
gccaagcgcggcagca

SEQ ID NO: 1656165 - RNA, 16 nt, Salmonella enterica enterica serovar Typhi
gccaagcggcaacucu

SEQ ID NO: 1656166 - RNA, 14 nt, Salmonella enterica enterica serovar Typhi
gccaagcugcaaua

SEQ ID NO: 1656167 - RNA, 24 nt, Salmonella enterica enterica serovar Typhi
gccaagcgccuguucaacaugcug

SEQ ID NO: 1656168 - RNA, 17 nt, Salmonella enterica enterica serovar Typhi
gccaagcgcggacagca

SEQ ID NO: 1656169 - RNA, 19 nt, Salmonella enterica enterica serovar Typhi
gccaaucgccgccgccaga

SEQ ID NO: 1656170 - RNA, 19 nt, Salmonella enterica enterica serovar Typhi
gccaaucaacgccgccagg

SEQ ID NO: 1656171 - RNA, 19 nt, Salmonella enterica enterica serovar Typhi
gccaccacgccgagaaaca

SEQ ID NO: 1656172 - RNA, 13 nt, Salmonella enterica enterica serovar Typhi
gccaccagcgcca

SEQ ID NO: 1656173 - RNA, 14 nt, Salmonella enterica enterica serovar Typhi
gccaccaucacuac

SEQ ID NO: 1656174 - RNA, 19 nt, Salmonella enterica enterica serovar Typhi
gccaccaucgucgccagac

SEQ ID NO: 1656175 - RNA, 11 nt, Salmonella enterica enterica serovar Typhi
gaccgccauaa

SEQ ID NO: 1656176 - RNA, 14 nt, Salmonella enterica enterica serovar Typhi
gaccgccagcagag

SEQ ID NO: 1656177 - RNA, 14 nt, Salmonella enterica enterica serovar Typhi
gaccaccgccauau

SEQ ID NO: 1656178 - RNA, 16 nt, Salmonella enterica enterica serovar Typhi
gaccauugauuuccgc

SEQ ID NO: 1656179 - RNA, 15 nt, Salmonella enterica enterica serovar Typhi
gacccacagccgguu

SEQ ID NO: 1656180 - RNA, 12 nt, Salmonella enterica enterica serovar Typhi
gacccagacaaa

SEQ ID NO: 1656181 - RNA, 20 nt, Salmonella enterica enterica serovar Typhi
gacccauacucuuucccggc

SEQ ID NO: 1656182 - RNA, 13 nt, Salmonella enterica enterica serovar Typhi
gaccuccgcguac

SEQ ID NO: 1656183 - RNA, 17 nt, Salmonella enterica enterica serovar Typhi
gaccggaugauggccug

SEQ ID NO: 1656184 - RNA, 14 nt, Salmonella enterica enterica serovar Typhi
gaccgcuucgcugg

SEQ ID NO: 1656185 - RNA, 22 nt, Salmonella enterica enterica serovar Typhi
gaccuucaacccagcagcagau

SEQ ID NO: 1656186 - RNA, 18 nt, Salmonella enterica enterica serovar Typhi
gacgaaccggcgccguuu

SEQ ID NO: 1656187 - RNA, 19 nt, Salmonella enterica enterica serovar Typhi
gacgagcagguuacucuuc

SEQ ID NO: 1656188 - RNA, 12 nt, Salmonella enterica enterica serovar Typhi
gacguagcgcca

SEQ ID NO: 1656189 - RNA, 23 nt, Salmonella enterica enterica serovar Typhi
gacgucaagaucgcgcagcaggc

SEQ ID NO: 1656190 - RNA, 14 nt, Salmonella enterica enterica serovar Typhi
gacguccaggccgu

SEQ ID NO: 1656191 - RNA, 20 nt, Salmonella enterica enterica serovar Typhi
gacgcuacugugggccguuc

SEQ ID NO: 1656192 - RNA, 15 nt, Salmonella enterica enterica serovar Typhi
gacgcuacgcgucgc

SEQ ID NO: 1656193 - RNA, 19 nt, Salmonella enterica enterica serovar Typhi
gacgcguuuuccagcacca

SEQ ID NO: 1656194 - RNA, 19 nt, Salmonella enterica enterica serovar Typhi
gacgcguuucacaucgcca

SEQ ID NO: 1656195 - RNA, 15 nt, Salmonella enterica enterica serovar Typhi
gacgcuccagaaucu

SEQ ID NO: 1656196 - RNA, 15 nt, Salmonella enterica enterica serovar Typhi
gacggccaccagcgu

SEQ ID NO: 1656197 - RNA, 18 nt, Salmonella enterica enterica serovar Typhi
gacggcagcgccauccgg

SEQ ID NO: 1656198 - RNA, 13 nt, Salmonella enterica enterica serovar Typhi
gacggcagccacg

SEQ ID NO: 1656199 - RNA, 20 nt, Salmonella enterica enterica serovar Typhi
gacggcccguaucgcucagg

SEQ ID NO: 1656200 - RNA, 12 nt, Salmonella enterica enterica serovar Typhi
gacggccagcgc

SEQ ID NO: 1656201 - RNA, 23 nt, Salmonella enterica enterica serovar Typhi
gacgccaccggguuaaagcccug

SEQ ID NO: 1656202 - RNA, 14 nt, Salmonella enterica enterica serovar Typhi
gacgccgccauccg

SEQ ID NO: 1656203 - RNA, 15 nt, Salmonella enterica enterica serovar Typhi
gacgaucagcgccac

SEQ ID NO: 1656204 - RNA, 14 nt, Salmonella enterica enterica serovar Typhi
gaagaacagcgucg

SEQ ID NO: 1656205 - RNA, 16 nt, Salmonella enterica enterica serovar Typhi
gaagaaaagccggaug

SEQ ID NO: 1656206 - RNA, 16 nt, Salmonella enterica enterica serovar Typhi
gaacuguucagccagc

SEQ ID NO: 1656207 - RNA, 20 nt, Salmonella enterica enterica serovar Typhi
gaagaucguuauccagcagc

SEQ ID NO: 1656208 - RNA, 20 nt, Salmonella enterica enterica serovar Typhi
gaagaucgcguacagcgcca

SEQ ID NO: 1656209 - RNA, 19 nt, Salmonella enterica enterica serovar Typhi
gaagaucgcguacagcgcc

SEQ ID NO: 1656210 - RNA, 19 nt, Salmonella enterica enterica serovar Typhi
gaagacguuuacaccgcca

SEQ ID NO: 1656211 - RNA, 20 nt, Salmonella enterica enterica serovar Typhi
gaaaccuccgcagugcggag

SEQ ID NO: 1656212 - RNA, 22 nt, Salmonella enterica enterica serovar Typhi
gaaacgccugaauaaucggcgu

SEQ ID NO: 1656213 - RNA, 20 nt, Salmonella enterica enterica serovar Typhi
gaacgacugaguauuggcaa

SEQ ID NO: 1656214 - RNA, 15 nt, Salmonella enterica enterica serovar Typhi
gaacgacucacgcgc

SEQ ID NO: 1656215 - RNA, 20 nt, Salmonella enterica enterica serovar Typhi
gaacgcacgcagccaacgcc

SEQ ID NO: 1656216 - RNA, 24 nt, Salmonella enterica enterica serovar Typhi
gaacgcuguugccgcugcuggcgu

SEQ ID NO: 1656217 - RNA, 23 nt, Salmonella enterica enterica serovar Typhi
gaacggcuuuccagcagccagaa

SEQ ID NO: 1656218 - RNA, 17 nt, Salmonella enterica enterica serovar Typhi
gaagcgguaguuaagcg

SEQ ID NO: 1656219 - RNA, 14 nt, Salmonella enterica enterica serovar Typhi
gaagcguaacagcg

SEQ ID NO: 1656220 - RNA, 14 nt, Salmonella enterica enterica serovar Typhi
gaagcggacgggcg

SEQ ID NO: 1656221 - RNA, 14 nt, Salmonella enterica enterica serovar Typhi
gaagcgcguguauu

SEQ ID NO: 1656222 - RNA, 16 nt, Salmonella enterica enterica serovar Typhi
gaaggcaacugauccu

SEQ ID NO: 1656223 - RNA, 21 nt, Salmonella enterica enterica serovar Typhi
gaagcgccuguuaucaggacg

SEQ ID NO: 1656224 - RNA, 22 nt, Salmonella enterica enterica serovar Typhi
gaagcgauguuuacugcggcgc

SEQ ID NO: 1656225 - RNA, 21 nt, Salmonella enterica enterica serovar Typhi
gaagcgauuuauccaccgcca

SEQ ID NO: 1656226 - RNA, 22 nt, Salmonella enterica enterica serovar Typhi
gaagcgcaaacggaucuuccac

SEQ ID NO: 1656227 - RNA, 22 nt, Salmonella enterica enterica serovar Typhi
gaagcgauguauuuauccacgc

SEQ ID NO: 1656228 - RNA, 17 nt, Salmonella enterica enterica serovar Typhi
gaagcgaauagcguauu

SEQ ID NO: 1656229 - RNA, 17 nt, Salmonella enterica enterica serovar Typhi
gacagauuaucagcgag

SEQ ID NO: 1656230 - RNA, 18 nt, Salmonella enterica enterica serovar Typhi
gacacuggaaacagccaa

SEQ ID NO: 1656231 - RNA, 12 nt, Salmonella enterica enterica serovar Typhi
gacaggacgcca

SEQ ID NO: 1656232 - RNA, 16 nt, Salmonella enterica enterica serovar Typhi
gacagccgacggcaaa

SEQ ID NO: 1656233 - RNA, 23 nt, Salmonella enterica enterica serovar Typhi
gacauguuuauguagccagccau

SEQ ID NO: 1656234 - RNA, 14 nt, Salmonella enterica enterica serovar Typhi
gacauguuccgccc

SEQ ID NO: 1656235 - RNA, 21 nt, Salmonella enterica enterica serovar Typhi
gacauguccgauagcauuauu

SEQ ID NO: 1656236 - RNA, 18 nt, Salmonella enterica enterica serovar Typhi
gaccaaagucaaacugau

SEQ ID NO: 1656237 - RNA, 22 nt, Salmonella enterica enterica serovar Typhi
gaagugccaguaacucaucgcc

SEQ ID NO: 1656238 - RNA, 16 nt, Salmonella enterica enterica serovar Typhi
gaaguaucgacgcaga

SEQ ID NO: 1656239 - RNA, 17 nt, Salmonella enterica enterica serovar Typhi
gaaggcuuugccauacg

SEQ ID NO: 1656240 - RNA, 15 nt, Salmonella enterica enterica serovar Typhi
gaaggucugacaacu

SEQ ID NO: 1656241 - RNA, 23 nt, Salmonella enterica enterica serovar Typhi
gaaucggacacuugcaacucgca

SEQ ID NO: 1656242 - RNA, 18 nt, Salmonella enterica enterica serovar Typhi
gaaucgccagucgcagca

SEQ ID NO: 1656243 - RNA, 22 nt, Salmonella enterica enterica serovar Typhi
gaauagcggcaguacgagcauc

SEQ ID NO: 1656244 - RNA, 22 nt, Salmonella enterica enterica serovar Typhi
gaauaugcagugcugcugccau

SEQ ID NO: 1656245 - RNA, 13 nt, Salmonella enterica enterica serovar Typhi
gaauagcgacaaa

SEQ ID NO: 1656246 - RNA, 15 nt, Salmonella enterica enterica serovar Typhi
gaauagcgccagggu

SEQ ID NO: 1656247 - RNA, 22 nt, Salmonella enterica enterica serovar Typhi
gaauaacccccgcgaacgcgau

SEQ ID NO: 1656248 - RNA, 20 nt, Salmonella enterica enterica serovar Typhi
gaauaaccacugauggcugg

SEQ ID NO: 1656249 - RNA, 16 nt, Salmonella enterica enterica serovar Typhi
gaauaaaaccggcaua

SEQ ID NO: 1656250 - RNA, 22 nt, Salmonella enterica enterica serovar Typhi
gaauaacauaauauuccagcgu

SEQ ID NO: 1656251 - RNA, 16 nt, Salmonella enterica enterica serovar Typhi
gaauaacaucuuccau

SEQ ID NO: 1656252 - RNA, 19 nt, Salmonella enterica enterica serovar Typhi
gaaugcgaauaaucgccgg

SEQ ID NO: 1656253 - RNA, 21 nt, Salmonella enterica enterica serovar Typhi
gaaugcgcgucaggccagggu

SEQ ID NO: 1656254 - RNA, 17 nt, Salmonella enterica enterica serovar Typhi
gaaugugcuuaucacgu

SEQ ID NO: 1656255 - RNA, 19 nt, Salmonella enterica enterica serovar Typhi
gaauguggguauccacgcc

SEQ ID NO: 1656256 - RNA, 19 nt, Salmonella enterica enterica serovar Typhi
gaauguuccugcaauauau

SEQ ID NO: 1656257 - RNA, 12 nt, Salmonella enterica enterica serovar Typhi
gaauuacgggcg

SEQ ID NO: 1656258 - RNA, 22 nt, Salmonella enterica enterica serovar Typhi
gaauuaacucaucacagccaca

SEQ ID NO: 1656259 - RNA, 17 nt, Salmonella enterica enterica serovar Typhi
gaaugccuuuuacaaua

SEQ ID NO: 1656260 - RNA, 14 nt, Salmonella enterica enterica serovar Typhi
gaaugccagcgccg

SEQ ID NO: 1656261 - RNA, 17 nt, Salmonella enterica enterica serovar Typhi
gaauugccauuguucgc

SEQ ID NO: 1656262 - RNA, 14 nt, Salmonella enterica enterica serovar Typhi
gaauugauuagcuu

SEQ ID NO: 1656263 - RNA, 13 nt, Salmonella enterica enterica serovar Typhi
gaauucaacgucc

SEQ ID NO: 1656264 - RNA, 14 nt, Salmonella enterica enterica serovar Typhi
cuggcaagcgccag

SEQ ID NO: 1656265 - RNA, 18 nt, Salmonella enterica enterica serovar Typhi
cuggcaacaugaccagcg

SEQ ID NO: 1656266 - RNA, 17 nt, Salmonella enterica enterica serovar Typhi
cuggcauggugcagccg

SEQ ID NO: 1656267 - RNA, 17 nt, Salmonella enterica enterica serovar Typhi
cuggcauuuuacuucug

SEQ ID NO: 1656268 - RNA, 18 nt, Salmonella enterica enterica serovar Typhi
cuggccaguuucaaugcc

SEQ ID NO: 1656269 - RNA, 23 nt, Salmonella enterica enterica serovar Typhi
cuggccaggcauugauaaagcgc

SEQ ID NO: 1656270 - RNA, 21 nt, Salmonella enterica enterica serovar Typhi
cuggcagugauccaucgguuc

SEQ ID NO: 1656271 - RNA, 20 nt, Salmonella enterica enterica serovar Typhi
cuggcccccuguuccagggc

SEQ ID NO: 1656272 - RNA, 23 nt, Salmonella enterica enterica serovar Typhi
cuggccggaaaggauauaagcgc

SEQ ID NO: 1656273 - RNA, 19 nt, Salmonella enterica enterica serovar Typhi
cugcuugucgaucaucaga

SEQ ID NO: 1656274 - RNA, 22 nt, Salmonella enterica enterica serovar Typhi
cugcuuaucgauaucugccugc

SEQ ID NO: 1656275 - RNA, 17 nt, Salmonella enterica enterica serovar Typhi
cuggaacagauguuuac

SEQ ID NO: 1656276 - RNA, 17 nt, Salmonella enterica enterica serovar Typhi
cugcuguccgccagcaa

SEQ ID NO: 1656277 - RNA, 23 nt, Salmonella enterica enterica serovar Typhi
cugcuguuccuggugcgacacca

SEQ ID NO: 1656278 - RNA, 13 nt, Salmonella enterica enterica serovar Typhi
cugcuuccagaau

SEQ ID NO: 1656279 - RNA, 17 nt, Salmonella enterica enterica serovar Typhi
cugcuggaaaucuuucu

SEQ ID NO: 1656280 - RNA, 18 nt, Salmonella enterica enterica serovar Typhi
cuggcgucccgggucagg

SEQ ID NO: 1656281 - RNA, 17 nt, Salmonella enterica enterica serovar Typhi
cuggcgugccgggcugg

SEQ ID NO: 1656282 - RNA, 21 nt, Salmonella enterica enterica serovar Typhi
cuggcguauucgcccggcagg

SEQ ID NO: 1656283 - RNA, 13 nt, Salmonella enterica enterica serovar Typhi
cuggccuccggcg

SEQ ID NO: 1656284 - RNA, 20 nt, Salmonella enterica enterica serovar Typhi
cuggcggcaaaaacgccggu

SEQ ID NO: 1656285 - RNA, 21 nt, Salmonella enterica enterica serovar Typhi
cuggucauggcuuagcgccag

SEQ ID NO: 1656286 - RNA, 17 nt, Salmonella enterica enterica serovar Typhi
cuggggucgucagcgga

SEQ ID NO: 1656287 - RNA, 13 nt, Salmonella enterica enterica serovar Typhi
cugggcgcaugag

SEQ ID NO: 1656288 - RNA, 18 nt, Salmonella enterica enterica serovar Typhi
cuggcuggucagcguacc

SEQ ID NO: 1656289 - RNA, 21 nt, Salmonella enterica enterica serovar Typhi
cuggcugugccaauaacgccu

SEQ ID NO: 1656290 - RNA, 21 nt, Salmonella enterica enterica serovar Typhi
cugcggaugaugucagcguga

SEQ ID NO: 1656291 - RNA, 17 nt, Salmonella enterica enterica serovar Typhi
cugcgcugcggucaggg

SEQ ID NO: 1656292 - RNA, 23 nt, Salmonella enterica enterica serovar Typhi
cugcgcuuaucaggccuaccagc

SEQ ID NO: 1656293 - RNA, 13 nt, Salmonella enterica enterica serovar Typhi
cugcggccaugau

SEQ ID NO: 1656294 - RNA, 16 nt, Salmonella enterica enterica serovar Typhi
cugcggccucgccucu

SEQ ID NO: 1656295 - RNA, 14 nt, Salmonella enterica enterica serovar Typhi
cugcggcagaccgg

SEQ ID NO: 1656296 - RNA, 15 nt, Salmonella enterica enterica serovar Typhi
cugcgcggcaaugag

SEQ ID NO: 1656297 - RNA, 13 nt, Salmonella enterica enterica serovar Typhi
cugcgcgccaaac

SEQ ID NO: 1656298 - RNA, 15 nt, Salmonella enterica enterica serovar Typhi
cugcgccagccugcu

SEQ ID NO: 1656299 - RNA, 22 nt, Salmonella enterica enterica serovar Typhi
cugcgccaaaucgguaaauguc

SEQ ID NO: 1656300 - RNA, 18 nt, Salmonella enterica enterica serovar Typhi
cugcgauagcugcugacg

SEQ ID NO: 1656301 - RNA, 20 nt, Salmonella enterica enterica serovar Typhi
cugcgaguuuaugguugucu

SEQ ID NO: 1656302 - RNA, 22 nt, Salmonella enterica enterica serovar Typhi
cugcugaccuuaauccagcagu

SEQ ID NO: 1656303 - RNA, 11 nt, Salmonella enterica enterica serovar Typhi
cugcugcgcca

SEQ ID NO: 1656304 - RNA, 13 nt, Salmonella enterica enterica serovar Typhi
cugcugcgccagc

SEQ ID NO: 1656305 - RNA, 13 nt, Salmonella enterica enterica serovar Typhi
cugcugccaucgc

SEQ ID NO: 1656306 - RNA, 19 nt, Salmonella enterica enterica serovar Typhi
cugcugacguagauucuga

SEQ ID NO: 1656307 - RNA, 21 nt, Salmonella enterica enterica serovar Typhi
cugcucccccaguugcugcau

SEQ ID NO: 1656308 - RNA, 22 nt, Salmonella enterica enterica serovar Typhi
cugcgucgggugcagcgucagg

SEQ ID NO: 1656309 - RNA, 14 nt, Salmonella enterica enterica serovar Typhi
cugcgugagccgga

SEQ ID NO: 1656310 - RNA, 15 nt, Salmonella enterica enterica serovar Typhi
cugcguaacgcgccg

SEQ ID NO: 1656311 - RNA, 15 nt, Salmonella enterica enterica serovar Typhi
cugcggcugacgcga

SEQ ID NO: 1656312 - RNA, 20 nt, Salmonella enterica enterica serovar Typhi
cuugccgcgccagacgccau

SEQ ID NO: 1656313 - RNA, 17 nt, Salmonella enterica enterica serovar Typhi
cuugccgggccuggcau

SEQ ID NO: 1656314 - RNA, 19 nt, Salmonella enterica enterica serovar Typhi
cuuguaagggaggugcucu

SEQ ID NO: 1656315 - RNA, 17 nt, Salmonella enterica enterica serovar Typhi
cuugaguuuuccgccau

SEQ ID NO: 1656316 - RNA, 13 nt, Salmonella enterica enterica serovar Typhi
cuugauacgccau

SEQ ID NO: 1656317 - RNA, 12 nt, Salmonella enterica enterica serovar Typhi
cuugaucgcgca

SEQ ID NO: 1656318 - RNA, 24 nt, Salmonella enterica enterica serovar Typhi
cuugcaucucauaaaacauuccug

SEQ ID NO: 1656319 - RNA, 14 nt, Salmonella enterica enterica serovar Typhi
cuugcaugaccauc

SEQ ID NO: 1656320 - RNA, 17 nt, Salmonella enterica enterica serovar Typhi
cuugccagagccccaau

SEQ ID NO: 1656321 - RNA, 22 nt, Salmonella enterica enterica serovar Typhi
cuuucugcuccaugaucgccug

SEQ ID NO: 1656322 - RNA, 14 nt, Salmonella enterica enterica serovar Typhi
cuuugauuuugcgc

SEQ ID NO: 1656323 - RNA, 20 nt, Salmonella enterica enterica serovar Typhi
cuuugacaaccucgcuucgc

SEQ ID NO: 1656324 - RNA, 18 nt, Salmonella enterica enterica serovar Typhi
cuuugccgcaaacgccga

SEQ ID NO: 1656325 - RNA, 21 nt, Salmonella enterica enterica serovar Typhi
cuuucauaauguucgguauau

SEQ ID NO: 1656326 - RNA, 21 nt, Salmonella enterica enterica serovar Typhi
cuuucaugaacguuggcgaua

SEQ ID NO: 1656327 - RNA, 20 nt, Salmonella enterica enterica serovar Typhi
cuugucacaauaacgccgga

SEQ ID NO: 1656328 - RNA, 23 nt, Salmonella enterica enterica serovar Typhi
cuuguccggcguuuuagcgccau

SEQ ID NO: 1656329 - RNA, 23 nt, Salmonella enterica enterica serovar Typhi
cuuucaacauauuuuucacacau

SEQ ID NO: 1656330 - RNA, 17 nt, Salmonella enterica enterica serovar Typhi
cuuucaaucgucagacg

SEQ ID NO: 1656331 - RNA, 16 nt, Salmonella enterica enterica serovar Typhi
cuuucaauuuccgcac

SEQ ID NO: 1656332 - RNA, 13 nt, Salmonella enterica enterica serovar Typhi
cuuucagaucggc

SEQ ID NO: 1656333 - RNA, 21 nt, Salmonella enterica enterica serovar Typhi
cuuucaccuccgcuuuuaucg

SEQ ID NO: 1656334 - RNA, 20 nt, Salmonella enterica enterica serovar Typhi
gaaaccgcuacccggcacaa

SEQ ID NO: 1656335 - RNA, 16 nt, Salmonella enterica enterica serovar Typhi
gaaaccggccgccauc

SEQ ID NO: 1656336 - RNA, 22 nt, Salmonella enterica enterica serovar Typhi
gaaaccggcgcgccuuccagca

SEQ ID NO: 1656337 - RNA, 17 nt, Salmonella enterica enterica serovar Typhi
gaaaccaguucacgcgu

SEQ ID NO: 1656338 - RNA, 19 nt, Salmonella enterica enterica serovar Typhi
gaaaccgagguucaccagc

SEQ ID NO: 1656339 - RNA, 18 nt, Salmonella enterica enterica serovar Typhi
gaaaagguuucggcgauc

SEQ ID NO: 1656340 - RNA, 19 nt, Salmonella enterica enterica serovar Typhi
gaaaacagcgccggcagca

SEQ ID NO: 1656341 - RNA, 17 nt, Salmonella enterica enterica serovar Typhi
gaaaaguauggcgguuc

SEQ ID NO: 1656342 - RNA, 18 nt, Salmonella enterica enterica serovar Typhi
gaaaaguuacaggcucca

SEQ ID NO: 1656343 - RNA, 15 nt, Salmonella enterica enterica serovar Typhi
gaaacaucaucguuu

SEQ ID NO: 1656344 - RNA, 23 nt, Salmonella enterica enterica serovar Typhi
gaaacaguuggcggacucgcugg

SEQ ID NO: 1656345 - RNA, 16 nt, Salmonella enterica enterica serovar Typhi
gaaaauauaugacaac

SEQ ID NO: 1656346 - RNA, 14 nt, Salmonella enterica enterica serovar Typhi
gaaaauauucagca

SEQ ID NO: 1656347 - RNA, 20 nt, Salmonella enterica enterica serovar Typhi
gaaaaucagugaacacccug

SEQ ID NO: 1656348 - RNA, 16 nt, Salmonella enterica enterica serovar Typhi
cuuugucgccaauaau

SEQ ID NO: 1656349 - RNA, 17 nt, Salmonella enterica enterica serovar Typhi
cuuuggugcgacgccag

SEQ ID NO: 1656350 - RNA, 15 nt, Salmonella enterica enterica serovar Typhi
gaaaaacaucauggc

SEQ ID NO: 1656351 - RNA, 23 nt, Salmonella enterica enterica serovar Typhi
gaaaaaagugaucccccagaauc

SEQ ID NO: 1656352 - RNA, 13 nt, Salmonella enterica enterica serovar Typhi
gaaaaauguucag

SEQ ID NO: 1656353 - RNA, 13 nt, Salmonella enterica enterica serovar Typhi
gaaaaccagcgcc

SEQ ID NO: 1656354 - RNA, 20 nt, Salmonella enterica enterica serovar Typhi
gaaaaccccaucccggcaac

SEQ ID NO: 1656355 - RNA, 13 nt, Salmonella enterica enterica serovar Typhi
gaaaaaucauuau

SEQ ID NO: 1656356 - RNA, 21 nt, Salmonella enterica enterica serovar Typhi
gaaaaagaccgacaucgccag

SEQ ID NO: 1656357 - RNA, 14 nt, Salmonella enterica enterica serovar Typhi
cuucgccaucucca

SEQ ID NO: 1656358 - RNA, 23 nt, Salmonella enterica enterica serovar Typhi
cuucgggcgauuuuugcagcaac

SEQ ID NO: 1656359 - RNA, 21 nt, Salmonella enterica enterica serovar Typhi
cuucuccccuucaucaguaac

SEQ ID NO: 1656360 - RNA, 16 nt, Salmonella enterica enterica serovar Typhi
cuucuccgccugcggu

SEQ ID NO: 1656361 - RNA, 17 nt, Salmonella enterica enterica serovar Typhi
cuucuuuauagauauca

SEQ ID NO: 1656362 - RNA, 13 nt, Salmonella enterica enterica serovar Typhi
cuucuuugcgcgu

SEQ ID NO: 1656363 - RNA, 12 nt, Salmonella enterica enterica serovar Typhi
cuucuuaccgug

SEQ ID NO: 1656364 - RNA, 21 nt, Salmonella enterica enterica serovar Typhi
cuucuguacgcugaauaaccc

SEQ ID NO: 1656365 - RNA, 22 nt, Salmonella enterica enterica serovar Typhi
cuucccauauuuuuucugccag

SEQ ID NO: 1656366 - RNA, 14 nt, Salmonella enterica enterica serovar Typhi
cuuccccugccaga

SEQ ID NO: 1656367 - RNA, 13 nt, Salmonella enterica enterica serovar Typhi
cuuccagcgccaa

SEQ ID NO: 1656368 - RNA, 22 nt, Salmonella enterica enterica serovar Typhi
cuucacccagacugugauggcg

SEQ ID NO: 1656369 - RNA, 20 nt, Salmonella enterica enterica serovar Typhi
cuucaaucgucguuccgcca

SEQ ID NO: 1656370 - RNA, 16 nt, Salmonella enterica enterica serovar Typhi
cuucaauuugccggaa

SEQ ID NO: 1656371 - RNA, 14 nt, Salmonella enterica enterica serovar Typhi
cuucacaaucagcg

SEQ ID NO: 1656372 - RNA, 20 nt, Salmonella enterica enterica serovar Typhi
cuuccgacaaaccuuuaucg

SEQ ID NO: 1656373 - RNA, 19 nt, Salmonella enterica enterica serovar Typhi
cuuccgacacugaaacucc

SEQ ID NO: 1656374 - RNA, 14 nt, Salmonella enterica enterica serovar Typhi
cuuccggcgcaaua

SEQ ID NO: 1656375 - RNA, 11 nt, Salmonella enterica enterica serovar Typhi
cuuccgccagc

SEQ ID NO: 1656376 - RNA, 20 nt, Salmonella enterica enterica serovar Typhi
cuuccgguugaccgcauaau

SEQ ID NO: 1656377 - RNA, 14 nt, Salmonella enterica enterica serovar Typhi
cuucgcccggcgua

SEQ ID NO: 1656378 - RNA, 18 nt, Salmonella enterica enterica serovar Typhi
cuucgaaugucucaauau

SEQ ID NO: 1656379 - RNA, 20 nt, Salmonella enterica enterica serovar Typhi
cuuaccgggcaggauacggc

SEQ ID NO: 1656380 - RNA, 11 nt, Salmonella enterica enterica serovar Typhi
cuuacgcagcu

SEQ ID NO: 1656381 - RNA, 17 nt, Salmonella enterica enterica serovar Typhi
cuuaccuugaguaacug

SEQ ID NO: 1656382 - RNA, 21 nt, Salmonella enterica enterica serovar Typhi
cuuaacgcucucaucgacgau

SEQ ID NO: 1656383 - RNA, 20 nt, Salmonella enterica enterica serovar Typhi
cuguuucgcccgcucgcgau

SEQ ID NO: 1656384 - RNA, 16 nt, Salmonella enterica enterica serovar Typhi
cuuaacgcccgcgucu

SEQ ID NO: 1656385 - RNA, 15 nt, Salmonella enterica enterica serovar Typhi
cuguuuagccgucuc

SEQ ID NO: 1656386 - RNA, 13 nt, Salmonella enterica enterica serovar Typhi
cuguuuaucugau

SEQ ID NO: 1656387 - RNA, 20 nt, Salmonella enterica enterica serovar Typhi
cuuacuuucuugccacuggc

SEQ ID NO: 1656388 - RNA, 20 nt, Salmonella enterica enterica serovar Typhi
cuuaucgccguaaccgccug

SEQ ID NO: 1656389 - RNA, 12 nt, Salmonella enterica enterica serovar Typhi
cuuauccggcuu

SEQ ID NO: 1656390 - RNA, 15 nt, Salmonella enterica enterica serovar Typhi
cuuacugugccgccg

SEQ ID NO: 1656391 - RNA, 13 nt, Salmonella enterica enterica serovar Typhi
cuuaugaucgccc

SEQ ID NO: 1656392 - RNA, 20 nt, Salmonella enterica enterica serovar Typhi
cuuauuagaggcguaaguaa

SEQ ID NO: 1656393 - RNA, 15 nt, Salmonella enterica enterica serovar Typhi
cuuauugaguuaccg

SEQ ID NO: 1656394 - RNA, 23 nt, Salmonella enterica enterica serovar Typhi
cuucaaauauauugaaaagggac

SEQ ID NO: 1656395 - RNA, 19 nt, Salmonella enterica enterica serovar Typhi
cuucaaaacagaaccccau

SEQ ID NO: 1656396 - RNA, 22 nt, Salmonella enterica enterica serovar Typhi
cuuauuuuauuuuuauauuccg

SEQ ID NO: 1656397 - RNA, 19 nt, Salmonella enterica enterica serovar Typhi
cuucaacagcggcggcagu

SEQ ID NO: 1656398 - RNA, 18 nt, Salmonella enterica enterica serovar Typhi
cugugaagcgaucggcgu

SEQ ID NO: 1656399 - RNA, 15 nt, Salmonella enterica enterica serovar Typhi
cugugcgugaugggc

SEQ ID NO: 1656400 - RNA, 21 nt, Salmonella enterica enterica serovar Typhi
cugugcaacaucuuaccggug

SEQ ID NO: 1656401 - RNA, 15 nt, Salmonella enterica enterica serovar Typhi
cuguguccgccugcu

SEQ ID NO: 1656402 - RNA, 21 nt, Salmonella enterica enterica serovar Typhi
cuguuaauaaguccgcgggca

SEQ ID NO: 1656403 - RNA, 14 nt, Salmonella enterica enterica serovar Typhi
cuguuaauaccgug

SEQ ID NO: 1656404 - RNA, 16 nt, Salmonella enterica enterica serovar Typhi
cugugguucugccaga

SEQ ID NO: 1656405 - RNA, 20 nt, Salmonella enterica enterica serovar Typhi
cuguauucguccauaagcgc

SEQ ID NO: 1656406 - RNA, 20 nt, Salmonella enterica enterica serovar Typhi
cugucacuccggcugcacca

SEQ ID NO: 1656407 - RNA, 21 nt, Salmonella enterica enterica serovar Typhi
cugucaucaucaaguaccgug

SEQ ID NO: 1656408 - RNA, 16 nt, Salmonella enterica enterica serovar Typhi
cugucgaaaccagcau

SEQ ID NO: 1656409 - RNA, 19 nt, Salmonella enterica enterica serovar Typhi
cuguccggaauaacuccag

SEQ ID NO: 1656410 - RNA, 21 nt, Salmonella enterica enterica serovar Typhi
cugucgauaacagcauaaacg

SEQ ID NO: 1656411 - RNA, 17 nt, Salmonella enterica enterica serovar Typhi
cgguggaaaccgcagaa

SEQ ID NO: 1656412 - RNA, 16 nt, Salmonella enterica enterica serovar Typhi
cggugacgcgaucguc

SEQ ID NO: 1656413 - RNA, 21 nt, Salmonella enterica enterica serovar Typhi
cggugaccugccuuucccauc

SEQ ID NO: 1656414 - RNA, 19 nt, Salmonella enterica enterica serovar Typhi
cggugacgucaagaucgcg

SEQ ID NO: 1656415 - RNA, 21 nt, Salmonella enterica enterica serovar Typhi
cgguuuuacuauugccgauaa

SEQ ID NO: 1656416 - RNA, 13 nt, Salmonella enterica enterica serovar Typhi
cgguuuuuccgcu

SEQ ID NO: 1656417 - RNA, 15 nt, Salmonella enterica enterica serovar Typhi
cguaaaacaacagcg

SEQ ID NO: 1656418 - RNA, 12 nt, Salmonella enterica enterica serovar Typhi
cguaaaacugca

SEQ ID NO: 1656419 - RNA, 19 nt, Salmonella enterica enterica serovar Typhi
cguaaacggcagccgccac

SEQ ID NO: 1656420 - RNA, 14 nt, Salmonella enterica enterica serovar Typhi
cguaaaaccgcgcu

SEQ ID NO: 1656421 - RNA, 12 nt, Salmonella enterica enterica serovar Typhi
cguacagguugu

SEQ ID NO: 1656422 - RNA, 17 nt, Salmonella enterica enterica serovar Typhi
cguaauuccgcauugag

SEQ ID NO: 1656423 - RNA, 17 nt, Salmonella enterica enterica serovar Typhi
cgguuugagcaccacgc

SEQ ID NO: 1656424 - RNA, 12 nt, Salmonella enterica enterica serovar Typhi
cgguugacgcug

SEQ ID NO: 1656425 - RNA, 19 nt, Salmonella enterica enterica serovar Typhi
cgguuaaaaacagccagca

SEQ ID NO: 1656426 - RNA, 17 nt, Salmonella enterica enterica serovar Typhi
cgguuaugccugccagc

SEQ ID NO: 1656427 - RNA, 20 nt, Salmonella enterica enterica serovar Typhi
cgguuaugccugccagcauu

SEQ ID NO: 1656428 - RNA, 12 nt, Salmonella enterica enterica serovar Typhi
cgguuaugcgau

SEQ ID NO: 1656429 - RNA, 14 nt, Salmonella enterica enterica serovar Typhi
cgguuauaaccgga

SEQ ID NO: 1656430 - RNA, 13 nt, Salmonella enterica enterica serovar Typhi
cgguuaauacgcc

SEQ ID NO: 1656431 - RNA, 14 nt, Salmonella enterica enterica serovar Typhi
cgguguacagcgcg

SEQ ID NO: 1656432 - RNA, 16 nt, Salmonella enterica enterica serovar Typhi
cguacauugccggaug

SEQ ID NO: 1656433 - RNA, 15 nt, Salmonella enterica enterica serovar Typhi
cguacuggucggcga

SEQ ID NO: 1656434 - RNA, 21 nt, Salmonella enterica enterica serovar Typhi
cguagcccagcgccgcaucgc

SEQ ID NO: 1656435 - RNA, 20 nt, Salmonella enterica enterica serovar Typhi
cguaccgaugacggcaaagc

SEQ ID NO: 1656436 - RNA, 16 nt, Salmonella enterica enterica serovar Typhi
cguagaaaaugcgcug

SEQ ID NO: 1656437 - RNA, 18 nt, Salmonella enterica enterica serovar Typhi
cguaguagguauccagca

SEQ ID NO: 1656438 - RNA, 17 nt, Salmonella enterica enterica serovar Typhi
cguaggccggaagacgu

SEQ ID NO: 1656439 - RNA, 19 nt, Salmonella enterica enterica serovar Typhi
cguaggccggauaagacgc

SEQ ID NO: 1656440 - RNA, 14 nt, Salmonella enterica enterica serovar Typhi
cguaggcgacgcca

SEQ ID NO: 1656441 - RNA, 18 nt, Salmonella enterica enterica serovar Typhi
cguaggccugauaagcgc

SEQ ID NO: 1656442 - RNA, 21 nt, Salmonella enterica enterica serovar Typhi
cguaucgcucaggagcgccug

SEQ ID NO: 1656443 - RNA, 14 nt, Salmonella enterica enterica serovar Typhi
cguaucuuccagcg

SEQ ID NO: 1656444 - RNA, 22 nt, Salmonella enterica enterica serovar Typhi
cguaucuuccggugugaccagc

SEQ ID NO: 1656445 - RNA, 20 nt, Salmonella enterica enterica serovar Typhi
cgucaagaucgcgcagcagg

SEQ ID NO: 1656446 - RNA, 20 nt, Salmonella enterica enterica serovar Typhi
cguauacuucucgaaguucu

SEQ ID NO: 1656447 - RNA, 11 nt, Salmonella enterica enterica serovar Typhi
cguauccagca

SEQ ID NO: 1656448 - RNA, 12 nt, Salmonella enterica enterica serovar Typhi
cguauccagcgc

SEQ ID NO: 1656449 - RNA, 15 nt, Salmonella enterica enterica serovar Typhi
cgucagacaggccug

SEQ ID NO: 1656450 - RNA, 18 nt, Salmonella enterica enterica serovar Typhi
cgucagcgcccgauaaau

SEQ ID NO: 1656451 - RNA, 18 nt, Salmonella enterica enterica serovar Typhi
cgucacguuauaccacug

SEQ ID NO: 1656452 - RNA, 16 nt, Salmonella enterica enterica serovar Typhi
cgucaccggaucgcug

SEQ ID NO: 1656453 - RNA, 16 nt, Salmonella enterica enterica serovar Typhi
cgucacgucagcgucg

SEQ ID NO: 1656454 - RNA, 22 nt, Salmonella enterica enterica serovar Typhi
cgucggcaccgaauguuccgca

SEQ ID NO: 1656455 - RNA, 14 nt, Salmonella enterica enterica serovar Typhi
cgucgccagggcgg

SEQ ID NO: 1656456 - RNA, 18 nt, Salmonella enterica enterica serovar Typhi
cgucgccuguuucugcgc

SEQ ID NO: 1656457 - RNA, 13 nt, Salmonella enterica enterica serovar Typhi
cgucgcgaaucgu

SEQ ID NO: 1656458 - RNA, 15 nt, Salmonella enterica enterica serovar Typhi
cgucgccaaucagca

SEQ ID NO: 1656459 - RNA, 13 nt, Salmonella enterica enterica serovar Typhi
cgucgcacgaauc

SEQ ID NO: 1656460 - RNA, 14 nt, Salmonella enterica enterica serovar Typhi
cgucgagacggugu

SEQ ID NO: 1656461 - RNA, 18 nt, Salmonella enterica enterica serovar Typhi
cgucgagaaaccgcucgc

SEQ ID NO: 1656462 - RNA, 20 nt, Salmonella enterica enterica serovar Typhi
cgucgacaaagccgacgcca

SEQ ID NO: 1656463 - RNA, 12 nt, Salmonella enterica enterica serovar Typhi
cguccggcugcc

SEQ ID NO: 1656464 - RNA, 15 nt, Salmonella enterica enterica serovar Typhi
cgucccuuccgccac

SEQ ID NO: 1656465 - RNA, 17 nt, Salmonella enterica enterica serovar Typhi
cgucccugcaacgccug

SEQ ID NO: 1656466 - RNA, 15 nt, Salmonella enterica enterica serovar Typhi
cgucccugccacagu

SEQ ID NO: 1656467 - RNA, 21 nt, Salmonella enterica enterica serovar Typhi
cguccugacggugcgcgacgc

SEQ ID NO: 1656468 - RNA, 13 nt, Salmonella enterica enterica serovar Typhi
cgucccagcgcac

SEQ ID NO: 1656469 - RNA, 20 nt, Salmonella enterica enterica serovar Typhi
cgucccaccacgcagccaug

SEQ ID NO: 1656470 - RNA, 13 nt, Salmonella enterica enterica serovar Typhi
cgucaucaacaua

SEQ ID NO: 1656471 - RNA, 15 nt, Salmonella enterica enterica serovar Typhi
cgucaucaggcguug

SEQ ID NO: 1656472 - RNA, 15 nt, Salmonella enterica enterica serovar Typhi
cgucauaacgcgcau

SEQ ID NO: 1656473 - RNA, 17 nt, Salmonella enterica enterica serovar Typhi
cgucauaucauccagcc

SEQ ID NO: 1656474 - RNA, 15 nt, Salmonella enterica enterica serovar Typhi
cgucagucgccagaa

SEQ ID NO: 1656475 - RNA, 16 nt, Salmonella enterica enterica serovar Typhi
cgucaguaccagcgag

SEQ ID NO: 1656476 - RNA, 14 nt, Salmonella enterica enterica serovar Typhi
cgucaggaggccug

SEQ ID NO: 1656477 - RNA, 17 nt, Salmonella enterica enterica serovar Typhi
cgugaguuucaguauca

SEQ ID NO: 1656478 - RNA, 18 nt, Salmonella enterica enterica serovar Typhi
cgugaguuucaguaucau

SEQ ID NO: 1656479 - RNA, 21 nt, Salmonella enterica enterica serovar Typhi
cgugauaaaacauuccaucgc

SEQ ID NO: 1656480 - RNA, 23 nt, Salmonella enterica enterica serovar Typhi
cgugauaauaguggugcgcaucc

SEQ ID NO: 1656481 - RNA, 21 nt, Salmonella enterica enterica serovar Typhi
cgugauaauucccccauccgc

SEQ ID NO: 1656482 - RNA, 17 nt, Salmonella enterica enterica serovar Typhi
cgugacgcgccagcgga

SEQ ID NO: 1656483 - RNA, 18 nt, Salmonella enterica enterica serovar Typhi
cgugaagaaacggaaauc

SEQ ID NO: 1656484 - RNA, 17 nt, Salmonella enterica enterica serovar Typhi
cgugauauugaccaucu

SEQ ID NO: 1656485 - RNA, 15 nt, Salmonella enterica enterica serovar Typhi
cgugcaggacagaca

SEQ ID NO: 1656486 - RNA, 20 nt, Salmonella enterica enterica serovar Typhi
cgugcaguucuguaggccgg

SEQ ID NO: 1656487 - RNA, 18 nt, Salmonella enterica enterica serovar Typhi
cgugccgccgcgaaaacg

SEQ ID NO: 1656488 - RNA, 23 nt, Salmonella enterica enterica serovar Typhi
cgugcaguuuugcuucaugcaca

SEQ ID NO: 1656489 - RNA, 21 nt, Salmonella enterica enterica serovar Typhi
cgucgggauaagcgaugcgcg

SEQ ID NO: 1656490 - RNA, 16 nt, Salmonella enterica enterica serovar Typhi
cgucggcgacgacgau

SEQ ID NO: 1656491 - RNA, 15 nt, Salmonella enterica enterica serovar Typhi
cgucggcgccggcgu

SEQ ID NO: 1656492 - RNA, 16 nt, Salmonella enterica enterica serovar Typhi
cgucugacgcuugcau

SEQ ID NO: 1656493 - RNA, 22 nt, Salmonella enterica enterica serovar Typhi
cgucugcaaugguaaaacgcug

SEQ ID NO: 1656494 - RNA, 16 nt, Salmonella enterica enterica serovar Typhi
cgucugguaauaggcc

SEQ ID NO: 1656495 - RNA, 15 nt, Salmonella enterica enterica serovar Typhi
cgucgucccaggcca

SEQ ID NO: 1656496 - RNA, 19 nt, Salmonella enterica enterica serovar Typhi
cgucuccagacaauccgcg

SEQ ID NO: 1656497 - RNA, 15 nt, Salmonella enterica enterica serovar Typhi
cgucguuccgccagg

SEQ ID NO: 1656498 - RNA, 22 nt, Salmonella enterica enterica serovar Typhi
cgucguuacccuccugcaaucc

SEQ ID NO: 1656499 - RNA, 23 nt, Salmonella enterica enterica serovar Typhi
cgucguuaacaucaucaggccug

SEQ ID NO: 1656500 - RNA, 19 nt, Salmonella enterica enterica serovar Typhi
cgucguuaacugcauuaca

SEQ ID NO: 1656501 - RNA, 14 nt, Salmonella enterica enterica serovar Typhi
cguuucaaccgcgc

SEQ ID NO: 1656502 - RNA, 16 nt, Salmonella enterica enterica serovar Typhi
cguuuaugccgccauc

SEQ ID NO: 1656503 - RNA, 21 nt, Salmonella enterica enterica serovar Typhi
cguuguuucucuuccgccagc

SEQ ID NO: 1656504 - RNA, 12 nt, Salmonella enterica enterica serovar Typhi
cguuuaaagcgc

SEQ ID NO: 1656505 - RNA, 22 nt, Salmonella enterica enterica serovar Typhi
cguuuaagucccuggcgcgcca

SEQ ID NO: 1656506 - RNA, 21 nt, Salmonella enterica enterica serovar Typhi
cguuuacaccgccauccggca

SEQ ID NO: 1656507 - RNA, 23 nt, Salmonella enterica enterica serovar Typhi
cguugguuucggcguaagaucgc

SEQ ID NO: 1656508 - RNA, 19 nt, Salmonella enterica enterica serovar Typhi
cguuguaguuaucgccgaa

SEQ ID NO: 1656509 - RNA, 17 nt, Salmonella enterica enterica serovar Typhi
cguuggcuaucgcacug

SEQ ID NO: 1656510 - RNA, 22 nt, Salmonella enterica enterica serovar Typhi
cuaaagcgacuuauccggccua

SEQ ID NO: 1656511 - RNA, 15 nt, Salmonella enterica enterica serovar Typhi
cuaaagcgcuggcgg

SEQ ID NO: 1656512 - RNA, 18 nt, Salmonella enterica enterica serovar Typhi
cuaaagacgguaaucaga

SEQ ID NO: 1656513 - RNA, 22 nt, Salmonella enterica enterica serovar Typhi
cuaacagcagcagcaaaccgau

SEQ ID NO: 1656514 - RNA, 16 nt, Salmonella enterica enterica serovar Typhi
cguuugcgcuacgcug

SEQ ID NO: 1656515 - RNA, 20 nt, Salmonella enterica enterica serovar Typhi
cguuugcgucaaucaggaaa

SEQ ID NO: 1656516 - RNA, 20 nt, Salmonella enterica enterica serovar Typhi
cguuucuauuauugaucggc

SEQ ID NO: 1656517 - RNA, 15 nt, Salmonella enterica enterica serovar Typhi
cguuuucgccggaug

SEQ ID NO: 1656518 - RNA, 21 nt, Salmonella enterica enterica serovar Typhi
cguuuuggcagacagccauau

SEQ ID NO: 1656519 - RNA, 16 nt, Salmonella enterica enterica serovar Typhi
cuaaaaacagcgcaau

SEQ ID NO: 1656520 - RNA, 17 nt, Salmonella enterica enterica serovar Typhi
cuaaaaaggaaagggac

SEQ ID NO: 1656521 - RNA, 16 nt, Salmonella enterica enterica serovar Typhi
cguuuuucucaucaag

SEQ ID NO: 1656522 - RNA, 20 nt, Salmonella enterica enterica serovar Typhi
cguuuugauguccagaugcu

SEQ ID NO: 1656523 - RNA, 15 nt, Salmonella enterica enterica serovar Typhi
cguuuugcagcgcca

SEQ ID NO: 1656524 - RNA, 16 nt, Salmonella enterica enterica serovar Typhi
cguuuuaccuucugcc

SEQ ID NO: 1656525 - RNA, 22 nt, Salmonella enterica enterica serovar Typhi
cguucgguuuccggcauccagc

SEQ ID NO: 1656526 - RNA, 18 nt, Salmonella enterica enterica serovar Typhi
cguucguugauagcgacg

SEQ ID NO: 1656527 - RNA, 18 nt, Salmonella enterica enterica serovar Typhi
cguucgacaacggaucgc

SEQ ID NO: 1656528 - RNA, 23 nt, Salmonella enterica enterica serovar Typhi
cguuccguucgcgucacaaucgc

SEQ ID NO: 1656529 - RNA, 23 nt, Salmonella enterica enterica serovar Typhi
cguugauccugaccgggcucacg

SEQ ID NO: 1656530 - RNA, 22 nt, Salmonella enterica enterica serovar Typhi
cguucucacggucuccugaacu

SEQ ID NO: 1656531 - RNA, 15 nt, Salmonella enterica enterica serovar Typhi
cguugaccagcgacg

SEQ ID NO: 1656532 - RNA, 17 nt, Salmonella enterica enterica serovar Typhi
cguugcaggcgauugcc

SEQ ID NO: 1656533 - RNA, 13 nt, Salmonella enterica enterica serovar Typhi
cguugccagcggc

SEQ ID NO: 1656534 - RNA, 16 nt, Salmonella enterica enterica serovar Typhi
cguugcgacuaucggc

SEQ ID NO: 1656535 - RNA, 22 nt, Salmonella enterica enterica serovar Typhi
cguugcugucgcgcaauaccug

SEQ ID NO: 1656536 - RNA, 16 nt, Salmonella enterica enterica serovar Typhi
cguugcgcgcgucaca

SEQ ID NO: 1656537 - RNA, 19 nt, Salmonella enterica enterica serovar Typhi
cguugcgcccaucaucauc

SEQ ID NO: 1656538 - RNA, 17 nt, Salmonella enterica enterica serovar Typhi
cuaagugaguaaacgcu

SEQ ID NO: 1656539 - RNA, 19 nt, Salmonella enterica enterica serovar Typhi
cuaacgcguacccggcuua

SEQ ID NO: 1656540 - RNA, 18 nt, Salmonella enterica enterica serovar Typhi
cuaacccgcugcgccguu

SEQ ID NO: 1656541 - RNA, 22 nt, Salmonella enterica enterica serovar Typhi
cuaacuccggagcuaaaccguc

SEQ ID NO: 1656542 - RNA, 20 nt, Salmonella enterica enterica serovar Typhi
cuaacgucuuauccggccua

SEQ ID NO: 1656543 - RNA, 15 nt, Salmonella enterica enterica serovar Typhi
cuaccacgcugccgc

SEQ ID NO: 1656544 - RNA, 23 nt, Salmonella enterica enterica serovar Typhi
cuaccacagaaaucgccgggcua

SEQ ID NO: 1656545 - RNA, 20 nt, Salmonella enterica enterica serovar Typhi
cuaccacgccgcuacugccg

SEQ ID NO: 1656546 - RNA, 15 nt, Salmonella enterica enterica serovar Typhi
cuaaugaagcgcguu

SEQ ID NO: 1656547 - RNA, 15 nt, Salmonella enterica enterica serovar Typhi
cuaaugagccagaug

SEQ ID NO: 1656548 - RNA, 23 nt, Salmonella enterica enterica serovar Typhi
cuauccucuuuuaucacccggau

SEQ ID NO: 1656549 - RNA, 20 nt, Salmonella enterica enterica serovar Typhi
cuaucgcugcugauuggcga

SEQ ID NO: 1656550 - RNA, 18 nt, Salmonella enterica enterica serovar Typhi
cuaucgcgccggacagca

SEQ ID NO: 1656551 - RNA, 12 nt, Salmonella enterica enterica serovar Typhi
cuaucgcuaucg

SEQ ID NO: 1656552 - RNA, 17 nt, Salmonella enterica enterica serovar Typhi
cuaucgcuccucccuga

SEQ ID NO: 1656553 - RNA, 16 nt, Salmonella enterica enterica serovar Typhi
cuaucgccagcgcguu

SEQ ID NO: 1656554 - RNA, 15 nt, Salmonella enterica enterica serovar Typhi
cuauaacagcgcugg

SEQ ID NO: 1656555 - RNA, 17 nt, Salmonella enterica enterica serovar Typhi
cuaugggauaacgcaga

SEQ ID NO: 1656556 - RNA, 22 nt, Salmonella enterica enterica serovar Typhi
cuaucgggucugcgcgccggaa

SEQ ID NO: 1656557 - RNA, 22 nt, Salmonella enterica enterica serovar Typhi
cuauuagcgcgggauaucgcug

SEQ ID NO: 1656558 - RNA, 23 nt, Salmonella enterica enterica serovar Typhi
cuaggcgcugcuggcagcgcuga

SEQ ID NO: 1656559 - RNA, 13 nt, Salmonella enterica enterica serovar Typhi
cuagggcaucaga

SEQ ID NO: 1656560 - RNA, 18 nt, Salmonella enterica enterica serovar Typhi
cuacgcuuauccggcuua

SEQ ID NO: 1656561 - RNA, 16 nt, Salmonella enterica enterica serovar Typhi
cuacgcugcgcguucu

SEQ ID NO: 1656562 - RNA, 15 nt, Salmonella enterica enterica serovar Typhi
cuacgcuuaucaggc

SEQ ID NO: 1656563 - RNA, 20 nt, Salmonella enterica enterica serovar Typhi
cuacgcggcgggcggaaagc

SEQ ID NO: 1656564 - RNA, 23 nt, Salmonella enterica enterica serovar Typhi
cuacgcgucgccauccggcgaga

SEQ ID NO: 1656565 - RNA, 19 nt, Salmonella enterica enterica serovar Typhi
cuacgccuuauccggccua

SEQ ID NO: 1656566 - RNA, 16 nt, Salmonella enterica enterica serovar Typhi
cuauuucuuagcgcca

SEQ ID NO: 1656567 - RNA, 11 nt, Salmonella enterica enterica serovar Typhi
cucacccugaa

SEQ ID NO: 1656568 - RNA, 17 nt, Salmonella enterica enterica serovar Typhi
cucaccgagacugcccg

SEQ ID NO: 1656569 - RNA, 18 nt, Salmonella enterica enterica serovar Typhi
cucauaaauugcagcgac

SEQ ID NO: 1656570 - RNA, 18 nt, Salmonella enterica enterica serovar Typhi
cucaggccggauaaggcg

SEQ ID NO: 1656571 - RNA, 14 nt, Salmonella enterica enterica serovar Typhi
cucacgcagggugu

SEQ ID NO: 1656572 - RNA, 21 nt, Salmonella enterica enterica serovar Typhi
cuccaccauaucgcagaccau

SEQ ID NO: 1656573 - RNA, 14 nt, Salmonella enterica enterica serovar Typhi
cucaucagcgccau

SEQ ID NO: 1656574 - RNA, 17 nt, Salmonella enterica enterica serovar Typhi
cucaucaaacagggcgu

SEQ ID NO: 1656575 - RNA, 13 nt, Salmonella enterica enterica serovar Typhi
cucaucagaccgu

SEQ ID NO: 1656576 - RNA, 18 nt, Salmonella enterica enterica serovar Typhi
cucauaacggcuacgcag

SEQ ID NO: 1656577 - RNA, 21 nt, Salmonella enterica enterica serovar Typhi
cucauacccacaagcgggaua

SEQ ID NO: 1656578 - RNA, 22 nt, Salmonella enterica enterica serovar Typhi
cucccaggcgcgcagcugccac

SEQ ID NO: 1656579 - RNA, 17 nt, Salmonella enterica enterica serovar Typhi
cucccaggccgccaccg

SEQ ID NO: 1656580 - RNA, 12 nt, Salmonella enterica enterica serovar Typhi
cuccaucacggu

SEQ ID NO: 1656581 - RNA, 19 nt, Salmonella enterica enterica serovar Typhi
cuccagacaggacgccagc

SEQ ID NO: 1656582 - RNA, 12 nt, Salmonella enterica enterica serovar Typhi
cucgcuaaugcc

SEQ ID NO: 1656583 - RNA, 19 nt, Salmonella enterica enterica serovar Typhi
cucgauuugcccuuccagc

SEQ ID NO: 1656584 - RNA, 13 nt, Salmonella enterica enterica serovar Typhi
cucgauccggcag

SEQ ID NO: 1656585 - RNA, 22 nt, Salmonella enterica enterica serovar Typhi
cucgauaauauccgacgccugu

SEQ ID NO: 1656586 - RNA, 16 nt, Salmonella enterica enterica serovar Typhi
cucgauaacuuucggg

SEQ ID NO: 1656587 - RNA, 15 nt, Salmonella enterica enterica serovar Typhi
cuccugcgauagcug

SEQ ID NO: 1656588 - RNA, 18 nt, Salmonella enterica enterica serovar Typhi
cuccugccgaugccgccg

SEQ ID NO: 1656589 - RNA, 18 nt, Salmonella enterica enterica serovar Typhi
cuccucagcgcuuaccac

SEQ ID NO: 1656590 - RNA, 14 nt, Salmonella enterica enterica serovar Typhi
cuccgguugcugau

SEQ ID NO: 1656591 - RNA, 23 nt, Salmonella enterica enterica serovar Typhi
cuccgguaaucaccagaucggca

SEQ ID NO: 1656592 - RNA, 15 nt, Salmonella enterica enterica serovar Typhi
cucccgccagcgaga

SEQ ID NO: 1656593 - RNA, 16 nt, Salmonella enterica enterica serovar Typhi
cugagcuaaucaccca

SEQ ID NO: 1656594 - RNA, 21 nt, Salmonella enterica enterica serovar Typhi
cugagcaaaaccagacgccga

SEQ ID NO: 1656595 - RNA, 20 nt, Salmonella enterica enterica serovar Typhi
cugagccaauuuaugccgga

SEQ ID NO: 1656596 - RNA, 20 nt, Salmonella enterica enterica serovar Typhi
cugagaaaaauacgccagau

SEQ ID NO: 1656597 - RNA, 19 nt, Salmonella enterica enterica serovar Typhi
cugagacucagcagcgcau

SEQ ID NO: 1656598 - RNA, 13 nt, Salmonella enterica enterica serovar Typhi
cugagcaaucagu

SEQ ID NO: 1656599 - RNA, 17 nt, Salmonella enterica enterica serovar Typhi
cugacgcggacgccacc

SEQ ID NO: 1656600 - RNA, 18 nt, Salmonella enterica enterica serovar Typhi
cugacgcggacgccacca

SEQ ID NO: 1656601 - RNA, 22 nt, Salmonella enterica enterica serovar Typhi
cugacugccguauaauccagcu

SEQ ID NO: 1656602 - RNA, 15 nt, Salmonella enterica enterica serovar Typhi
cugacuaucuggaua

SEQ ID NO: 1656603 - RNA, 21 nt, Salmonella enterica enterica serovar Typhi
cugacuguucacgcagcgcau

SEQ ID NO: 1656604 - RNA, 20 nt, Salmonella enterica enterica serovar Typhi
cugaagcguaacagcgcuau

SEQ ID NO: 1656605 - RNA, 13 nt, Salmonella enterica enterica serovar Typhi
cugaagccauccu

SEQ ID NO: 1656606 - RNA, 19 nt, Salmonella enterica enterica serovar Typhi
cugaagcgcaguguuaauc

SEQ ID NO: 1656607 - RNA, 15 nt, Salmonella enterica enterica serovar Typhi
cugacgcgaucgccg

SEQ ID NO: 1656608 - RNA, 20 nt, Salmonella enterica enterica serovar Typhi
cugacgcgcagcgauauagc

SEQ ID NO: 1656609 - RNA, 17 nt, Salmonella enterica enterica serovar Typhi
cugacgcagcuucugau

SEQ ID NO: 1656610 - RNA, 15 nt, Salmonella enterica enterica serovar Typhi
cugaccucaauccgu

SEQ ID NO: 1656611 - RNA, 21 nt, Salmonella enterica enterica serovar Typhi
cugacgacacuuuugccgagc

SEQ ID NO: 1656612 - RNA, 15 nt, Salmonella enterica enterica serovar Typhi
cugauagcacagcgc

SEQ ID NO: 1656613 - RNA, 23 nt, Salmonella enterica enterica serovar Typhi
cugauggcgcugcgcuuaucagg

SEQ ID NO: 1656614 - RNA, 19 nt, Salmonella enterica enterica serovar Typhi
cugauuaauaugaaccaau

SEQ ID NO: 1656615 - RNA, 16 nt, Salmonella enterica enterica serovar Typhi
cugauuuguaggccug

SEQ ID NO: 1656616 - RNA, 16 nt, Salmonella enterica enterica serovar Typhi
cugcaagaagcguuga

SEQ ID NO: 1656617 - RNA, 16 nt, Salmonella enterica enterica serovar Typhi
cugcacaaucgccagc

SEQ ID NO: 1656618 - RNA, 13 nt, Salmonella enterica enterica serovar Typhi
cugaguauagagc

SEQ ID NO: 1656619 - RNA, 19 nt, Salmonella enterica enterica serovar Typhi
cugauaaaagagagcgcca

SEQ ID NO: 1656620 - RNA, 17 nt, Salmonella enterica enterica serovar Typhi
cugauaagcauagcgcc

SEQ ID NO: 1656621 - RNA, 11 nt, Salmonella enterica enterica serovar Typhi
cugaugcguau

SEQ ID NO: 1656622 - RNA, 17 nt, Salmonella enterica enterica serovar Typhi
cugaugcguauccagcg

SEQ ID NO: 1656623 - RNA, 15 nt, Salmonella enterica enterica serovar Typhi
cugaugcgaacgccc

SEQ ID NO: 1656624 - RNA, 17 nt, Salmonella enterica enterica serovar Typhi
cugaugccugaaggcgc

SEQ ID NO: 1656625 - RNA, 23 nt, Salmonella enterica enterica serovar Typhi
cugauacuuauuacgguaucagc

SEQ ID NO: 1656626 - RNA, 14 nt, Salmonella enterica enterica serovar Typhi
cugauaagcguagc

SEQ ID NO: 1656627 - RNA, 16 nt, Salmonella enterica enterica serovar Typhi
cucgguauguccugcc

SEQ ID NO: 1656628 - RNA, 21 nt, Salmonella enterica enterica serovar Typhi
cucgucauagugagcgacuuc

SEQ ID NO: 1656629 - RNA, 20 nt, Salmonella enterica enterica serovar Typhi
cugaacaauacguuucucgc

SEQ ID NO: 1656630 - RNA, 12 nt, Salmonella enterica enterica serovar Typhi
cugaaacgggaa

SEQ ID NO: 1656631 - RNA, 16 nt, Salmonella enterica enterica serovar Typhi
cucuucgugacccgcc

SEQ ID NO: 1656632 - RNA, 14 nt, Salmonella enterica enterica serovar Typhi
cucuucaguaagcg

SEQ ID NO: 1656633 - RNA, 14 nt, Salmonella enterica enterica serovar Typhi
cucuucaguaacca

SEQ ID NO: 1656634 - RNA, 23 nt, Salmonella enterica enterica serovar Typhi
cucuccgguugcugauaacgugc

SEQ ID NO: 1656635 - RNA, 14 nt, Salmonella enterica enterica serovar Typhi
cucuccacgccgca

SEQ ID NO: 1656636 - RNA, 22 nt, Salmonella enterica enterica serovar Typhi
cucgugcaggccggauaagccg

SEQ ID NO: 1656637 - RNA, 21 nt, Salmonella enterica enterica serovar Typhi
cucgugcaggccggauaagcc

SEQ ID NO: 1656638 - RNA, 21 nt, Salmonella enterica enterica serovar Typhi
cucguuaauccaaauccgcau

SEQ ID NO: 1656639 - RNA, 17 nt, Salmonella enterica enterica serovar Typhi
cucugauuucgacgaua

SEQ ID NO: 1656640 - RNA, 16 nt, Salmonella enterica enterica serovar Typhi
cucuucuuccggcgau

SEQ ID NO: 1656641 - RNA, 14 nt, Salmonella enterica enterica serovar Typhi
cucugaaacgcuuc

SEQ ID NO: 1656642 - RNA, 14 nt, Salmonella enterica enterica serovar Typhi
cucguucggucagg

SEQ ID NO: 1656643 - RNA, 20 nt, Salmonella enterica enterica serovar Typhi
cucuaaaugggcaggagaug

SEQ ID NO: 1656644 - RNA, 20 nt, Salmonella enterica enterica serovar Typhi
cucucgugcaggccggauaa

SEQ ID NO: 1656645 - RNA, 20 nt, Salmonella enterica enterica serovar Typhi
cucguaggccggauaagacg

SEQ ID NO: 1656646 - RNA, 17 nt, Salmonella enterica enterica serovar Typhi
cucgauuccugacgcac

SEQ ID NO: 1656647 - RNA, 20 nt, Salmonella enterica enterica serovar Typhi
cucgcaauauucaugccaga

SEQ ID NO: 1656648 - RNA, 15 nt, Salmonella enterica enterica serovar Typhi
cucgcugauggcgag

SEQ ID NO: 1656649 - RNA, 15 nt, Salmonella enterica enterica serovar Typhi
cucgcuaccggcgaa

SEQ ID NO: 1656650 - RNA, 17 nt, Salmonella enterica enterica serovar Typhi
cuccuuuuaccggcgaa

SEQ ID NO: 1656651 - RNA, 20 nt, Salmonella enterica enterica serovar Typhi
cuccggcuaugccggaggau

SEQ ID NO: 1656652 - RNA, 14 nt, Salmonella enterica enterica serovar Typhi
cuccggcugcacca

SEQ ID NO: 1656653 - RNA, 23 nt, Salmonella enterica enterica serovar Typhi
cuccgccgucguaauaauaugcc

SEQ ID NO: 1656654 - RNA, 15 nt, Salmonella enterica enterica serovar Typhi
cuccgcccauccagg

SEQ ID NO: 1656655 - RNA, 16 nt, Salmonella enterica enterica serovar Typhi
cuccgcgcgcguaagc

SEQ ID NO: 1656656 - RNA, 15 nt, Salmonella enterica enterica serovar Typhi
cucgaccuggcgcuc

SEQ ID NO: 1656657 - RNA, 19 nt, Salmonella enterica enterica serovar Typhi
cucaugauagggcagcagu

SEQ ID NO: 1656658 - RNA, 13 nt, Salmonella enterica enterica serovar Typhi
cucauccggcagc

SEQ ID NO: 1656659 - RNA, 19 nt, Salmonella enterica enterica serovar Typhi
cucauacagcccgcgcaga

SEQ ID NO: 1656660 - RNA, 14 nt, Salmonella enterica enterica serovar Typhi
cucauaaccgcgau

SEQ ID NO: 1656661 - RNA, 18 nt, Salmonella enterica enterica serovar Typhi
cucauccccagcaucaug

SEQ ID NO: 1656662 - RNA, 20 nt, Salmonella enterica enterica serovar Typhi
cucauauacccugcggcgaa

SEQ ID NO: 1656663 - RNA, 19 nt, Salmonella enterica enterica serovar Typhi
cucagguuauauuccgccu

SEQ ID NO: 1656664 - RNA, 17 nt, Salmonella enterica enterica serovar Typhi
cucccggcgcccauccg

SEQ ID NO: 1656665 - RNA, 22 nt, Salmonella enterica enterica serovar Typhi
cucccgcgucacgaccggcgaa

SEQ ID NO: 1656666 - RNA, 17 nt, Salmonella enterica enterica serovar Typhi
cuccgcaaagcccauca

SEQ ID NO: 1656667 - RNA, 19 nt, Salmonella enterica enterica serovar Typhi
cuccgcacgguuagccgga

SEQ ID NO: 1656668 - RNA, 16 nt, Salmonella enterica enterica serovar Typhi
cuccgcagccgccgga

SEQ ID NO: 1656669 - RNA, 14 nt, Salmonella enterica enterica serovar Typhi
cuccagcaucacau

SEQ ID NO: 1656670 - RNA, 14 nt, Salmonella enterica enterica serovar Typhi
cuccagccauaaug

SEQ ID NO: 1656671 - RNA, 23 nt, Salmonella enterica enterica serovar Typhi
cuccagcgauagucguugcgccg

SEQ ID NO: 1656672 - RNA, 20 nt, Salmonella enterica enterica serovar Typhi
cuccccagaaugauaaugcc

SEQ ID NO: 1656673 - RNA, 13 nt, Salmonella enterica enterica serovar Typhi
cuccagcgccagc

SEQ ID NO: 1656674 - RNA, 19 nt, Salmonella enterica enterica serovar Typhi
cguucugaccugcgcaaau

SEQ ID NO: 1656675 - RNA, 23 nt, Salmonella enterica enterica serovar Typhi
cguucuauugucaccgggcgcug

SEQ ID NO: 1656676 - RNA, 14 nt, Salmonella enterica enterica serovar Typhi
cguugauaucgcug

SEQ ID NO: 1656677 - RNA, 13 nt, Salmonella enterica enterica serovar Typhi
cguugaucgccau

SEQ ID NO: 1656678 - RNA, 19 nt, Salmonella enterica enterica serovar Typhi
cguugaguuugacugccag

SEQ ID NO: 1656679 - RNA, 14 nt, Salmonella enterica enterica serovar Typhi
cguugcggcguauc

SEQ ID NO: 1656680 - RNA, 17 nt, Salmonella enterica enterica serovar Typhi
cguugcccaucgcaacg

SEQ ID NO: 1656681 - RNA, 22 nt, Salmonella enterica enterica serovar Typhi
cguucgcggggguuauucagcg

SEQ ID NO: 1656682 - RNA, 17 nt, Salmonella enterica enterica serovar Typhi
cguucgcggaacggcga

SEQ ID NO: 1656683 - RNA, 17 nt, Salmonella enterica enterica serovar Typhi
cguucgcgguaaucgcg

SEQ ID NO: 1656684 - RNA, 20 nt, Salmonella enterica enterica serovar Typhi
cguucgcgucacaaucgcgc

SEQ ID NO: 1656685 - RNA, 20 nt, Salmonella enterica enterica serovar Typhi
cguucggacuggggauggcc

SEQ ID NO: 1656686 - RNA, 16 nt, Salmonella enterica enterica serovar Typhi
cguucgcccugcgcca

SEQ ID NO: 1656687 - RNA, 15 nt, Salmonella enterica enterica serovar Typhi
cguucaugucggccu

SEQ ID NO: 1656688 - RNA, 15 nt, Salmonella enterica enterica serovar Typhi
cguucaucggcauac

SEQ ID NO: 1656689 - RNA, 21 nt, Salmonella enterica enterica serovar Typhi
cguuccacacguccauccggg

SEQ ID NO: 1656690 - RNA, 18 nt, Salmonella enterica enterica serovar Typhi
cguuccgguucaggcuua

SEQ ID NO: 1656691 - RNA, 16 nt, Salmonella enterica enterica serovar Typhi
cguuccucaacagcgc

SEQ ID NO: 1656692 - RNA, 14 nt, Salmonella enterica enterica serovar Typhi
cguuccuuaucagc

SEQ ID NO: 1656693 - RNA, 12 nt, Salmonella enterica enterica serovar Typhi
cguuagcgcaaa

SEQ ID NO: 1656694 - RNA, 21 nt, Salmonella enterica enterica serovar Typhi
cguuagcguuuugaacgccgc

SEQ ID NO: 1656695 - RNA, 22 nt, Salmonella enterica enterica serovar Typhi
cguuagcucuuucauuucugcc

SEQ ID NO: 1656696 - RNA, 16 nt, Salmonella enterica enterica serovar Typhi
cguuagcggcguugcc

SEQ ID NO: 1656697 - RNA, 18 nt, Salmonella enterica enterica serovar Typhi
cguuagcgucauccggca

SEQ ID NO: 1656698 - RNA, 13 nt, Salmonella enterica enterica serovar Typhi
cguuauccgccug

SEQ ID NO: 1656699 - RNA, 14 nt, Salmonella enterica enterica serovar Typhi
cguuaccguggcgg

SEQ ID NO: 1656700 - RNA, 18 nt, Salmonella enterica enterica serovar Typhi
cguuacccgugcgcgucg

SEQ ID NO: 1656701 - RNA, 19 nt, Salmonella enterica enterica serovar Typhi
cguggccaaaaaaucgcug

SEQ ID NO: 1656702 - RNA, 13 nt, Salmonella enterica enterica serovar Typhi
cguggcaaucagc

SEQ ID NO: 1656703 - RNA, 18 nt, Salmonella enterica enterica serovar Typhi
cgugcucauuugcggcgu

SEQ ID NO: 1656704 - RNA, 17 nt, Salmonella enterica enterica serovar Typhi
cgugcggacguagcggc

SEQ ID NO: 1656705 - RNA, 15 nt, Salmonella enterica enterica serovar Typhi
cgugcgcugcggcca

SEQ ID NO: 1656706 - RNA, 23 nt, Salmonella enterica enterica serovar Typhi
cgugcgcugcggccagaccgccg

SEQ ID NO: 1656707 - RNA, 13 nt, Salmonella enterica enterica serovar Typhi
cguggccuccggc

SEQ ID NO: 1656708 - RNA, 17 nt, Salmonella enterica enterica serovar Typhi
cguguaaggcuuccggc

SEQ ID NO: 1656709 - RNA, 23 nt, Salmonella enterica enterica serovar Typhi
cgugucaucaaaaucaucgccac

SEQ ID NO: 1656710 - RNA, 23 nt, Salmonella enterica enterica serovar Typhi
cgugucagacccgauagcgccgc

SEQ ID NO: 1656711 - RNA, 13 nt, Salmonella enterica enterica serovar Typhi
cuacaacucagcg

SEQ ID NO: 1656712 - RNA, 21 nt, Salmonella enterica enterica serovar Typhi
cuaauuugagucgcagcacau

SEQ ID NO: 1656713 - RNA, 21 nt, Salmonella enterica enterica serovar Typhi
cuacagacaucuuugccaaac

SEQ ID NO: 1656714 - RNA, 13 nt, Salmonella enterica enterica serovar Typhi
cuaccacccagcc

SEQ ID NO: 1656715 - RNA, 19 nt, Salmonella enterica enterica serovar Typhi
cuacccagacaagcacaua

SEQ ID NO: 1656716 - RNA, 17 nt, Salmonella enterica enterica serovar Typhi
cuaccagcgcggcgcca

SEQ ID NO: 1656717 - RNA, 16 nt, Salmonella enterica enterica serovar Typhi
cuaccaucggcgcuac

SEQ ID NO: 1656718 - RNA, 17 nt, Salmonella enterica enterica serovar Typhi
cuaagcagaacggcgau

SEQ ID NO: 1656719 - RNA, 14 nt, Salmonella enterica enterica serovar Typhi
cuaagaccagcauc

SEQ ID NO: 1656720 - RNA, 19 nt, Salmonella enterica enterica serovar Typhi
cuaauauccaccagcccau

SEQ ID NO: 1656721 - RNA, 19 nt, Salmonella enterica enterica serovar Typhi
cuaaugcuuauccggccua

SEQ ID NO: 1656722 - RNA, 16 nt, Salmonella enterica enterica serovar Typhi
cuaauuaucugccagc

SEQ ID NO: 1656723 - RNA, 23 nt, Salmonella enterica enterica serovar Typhi
cuacgcuuaucaggccuacaacg

SEQ ID NO: 1656724 - RNA, 18 nt, Salmonella enterica enterica serovar Typhi
cuacgcuuaucaggccua

SEQ ID NO: 1656725 - RNA, 16 nt, Salmonella enterica enterica serovar Typhi
cuaccgucgccgacaa

SEQ ID NO: 1656726 - RNA, 13 nt, Salmonella enterica enterica serovar Typhi
cuacccgcugacg

SEQ ID NO: 1656727 - RNA, 12 nt, Salmonella enterica enterica serovar Typhi
cuacugccgcca

SEQ ID NO: 1656728 - RNA, 20 nt, Salmonella enterica enterica serovar Typhi
cuacuuuaaauucggcguua

SEQ ID NO: 1656729 - RNA, 21 nt, Salmonella enterica enterica serovar Typhi
cuacuuuaucgaaugccggaa

SEQ ID NO: 1656730 - RNA, 14 nt, Salmonella enterica enterica serovar Typhi
cuagcgcaguuugu

SEQ ID NO: 1656731 - RNA, 20 nt, Salmonella enterica enterica serovar Typhi
cuagcgccuuauccggccua

SEQ ID NO: 1656732 - RNA, 15 nt, Salmonella enterica enterica serovar Typhi
cuagcuuaucgggcc

SEQ ID NO: 1656733 - RNA, 23 nt, Salmonella enterica enterica serovar Typhi
cguuucacgcgcgccugccgcca

SEQ ID NO: 1656734 - RNA, 14 nt, Salmonella enterica enterica serovar Typhi
cguuuaugccgcca

SEQ ID NO: 1656735 - RNA, 20 nt, Salmonella enterica enterica serovar Typhi
cguuuauauaaaaauagcug

SEQ ID NO: 1656736 - RNA, 17 nt, Salmonella enterica enterica serovar Typhi
cguuuaccuucgauaac

SEQ ID NO: 1656737 - RNA, 20 nt, Salmonella enterica enterica serovar Typhi
cguuuacaccgccauccggc

SEQ ID NO: 1656738 - RNA, 19 nt, Salmonella enterica enterica serovar Typhi
cguuuaacgcaucgcggau

SEQ ID NO: 1656739 - RNA, 12 nt, Salmonella enterica enterica serovar Typhi
cguuuaaacggg

SEQ ID NO: 1656740 - RNA, 16 nt, Salmonella enterica enterica serovar Typhi
cguuggcgauuuccag

SEQ ID NO: 1656741 - RNA, 23 nt, Salmonella enterica enterica serovar Typhi
cuaaacaauuugcccagcgcugg

SEQ ID NO: 1656742 - RNA, 11 nt, Salmonella enterica enterica serovar Typhi
cuaaaccggcg

SEQ ID NO: 1656743 - RNA, 18 nt, Salmonella enterica enterica serovar Typhi
cuaaaccggcggaauagc

SEQ ID NO: 1656744 - RNA, 16 nt, Salmonella enterica enterica serovar Typhi
cuaaagagcgccugac

SEQ ID NO: 1656745 - RNA, 20 nt, Salmonella enterica enterica serovar Typhi
cuaacgccugauccggccua

SEQ ID NO: 1656746 - RNA, 19 nt, Salmonella enterica enterica serovar Typhi
cuaacgcuuauccggccua

SEQ ID NO: 1656747 - RNA, 22 nt, Salmonella enterica enterica serovar Typhi
cguuuugugucaaaaaguuguc

SEQ ID NO: 1656748 - RNA, 14 nt, Salmonella enterica enterica serovar Typhi
cguuuugcgcguaa

SEQ ID NO: 1656749 - RNA, 16 nt, Salmonella enterica enterica serovar Typhi
cguuuugcagcgccau

SEQ ID NO: 1656750 - RNA, 14 nt, Salmonella enterica enterica serovar Typhi
cguuuuacgcugcc

SEQ ID NO: 1656751 - RNA, 13 nt, Salmonella enterica enterica serovar Typhi
cguuuuauaagcc

SEQ ID NO: 1656752 - RNA, 15 nt, Salmonella enterica enterica serovar Typhi
cguuuggcgauguuu

SEQ ID NO: 1656753 - RNA, 19 nt, Salmonella enterica enterica serovar Typhi
cguuucguguuguccggcu

SEQ ID NO: 1656754 - RNA, 18 nt, Salmonella enterica enterica serovar Typhi
cguuucguuuagcgccug

SEQ ID NO: 1656755 - RNA, 14 nt, Salmonella enterica enterica serovar Typhi
cggguaauuugcgc

SEQ ID NO: 1656756 - RNA, 21 nt, Salmonella enterica enterica serovar Typhi
cggucgccguuaacuggcgca

SEQ ID NO: 1656757 - RNA, 16 nt, Salmonella enterica enterica serovar Typhi
cggucgcuucaaucgu

SEQ ID NO: 1656758 - RNA, 17 nt, Salmonella enterica enterica serovar Typhi
cggucgcgccagcgacc

SEQ ID NO: 1656759 - RNA, 17 nt, Salmonella enterica enterica serovar Typhi
cggugaaaguaccgcuu

SEQ ID NO: 1656760 - RNA, 24 nt, Salmonella enterica enterica serovar Typhi
cggugauauuuuagccaucccggc

SEQ ID NO: 1656761 - RNA, 22 nt, Salmonella enterica enterica serovar Typhi
cggugacgcgaucgucgguaau

SEQ ID NO: 1656762 - RNA, 19 nt, Salmonella enterica enterica serovar Typhi
cggugcggucacaggcaua

SEQ ID NO: 1656763 - RNA, 18 nt, Salmonella enterica enterica serovar Typhi
cgguggcaacgcuggcgg

SEQ ID NO: 1656764 - RNA, 17 nt, Salmonella enterica enterica serovar Typhi
cggugcuguagcugccc

SEQ ID NO: 1656765 - RNA, 17 nt, Salmonella enterica enterica serovar Typhi
cggugcgauucagcgca

SEQ ID NO: 1656766 - RNA, 16 nt, Salmonella enterica enterica serovar Typhi
cgguggucaucgcggc

SEQ ID NO: 1656767 - RNA, 22 nt, Salmonella enterica enterica serovar Typhi
cgguggccgagaguccagcgcc

SEQ ID NO: 1656768 - RNA, 13 nt, Salmonella enterica enterica serovar Typhi
cgguggcgccacg

SEQ ID NO: 1656769 - RNA, 18 nt, Salmonella enterica enterica serovar Typhi
cggugugaccagcgcguu

SEQ ID NO: 1656770 - RNA, 15 nt, Salmonella enterica enterica serovar Typhi
cgguguccaucaggc

SEQ ID NO: 1656771 - RNA, 18 nt, Salmonella enterica enterica serovar Typhi
cgguguaccccgccugac

SEQ ID NO: 1656772 - RNA, 22 nt, Salmonella enterica enterica serovar Typhi
cgguuggccagcauggcgguca

SEQ ID NO: 1656773 - RNA, 15 nt, Salmonella enterica enterica serovar Typhi
cguaaaaucagcauc

SEQ ID NO: 1656774 - RNA, 13 nt, Salmonella enterica enterica serovar Typhi
cguaaaaucagca

SEQ ID NO: 1656775 - RNA, 18 nt, Salmonella enterica enterica serovar Typhi
cguaaagcgcauccagcu

SEQ ID NO: 1656776 - RNA, 18 nt, Salmonella enterica enterica serovar Typhi
cgguuguuuacacggcaa

SEQ ID NO: 1656777 - RNA, 15 nt, Salmonella enterica enterica serovar Typhi
cgguuuaagcggaua

SEQ ID NO: 1656778 - RNA, 20 nt, Salmonella enterica enterica serovar Typhi
cgguuuauccgcaacugaaa

SEQ ID NO: 1656779 - RNA, 23 nt, Salmonella enterica enterica serovar Typhi
cgguuuaugaugccgcuucgcca

SEQ ID NO: 1656780 - RNA, 14 nt, Salmonella enterica enterica serovar Typhi
cgguucucccggca

SEQ ID NO: 1656781 - RNA, 22 nt, Salmonella enterica enterica serovar Typhi
cgguuaacugcccguuacgcau

SEQ ID NO: 1656782 - RNA, 21 nt, Salmonella enterica enterica serovar Typhi
cgguguuucaucuucaucacu

SEQ ID NO: 1656783 - RNA, 23 nt, Salmonella enterica enterica serovar Typhi
cguaggguacagagguaagaugu

SEQ ID NO: 1656784 - RNA, 19 nt, Salmonella enterica enterica serovar Typhi
cguaaugccgaccagcguc

SEQ ID NO: 1656785 - RNA, 20 nt, Salmonella enterica enterica serovar Typhi
cguaaugagcgucgccagac

SEQ ID NO: 1656786 - RNA, 19 nt, Salmonella enterica enterica serovar Typhi
cguaaucacccgcuuccag

SEQ ID NO: 1656787 - RNA, 16 nt, Salmonella enterica enterica serovar Typhi
cguaagucguaccggc

SEQ ID NO: 1656788 - RNA, 16 nt, Salmonella enterica enterica serovar Typhi
cguaauaaggcggaua

SEQ ID NO: 1656789 - RNA, 19 nt, Salmonella enterica enterica serovar Typhi
cguaauacguaaaccgcuc

SEQ ID NO: 1656790 - RNA, 13 nt, Salmonella enterica enterica serovar Typhi
cguaaaucaggcc

SEQ ID NO: 1656791 - RNA, 19 nt, Salmonella enterica enterica serovar Typhi
cguaaauccacauuccaga

SEQ ID NO: 1656792 - RNA, 23 nt, Salmonella enterica enterica serovar Typhi
cguaaauccuccaucaugggcgc

SEQ ID NO: 1656793 - RNA, 22 nt, Salmonella enterica enterica serovar Typhi
cguaaauuauuuuacgcgggau

SEQ ID NO: 1656794 - RNA, 23 nt, Salmonella enterica enterica serovar Typhi
cguaaaucgcgagccuucaacaa

SEQ ID NO: 1656795 - RNA, 22 nt, Salmonella enterica enterica serovar Typhi
cgucaacgcacuguaacgcacu

SEQ ID NO: 1656796 - RNA, 12 nt, Salmonella enterica enterica serovar Typhi
cgucaagacgcu

SEQ ID NO: 1656797 - RNA, 21 nt, Salmonella enterica enterica serovar Typhi
cguauugccggauaagacgca

SEQ ID NO: 1656798 - RNA, 13 nt, Salmonella enterica enterica serovar Typhi
cgucaaacgucca

SEQ ID NO: 1656799 - RNA, 14 nt, Salmonella enterica enterica serovar Typhi
cguauggcgucgug

SEQ ID NO: 1656800 - RNA, 20 nt, Salmonella enterica enterica serovar Typhi
cguauugccggauaagacgc

SEQ ID NO: 1656801 - RNA, 16 nt, Salmonella enterica enterica serovar Typhi
cguauagcccagaauc

SEQ ID NO: 1656802 - RNA, 19 nt, Salmonella enterica enterica serovar Typhi
cguauaaggcgaagcccau

SEQ ID NO: 1656803 - RNA, 16 nt, Salmonella enterica enterica serovar Typhi
cgucaggcuugccgcg

SEQ ID NO: 1656804 - RNA, 19 nt, Salmonella enterica enterica serovar Typhi
cgucaggcuugccgcgcca

SEQ ID NO: 1656805 - RNA, 19 nt, Salmonella enterica enterica serovar Typhi
cgucaggccgccgcacagg

SEQ ID NO: 1656806 - RNA, 17 nt, Salmonella enterica enterica serovar Typhi
cgucaggacggcgaaua

SEQ ID NO: 1656807 - RNA, 15 nt, Salmonella enterica enterica serovar Typhi
cgucagcaucuccug

SEQ ID NO: 1656808 - RNA, 20 nt, Salmonella enterica enterica serovar Typhi
cgucagcgaccauugcguau

SEQ ID NO: 1656809 - RNA, 17 nt, Salmonella enterica enterica serovar Typhi
cgucagcgcuugccgca

SEQ ID NO: 1656810 - RNA, 14 nt, Salmonella enterica enterica serovar Typhi
cgucacaaucgcgc

SEQ ID NO: 1656811 - RNA, 13 nt, Salmonella enterica enterica serovar Typhi
cgucacaaucgcg

SEQ ID NO: 1656812 - RNA, 15 nt, Salmonella enterica enterica serovar Typhi
cgucaauaaucgcgc

SEQ ID NO: 1656813 - RNA, 13 nt, Salmonella enterica enterica serovar Typhi
cgucacuuuauca

SEQ ID NO: 1656814 - RNA, 22 nt, Salmonella enterica enterica serovar Typhi
cgucacuuccggaugcgccuca

SEQ ID NO: 1656815 - RNA, 22 nt, Salmonella enterica enterica serovar Typhi
cgucagacggcuccagcgccag

SEQ ID NO: 1656816 - RNA, 15 nt, Salmonella enterica enterica serovar Typhi
cgucagaaauccgcg

SEQ ID NO: 1656817 - RNA, 15 nt, Salmonella enterica enterica serovar Typhi
cgucagauucugcgg

SEQ ID NO: 1656818 - RNA, 19 nt, Salmonella enterica enterica serovar Typhi
cgucagauucugcgguaau

SEQ ID NO: 1656819 - RNA, 12 nt, Salmonella enterica enterica serovar Typhi
cguccugcggcu

SEQ ID NO: 1656820 - RNA, 20 nt, Salmonella enterica enterica serovar Typhi
cguccgucagauccgcaaga

SEQ ID NO: 1656821 - RNA, 22 nt, Salmonella enterica enterica serovar Typhi
cguccgauggacucccaggugu

SEQ ID NO: 1656822 - RNA, 13 nt, Salmonella enterica enterica serovar Typhi
cgucauccggcaa

SEQ ID NO: 1656823 - RNA, 13 nt, Salmonella enterica enterica serovar Typhi
cgucauaaucgcg

SEQ ID NO: 1656824 - RNA, 15 nt, Salmonella enterica enterica serovar Typhi
cgucauacugccaac

SEQ ID NO: 1656825 - RNA, 21 nt, Salmonella enterica enterica serovar Typhi
cgucaucaggcguuguaauaa

SEQ ID NO: 1656826 - RNA, 16 nt, Salmonella enterica enterica serovar Typhi
cgucauauagccgcgc

SEQ ID NO: 1656827 - RNA, 14 nt, Salmonella enterica enterica serovar Typhi
cguccacacgccug

SEQ ID NO: 1656828 - RNA, 23 nt, Salmonella enterica enterica serovar Typhi
cguccacggcgggacgcugcgcg

SEQ ID NO: 1656829 - RNA, 13 nt, Salmonella enterica enterica serovar Typhi
cguccccagccag

SEQ ID NO: 1656830 - RNA, 17 nt, Salmonella enterica enterica serovar Typhi
cgucgggggcgacaaac

SEQ ID NO: 1656831 - RNA, 23 nt, Salmonella enterica enterica serovar Typhi
cgucgcgacguccgccaacagcc

SEQ ID NO: 1656832 - RNA, 15 nt, Salmonella enterica enterica serovar Typhi
cgucgccugaaugca

SEQ ID NO: 1656833 - RNA, 14 nt, Salmonella enterica enterica serovar Typhi
cgucgccgacaacg

SEQ ID NO: 1656834 - RNA, 21 nt, Salmonella enterica enterica serovar Typhi
cugguuauccaccagcgccau

SEQ ID NO: 1656835 - RNA, 16 nt, Salmonella enterica enterica serovar Typhi
cuggucgcucugcgca

SEQ ID NO: 1656836 - RNA, 16 nt, Salmonella enterica enterica serovar Typhi
cuggucgucugaaagc

SEQ ID NO: 1656837 - RNA, 14 nt, Salmonella enterica enterica serovar Typhi
cuggugaaacaggu

SEQ ID NO: 1656838 - RNA, 20 nt, Salmonella enterica enterica serovar Typhi
cuggccguuuucccggcaau

SEQ ID NO: 1656839 - RNA, 19 nt, Salmonella enterica enterica serovar Typhi
cuggccguuuucccggcaa

SEQ ID NO: 1656840 - RNA, 23 nt, Salmonella enterica enterica serovar Typhi
cugguagagcaucgcggcaucau

SEQ ID NO: 1656841 - RNA, 14 nt, Salmonella enterica enterica serovar Typhi
cugguaagcguagc

SEQ ID NO: 1656842 - RNA, 20 nt, Salmonella enterica enterica serovar Typhi
cuggguauuuuuuagcgcca

SEQ ID NO: 1656843 - RNA, 16 nt, Salmonella enterica enterica serovar Typhi
cuggguagaguaaccc

SEQ ID NO: 1656844 - RNA, 22 nt, Salmonella enterica enterica serovar Typhi
cugucgauaacagcauaaacgu

SEQ ID NO: 1656845 - RNA, 14 nt, Salmonella enterica enterica serovar Typhi
cuguucaugccaga

SEQ ID NO: 1656846 - RNA, 19 nt, Salmonella enterica enterica serovar Typhi
cuguuccagugggcggaua

SEQ ID NO: 1656847 - RNA, 14 nt, Salmonella enterica enterica serovar Typhi
cuguucgccuucgu

SEQ ID NO: 1656848 - RNA, 20 nt, Salmonella enterica enterica serovar Typhi
cuguaaacgcuucugcgccg

SEQ ID NO: 1656849 - RNA, 15 nt, Salmonella enterica enterica serovar Typhi
cuguaacaguauccg

SEQ ID NO: 1656850 - RNA, 14 nt, Salmonella enterica enterica serovar Typhi
cuguaacaguaucc

SEQ ID NO: 1656851 - RNA, 14 nt, Salmonella enterica enterica serovar Typhi
cuguaauacgcugu

SEQ ID NO: 1656852 - RNA, 20 nt, Salmonella enterica enterica serovar Typhi
cuguaacuucggccagcgag

SEQ ID NO: 1656853 - RNA, 19 nt, Salmonella enterica enterica serovar Typhi
cuguaccagacgcgaacgu

SEQ ID NO: 1656854 - RNA, 17 nt, Salmonella enterica enterica serovar Typhi
cuguccgguguccauca

SEQ ID NO: 1656855 - RNA, 13 nt, Salmonella enterica enterica serovar Typhi
cuguccggguauc

SEQ ID NO: 1656856 - RNA, 18 nt, Salmonella enterica enterica serovar Typhi
cuguccuuucugcugccg

SEQ ID NO: 1656857 - RNA, 14 nt, Salmonella enterica enterica serovar Typhi
cugucccugccagc

SEQ ID NO: 1656858 - RNA, 22 nt, Salmonella enterica enterica serovar Typhi
cuucacgcgcggcuacugccag

SEQ ID NO: 1656859 - RNA, 15 nt, Salmonella enterica enterica serovar Typhi
cuucaccucagccaa

SEQ ID NO: 1656860 - RNA, 13 nt, Salmonella enterica enterica serovar Typhi
cuucacgccaucg

SEQ ID NO: 1656861 - RNA, 18 nt, Salmonella enterica enterica serovar Typhi
cuucacaaccaucgucug

SEQ ID NO: 1656862 - RNA, 19 nt, Salmonella enterica enterica serovar Typhi
cuucacacgaacuuuaucu

SEQ ID NO: 1656863 - RNA, 23 nt, Salmonella enterica enterica serovar Typhi
cuucacccgcgggcggcguuuca

SEQ ID NO: 1656864 - RNA, 15 nt, Salmonella enterica enterica serovar Typhi
cuuaucaagcgauac

SEQ ID NO: 1656865 - RNA, 14 nt, Salmonella enterica enterica serovar Typhi
cuuauaucauggga

SEQ ID NO: 1656866 - RNA, 23 nt, Salmonella enterica enterica serovar Typhi
cuuaucaggccuguaaaccgccu

SEQ ID NO: 1656867 - RNA, 18 nt, Salmonella enterica enterica serovar Typhi
cuguugaggaaauucuga

SEQ ID NO: 1656868 - RNA, 23 nt, Salmonella enterica enterica serovar Typhi
cuuacagcuucgguccggcgcua

SEQ ID NO: 1656869 - RNA, 17 nt, Salmonella enterica enterica serovar Typhi
cuuacacacccggccua

SEQ ID NO: 1656870 - RNA, 19 nt, Salmonella enterica enterica serovar Typhi
cuuagcaacugccggcuua

SEQ ID NO: 1656871 - RNA, 16 nt, Salmonella enterica enterica serovar Typhi
cuuacccacuguaucg

SEQ ID NO: 1656872 - RNA, 13 nt, Salmonella enterica enterica serovar Typhi
cuuaccgcaucgc

SEQ ID NO: 1656873 - RNA, 16 nt, Salmonella enterica enterica serovar Typhi
cuuacgcucgcugaug

SEQ ID NO: 1656874 - RNA, 19 nt, Salmonella enterica enterica serovar Typhi
cuuacgcuuacccggccua

SEQ ID NO: 1656875 - RNA, 21 nt, Salmonella enterica enterica serovar Typhi
cuugauggaaaacgcaucugg

SEQ ID NO: 1656876 - RNA, 21 nt, Salmonella enterica enterica serovar Typhi
cuugauggcgaucagcgccac

SEQ ID NO: 1656877 - RNA, 20 nt, Salmonella enterica enterica serovar Typhi
cuugauugcaagaauaugag

SEQ ID NO: 1656878 - RNA, 13 nt, Salmonella enterica enterica serovar Typhi
cuugccagcgcau

SEQ ID NO: 1656879 - RNA, 22 nt, Salmonella enterica enterica serovar Typhi
cuuguaaaaaugccugugccag

SEQ ID NO: 1656880 - RNA, 19 nt, Salmonella enterica enterica serovar Typhi
cuugcgcagcauaucgccg

SEQ ID NO: 1656881 - RNA, 21 nt, Salmonella enterica enterica serovar Typhi
cuugcgccgccauccggccug

SEQ ID NO: 1656882 - RNA, 20 nt, Salmonella enterica enterica serovar Typhi
cuugccucacccugaaaucc

SEQ ID NO: 1656883 - RNA, 15 nt, Salmonella enterica enterica serovar Typhi
cuucgauaaacgccu

SEQ ID NO: 1656884 - RNA, 16 nt, Salmonella enterica enterica serovar Typhi
cuucgaccgccauaau

SEQ ID NO: 1656885 - RNA, 17 nt, Salmonella enterica enterica serovar Typhi
cuucgccguuaucggcc

SEQ ID NO: 1656886 - RNA, 20 nt, Salmonella enterica enterica serovar Typhi
cuucacuaauuugaugccug

SEQ ID NO: 1656887 - RNA, 16 nt, Salmonella enterica enterica serovar Typhi
cuucccacagucggcg

SEQ ID NO: 1656888 - RNA, 16 nt, Salmonella enterica enterica serovar Typhi
cuuccaguugaaaacc

SEQ ID NO: 1656889 - RNA, 15 nt, Salmonella enterica enterica serovar Typhi
cuuccggugugacca

SEQ ID NO: 1656890 - RNA, 17 nt, Salmonella enterica enterica serovar Typhi
cuugaauccuuuaaucg

SEQ ID NO: 1656891 - RNA, 17 nt, Salmonella enterica enterica serovar Typhi
cuucugacagugacggc

SEQ ID NO: 1656892 - RNA, 16 nt, Salmonella enterica enterica serovar Typhi
cuucuguaauacgcug

SEQ ID NO: 1656893 - RNA, 23 nt, Salmonella enterica enterica serovar Typhi
cuucugucagccuugcaucucau

SEQ ID NO: 1656894 - RNA, 13 nt, Salmonella enterica enterica serovar Typhi
cugcgcugccagc

SEQ ID NO: 1656895 - RNA, 18 nt, Salmonella enterica enterica serovar Typhi
cugcgcuuaucaggccua

SEQ ID NO: 1656896 - RNA, 13 nt, Salmonella enterica enterica serovar Typhi
cugcgcuucugau

SEQ ID NO: 1656897 - RNA, 16 nt, Salmonella enterica enterica serovar Typhi
cugcgcuugcggccga

SEQ ID NO: 1656898 - RNA, 19 nt, Salmonella enterica enterica serovar Typhi
cugcggcugacgcgaugac

SEQ ID NO: 1656899 - RNA, 20 nt, Salmonella enterica enterica serovar Typhi
cugcggcacgucauuacggu

SEQ ID NO: 1656900 - RNA, 20 nt, Salmonella enterica enterica serovar Typhi
cugcggcaaaauuagccagu

SEQ ID NO: 1656901 - RNA, 13 nt, Salmonella enterica enterica serovar Typhi
cugcgccagcgca

SEQ ID NO: 1656902 - RNA, 23 nt, Salmonella enterica enterica serovar Typhi
cugcgccauguucauaaagugcc

SEQ ID NO: 1656903 - RNA, 14 nt, Salmonella enterica enterica serovar Typhi
cugcgccagccgga

SEQ ID NO: 1656904 - RNA, 20 nt, Salmonella enterica enterica serovar Typhi
cugcgccacaucauugcugu

SEQ ID NO: 1656905 - RNA, 23 nt, Salmonella enterica enterica serovar Typhi
cugcgcgccaaaccguucacgcu

SEQ ID NO: 1656906 - RNA, 22 nt, Salmonella enterica enterica serovar Typhi
cugcgccguuccguucgcguca

SEQ ID NO: 1656907 - RNA, 20 nt, Salmonella enterica enterica serovar Typhi
cugccguuuuuaacgccggc

SEQ ID NO: 1656908 - RNA, 22 nt, Salmonella enterica enterica serovar Typhi
cugccguuuuuaacgccggcaa

SEQ ID NO: 1656909 - RNA, 14 nt, Salmonella enterica enterica serovar Typhi
cugccugcuucaga

SEQ ID NO: 1656910 - RNA, 16 nt, Salmonella enterica enterica serovar Typhi
cugccuucugaaaguu

SEQ ID NO: 1656911 - RNA, 21 nt, Salmonella enterica enterica serovar Typhi
cugccuuuguacagcuugccg

SEQ ID NO: 1656912 - RNA, 15 nt, Salmonella enterica enterica serovar Typhi
cugcgaaaagcgugc

SEQ ID NO: 1656913 - RNA, 20 nt, Salmonella enterica enterica serovar Typhi
cugccuguagcagcgccagc

SEQ ID NO: 1656914 - RNA, 18 nt, Salmonella enterica enterica serovar Typhi
cugccuguuuacggcagg

SEQ ID NO: 1656915 - RNA, 18 nt, Salmonella enterica enterica serovar Typhi
cugaaacgcuucaccggc

SEQ ID NO: 1656916 - RNA, 12 nt, Salmonella enterica enterica serovar Typhi
cugaaagcgccu

SEQ ID NO: 1656917 - RNA, 21 nt, Salmonella enterica enterica serovar Typhi
cugaaagccgacccgcaucag

SEQ ID NO: 1656918 - RNA, 14 nt, Salmonella enterica enterica serovar Typhi
cugccgcaaacgcc

SEQ ID NO: 1656919 - RNA, 16 nt, Salmonella enterica enterica serovar Typhi
cugccggcuuaacgcu

SEQ ID NO: 1656920 - RNA, 15 nt, Salmonella enterica enterica serovar Typhi
cugccgcgcgguauu

SEQ ID NO: 1656921 - RNA, 18 nt, Salmonella enterica enterica serovar Typhi
cugcucccgcugcggcgu

SEQ ID NO: 1656922 - RNA, 15 nt, Salmonella enterica enterica serovar Typhi
cugcuccugcggcgu

SEQ ID NO: 1656923 - RNA, 15 nt, Salmonella enterica enterica serovar Typhi
cugcuccgccagcaa

SEQ ID NO: 1656924 - RNA, 14 nt, Salmonella enterica enterica serovar Typhi
cugcggguagucau

SEQ ID NO: 1656925 - RNA, 15 nt, Salmonella enterica enterica serovar Typhi
cugcgguaaucgccg

SEQ ID NO: 1656926 - RNA, 16 nt, Salmonella enterica enterica serovar Typhi
cugcgguacggccagc

SEQ ID NO: 1656927 - RNA, 22 nt, Salmonella enterica enterica serovar Typhi
cugcggucguauuuaccgcugg

SEQ ID NO: 1656928 - RNA, 17 nt, Salmonella enterica enterica serovar Typhi
cugcguaaaaucagcau

SEQ ID NO: 1656929 - RNA, 23 nt, Salmonella enterica enterica serovar Typhi
cugcguagacgaugcaggccgga

SEQ ID NO: 1656930 - RNA, 21 nt, Salmonella enterica enterica serovar Typhi
cugcugcucccucacgcguca

SEQ ID NO: 1656931 - RNA, 22 nt, Salmonella enterica enterica serovar Typhi
cugcugcucgguuuugccgaca

SEQ ID NO: 1656932 - RNA, 21 nt, Salmonella enterica enterica serovar Typhi
cugcugccagccgccgccgga

SEQ ID NO: 1656933 - RNA, 16 nt, Salmonella enterica enterica serovar Typhi
cugcugauuggcgacg

SEQ ID NO: 1656934 - RNA, 15 nt, Salmonella enterica enterica serovar Typhi
cugcugacaaucagc

SEQ ID NO: 1656935 - RNA, 16 nt, Salmonella enterica enterica serovar Typhi
cugcucggcggucagc

SEQ ID NO: 1656936 - RNA, 15 nt, Salmonella enterica enterica serovar Typhi
aaccgcuacccggca

SEQ ID NO: 1656937 - RNA, 15 nt, Salmonella enterica enterica serovar Typhi
aaccgcuuuuccugc

SEQ ID NO: 1656938 - RNA, 19 nt, Salmonella enterica enterica serovar Typhi
aaccggacgauuuaagcuu

SEQ ID NO: 1656939 - RNA, 14 nt, Salmonella enterica enterica serovar Typhi
aaccggcaacucgc

SEQ ID NO: 1656940 - RNA, 19 nt, Salmonella enterica enterica serovar Typhi
cuggcagcgccugacggcg

SEQ ID NO: 1656941 - RNA, 17 nt, Salmonella enterica enterica serovar Typhi
cuggauguccgacgccg

SEQ ID NO: 1656942 - RNA, 20 nt, Salmonella enterica enterica serovar Typhi
cuggcauaaaaagccauccc

SEQ ID NO: 1656943 - RNA, 23 nt, Salmonella enterica enterica serovar Typhi
cuggcauuuuuauuuaacgccag

SEQ ID NO: 1656944 - RNA, 16 nt, Salmonella enterica enterica serovar Typhi
cuggcauggcucgccg

SEQ ID NO: 1656945 - RNA, 13 nt, Salmonella enterica enterica serovar Typhi
cuggccagggcau

SEQ ID NO: 1656946 - RNA, 16 nt, Salmonella enterica enterica serovar Typhi
cugcuuuggccgguuc

SEQ ID NO: 1656947 - RNA, 16 nt, Salmonella enterica enterica serovar Typhi
cugcuuuuccggcagc

SEQ ID NO: 1656948 - RNA, 14 nt, Salmonella enterica enterica serovar Typhi
cugcuuuuccggca

SEQ ID NO: 1656949 - RNA, 16 nt, Salmonella enterica enterica serovar Typhi
cuggaaaaaacggggc

SEQ ID NO: 1656950 - RNA, 16 nt, Salmonella enterica enterica serovar Typhi
cuggaaaaaagcgccc

SEQ ID NO: 1656951 - RNA, 19 nt, Salmonella enterica enterica serovar Typhi
cugcuuucuuacaccucgc

SEQ ID NO: 1656952 - RNA, 19 nt, Salmonella enterica enterica serovar Typhi
cuggacaaagcguuugccg

SEQ ID NO: 1656953 - RNA, 23 nt, Salmonella enterica enterica serovar Typhi
cuggaagagaacguucguugucc

SEQ ID NO: 1656954 - RNA, 19 nt, Salmonella enterica enterica serovar Typhi
cuggaaucauccaccagaa

SEQ ID NO: 1656955 - RNA, 15 nt, Salmonella enterica enterica serovar Typhi
cugcuggagccggaa

SEQ ID NO: 1656956 - RNA, 18 nt, Salmonella enterica enterica serovar Typhi
cugcuguuuuugaaaaug

SEQ ID NO: 1656957 - RNA, 17 nt, Salmonella enterica enterica serovar Typhi
cugcuuagcucaucagc

SEQ ID NO: 1656958 - RNA, 21 nt, Salmonella enterica enterica serovar Typhi
cugcuuaucgauaucugccug

SEQ ID NO: 1656959 - RNA, 14 nt, Salmonella enterica enterica serovar Typhi
cugcuuccugccgc

SEQ ID NO: 1656960 - RNA, 20 nt, Salmonella enterica enterica serovar Typhi
aacggcgcuggcguacgcau

SEQ ID NO: 1656961 - RNA, 18 nt, Salmonella enterica enterica serovar Typhi
gaccggcaucucaucuug

SEQ ID NO: 1656962 - RNA, 17 nt, Salmonella enterica enterica serovar Typhi
gaccgcuuucccggcau

SEQ ID NO: 1656963 - RNA, 12 nt, Salmonella enterica enterica serovar Typhi
gaccgcugaugg

SEQ ID NO: 1656964 - RNA, 15 nt, Salmonella enterica enterica serovar Typhi
gaccgccuaacagcg

SEQ ID NO: 1656965 - RNA, 14 nt, Salmonella enterica enterica serovar Typhi
gaccgacaucgcca

SEQ ID NO: 1656966 - RNA, 15 nt, Salmonella enterica enterica serovar Typhi
aacgcucuuaccgcu

SEQ ID NO: 1656967 - RNA, 22 nt, Salmonella enterica enterica serovar Typhi
aacgcugcauccuguaccacca

SEQ ID NO: 1656968 - RNA, 14 nt, Salmonella enterica enterica serovar Typhi
aacgcugcgcuaca

SEQ ID NO: 1656969 - RNA, 19 nt, Salmonella enterica enterica serovar Typhi
aacgcuggcggcaggccua

SEQ ID NO: 1656970 - RNA, 15 nt, Salmonella enterica enterica serovar Typhi
gaccgccaagcgcgg

SEQ ID NO: 1656971 - RNA, 19 nt, Salmonella enterica enterica serovar Typhi
gaccgccccguaucauuag

SEQ ID NO: 1656972 - RNA, 15 nt, Salmonella enterica enterica serovar Typhi
gaccgagaucaggcc

SEQ ID NO: 1656973 - RNA, 13 nt, Salmonella enterica enterica serovar Typhi
gaccgcaacgucc

SEQ ID NO: 1656974 - RNA, 15 nt, Salmonella enterica enterica serovar Typhi
aacgggcccggcuuu

SEQ ID NO: 1656975 - RNA, 15 nt, Salmonella enterica enterica serovar Typhi
gaccguuagcgacgg

SEQ ID NO: 1656976 - RNA, 20 nt, Salmonella enterica enterica serovar Typhi
gaccucacgcuuaucgccaa

SEQ ID NO: 1656977 - RNA, 18 nt, Salmonella enterica enterica serovar Typhi
aacggcugacgcccauca

SEQ ID NO: 1656978 - RNA, 21 nt, Salmonella enterica enterica serovar Typhi
aacggcugacgcccaucagca

SEQ ID NO: 1656979 - RNA, 17 nt, Salmonella enterica enterica serovar Typhi
aacggcugacgcccauc

SEQ ID NO: 1656980 - RNA, 14 nt, Salmonella enterica enterica serovar Typhi
aacggcguaccaga

SEQ ID NO: 1656981 - RNA, 21 nt, Salmonella enterica enterica serovar Typhi
gaccguggaucucgucgccgg

SEQ ID NO: 1656982 - RNA, 21 nt, Salmonella enterica enterica serovar Typhi
gaccgugauuuuuaccgccgg

SEQ ID NO: 1656983 - RNA, 18 nt, Salmonella enterica enterica serovar Typhi
gaccguccccagccagag

SEQ ID NO: 1656984 - RNA, 15 nt, Salmonella enterica enterica serovar Typhi
gacgaaagucaucca

SEQ ID NO: 1656985 - RNA, 12 nt, Salmonella enterica enterica serovar Typhi
gacgaacgcuau

SEQ ID NO: 1656986 - RNA, 13 nt, Salmonella enterica enterica serovar Typhi
gaccugaucggcc

SEQ ID NO: 1656987 - RNA, 18 nt, Salmonella enterica enterica serovar Typhi
gaccagcugacgacgcca

SEQ ID NO: 1656988 - RNA, 21 nt, Salmonella enterica enterica serovar Typhi
gaccaggaauuuaccggugcg

SEQ ID NO: 1656989 - RNA, 14 nt, Salmonella enterica enterica serovar Typhi
aacgcgagaagccc

SEQ ID NO: 1656990 - RNA, 13 nt, Salmonella enterica enterica serovar Typhi
aacgcgacaacgc

SEQ ID NO: 1656991 - RNA, 14 nt, Salmonella enterica enterica serovar Typhi
aacgccuucguccg

SEQ ID NO: 1656992 - RNA, 14 nt, Salmonella enterica enterica serovar Typhi
aacgcgccaucuuu

SEQ ID NO: 1656993 - RNA, 16 nt, Salmonella enterica enterica serovar Typhi
aacgcgccacgcgcca

SEQ ID NO: 1656994 - RNA, 17 nt, Salmonella enterica enterica serovar Typhi
gaccauaauuuccggcg

SEQ ID NO: 1656995 - RNA, 16 nt, Salmonella enterica enterica serovar Typhi
gaccauaaauagccga

SEQ ID NO: 1656996 - RNA, 19 nt, Salmonella enterica enterica serovar Typhi
aacgccguacuccagccca

SEQ ID NO: 1656997 - RNA, 17 nt, Salmonella enterica enterica serovar Typhi
aacgccgguacgcagca

SEQ ID NO: 1656998 - RNA, 20 nt, Salmonella enterica enterica serovar Typhi
aacgccggucguggcgauca

SEQ ID NO: 1656999 - RNA, 20 nt, Salmonella enterica enterica serovar Typhi
aacgccuuauccgaccuaca

SEQ ID NO: 1657000 - RNA, 20 nt, Salmonella enterica enterica serovar Typhi
aacgccuuauccggccuaca

SEQ ID NO: 1657001 - RNA, 19 nt, Salmonella enterica enterica serovar Typhi
aacgccugaugcugcgcau

SEQ ID NO: 1657002 - RNA, 20 nt, Salmonella enterica enterica serovar Typhi
aacgccugauccggccuaca

SEQ ID NO: 1657003 - RNA, 19 nt, Salmonella enterica enterica serovar Typhi
aacgcaacaccaucccgcu

SEQ ID NO: 1657004 - RNA, 15 nt, Salmonella enterica enterica serovar Typhi
aacgcaaagacaccc

SEQ ID NO: 1657005 - RNA, 23 nt, Salmonella enterica enterica serovar Typhi
aacgcaggcaguuugcgaaaagc

SEQ ID NO: 1657006 - RNA, 22 nt, Salmonella enterica enterica serovar Typhi
aacgcaggcgaaaucaaaaggc

SEQ ID NO: 1657007 - RNA, 18 nt, Salmonella enterica enterica serovar Typhi
aacgcacgcagccaacgc

SEQ ID NO: 1657008 - RNA, 15 nt, Salmonella enterica enterica serovar Typhi
aacgcaggcgauagc

SEQ ID NO: 1657009 - RNA, 18 nt, Salmonella enterica enterica serovar Typhi
aacgcaucacaugcggga

SEQ ID NO: 1657010 - RNA, 15 nt, Salmonella enterica enterica serovar Typhi
gaccaccauauucgc

SEQ ID NO: 1657011 - RNA, 22 nt, Salmonella enterica enterica serovar Typhi
gaccaacgguuggauuucggcg

SEQ ID NO: 1657012 - RNA, 14 nt, Salmonella enterica enterica serovar Typhi
gaccaaagcuauuc

SEQ ID NO: 1657013 - RNA, 18 nt, Salmonella enterica enterica serovar Typhi
gaccaacaccagccgcau

SEQ ID NO: 1657014 - RNA, 14 nt, Salmonella enterica enterica serovar Typhi
aacgacucacgcgc

SEQ ID NO: 1657015 - RNA, 16 nt, Salmonella enterica enterica serovar Typhi
gaccaauauccgcagg

SEQ ID NO: 1657016 - RNA, 17 nt, Salmonella enterica enterica serovar Typhi
gaccaauugcaggcagc

SEQ ID NO: 1657017 - RNA, 15 nt, Salmonella enterica enterica serovar Typhi
gaccaaugacgcuau

SEQ ID NO: 1657018 - RNA, 14 nt, Salmonella enterica enterica serovar Typhi
gacagugcgccaua

SEQ ID NO: 1657019 - RNA, 23 nt, Salmonella enterica enterica serovar Typhi
gacagucgcagagcccagcgcga

SEQ ID NO: 1657020 - RNA, 20 nt, Salmonella enterica enterica serovar Typhi
gacauuuaucuuccggcauc

SEQ ID NO: 1657021 - RNA, 17 nt, Salmonella enterica enterica serovar Typhi
gacauugguuucaugca

SEQ ID NO: 1657022 - RNA, 23 nt, Salmonella enterica enterica serovar Typhi
gacauuacccggccaggcgugau

SEQ ID NO: 1657023 - RNA, 23 nt, Salmonella enterica enterica serovar Typhi
gacaugcuguugaaacgccguuu

SEQ ID NO: 1657024 - RNA, 18 nt, Salmonella enterica enterica serovar Typhi
gacauggcggucgccaua

SEQ ID NO: 1657025 - RNA, 23 nt, Salmonella enterica enterica serovar Typhi
gaauuccugcggcgguaacgccu

SEQ ID NO: 1657026 - RNA, 15 nt, Salmonella enterica enterica serovar Typhi
gacagccgacggcaa

SEQ ID NO: 1657027 - RNA, 14 nt, Salmonella enterica enterica serovar Typhi
gaauuaacagcgcg

SEQ ID NO: 1657028 - RNA, 19 nt, Salmonella enterica enterica serovar Typhi
gaaugugaaauacagccag

SEQ ID NO: 1657029 - RNA, 12 nt, Salmonella enterica enterica serovar Typhi
gacagcgacauc

SEQ ID NO: 1657030 - RNA, 13 nt, Salmonella enterica enterica serovar Typhi
gacagcgccauau

SEQ ID NO: 1657031 - RNA, 20 nt, Salmonella enterica enterica serovar Typhi
gaagcccggccacagcgcca

SEQ ID NO: 1657032 - RNA, 13 nt, Salmonella enterica enterica serovar Typhi
gaagccagugccc

SEQ ID NO: 1657033 - RNA, 15 nt, Salmonella enterica enterica serovar Typhi
gaagagacacgcuga

SEQ ID NO: 1657034 - RNA, 21 nt, Salmonella enterica enterica serovar Typhi
gaagaguuaacuucuccgcca

SEQ ID NO: 1657035 - RNA, 22 nt, Salmonella enterica enterica serovar Typhi
gaagaucguuauccagcagcca

SEQ ID NO: 1657036 - RNA, 20 nt, Salmonella enterica enterica serovar Typhi
gaagaugaggagcuggagca

SEQ ID NO: 1657037 - RNA, 14 nt, Salmonella enterica enterica serovar Typhi
gaagcacauccaug

SEQ ID NO: 1657038 - RNA, 17 nt, Salmonella enterica enterica serovar Typhi
gaagcguaacagcgcua

SEQ ID NO: 1657039 - RNA, 20 nt, Salmonella enterica enterica serovar Typhi
gaagcuacuugaucggcugg

SEQ ID NO: 1657040 - RNA, 22 nt, Salmonella enterica enterica serovar Typhi
gaagcugcagggauaugcugau

SEQ ID NO: 1657041 - RNA, 20 nt, Salmonella enterica enterica serovar Typhi
gaaggcaacugauccugcgu

SEQ ID NO: 1657042 - RNA, 19 nt, Salmonella enterica enterica serovar Typhi
gaaggacugauacagccaa

SEQ ID NO: 1657043 - RNA, 16 nt, Salmonella enterica enterica serovar Typhi
gaaggaagggcgcugc

SEQ ID NO: 1657044 - RNA, 19 nt, Salmonella enterica enterica serovar Typhi
gaagcgauguauuuaucca

SEQ ID NO: 1657045 - RNA, 19 nt, Salmonella enterica enterica serovar Typhi
gaagcggcgcuauccggca

SEQ ID NO: 1657046 - RNA, 22 nt, Salmonella enterica enterica serovar Typhi
gaagcgggccaguauuaagcau

SEQ ID NO: 1657047 - RNA, 15 nt, Salmonella enterica enterica serovar Typhi
gaaggcgugcagcgu

SEQ ID NO: 1657048 - RNA, 14 nt, Salmonella enterica enterica serovar Typhi
gaaggcuccggcac

SEQ ID NO: 1657049 - RNA, 22 nt, Salmonella enterica enterica serovar Typhi
gaagggguggcgaucguuguuu

SEQ ID NO: 1657050 - RNA, 16 nt, Salmonella enterica enterica serovar Typhi
gaaggcuuugccauac

SEQ ID NO: 1657051 - RNA, 22 nt, Salmonella enterica enterica serovar Typhi
gaagguucgauucgagcgcagc

SEQ ID NO: 1657052 - RNA, 12 nt, Salmonella enterica enterica serovar Typhi
gaaguaaggcau

SEQ ID NO: 1657053 - RNA, 13 nt, Salmonella enterica enterica serovar Typhi
gaaggucgcgccg

SEQ ID NO: 1657054 - RNA, 23 nt, Salmonella enterica enterica serovar Typhi
gaaucgcgguuucguggcgcugu

SEQ ID NO: 1657055 - RNA, 16 nt, Salmonella enterica enterica serovar Typhi
gaaucgcucacccgau

SEQ ID NO: 1657056 - RNA, 15 nt, Salmonella enterica enterica serovar Typhi
gaaucgcgauaacgu

SEQ ID NO: 1657057 - RNA, 18 nt, Salmonella enterica enterica serovar Typhi
gaaugcccggcggcgcga

SEQ ID NO: 1657058 - RNA, 15 nt, Salmonella enterica enterica serovar Typhi
gaaugccaagcgcau

SEQ ID NO: 1657059 - RNA, 17 nt, Salmonella enterica enterica serovar Typhi
gaaugcccuuuuccaga

SEQ ID NO: 1657060 - RNA, 21 nt, Salmonella enterica enterica serovar Typhi
gaaugacaaacgccaccgcca

SEQ ID NO: 1657061 - RNA, 17 nt, Salmonella enterica enterica serovar Typhi
gaaugacacauuucuau

SEQ ID NO: 1657062 - RNA, 13 nt, Salmonella enterica enterica serovar Typhi
gaauagccggaua

SEQ ID NO: 1657063 - RNA, 17 nt, Salmonella enterica enterica serovar Typhi
gaauagcgaacagucca

SEQ ID NO: 1657064 - RNA, 21 nt, Salmonella enterica enterica serovar Typhi
gaauacgcuccagcuggcugg

SEQ ID NO: 1657065 - RNA, 17 nt, Salmonella enterica enterica serovar Typhi
gaauacuacugguggaa

SEQ ID NO: 1657066 - RNA, 17 nt, Salmonella enterica enterica serovar Typhi
gaauacugggcgcauga

SEQ ID NO: 1657067 - RNA, 19 nt, Salmonella enterica enterica serovar Typhi
gaauacgguccguuuucgc

SEQ ID NO: 1657068 - RNA, 22 nt, Salmonella enterica enterica serovar Typhi
gaaucagaugcucaucaacgau

SEQ ID NO: 1657069 - RNA, 18 nt, Salmonella enterica enterica serovar Typhi
gaagugauccuucaacgu

SEQ ID NO: 1657070 - RNA, 12 nt, Salmonella enterica enterica serovar Typhi
gaauaccacauc

SEQ ID NO: 1657071 - RNA, 20 nt, Salmonella enterica enterica serovar Typhi
gaauaccagaaucaccgaca

SEQ ID NO: 1657072 - RNA, 18 nt, Salmonella enterica enterica serovar Typhi
gaauacaccgccuagcgu

SEQ ID NO: 1657073 - RNA, 23 nt, Salmonella enterica enterica serovar Typhi
gaagugccaguaacucaucgcca

SEQ ID NO: 1657074 - RNA, 21 nt, Salmonella enterica enterica serovar Typhi
gaacggcuuuccagcagccag

SEQ ID NO: 1657075 - RNA, 21 nt, Salmonella enterica enterica serovar Typhi
gaagaccgcaucacggcagca

SEQ ID NO: 1657076 - RNA, 14 nt, Salmonella enterica enterica serovar Typhi
gaagaccuuauccc

SEQ ID NO: 1657077 - RNA, 22 nt, Salmonella enterica enterica serovar Typhi
gaagacgaugauguagccgcgu

SEQ ID NO: 1657078 - RNA, 16 nt, Salmonella enterica enterica serovar Typhi
gaagaaaccgcagaaa

SEQ ID NO: 1657079 - RNA, 12 nt, Salmonella enterica enterica serovar Typhi
gaagaaaccgca

SEQ ID NO: 1657080 - RNA, 15 nt, Salmonella enterica enterica serovar Typhi
gaacuguucagccag

SEQ ID NO: 1657081 - RNA, 16 nt, Salmonella enterica enterica serovar Typhi
gaaccuguccugagcg

SEQ ID NO: 1657082 - RNA, 20 nt, Salmonella enterica enterica serovar Typhi
gaaccuguccugagcgaaug

SEQ ID NO: 1657083 - RNA, 22 nt, Salmonella enterica enterica serovar Typhi
gaaccguucucaauccgcagca

SEQ ID NO: 1657084 - RNA, 12 nt, Salmonella enterica enterica serovar Typhi
gaaccggaccag

SEQ ID NO: 1657085 - RNA, 14 nt, Salmonella enterica enterica serovar Typhi
gaacauuuaagauu

SEQ ID NO: 1657086 - RNA, 17 nt, Salmonella enterica enterica serovar Typhi
gaacgcauccagccacg

SEQ ID NO: 1657087 - RNA, 19 nt, Salmonella enterica enterica serovar Typhi
gaaaucgccucauucgggc

SEQ ID NO: 1657088 - RNA, 18 nt, Salmonella enterica enterica serovar Typhi
gaaaucgguacgcgucug

SEQ ID NO: 1657089 - RNA, 14 nt, Salmonella enterica enterica serovar Typhi
gaacaccagcgccg

SEQ ID NO: 1657090 - RNA, 20 nt, Salmonella enterica enterica serovar Typhi
gaacauacguuuaaagcgcu

SEQ ID NO: 1657091 - RNA, 18 nt, Salmonella enterica enterica serovar Typhi
gaacaucguguccugggu

SEQ ID NO: 1657092 - RNA, 21 nt, Salmonella enterica enterica serovar Typhi
gaacaguguaaacgccagaua

SEQ ID NO: 1657093 - RNA, 18 nt, Salmonella enterica enterica serovar Typhi
gaacaguguaaacgccag

SEQ ID NO: 1657094 - RNA, 15 nt, Salmonella enterica enterica serovar Typhi
gaacaggcuggcgac

SEQ ID NO: 1657095 - RNA, 18 nt, Salmonella enterica enterica serovar Typhi
gaacagccccaccgccag

SEQ ID NO: 1657096 - RNA, 14 nt, Salmonella enterica enterica serovar Typhi
gaaacucagcggcc

SEQ ID NO: 1657097 - RNA, 18 nt, Salmonella enterica enterica serovar Typhi
gaaacugcuguagcacau

SEQ ID NO: 1657098 - RNA, 19 nt, Salmonella enterica enterica serovar Typhi
gaaagugggcgcuuuguua

SEQ ID NO: 1657099 - RNA, 15 nt, Salmonella enterica enterica serovar Typhi
gaaagggacgaugau

SEQ ID NO: 1657100 - RNA, 16 nt, Salmonella enterica enterica serovar Typhi
gaaagccgcgacggca

SEQ ID NO: 1657101 - RNA, 15 nt, Salmonella enterica enterica serovar Typhi
gaaagaaaucaccgu

SEQ ID NO: 1657102 - RNA, 20 nt, Salmonella enterica enterica serovar Typhi
gccaaaaggcgccgcuuccc

SEQ ID NO: 1657103 - RNA, 12 nt, Salmonella enterica enterica serovar Typhi
gccaaaauggcg

SEQ ID NO: 1657104 - RNA, 22 nt, Salmonella enterica enterica serovar Typhi
gccaaagcuggauaucacgcgc

SEQ ID NO: 1657105 - RNA, 23 nt, Salmonella enterica enterica serovar Typhi
gccaaagauuagccccagcgcca

SEQ ID NO: 1657106 - RNA, 12 nt, Salmonella enterica enterica serovar Typhi
gccaaacugcug

SEQ ID NO: 1657107 - RNA, 15 nt, Salmonella enterica enterica serovar Typhi
gccaaagaaacgcug

SEQ ID NO: 1657108 - RNA, 23 nt, Salmonella enterica enterica serovar Typhi
gccaaacuccaccugaucgccaa

SEQ ID NO: 1657109 - RNA, 14 nt, Salmonella enterica enterica serovar Typhi
gccaaacugcggaa

SEQ ID NO: 1657110 - RNA, 16 nt, Salmonella enterica enterica serovar Typhi
gccaaaccggcgaaua

SEQ ID NO: 1657111 - RNA, 19 nt, Salmonella enterica enterica serovar Typhi
gccaaacuccucacugcgu

SEQ ID NO: 1657112 - RNA, 16 nt, Salmonella enterica enterica serovar Typhi
gccaaauagcgccaga

SEQ ID NO: 1657113 - RNA, 16 nt, Salmonella enterica enterica serovar Typhi
gccaacauagccacag

SEQ ID NO: 1657114 - RNA, 19 nt, Salmonella enterica enterica serovar Typhi
gccaaccaguaccgucauu

SEQ ID NO: 1657115 - RNA, 13 nt, Salmonella enterica enterica serovar Typhi
gcauuuugcggcg

SEQ ID NO: 1657116 - RNA, 18 nt, Salmonella enterica enterica serovar Typhi
gcauuguuccugcuggca

SEQ ID NO: 1657117 - RNA, 23 nt, Salmonella enterica enterica serovar Typhi
gcauuucgccgccauccggcacu

SEQ ID NO: 1657118 - RNA, 21 nt, Salmonella enterica enterica serovar Typhi
gcauucucugucgccgcccgu

SEQ ID NO: 1657119 - RNA, 21 nt, Salmonella enterica enterica serovar Typhi
gccaacgccagcagcgcgaua

SEQ ID NO: 1657120 - RNA, 13 nt, Salmonella enterica enterica serovar Typhi
gccaacgccaaca

SEQ ID NO: 1657121 - RNA, 19 nt, Salmonella enterica enterica serovar Typhi
gccaacgucgacagacgca

SEQ ID NO: 1657122 - RNA, 14 nt, Salmonella enterica enterica serovar Typhi
gccaagcagcgcca

SEQ ID NO: 1657123 - RNA, 21 nt, Salmonella enterica enterica serovar Typhi
gccaacgggcggugugauuaa

SEQ ID NO: 1657124 - RNA, 14 nt, Salmonella enterica enterica serovar Typhi
gccaacgccgguug

SEQ ID NO: 1657125 - RNA, 22 nt, Salmonella enterica enterica serovar Typhi
gccaaugccggacgccaccacg

SEQ ID NO: 1657126 - RNA, 13 nt, Salmonella enterica enterica serovar Typhi
gccaagcggcauc

SEQ ID NO: 1657127 - RNA, 19 nt, Salmonella enterica enterica serovar Typhi
gccaauagggacuuuaccg

SEQ ID NO: 1657128 - RNA, 22 nt, Salmonella enterica enterica serovar Typhi
gccaauccugcacccgccuuac

SEQ ID NO: 1657129 - RNA, 12 nt, Salmonella enterica enterica serovar Typhi
gccaaucgccgc

SEQ ID NO: 1657130 - RNA, 20 nt, Salmonella enterica enterica serovar Typhi
gcauggcgucguaccguuaa

SEQ ID NO: 1657131 - RNA, 13 nt, Salmonella enterica enterica serovar Typhi
gcauucagccagc

SEQ ID NO: 1657132 - RNA, 15 nt, Salmonella enterica enterica serovar Typhi
gcauuagcaugggcu

SEQ ID NO: 1657133 - RNA, 14 nt, Salmonella enterica enterica serovar Typhi
gcaugcccgccagc

SEQ ID NO: 1657134 - RNA, 22 nt, Salmonella enterica enterica serovar Typhi
gcaugaugggcgcacagcgcca

SEQ ID NO: 1657135 - RNA, 23 nt, Salmonella enterica enterica serovar Typhi
gcaugauccaccaucggcgcgua

SEQ ID NO: 1657136 - RNA, 21 nt, Salmonella enterica enterica serovar Typhi
gcaucugauauaucuucaucg

SEQ ID NO: 1657137 - RNA, 13 nt, Salmonella enterica enterica serovar Typhi
gcaucugcgcaac

SEQ ID NO: 1657138 - RNA, 13 nt, Salmonella enterica enterica serovar Typhi
gcaucugggcuga

SEQ ID NO: 1657139 - RNA, 15 nt, Salmonella enterica enterica serovar Typhi
gcaucuuauauuuug

SEQ ID NO: 1657140 - RNA, 19 nt, Salmonella enterica enterica serovar Typhi
gcaucuuuccggaacgcgu

SEQ ID NO: 1657141 - RNA, 12 nt, Salmonella enterica enterica serovar Typhi
gcaguucaucca

SEQ ID NO: 1657142 - RNA, 17 nt, Salmonella enterica enterica serovar Typhi
gcaguucuucgccggua

SEQ ID NO: 1657143 - RNA, 20 nt, Salmonella enterica enterica serovar Typhi
gcaguucuucgccguuaucg

SEQ ID NO: 1657144 - RNA, 22 nt, Salmonella enterica enterica serovar Typhi
gcaguugaucguaaagcgcauc

SEQ ID NO: 1657145 - RNA, 18 nt, Salmonella enterica enterica serovar Typhi
gcaguuuacgcagcgccu

SEQ ID NO: 1657146 - RNA, 22 nt, Salmonella enterica enterica serovar Typhi
gcauaauccagcaggugcggac

SEQ ID NO: 1657147 - RNA, 20 nt, Salmonella enterica enterica serovar Typhi
gcaguggccagaaugaucgc

SEQ ID NO: 1657148 - RNA, 22 nt, Salmonella enterica enterica serovar Typhi
gcaguucagucgggaucgccag

SEQ ID NO: 1657149 - RNA, 13 nt, Salmonella enterica enterica serovar Typhi
gcaguucagcagc

SEQ ID NO: 1657150 - RNA, 15 nt, Salmonella enterica enterica serovar Typhi
gcaguggcucaguca

SEQ ID NO: 1657151 - RNA, 23 nt, Salmonella enterica enterica serovar Typhi
gcauacgccccgguggcgguacc

SEQ ID NO: 1657152 - RNA, 16 nt, Salmonella enterica enterica serovar Typhi
gcauacguuucaccag

SEQ ID NO: 1657153 - RNA, 22 nt, Salmonella enterica enterica serovar Typhi
gcauacucuccuccauaccuuu

SEQ ID NO: 1657154 - RNA, 14 nt, Salmonella enterica enterica serovar Typhi
gcauaccagccaua

SEQ ID NO: 1657155 - RNA, 19 nt, Salmonella enterica enterica serovar Typhi
gcauacagaugccguccau

SEQ ID NO: 1657156 - RNA, 16 nt, Salmonella enterica enterica serovar Typhi
gcauaauauccaggag

SEQ ID NO: 1657157 - RNA, 15 nt, Salmonella enterica enterica serovar Typhi
gcauauccagcgccu

SEQ ID NO: 1657158 - RNA, 14 nt, Salmonella enterica enterica serovar Typhi
gcauaucgccauac

SEQ ID NO: 1657159 - RNA, 13 nt, Salmonella enterica enterica serovar Typhi
gcaucaaagccac

SEQ ID NO: 1657160 - RNA, 18 nt, Salmonella enterica enterica serovar Typhi
gcauaugcacacgcagcu

SEQ ID NO: 1657161 - RNA, 23 nt, Salmonella enterica enterica serovar Typhi
gcauauuugccccuuccgccacg

SEQ ID NO: 1657162 - RNA, 15 nt, Salmonella enterica enterica serovar Typhi
gcaucaccaggcaau

SEQ ID NO: 1657163 - RNA, 17 nt, Salmonella enterica enterica serovar Typhi
gcaucacaaugaccucu

SEQ ID NO: 1657164 - RNA, 18 nt, Salmonella enterica enterica serovar Typhi
gcaucaggaaauccugga

SEQ ID NO: 1657165 - RNA, 19 nt, Salmonella enterica enterica serovar Typhi
gcaucagaacaaacuuauc

SEQ ID NO: 1657166 - RNA, 17 nt, Salmonella enterica enterica serovar Typhi
gcauccggccagcgacu

SEQ ID NO: 1657167 - RNA, 12 nt, Salmonella enterica enterica serovar Typhi
gcaucgaccagg

SEQ ID NO: 1657168 - RNA, 20 nt, Salmonella enterica enterica serovar Typhi
gcaucccggugucaaagcgc

SEQ ID NO: 1657169 - RNA, 14 nt, Salmonella enterica enterica serovar Typhi
gcauccgcgcaaua

SEQ ID NO: 1657170 - RNA, 21 nt, Salmonella enterica enterica serovar Typhi
gcauccagcacgagcgccagc

SEQ ID NO: 1657171 - RNA, 18 nt, Salmonella enterica enterica serovar Typhi
gcaucgggccguccggca

SEQ ID NO: 1657172 - RNA, 14 nt, Salmonella enterica enterica serovar Typhi
gcaucuccagcgca

SEQ ID NO: 1657173 - RNA, 22 nt, Salmonella enterica enterica serovar Typhi
gcaucguuaucauuaucgccaa

SEQ ID NO: 1657174 - RNA, 21 nt, Salmonella enterica enterica serovar Typhi
gcaucggcagcgucaggcuua

SEQ ID NO: 1657175 - RNA, 15 nt, Salmonella enterica enterica serovar Typhi
gcaucggcagcgcca

SEQ ID NO: 1657176 - RNA, 20 nt, Salmonella enterica enterica serovar Typhi
gcaucgcccguaucacugau

SEQ ID NO: 1657177 - RNA, 17 nt, Salmonella enterica enterica serovar Typhi
gccagcgcaacgcgcau

SEQ ID NO: 1657178 - RNA, 22 nt, Salmonella enterica enterica serovar Typhi
gccagcccgacuaccggcacca

SEQ ID NO: 1657179 - RNA, 16 nt, Salmonella enterica enterica serovar Typhi
gccagccccaccgucc

SEQ ID NO: 1657180 - RNA, 22 nt, Salmonella enterica enterica serovar Typhi
gccagcauuuccagcugguuaa

SEQ ID NO: 1657181 - RNA, 15 nt, Salmonella enterica enterica serovar Typhi
gccagccagcgccac

SEQ ID NO: 1657182 - RNA, 18 nt, Salmonella enterica enterica serovar Typhi
gccagcagcagcgcaaug

SEQ ID NO: 1657183 - RNA, 14 nt, Salmonella enterica enterica serovar Typhi
gccagcagccauuc

SEQ ID NO: 1657184 - RNA, 15 nt, Salmonella enterica enterica serovar Typhi
gccagaugucggcgg

SEQ ID NO: 1657185 - RNA, 23 nt, Salmonella enterica enterica serovar Typhi
gccagaugguaagcauagcgccu

SEQ ID NO: 1657186 - RNA, 16 nt, Salmonella enterica enterica serovar Typhi
gccagcaccaggcucg

SEQ ID NO: 1657187 - RNA, 13 nt, Salmonella enterica enterica serovar Typhi
gccacaucgccag

SEQ ID NO: 1657188 - RNA, 13 nt, Salmonella enterica enterica serovar Typhi
gccacaugcggca

SEQ ID NO: 1657189 - RNA, 13 nt, Salmonella enterica enterica serovar Typhi
gccacgccgccau

SEQ ID NO: 1657190 - RNA, 16 nt, Salmonella enterica enterica serovar Typhi
gccagaacucaucuuc

SEQ ID NO: 1657191 - RNA, 20 nt, Salmonella enterica enterica serovar Typhi
gccagaauacaccgccuagc

SEQ ID NO: 1657192 - RNA, 21 nt, Salmonella enterica enterica serovar Typhi
gccagaccccaguaauccggc

SEQ ID NO: 1657193 - RNA, 22 nt, Salmonella enterica enterica serovar Typhi
gccagaggcgugcaugggcagc

SEQ ID NO: 1657194 - RNA, 16 nt, Salmonella enterica enterica serovar Typhi
gccagaggcagcacau

SEQ ID NO: 1657195 - RNA, 14 nt, Salmonella enterica enterica serovar Typhi
gccagauaaagcag

SEQ ID NO: 1657196 - RNA, 20 nt, Salmonella enterica enterica serovar Typhi
gccagauaaagcagcgacaa

SEQ ID NO: 1657197 - RNA, 16 nt, Salmonella enterica enterica serovar Typhi
gccagacucgcuucac

SEQ ID NO: 1657198 - RNA, 17 nt, Salmonella enterica enterica serovar Typhi
gccagacgcuuauucgc

SEQ ID NO: 1657199 - RNA, 18 nt, Salmonella enterica enterica serovar Typhi
gccagacgaacggccuga

SEQ ID NO: 1657200 - RNA, 18 nt, Salmonella enterica enterica serovar Typhi
gccauaaaacgggcaaac

SEQ ID NO: 1657201 - RNA, 22 nt, Salmonella enterica enterica serovar Typhi
gccauacacgcggcgaaccggc

SEQ ID NO: 1657202 - RNA, 16 nt, Salmonella enterica enterica serovar Typhi
gccauaaugcacaaua

SEQ ID NO: 1657203 - RNA, 15 nt, Salmonella enterica enterica serovar Typhi
gccaguuuccugacc

SEQ ID NO: 1657204 - RNA, 15 nt, Salmonella enterica enterica serovar Typhi
gccauauccagccag

SEQ ID NO: 1657205 - RNA, 18 nt, Salmonella enterica enterica serovar Typhi
gccauauggcauucgcag

SEQ ID NO: 1657206 - RNA, 23 nt, Salmonella enterica enterica serovar Typhi
gccauagacgguugcaugauuaa

SEQ ID NO: 1657207 - RNA, 21 nt, Salmonella enterica enterica serovar Typhi
gccaucacguccugauagcaa

SEQ ID NO: 1657208 - RNA, 19 nt, Salmonella enterica enterica serovar Typhi
gccauccaucuccggcauc

SEQ ID NO: 1657209 - RNA, 17 nt, Salmonella enterica enterica serovar Typhi
gccaucccggcgacagc

SEQ ID NO: 1657210 - RNA, 21 nt, Salmonella enterica enterica serovar Typhi
gccaucaguaaaggaugccac

SEQ ID NO: 1657211 - RNA, 22 nt, Salmonella enterica enterica serovar Typhi
gccaucauuaauuuacugauaa

SEQ ID NO: 1657212 - RNA, 13 nt, Salmonella enterica enterica serovar Typhi
gccaugaauaauc

SEQ ID NO: 1657213 - RNA, 13 nt, Salmonella enterica enterica serovar Typhi
gccaucuuccagc

SEQ ID NO: 1657214 - RNA, 16 nt, Salmonella enterica enterica serovar Typhi
aagaaugcgcgucagg

SEQ ID NO: 1657215 - RNA, 16 nt, Salmonella enterica enterica serovar Typhi
gccaucgcggcgcaaa

SEQ ID NO: 1657216 - RNA, 18 nt, Salmonella enterica enterica serovar Typhi
gccaucggcuuuggcaaa

SEQ ID NO: 1657217 - RNA, 21 nt, Salmonella enterica enterica serovar Typhi
gccaucggcgccggggugcug

SEQ ID NO: 1657218 - RNA, 17 nt, Salmonella enterica enterica serovar Typhi
gccaucgucaccggauc

SEQ ID NO: 1657219 - RNA, 16 nt, Salmonella enterica enterica serovar Typhi
gccaucgucaccggau

SEQ ID NO: 1657220 - RNA, 17 nt, Salmonella enterica enterica serovar Typhi
gccauccggcaucacgu

SEQ ID NO: 1657221 - RNA, 17 nt, Salmonella enterica enterica serovar Typhi
gccauccggcacuacag

SEQ ID NO: 1657222 - RNA, 12 nt, Salmonella enterica enterica serovar Typhi
gccaguggcgaa

SEQ ID NO: 1657223 - RNA, 21 nt, Salmonella enterica enterica serovar Typhi
gccaguucauugauuaacagg

SEQ ID NO: 1657224 - RNA, 15 nt, Salmonella enterica enterica serovar Typhi
gccaggguucaaccu

SEQ ID NO: 1657225 - RNA, 15 nt, Salmonella enterica enterica serovar Typhi
gccaggucugcacca

SEQ ID NO: 1657226 - RNA, 18 nt, Salmonella enterica enterica serovar Typhi
gccagcguaccagcguca

SEQ ID NO: 1657227 - RNA, 16 nt, Salmonella enterica enterica serovar Typhi
gccagcgucgcugauu

SEQ ID NO: 1657228 - RNA, 17 nt, Salmonella enterica enterica serovar Typhi
gccagcgucaucagauc

SEQ ID NO: 1657229 - RNA, 15 nt, Salmonella enterica enterica serovar Typhi
gccgcaaacagcacg

SEQ ID NO: 1657230 - RNA, 23 nt, Salmonella enterica enterica serovar Typhi
gccgcaaaggaucaucggccaga

SEQ ID NO: 1657231 - RNA, 22 nt, Salmonella enterica enterica serovar Typhi
gccgcaaacgccugcuccgucc

SEQ ID NO: 1657232 - RNA, 14 nt, Salmonella enterica enterica serovar Typhi
gccgcagacggaga

SEQ ID NO: 1657233 - RNA, 19 nt, Salmonella enterica enterica serovar Typhi
gccgcagaaaauggucugc

SEQ ID NO: 1657234 - RNA, 17 nt, Salmonella enterica enterica serovar Typhi
gccgcaccagucggcaa

SEQ ID NO: 1657235 - RNA, 13 nt, Salmonella enterica enterica serovar Typhi
gccgccaggaacg

SEQ ID NO: 1657236 - RNA, 19 nt, Salmonella enterica enterica serovar Typhi
gccgccagccauccccaua

SEQ ID NO: 1657237 - RNA, 20 nt, Salmonella enterica enterica serovar Typhi
gccgcauaauucaucuuccg

SEQ ID NO: 1657238 - RNA, 19 nt, Salmonella enterica enterica serovar Typhi
gccgccaaaaauaucgccg

SEQ ID NO: 1657239 - RNA, 15 nt, Salmonella enterica enterica serovar Typhi
gccgcccaucgccac

SEQ ID NO: 1657240 - RNA, 22 nt, Salmonella enterica enterica serovar Typhi
gccgccaucuccggcagcgaau

SEQ ID NO: 1657241 - RNA, 15 nt, Salmonella enterica enterica serovar Typhi
gccgccauccggcac

SEQ ID NO: 1657242 - RNA, 16 nt, Salmonella enterica enterica serovar Typhi
gccgccauugccagua

SEQ ID NO: 1657243 - RNA, 23 nt, Salmonella enterica enterica serovar Typhi
gccgccaucaacgaccaugguuc

SEQ ID NO: 1657244 - RNA, 17 nt, Salmonella enterica enterica serovar Typhi
gccgccauccggcaaac

SEQ ID NO: 1657245 - RNA, 12 nt, Salmonella enterica enterica serovar Typhi
gccgccgccagg

SEQ ID NO: 1657246 - RNA, 23 nt, Salmonella enterica enterica serovar Typhi
gccgagcgaaggggcgggcagca

SEQ ID NO: 1657247 - RNA, 18 nt, Salmonella enterica enterica serovar Typhi
gccgacguuaucgccgac

SEQ ID NO: 1657248 - RNA, 19 nt, Salmonella enterica enterica serovar Typhi
gccgacuuuacggccuagc

SEQ ID NO: 1657249 - RNA, 20 nt, Salmonella enterica enterica serovar Typhi
gccgauaguggucgccacgc

SEQ ID NO: 1657250 - RNA, 19 nt, Salmonella enterica enterica serovar Typhi
gccgauauggccguuuuca

SEQ ID NO: 1657251 - RNA, 21 nt, Salmonella enterica enterica serovar Typhi
gccgaucagauugaucaucac

SEQ ID NO: 1657252 - RNA, 13 nt, Salmonella enterica enterica serovar Typhi
gccgaucaggccg

SEQ ID NO: 1657253 - RNA, 14 nt, Salmonella enterica enterica serovar Typhi
gccgaucagcgcca

SEQ ID NO: 1657254 - RNA, 16 nt, Salmonella enterica enterica serovar Typhi
gccgauaaauccuccg

SEQ ID NO: 1657255 - RNA, 13 nt, Salmonella enterica enterica serovar Typhi
gccgauaagcgcu

SEQ ID NO: 1657256 - RNA, 15 nt, Salmonella enterica enterica serovar Typhi
gccgauaauacgcgc

SEQ ID NO: 1657257 - RNA, 19 nt, Salmonella enterica enterica serovar Typhi
gccgauaauaaacgcgcca

SEQ ID NO: 1657258 - RNA, 20 nt, Salmonella enterica enterica serovar Typhi
gccgagucgguuuuauuaac

SEQ ID NO: 1657259 - RNA, 17 nt, Salmonella enterica enterica serovar Typhi
gccgaccaccauccggc

SEQ ID NO: 1657260 - RNA, 17 nt, Salmonella enterica enterica serovar Typhi
gccgaccaccgcccugu

SEQ ID NO: 1657261 - RNA, 17 nt, Salmonella enterica enterica serovar Typhi
gccgaccgucggcgcaa

SEQ ID NO: 1657262 - RNA, 17 nt, Salmonella enterica enterica serovar Typhi
aagaucgcguacagcgc

SEQ ID NO: 1657263 - RNA, 21 nt, Salmonella enterica enterica serovar Typhi
aagaucccagggcggcgucgc

SEQ ID NO: 1657264 - RNA, 20 nt, Salmonella enterica enterica serovar Typhi
aagaucggguggccuaacgc

SEQ ID NO: 1657265 - RNA, 16 nt, Salmonella enterica enterica serovar Typhi
gccgacgccagccauu

SEQ ID NO: 1657266 - RNA, 23 nt, Salmonella enterica enterica serovar Typhi
gccgacgcauuucuccugauuaa

SEQ ID NO: 1657267 - RNA, 15 nt, Salmonella enterica enterica serovar Typhi
gccgacaaaugacgu

SEQ ID NO: 1657268 - RNA, 21 nt, Salmonella enterica enterica serovar Typhi
gccgaauucguuacccgauac

SEQ ID NO: 1657269 - RNA, 18 nt, Salmonella enterica enterica serovar Typhi
gcccuccagcuccgcgua

SEQ ID NO: 1657270 - RNA, 12 nt, Salmonella enterica enterica serovar Typhi
gccgaaagcgau

SEQ ID NO: 1657271 - RNA, 18 nt, Salmonella enterica enterica serovar Typhi
gcccguccagauaaugau

SEQ ID NO: 1657272 - RNA, 19 nt, Salmonella enterica enterica serovar Typhi
gcccgguggcguggcgcca

SEQ ID NO: 1657273 - RNA, 20 nt, Salmonella enterica enterica serovar Typhi
gcccgguuuuuuuaugccgg

SEQ ID NO: 1657274 - RNA, 17 nt, Salmonella enterica enterica serovar Typhi
gcccgguacguuaaccg

SEQ ID NO: 1657275 - RNA, 16 nt, Salmonella enterica enterica serovar Typhi
gcccgguaagcacaac

SEQ ID NO: 1657276 - RNA, 21 nt, Salmonella enterica enterica serovar Typhi
gcccgguaagcgcuagcgcca

SEQ ID NO: 1657277 - RNA, 21 nt, Salmonella enterica enterica serovar Typhi
gcccgguaagaaugcgcguca

SEQ ID NO: 1657278 - RNA, 19 nt, Salmonella enterica enterica serovar Typhi
gcccgggcgauaucacgga

SEQ ID NO: 1657279 - RNA, 16 nt, Salmonella enterica enterica serovar Typhi
gcccggcgcggcauca

SEQ ID NO: 1657280 - RNA, 15 nt, Salmonella enterica enterica serovar Typhi
gcccggccuacguuu

SEQ ID NO: 1657281 - RNA, 20 nt, Salmonella enterica enterica serovar Typhi
gcccggaaauaaacgccagu

SEQ ID NO: 1657282 - RNA, 17 nt, Salmonella enterica enterica serovar Typhi
gcccggccacagcgcca

SEQ ID NO: 1657283 - RNA, 15 nt, Salmonella enterica enterica serovar Typhi
gcccggcaguugcug

SEQ ID NO: 1657284 - RNA, 19 nt, Salmonella enterica enterica serovar Typhi
gcccggacaucauccccgg

SEQ ID NO: 1657285 - RNA, 12 nt, Salmonella enterica enterica serovar Typhi
gcccaggucgcc

SEQ ID NO: 1657286 - RNA, 11 nt, Salmonella enterica enterica serovar Typhi
gcccaggccug

SEQ ID NO: 1657287 - RNA, 19 nt, Salmonella enterica enterica serovar Typhi
gcccauuauugaucucuuc

SEQ ID NO: 1657288 - RNA, 19 nt, Salmonella enterica enterica serovar Typhi
gcccauuuaacagauaauu

SEQ ID NO: 1657289 - RNA, 22 nt, Salmonella enterica enterica serovar Typhi
aagacggcagcgccauccggca

SEQ ID NO: 1657290 - RNA, 19 nt, Salmonella enterica enterica serovar Typhi
aagacgugccggaagcgau

SEQ ID NO: 1657291 - RNA, 20 nt, Salmonella enterica enterica serovar Typhi
aagacguuuacaccgccauc

SEQ ID NO: 1657292 - RNA, 12 nt, Salmonella enterica enterica serovar Typhi
gccccgaccagg

SEQ ID NO: 1657293 - RNA, 23 nt, Salmonella enterica enterica serovar Typhi
gccccgccgcauugguaaagccg

SEQ ID NO: 1657294 - RNA, 21 nt, Salmonella enterica enterica serovar Typhi
aagagccgcgcagcgcaacgc

SEQ ID NO: 1657295 - RNA, 19 nt, Salmonella enterica enterica serovar Typhi
aagagcgagucuuuguccg

SEQ ID NO: 1657296 - RNA, 14 nt, Salmonella enterica enterica serovar Typhi
gcccgccuccguca

SEQ ID NO: 1657297 - RNA, 13 nt, Salmonella enterica enterica serovar Typhi
gcccgccgccaau

SEQ ID NO: 1657298 - RNA, 16 nt, Salmonella enterica enterica serovar Typhi
gcccgccagcacagca

SEQ ID NO: 1657299 - RNA, 14 nt, Salmonella enterica enterica serovar Typhi
gcccgccagcacag

SEQ ID NO: 1657300 - RNA, 16 nt, Salmonella enterica enterica serovar Typhi
gccccuuuacgcguga

SEQ ID NO: 1657301 - RNA, 17 nt, Salmonella enterica enterica serovar Typhi
aagauaaaaagacagau

SEQ ID NO: 1657302 - RNA, 13 nt, Salmonella enterica enterica serovar Typhi
gcccgacgcgcca

SEQ ID NO: 1657303 - RNA, 13 nt, Salmonella enterica enterica serovar Typhi
gcccgaaucgccg

SEQ ID NO: 1657304 - RNA, 11 nt, Salmonella enterica enterica serovar Typhi
gcccgaaucgc

SEQ ID NO: 1657305 - RNA, 13 nt, Salmonella enterica enterica serovar Typhi
gagaucuccagau

SEQ ID NO: 1657306 - RNA, 17 nt, Salmonella enterica enterica serovar Typhi
gagcagaaguaaauccg

SEQ ID NO: 1657307 - RNA, 17 nt, Salmonella enterica enterica serovar Typhi
gagacauuaguggcgac

SEQ ID NO: 1657308 - RNA, 22 nt, Salmonella enterica enterica serovar Typhi
gagaauuauucguguuucgacc

SEQ ID NO: 1657309 - RNA, 13 nt, Salmonella enterica enterica serovar Typhi
gagaauucugcgc

SEQ ID NO: 1657310 - RNA, 13 nt, Salmonella enterica enterica serovar Typhi
gagacugccgccg

SEQ ID NO: 1657311 - RNA, 15 nt, Salmonella enterica enterica serovar Typhi
gagagagcgcuucca

SEQ ID NO: 1657312 - RNA, 20 nt, Salmonella enterica enterica serovar Typhi
gagacuguuugacacuauau

SEQ ID NO: 1657313 - RNA, 19 nt, Salmonella enterica enterica serovar Typhi
gagaguaaaaccggcacau

SEQ ID NO: 1657314 - RNA, 18 nt, Salmonella enterica enterica serovar Typhi
gagaggccaccagcgcca

SEQ ID NO: 1657315 - RNA, 15 nt, Salmonella enterica enterica serovar Typhi
gagaguccagcgcca

SEQ ID NO: 1657316 - RNA, 18 nt, Salmonella enterica enterica serovar Typhi
gagaguugaugccggaua

SEQ ID NO: 1657317 - RNA, 17 nt, Salmonella enterica enterica serovar Typhi
gagaguugcuuuccguu

SEQ ID NO: 1657318 - RNA, 13 nt, Salmonella enterica enterica serovar Typhi
gagaucagcggau

SEQ ID NO: 1657319 - RNA, 15 nt, Salmonella enterica enterica serovar Typhi
gagcagucguugcgc

SEQ ID NO: 1657320 - RNA, 13 nt, Salmonella enterica enterica serovar Typhi
aacuccuccggcg

SEQ ID NO: 1657321 - RNA, 14 nt, Salmonella enterica enterica serovar Typhi
aacuccaccugauc

SEQ ID NO: 1657322 - RNA, 16 nt, Salmonella enterica enterica serovar Typhi
gagcauccagaucggc

SEQ ID NO: 1657323 - RNA, 21 nt, Salmonella enterica enterica serovar Typhi
gagcgaaggggcgggcagcag

SEQ ID NO: 1657324 - RNA, 12 nt, Salmonella enterica enterica serovar Typhi
gagcgacaauga

SEQ ID NO: 1657325 - RNA, 14 nt, Salmonella enterica enterica serovar Typhi
gagcgccugaugcc

SEQ ID NO: 1657326 - RNA, 22 nt, Salmonella enterica enterica serovar Typhi
gagcgccgcgccuaccagcgcu

SEQ ID NO: 1657327 - RNA, 15 nt, Salmonella enterica enterica serovar Typhi
gacuaucgucacccu

SEQ ID NO: 1657328 - RNA, 20 nt, Salmonella enterica enterica serovar Typhi
gacguuuaugccgccauccg

SEQ ID NO: 1657329 - RNA, 15 nt, Salmonella enterica enterica serovar Typhi
gacguuuauacccca

SEQ ID NO: 1657330 - RNA, 18 nt, Salmonella enterica enterica serovar Typhi
gacuaaccuugauucccu

SEQ ID NO: 1657331 - RNA, 19 nt, Salmonella enterica enterica serovar Typhi
gacguggauauucaucagu

SEQ ID NO: 1657332 - RNA, 21 nt, Salmonella enterica enterica serovar Typhi
gacguuaacgcagcaucgcca

SEQ ID NO: 1657333 - RNA, 20 nt, Salmonella enterica enterica serovar Typhi
gacguaccgcuuuaucauac

SEQ ID NO: 1657334 - RNA, 17 nt, Salmonella enterica enterica serovar Typhi
gacguagcgccaucagg

SEQ ID NO: 1657335 - RNA, 20 nt, Salmonella enterica enterica serovar Typhi
gacgugauuuuggcagcccg

SEQ ID NO: 1657336 - RNA, 13 nt, Salmonella enterica enterica serovar Typhi
gacgucgccauau

SEQ ID NO: 1657337 - RNA, 20 nt, Salmonella enterica enterica serovar Typhi
gacugauaaaagcccuuauc

SEQ ID NO: 1657338 - RNA, 16 nt, Salmonella enterica enterica serovar Typhi
gacugauaccgcguuu

SEQ ID NO: 1657339 - RNA, 15 nt, Salmonella enterica enterica serovar Typhi
gacugaauuuucagc

SEQ ID NO: 1657340 - RNA, 16 nt, Salmonella enterica enterica serovar Typhi
gacugaaccuucacgc

SEQ ID NO: 1657341 - RNA, 18 nt, Salmonella enterica enterica serovar Typhi
gacuccuuuuaccggcga

SEQ ID NO: 1657342 - RNA, 21 nt, Salmonella enterica enterica serovar Typhi
gacuguaaaucugccgucauc

SEQ ID NO: 1657343 - RNA, 18 nt, Salmonella enterica enterica serovar Typhi
aacguggcggcagagcca

SEQ ID NO: 1657344 - RNA, 10 nt, Salmonella enterica enterica serovar Typhi
gacuggcuga

SEQ ID NO: 1657345 - RNA, 18 nt, Salmonella enterica enterica serovar Typhi
gacuggcgaccgccacca

SEQ ID NO: 1657346 - RNA, 17 nt, Salmonella enterica enterica serovar Typhi
gacuucgcuuccugcau

SEQ ID NO: 1657347 - RNA, 17 nt, Salmonella enterica enterica serovar Typhi
gagaacugcugcauccg

SEQ ID NO: 1657348 - RNA, 19 nt, Salmonella enterica enterica serovar Typhi
aacguuucuuucaucagau

SEQ ID NO: 1657349 - RNA, 18 nt, Salmonella enterica enterica serovar Typhi
gacugucuuaucaggccu

SEQ ID NO: 1657350 - RNA, 14 nt, Salmonella enterica enterica serovar Typhi
aacucaaucaggcu

SEQ ID NO: 1657351 - RNA, 19 nt, Salmonella enterica enterica serovar Typhi
gagcgcggagaacgguuca

SEQ ID NO: 1657352 - RNA, 13 nt, Salmonella enterica enterica serovar Typhi
gaggaaaccuuuc

SEQ ID NO: 1657353 - RNA, 15 nt, Salmonella enterica enterica serovar Typhi
gaggaugccugcgca

SEQ ID NO: 1657354 - RNA, 18 nt, Salmonella enterica enterica serovar Typhi
gaggcgugagcgaacagg

SEQ ID NO: 1657355 - RNA, 22 nt, Salmonella enterica enterica serovar Typhi
gaggcggaguuauacagugcca

SEQ ID NO: 1657356 - RNA, 13 nt, Salmonella enterica enterica serovar Typhi
gaguuccggauac

SEQ ID NO: 1657357 - RNA, 22 nt, Salmonella enterica enterica serovar Typhi
gaguggagcggucgacagccac

SEQ ID NO: 1657358 - RNA, 13 nt, Salmonella enterica enterica serovar Typhi
gaguaugaacagg

SEQ ID NO: 1657359 - RNA, 14 nt, Salmonella enterica enterica serovar Typhi
gauaaagcagcgac

SEQ ID NO: 1657360 - RNA, 14 nt, Salmonella enterica enterica serovar Typhi
gauaaacugcgcca

SEQ ID NO: 1657361 - RNA, 16 nt, Salmonella enterica enterica serovar Typhi
gauaaagaacgcgccg

SEQ ID NO: 1657362 - RNA, 21 nt, Salmonella enterica enterica serovar Typhi
gauaaagaacgcgccgaccau

SEQ ID NO: 1657363 - RNA, 15 nt, Salmonella enterica enterica serovar Typhi
gauacgccagcagac

SEQ ID NO: 1657364 - RNA, 16 nt, Salmonella enterica enterica serovar Typhi
gauaccgcgccagcga

SEQ ID NO: 1657365 - RNA, 22 nt, Salmonella enterica enterica serovar Typhi
gauacgcagcaccgccgcgaua

SEQ ID NO: 1657366 - RNA, 15 nt, Salmonella enterica enterica serovar Typhi
gauaccggcaacgcc

SEQ ID NO: 1657367 - RNA, 22 nt, Salmonella enterica enterica serovar Typhi
gauaccuaaacgcgucagaaau

SEQ ID NO: 1657368 - RNA, 14 nt, Salmonella enterica enterica serovar Typhi
gauaccgcgccagc

SEQ ID NO: 1657369 - RNA, 19 nt, Salmonella enterica enterica serovar Typhi
gauaauuuuaccuucgcgu

SEQ ID NO: 1657370 - RNA, 18 nt, Salmonella enterica enterica serovar Typhi
gauacacgccuuccucca

SEQ ID NO: 1657371 - RNA, 22 nt, Salmonella enterica enterica serovar Typhi
gauaauuuucccaguucaucca

SEQ ID NO: 1657372 - RNA, 17 nt, Salmonella enterica enterica serovar Typhi
gauaagccgcguccggc

SEQ ID NO: 1657373 - RNA, 21 nt, Salmonella enterica enterica serovar Typhi
gauaagcauuagcgccauccg

SEQ ID NO: 1657374 - RNA, 23 nt, Salmonella enterica enterica serovar Typhi
gauaagccagcgaugagcgccag

SEQ ID NO: 1657375 - RNA, 16 nt, Salmonella enterica enterica serovar Typhi
gauaagcgaagcgcca

SEQ ID NO: 1657376 - RNA, 20 nt, Salmonella enterica enterica serovar Typhi
gauaagcgaagcgccaucag

SEQ ID NO: 1657377 - RNA, 20 nt, Salmonella enterica enterica serovar Typhi
gauaagcauagcgccaucag

SEQ ID NO: 1657378 - RNA, 23 nt, Salmonella enterica enterica serovar Typhi
gauaagcaacgcgccauccggca

SEQ ID NO: 1657379 - RNA, 16 nt, Salmonella enterica enterica serovar Typhi
gauaagcaagcgccau

SEQ ID NO: 1657380 - RNA, 14 nt, Salmonella enterica enterica serovar Typhi
gauaauacgcgcga

SEQ ID NO: 1657381 - RNA, 20 nt, Salmonella enterica enterica serovar Typhi
gauaagcgcagcgccaucag

SEQ ID NO: 1657382 - RNA, 23 nt, Salmonella enterica enterica serovar Typhi
gauaucuuccagcgcguccagcc

SEQ ID NO: 1657383 - RNA, 17 nt, Salmonella enterica enterica serovar Typhi
gauaucuucgauaagau

SEQ ID NO: 1657384 - RNA, 19 nt, Salmonella enterica enterica serovar Typhi
gauaucugccugcagaccc

SEQ ID NO: 1657385 - RNA, 17 nt, Salmonella enterica enterica serovar Typhi
gaucaaguuuuacgccg

SEQ ID NO: 1657386 - RNA, 17 nt, Salmonella enterica enterica serovar Typhi
gauagcccgccagcacc

SEQ ID NO: 1657387 - RNA, 18 nt, Salmonella enterica enterica serovar Typhi
gauacgccagcagacagg

SEQ ID NO: 1657388 - RNA, 23 nt, Salmonella enterica enterica serovar Typhi
gauagagcgccugcaggcgacuc

SEQ ID NO: 1657389 - RNA, 18 nt, Salmonella enterica enterica serovar Typhi
gauaguguaaacgcgcca

SEQ ID NO: 1657390 - RNA, 13 nt, Salmonella enterica enterica serovar Typhi
gauauccgccagu

SEQ ID NO: 1657391 - RNA, 22 nt, Salmonella enterica enterica serovar Typhi
gauauccauugggggguuagug

SEQ ID NO: 1657392 - RNA, 14 nt, Salmonella enterica enterica serovar Typhi
gauagucuucaagc

SEQ ID NO: 1657393 - RNA, 15 nt, Salmonella enterica enterica serovar Typhi
gauagucuucaagcc

SEQ ID NO: 1657394 - RNA, 18 nt, Salmonella enterica enterica serovar Typhi
gauagugauauagcgcca

SEQ ID NO: 1657395 - RNA, 13 nt, Salmonella enterica enterica serovar Typhi
gauagucaggcga

SEQ ID NO: 1657396 - RNA, 20 nt, Salmonella enterica enterica serovar Typhi
gaucgcgccggucgccagca

SEQ ID NO: 1657397 - RNA, 20 nt, Salmonella enterica enterica serovar Typhi
gaucgcggcaaccguaucca

SEQ ID NO: 1657398 - RNA, 20 nt, Salmonella enterica enterica serovar Typhi
gaucgcuggugcccgguacg

SEQ ID NO: 1657399 - RNA, 22 nt, Salmonella enterica enterica serovar Typhi
gaucggcaaaagugugauaagc

SEQ ID NO: 1657400 - RNA, 18 nt, Salmonella enterica enterica serovar Typhi
gaucggaagacuggcgca

SEQ ID NO: 1657401 - RNA, 13 nt, Salmonella enterica enterica serovar Typhi
gaucggaacgcga

SEQ ID NO: 1657402 - RNA, 21 nt, Salmonella enterica enterica serovar Typhi
gaucggcggcccacucaucca

SEQ ID NO: 1657403 - RNA, 11 nt, Salmonella enterica enterica serovar Typhi
gaucuaucuga

SEQ ID NO: 1657404 - RNA, 22 nt, Salmonella enterica enterica serovar Typhi
gaucuaacgaaaccggcggcga

SEQ ID NO: 1657405 - RNA, 17 nt, Salmonella enterica enterica serovar Typhi
gaucgucgggauaagcg

SEQ ID NO: 1657406 - RNA, 15 nt, Salmonella enterica enterica serovar Typhi
gaucgugccguccgg

SEQ ID NO: 1657407 - RNA, 24 nt, Salmonella enterica enterica serovar Typhi
gaucgugccaugaccauucacacu

SEQ ID NO: 1657408 - RNA, 17 nt, Salmonella enterica enterica serovar Typhi
gaucguccauuggcgga

SEQ ID NO: 1657409 - RNA, 17 nt, Salmonella enterica enterica serovar Typhi
gaucgucacgacggcga

SEQ ID NO: 1657410 - RNA, 13 nt, Salmonella enterica enterica serovar Typhi
gaucgucaacgac

SEQ ID NO: 1657411 - RNA, 12 nt, Salmonella enterica enterica serovar Typhi
gaucgucaacgc

SEQ ID NO: 1657412 - RNA, 14 nt, Salmonella enterica enterica serovar Typhi
gaucguaugcgccu

SEQ ID NO: 1657413 - RNA, 12 nt, Salmonella enterica enterica serovar Typhi
gaucgucaacga

SEQ ID NO: 1657414 - RNA, 14 nt, Salmonella enterica enterica serovar Typhi
gaucgggcuuccag

SEQ ID NO: 1657415 - RNA, 19 nt, Salmonella enterica enterica serovar Typhi
gaucaugcguccgcccaga

SEQ ID NO: 1657416 - RNA, 17 nt, Salmonella enterica enterica serovar Typhi
gaucaguagacgguaac

SEQ ID NO: 1657417 - RNA, 18 nt, Salmonella enterica enterica serovar Typhi
gauccaaauggcguacua

SEQ ID NO: 1657418 - RNA, 16 nt, Salmonella enterica enterica serovar Typhi
gauccaacacggcgcu

SEQ ID NO: 1657419 - RNA, 18 nt, Salmonella enterica enterica serovar Typhi
gauccaucgccugcggcg

SEQ ID NO: 1657420 - RNA, 22 nt, Salmonella enterica enterica serovar Typhi
gauccccucuuccaucagccag

SEQ ID NO: 1657421 - RNA, 15 nt, Salmonella enterica enterica serovar Typhi
gaucccccagaaucg

SEQ ID NO: 1657422 - RNA, 13 nt, Salmonella enterica enterica serovar Typhi
gaucccaggccgg

SEQ ID NO: 1657423 - RNA, 21 nt, Salmonella enterica enterica serovar Typhi
gaucagaaauucgcagcgcag

SEQ ID NO: 1657424 - RNA, 22 nt, Salmonella enterica enterica serovar Typhi
gaucacgguacgcaucaccagg

SEQ ID NO: 1657425 - RNA, 14 nt, Salmonella enterica enterica serovar Typhi
gaucacggugguga

SEQ ID NO: 1657426 - RNA, 23 nt, Salmonella enterica enterica serovar Typhi
gaucacuaccgccaucaaacgca

SEQ ID NO: 1657427 - RNA, 21 nt, Salmonella enterica enterica serovar Typhi
gaucagaccaucggccgcuau

SEQ ID NO: 1657428 - RNA, 18 nt, Salmonella enterica enterica serovar Typhi
gauccgcgagacgccugg

SEQ ID NO: 1657429 - RNA, 20 nt, Salmonella enterica enterica serovar Typhi
gaucccgggcgauaaaccag

SEQ ID NO: 1657430 - RNA, 15 nt, Salmonella enterica enterica serovar Typhi
gauccggcagccaau

SEQ ID NO: 1657431 - RNA, 20 nt, Salmonella enterica enterica serovar Typhi
gaucgagccgucgccggccu

SEQ ID NO: 1657432 - RNA, 18 nt, Salmonella enterica enterica serovar Typhi
gaucgcauaaauauccgg

SEQ ID NO: 1657433 - RNA, 14 nt, Salmonella enterica enterica serovar Typhi
gaucgccuggccga

SEQ ID NO: 1657434 - RNA, 14 nt, Salmonella enterica enterica serovar Typhi
gaucgcgcagcagg

SEQ ID NO: 1657435 - RNA, 19 nt, Salmonella enterica enterica serovar Typhi
gaucgcauuuaaucgccug

SEQ ID NO: 1657436 - RNA, 19 nt, Salmonella enterica enterica serovar Typhi
gaucgccaacgaccggcgc

SEQ ID NO: 1657437 - RNA, 17 nt, Salmonella enterica enterica serovar Typhi
gcacgcgucaucggcgc

SEQ ID NO: 1657438 - RNA, 16 nt, Salmonella enterica enterica serovar Typhi
gcaccucuuuaugcgg

SEQ ID NO: 1657439 - RNA, 21 nt, Salmonella enterica enterica serovar Typhi
gcaccucagaccguuagccgg

SEQ ID NO: 1657440 - RNA, 13 nt, Salmonella enterica enterica serovar Typhi
gcaccuccagcgc

SEQ ID NO: 1657441 - RNA, 17 nt, Salmonella enterica enterica serovar Typhi
gcacgcacgacagugcu

SEQ ID NO: 1657442 - RNA, 20 nt, Salmonella enterica enterica serovar Typhi
gcacagcacuaacgaggcca

SEQ ID NO: 1657443 - RNA, 14 nt, Salmonella enterica enterica serovar Typhi
gcacagaagcgccu

SEQ ID NO: 1657444 - RNA, 15 nt, Salmonella enterica enterica serovar Typhi
gcaccgaauguuccg

SEQ ID NO: 1657445 - RNA, 21 nt, Salmonella enterica enterica serovar Typhi
gcagacgccgcgguugacggc

SEQ ID NO: 1657446 - RNA, 16 nt, Salmonella enterica enterica serovar Typhi
aacuuuuggugcccau

SEQ ID NO: 1657447 - RNA, 14 nt, Salmonella enterica enterica serovar Typhi
gcagaagcagaccg

SEQ ID NO: 1657448 - RNA, 23 nt, Salmonella enterica enterica serovar Typhi
gcagaauggcgauuaacgcauag

SEQ ID NO: 1657449 - RNA, 21 nt, Salmonella enterica enterica serovar Typhi
gcagaauuuauuucugcgcga

SEQ ID NO: 1657450 - RNA, 19 nt, Salmonella enterica enterica serovar Typhi
gcagaccuauauggcgcaa

SEQ ID NO: 1657451 - RNA, 15 nt, Salmonella enterica enterica serovar Typhi
gcagaccgagcgcau

SEQ ID NO: 1657452 - RNA, 14 nt, Salmonella enterica enterica serovar Typhi
gcagcacugcuuaa

SEQ ID NO: 1657453 - RNA, 14 nt, Salmonella enterica enterica serovar Typhi
gcagcagcggaauc

SEQ ID NO: 1657454 - RNA, 18 nt, Salmonella enterica enterica serovar Typhi
gcagauccaaauggcgua

SEQ ID NO: 1657455 - RNA, 21 nt, Salmonella enterica enterica serovar Typhi
gcagccacccuggcauaugga

SEQ ID NO: 1657456 - RNA, 18 nt, Salmonella enterica enterica serovar Typhi
gcagccaacgccgccaua

SEQ ID NO: 1657457 - RNA, 14 nt, Salmonella enterica enterica serovar Typhi
gcagcaugauaucg

SEQ ID NO: 1657458 - RNA, 17 nt, Salmonella enterica enterica serovar Typhi
gcagcauaaacaucagc

SEQ ID NO: 1657459 - RNA, 14 nt, Salmonella enterica enterica serovar Typhi
gcagcauaucgccg

SEQ ID NO: 1657460 - RNA, 13 nt, Salmonella enterica enterica serovar Typhi
gcagccgacagcg

SEQ ID NO: 1657461 - RNA, 23 nt, Salmonella enterica enterica serovar Typhi
gcagcccuuacgcuuuauucugu

SEQ ID NO: 1657462 - RNA, 20 nt, Salmonella enterica enterica serovar Typhi
gcagcccugcgucgcguacc

SEQ ID NO: 1657463 - RNA, 17 nt, Salmonella enterica enterica serovar Typhi
gcagccgccauccggca

SEQ ID NO: 1657464 - RNA, 20 nt, Salmonella enterica enterica serovar Typhi
gcagcgaggugauaaucagc

SEQ ID NO: 1657465 - RNA, 13 nt, Salmonella enterica enterica serovar Typhi
gcagcgccagcga

SEQ ID NO: 1657466 - RNA, 20 nt, Salmonella enterica enterica serovar Typhi
gcagcgccaucaggcacggc

SEQ ID NO: 1657467 - RNA, 13 nt, Salmonella enterica enterica serovar Typhi
gcagcgccagcgu

SEQ ID NO: 1657468 - RNA, 16 nt, Salmonella enterica enterica serovar Typhi
gcagcgccauccggca

SEQ ID NO: 1657469 - RNA, 16 nt, Salmonella enterica enterica serovar Typhi
gauggugucaaucgcc

SEQ ID NO: 1657470 - RNA, 18 nt, Salmonella enterica enterica serovar Typhi
gaugggcgcacagcgcca

SEQ ID NO: 1657471 - RNA, 20 nt, Salmonella enterica enterica serovar Typhi
gaugguaggccugauaagcg

SEQ ID NO: 1657472 - RNA, 19 nt, Salmonella enterica enterica serovar Typhi
gaugguauaaaucacgcug

SEQ ID NO: 1657473 - RNA, 17 nt, Salmonella enterica enterica serovar Typhi
gauggcgaucagcgcca

SEQ ID NO: 1657474 - RNA, 22 nt, Salmonella enterica enterica serovar Typhi
gauggcgacuaccucuuauccg

SEQ ID NO: 1657475 - RNA, 21 nt, Salmonella enterica enterica serovar Typhi
gauggcgauucauaugcgcca

SEQ ID NO: 1657476 - RNA, 22 nt, Salmonella enterica enterica serovar Typhi
gauggcgccagccauagcagca

SEQ ID NO: 1657477 - RNA, 20 nt, Salmonella enterica enterica serovar Typhi
gauggcgcgacgcuuaucag

SEQ ID NO: 1657478 - RNA, 22 nt, Salmonella enterica enterica serovar Typhi
gauggcggcugcgccuuauccg

SEQ ID NO: 1657479 - RNA, 22 nt, Salmonella enterica enterica serovar Typhi
gauggcggcuacgccuuauccg

SEQ ID NO: 1657480 - RNA, 20 nt, Salmonella enterica enterica serovar Typhi
gaugcggcgccaacgcgcua

SEQ ID NO: 1657481 - RNA, 13 nt, Salmonella enterica enterica serovar Typhi
gaucuggacgcca

SEQ ID NO: 1657482 - RNA, 18 nt, Salmonella enterica enterica serovar Typhi
gauggacaauccgcgaau

SEQ ID NO: 1657483 - RNA, 20 nt, Salmonella enterica enterica serovar Typhi
gaugcguaccgcuaucgcca

SEQ ID NO: 1657484 - RNA, 19 nt, Salmonella enterica enterica serovar Typhi
gaugcugcucuccacgccg

SEQ ID NO: 1657485 - RNA, 21 nt, Salmonella enterica enterica serovar Typhi
gauggaacgcauccagccacg

SEQ ID NO: 1657486 - RNA, 20 nt, Salmonella enterica enterica serovar Typhi
gcaacccauacagcccauac

SEQ ID NO: 1657487 - RNA, 17 nt, Salmonella enterica enterica serovar Typhi
gcaaagguugccgcaau

SEQ ID NO: 1657488 - RNA, 16 nt, Salmonella enterica enterica serovar Typhi
gcaaagcgucgcguca

SEQ ID NO: 1657489 - RNA, 18 nt, Salmonella enterica enterica serovar Typhi
gcaaaggaucaucggcca

SEQ ID NO: 1657490 - RNA, 12 nt, Salmonella enterica enterica serovar Typhi
gcaacacacgcu

SEQ ID NO: 1657491 - RNA, 14 nt, Salmonella enterica enterica serovar Typhi
gcaacacagccagc

SEQ ID NO: 1657492 - RNA, 14 nt, Salmonella enterica enterica serovar Typhi
gauuugcguuguuu

SEQ ID NO: 1657493 - RNA, 17 nt, Salmonella enterica enterica serovar Typhi
gcaaaauaccggcagcg

SEQ ID NO: 1657494 - RNA, 14 nt, Salmonella enterica enterica serovar Typhi
gcaaacagcacgcc

SEQ ID NO: 1657495 - RNA, 21 nt, Salmonella enterica enterica serovar Typhi
gcaaacacaaucacgcccagc

SEQ ID NO: 1657496 - RNA, 19 nt, Salmonella enterica enterica serovar Typhi
gcaaagcccaucagcgcca

SEQ ID NO: 1657497 - RNA, 13 nt, Salmonella enterica enterica serovar Typhi
gauucccauccgu

SEQ ID NO: 1657498 - RNA, 20 nt, Salmonella enterica enterica serovar Typhi
gauucccagugcgcggucau

SEQ ID NO: 1657499 - RNA, 20 nt, Salmonella enterica enterica serovar Typhi
gauuagcuuuaauccguuac

SEQ ID NO: 1657500 - RNA, 17 nt, Salmonella enterica enterica serovar Typhi
gauuaggguucacggcg

SEQ ID NO: 1657501 - RNA, 20 nt, Salmonella enterica enterica serovar Typhi
gauuauuuuaucaucagcac

SEQ ID NO: 1657502 - RNA, 18 nt, Salmonella enterica enterica serovar Typhi
gauuauuuuaucaucagc

SEQ ID NO: 1657503 - RNA, 21 nt, Salmonella enterica enterica serovar Typhi
gauuagcgacagcgcuauccg

SEQ ID NO: 1657504 - RNA, 17 nt, Salmonella enterica enterica serovar Typhi
gauuagccccagcgcca

SEQ ID NO: 1657505 - RNA, 20 nt, Salmonella enterica enterica serovar Typhi
gauuacucucuugccagcgc

SEQ ID NO: 1657506 - RNA, 21 nt, Salmonella enterica enterica serovar Typhi
gauuucuugagcggcaucacu

SEQ ID NO: 1657507 - RNA, 19 nt, Salmonella enterica enterica serovar Typhi
gauuucuucuggcugcuga

SEQ ID NO: 1657508 - RNA, 21 nt, Salmonella enterica enterica serovar Typhi
gauuuggcguaaucgauaagc

SEQ ID NO: 1657509 - RNA, 21 nt, Salmonella enterica enterica serovar Typhi
gauuugcccuuccagcagcca

SEQ ID NO: 1657510 - RNA, 17 nt, Salmonella enterica enterica serovar Typhi
gauuugcgcucgcgcca

SEQ ID NO: 1657511 - RNA, 17 nt, Salmonella enterica enterica serovar Typhi
gauugagcguuucccgc

SEQ ID NO: 1657512 - RNA, 22 nt, Salmonella enterica enterica serovar Typhi
gauugaaacucgccaugccauc

SEQ ID NO: 1657513 - RNA, 17 nt, Salmonella enterica enterica serovar Typhi
gcaauguuccccugaug

SEQ ID NO: 1657514 - RNA, 20 nt, Salmonella enterica enterica serovar Typhi
gcaauggccgcagcgccaua

SEQ ID NO: 1657515 - RNA, 18 nt, Salmonella enterica enterica serovar Typhi
gcaauggccgcagcgcca

SEQ ID NO: 1657516 - RNA, 21 nt, Salmonella enterica enterica serovar Typhi
gcaaucuuuacccggcgcaaa

SEQ ID NO: 1657517 - RNA, 13 nt, Salmonella enterica enterica serovar Typhi
gcaaugaacagca

SEQ ID NO: 1657518 - RNA, 18 nt, Salmonella enterica enterica serovar Typhi
gcaaugauaacggcgcca

SEQ ID NO: 1657519 - RNA, 22 nt, Salmonella enterica enterica serovar Typhi
gcacaauaacgucacgauagcg

SEQ ID NO: 1657520 - RNA, 12 nt, Salmonella enterica enterica serovar Typhi
gcaauucauccu

SEQ ID NO: 1657521 - RNA, 14 nt, Salmonella enterica enterica serovar Typhi
gcaauuccggucau

SEQ ID NO: 1657522 - RNA, 17 nt, Salmonella enterica enterica serovar Typhi
gcaauuccggucaucgc

SEQ ID NO: 1657523 - RNA, 13 nt, Salmonella enterica enterica serovar Typhi
gcacaauagcgcu

SEQ ID NO: 1657524 - RNA, 23 nt, Salmonella enterica enterica serovar Typhi
gcacaauaacgucacgauagcgc

SEQ ID NO: 1657525 - RNA, 20 nt, Salmonella enterica enterica serovar Typhi
gcacaauaccuucugcgccc

SEQ ID NO: 1657526 - RNA, 18 nt, Salmonella enterica enterica serovar Typhi
gcacacuuucaucagccg

SEQ ID NO: 1657527 - RNA, 22 nt, Salmonella enterica enterica serovar Typhi
gcaauaugucuuaaacagcgau

SEQ ID NO: 1657528 - RNA, 24 nt, Salmonella enterica enterica serovar Typhi
gcaauaugucuuaaacagcgauca

SEQ ID NO: 1657529 - RNA, 15 nt, Salmonella enterica enterica serovar Typhi
gcaauacuguaagcc

SEQ ID NO: 1657530 - RNA, 22 nt, Salmonella enterica enterica serovar Typhi
gcaauagcgacguuaucucgcc

SEQ ID NO: 1657531 - RNA, 18 nt, Salmonella enterica enterica serovar Typhi
gcaaucaguggcggcaaa

SEQ ID NO: 1657532 - RNA, 22 nt, Salmonella enterica enterica serovar Typhi
gcaaucauccugauuuuacuga

SEQ ID NO: 1657533 - RNA, 15 nt, Salmonella enterica enterica serovar Typhi
gcaaucaucagaccg

SEQ ID NO: 1657534 - RNA, 18 nt, Salmonella enterica enterica serovar Typhi
gcaauaauguuugcgcca

SEQ ID NO: 1657535 - RNA, 19 nt, Salmonella enterica enterica serovar Typhi
gcaauaaacucccgcauau

SEQ ID NO: 1657536 - RNA, 22 nt, Salmonella enterica enterica serovar Typhi
gcaacguucagcucgauccggc

SEQ ID NO: 1657537 - RNA, 20 nt, Salmonella enterica enterica serovar Typhi
gcaacguuucuuucaucaga

SEQ ID NO: 1657538 - RNA, 19 nt, Salmonella enterica enterica serovar Typhi
gcaacguaaucccgccagc

SEQ ID NO: 1657539 - RNA, 15 nt, Salmonella enterica enterica serovar Typhi
gcaacggccagcgca

SEQ ID NO: 1657540 - RNA, 23 nt, Salmonella enterica enterica serovar Typhi
gcaacgggacggcggccagcauu

SEQ ID NO: 1657541 - RNA, 11 nt, Salmonella enterica enterica serovar Typhi
gcaacgcgcac

SEQ ID NO: 1657542 - RNA, 17 nt, Salmonella enterica enterica serovar Typhi
gcaacgcugcauccugu

SEQ ID NO: 1657543 - RNA, 14 nt, Salmonella enterica enterica serovar Typhi
gcaacgccgccagc

SEQ ID NO: 1657544 - RNA, 22 nt, Salmonella enterica enterica serovar Typhi
gcaaccgauagcuaaugcgguu

SEQ ID NO: 1657545 - RNA, 19 nt, Salmonella enterica enterica serovar Typhi
gcaaccugacgcugcgccu

SEQ ID NO: 1657546 - RNA, 20 nt, Salmonella enterica enterica serovar Typhi
gcaacgacgucuuucuucgc

SEQ ID NO: 1657547 - RNA, 13 nt, Salmonella enterica enterica serovar Typhi
gcaagcagcacac

SEQ ID NO: 1657548 - RNA, 22 nt, Salmonella enterica enterica serovar Typhi
gcaacuuacgcccuauccggcc

SEQ ID NO: 1657549 - RNA, 21 nt, Salmonella enterica enterica serovar Typhi
gcaacuggcaagcgcuaagca

SEQ ID NO: 1657550 - RNA, 13 nt, Salmonella enterica enterica serovar Typhi
gcaacuggcaaua

SEQ ID NO: 1657551 - RNA, 14 nt, Salmonella enterica enterica serovar Typhi
gcaagaaacaggcu

SEQ ID NO: 1657552 - RNA, 16 nt, Salmonella enterica enterica serovar Typhi
ggcggccaaucagaua

SEQ ID NO: 1657553 - RNA, 20 nt, Salmonella enterica enterica serovar Typhi
ggcgcuuugcuuauccggcc

SEQ ID NO: 1657554 - RNA, 19 nt, Salmonella enterica enterica serovar Typhi
ggcggacaacgcuccagca

SEQ ID NO: 1657555 - RNA, 16 nt, Salmonella enterica enterica serovar Typhi
ggcggaagguuuccgc

SEQ ID NO: 1657556 - RNA, 14 nt, Salmonella enterica enterica serovar Typhi
ggcggacucgcugg

SEQ ID NO: 1657557 - RNA, 14 nt, Salmonella enterica enterica serovar Typhi
ggcggcuaccgccg

SEQ ID NO: 1657558 - RNA, 21 nt, Salmonella enterica enterica serovar Typhi
ggcggcuaacgccugauccgg

SEQ ID NO: 1657559 - RNA, 19 nt, Salmonella enterica enterica serovar Typhi
ggcggcuacgccuuauccg

SEQ ID NO: 1657560 - RNA, 20 nt, Salmonella enterica enterica serovar Typhi
ggcggcuacgccuuauccgg

SEQ ID NO: 1657561 - RNA, 23 nt, Salmonella enterica enterica serovar Typhi
ggcggcgugaccgccuuauccgg

SEQ ID NO: 1657562 - RNA, 23 nt, Salmonella enterica enterica serovar Typhi
ggcguaauaugaauauccgccgc

SEQ ID NO: 1657563 - RNA, 15 nt, Salmonella enterica enterica serovar Typhi
ggcguaagcgacauc

SEQ ID NO: 1657564 - RNA, 21 nt, Salmonella enterica enterica serovar Typhi
ggcguaaccgccauccggcga

SEQ ID NO: 1657565 - RNA, 12 nt, Salmonella enterica enterica serovar Typhi
ggcguaccgccg

SEQ ID NO: 1657566 - RNA, 18 nt, Salmonella enterica enterica serovar Typhi
ggcguacauugccggaug

SEQ ID NO: 1657567 - RNA, 14 nt, Salmonella enterica enterica serovar Typhi
ggcguagucagcga

SEQ ID NO: 1657568 - RNA, 14 nt, Salmonella enterica enterica serovar Typhi
ggcguacgggcaaa

SEQ ID NO: 1657569 - RNA, 16 nt, Salmonella enterica enterica serovar Typhi
ggcguagcgagaaggc

SEQ ID NO: 1657570 - RNA, 12 nt, Salmonella enterica enterica serovar Typhi
ggcgguuauccg

SEQ ID NO: 1657571 - RNA, 19 nt, Salmonella enterica enterica serovar Typhi
ggcgguucauccugcgcca

SEQ ID NO: 1657572 - RNA, 20 nt, Salmonella enterica enterica serovar Typhi
ggcgguuauccgccagcgca

SEQ ID NO: 1657573 - RNA, 14 nt, Salmonella enterica enterica serovar Typhi
ggcggucaucgccc

SEQ ID NO: 1657574 - RNA, 23 nt, Salmonella enterica enterica serovar Typhi
ggcggucagcuuuucagcccagg

SEQ ID NO: 1657575 - RNA, 16 nt, Salmonella enterica enterica serovar Typhi
ggcgguagcugcgcca

SEQ ID NO: 1657576 - RNA, 23 nt, Salmonella enterica enterica serovar Typhi
ggcgguauaacugccuuauccgg

SEQ ID NO: 1657577 - RNA, 19 nt, Salmonella enterica enterica serovar Typhi
ggcgggauacucggcacca

SEQ ID NO: 1657578 - RNA, 17 nt, Salmonella enterica enterica serovar Typhi
aaggucgcuauccagca

SEQ ID NO: 1657579 - RNA, 19 nt, Salmonella enterica enterica serovar Typhi
aaggugagcauugcgcuca

SEQ ID NO: 1657580 - RNA, 18 nt, Salmonella enterica enterica serovar Typhi
ggcgcucaauagccagaa

SEQ ID NO: 1657581 - RNA, 14 nt, Salmonella enterica enterica serovar Typhi
ggcgcucagccaga

SEQ ID NO: 1657582 - RNA, 21 nt, Salmonella enterica enterica serovar Typhi
ggcgcucagccagaaacgguc

SEQ ID NO: 1657583 - RNA, 20 nt, Salmonella enterica enterica serovar Typhi
aagguguuuacgccgccauc

SEQ ID NO: 1657584 - RNA, 14 nt, Salmonella enterica enterica serovar Typhi
aagguuauccgccg

SEQ ID NO: 1657585 - RNA, 22 nt, Salmonella enterica enterica serovar Typhi
ggcgcuacgcuuaucaggccua

SEQ ID NO: 1657586 - RNA, 20 nt, Salmonella enterica enterica serovar Typhi
aaggucgcauccgcguuagc

SEQ ID NO: 1657587 - RNA, 20 nt, Salmonella enterica enterica serovar Typhi
ggcgcuacgcuuaucaggcc

SEQ ID NO: 1657588 - RNA, 18 nt, Salmonella enterica enterica serovar Typhi
ggcgcuacguuuaucugg

SEQ ID NO: 1657589 - RNA, 20 nt, Salmonella enterica enterica serovar Typhi
ggcgcgccaauaaagcuuga

SEQ ID NO: 1657590 - RNA, 22 nt, Salmonella enterica enterica serovar Typhi
ggcgcacaguacgcgaccgccg

SEQ ID NO: 1657591 - RNA, 14 nt, Salmonella enterica enterica serovar Typhi
ggcgcacagcgcca

SEQ ID NO: 1657592 - RNA, 17 nt, Salmonella enterica enterica serovar Typhi
ggcgccaaucaccgcca

SEQ ID NO: 1657593 - RNA, 14 nt, Salmonella enterica enterica serovar Typhi
ggcgcaguuuacgc

SEQ ID NO: 1657594 - RNA, 20 nt, Salmonella enterica enterica serovar Typhi
ggcgcaggggcauuuuccgg

SEQ ID NO: 1657595 - RNA, 17 nt, Salmonella enterica enterica serovar Typhi
aaggucacuacgcggcu

SEQ ID NO: 1657596 - RNA, 21 nt, Salmonella enterica enterica serovar Typhi
aaggucagguuaugcgcgcca

SEQ ID NO: 1657597 - RNA, 15 nt, Salmonella enterica enterica serovar Typhi
aagguauccgccaua

SEQ ID NO: 1657598 - RNA, 23 nt, Salmonella enterica enterica serovar Typhi
ggccugaaucagcaucuuaugcg

SEQ ID NO: 1657599 - RNA, 22 nt, Salmonella enterica enterica serovar Typhi
aaggcguucacaccgccgccag

SEQ ID NO: 1657600 - RNA, 20 nt, Salmonella enterica enterica serovar Typhi
aaggcgcuugcgccgccauc

SEQ ID NO: 1657601 - RNA, 15 nt, Salmonella enterica enterica serovar Typhi
aaggcggcaaagaua

SEQ ID NO: 1657602 - RNA, 20 nt, Salmonella enterica enterica serovar Typhi
aaggcggcaaagauaaucug

SEQ ID NO: 1657603 - RNA, 23 nt, Salmonella enterica enterica serovar Typhi
aaggcgaaaccgcuacccggcac

SEQ ID NO: 1657604 - RNA, 12 nt, Salmonella enterica enterica serovar Typhi
aaggcgcagccg

SEQ ID NO: 1657605 - RNA, 22 nt, Salmonella enterica enterica serovar Typhi
ggccugugacguuaacgcagca

SEQ ID NO: 1657606 - RNA, 20 nt, Salmonella enterica enterica serovar Typhi
ggccugguuaacaauauugc

SEQ ID NO: 1657607 - RNA, 20 nt, Salmonella enterica enterica serovar Typhi
ggccuguuccuuacagcuuc

SEQ ID NO: 1657608 - RNA, 16 nt, Salmonella enterica enterica serovar Typhi
ggcgaacgacucacgc

SEQ ID NO: 1657609 - RNA, 17 nt, Salmonella enterica enterica serovar Typhi
ggcgaaccggcaucggc

SEQ ID NO: 1657610 - RNA, 21 nt, Salmonella enterica enterica serovar Typhi
ggcgaaccggcaucggcagcg

SEQ ID NO: 1657611 - RNA, 23 nt, Salmonella enterica enterica serovar Typhi
ggcgaagacugauuuaucaccca

SEQ ID NO: 1657612 - RNA, 23 nt, Salmonella enterica enterica serovar Typhi
ggcgaacagccccaccgccagaa

SEQ ID NO: 1657613 - RNA, 22 nt, Salmonella enterica enterica serovar Typhi
ggcgaacagccccaccgccaga

SEQ ID NO: 1657614 - RNA, 21 nt, Salmonella enterica enterica serovar Typhi
ggcgaacaggcucagcgccac

SEQ ID NO: 1657615 - RNA, 15 nt, Salmonella enterica enterica serovar Typhi
ggcgaacaauaccgu

SEQ ID NO: 1657616 - RNA, 17 nt, Salmonella enterica enterica serovar Typhi
ggcgaaaaaguucacgc

SEQ ID NO: 1657617 - RNA, 12 nt, Salmonella enterica enterica serovar Typhi
ggcgaaaacgcu

SEQ ID NO: 1657618 - RNA, 20 nt, Salmonella enterica enterica serovar Typhi
aaggcguucacgccgccauc

SEQ ID NO: 1657619 - RNA, 20 nt, Salmonella enterica enterica serovar Typhi
aaggcguuuacgccgccauc

SEQ ID NO: 1657620 - RNA, 16 nt, Salmonella enterica enterica serovar Typhi
ggcgacgaucagcgcc

SEQ ID NO: 1657621 - RNA, 22 nt, Salmonella enterica enterica serovar Typhi
aagggaagaucauuaucaauag

SEQ ID NO: 1657622 - RNA, 21 nt, Salmonella enterica enterica serovar Typhi
ggcgacuaacgucuuauccgg

SEQ ID NO: 1657623 - RNA, 20 nt, Salmonella enterica enterica serovar Typhi
ggcgacuaccucuuauccgg

SEQ ID NO: 1657624 - RNA, 20 nt, Salmonella enterica enterica serovar Typhi
ggcgacuucauucaggcagg

SEQ ID NO: 1657625 - RNA, 20 nt, Salmonella enterica enterica serovar Typhi
ggcgacaagaauaugggugu

SEQ ID NO: 1657626 - RNA, 14 nt, Salmonella enterica enterica serovar Typhi
ggcgacaaucucac

SEQ ID NO: 1657627 - RNA, 16 nt, Salmonella enterica enterica serovar Typhi
ggcgacaaucucaccg

SEQ ID NO: 1657628 - RNA, 17 nt, Salmonella enterica enterica serovar Typhi
ggcgacacaacggcaca

SEQ ID NO: 1657629 - RNA, 23 nt, Salmonella enterica enterica serovar Typhi
ggcgaauccccaucuccagacga

SEQ ID NO: 1657630 - RNA, 22 nt, Salmonella enterica enterica serovar Typhi
ggcgaaucucgugaucgccaaa

SEQ ID NO: 1657631 - RNA, 20 nt, Salmonella enterica enterica serovar Typhi
ggcgaauaaaauucagcgca

SEQ ID NO: 1657632 - RNA, 21 nt, Salmonella enterica enterica serovar Typhi
ggcccgaagggcgagcguagc

SEQ ID NO: 1657633 - RNA, 23 nt, Salmonella enterica enterica serovar Typhi
ggccgcuaucugcuccgccagca

SEQ ID NO: 1657634 - RNA, 19 nt, Salmonella enterica enterica serovar Typhi
ggccgcguuaacgccguug

SEQ ID NO: 1657635 - RNA, 17 nt, Salmonella enterica enterica serovar Typhi
ggccuacagaugaacgu

SEQ ID NO: 1657636 - RNA, 13 nt, Salmonella enterica enterica serovar Typhi
ggcagacagccau

SEQ ID NO: 1657637 - RNA, 15 nt, Salmonella enterica enterica serovar Typhi
ggcagacaucgccgu

SEQ ID NO: 1657638 - RNA, 16 nt, Salmonella enterica enterica serovar Typhi
ggcagccaggcaaagc

SEQ ID NO: 1657639 - RNA, 15 nt, Salmonella enterica enterica serovar Typhi
ggcagccucaggccu

SEQ ID NO: 1657640 - RNA, 19 nt, Salmonella enterica enterica serovar Typhi
ggcaguccuugcagccaga

SEQ ID NO: 1657641 - RNA, 18 nt, Salmonella enterica enterica serovar Typhi
ggcagucuggcggcagcc

SEQ ID NO: 1657642 - RNA, 12 nt, Salmonella enterica enterica serovar Typhi
ggcagcgucagc

SEQ ID NO: 1657643 - RNA, 13 nt, Salmonella enterica enterica serovar Typhi
ggcauaucgccau

SEQ ID NO: 1657644 - RNA, 19 nt, Salmonella enterica enterica serovar Typhi
ggcaacauggacaccggaa

SEQ ID NO: 1657645 - RNA, 12 nt, Salmonella enterica enterica serovar Typhi
ggcaacagccau

SEQ ID NO: 1657646 - RNA, 22 nt, Salmonella enterica enterica serovar Typhi
ggcaaaucuggugauaaagcag

SEQ ID NO: 1657647 - RNA, 12 nt, Salmonella enterica enterica serovar Typhi
ggcaaauaccgu

SEQ ID NO: 1657648 - RNA, 18 nt, Salmonella enterica enterica serovar Typhi
ggcaaauucuuuucacgc

SEQ ID NO: 1657649 - RNA, 14 nt, Salmonella enterica enterica serovar Typhi
ggcaaauucagcga

SEQ ID NO: 1657650 - RNA, 20 nt, Salmonella enterica enterica serovar Typhi
ggcaagcuggcgaaucgcau

SEQ ID NO: 1657651 - RNA, 16 nt, Salmonella enterica enterica serovar Typhi
ggcaacggccagcgca

SEQ ID NO: 1657652 - RNA, 22 nt, Salmonella enterica enterica serovar Typhi
ggcaacgggacggcggccagca

SEQ ID NO: 1657653 - RNA, 21 nt, Salmonella enterica enterica serovar Typhi
ggcaauauccuccggcguaaa

SEQ ID NO: 1657654 - RNA, 18 nt, Salmonella enterica enterica serovar Typhi
ggcaauagccuuuaucgg

SEQ ID NO: 1657655 - RNA, 12 nt, Salmonella enterica enterica serovar Typhi
ggcaaucaguac

SEQ ID NO: 1657656 - RNA, 19 nt, Salmonella enterica enterica serovar Typhi
ggcaaguucuuguuucauc

SEQ ID NO: 1657657 - RNA, 13 nt, Salmonella enterica enterica serovar Typhi
ggcaauuucucgc

SEQ ID NO: 1657658 - RNA, 22 nt, Salmonella enterica enterica serovar Typhi
ggcaaucgacguugaucgccau

SEQ ID NO: 1657659 - RNA, 14 nt, Salmonella enterica enterica serovar Typhi
ggcacacaggccgc

SEQ ID NO: 1657660 - RNA, 16 nt, Salmonella enterica enterica serovar Typhi
ggcaauuucucgcucg

SEQ ID NO: 1657661 - RNA, 12 nt, Salmonella enterica enterica serovar Typhi
ggcaccacguca

SEQ ID NO: 1657662 - RNA, 12 nt, Salmonella enterica enterica serovar Typhi
ggcaccagcaau

SEQ ID NO: 1657663 - RNA, 12 nt, Salmonella enterica enterica serovar Typhi
ggcaccagcgua

SEQ ID NO: 1657664 - RNA, 19 nt, Salmonella enterica enterica serovar Typhi
ggccaugaucgccgccauc

SEQ ID NO: 1657665 - RNA, 16 nt, Salmonella enterica enterica serovar Typhi
ggcccacgcgcagaga

SEQ ID NO: 1657666 - RNA, 21 nt, Salmonella enterica enterica serovar Typhi
ggcccaggccauuaaccuugc

SEQ ID NO: 1657667 - RNA, 15 nt, Salmonella enterica enterica serovar Typhi
ggccaucuggcguug

SEQ ID NO: 1657668 - RNA, 16 nt, Salmonella enterica enterica serovar Typhi
ggccaucauaccgcca

SEQ ID NO: 1657669 - RNA, 21 nt, Salmonella enterica enterica serovar Typhi
ggccagcgaaaaccagcgccg

SEQ ID NO: 1657670 - RNA, 18 nt, Salmonella enterica enterica serovar Typhi
ggcaugccccucgacagg

SEQ ID NO: 1657671 - RNA, 20 nt, Salmonella enterica enterica serovar Typhi
aaggcauuuaugccgccauc

SEQ ID NO: 1657672 - RNA, 17 nt, Salmonella enterica enterica serovar Typhi
aaggccacgccgccauc

SEQ ID NO: 1657673 - RNA, 20 nt, Salmonella enterica enterica serovar Typhi
aaggcagcaaugugcgccag

SEQ ID NO: 1657674 - RNA, 15 nt, Salmonella enterica enterica serovar Typhi
aaggauacagcgccg

SEQ ID NO: 1657675 - RNA, 14 nt, Salmonella enterica enterica serovar Typhi
aaggaugcccguag

SEQ ID NO: 1657676 - RNA, 20 nt, Salmonella enterica enterica serovar Typhi
aaggcaaaaugccagcccga

SEQ ID NO: 1657677 - RNA, 23 nt, Salmonella enterica enterica serovar Typhi
ggagccucugcgggacgcaucau

SEQ ID NO: 1657678 - RNA, 19 nt, Salmonella enterica enterica serovar Typhi
ggagaagacgccgccgcau

SEQ ID NO: 1657679 - RNA, 15 nt, Salmonella enterica enterica serovar Typhi
ggagagcaacgccau

SEQ ID NO: 1657680 - RNA, 23 nt, Salmonella enterica enterica serovar Typhi
ggagagcauuuguagcggcaaca

SEQ ID NO: 1657681 - RNA, 11 nt, Salmonella enterica enterica serovar Typhi
ggagcccagua

SEQ ID NO: 1657682 - RNA, 12 nt, Salmonella enterica enterica serovar Typhi
ggacuggugcau

SEQ ID NO: 1657683 - RNA, 22 nt, Salmonella enterica enterica serovar Typhi
ggacucaucgguuaacacauau

SEQ ID NO: 1657684 - RNA, 16 nt, Salmonella enterica enterica serovar Typhi
ggacuaccugccggaa

SEQ ID NO: 1657685 - RNA, 11 nt, Salmonella enterica enterica serovar Typhi
ggagcgugcuu

SEQ ID NO: 1657686 - RNA, 18 nt, Salmonella enterica enterica serovar Typhi
ggagcugacugcaaaucu

SEQ ID NO: 1657687 - RNA, 15 nt, Salmonella enterica enterica serovar Typhi
ggaggaacagcgccg

SEQ ID NO: 1657688 - RNA, 14 nt, Salmonella enterica enterica serovar Typhi
ggagcggcguccgc

SEQ ID NO: 1657689 - RNA, 20 nt, Salmonella enterica enterica serovar Typhi
aaggccuuauccggccuacg

SEQ ID NO: 1657690 - RNA, 15 nt, Salmonella enterica enterica serovar Typhi
ggaggucauuauuca

SEQ ID NO: 1657691 - RNA, 15 nt, Salmonella enterica enterica serovar Typhi
ggauaaaaucgccaa

SEQ ID NO: 1657692 - RNA, 22 nt, Salmonella enterica enterica serovar Typhi
ggauaaauagugacgccgccau

SEQ ID NO: 1657693 - RNA, 15 nt, Salmonella enterica enterica serovar Typhi
ggauaacggcgcaaa

SEQ ID NO: 1657694 - RNA, 20 nt, Salmonella enterica enterica serovar Typhi
ggauaagauagcaggcgauu

SEQ ID NO: 1657695 - RNA, 21 nt, Salmonella enterica enterica serovar Typhi
ggauaaccuuuaacagauggc

SEQ ID NO: 1657696 - RNA, 19 nt, Salmonella enterica enterica serovar Typhi
ggauaagcggcagcgccau

SEQ ID NO: 1657697 - RNA, 18 nt, Salmonella enterica enterica serovar Typhi
ggauaagcguagcgccau

SEQ ID NO: 1657698 - RNA, 17 nt, Salmonella enterica enterica serovar Typhi
ggauaagcgugcgccau

SEQ ID NO: 1657699 - RNA, 15 nt, Salmonella enterica enterica serovar Typhi
ggauaaggcagcaau

SEQ ID NO: 1657700 - RNA, 23 nt, Salmonella enterica enterica serovar Typhi
ggauaaggcauuuaugccgccau

SEQ ID NO: 1657701 - RNA, 14 nt, Salmonella enterica enterica serovar Typhi
ggauaaggcgcagc

SEQ ID NO: 1657702 - RNA, 20 nt, Salmonella enterica enterica serovar Typhi
ggauaaggcgcuugcgccau

SEQ ID NO: 1657703 - RNA, 23 nt, Salmonella enterica enterica serovar Typhi
ggauaaggcgcuugcgccgccau

SEQ ID NO: 1657704 - RNA, 20 nt, Salmonella enterica enterica serovar Typhi
ggauaaggcggagccgccau

SEQ ID NO: 1657705 - RNA, 20 nt, Salmonella enterica enterica serovar Typhi
ggauaaggcguaaccgccau

SEQ ID NO: 1657706 - RNA, 15 nt, Salmonella enterica enterica serovar Typhi
ggauaaggcgugagc

SEQ ID NO: 1657707 - RNA, 17 nt, Salmonella enterica enterica serovar Typhi
ggauaaggcguuuacgc

SEQ ID NO: 1657708 - RNA, 20 nt, Salmonella enterica enterica serovar Typhi
ggauaucuugaugauucacc

SEQ ID NO: 1657709 - RNA, 20 nt, Salmonella enterica enterica serovar Typhi
ggauauucaucaguuuaacc

SEQ ID NO: 1657710 - RNA, 16 nt, Salmonella enterica enterica serovar Typhi
ggauaucaaugcgcgu

SEQ ID NO: 1657711 - RNA, 15 nt, Salmonella enterica enterica serovar Typhi
ggauaccuucgauga

SEQ ID NO: 1657712 - RNA, 23 nt, Salmonella enterica enterica serovar Typhi
ggauacguuccagcagcgcauca

SEQ ID NO: 1657713 - RNA, 23 nt, Salmonella enterica enterica serovar Typhi
ggauagcacuacccagaucgccc

SEQ ID NO: 1657714 - RNA, 18 nt, Salmonella enterica enterica serovar Typhi
ggauagcgacggggcgca

SEQ ID NO: 1657715 - RNA, 14 nt, Salmonella enterica enterica serovar Typhi
ggauaguacugacc

SEQ ID NO: 1657716 - RNA, 16 nt, Salmonella enterica enterica serovar Typhi
ggauacccagccacau

SEQ ID NO: 1657717 - RNA, 15 nt, Salmonella enterica enterica serovar Typhi
ggauaccgcgccagc

SEQ ID NO: 1657718 - RNA, 16 nt, Salmonella enterica enterica serovar Typhi
ggauacccccuaucug

SEQ ID NO: 1657719 - RNA, 17 nt, Salmonella enterica enterica serovar Typhi
ggauaagguguuuacgc

SEQ ID NO: 1657720 - RNA, 13 nt, Salmonella enterica enterica serovar Typhi
ggauacagcgccg

SEQ ID NO: 1657721 - RNA, 16 nt, Salmonella enterica enterica serovar Typhi
ggauacacaucaggaa

SEQ ID NO: 1657722 - RNA, 21 nt, Salmonella enterica enterica serovar Typhi
ggaucaggcguuagccgccau

SEQ ID NO: 1657723 - RNA, 19 nt, Salmonella enterica enterica serovar Typhi
ggaucaucuuuuaccgccu

SEQ ID NO: 1657724 - RNA, 17 nt, Salmonella enterica enterica serovar Typhi
ggaucagaaauucgcag

SEQ ID NO: 1657725 - RNA, 15 nt, Salmonella enterica enterica serovar Typhi
ggaucagacggcuga

SEQ ID NO: 1657726 - RNA, 17 nt, Salmonella enterica enterica serovar Typhi
ggaauguuuggcgccau

SEQ ID NO: 1657727 - RNA, 12 nt, Salmonella enterica enterica serovar Typhi
ggaaucgaugcu

SEQ ID NO: 1657728 - RNA, 21 nt, Salmonella enterica enterica serovar Typhi
ggaaguaugccucgcgcacca

SEQ ID NO: 1657729 - RNA, 13 nt, Salmonella enterica enterica serovar Typhi
ggaauaagcgccc

SEQ ID NO: 1657730 - RNA, 17 nt, Salmonella enterica enterica serovar Typhi
ggaagacuggcgcagca

SEQ ID NO: 1657731 - RNA, 21 nt, Salmonella enterica enterica serovar Typhi
ggaagacguuuacaccgccau

SEQ ID NO: 1657732 - RNA, 17 nt, Salmonella enterica enterica serovar Typhi
ggaagcgcgaaucgccu

SEQ ID NO: 1657733 - RNA, 23 nt, Salmonella enterica enterica serovar Typhi
gcuggcgcgucuguguuuauccg

SEQ ID NO: 1657734 - RNA, 21 nt, Salmonella enterica enterica serovar Typhi
ggaacaguuuaguugccguuu

SEQ ID NO: 1657735 - RNA, 12 nt, Salmonella enterica enterica serovar Typhi
ggaaccuggcag

SEQ ID NO: 1657736 - RNA, 16 nt, Salmonella enterica enterica serovar Typhi
ggaaccgcccaucaac

SEQ ID NO: 1657737 - RNA, 13 nt, Salmonella enterica enterica serovar Typhi
ggaacgucaucau

SEQ ID NO: 1657738 - RNA, 14 nt, Salmonella enterica enterica serovar Typhi
ggaacgugccguuu

SEQ ID NO: 1657739 - RNA, 15 nt, Salmonella enterica enterica serovar Typhi
ggaacguugcgccau

SEQ ID NO: 1657740 - RNA, 11 nt, Salmonella enterica enterica serovar Typhi
ggacagcgaca

SEQ ID NO: 1657741 - RNA, 18 nt, Salmonella enterica enterica serovar Typhi
ggacacccgcagccagaa

SEQ ID NO: 1657742 - RNA, 22 nt, Salmonella enterica enterica serovar Typhi
ggacaaggcgguacgccgccau

SEQ ID NO: 1657743 - RNA, 13 nt, Salmonella enterica enterica serovar Typhi
ggacaauccgcga

SEQ ID NO: 1657744 - RNA, 12 nt, Salmonella enterica enterica serovar Typhi
ggacaucgccau

SEQ ID NO: 1657745 - RNA, 20 nt, Salmonella enterica enterica serovar Typhi
ggacgagcgcgucagcgccu

SEQ ID NO: 1657746 - RNA, 18 nt, Salmonella enterica enterica serovar Typhi
ggacgcagaccaaaguca

SEQ ID NO: 1657747 - RNA, 14 nt, Salmonella enterica enterica serovar Typhi
gggcagcgagcacc

SEQ ID NO: 1657748 - RNA, 17 nt, Salmonella enterica enterica serovar Typhi
gggccagcagcgcauca

SEQ ID NO: 1657749 - RNA, 16 nt, Salmonella enterica enterica serovar Typhi
gggccgggccugagcg

SEQ ID NO: 1657750 - RNA, 15 nt, Salmonella enterica enterica serovar Typhi
gggaucuuuuucagc

SEQ ID NO: 1657751 - RNA, 19 nt, Salmonella enterica enterica serovar Typhi
gggaucuuccugcgcgcca

SEQ ID NO: 1657752 - RNA, 23 nt, Salmonella enterica enterica serovar Typhi
gggcaacaaacauaagcaaaucc

SEQ ID NO: 1657753 - RNA, 24 nt, Salmonella enterica enterica serovar Typhi
gggcaacccggcuaaaugacgcgc

SEQ ID NO: 1657754 - RNA, 17 nt, Salmonella enterica enterica serovar Typhi
gggauguugccacaggc

SEQ ID NO: 1657755 - RNA, 20 nt, Salmonella enterica enterica serovar Typhi
gggcaauccauuaauggcgc

SEQ ID NO: 1657756 - RNA, 22 nt, Salmonella enterica enterica serovar Typhi
gggcagcaucucgauuacagcg

SEQ ID NO: 1657757 - RNA, 19 nt, Salmonella enterica enterica serovar Typhi
gggagaaaacgcggccugg

SEQ ID NO: 1657758 - RNA, 13 nt, Salmonella enterica enterica serovar Typhi
gggagaccgggcu

SEQ ID NO: 1657759 - RNA, 15 nt, Salmonella enterica enterica serovar Typhi
gggaggugcuggugg

SEQ ID NO: 1657760 - RNA, 19 nt, Salmonella enterica enterica serovar Typhi
gggauaacgauucccgccg

SEQ ID NO: 1657761 - RNA, 19 nt, Salmonella enterica enterica serovar Typhi
gggauaaagaucuuuacgc

SEQ ID NO: 1657762 - RNA, 17 nt, Salmonella enterica enterica serovar Typhi
ggcguauucgcaucggu

SEQ ID NO: 1657763 - RNA, 15 nt, Salmonella enterica enterica serovar Typhi
ggcguauucggcaua

SEQ ID NO: 1657764 - RNA, 14 nt, Salmonella enterica enterica serovar Typhi
aaguaagcgccagc

SEQ ID NO: 1657765 - RNA, 13 nt, Salmonella enterica enterica serovar Typhi
aaguaaaagccgu

SEQ ID NO: 1657766 - RNA, 14 nt, Salmonella enterica enterica serovar Typhi
ggggaguccauuuc

SEQ ID NO: 1657767 - RNA, 17 nt, Salmonella enterica enterica serovar Typhi
gggcguuuguuguagcc

SEQ ID NO: 1657768 - RNA, 21 nt, Salmonella enterica enterica serovar Typhi
gggcgucaaaaucccggcugg

SEQ ID NO: 1657769 - RNA, 15 nt, Salmonella enterica enterica serovar Typhi
gggcugccaucaggc

SEQ ID NO: 1657770 - RNA, 13 nt, Salmonella enterica enterica serovar Typhi
gggcugcggcaaa

SEQ ID NO: 1657771 - RNA, 14 nt, Salmonella enterica enterica serovar Typhi
gggcuccugcgccg

SEQ ID NO: 1657772 - RNA, 14 nt, Salmonella enterica enterica serovar Typhi
gggcgaacuggcgg

SEQ ID NO: 1657773 - RNA, 22 nt, Salmonella enterica enterica serovar Typhi
gggcgaggucaucuuucagaug

SEQ ID NO: 1657774 - RNA, 22 nt, Salmonella enterica enterica serovar Typhi
gggcgcaaaaucgcaaacgcca

SEQ ID NO: 1657775 - RNA, 13 nt, Salmonella enterica enterica serovar Typhi
gggcgcggcgcaa

SEQ ID NO: 1657776 - RNA, 12 nt, Salmonella enterica enterica serovar Typhi
gggcgcggcugg

SEQ ID NO: 1657777 - RNA, 22 nt, Salmonella enterica enterica serovar Typhi
gggcggacaugcgcaucaauug

SEQ ID NO: 1657778 - RNA, 16 nt, Salmonella enterica enterica serovar Typhi
ggucaauacaucacgc

SEQ ID NO: 1657779 - RNA, 21 nt, Salmonella enterica enterica serovar Typhi
ggucacaucgcccugauggcg

SEQ ID NO: 1657780 - RNA, 12 nt, Salmonella enterica enterica serovar Typhi
gguauuaacagg

SEQ ID NO: 1657781 - RNA, 14 nt, Salmonella enterica enterica serovar Typhi
gguauuauccgccg

SEQ ID NO: 1657782 - RNA, 12 nt, Salmonella enterica enterica serovar Typhi
gguagcagaccg

SEQ ID NO: 1657783 - RNA, 14 nt, Salmonella enterica enterica serovar Typhi
gguagcagaccggu

SEQ ID NO: 1657784 - RNA, 12 nt, Salmonella enterica enterica serovar Typhi
gguagaggcgcc

SEQ ID NO: 1657785 - RNA, 12 nt, Salmonella enterica enterica serovar Typhi
gguauccagcgc

SEQ ID NO: 1657786 - RNA, 21 nt, Salmonella enterica enterica serovar Typhi
gguauaaauuuccgcagccag

SEQ ID NO: 1657787 - RNA, 19 nt, Salmonella enterica enterica serovar Typhi
ggguucguuaacccggcau

SEQ ID NO: 1657788 - RNA, 15 nt, Salmonella enterica enterica serovar Typhi
ggguugagcgaguca

SEQ ID NO: 1657789 - RNA, 18 nt, Salmonella enterica enterica serovar Typhi
ggguggugugcguaucgc

SEQ ID NO: 1657790 - RNA, 15 nt, Salmonella enterica enterica serovar Typhi
gguaaauccgccagu

SEQ ID NO: 1657791 - RNA, 12 nt, Salmonella enterica enterica serovar Typhi
gguaaccauuuc

SEQ ID NO: 1657792 - RNA, 21 nt, Salmonella enterica enterica serovar Typhi
gguaaacucacccaggcgaug

SEQ ID NO: 1657793 - RNA, 20 nt, Salmonella enterica enterica serovar Typhi
gguaaaggucguuaggccac

SEQ ID NO: 1657794 - RNA, 22 nt, Salmonella enterica enterica serovar Typhi
gguaagacguuuaugccgccau

SEQ ID NO: 1657795 - RNA, 22 nt, Salmonella enterica enterica serovar Typhi
gguaagcccauggcaggcagca

SEQ ID NO: 1657796 - RNA, 23 nt, Salmonella enterica enterica serovar Typhi
gguaagacguuuaugccgccauc

SEQ ID NO: 1657797 - RNA, 23 nt, Salmonella enterica enterica serovar Typhi
gguaagagagccuuacaggcgca

SEQ ID NO: 1657798 - RNA, 17 nt, Salmonella enterica enterica serovar Typhi
gguaagcgcagcgccau

SEQ ID NO: 1657799 - RNA, 14 nt, Salmonella enterica enterica serovar Typhi
gguaauaacgguaa

SEQ ID NO: 1657800 - RNA, 21 nt, Salmonella enterica enterica serovar Typhi
gguaauaauuagcauccagca

SEQ ID NO: 1657801 - RNA, 18 nt, Salmonella enterica enterica serovar Typhi
gguaaucacugccgccac

SEQ ID NO: 1657802 - RNA, 14 nt, Salmonella enterica enterica serovar Typhi
gguaccccagccau

SEQ ID NO: 1657803 - RNA, 16 nt, Salmonella enterica enterica serovar Typhi
gguaauuagaucggca

SEQ ID NO: 1657804 - RNA, 17 nt, Salmonella enterica enterica serovar Typhi
ggugaauaacuucacgc

SEQ ID NO: 1657805 - RNA, 21 nt, Salmonella enterica enterica serovar Typhi
ggugaauagcauugccgucaa

SEQ ID NO: 1657806 - RNA, 23 nt, Salmonella enterica enterica serovar Typhi
ggugagaucgguaauuuccacgc

SEQ ID NO: 1657807 - RNA, 19 nt, Salmonella enterica enterica serovar Typhi
ggugauuaacagcgccauc

SEQ ID NO: 1657808 - RNA, 17 nt, Salmonella enterica enterica serovar Typhi
ggugauuaacagcgcca

SEQ ID NO: 1657809 - RNA, 13 nt, Salmonella enterica enterica serovar Typhi
ggucuugauggcg

SEQ ID NO: 1657810 - RNA, 18 nt, Salmonella enterica enterica serovar Typhi
ggucugccaguagcggaa

SEQ ID NO: 1657811 - RNA, 17 nt, Salmonella enterica enterica serovar Typhi
ggucuccaucagacguu

SEQ ID NO: 1657812 - RNA, 20 nt, Salmonella enterica enterica serovar Typhi
ggugcgcagccccagcgcca

SEQ ID NO: 1657813 - RNA, 19 nt, Salmonella enterica enterica serovar Typhi
ggugcgguuacguccggca

SEQ ID NO: 1657814 - RNA, 22 nt, Salmonella enterica enterica serovar Typhi
ggugcuacgggcgcugucgccg

SEQ ID NO: 1657815 - RNA, 16 nt, Salmonella enterica enterica serovar Typhi
gucgccaggaucgccg

SEQ ID NO: 1657816 - RNA, 19 nt, Salmonella enterica enterica serovar Typhi
gucgccauaaagcuguacc

SEQ ID NO: 1657817 - RNA, 15 nt, Salmonella enterica enterica serovar Typhi
gucgccgcccaucgg

SEQ ID NO: 1657818 - RNA, 13 nt, Salmonella enterica enterica serovar Typhi
gucgccauccuga

SEQ ID NO: 1657819 - RNA, 20 nt, Salmonella enterica enterica serovar Typhi
gucgcccggaaauggguauc

SEQ ID NO: 1657820 - RNA, 14 nt, Salmonella enterica enterica serovar Typhi
gucgcgauccgcga

SEQ ID NO: 1657821 - RNA, 18 nt, Salmonella enterica enterica serovar Typhi
gucgcggauaugcagcag

SEQ ID NO: 1657822 - RNA, 22 nt, Salmonella enterica enterica serovar Typhi
gucgcuuuuugcgccagcgcca

SEQ ID NO: 1657823 - RNA, 16 nt, Salmonella enterica enterica serovar Typhi
gucggagccaauaauc

SEQ ID NO: 1657824 - RNA, 14 nt, Salmonella enterica enterica serovar Typhi
gucggacagcgaca

SEQ ID NO: 1657825 - RNA, 18 nt, Salmonella enterica enterica serovar Typhi
gucgcuucgcuuaucugg

SEQ ID NO: 1657826 - RNA, 22 nt, Salmonella enterica enterica serovar Typhi
gucggaaaucuguuccagcgag

SEQ ID NO: 1657827 - RNA, 23 nt, Salmonella enterica enterica serovar Typhi
gucgcucacauucauugccgcca

SEQ ID NO: 1657828 - RNA, 22 nt, Salmonella enterica enterica serovar Typhi
gucgcuaccacagaaaucgccg

SEQ ID NO: 1657829 - RNA, 17 nt, Salmonella enterica enterica serovar Typhi
gucgcugauugccgcca

SEQ ID NO: 1657830 - RNA, 18 nt, Salmonella enterica enterica serovar Typhi
gucggcgcaguucgccgc

SEQ ID NO: 1657831 - RNA, 14 nt, Salmonella enterica enterica serovar Typhi
guccggauucgcgg

SEQ ID NO: 1657832 - RNA, 13 nt, Salmonella enterica enterica serovar Typhi
guccgcccgccuc

SEQ ID NO: 1657833 - RNA, 19 nt, Salmonella enterica enterica serovar Typhi
guccgacgaaaaagccaaa

SEQ ID NO: 1657834 - RNA, 18 nt, Salmonella enterica enterica serovar Typhi
guccgcguugguuaaggc

SEQ ID NO: 1657835 - RNA, 19 nt, Salmonella enterica enterica serovar Typhi
gucccaguaauaucgccuc

SEQ ID NO: 1657836 - RNA, 13 nt, Salmonella enterica enterica serovar Typhi
gucccgccgguuc

SEQ ID NO: 1657837 - RNA, 19 nt, Salmonella enterica enterica serovar Typhi
gucaucgcccaucugauaa

SEQ ID NO: 1657838 - RNA, 20 nt, Salmonella enterica enterica serovar Typhi
gucaucaaaaucaucgccac

SEQ ID NO: 1657839 - RNA, 14 nt, Salmonella enterica enterica serovar Typhi
gucgacaugcgcau

SEQ ID NO: 1657840 - RNA, 18 nt, Salmonella enterica enterica serovar Typhi
gucgacugguaggccuga

SEQ ID NO: 1657841 - RNA, 14 nt, Salmonella enterica enterica serovar Typhi
guccugaucggcgg

SEQ ID NO: 1657842 - RNA, 20 nt, Salmonella enterica enterica serovar Typhi
guccugaucaaggcgcaaaa

SEQ ID NO: 1657843 - RNA, 18 nt, Salmonella enterica enterica serovar Typhi
guaguacaugccauccgg

SEQ ID NO: 1657844 - RNA, 18 nt, Salmonella enterica enterica serovar Typhi
guaguaaccccaguagcc

SEQ ID NO: 1657845 - RNA, 15 nt, Salmonella enterica enterica serovar Typhi
guaucacaaucagcc

SEQ ID NO: 1657846 - RNA, 16 nt, Salmonella enterica enterica serovar Typhi
guauaguggcgacaaa

SEQ ID NO: 1657847 - RNA, 18 nt, Salmonella enterica enterica serovar Typhi
aagucgaugaaugacgag

SEQ ID NO: 1657848 - RNA, 18 nt, Salmonella enterica enterica serovar Typhi
aagucgccacccggcuuu

SEQ ID NO: 1657849 - RNA, 14 nt, Salmonella enterica enterica serovar Typhi
guagcugcgccagc

SEQ ID NO: 1657850 - RNA, 15 nt, Salmonella enterica enterica serovar Typhi
guagcacaucgcugg

SEQ ID NO: 1657851 - RNA, 22 nt, Salmonella enterica enterica serovar Typhi
guagacccggcauugaaacgca

SEQ ID NO: 1657852 - RNA, 22 nt, Salmonella enterica enterica serovar Typhi
guacgggcagauggucgcaugg

SEQ ID NO: 1657853 - RNA, 20 nt, Salmonella enterica enterica serovar Typhi
guacgucggauggccgguua

SEQ ID NO: 1657854 - RNA, 20 nt, Salmonella enterica enterica serovar Typhi
guacugccaaagcgaugcgg

SEQ ID NO: 1657855 - RNA, 16 nt, Salmonella enterica enterica serovar Typhi
guacucuaggcgcugc

SEQ ID NO: 1657856 - RNA, 16 nt, Salmonella enterica enterica serovar Typhi
guacuugcgccgccau

SEQ ID NO: 1657857 - RNA, 14 nt, Salmonella enterica enterica serovar Typhi
guagcauaaucagg

SEQ ID NO: 1657858 - RNA, 14 nt, Salmonella enterica enterica serovar Typhi
guagcagcgccagc

SEQ ID NO: 1657859 - RNA, 14 nt, Salmonella enterica enterica serovar Typhi
guagcgacugauaa

SEQ ID NO: 1657860 - RNA, 21 nt, Salmonella enterica enterica serovar Typhi
guagcgccugugcuuucgcca

SEQ ID NO: 1657861 - RNA, 16 nt, Salmonella enterica enterica serovar Typhi
guagcgccaucaggca

SEQ ID NO: 1657862 - RNA, 20 nt, Salmonella enterica enterica serovar Typhi
guagcucaagcccgcgucgu

SEQ ID NO: 1657863 - RNA, 21 nt, Salmonella enterica enterica serovar Typhi
guagcggaaccagccaugcca

SEQ ID NO: 1657864 - RNA, 23 nt, Salmonella enterica enterica serovar Typhi
guacggcuuucuuucuccagcgu

SEQ ID NO: 1657865 - RNA, 15 nt, Salmonella enterica enterica serovar Typhi
guacggcgucagcca

SEQ ID NO: 1657866 - RNA, 17 nt, Salmonella enterica enterica serovar Typhi
guaccgucucggccugg

SEQ ID NO: 1657867 - RNA, 17 nt, Salmonella enterica enterica serovar Typhi
guacccucuacauuuuc

SEQ ID NO: 1657868 - RNA, 12 nt, Salmonella enterica enterica serovar Typhi
guacccaacgca

SEQ ID NO: 1657869 - RNA, 14 nt, Salmonella enterica enterica serovar Typhi
guacagggcgauuu

SEQ ID NO: 1657870 - RNA, 23 nt, Salmonella enterica enterica serovar Typhi
guacagcuuaaucaccagcgcau

SEQ ID NO: 1657871 - RNA, 18 nt, Salmonella enterica enterica serovar Typhi
guacaucuacuucagcac

SEQ ID NO: 1657872 - RNA, 23 nt, Salmonella enterica enterica serovar Typhi
gguuugucgcuuuucacggucaa

SEQ ID NO: 1657873 - RNA, 21 nt, Salmonella enterica enterica serovar Typhi
guaaagccgccauccggcauu

SEQ ID NO: 1657874 - RNA, 14 nt, Salmonella enterica enterica serovar Typhi
guaaauccgcgaug

SEQ ID NO: 1657875 - RNA, 19 nt, Salmonella enterica enterica serovar Typhi
guaaaucgcgcccgacaug

SEQ ID NO: 1657876 - RNA, 20 nt, Salmonella enterica enterica serovar Typhi
guaaaacuggcuaucgccgu

SEQ ID NO: 1657877 - RNA, 17 nt, Salmonella enterica enterica serovar Typhi
guaaguuaaaacgccau

SEQ ID NO: 1657878 - RNA, 22 nt, Salmonella enterica enterica serovar Typhi
guaagggcuggaaaaucacgcu

SEQ ID NO: 1657879 - RNA, 15 nt, Salmonella enterica enterica serovar Typhi
guaagcgccagccgu

SEQ ID NO: 1657880 - RNA, 19 nt, Salmonella enterica enterica serovar Typhi
guaagcguagcgccguccg

SEQ ID NO: 1657881 - RNA, 15 nt, Salmonella enterica enterica serovar Typhi
guaagcuauuacaaa

SEQ ID NO: 1657882 - RNA, 16 nt, Salmonella enterica enterica serovar Typhi
guaagcuauuccugua

SEQ ID NO: 1657883 - RNA, 18 nt, Salmonella enterica enterica serovar Typhi
guaagcgcagcgccaccg

SEQ ID NO: 1657884 - RNA, 19 nt, Salmonella enterica enterica serovar Typhi
guaaaugccuuauccggcc

SEQ ID NO: 1657885 - RNA, 19 nt, Salmonella enterica enterica serovar Typhi
guaaaucugccgucaucga

SEQ ID NO: 1657886 - RNA, 19 nt, Salmonella enterica enterica serovar Typhi
guaaauuccgcaggcaaca

SEQ ID NO: 1657887 - RNA, 22 nt, Salmonella enterica enterica serovar Typhi
guaaauucucuauacugcugac

SEQ ID NO: 1657888 - RNA, 15 nt, Salmonella enterica enterica serovar Typhi
guaacucaucgccag

SEQ ID NO: 1657889 - RNA, 20 nt, Salmonella enterica enterica serovar Typhi
guaacuauuucuaucaggua

SEQ ID NO: 1657890 - RNA, 17 nt, Salmonella enterica enterica serovar Typhi
guaagaaugcgcgucag

SEQ ID NO: 1657891 - RNA, 17 nt, Salmonella enterica enterica serovar Typhi
guaacuucacgccaucg

SEQ ID NO: 1657892 - RNA, 13 nt, Salmonella enterica enterica serovar Typhi
guaagagguaucc

SEQ ID NO: 1657893 - RNA, 16 nt, Salmonella enterica enterica serovar Typhi
guaagagagccuuaca

SEQ ID NO: 1657894 - RNA, 17 nt, Salmonella enterica enterica serovar Typhi
gucagaggaauucucca

SEQ ID NO: 1657895 - RNA, 15 nt, Salmonella enterica enterica serovar Typhi
gucagacggacauca

SEQ ID NO: 1657896 - RNA, 16 nt, Salmonella enterica enterica serovar Typhi
gucagcucacgcgcca

SEQ ID NO: 1657897 - RNA, 19 nt, Salmonella enterica enterica serovar Typhi
gucagccacgguucacggc

SEQ ID NO: 1657898 - RNA, 16 nt, Salmonella enterica enterica serovar Typhi
guauucgugcaucagg

SEQ ID NO: 1657899 - RNA, 20 nt, Salmonella enterica enterica serovar Typhi
guauucucaaccagccgauc

SEQ ID NO: 1657900 - RNA, 19 nt, Salmonella enterica enterica serovar Typhi
guauuaccgcucguuaauc

SEQ ID NO: 1657901 - RNA, 12 nt, Salmonella enterica enterica serovar Typhi
gucaaagcgcca

SEQ ID NO: 1657902 - RNA, 18 nt, Salmonella enterica enterica serovar Typhi
guauuucgcagcggucag

SEQ ID NO: 1657903 - RNA, 16 nt, Salmonella enterica enterica serovar Typhi
guaucauguuccggca

SEQ ID NO: 1657904 - RNA, 18 nt, Salmonella enterica enterica serovar Typhi
guaucaucagauccugcg

SEQ ID NO: 1657905 - RNA, 21 nt, Salmonella enterica enterica serovar Typhi
guaucgcugucggucagauuc

SEQ ID NO: 1657906 - RNA, 16 nt, Salmonella enterica enterica serovar Typhi
guaugcaccguuauuc

SEQ ID NO: 1657907 - RNA, 11 nt, Salmonella enterica enterica serovar Typhi
guaucuuccag

SEQ ID NO: 1657908 - RNA, 19 nt, Salmonella enterica enterica serovar Typhi
guaugacacccguguguua

SEQ ID NO: 1657909 - RNA, 22 nt, Salmonella enterica enterica serovar Typhi
gucacaauaugguuauccagca

SEQ ID NO: 1657910 - RNA, 20 nt, Salmonella enterica enterica serovar Typhi
gucaauggcgcugucggcgc

SEQ ID NO: 1657911 - RNA, 18 nt, Salmonella enterica enterica serovar Typhi
gucaacgguaaaauggcu

SEQ ID NO: 1657912 - RNA, 16 nt, Salmonella enterica enterica serovar Typhi
gucaacucgcacagua

SEQ ID NO: 1657913 - RNA, 13 nt, Salmonella enterica enterica serovar Typhi
gucaacgccaagc

SEQ ID NO: 1657914 - RNA, 18 nt, Salmonella enterica enterica serovar Typhi
gucaccgaauagcgacaa

SEQ ID NO: 1657915 - RNA, 17 nt, Salmonella enterica enterica serovar Typhi
gcguucgcccugcgcca

SEQ ID NO: 1657916 - RNA, 17 nt, Salmonella enterica enterica serovar Typhi
gcguucgcguagcgccc

SEQ ID NO: 1657917 - RNA, 23 nt, Salmonella enterica enterica serovar Typhi
gcguucggaagacugcuccggca

SEQ ID NO: 1657918 - RNA, 13 nt, Salmonella enterica enterica serovar Typhi
gcguuccuuauca

SEQ ID NO: 1657919 - RNA, 17 nt, Salmonella enterica enterica serovar Typhi
gcguuccuuaucagcaa

SEQ ID NO: 1657920 - RNA, 15 nt, Salmonella enterica enterica serovar Typhi
gcguuccuuaucagc

SEQ ID NO: 1657921 - RNA, 19 nt, Salmonella enterica enterica serovar Typhi
gcguuccccaacagcgacc

SEQ ID NO: 1657922 - RNA, 22 nt, Salmonella enterica enterica serovar Typhi
gcgugugucccggacaauguaa

SEQ ID NO: 1657923 - RNA, 14 nt, Salmonella enterica enterica serovar Typhi
gcguugaccgcuuc

SEQ ID NO: 1657924 - RNA, 13 nt, Salmonella enterica enterica serovar Typhi
gcguugauggcgu

SEQ ID NO: 1657925 - RNA, 14 nt, Salmonella enterica enterica serovar Typhi
gcguuuuagcgcca

SEQ ID NO: 1657926 - RNA, 13 nt, Salmonella enterica enterica serovar Typhi
gcguuuuauccgu

SEQ ID NO: 1657927 - RNA, 23 nt, Salmonella enterica enterica serovar Typhi
gcguuuugacuuugaccagcauc

SEQ ID NO: 1657928 - RNA, 20 nt, Salmonella enterica enterica serovar Typhi
gcguuuucauaucugcgccg

SEQ ID NO: 1657929 - RNA, 21 nt, Salmonella enterica enterica serovar Typhi
gcguuuucauuagccgccagc

SEQ ID NO: 1657930 - RNA, 18 nt, Salmonella enterica enterica serovar Typhi
gcguuuuccaucaucagg

SEQ ID NO: 1657931 - RNA, 18 nt, Salmonella enterica enterica serovar Typhi
gcuaaaaacagcgcaaua

SEQ ID NO: 1657932 - RNA, 18 nt, Salmonella enterica enterica serovar Typhi
gcuaaagacgugccggaa

SEQ ID NO: 1657933 - RNA, 22 nt, Salmonella enterica enterica serovar Typhi
gcuaaaccacaugaccagcgcc

SEQ ID NO: 1657934 - RNA, 14 nt, Salmonella enterica enterica serovar Typhi
gcuaaacagcaaau

SEQ ID NO: 1657935 - RNA, 21 nt, Salmonella enterica enterica serovar Typhi
gcuaacgaugucaucgccauc

SEQ ID NO: 1657936 - RNA, 14 nt, Salmonella enterica enterica serovar Typhi
gcuaacgccuugaa

SEQ ID NO: 1657937 - RNA, 18 nt, Salmonella enterica enterica serovar Typhi
gcuaacggcaccagcaac

SEQ ID NO: 1657938 - RNA, 17 nt, Salmonella enterica enterica serovar Typhi
gcuaacgcuuauccggc

SEQ ID NO: 1657939 - RNA, 21 nt, Salmonella enterica enterica serovar Typhi
gcuaacgcuuauccggccuac

SEQ ID NO: 1657940 - RNA, 21 nt, Salmonella enterica enterica serovar Typhi
gcuaauauccaccagcccauc

SEQ ID NO: 1657941 - RNA, 20 nt, Salmonella enterica enterica serovar Typhi
gcuaagcagaacggcgauac

SEQ ID NO: 1657942 - RNA, 20 nt, Salmonella enterica enterica serovar Typhi
gcguuggcgucagaccggca

SEQ ID NO: 1657943 - RNA, 18 nt, Salmonella enterica enterica serovar Typhi
gcguuguaaucgccugaa

SEQ ID NO: 1657944 - RNA, 13 nt, Salmonella enterica enterica serovar Typhi
gcguuguaccguu

SEQ ID NO: 1657945 - RNA, 15 nt, Salmonella enterica enterica serovar Typhi
gcguuguggacgaac

SEQ ID NO: 1657946 - RNA, 15 nt, Salmonella enterica enterica serovar Typhi
gcguugucgcugauu

SEQ ID NO: 1657947 - RNA, 22 nt, Salmonella enterica enterica serovar Typhi
gcguuucguaauggccuacaca

SEQ ID NO: 1657948 - RNA, 21 nt, Salmonella enterica enterica serovar Typhi
gcguuucucuugugcuuccag

SEQ ID NO: 1657949 - RNA, 18 nt, Salmonella enterica enterica serovar Typhi
gcguuucguuuagcgccu

SEQ ID NO: 1657950 - RNA, 14 nt, Salmonella enterica enterica serovar Typhi
gcguuuauuaggcc

SEQ ID NO: 1657951 - RNA, 20 nt, Salmonella enterica enterica serovar Typhi
gcguuuauuaggccuacaag

SEQ ID NO: 1657952 - RNA, 21 nt, Salmonella enterica enterica serovar Typhi
gcguuucaagcaguuccagca

SEQ ID NO: 1657953 - RNA, 20 nt, Salmonella enterica enterica serovar Typhi
gcuacgcuuaucaggccuac

SEQ ID NO: 1657954 - RNA, 16 nt, Salmonella enterica enterica serovar Typhi
gcuacgccuuauccgg

SEQ ID NO: 1657955 - RNA, 17 nt, Salmonella enterica enterica serovar Typhi
gcuacgccuuauccggc

SEQ ID NO: 1657956 - RNA, 21 nt, Salmonella enterica enterica serovar Typhi
gcuacgccuuauccggccuac

SEQ ID NO: 1657957 - RNA, 19 nt, Salmonella enterica enterica serovar Typhi
gcuacgcuuaucaggccua

SEQ ID NO: 1657958 - RNA, 19 nt, Salmonella enterica enterica serovar Typhi
gcuagcuuaucgggccuac

SEQ ID NO: 1657959 - RNA, 23 nt, Salmonella enterica enterica serovar Typhi
gcuacacguucacgaucaccugg

SEQ ID NO: 1657960 - RNA, 19 nt, Salmonella enterica enterica serovar Typhi
gcuacacgcgaauagccag

SEQ ID NO: 1657961 - RNA, 15 nt, Salmonella enterica enterica serovar Typhi
gcuacauccgccagc

SEQ ID NO: 1657962 - RNA, 18 nt, Salmonella enterica enterica serovar Typhi
gcuaaucccgcucgccag

SEQ ID NO: 1657963 - RNA, 14 nt, Salmonella enterica enterica serovar Typhi
gcuacccagacaag

SEQ ID NO: 1657964 - RNA, 16 nt, Salmonella enterica enterica serovar Typhi
gcuacgccuuacccga

SEQ ID NO: 1657965 - RNA, 16 nt, Salmonella enterica enterica serovar Typhi
gcuacccgcugacgcu

SEQ ID NO: 1657966 - RNA, 22 nt, Salmonella enterica enterica serovar Typhi
gcuaucggcgggguuuaacgag

SEQ ID NO: 1657967 - RNA, 19 nt, Salmonella enterica enterica serovar Typhi
gcuaucguugcgcgcaauc

SEQ ID NO: 1657968 - RNA, 18 nt, Salmonella enterica enterica serovar Typhi
gcuaucugcuccgccagc

SEQ ID NO: 1657969 - RNA, 16 nt, Salmonella enterica enterica serovar Typhi
gcuauauuccagccag

SEQ ID NO: 1657970 - RNA, 21 nt, Salmonella enterica enterica serovar Typhi
gcuauuagccaaagcgguaau

SEQ ID NO: 1657971 - RNA, 20 nt, Salmonella enterica enterica serovar Typhi
gcuaugcggcguuaauggcc

SEQ ID NO: 1657972 - RNA, 21 nt, Salmonella enterica enterica serovar Typhi
gcuauggccguuuacgagcca

SEQ ID NO: 1657973 - RNA, 21 nt, Salmonella enterica enterica serovar Typhi
gcuaugcuuaccaucuggccu

SEQ ID NO: 1657974 - RNA, 20 nt, Salmonella enterica enterica serovar Typhi
gcucaauguagcgucagccg

SEQ ID NO: 1657975 - RNA, 19 nt, Salmonella enterica enterica serovar Typhi
gcucaagccagguugcgcc

SEQ ID NO: 1657976 - RNA, 23 nt, Salmonella enterica enterica serovar Typhi
gcucaccagcugacgcagcaguu

SEQ ID NO: 1657977 - RNA, 23 nt, Salmonella enterica enterica serovar Typhi
gcucaccgagacugcccggcaua

SEQ ID NO: 1657978 - RNA, 18 nt, Salmonella enterica enterica serovar Typhi
gcguaggguagaucacgc

SEQ ID NO: 1657979 - RNA, 19 nt, Salmonella enterica enterica serovar Typhi
gcguaucucauugaugguc

SEQ ID NO: 1657980 - RNA, 18 nt, Salmonella enterica enterica serovar Typhi
gcguauucucaaccagcc

SEQ ID NO: 1657981 - RNA, 22 nt, Salmonella enterica enterica serovar Typhi
gcguauucucaaccagccgauc

SEQ ID NO: 1657982 - RNA, 14 nt, Salmonella enterica enterica serovar Typhi
gcguagcgcguuca

SEQ ID NO: 1657983 - RNA, 13 nt, Salmonella enterica enterica serovar Typhi
gcgucauccggca

SEQ ID NO: 1657984 - RNA, 20 nt, Salmonella enterica enterica serovar Typhi
gcgucaucgcuccagacggc

SEQ ID NO: 1657985 - RNA, 20 nt, Salmonella enterica enterica serovar Typhi
gcgucauggcuaaucgccac

SEQ ID NO: 1657986 - RNA, 19 nt, Salmonella enterica enterica serovar Typhi
gcgucaugucguuagaacc

SEQ ID NO: 1657987 - RNA, 17 nt, Salmonella enterica enterica serovar Typhi
gcgucaaaguugcauca

SEQ ID NO: 1657988 - RNA, 15 nt, Salmonella enterica enterica serovar Typhi
gcgucaaaucgccga

SEQ ID NO: 1657989 - RNA, 14 nt, Salmonella enterica enterica serovar Typhi
gcguccgccaucgc

SEQ ID NO: 1657990 - RNA, 15 nt, Salmonella enterica enterica serovar Typhi
gcguccgccaucgcc

SEQ ID NO: 1657991 - RNA, 20 nt, Salmonella enterica enterica serovar Typhi
gcguggucauuaggcguaau

SEQ ID NO: 1657992 - RNA, 19 nt, Salmonella enterica enterica serovar Typhi
gcgugguggauauccagca

SEQ ID NO: 1657993 - RNA, 21 nt, Salmonella enterica enterica serovar Typhi
gcguguagccaaucagcccca

SEQ ID NO: 1657994 - RNA, 19 nt, Salmonella enterica enterica serovar Typhi
gcguguaacugcaaacgcg

SEQ ID NO: 1657995 - RNA, 15 nt, Salmonella enterica enterica serovar Typhi
gcguguaaucgccgu

SEQ ID NO: 1657996 - RNA, 19 nt, Salmonella enterica enterica serovar Typhi
aaggaauuaugcagacgcu

SEQ ID NO: 1657997 - RNA, 13 nt, Salmonella enterica enterica serovar Typhi
aaggaagauagcg

SEQ ID NO: 1657998 - RNA, 22 nt, Salmonella enterica enterica serovar Typhi
aagcuuuuaguuacgcacgcca

SEQ ID NO: 1657999 - RNA, 22 nt, Salmonella enterica enterica serovar Typhi
gcgugcgacggcccgucagggc

SEQ ID NO: 1658000 - RNA, 13 nt, Salmonella enterica enterica serovar Typhi
gcgucggcgacuu

SEQ ID NO: 1658001 - RNA, 16 nt, Salmonella enterica enterica serovar Typhi
gcgucguuccgucagu

SEQ ID NO: 1658002 - RNA, 21 nt, Salmonella enterica enterica serovar Typhi
aagcugugcguugucuaccgc

SEQ ID NO: 1658003 - RNA, 14 nt, Salmonella enterica enterica serovar Typhi
gcgucugcggcuga

SEQ ID NO: 1658004 - RNA, 23 nt, Salmonella enterica enterica serovar Typhi
gcgucugaguuaaugccaucauc

SEQ ID NO: 1658005 - RNA, 12 nt, Salmonella enterica enterica serovar Typhi
gcugcuucacgg

SEQ ID NO: 1658006 - RNA, 15 nt, Salmonella enterica enterica serovar Typhi
gcuggacaugauaau

SEQ ID NO: 1658007 - RNA, 17 nt, Salmonella enterica enterica serovar Typhi
gcuggacgucaugccgc

SEQ ID NO: 1658008 - RNA, 22 nt, Salmonella enterica enterica serovar Typhi
gcuggauucucucccaggcauc

SEQ ID NO: 1658009 - RNA, 20 nt, Salmonella enterica enterica serovar Typhi
gcuggauaauugcucugcca

SEQ ID NO: 1658010 - RNA, 17 nt, Salmonella enterica enterica serovar Typhi
gcuggcgauauccgugc

SEQ ID NO: 1658011 - RNA, 20 nt, Salmonella enterica enterica serovar Typhi
gcugacgcccaucagcaucc

SEQ ID NO: 1658012 - RNA, 16 nt, Salmonella enterica enterica serovar Typhi
gcugacgcgccuggau

SEQ ID NO: 1658013 - RNA, 16 nt, Salmonella enterica enterica serovar Typhi
gcugcauaaugcgcga

SEQ ID NO: 1658014 - RNA, 14 nt, Salmonella enterica enterica serovar Typhi
gcugccgucaaagu

SEQ ID NO: 1658015 - RNA, 13 nt, Salmonella enterica enterica serovar Typhi
gcugccuuauccg

SEQ ID NO: 1658016 - RNA, 17 nt, Salmonella enterica enterica serovar Typhi
gcugccuuauccggccu

SEQ ID NO: 1658017 - RNA, 15 nt, Salmonella enterica enterica serovar Typhi
gcugcgcauccgcgg

SEQ ID NO: 1658018 - RNA, 19 nt, Salmonella enterica enterica serovar Typhi
gcugcgcauccgcggcgcu

SEQ ID NO: 1658019 - RNA, 20 nt, Salmonella enterica enterica serovar Typhi
gcugcgcuuaccgggccuac

SEQ ID NO: 1658020 - RNA, 19 nt, Salmonella enterica enterica serovar Typhi
gcugcgcuuaucaggccua

SEQ ID NO: 1658021 - RNA, 20 nt, Salmonella enterica enterica serovar Typhi
gcugcgcuuaucaggccuac

SEQ ID NO: 1658022 - RNA, 18 nt, Salmonella enterica enterica serovar Typhi
gcucuuccgccagcgcca

SEQ ID NO: 1658023 - RNA, 18 nt, Salmonella enterica enterica serovar Typhi
gcucugguugcagcgcca

SEQ ID NO: 1658024 - RNA, 18 nt, Salmonella enterica enterica serovar Typhi
gcugaccucaauccgugc

SEQ ID NO: 1658025 - RNA, 18 nt, Salmonella enterica enterica serovar Typhi
gcugaccugaacgccuac

SEQ ID NO: 1658026 - RNA, 17 nt, Salmonella enterica enterica serovar Typhi
gcugaagccccaacaga

SEQ ID NO: 1658027 - RNA, 18 nt, Salmonella enterica enterica serovar Typhi
gcucggucacuucaaccu

SEQ ID NO: 1658028 - RNA, 17 nt, Salmonella enterica enterica serovar Typhi
gcucguauuagauaagc

SEQ ID NO: 1658029 - RNA, 23 nt, Salmonella enterica enterica serovar Typhi
gcucgucaaacaguucagacacc

SEQ ID NO: 1658030 - RNA, 21 nt, Salmonella enterica enterica serovar Typhi
gcucgcucaucaguuugcgau

SEQ ID NO: 1658031 - RNA, 20 nt, Salmonella enterica enterica serovar Typhi
gcucgcugccgaucagauug

SEQ ID NO: 1658032 - RNA, 19 nt, Salmonella enterica enterica serovar Typhi
gcuccgccagggcggcaaa

SEQ ID NO: 1658033 - RNA, 17 nt, Salmonella enterica enterica serovar Typhi
gcuccgguuuuugcgcg

SEQ ID NO: 1658034 - RNA, 17 nt, Salmonella enterica enterica serovar Typhi
gcuccggguugccugau

SEQ ID NO: 1658035 - RNA, 13 nt, Salmonella enterica enterica serovar Typhi
gcucagaccgauc

SEQ ID NO: 1658036 - RNA, 20 nt, Salmonella enterica enterica serovar Typhi
gcucacggcacgcccuucgu

SEQ ID NO: 1658037 - RNA, 20 nt, Salmonella enterica enterica serovar Typhi
gcucacgcuuauccggccua

SEQ ID NO: 1658038 - RNA, 14 nt, Salmonella enterica enterica serovar Typhi
gcgcuuuuccagca

SEQ ID NO: 1658039 - RNA, 14 nt, Salmonella enterica enterica serovar Typhi
gcgcuuuuucacga

SEQ ID NO: 1658040 - RNA, 23 nt, Salmonella enterica enterica serovar Typhi
gcgcuuuuaauugcgcaucaagc

SEQ ID NO: 1658041 - RNA, 20 nt, Salmonella enterica enterica serovar Typhi
gcgcuuugcuuauccggccu

SEQ ID NO: 1658042 - RNA, 18 nt, Salmonella enterica enterica serovar Typhi
gcgcuuucaccgccucau

SEQ ID NO: 1658043 - RNA, 22 nt, Salmonella enterica enterica serovar Typhi
gcggaaagcauucgcagcagac

SEQ ID NO: 1658044 - RNA, 19 nt, Salmonella enterica enterica serovar Typhi
gcggaaaauauucagcaca

SEQ ID NO: 1658045 - RNA, 17 nt, Salmonella enterica enterica serovar Typhi
gcggaaaaucugcgcca

SEQ ID NO: 1658046 - RNA, 18 nt, Salmonella enterica enterica serovar Typhi
gcggaaaaaagcagcauc

SEQ ID NO: 1658047 - RNA, 22 nt, Salmonella enterica enterica serovar Typhi
gcgcuuuuugcuucgccaucuc

SEQ ID NO: 1658048 - RNA, 21 nt, Salmonella enterica enterica serovar Typhi
gcgcuuuacugucgcuggaua

SEQ ID NO: 1658049 - RNA, 16 nt, Salmonella enterica enterica serovar Typhi
gcggaaauguagcccc

SEQ ID NO: 1658050 - RNA, 19 nt, Salmonella enterica enterica serovar Typhi
gcggaaauuagcccgcuuc

SEQ ID NO: 1658051 - RNA, 23 nt, Salmonella enterica enterica serovar Typhi
gcggaaauuagcccgcuucacgc

SEQ ID NO: 1658052 - RNA, 21 nt, Salmonella enterica enterica serovar Typhi
gcggaaguagccuccggcggu

SEQ ID NO: 1658053 - RNA, 22 nt, Salmonella enterica enterica serovar Typhi
gcggaaguagagaaccaacguc

SEQ ID NO: 1658054 - RNA, 23 nt, Salmonella enterica enterica serovar Typhi
gcggaagggauucccauccgugc

SEQ ID NO: 1658055 - RNA, 14 nt, Salmonella enterica enterica serovar Typhi
gcggaauagacggc

SEQ ID NO: 1658056 - RNA, 16 nt, Salmonella enterica enterica serovar Typhi
gcggaaucgcuuccug

SEQ ID NO: 1658057 - RNA, 21 nt, Salmonella enterica enterica serovar Typhi
gcggaauucccacaucgcgau

SEQ ID NO: 1658058 - RNA, 17 nt, Salmonella enterica enterica serovar Typhi
gcggaaucuccggcgaa

SEQ ID NO: 1658059 - RNA, 12 nt, Salmonella enterica enterica serovar Typhi
gcgcuggcguga

SEQ ID NO: 1658060 - RNA, 14 nt, Salmonella enterica enterica serovar Typhi
gcgcuggcggcgac

SEQ ID NO: 1658061 - RNA, 14 nt, Salmonella enterica enterica serovar Typhi
gcgcuggcgcgucu

SEQ ID NO: 1658062 - RNA, 15 nt, Salmonella enterica enterica serovar Typhi
gcgcuggcgcgucug

SEQ ID NO: 1658063 - RNA, 14 nt, Salmonella enterica enterica serovar Typhi
gcgcuguaacuuca

SEQ ID NO: 1658064 - RNA, 17 nt, Salmonella enterica enterica serovar Typhi
gcgcuguaacuucacgc

SEQ ID NO: 1658065 - RNA, 15 nt, Salmonella enterica enterica serovar Typhi
gcgcuguacggacau

SEQ ID NO: 1658066 - RNA, 20 nt, Salmonella enterica enterica serovar Typhi
gcgcuucgcuugcccggccu

SEQ ID NO: 1658067 - RNA, 21 nt, Salmonella enterica enterica serovar Typhi
gcgcuucguugagcuuaucgg

SEQ ID NO: 1658068 - RNA, 17 nt, Salmonella enterica enterica serovar Typhi
gcgcuuccagacuacgg

SEQ ID NO: 1658069 - RNA, 20 nt, Salmonella enterica enterica serovar Typhi
gcgcuuaccgggccuacacg

SEQ ID NO: 1658070 - RNA, 15 nt, Salmonella enterica enterica serovar Typhi
gcgcuuauccggccu

SEQ ID NO: 1658071 - RNA, 18 nt, Salmonella enterica enterica serovar Typhi
gcgcugugcuaucaggcc

SEQ ID NO: 1658072 - RNA, 22 nt, Salmonella enterica enterica serovar Typhi
gcgcuuaccgggccgacaggcg

SEQ ID NO: 1658073 - RNA, 20 nt, Salmonella enterica enterica serovar Typhi
gcgcuuaccgggccuacagg

SEQ ID NO: 1658074 - RNA, 15 nt, Salmonella enterica enterica serovar Typhi
gcgcuguguccgccu

SEQ ID NO: 1658075 - RNA, 18 nt, Salmonella enterica enterica serovar Typhi
gcgcuguucuugcugcug

SEQ ID NO: 1658076 - RNA, 23 nt, Salmonella enterica enterica serovar Typhi
gcgcuggcgcacgcgucaucggc

SEQ ID NO: 1658077 - RNA, 17 nt, Salmonella enterica enterica serovar Typhi
gcgcugcggucagggcu

SEQ ID NO: 1658078 - RNA, 11 nt, Salmonella enterica enterica serovar Typhi
gcgcugcgccg

SEQ ID NO: 1658079 - RNA, 18 nt, Salmonella enterica enterica serovar Typhi
gcgcugcgcgcgaugcug

SEQ ID NO: 1658080 - RNA, 18 nt, Salmonella enterica enterica serovar Typhi
gcgcugccagcugcguca

SEQ ID NO: 1658081 - RNA, 12 nt, Salmonella enterica enterica serovar Typhi
gcgcugaccuca

SEQ ID NO: 1658082 - RNA, 15 nt, Salmonella enterica enterica serovar Typhi
gcgcucgcucaucac

SEQ ID NO: 1658083 - RNA, 22 nt, Salmonella enterica enterica serovar Typhi
gcgcgcaucgggccguccggca

SEQ ID NO: 1658084 - RNA, 15 nt, Salmonella enterica enterica serovar Typhi
gcgcgcacguucagg

SEQ ID NO: 1658085 - RNA, 22 nt, Salmonella enterica enterica serovar Typhi
aagccgggucagcccccaguuu

SEQ ID NO: 1658086 - RNA, 23 nt, Salmonella enterica enterica serovar Typhi
aagccggauagcguagcgccauc

SEQ ID NO: 1658087 - RNA, 19 nt, Salmonella enterica enterica serovar Typhi
aagccgcguucugucgaua

SEQ ID NO: 1658088 - RNA, 23 nt, Salmonella enterica enterica serovar Typhi
gcggcaauggccgcagcgccaua

SEQ ID NO: 1658089 - RNA, 15 nt, Salmonella enterica enterica serovar Typhi
aagccgucggcgcca

SEQ ID NO: 1658090 - RNA, 18 nt, Salmonella enterica enterica serovar Typhi
aagccugagcgcgaggca

SEQ ID NO: 1658091 - RNA, 18 nt, Salmonella enterica enterica serovar Typhi
gcggcaagaucauccggg

SEQ ID NO: 1658092 - RNA, 22 nt, Salmonella enterica enterica serovar Typhi
gcggcaaaaaauauagccauuu

SEQ ID NO: 1658093 - RNA, 19 nt, Salmonella enterica enterica serovar Typhi
gcggauuaucguccggcau

SEQ ID NO: 1658094 - RNA, 19 nt, Salmonella enterica enterica serovar Typhi
gcggauugccauacacgcg

SEQ ID NO: 1658095 - RNA, 18 nt, Salmonella enterica enterica serovar Typhi
gcggauugccauacacgc

SEQ ID NO: 1658096 - RNA, 17 nt, Salmonella enterica enterica serovar Typhi
gcggauaugcagcagcc

SEQ ID NO: 1658097 - RNA, 20 nt, Salmonella enterica enterica serovar Typhi
gcggauacagcggcgcgcca

SEQ ID NO: 1658098 - RNA, 21 nt, Salmonella enterica enterica serovar Typhi
gcggauaagauagcaggcgau

SEQ ID NO: 1658099 - RNA, 16 nt, Salmonella enterica enterica serovar Typhi
gcggauaguccugcgc

SEQ ID NO: 1658100 - RNA, 19 nt, Salmonella enterica enterica serovar Typhi
gcggauaagauagcaggcg

SEQ ID NO: 1658101 - RNA, 20 nt, Salmonella enterica enterica serovar Typhi
gcggauaagcgcagcgccau

SEQ ID NO: 1658102 - RNA, 18 nt, Salmonella enterica enterica serovar Typhi
gcggaucagacggcugac

SEQ ID NO: 1658103 - RNA, 20 nt, Salmonella enterica enterica serovar Typhi
gcggaucgauaacgaccaga

SEQ ID NO: 1658104 - RNA, 19 nt, Salmonella enterica enterica serovar Typhi
gcggaucgugaggauaauc

SEQ ID NO: 1658105 - RNA, 17 nt, Salmonella enterica enterica serovar Typhi
gcggaugaucgccucuu

SEQ ID NO: 1658106 - RNA, 18 nt, Salmonella enterica enterica serovar Typhi
gcggacacccgcagccag

SEQ ID NO: 1658107 - RNA, 16 nt, Salmonella enterica enterica serovar Typhi
gcggacgcugacgcca

SEQ ID NO: 1658108 - RNA, 21 nt, Salmonella enterica enterica serovar Typhi
gcggagagaucgacagcgcgc

SEQ ID NO: 1658109 - RNA, 16 nt, Salmonella enterica enterica serovar Typhi
aagcuguaacacugcc

SEQ ID NO: 1658110 - RNA, 21 nt, Salmonella enterica enterica serovar Typhi
aagcugguggcgaguccugcc

SEQ ID NO: 1658111 - RNA, 18 nt, Salmonella enterica enterica serovar Typhi
aagcuggauaccgcgcca

SEQ ID NO: 1658112 - RNA, 14 nt, Salmonella enterica enterica serovar Typhi
gcggcucaccagcu

SEQ ID NO: 1658113 - RNA, 21 nt, Salmonella enterica enterica serovar Typhi
gcggcuauugucugauggcgc

SEQ ID NO: 1658114 - RNA, 22 nt, Salmonella enterica enterica serovar Typhi
gcggcuugaguuuuccgccauu

SEQ ID NO: 1658115 - RNA, 20 nt, Salmonella enterica enterica serovar Typhi
gcggcuuuaaugccgccgua

SEQ ID NO: 1658116 - RNA, 13 nt, Salmonella enterica enterica serovar Typhi
gcggcuuucagca

SEQ ID NO: 1658117 - RNA, 17 nt, Salmonella enterica enterica serovar Typhi
gcgggauacucggcacc

SEQ ID NO: 1658118 - RNA, 19 nt, Salmonella enterica enterica serovar Typhi
gcgggcagaaaaaucagca

SEQ ID NO: 1658119 - RNA, 14 nt, Salmonella enterica enterica serovar Typhi
gcgggacugcugcu

SEQ ID NO: 1658120 - RNA, 16 nt, Salmonella enterica enterica serovar Typhi
gcgggcuuauccccau

SEQ ID NO: 1658121 - RNA, 20 nt, Salmonella enterica enterica serovar Typhi
gcgggccaguuuccugaccc

SEQ ID NO: 1658122 - RNA, 19 nt, Salmonella enterica enterica serovar Typhi
gcgguaugaaagccaucgc

SEQ ID NO: 1658123 - RNA, 23 nt, Salmonella enterica enterica serovar Typhi
gcgguagagaacagcaucaccgg

SEQ ID NO: 1658124 - RNA, 15 nt, Salmonella enterica enterica serovar Typhi
gcgguauuauccgcc

SEQ ID NO: 1658125 - RNA, 16 nt, Salmonella enterica enterica serovar Typhi
gcgguacgaaucgccg

SEQ ID NO: 1658126 - RNA, 18 nt, Salmonella enterica enterica serovar Typhi
gcgguacgccgccauccg

SEQ ID NO: 1658127 - RNA, 21 nt, Salmonella enterica enterica serovar Typhi
gcgguaccggcauuacccagu

SEQ ID NO: 1658128 - RNA, 23 nt, Salmonella enterica enterica serovar Typhi
gcgggucaacgccaagcgcggca

SEQ ID NO: 1658129 - RNA, 13 nt, Salmonella enterica enterica serovar Typhi
gcgggugcgcagc

SEQ ID NO: 1658130 - RNA, 14 nt, Salmonella enterica enterica serovar Typhi
gcgggugcgcagcc

SEQ ID NO: 1658131 - RNA, 17 nt, Salmonella enterica enterica serovar Typhi
gcgggugcgcagcccca

SEQ ID NO: 1658132 - RNA, 17 nt, Salmonella enterica enterica serovar Typhi
gcgggggacgcgacgcc

SEQ ID NO: 1658133 - RNA, 14 nt, Salmonella enterica enterica serovar Typhi
gcggcggaccgcaa

SEQ ID NO: 1658134 - RNA, 14 nt, Salmonella enterica enterica serovar Typhi
aagcguuccgccac

SEQ ID NO: 1658135 - RNA, 22 nt, Salmonella enterica enterica serovar Typhi
gcggcgcacugccugauggcgc

SEQ ID NO: 1658136 - RNA, 17 nt, Salmonella enterica enterica serovar Typhi
gcggcgcaaaucgccau

SEQ ID NO: 1658137 - RNA, 20 nt, Salmonella enterica enterica serovar Typhi
gcggcgauuuauagagcagc

SEQ ID NO: 1658138 - RNA, 20 nt, Salmonella enterica enterica serovar Typhi
gcggcgcauucucugucgcc

SEQ ID NO: 1658139 - RNA, 14 nt, Salmonella enterica enterica serovar Typhi
gcggcguaaacgcc

SEQ ID NO: 1658140 - RNA, 14 nt, Salmonella enterica enterica serovar Typhi
gcggcguaccgcgc

SEQ ID NO: 1658141 - RNA, 14 nt, Salmonella enterica enterica serovar Typhi
gcggcguaacggcu

SEQ ID NO: 1658142 - RNA, 17 nt, Salmonella enterica enterica serovar Typhi
aagcucccgccagcgag

SEQ ID NO: 1658143 - RNA, 13 nt, Salmonella enterica enterica serovar Typhi
aagcucagcggca

SEQ ID NO: 1658144 - RNA, 22 nt, Salmonella enterica enterica serovar Typhi
aagcuauuacaaaaaucaugcc

SEQ ID NO: 1658145 - RNA, 17 nt, Salmonella enterica enterica serovar Typhi
gcggcggcccgaagggc

SEQ ID NO: 1658146 - RNA, 13 nt, Salmonella enterica enterica serovar Typhi
gcggccugcgcca

SEQ ID NO: 1658147 - RNA, 17 nt, Salmonella enterica enterica serovar Typhi
gcggcgacaccagcguc

SEQ ID NO: 1658148 - RNA, 20 nt, Salmonella enterica enterica serovar Typhi
gcggcgacagagaaugcgcc

SEQ ID NO: 1658149 - RNA, 20 nt, Salmonella enterica enterica serovar Typhi
gcggcgaagcaucuuuccgg

SEQ ID NO: 1658150 - RNA, 15 nt, Salmonella enterica enterica serovar Typhi
gcggcgacaccagcg

SEQ ID NO: 1658151 - RNA, 19 nt, Salmonella enterica enterica serovar Typhi
gcggcauuggcguuaccgg

SEQ ID NO: 1658152 - RNA, 19 nt, Salmonella enterica enterica serovar Typhi
gcggcauggguaaagccca

SEQ ID NO: 1658153 - RNA, 15 nt, Salmonella enterica enterica serovar Typhi
gccgcuuucaccuua

SEQ ID NO: 1658154 - RNA, 22 nt, Salmonella enterica enterica serovar Typhi
gccggaaaggauauaagcgcca

SEQ ID NO: 1658155 - RNA, 16 nt, Salmonella enterica enterica serovar Typhi
gccggaaagaauaauc

SEQ ID NO: 1658156 - RNA, 23 nt, Salmonella enterica enterica serovar Typhi
gccggaagacguuuacaccgcca

SEQ ID NO: 1658157 - RNA, 23 nt, Salmonella enterica enterica serovar Typhi
gccggaaucgcgauccagcccca

SEQ ID NO: 1658158 - RNA, 21 nt, Salmonella enterica enterica serovar Typhi
gccggagaaaaagaccgacau

SEQ ID NO: 1658159 - RNA, 22 nt, Salmonella enterica enterica serovar Typhi
gccggagagcggauaauccgcc

SEQ ID NO: 1658160 - RNA, 13 nt, Salmonella enterica enterica serovar Typhi
gccggagcgucau

SEQ ID NO: 1658161 - RNA, 12 nt, Salmonella enterica enterica serovar Typhi
gccggaccugcg

SEQ ID NO: 1658162 - RNA, 21 nt, Salmonella enterica enterica serovar Typhi
gccggacguaccuugccgaau

SEQ ID NO: 1658163 - RNA, 20 nt, Salmonella enterica enterica serovar Typhi
gccggauaucgcuauccggc

SEQ ID NO: 1658164 - RNA, 17 nt, Salmonella enterica enterica serovar Typhi
gccggauagggcguaag

SEQ ID NO: 1658165 - RNA, 17 nt, Salmonella enterica enterica serovar Typhi
gccggauaaggccacgc

SEQ ID NO: 1658166 - RNA, 19 nt, Salmonella enterica enterica serovar Typhi
gccggauaagcguagcgca

SEQ ID NO: 1658167 - RNA, 21 nt, Salmonella enterica enterica serovar Typhi
gccggauaaggcgcuugugau

SEQ ID NO: 1658168 - RNA, 21 nt, Salmonella enterica enterica serovar Typhi
gccggauaagcauuagcgcca

SEQ ID NO: 1658169 - RNA, 15 nt, Salmonella enterica enterica serovar Typhi
gccggauaagcgcag

SEQ ID NO: 1658170 - RNA, 21 nt, Salmonella enterica enterica serovar Typhi
gccggauaagcggcagcgcca

SEQ ID NO: 1658171 - RNA, 20 nt, Salmonella enterica enterica serovar Typhi
gccggauaagcguagcgcca

SEQ ID NO: 1658172 - RNA, 22 nt, Salmonella enterica enterica serovar Typhi
gccggaugaggcgcagccgcca

SEQ ID NO: 1658173 - RNA, 21 nt, Salmonella enterica enterica serovar Typhi
gccggaugagcguuagcgcca

SEQ ID NO: 1658174 - RNA, 14 nt, Salmonella enterica enterica serovar Typhi
gccggaugcagucu

SEQ ID NO: 1658175 - RNA, 14 nt, Salmonella enterica enterica serovar Typhi
gccggcaaagccau

SEQ ID NO: 1658176 - RNA, 16 nt, Salmonella enterica enterica serovar Typhi
gccggcaaagguugcc

SEQ ID NO: 1658177 - RNA, 22 nt, Salmonella enterica enterica serovar Typhi
gccggaugugagcgcauccggc

SEQ ID NO: 1658178 - RNA, 21 nt, Salmonella enterica enterica serovar Typhi
gccggauggcgcuuugcuuau

SEQ ID NO: 1658179 - RNA, 23 nt, Salmonella enterica enterica serovar Typhi
gccggauggggcauuagccgcca

SEQ ID NO: 1658180 - RNA, 19 nt, Salmonella enterica enterica serovar Typhi
gccggauggcaacgccaga

SEQ ID NO: 1658181 - RNA, 17 nt, Salmonella enterica enterica serovar Typhi
gccggaugugagcgcau

SEQ ID NO: 1658182 - RNA, 14 nt, Salmonella enterica enterica serovar Typhi
gccggauguaggcc

SEQ ID NO: 1658183 - RNA, 21 nt, Salmonella enterica enterica serovar Typhi
gccggcggaaaaaagcagcau

SEQ ID NO: 1658184 - RNA, 17 nt, Salmonella enterica enterica serovar Typhi
gccgggaucugauacgg

SEQ ID NO: 1658185 - RNA, 16 nt, Salmonella enterica enterica serovar Typhi
aagcauagcgucauca

SEQ ID NO: 1658186 - RNA, 18 nt, Salmonella enterica enterica serovar Typhi
gccggcgauaacccgcgc

SEQ ID NO: 1658187 - RNA, 17 nt, Salmonella enterica enterica serovar Typhi
gccggcgaccaugccag

SEQ ID NO: 1658188 - RNA, 20 nt, Salmonella enterica enterica serovar Typhi
gccugcucaauacuuuccgg

SEQ ID NO: 1658189 - RNA, 22 nt, Salmonella enterica enterica serovar Typhi
gccugcgcguaaauuucacuua

SEQ ID NO: 1658190 - RNA, 19 nt, Salmonella enterica enterica serovar Typhi
gccugcgcucauauacccu

SEQ ID NO: 1658191 - RNA, 21 nt, Salmonella enterica enterica serovar Typhi
gccugcgcgccugacgcggac

SEQ ID NO: 1658192 - RNA, 22 nt, Salmonella enterica enterica serovar Typhi
gccuggcaacaugaccagcgca

SEQ ID NO: 1658193 - RNA, 14 nt, Salmonella enterica enterica serovar Typhi
gccugcugcgcaac

SEQ ID NO: 1658194 - RNA, 16 nt, Salmonella enterica enterica serovar Typhi
gccugcucuugcggca

SEQ ID NO: 1658195 - RNA, 21 nt, Salmonella enterica enterica serovar Typhi
gccugcugcggauaacguucg

SEQ ID NO: 1658196 - RNA, 15 nt, Salmonella enterica enterica serovar Typhi
gccugcuucagacaa

SEQ ID NO: 1658197 - RNA, 17 nt, Salmonella enterica enterica serovar Typhi
gccuguuuacugacgcc

SEQ ID NO: 1658198 - RNA, 19 nt, Salmonella enterica enterica serovar Typhi
gccuguugcgggccagcag

SEQ ID NO: 1658199 - RNA, 19 nt, Salmonella enterica enterica serovar Typhi
gccuuaucaagccuacacc

SEQ ID NO: 1658200 - RNA, 14 nt, Salmonella enterica enterica serovar Typhi
gccuuacccggccu

SEQ ID NO: 1658201 - RNA, 15 nt, Salmonella enterica enterica serovar Typhi
gccuuaucaggccug

SEQ ID NO: 1658202 - RNA, 14 nt, Salmonella enterica enterica serovar Typhi
gccuuauccggccu

SEQ ID NO: 1658203 - RNA, 16 nt, Salmonella enterica enterica serovar Typhi
gccuguagcagcgcca

SEQ ID NO: 1658204 - RNA, 13 nt, Salmonella enterica enterica serovar Typhi
gccugucaggccu

SEQ ID NO: 1658205 - RNA, 14 nt, Salmonella enterica enterica serovar Typhi
gccuguaaaccgcc

SEQ ID NO: 1658206 - RNA, 17 nt, Salmonella enterica enterica serovar Typhi
gccuguacuugcgccgc

SEQ ID NO: 1658207 - RNA, 20 nt, Salmonella enterica enterica serovar Typhi
gccuguacuugcgccgccau

SEQ ID NO: 1658208 - RNA, 16 nt, Salmonella enterica enterica serovar Typhi
gccugguaagcguagc

SEQ ID NO: 1658209 - RNA, 18 nt, Salmonella enterica enterica serovar Typhi
gccugguaagcguagcgc

SEQ ID NO: 1658210 - RNA, 16 nt, Salmonella enterica enterica serovar Typhi
aagcccaucagcgcca

SEQ ID NO: 1658211 - RNA, 16 nt, Salmonella enterica enterica serovar Typhi
gccuccggaugacgcc

SEQ ID NO: 1658212 - RNA, 12 nt, Salmonella enterica enterica serovar Typhi
gccuccggcaga

SEQ ID NO: 1658213 - RNA, 20 nt, Salmonella enterica enterica serovar Typhi
gccuacacucugcgcgcgau

SEQ ID NO: 1658214 - RNA, 22 nt, Salmonella enterica enterica serovar Typhi
gccuacaaaaucgcccaggccu

SEQ ID NO: 1658215 - RNA, 16 nt, Salmonella enterica enterica serovar Typhi
gccuaccugccgccau

SEQ ID NO: 1658216 - RNA, 17 nt, Salmonella enterica enterica serovar Typhi
gccuaccugccgccaua

SEQ ID NO: 1658217 - RNA, 18 nt, Salmonella enterica enterica serovar Typhi
gccuacccgcgugcggac

SEQ ID NO: 1658218 - RNA, 15 nt, Salmonella enterica enterica serovar Typhi
gccuacauccggcuc

SEQ ID NO: 1658219 - RNA, 22 nt, Salmonella enterica enterica serovar Typhi
gccugaugcgcguuuagcgcca

SEQ ID NO: 1658220 - RNA, 18 nt, Salmonella enterica enterica serovar Typhi
gccugacaaugacgcuuc

SEQ ID NO: 1658221 - RNA, 16 nt, Salmonella enterica enterica serovar Typhi
gccugaugcugcgcau

SEQ ID NO: 1658222 - RNA, 22 nt, Salmonella enterica enterica serovar Typhi
gccugacaggagcgccguggaa

SEQ ID NO: 1658223 - RNA, 13 nt, Salmonella enterica enterica serovar Typhi
gccugaaucgccg

SEQ ID NO: 1658224 - RNA, 11 nt, Salmonella enterica enterica serovar Typhi
gccugaaugcu

SEQ ID NO: 1658225 - RNA, 15 nt, Salmonella enterica enterica serovar Typhi
gccugaauaaugacc

SEQ ID NO: 1658226 - RNA, 20 nt, Salmonella enterica enterica serovar Typhi
gccugauggcgcuacgcuua

SEQ ID NO: 1658227 - RNA, 15 nt, Salmonella enterica enterica serovar Typhi
gccugauggcgcugc

SEQ ID NO: 1658228 - RNA, 14 nt, Salmonella enterica enterica serovar Typhi
gccugauggcguag

SEQ ID NO: 1658229 - RNA, 22 nt, Salmonella enterica enterica serovar Typhi
gccugauggcgacguuagcgca

SEQ ID NO: 1658230 - RNA, 23 nt, Salmonella enterica enterica serovar Typhi
gccugauggcgacguuagcgcau

SEQ ID NO: 1658231 - RNA, 11 nt, Salmonella enterica enterica serovar Typhi
gccugauggcg

SEQ ID NO: 1658232 - RNA, 17 nt, Salmonella enterica enterica serovar Typhi
gccugauggcgcuacgc

SEQ ID NO: 1658233 - RNA, 19 nt, Salmonella enterica enterica serovar Typhi
gccugccgggccugcggcg

SEQ ID NO: 1658234 - RNA, 21 nt, Salmonella enterica enterica serovar Typhi
gccugccgggccugcggcgac

SEQ ID NO: 1658235 - RNA, 15 nt, Salmonella enterica enterica serovar Typhi
gccugccguccugau

SEQ ID NO: 1658236 - RNA, 23 nt, Salmonella enterica enterica serovar Typhi
gccugccgccagcaguugcagcg

SEQ ID NO: 1658237 - RNA, 18 nt, Salmonella enterica enterica serovar Typhi
gccgugaaauauccuccg

SEQ ID NO: 1658238 - RNA, 22 nt, Salmonella enterica enterica serovar Typhi
gccgugaaauauccuccgccga

SEQ ID NO: 1658239 - RNA, 19 nt, Salmonella enterica enterica serovar Typhi
gccgugaauaaaaccggca

SEQ ID NO: 1658240 - RNA, 18 nt, Salmonella enterica enterica serovar Typhi
gccgugccugcuccgcca

SEQ ID NO: 1658241 - RNA, 22 nt, Salmonella enterica enterica serovar Typhi
gccgugccugggcggcaacccg

SEQ ID NO: 1658242 - RNA, 20 nt, Salmonella enterica enterica serovar Typhi
gccgugcgccgacaucgcca

SEQ ID NO: 1658243 - RNA, 23 nt, Salmonella enterica enterica serovar Typhi
gccguguauuuuaccucgccagu

SEQ ID NO: 1658244 - RNA, 22 nt, Salmonella enterica enterica serovar Typhi
gccguugcgauaauacacggua

SEQ ID NO: 1658245 - RNA, 16 nt, Salmonella enterica enterica serovar Typhi
gccguacuccagccca

SEQ ID NO: 1658246 - RNA, 20 nt, Salmonella enterica enterica serovar Typhi
gccgucaaacaagccgccaa

SEQ ID NO: 1658247 - RNA, 16 nt, Salmonella enterica enterica serovar Typhi
gccgucacuuuaucac

SEQ ID NO: 1658248 - RNA, 21 nt, Salmonella enterica enterica serovar Typhi
gccgucaggcuacccgcaaua

SEQ ID NO: 1658249 - RNA, 14 nt, Salmonella enterica enterica serovar Typhi
gccgucauccgcgu

SEQ ID NO: 1658250 - RNA, 23 nt, Salmonella enterica enterica serovar Typhi
gccgucaggcuugccgcgccaga

SEQ ID NO: 1658251 - RNA, 21 nt, Salmonella enterica enterica serovar Typhi
gccgguaaucacugccgccac

SEQ ID NO: 1658252 - RNA, 14 nt, Salmonella enterica enterica serovar Typhi
gccgguaaucgcgc

SEQ ID NO: 1658253 - RNA, 14 nt, Salmonella enterica enterica serovar Typhi
gccgguaucaucag

SEQ ID NO: 1658254 - RNA, 15 nt, Salmonella enterica enterica serovar Typhi
gccgguauccagcgc

SEQ ID NO: 1658255 - RNA, 18 nt, Salmonella enterica enterica serovar Typhi
gccgguaaagggcgggau

SEQ ID NO: 1658256 - RNA, 23 nt, Salmonella enterica enterica serovar Typhi
gccgguaagaagaaccagcgcga

SEQ ID NO: 1658257 - RNA, 18 nt, Salmonella enterica enterica serovar Typhi
gcgcaacgccuucguccg

SEQ ID NO: 1658258 - RNA, 19 nt, Salmonella enterica enterica serovar Typhi
gcgcaacgcgcaucaacgc

SEQ ID NO: 1658259 - RNA, 22 nt, Salmonella enterica enterica serovar Typhi
gcgcacgagugaucccgacaua

SEQ ID NO: 1658260 - RNA, 15 nt, Salmonella enterica enterica serovar Typhi
gcgauguccgguccg

SEQ ID NO: 1658261 - RNA, 19 nt, Salmonella enterica enterica serovar Typhi
gcgaugucgggauaacgau

SEQ ID NO: 1658262 - RNA, 14 nt, Salmonella enterica enterica serovar Typhi
gcgcaaacguaacc

SEQ ID NO: 1658263 - RNA, 12 nt, Salmonella enterica enterica serovar Typhi
gcgcaaacggcg

SEQ ID NO: 1658264 - RNA, 13 nt, Salmonella enterica enterica serovar Typhi
gcgauuuucucgc

SEQ ID NO: 1658265 - RNA, 14 nt, Salmonella enterica enterica serovar Typhi
gcgauuuuuaggcc

SEQ ID NO: 1658266 - RNA, 15 nt, Salmonella enterica enterica serovar Typhi
gcgcaaaucgccauc

SEQ ID NO: 1658267 - RNA, 13 nt, Salmonella enterica enterica serovar Typhi
gcgcaaauacuga

SEQ ID NO: 1658268 - RNA, 14 nt, Salmonella enterica enterica serovar Typhi
gcgcaaaucgccau

SEQ ID NO: 1658269 - RNA, 17 nt, Salmonella enterica enterica serovar Typhi
gcgcaaccgcaucacgc

SEQ ID NO: 1658270 - RNA, 17 nt, Salmonella enterica enterica serovar Typhi
gcgauucauaugcgcca

SEQ ID NO: 1658271 - RNA, 18 nt, Salmonella enterica enterica serovar Typhi
gcgauuccggacaacgca

SEQ ID NO: 1658272 - RNA, 12 nt, Salmonella enterica enterica serovar Typhi
gcgauuuccagc

SEQ ID NO: 1658273 - RNA, 21 nt, Salmonella enterica enterica serovar Typhi
gcgauuuagcguuggcgucau

SEQ ID NO: 1658274 - RNA, 17 nt, Salmonella enterica enterica serovar Typhi
gcgauuugccgcgccuu

SEQ ID NO: 1658275 - RNA, 15 nt, Salmonella enterica enterica serovar Typhi
gcgauuuuuacgcca

SEQ ID NO: 1658276 - RNA, 18 nt, Salmonella enterica enterica serovar Typhi
gcgauuuucaccggcguu

SEQ ID NO: 1658277 - RNA, 16 nt, Salmonella enterica enterica serovar Typhi
gcgauuuucaucaagc

SEQ ID NO: 1658278 - RNA, 12 nt, Salmonella enterica enterica serovar Typhi
gcgaucgcgcca

SEQ ID NO: 1658279 - RNA, 19 nt, Salmonella enterica enterica serovar Typhi
gcgauccucauacagcccg

SEQ ID NO: 1658280 - RNA, 16 nt, Salmonella enterica enterica serovar Typhi
gcgaucgagcgcaaua

SEQ ID NO: 1658281 - RNA, 14 nt, Salmonella enterica enterica serovar Typhi
gcgaucccggccuu

SEQ ID NO: 1658282 - RNA, 20 nt, Salmonella enterica enterica serovar Typhi
gcgaucaguggcgccgcaau

SEQ ID NO: 1658283 - RNA, 21 nt, Salmonella enterica enterica serovar Typhi
gcgauccacaaucgucgugcc

SEQ ID NO: 1658284 - RNA, 15 nt, Salmonella enterica enterica serovar Typhi
gcgauccagaucggc

SEQ ID NO: 1658285 - RNA, 12 nt, Salmonella enterica enterica serovar Typhi
gcgaucaccacg

SEQ ID NO: 1658286 - RNA, 13 nt, Salmonella enterica enterica serovar Typhi
gcgaucagcgcca

SEQ ID NO: 1658287 - RNA, 16 nt, Salmonella enterica enterica serovar Typhi
gcgaucacuaccgcca

SEQ ID NO: 1658288 - RNA, 18 nt, Salmonella enterica enterica serovar Typhi
gcgaucacuaccgccauc

SEQ ID NO: 1658289 - RNA, 20 nt, Salmonella enterica enterica serovar Typhi
gcgaugccaguagcucgccg

SEQ ID NO: 1658290 - RNA, 17 nt, Salmonella enterica enterica serovar Typhi
gcgaugcgaccgcgcca

SEQ ID NO: 1658291 - RNA, 19 nt, Salmonella enterica enterica serovar Typhi
gcgaugcgaccgcgccacg

SEQ ID NO: 1658292 - RNA, 16 nt, Salmonella enterica enterica serovar Typhi
gcgaugagauccgggc

SEQ ID NO: 1658293 - RNA, 13 nt, Salmonella enterica enterica serovar Typhi
gcgacaggcgcuu

SEQ ID NO: 1658294 - RNA, 17 nt, Salmonella enterica enterica serovar Typhi
gcgacagucgcagagcc

SEQ ID NO: 1658295 - RNA, 15 nt, Salmonella enterica enterica serovar Typhi
gcgaccacgcauacc

SEQ ID NO: 1658296 - RNA, 18 nt, Salmonella enterica enterica serovar Typhi
gcgacagcgcuauccggc

SEQ ID NO: 1658297 - RNA, 20 nt, Salmonella enterica enterica serovar Typhi
gcgacaaugaaccagcccau

SEQ ID NO: 1658298 - RNA, 20 nt, Salmonella enterica enterica serovar Typhi
gccuucgacuuccgcaucaa

SEQ ID NO: 1658299 - RNA, 19 nt, Salmonella enterica enterica serovar Typhi
gccuuauccggccuacaga

SEQ ID NO: 1658300 - RNA, 19 nt, Salmonella enterica enterica serovar Typhi
gccuuauccggccuacacg

SEQ ID NO: 1658301 - RNA, 18 nt, Salmonella enterica enterica serovar Typhi
gccuuauccggccuacag

SEQ ID NO: 1658302 - RNA, 16 nt, Salmonella enterica enterica serovar Typhi
gccuuccuccagcauc

SEQ ID NO: 1658303 - RNA, 16 nt, Salmonella enterica enterica serovar Typhi
gccuucgacuuccgca

SEQ ID NO: 1658304 - RNA, 16 nt, Salmonella enterica enterica serovar Typhi
gcgagagaauuaacag

SEQ ID NO: 1658305 - RNA, 23 nt, Salmonella enterica enterica serovar Typhi
gcgacuuccgucuccggacguuu

SEQ ID NO: 1658306 - RNA, 14 nt, Salmonella enterica enterica serovar Typhi
gcgacuuauccggc

SEQ ID NO: 1658307 - RNA, 17 nt, Salmonella enterica enterica serovar Typhi
gcgagaccauauugaag

SEQ ID NO: 1658308 - RNA, 23 nt, Salmonella enterica enterica serovar Typhi
gcgagcaggaaccacaucgcgac

SEQ ID NO: 1658309 - RNA, 16 nt, Salmonella enterica enterica serovar Typhi
gcgacucauucagcaa

SEQ ID NO: 1658310 - RNA, 14 nt, Salmonella enterica enterica serovar Typhi
gcgacguuccgcga

SEQ ID NO: 1658311 - RNA, 19 nt, Salmonella enterica enterica serovar Typhi
gcgaggaaaacgcuucuac

SEQ ID NO: 1658312 - RNA, 15 nt, Salmonella enterica enterica serovar Typhi
gcgaggaacaucagc

SEQ ID NO: 1658313 - RNA, 20 nt, Salmonella enterica enterica serovar Typhi
gcgaggucuggucagcgaug

SEQ ID NO: 1658314 - RNA, 21 nt, Salmonella enterica enterica serovar Typhi
gcgauaaaaauauccgccauc

SEQ ID NO: 1658315 - RNA, 21 nt, Salmonella enterica enterica serovar Typhi
gcgauaaggucgcuauccagc

SEQ ID NO: 1658316 - RNA, 18 nt, Salmonella enterica enterica serovar Typhi
gcgauaccgugacugacc

SEQ ID NO: 1658317 - RNA, 15 nt, Salmonella enterica enterica serovar Typhi
gcgauacucucgcag

SEQ ID NO: 1658318 - RNA, 15 nt, Salmonella enterica enterica serovar Typhi
gcgauacguaggccu

SEQ ID NO: 1658319 - RNA, 18 nt, Salmonella enterica enterica serovar Typhi
gcgccugaagauacgcca

SEQ ID NO: 1658320 - RNA, 21 nt, Salmonella enterica enterica serovar Typhi
gcgccuggaugaagcagacau

SEQ ID NO: 1658321 - RNA, 15 nt, Salmonella enterica enterica serovar Typhi
gcgccuuccagcaau

SEQ ID NO: 1658322 - RNA, 14 nt, Salmonella enterica enterica serovar Typhi
gcgccuucaggcau

SEQ ID NO: 1658323 - RNA, 21 nt, Salmonella enterica enterica serovar Typhi
gcgccuucuucgcaaucuccg

SEQ ID NO: 1658324 - RNA, 21 nt, Salmonella enterica enterica serovar Typhi
gcgccuguuagggcgcggcug

SEQ ID NO: 1658325 - RNA, 17 nt, Salmonella enterica enterica serovar Typhi
gcgccugggauaagcag

SEQ ID NO: 1658326 - RNA, 14 nt, Salmonella enterica enterica serovar Typhi
gcgccuggcgguau

SEQ ID NO: 1658327 - RNA, 18 nt, Salmonella enterica enterica serovar Typhi
gcgcgaggcauaccgccc

SEQ ID NO: 1658328 - RNA, 23 nt, Salmonella enterica enterica serovar Typhi
gcgccuuuaauuccgccgggcaa

SEQ ID NO: 1658329 - RNA, 19 nt, Salmonella enterica enterica serovar Typhi
gcgcgaaacgcacccgcgc

SEQ ID NO: 1658330 - RNA, 14 nt, Salmonella enterica enterica serovar Typhi
gcgcgaaaacagcu

SEQ ID NO: 1658331 - RNA, 15 nt, Salmonella enterica enterica serovar Typhi
gcgccuuuccggccu

SEQ ID NO: 1658332 - RNA, 22 nt, Salmonella enterica enterica serovar Typhi
gcgcgaacgccuuauccggccu

SEQ ID NO: 1658333 - RNA, 15 nt, Salmonella enterica enterica serovar Typhi
gcgccgccagcgacu

SEQ ID NO: 1658334 - RNA, 13 nt, Salmonella enterica enterica serovar Typhi
gcgccgccagcga

SEQ ID NO: 1658335 - RNA, 15 nt, Salmonella enterica enterica serovar Typhi
gcgccgcuuccggca

SEQ ID NO: 1658336 - RNA, 17 nt, Salmonella enterica enterica serovar Typhi
gcgccgucggcaucggg

SEQ ID NO: 1658337 - RNA, 21 nt, Salmonella enterica enterica serovar Typhi
gcgccgugcccagcaucccgc

SEQ ID NO: 1658338 - RNA, 14 nt, Salmonella enterica enterica serovar Typhi
gcgccguccugcaa

SEQ ID NO: 1658339 - RNA, 15 nt, Salmonella enterica enterica serovar Typhi
gcgccguggccgaua

SEQ ID NO: 1658340 - RNA, 15 nt, Salmonella enterica enterica serovar Typhi
gcgccuaccgccaua

SEQ ID NO: 1658341 - RNA, 14 nt, Salmonella enterica enterica serovar Typhi
gcgcaucaacgcca

SEQ ID NO: 1658342 - RNA, 15 nt, Salmonella enterica enterica serovar Typhi
gcgcauauuccggcg

SEQ ID NO: 1658343 - RNA, 13 nt, Salmonella enterica enterica serovar Typhi
gcgcauccggcau

SEQ ID NO: 1658344 - RNA, 19 nt, Salmonella enterica enterica serovar Typhi
gcgcaucccacaccacacg

SEQ ID NO: 1658345 - RNA, 22 nt, Salmonella enterica enterica serovar Typhi
gcgcauggaagaaaauauaauc

SEQ ID NO: 1658346 - RNA, 23 nt, Salmonella enterica enterica serovar Typhi
gcgccagccgucaaacaucgcgc

SEQ ID NO: 1658347 - RNA, 15 nt, Salmonella enterica enterica serovar Typhi
gcgccagccggauac

SEQ ID NO: 1658348 - RNA, 12 nt, Salmonella enterica enterica serovar Typhi
gcgccagcgacg

SEQ ID NO: 1658349 - RNA, 12 nt, Salmonella enterica enterica serovar Typhi
gcgccagcgcau

SEQ ID NO: 1658350 - RNA, 21 nt, Salmonella enterica enterica serovar Typhi
gcgccauuaacgccaugacgc

SEQ ID NO: 1658351 - RNA, 13 nt, Salmonella enterica enterica serovar Typhi
gcgcccagcgccg

SEQ ID NO: 1658352 - RNA, 19 nt, Salmonella enterica enterica serovar Typhi
gcgccaugcggaaucacgc

SEQ ID NO: 1658353 - RNA, 13 nt, Salmonella enterica enterica serovar Typhi
gcgccagguauac

SEQ ID NO: 1658354 - RNA, 18 nt, Salmonella enterica enterica serovar Typhi
gcgccgacuuuacggccu

SEQ ID NO: 1658355 - RNA, 14 nt, Salmonella enterica enterica serovar Typhi
gcgccgacaggcuc

SEQ ID NO: 1658356 - RNA, 14 nt, Salmonella enterica enterica serovar Typhi
cgcccuccuccagc

SEQ ID NO: 1658357 - RNA, 13 nt, Salmonella enterica enterica serovar Typhi
cgcccguuuccgc

SEQ ID NO: 1658358 - RNA, 17 nt, Salmonella enterica enterica serovar Typhi
cgcccguacaccugcaa

SEQ ID NO: 1658359 - RNA, 13 nt, Salmonella enterica enterica serovar Typhi
cgcccguccgcua

SEQ ID NO: 1658360 - RNA, 15 nt, Salmonella enterica enterica serovar Typhi
cgcccgugacgccag

SEQ ID NO: 1658361 - RNA, 19 nt, Salmonella enterica enterica serovar Typhi
cgcccgugacgccaggcag

SEQ ID NO: 1658362 - RNA, 13 nt, Salmonella enterica enterica serovar Typhi
cgcccugacgccg

SEQ ID NO: 1658363 - RNA, 21 nt, Salmonella enterica enterica serovar Typhi
cgcccugaggaguauuaucca

SEQ ID NO: 1658364 - RNA, 16 nt, Salmonella enterica enterica serovar Typhi
cgcccugcccgccagg

SEQ ID NO: 1658365 - RNA, 20 nt, Salmonella enterica enterica serovar Typhi
cgcccugccauucccagccg

SEQ ID NO: 1658366 - RNA, 21 nt, Salmonella enterica enterica serovar Typhi
cgcccugcgccagcauggcgu

SEQ ID NO: 1658367 - RNA, 18 nt, Salmonella enterica enterica serovar Typhi
cgcccugcgccagcaugg

SEQ ID NO: 1658368 - RNA, 18 nt, Salmonella enterica enterica serovar Typhi
cgcccugcucccacagcu

SEQ ID NO: 1658369 - RNA, 14 nt, Salmonella enterica enterica serovar Typhi
cgcccuucacgccg

SEQ ID NO: 1658370 - RNA, 16 nt, Salmonella enterica enterica serovar Typhi
cgcccuucaucuucca

SEQ ID NO: 1658371 - RNA, 18 nt, Salmonella enterica enterica serovar Typhi
cgcccugggcuucgucga

SEQ ID NO: 1658372 - RNA, 23 nt, Salmonella enterica enterica serovar Typhi
cgcccuguaaaggauugccgccg

SEQ ID NO: 1658373 - RNA, 14 nt, Salmonella enterica enterica serovar Typhi
cgccgaagcaggcg

SEQ ID NO: 1658374 - RNA, 18 nt, Salmonella enterica enterica serovar Typhi
cgccgacggaacccagca

SEQ ID NO: 1658375 - RNA, 17 nt, Salmonella enterica enterica serovar Typhi
cgccgacccccuccuug

SEQ ID NO: 1658376 - RNA, 14 nt, Salmonella enterica enterica serovar Typhi
cgccgaccauccag

SEQ ID NO: 1658377 - RNA, 15 nt, Salmonella enterica enterica serovar Typhi
cgccgaccauccaga

SEQ ID NO: 1658378 - RNA, 13 nt, Salmonella enterica enterica serovar Typhi
cgccgaccaccag

SEQ ID NO: 1658379 - RNA, 17 nt, Salmonella enterica enterica serovar Typhi
cgccgacaucgccaccg

SEQ ID NO: 1658380 - RNA, 22 nt, Salmonella enterica enterica serovar Typhi
cgccgacguaguucaacgccug

SEQ ID NO: 1658381 - RNA, 12 nt, Salmonella enterica enterica serovar Typhi
cgccgagcaucg

SEQ ID NO: 1658382 - RNA, 15 nt, Salmonella enterica enterica serovar Typhi
cgccgaucggcguuu

SEQ ID NO: 1658383 - RNA, 15 nt, Salmonella enterica enterica serovar Typhi
cgccgaugccgccga

SEQ ID NO: 1658384 - RNA, 18 nt, Salmonella enterica enterica serovar Typhi
cgccgaugccgccgacaa

SEQ ID NO: 1658385 - RNA, 22 nt, Salmonella enterica enterica serovar Typhi
cgcccgcgauaaaaauccugcu

SEQ ID NO: 1658386 - RNA, 23 nt, Salmonella enterica enterica serovar Typhi
cgcccgccugccggauagcggcu

SEQ ID NO: 1658387 - RNA, 13 nt, Salmonella enterica enterica serovar Typhi
cgcccgccgccag

SEQ ID NO: 1658388 - RNA, 13 nt, Salmonella enterica enterica serovar Typhi
cgcccgccaucug

SEQ ID NO: 1658389 - RNA, 14 nt, Salmonella enterica enterica serovar Typhi
cgcccgagcgacgc

SEQ ID NO: 1658390 - RNA, 16 nt, Salmonella enterica enterica serovar Typhi
cgcccgagcgacgccc

SEQ ID NO: 1658391 - RNA, 15 nt, Salmonella enterica enterica serovar Typhi
cgcccgauagcguaa

SEQ ID NO: 1658392 - RNA, 12 nt, Salmonella enterica enterica serovar Typhi
cgcccaggccug

SEQ ID NO: 1658393 - RNA, 15 nt, Salmonella enterica enterica serovar Typhi
cgcccaguaccagca

SEQ ID NO: 1658394 - RNA, 18 nt, Salmonella enterica enterica serovar Typhi
cgcccaguccuuccggcg

SEQ ID NO: 1658395 - RNA, 22 nt, Salmonella enterica enterica serovar Typhi
cgcccaucuccagcccgacgau

SEQ ID NO: 1658396 - RNA, 13 nt, Salmonella enterica enterica serovar Typhi
cgccaccgcaugg

SEQ ID NO: 1658397 - RNA, 18 nt, Salmonella enterica enterica serovar Typhi
cgccaccgccagccaugg

SEQ ID NO: 1658398 - RNA, 17 nt, Salmonella enterica enterica serovar Typhi
cgccaccgccgccacca

SEQ ID NO: 1658399 - RNA, 20 nt, Salmonella enterica enterica serovar Typhi
cgcccauuagcauuccgccc

SEQ ID NO: 1658400 - RNA, 14 nt, Salmonella enterica enterica serovar Typhi
cgccccacagaccu

SEQ ID NO: 1658401 - RNA, 14 nt, Salmonella enterica enterica serovar Typhi
cgcccccugccagc

SEQ ID NO: 1658402 - RNA, 15 nt, Salmonella enterica enterica serovar Typhi
cgccgggaacuggca

SEQ ID NO: 1658403 - RNA, 17 nt, Salmonella enterica enterica serovar Typhi
cgccgggauauuuccgc

SEQ ID NO: 1658404 - RNA, 13 nt, Salmonella enterica enterica serovar Typhi
cgccgucaggcua

SEQ ID NO: 1658405 - RNA, 23 nt, Salmonella enterica enterica serovar Typhi
cgccgugacuguucacauccagc

SEQ ID NO: 1658406 - RNA, 16 nt, Salmonella enterica enterica serovar Typhi
cgccgugacggcguaa

SEQ ID NO: 1658407 - RNA, 20 nt, Salmonella enterica enterica serovar Typhi
cgccgugcacuucugcggua

SEQ ID NO: 1658408 - RNA, 13 nt, Salmonella enterica enterica serovar Typhi
cgccguccggcga

SEQ ID NO: 1658409 - RNA, 14 nt, Salmonella enterica enterica serovar Typhi
cgccguccggcgaa

SEQ ID NO: 1658410 - RNA, 23 nt, Salmonella enterica enterica serovar Typhi
cgccugacgaaagucauccagua

SEQ ID NO: 1658411 - RNA, 13 nt, Salmonella enterica enterica serovar Typhi
cgccugcauaaug

SEQ ID NO: 1658412 - RNA, 18 nt, Salmonella enterica enterica serovar Typhi
cgccugccaggauccguu

SEQ ID NO: 1658413 - RNA, 17 nt, Salmonella enterica enterica serovar Typhi
cgccugaauaaucggcg

SEQ ID NO: 1658414 - RNA, 23 nt, Salmonella enterica enterica serovar Typhi
cgccugaacgcgugguugcguaa

SEQ ID NO: 1658415 - RNA, 20 nt, Salmonella enterica enterica serovar Typhi
cgccucuggcguacgcagau

SEQ ID NO: 1658416 - RNA, 21 nt, Salmonella enterica enterica serovar Typhi
cgccucauugauaccuaaacg

SEQ ID NO: 1658417 - RNA, 18 nt, Salmonella enterica enterica serovar Typhi
cgccucgcgauccgccag

SEQ ID NO: 1658418 - RNA, 14 nt, Salmonella enterica enterica serovar Typhi
cgccucaaaucagg

SEQ ID NO: 1658419 - RNA, 18 nt, Salmonella enterica enterica serovar Typhi
cgccucaauugccgccag

SEQ ID NO: 1658420 - RNA, 18 nt, Salmonella enterica enterica serovar Typhi
cgccuagcgucccggcaa

SEQ ID NO: 1658421 - RNA, 18 nt, Salmonella enterica enterica serovar Typhi
aacagauacggcgcgucg

SEQ ID NO: 1658422 - RNA, 15 nt, Salmonella enterica enterica serovar Typhi
cgccguuaucggccu

SEQ ID NO: 1658423 - RNA, 15 nt, Salmonella enterica enterica serovar Typhi
cgccguuccauucca

SEQ ID NO: 1658424 - RNA, 18 nt, Salmonella enterica enterica serovar Typhi
cgccguuaccaaucugcg

SEQ ID NO: 1658425 - RNA, 18 nt, Salmonella enterica enterica serovar Typhi
cgccguuaccagcaucaa

SEQ ID NO: 1658426 - RNA, 17 nt, Salmonella enterica enterica serovar Typhi
cgccguguugugugccg

SEQ ID NO: 1658427 - RNA, 20 nt, Salmonella enterica enterica serovar Typhi
cgccguuaaaccguuaugaa

SEQ ID NO: 1658428 - RNA, 15 nt, Salmonella enterica enterica serovar Typhi
cgccuaaaucaagca

SEQ ID NO: 1658429 - RNA, 15 nt, Salmonella enterica enterica serovar Typhi
cgccguuuguuuauu

SEQ ID NO: 1658430 - RNA, 13 nt, Salmonella enterica enterica serovar Typhi
aacacggcgcuca

SEQ ID NO: 1658431 - RNA, 12 nt, Salmonella enterica enterica serovar Typhi
cgccuaccagca

SEQ ID NO: 1658432 - RNA, 14 nt, Salmonella enterica enterica serovar Typhi
cgccuaccgccaua

SEQ ID NO: 1658433 - RNA, 16 nt, Salmonella enterica enterica serovar Typhi
cgccgcuuccggcagg

SEQ ID NO: 1658434 - RNA, 17 nt, Salmonella enterica enterica serovar Typhi
cgccgcuuuucaggggu

SEQ ID NO: 1658435 - RNA, 18 nt, Salmonella enterica enterica serovar Typhi
aacaccgcauggcuggca

SEQ ID NO: 1658436 - RNA, 23 nt, Salmonella enterica enterica serovar Typhi
cgccgccucccccucaaucggcg

SEQ ID NO: 1658437 - RNA, 20 nt, Salmonella enterica enterica serovar Typhi
cgccgccucuucaaacggca

SEQ ID NO: 1658438 - RNA, 13 nt, Salmonella enterica enterica serovar Typhi
cgccgccguacuu

SEQ ID NO: 1658439 - RNA, 12 nt, Salmonella enterica enterica serovar Typhi
cgccgccgccga

SEQ ID NO: 1658440 - RNA, 21 nt, Salmonella enterica enterica serovar Typhi
cgccgcguaaucuucgcggcu

SEQ ID NO: 1658441 - RNA, 14 nt, Salmonella enterica enterica serovar Typhi
cgccgcgcguucca

SEQ ID NO: 1658442 - RNA, 14 nt, Salmonella enterica enterica serovar Typhi
cgccgcggccuccg

SEQ ID NO: 1658443 - RNA, 17 nt, Salmonella enterica enterica serovar Typhi
cgcggcguucugcgcca

SEQ ID NO: 1658444 - RNA, 22 nt, Salmonella enterica enterica serovar Typhi
cgcggccuccggaucgacagca

SEQ ID NO: 1658445 - RNA, 16 nt, Salmonella enterica enterica serovar Typhi
aacagcacgcccugcc

SEQ ID NO: 1658446 - RNA, 13 nt, Salmonella enterica enterica serovar Typhi
cgcgggcgguauu

SEQ ID NO: 1658447 - RNA, 14 nt, Salmonella enterica enterica serovar Typhi
cgcgggcggcguuu

SEQ ID NO: 1658448 - RNA, 20 nt, Salmonella enterica enterica serovar Typhi
cgcggggaucgguuuauccc

SEQ ID NO: 1658449 - RNA, 16 nt, Salmonella enterica enterica serovar Typhi
cgcgggcuucacguug

SEQ ID NO: 1658450 - RNA, 19 nt, Salmonella enterica enterica serovar Typhi
cgcguaaacgcaacaccau

SEQ ID NO: 1658451 - RNA, 17 nt, Salmonella enterica enterica serovar Typhi
cgcguaaacuuccgcca

SEQ ID NO: 1658452 - RNA, 15 nt, Salmonella enterica enterica serovar Typhi
cgcguacagcgccau

SEQ ID NO: 1658453 - RNA, 12 nt, Salmonella enterica enterica serovar Typhi
cgcguaccagcg

SEQ ID NO: 1658454 - RNA, 23 nt, Salmonella enterica enterica serovar Typhi
cgcguaauuugcgacauggcgac

SEQ ID NO: 1658455 - RNA, 21 nt, Salmonella enterica enterica serovar Typhi
cgcucguuauaauugcccgca

SEQ ID NO: 1658456 - RNA, 15 nt, Salmonella enterica enterica serovar Typhi
cgcucucagcgucgg

SEQ ID NO: 1658457 - RNA, 16 nt, Salmonella enterica enterica serovar Typhi
cgcucuauauccugcc

SEQ ID NO: 1658458 - RNA, 14 nt, Salmonella enterica enterica serovar Typhi
cgcucuuaccgcua

SEQ ID NO: 1658459 - RNA, 12 nt, Salmonella enterica enterica serovar Typhi
cgcucuuaccgc

SEQ ID NO: 1658460 - RNA, 14 nt, Salmonella enterica enterica serovar Typhi
cgcucuccggcaca

SEQ ID NO: 1658461 - RNA, 13 nt, Salmonella enterica enterica serovar Typhi
cgcucggcauaca

SEQ ID NO: 1658462 - RNA, 13 nt, Salmonella enterica enterica serovar Typhi
cgcucgcgccacg

SEQ ID NO: 1658463 - RNA, 18 nt, Salmonella enterica enterica serovar Typhi
cgcucgcggaagcgaccg

SEQ ID NO: 1658464 - RNA, 16 nt, Salmonella enterica enterica serovar Typhi
cgcuccagaccaccag

SEQ ID NO: 1658465 - RNA, 13 nt, Salmonella enterica enterica serovar Typhi
cgcucauuugcga

SEQ ID NO: 1658466 - RNA, 12 nt, Salmonella enterica enterica serovar Typhi
cgcuccagggcu

SEQ ID NO: 1658467 - RNA, 22 nt, Salmonella enterica enterica serovar Typhi
cgcucgauuugcccuuccagca

SEQ ID NO: 1658468 - RNA, 18 nt, Salmonella enterica enterica serovar Typhi
cgcgucacgaccggcgaa

SEQ ID NO: 1658469 - RNA, 17 nt, Salmonella enterica enterica serovar Typhi
cgcguuauagccgccaa

SEQ ID NO: 1658470 - RNA, 19 nt, Salmonella enterica enterica serovar Typhi
cgcgucuguguuuauccgg

SEQ ID NO: 1658471 - RNA, 17 nt, Salmonella enterica enterica serovar Typhi
cgcgucuucaucagcca

SEQ ID NO: 1658472 - RNA, 23 nt, Salmonella enterica enterica serovar Typhi
cgcguugacguuuaccugaacaa

SEQ ID NO: 1658473 - RNA, 12 nt, Salmonella enterica enterica serovar Typhi
cgcguugccgca

SEQ ID NO: 1658474 - RNA, 12 nt, Salmonella enterica enterica serovar Typhi
cgcguugccgcc

SEQ ID NO: 1658475 - RNA, 13 nt, Salmonella enterica enterica serovar Typhi
cgcguugccgccg

SEQ ID NO: 1658476 - RNA, 14 nt, Salmonella enterica enterica serovar Typhi
cgcguucuggcgau

SEQ ID NO: 1658477 - RNA, 12 nt, Salmonella enterica enterica serovar Typhi
cgcuauccagca

SEQ ID NO: 1658478 - RNA, 14 nt, Salmonella enterica enterica serovar Typhi
cgcuauccgcauau

SEQ ID NO: 1658479 - RNA, 13 nt, Salmonella enterica enterica serovar Typhi
cgcuauaucacgc

SEQ ID NO: 1658480 - RNA, 16 nt, Salmonella enterica enterica serovar Typhi
cgcuacgcuuaucagg

SEQ ID NO: 1658481 - RNA, 20 nt, Salmonella enterica enterica serovar Typhi
cgcuacguuuaucaggccua

SEQ ID NO: 1658482 - RNA, 15 nt, Salmonella enterica enterica serovar Typhi
cgcucaagcggcacc

SEQ ID NO: 1658483 - RNA, 18 nt, Salmonella enterica enterica serovar Typhi
cgcucaagcugggcguua

SEQ ID NO: 1658484 - RNA, 13 nt, Salmonella enterica enterica serovar Typhi
cgcucaaucagcg

SEQ ID NO: 1658485 - RNA, 20 nt, Salmonella enterica enterica serovar Typhi
cgcucaaauacgcgauaaaa

SEQ ID NO: 1658486 - RNA, 12 nt, Salmonella enterica enterica serovar Typhi
cgcuauuaccag

SEQ ID NO: 1658487 - RNA, 15 nt, Salmonella enterica enterica serovar Typhi
cgcuauuaccaguaa

SEQ ID NO: 1658488 - RNA, 23 nt, Salmonella enterica enterica serovar Typhi
cgcuauccgcgcucgccagcaua

SEQ ID NO: 1658489 - RNA, 12 nt, Salmonella enterica enterica serovar Typhi
cgcuaucgccaa

SEQ ID NO: 1658490 - RNA, 20 nt, Salmonella enterica enterica serovar Typhi
cgcuaucucuuccagcgucu

SEQ ID NO: 1658491 - RNA, 24 nt, Salmonella enterica enterica serovar Typhi
cgcuaucuuuuaacaaacgccagg

SEQ ID NO: 1658492 - RNA, 14 nt, Salmonella enterica enterica serovar Typhi
cgcuauccggcuuu

SEQ ID NO: 1658493 - RNA, 21 nt, Salmonella enterica enterica serovar Typhi
cgcuaucucuuccagcgucuc

SEQ ID NO: 1658494 - RNA, 19 nt, Salmonella enterica enterica serovar Typhi
cgcuaucuuugagcagaua

SEQ ID NO: 1658495 - RNA, 22 nt, Salmonella enterica enterica serovar Typhi
cgcucaugauucuugcggauua

SEQ ID NO: 1658496 - RNA, 15 nt, Salmonella enterica enterica serovar Typhi
cgcucaugccacgcc

SEQ ID NO: 1658497 - RNA, 16 nt, Salmonella enterica enterica serovar Typhi
cgcucacccgauaaaa

SEQ ID NO: 1658498 - RNA, 20 nt, Salmonella enterica enterica serovar Typhi
cgcgccugugaaacggcgga

SEQ ID NO: 1658499 - RNA, 19 nt, Salmonella enterica enterica serovar Typhi
cgcgccugccugacgccug

SEQ ID NO: 1658500 - RNA, 23 nt, Salmonella enterica enterica serovar Typhi
cgcgccugcgcuggaaucaucca

SEQ ID NO: 1658501 - RNA, 15 nt, Salmonella enterica enterica serovar Typhi
cgcgccuaccgccau

SEQ ID NO: 1658502 - RNA, 14 nt, Salmonella enterica enterica serovar Typhi
cgcgcgccggugau

SEQ ID NO: 1658503 - RNA, 13 nt, Salmonella enterica enterica serovar Typhi
cgcgcgcgcguca

SEQ ID NO: 1658504 - RNA, 19 nt, Salmonella enterica enterica serovar Typhi
cgcgcgcccaugcggcuga

SEQ ID NO: 1658505 - RNA, 19 nt, Salmonella enterica enterica serovar Typhi
cgcgcgccgcuuccggcag

SEQ ID NO: 1658506 - RNA, 17 nt, Salmonella enterica enterica serovar Typhi
cgcgcugccgcccuuuc

SEQ ID NO: 1658507 - RNA, 17 nt, Salmonella enterica enterica serovar Typhi
cgcgcugcugcggcguu

SEQ ID NO: 1658508 - RNA, 20 nt, Salmonella enterica enterica serovar Typhi
cgcgcugcggcgucugccuu

SEQ ID NO: 1658509 - RNA, 19 nt, Salmonella enterica enterica serovar Typhi
cgcggaagccacguucuuc

SEQ ID NO: 1658510 - RNA, 18 nt, Salmonella enterica enterica serovar Typhi
cgcgcuuuuuuggcguag

SEQ ID NO: 1658511 - RNA, 20 nt, Salmonella enterica enterica serovar Typhi
cgcgcuuuucgccagcgcau

SEQ ID NO: 1658512 - RNA, 19 nt, Salmonella enterica enterica serovar Typhi
cgcgcuuuuuuuacgccug

SEQ ID NO: 1658513 - RNA, 14 nt, Salmonella enterica enterica serovar Typhi
cgcgcguucaucca

SEQ ID NO: 1658514 - RNA, 13 nt, Salmonella enterica enterica serovar Typhi
cgcgcguauccgc

SEQ ID NO: 1658515 - RNA, 16 nt, Salmonella enterica enterica serovar Typhi
cgcgcuaucgguauca

SEQ ID NO: 1658516 - RNA, 15 nt, Salmonella enterica enterica serovar Typhi
cgcgcgguuuauccc

SEQ ID NO: 1658517 - RNA, 14 nt, Salmonella enterica enterica serovar Typhi
cgcgcggugaaagu

SEQ ID NO: 1658518 - RNA, 19 nt, Salmonella enterica enterica serovar Typhi
cgcgccaaagauaagaccg

SEQ ID NO: 1658519 - RNA, 16 nt, Salmonella enterica enterica serovar Typhi
cgcgccaauaacgcau

SEQ ID NO: 1658520 - RNA, 19 nt, Salmonella enterica enterica serovar Typhi
cgcgcauggcagggcgaua

SEQ ID NO: 1658521 - RNA, 22 nt, Salmonella enterica enterica serovar Typhi
cgcgccaguuuggugaugcgau

SEQ ID NO: 1658522 - RNA, 18 nt, Salmonella enterica enterica serovar Typhi
cgcgcaguacggcgcaca

SEQ ID NO: 1658523 - RNA, 22 nt, Salmonella enterica enterica serovar Typhi
cgcgcaucuucacuguuaucgc

SEQ ID NO: 1658524 - RNA, 14 nt, Salmonella enterica enterica serovar Typhi
cgcgccgccgccug

SEQ ID NO: 1658525 - RNA, 11 nt, Salmonella enterica enterica serovar Typhi
cgcgccggcaa

SEQ ID NO: 1658526 - RNA, 17 nt, Salmonella enterica enterica serovar Typhi
cgcgccggucgccagca

SEQ ID NO: 1658527 - RNA, 20 nt, Salmonella enterica enterica serovar Typhi
cgcgccauacuuacugcugu

SEQ ID NO: 1658528 - RNA, 14 nt, Salmonella enterica enterica serovar Typhi
cgccugcugccugc

SEQ ID NO: 1658529 - RNA, 20 nt, Salmonella enterica enterica serovar Typhi
cgcgacgcuuaucagcccua

SEQ ID NO: 1658530 - RNA, 13 nt, Salmonella enterica enterica serovar Typhi
cgcgacggcagcc

SEQ ID NO: 1658531 - RNA, 17 nt, Salmonella enterica enterica serovar Typhi
cgcgacggaccggcagc

SEQ ID NO: 1658532 - RNA, 16 nt, Salmonella enterica enterica serovar Typhi
cgcgacuuaucuucca

SEQ ID NO: 1658533 - RNA, 21 nt, Salmonella enterica enterica serovar Typhi
cgcgacuuaucuuccacgccg

SEQ ID NO: 1658534 - RNA, 21 nt, Salmonella enterica enterica serovar Typhi
cgcgacuggaacgucaucauu

SEQ ID NO: 1658535 - RNA, 14 nt, Salmonella enterica enterica serovar Typhi
cgcgauacugccgc

SEQ ID NO: 1658536 - RNA, 20 nt, Salmonella enterica enterica serovar Typhi
cgcgauacgcagcaccgccg

SEQ ID NO: 1658537 - RNA, 15 nt, Salmonella enterica enterica serovar Typhi
cgcgauacccgcgau

SEQ ID NO: 1658538 - RNA, 21 nt, Salmonella enterica enterica serovar Typhi
cgcgauacccgcgaucacuac

SEQ ID NO: 1658539 - RNA, 23 nt, Salmonella enterica enterica serovar Typhi
cgcgagaccaucgcgugacgcag

SEQ ID NO: 1658540 - RNA, 21 nt, Salmonella enterica enterica serovar Typhi
cgcgauaaaaaacgcccagau

SEQ ID NO: 1658541 - RNA, 17 nt, Salmonella enterica enterica serovar Typhi
cgcgcaauaugcggcgc

SEQ ID NO: 1658542 - RNA, 16 nt, Salmonella enterica enterica serovar Typhi
cgcgaugccuggcgau

SEQ ID NO: 1658543 - RNA, 14 nt, Salmonella enterica enterica serovar Typhi
cgcgauggcgucac

SEQ ID NO: 1658544 - RNA, 17 nt, Salmonella enterica enterica serovar Typhi
cgcgauauuacuccagc

SEQ ID NO: 1658545 - RNA, 15 nt, Salmonella enterica enterica serovar Typhi
cgcgaugacucguau

SEQ ID NO: 1658546 - RNA, 18 nt, Salmonella enterica enterica serovar Typhi
cgcgaugagcugcgauaa

SEQ ID NO: 1658547 - RNA, 19 nt, Salmonella enterica enterica serovar Typhi
cggccuucgcagaucgccu

SEQ ID NO: 1658548 - RNA, 14 nt, Salmonella enterica enterica serovar Typhi
cggccugacgcagc

SEQ ID NO: 1658549 - RNA, 15 nt, Salmonella enterica enterica serovar Typhi
cggccuccgcuuccu

SEQ ID NO: 1658550 - RNA, 15 nt, Salmonella enterica enterica serovar Typhi
cggcauguccggcga

SEQ ID NO: 1658551 - RNA, 18 nt, Salmonella enterica enterica serovar Typhi
cggcaugucgccagccag

SEQ ID NO: 1658552 - RNA, 19 nt, Salmonella enterica enterica serovar Typhi
cggcauuaugcaggcgucg

SEQ ID NO: 1658553 - RNA, 17 nt, Salmonella enterica enterica serovar Typhi
cggccacaauugccagc

SEQ ID NO: 1658554 - RNA, 17 nt, Salmonella enterica enterica serovar Typhi
cggccacagcgccagac

SEQ ID NO: 1658555 - RNA, 13 nt, Salmonella enterica enterica serovar Typhi
cggccacagccau

SEQ ID NO: 1658556 - RNA, 14 nt, Salmonella enterica enterica serovar Typhi
cggccaccaggccu

SEQ ID NO: 1658557 - RNA, 18 nt, Salmonella enterica enterica serovar Typhi
cggccacccauccccaua

SEQ ID NO: 1658558 - RNA, 12 nt, Salmonella enterica enterica serovar Typhi
cggcaggcacua

SEQ ID NO: 1658559 - RNA, 15 nt, Salmonella enterica enterica serovar Typhi
cggcaggcagcgcca

SEQ ID NO: 1658560 - RNA, 16 nt, Salmonella enterica enterica serovar Typhi
cggcaggcagcgccag

SEQ ID NO: 1658561 - RNA, 23 nt, Salmonella enterica enterica serovar Typhi
cggcagguagucauauucacggc

SEQ ID NO: 1658562 - RNA, 15 nt, Salmonella enterica enterica serovar Typhi
cggcaucacgccggu

SEQ ID NO: 1658563 - RNA, 11 nt, Salmonella enterica enterica serovar Typhi
cggcaucacgc

SEQ ID NO: 1658564 - RNA, 17 nt, Salmonella enterica enterica serovar Typhi
cggcauaugcaggucgc

SEQ ID NO: 1658565 - RNA, 18 nt, Salmonella enterica enterica serovar Typhi
cggcauauucccugacug

SEQ ID NO: 1658566 - RNA, 16 nt, Salmonella enterica enterica serovar Typhi
aacaucuuugccacgu

SEQ ID NO: 1658567 - RNA, 15 nt, Salmonella enterica enterica serovar Typhi
cggccacgguguggc

SEQ ID NO: 1658568 - RNA, 17 nt, Salmonella enterica enterica serovar Typhi
cggccacuccgccacaa

SEQ ID NO: 1658569 - RNA, 23 nt, Salmonella enterica enterica serovar Typhi
cggccagacaauacuuaaaccug

SEQ ID NO: 1658570 - RNA, 21 nt, Salmonella enterica enterica serovar Typhi
cggccagauaaguuugcagau

SEQ ID NO: 1658571 - RNA, 15 nt, Salmonella enterica enterica serovar Typhi
cggauauuacccggc

SEQ ID NO: 1658572 - RNA, 16 nt, Salmonella enterica enterica serovar Typhi
cggaucaccggcauuu

SEQ ID NO: 1658573 - RNA, 21 nt, Salmonella enterica enterica serovar Typhi
cggaucacggccuucgcagau

SEQ ID NO: 1658574 - RNA, 14 nt, Salmonella enterica enterica serovar Typhi
cggauaaggcgcuu

SEQ ID NO: 1658575 - RNA, 20 nt, Salmonella enterica enterica serovar Typhi
cggauaaggcggagccgcca

SEQ ID NO: 1658576 - RNA, 11 nt, Salmonella enterica enterica serovar Typhi
cggauaagcgu

SEQ ID NO: 1658577 - RNA, 19 nt, Salmonella enterica enterica serovar Typhi
cggauaagcgugagcgcau

SEQ ID NO: 1658578 - RNA, 22 nt, Salmonella enterica enterica serovar Typhi
cggauacggcugucaggagcca

SEQ ID NO: 1658579 - RNA, 16 nt, Salmonella enterica enterica serovar Typhi
cggauagcguagcgcc

SEQ ID NO: 1658580 - RNA, 21 nt, Salmonella enterica enterica serovar Typhi
cggauagcucgcuguagcgcc

SEQ ID NO: 1658581 - RNA, 22 nt, Salmonella enterica enterica serovar Typhi
cggauagcggcuucgccagauc

SEQ ID NO: 1658582 - RNA, 15 nt, Salmonella enterica enterica serovar Typhi
cggagucuuauccga

SEQ ID NO: 1658583 - RNA, 15 nt, Salmonella enterica enterica serovar Typhi
cggagugcgcggcga

SEQ ID NO: 1658584 - RNA, 16 nt, Salmonella enterica enterica serovar Typhi
cggauaagcauagcgu

SEQ ID NO: 1658585 - RNA, 19 nt, Salmonella enterica enterica serovar Typhi
cggauaagcauuagcgcca

SEQ ID NO: 1658586 - RNA, 14 nt, Salmonella enterica enterica serovar Typhi
cggauaagcccggc

SEQ ID NO: 1658587 - RNA, 18 nt, Salmonella enterica enterica serovar Typhi
cggauaagcgcagcgcca

SEQ ID NO: 1658588 - RNA, 19 nt, Salmonella enterica enterica serovar Typhi
cggauaagcgcagcgccau

SEQ ID NO: 1658589 - RNA, 18 nt, Salmonella enterica enterica serovar Typhi
cggauaagcggcagcgcc

SEQ ID NO: 1658590 - RNA, 19 nt, Salmonella enterica enterica serovar Typhi
cggauaagcggcagcgcca

SEQ ID NO: 1658591 - RNA, 20 nt, Salmonella enterica enterica serovar Typhi
cggauaagcggcagcgccau

SEQ ID NO: 1658592 - RNA, 14 nt, Salmonella enterica enterica serovar Typhi
cggauaacgcgcug

SEQ ID NO: 1658593 - RNA, 17 nt, Salmonella enterica enterica serovar Typhi
cggauaaacgcugcgca

SEQ ID NO: 1658594 - RNA, 13 nt, Salmonella enterica enterica serovar Typhi
cggauaacgcgcu

SEQ ID NO: 1658595 - RNA, 20 nt, Salmonella enterica enterica serovar Typhi
cggauaacgacgacgcagcu

SEQ ID NO: 1658596 - RNA, 17 nt, Salmonella enterica enterica serovar Typhi
cggagcguucaugcugg

SEQ ID NO: 1658597 - RNA, 18 nt, Salmonella enterica enterica serovar Typhi
cggagcggcguccgccag

SEQ ID NO: 1658598 - RNA, 14 nt, Salmonella enterica enterica serovar Typhi
cggagaacggcaca

SEQ ID NO: 1658599 - RNA, 21 nt, Salmonella enterica enterica serovar Typhi
cggagaacgguucauccagca

SEQ ID NO: 1658600 - RNA, 16 nt, Salmonella enterica enterica serovar Typhi
cggagccaauaaucaa

SEQ ID NO: 1658601 - RNA, 20 nt, Salmonella enterica enterica serovar Typhi
cggagauuaacagcgcgacc

SEQ ID NO: 1658602 - RNA, 23 nt, Salmonella enterica enterica serovar Typhi
cggagauacccuuaugauagccg

SEQ ID NO: 1658603 - RNA, 13 nt, Salmonella enterica enterica serovar Typhi
cggacugcgggga

SEQ ID NO: 1658604 - RNA, 21 nt, Salmonella enterica enterica serovar Typhi
cggacugauagcgaggcagca

SEQ ID NO: 1658605 - RNA, 19 nt, Salmonella enterica enterica serovar Typhi
cggacgaacaacaucagac

SEQ ID NO: 1658606 - RNA, 20 nt, Salmonella enterica enterica serovar Typhi
cggacgagcgcgucagcgcc

SEQ ID NO: 1658607 - RNA, 14 nt, Salmonella enterica enterica serovar Typhi
cggacgcaccagcc

SEQ ID NO: 1658608 - RNA, 20 nt, Salmonella enterica enterica serovar Typhi
cggacgccgggugaucgucg

SEQ ID NO: 1658609 - RNA, 21 nt, Salmonella enterica enterica serovar Typhi
cgcugagcggcucauccagca

SEQ ID NO: 1658610 - RNA, 20 nt, Salmonella enterica enterica serovar Typhi
cgcugagcggcucauccagc

SEQ ID NO: 1658611 - RNA, 20 nt, Salmonella enterica enterica serovar Typhi
cggacaucauccccggcagg

SEQ ID NO: 1658612 - RNA, 18 nt, Salmonella enterica enterica serovar Typhi
cgcugaauagcgcugcgg

SEQ ID NO: 1658613 - RNA, 17 nt, Salmonella enterica enterica serovar Typhi
cggcaaauaccgucaua

SEQ ID NO: 1658614 - RNA, 16 nt, Salmonella enterica enterica serovar Typhi
cggcaaauccuccaua

SEQ ID NO: 1658615 - RNA, 12 nt, Salmonella enterica enterica serovar Typhi
cggcaacccgcu

SEQ ID NO: 1658616 - RNA, 22 nt, Salmonella enterica enterica serovar Typhi
cggcaagagauucaggccgcca

SEQ ID NO: 1658617 - RNA, 15 nt, Salmonella enterica enterica serovar Typhi
cggcaagaucauccg

SEQ ID NO: 1658618 - RNA, 18 nt, Salmonella enterica enterica serovar Typhi
cggcaaggucugcgccca

SEQ ID NO: 1658619 - RNA, 17 nt, Salmonella enterica enterica serovar Typhi
cggcaagcaucugauau

SEQ ID NO: 1658620 - RNA, 20 nt, Salmonella enterica enterica serovar Typhi
cggcaaugcucugcagguca

SEQ ID NO: 1658621 - RNA, 16 nt, Salmonella enterica enterica serovar Typhi
cggcaauauugccgca

SEQ ID NO: 1658622 - RNA, 13 nt, Salmonella enterica enterica serovar Typhi
cggcaaucaauac

SEQ ID NO: 1658623 - RNA, 15 nt, Salmonella enterica enterica serovar Typhi
cggcaauuuccggcg

SEQ ID NO: 1658624 - RNA, 20 nt, Salmonella enterica enterica serovar Typhi
cggcacaaugcccggcauac

SEQ ID NO: 1658625 - RNA, 16 nt, Salmonella enterica enterica serovar Typhi
cggcaauuuccggcga

SEQ ID NO: 1658626 - RNA, 15 nt, Salmonella enterica enterica serovar Typhi
cggcaauuaccgcca

SEQ ID NO: 1658627 - RNA, 23 nt, Salmonella enterica enterica serovar Typhi
cggcaccacgcacaguacgcccg

SEQ ID NO: 1658628 - RNA, 17 nt, Salmonella enterica enterica serovar Typhi
aacagguugcguaacgc

SEQ ID NO: 1658629 - RNA, 19 nt, Salmonella enterica enterica serovar Typhi
cggcaccauuggcgcguca

SEQ ID NO: 1658630 - RNA, 19 nt, Salmonella enterica enterica serovar Typhi
cggcaaaccuaccggcaua

SEQ ID NO: 1658631 - RNA, 17 nt, Salmonella enterica enterica serovar Typhi
cggcaaacauagccuca

SEQ ID NO: 1658632 - RNA, 17 nt, Salmonella enterica enterica serovar Typhi
cggcaaagguugccgca

SEQ ID NO: 1658633 - RNA, 20 nt, Salmonella enterica enterica serovar Typhi
cggcaaagguugccgcaaua

SEQ ID NO: 1658634 - RNA, 20 nt, Salmonella enterica enterica serovar Typhi
cggcaaaauaguucagcgca

SEQ ID NO: 1658635 - RNA, 15 nt, Salmonella enterica enterica serovar Typhi
cggcaaacagcuuca

SEQ ID NO: 1658636 - RNA, 16 nt, Salmonella enterica enterica serovar Typhi
cggauucaauauugaa

SEQ ID NO: 1658637 - RNA, 19 nt, Salmonella enterica enterica serovar Typhi
cggauucgacugcggucgu

SEQ ID NO: 1658638 - RNA, 22 nt, Salmonella enterica enterica serovar Typhi
cggauucucuaacgucagcgcc

SEQ ID NO: 1658639 - RNA, 20 nt, Salmonella enterica enterica serovar Typhi
cggauucuucgaugaugccg

SEQ ID NO: 1658640 - RNA, 22 nt, Salmonella enterica enterica serovar Typhi
cggauugccgcgcucaaucuga

SEQ ID NO: 1658641 - RNA, 20 nt, Salmonella enterica enterica serovar Typhi
cggauuaagcgaauccagcg

SEQ ID NO: 1658642 - RNA, 17 nt, Salmonella enterica enterica serovar Typhi
cggauuaaaacgcauac

SEQ ID NO: 1658643 - RNA, 22 nt, Salmonella enterica enterica serovar Typhi
cggauuaagcgaauccagcgcc

SEQ ID NO: 1658644 - RNA, 18 nt, Salmonella enterica enterica serovar Typhi
cggauuagcgacagcgcu

SEQ ID NO: 1658645 - RNA, 20 nt, Salmonella enterica enterica serovar Typhi
cggauggcaguacagggcga

SEQ ID NO: 1658646 - RNA, 14 nt, Salmonella enterica enterica serovar Typhi
cggauggcggcgca

SEQ ID NO: 1658647 - RNA, 15 nt, Salmonella enterica enterica serovar Typhi
cggaucggaacgcga

SEQ ID NO: 1658648 - RNA, 12 nt, Salmonella enterica enterica serovar Typhi
cggaucgcguuu

SEQ ID NO: 1658649 - RNA, 19 nt, Salmonella enterica enterica serovar Typhi
cggaucgcaagauccugau

SEQ ID NO: 1658650 - RNA, 19 nt, Salmonella enterica enterica serovar Typhi
cggaucgcgcggaucgucg

SEQ ID NO: 1658651 - RNA, 23 nt, Salmonella enterica enterica serovar Typhi
cggaucgcggcccucuaagcgcu

SEQ ID NO: 1658652 - RNA, 15 nt, Salmonella enterica enterica serovar Typhi
cggaucgaucccggc

SEQ ID NO: 1658653 - RNA, 19 nt, Salmonella enterica enterica serovar Typhi
cggaucgaucucgauauuc

SEQ ID NO: 1658654 - RNA, 11 nt, Salmonella enterica enterica serovar Typhi
cggaucgggcu

SEQ ID NO: 1658655 - RNA, 16 nt, Salmonella enterica enterica serovar Typhi
cggcgaaaccgauuuc

SEQ ID NO: 1658656 - RNA, 19 nt, Salmonella enterica enterica serovar Typhi
cggcgauggugcggcgcac

SEQ ID NO: 1658657 - RNA, 16 nt, Salmonella enterica enterica serovar Typhi
cggcgccaucaaucca

SEQ ID NO: 1658658 - RNA, 14 nt, Salmonella enterica enterica serovar Typhi
cggcgccaucacca

SEQ ID NO: 1658659 - RNA, 15 nt, Salmonella enterica enterica serovar Typhi
cggcgccaucaccau

SEQ ID NO: 1658660 - RNA, 15 nt, Salmonella enterica enterica serovar Typhi
cggcggcaaugccgc

SEQ ID NO: 1658661 - RNA, 18 nt, Salmonella enterica enterica serovar Typhi
cggcggcaagcuggcgaa

SEQ ID NO: 1658662 - RNA, 22 nt, Salmonella enterica enterica serovar Typhi
cggcggaaccauuuuccccaga

SEQ ID NO: 1658663 - RNA, 23 nt, Salmonella enterica enterica serovar Typhi
cggcggaaccauuuuccccagaa

SEQ ID NO: 1658664 - RNA, 19 nt, Salmonella enterica enterica serovar Typhi
cggcgcugaugacgcgccg

SEQ ID NO: 1658665 - RNA, 22 nt, Salmonella enterica enterica serovar Typhi
cggcgcuguacggacauugacc

SEQ ID NO: 1658666 - RNA, 22 nt, Salmonella enterica enterica serovar Typhi
cggcggaaaauagccagaaugc

SEQ ID NO: 1658667 - RNA, 16 nt, Salmonella enterica enterica serovar Typhi
cggcgcgguuuccggu

SEQ ID NO: 1658668 - RNA, 20 nt, Salmonella enterica enterica serovar Typhi
cggcgcgggugaugacgcgc

SEQ ID NO: 1658669 - RNA, 23 nt, Salmonella enterica enterica serovar Typhi
cggcgcgacuuuaaucaccugcc

SEQ ID NO: 1658670 - RNA, 18 nt, Salmonella enterica enterica serovar Typhi
cggcguagcgcguucagg

SEQ ID NO: 1658671 - RNA, 20 nt, Salmonella enterica enterica serovar Typhi
cggcguagcgcguucagggu

SEQ ID NO: 1658672 - RNA, 15 nt, Salmonella enterica enterica serovar Typhi
cggcguagccgccga

SEQ ID NO: 1658673 - RNA, 21 nt, Salmonella enterica enterica serovar Typhi
cggcgguuauccgccagcgca

SEQ ID NO: 1658674 - RNA, 22 nt, Salmonella enterica enterica serovar Typhi
cggcgggcggaaagcauucgca

SEQ ID NO: 1658675 - RNA, 22 nt, Salmonella enterica enterica serovar Typhi
cgggcuggccggcgcaauguuc

SEQ ID NO: 1658676 - RNA, 15 nt, Salmonella enterica enterica serovar Typhi
cgggcugcacgccau

SEQ ID NO: 1658677 - RNA, 15 nt, Salmonella enterica enterica serovar Typhi
cgggcucacgcuggu

SEQ ID NO: 1658678 - RNA, 16 nt, Salmonella enterica enterica serovar Typhi
cgggccugugccugac

SEQ ID NO: 1658679 - RNA, 19 nt, Salmonella enterica enterica serovar Typhi
cgggcgcuaaacccaacgu

SEQ ID NO: 1658680 - RNA, 15 nt, Salmonella enterica enterica serovar Typhi
cgggcgauaaccucu

SEQ ID NO: 1658681 - RNA, 13 nt, Salmonella enterica enterica serovar Typhi
cggggaucgguuu

SEQ ID NO: 1658682 - RNA, 15 nt, Salmonella enterica enterica serovar Typhi
cggggauggcggauu

SEQ ID NO: 1658683 - RNA, 18 nt, Salmonella enterica enterica serovar Typhi
cgggguaguuaucacguu

SEQ ID NO: 1658684 - RNA, 20 nt, Salmonella enterica enterica serovar Typhi
cggguaagcguaagcgucac

SEQ ID NO: 1658685 - RNA, 21 nt, Salmonella enterica enterica serovar Typhi
cggguaaggcgaagucgccac

SEQ ID NO: 1658686 - RNA, 18 nt, Salmonella enterica enterica serovar Typhi
cgggaaagggcggcagcg

SEQ ID NO: 1658687 - RNA, 19 nt, Salmonella enterica enterica serovar Typhi
cgggaaacuguuugaacga

SEQ ID NO: 1658688 - RNA, 17 nt, Salmonella enterica enterica serovar Typhi
cggcuuuaaugccgccg

SEQ ID NO: 1658689 - RNA, 15 nt, Salmonella enterica enterica serovar Typhi
cggcuuguuaugcgg

SEQ ID NO: 1658690 - RNA, 13 nt, Salmonella enterica enterica serovar Typhi
cggcuguucacgu

SEQ ID NO: 1658691 - RNA, 13 nt, Salmonella enterica enterica serovar Typhi
cggcuggcuauag

SEQ ID NO: 1658692 - RNA, 22 nt, Salmonella enterica enterica serovar Typhi
cggcugggccggugcagcaggu

SEQ ID NO: 1658693 - RNA, 16 nt, Salmonella enterica enterica serovar Typhi
cggcgugguagcguca

SEQ ID NO: 1658694 - RNA, 12 nt, Salmonella enterica enterica serovar Typhi
cggcugaagcug

SEQ ID NO: 1658695 - RNA, 19 nt, Salmonella enterica enterica serovar Typhi
cggcugacacucauccaga

SEQ ID NO: 1658696 - RNA, 20 nt, Salmonella enterica enterica serovar Typhi
cggcugacgcccaucagcau

SEQ ID NO: 1658697 - RNA, 21 nt, Salmonella enterica enterica serovar Typhi
cggcugaggcuuugagcguca

SEQ ID NO: 1658698 - RNA, 18 nt, Salmonella enterica enterica serovar Typhi
cgggacuuuaaacgucau

SEQ ID NO: 1658699 - RNA, 15 nt, Salmonella enterica enterica serovar Typhi
cgggacuucaggcau

SEQ ID NO: 1658700 - RNA, 17 nt, Salmonella enterica enterica serovar Typhi
cgggacguuucgauaac

SEQ ID NO: 1658701 - RNA, 19 nt, Salmonella enterica enterica serovar Typhi
cgggacggcggccagcauu

SEQ ID NO: 1658702 - RNA, 21 nt, Salmonella enterica enterica serovar Typhi
aacaugccugauggcgcugcg

SEQ ID NO: 1658703 - RNA, 22 nt, Salmonella enterica enterica serovar Typhi
aacaugccugauggcgcugcgc

SEQ ID NO: 1658704 - RNA, 22 nt, Salmonella enterica enterica serovar Typhi
cgggauguuaauuucaucgccg

SEQ ID NO: 1658705 - RNA, 20 nt, Salmonella enterica enterica serovar Typhi
cgggauugccgccgcgcugg

SEQ ID NO: 1658706 - RNA, 17 nt, Salmonella enterica enterica serovar Typhi
cgggcagacaucgccgu

SEQ ID NO: 1658707 - RNA, 15 nt, Salmonella enterica enterica serovar Typhi
cgggccauucgccau

SEQ ID NO: 1658708 - RNA, 13 nt, Salmonella enterica enterica serovar Typhi
cgacggggcguua

SEQ ID NO: 1658709 - RNA, 23 nt, Salmonella enterica enterica serovar Typhi
cgacgcauugagacaugccgcca

SEQ ID NO: 1658710 - RNA, 14 nt, Salmonella enterica enterica serovar Typhi
cgacgccagccgga

SEQ ID NO: 1658711 - RNA, 13 nt, Salmonella enterica enterica serovar Typhi
cgacgccagccag

SEQ ID NO: 1658712 - RNA, 23 nt, Salmonella enterica enterica serovar Typhi
cgacgccagcgggugaucgcuug

SEQ ID NO: 1658713 - RNA, 14 nt, Salmonella enterica enterica serovar Typhi
cgacgcuguuuaug

SEQ ID NO: 1658714 - RNA, 14 nt, Salmonella enterica enterica serovar Typhi
cgacgcuucacgua

SEQ ID NO: 1658715 - RNA, 12 nt, Salmonella enterica enterica serovar Typhi
cgacggaaguca

SEQ ID NO: 1658716 - RNA, 20 nt, Salmonella enterica enterica serovar Typhi
cgacggaguggaugacaucg

SEQ ID NO: 1658717 - RNA, 17 nt, Salmonella enterica enterica serovar Typhi
cgacggcgaccggcaaa

SEQ ID NO: 1658718 - RNA, 14 nt, Salmonella enterica enterica serovar Typhi
cgacggccauaaac

SEQ ID NO: 1658719 - RNA, 16 nt, Salmonella enterica enterica serovar Typhi
aacacaaucaggcgca

SEQ ID NO: 1658720 - RNA, 13 nt, Salmonella enterica enterica serovar Typhi
cgacuaccgccga

SEQ ID NO: 1658721 - RNA, 15 nt, Salmonella enterica enterica serovar Typhi
cgacugaccagacag

SEQ ID NO: 1658722 - RNA, 22 nt, Salmonella enterica enterica serovar Typhi
cgagagauuaagcgaaccuuaa

SEQ ID NO: 1658723 - RNA, 14 nt, Salmonella enterica enterica serovar Typhi
cgagcaauaacgug

SEQ ID NO: 1658724 - RNA, 14 nt, Salmonella enterica enterica serovar Typhi
cgacugccgcagac

SEQ ID NO: 1658725 - RNA, 14 nt, Salmonella enterica enterica serovar Typhi
cgagaaugucgcca

SEQ ID NO: 1658726 - RNA, 15 nt, Salmonella enterica enterica serovar Typhi
cgagaagucggcuuu

SEQ ID NO: 1658727 - RNA, 21 nt, Salmonella enterica enterica serovar Typhi
cgagaacugcugcauccgcgc

SEQ ID NO: 1658728 - RNA, 22 nt, Salmonella enterica enterica serovar Typhi
cgagaagcccagcucauaggau

SEQ ID NO: 1658729 - RNA, 15 nt, Salmonella enterica enterica serovar Typhi
cgagacugcccggca

SEQ ID NO: 1658730 - RNA, 19 nt, Salmonella enterica enterica serovar Typhi
cgacgaucagcgccacgca

SEQ ID NO: 1658731 - RNA, 15 nt, Salmonella enterica enterica serovar Typhi
cgacgaucagcgcca

SEQ ID NO: 1658732 - RNA, 21 nt, Salmonella enterica enterica serovar Typhi
cgaccuguucaaaauugccac

SEQ ID NO: 1658733 - RNA, 19 nt, Salmonella enterica enterica serovar Typhi
cgaccuguagaugaaacuc

SEQ ID NO: 1658734 - RNA, 15 nt, Salmonella enterica enterica serovar Typhi
cgaccggcagcguca

SEQ ID NO: 1658735 - RNA, 15 nt, Salmonella enterica enterica serovar Typhi
cgaccgucagcagca

SEQ ID NO: 1658736 - RNA, 14 nt, Salmonella enterica enterica serovar Typhi
cgaccguauccgcc

SEQ ID NO: 1658737 - RNA, 15 nt, Salmonella enterica enterica serovar Typhi
cgacaaaaagcgcgc

SEQ ID NO: 1658738 - RNA, 15 nt, Salmonella enterica enterica serovar Typhi
cgaauuuaaauagca

SEQ ID NO: 1658739 - RNA, 23 nt, Salmonella enterica enterica serovar Typhi
cgacauauuugcgugucaucaaa

SEQ ID NO: 1658740 - RNA, 14 nt, Salmonella enterica enterica serovar Typhi
cgacaaccagcgaa

SEQ ID NO: 1658741 - RNA, 12 nt, Salmonella enterica enterica serovar Typhi
cgacauacgcgc

SEQ ID NO: 1658742 - RNA, 15 nt, Salmonella enterica enterica serovar Typhi
cgacauaaccggcaa

SEQ ID NO: 1658743 - RNA, 17 nt, Salmonella enterica enterica serovar Typhi
cgacaugcuccugcauc

SEQ ID NO: 1658744 - RNA, 14 nt, Salmonella enterica enterica serovar Typhi
cgacaugcgcaugu

SEQ ID NO: 1658745 - RNA, 14 nt, Salmonella enterica enterica serovar Typhi
cgacauuagcgagu

SEQ ID NO: 1658746 - RNA, 14 nt, Salmonella enterica enterica serovar Typhi
cgacccaccugacu

SEQ ID NO: 1658747 - RNA, 19 nt, Salmonella enterica enterica serovar Typhi
cgaccaugacggguaacgc

SEQ ID NO: 1658748 - RNA, 17 nt, Salmonella enterica enterica serovar Typhi
cgaccagcgucagccag

SEQ ID NO: 1658749 - RNA, 18 nt, Salmonella enterica enterica serovar Typhi
cgaccacggccacagcca

SEQ ID NO: 1658750 - RNA, 20 nt, Salmonella enterica enterica serovar Typhi
cgaccacccgcgaccagguc

SEQ ID NO: 1658751 - RNA, 20 nt, Salmonella enterica enterica serovar Typhi
cgaccacauuauagauguca

SEQ ID NO: 1658752 - RNA, 21 nt, Salmonella enterica enterica serovar Typhi
ccugucguccucaggccggau

SEQ ID NO: 1658753 - RNA, 21 nt, Salmonella enterica enterica serovar Typhi
ccugugaaguaaaaaaaccgu

SEQ ID NO: 1658754 - RNA, 16 nt, Salmonella enterica enterica serovar Typhi
ccugugccgcuggugc

SEQ ID NO: 1658755 - RNA, 13 nt, Salmonella enterica enterica serovar Typhi
ccuguucaucggc

SEQ ID NO: 1658756 - RNA, 14 nt, Salmonella enterica enterica serovar Typhi
ccuguuagggcgcg

SEQ ID NO: 1658757 - RNA, 18 nt, Salmonella enterica enterica serovar Typhi
ccuguuucugcgccgcuu

SEQ ID NO: 1658758 - RNA, 20 nt, Salmonella enterica enterica serovar Typhi
ccuuaaucaacugcgccaca

SEQ ID NO: 1658759 - RNA, 14 nt, Salmonella enterica enterica serovar Typhi
ccuuacaggcgcau

SEQ ID NO: 1658760 - RNA, 17 nt, Salmonella enterica enterica serovar Typhi
ccuucacucuucgacau

SEQ ID NO: 1658761 - RNA, 19 nt, Salmonella enterica enterica serovar Typhi
ccuuauuuuucagcgccag

SEQ ID NO: 1658762 - RNA, 22 nt, Salmonella enterica enterica serovar Typhi
ccuucaacccagcagcagauaa

SEQ ID NO: 1658763 - RNA, 22 nt, Salmonella enterica enterica serovar Typhi
ccuuauacaggcgcagggcauu

SEQ ID NO: 1658764 - RNA, 13 nt, Salmonella enterica enterica serovar Typhi
ccuucguccggau

SEQ ID NO: 1658765 - RNA, 19 nt, Salmonella enterica enterica serovar Typhi
ccuucguuauaaggccugc

SEQ ID NO: 1658766 - RNA, 18 nt, Salmonella enterica enterica serovar Typhi
ccuucgucaggaggccug

SEQ ID NO: 1658767 - RNA, 22 nt, Salmonella enterica enterica serovar Typhi
ccuucugugaaaguuucaggau

SEQ ID NO: 1658768 - RNA, 15 nt, Salmonella enterica enterica serovar Typhi
ccuucuucgccguca

SEQ ID NO: 1658769 - RNA, 15 nt, Salmonella enterica enterica serovar Typhi
ccuugaccgccugau

SEQ ID NO: 1658770 - RNA, 15 nt, Salmonella enterica enterica serovar Typhi
ccuucuuuaugcgcc

SEQ ID NO: 1658771 - RNA, 21 nt, Salmonella enterica enterica serovar Typhi
ccuucagugauaaagcacagc

SEQ ID NO: 1658772 - RNA, 15 nt, Salmonella enterica enterica serovar Typhi
ccuucauacugcgga

SEQ ID NO: 1658773 - RNA, 15 nt, Salmonella enterica enterica serovar Typhi
ccuucaucaguaacu

SEQ ID NO: 1658774 - RNA, 18 nt, Salmonella enterica enterica serovar Typhi
ccuuccaguaguaaaccg

SEQ ID NO: 1658775 - RNA, 22 nt, Salmonella enterica enterica serovar Typhi
ccuuccaggcggugaagacgac

SEQ ID NO: 1658776 - RNA, 19 nt, Salmonella enterica enterica serovar Typhi
ccuucgccgccgcugaauu

SEQ ID NO: 1658777 - RNA, 17 nt, Salmonella enterica enterica serovar Typhi
ccuuccggccacuccgc

SEQ ID NO: 1658778 - RNA, 13 nt, Salmonella enterica enterica serovar Typhi
cgaaaccagcaua

SEQ ID NO: 1658779 - RNA, 19 nt, Salmonella enterica enterica serovar Typhi
cgaaagcacuucucgcgca

SEQ ID NO: 1658780 - RNA, 15 nt, Salmonella enterica enterica serovar Typhi
cgaaacuccagcgau

SEQ ID NO: 1658781 - RNA, 13 nt, Salmonella enterica enterica serovar Typhi
cgaaacggcggaa

SEQ ID NO: 1658782 - RNA, 16 nt, Salmonella enterica enterica serovar Typhi
cgaaaaggccuggcug

SEQ ID NO: 1658783 - RNA, 18 nt, Salmonella enterica enterica serovar Typhi
cgaaaacagcuggcgaua

SEQ ID NO: 1658784 - RNA, 15 nt, Salmonella enterica enterica serovar Typhi
cgaaaaugcgcauga

SEQ ID NO: 1658785 - RNA, 12 nt, Salmonella enterica enterica serovar Typhi
cgaaaauacgcg

SEQ ID NO: 1658786 - RNA, 21 nt, Salmonella enterica enterica serovar Typhi
cgaaaaguguguaccagcagc

SEQ ID NO: 1658787 - RNA, 22 nt, Salmonella enterica enterica serovar Typhi
ccuuuauuucaagcaauaccgg

SEQ ID NO: 1658788 - RNA, 21 nt, Salmonella enterica enterica serovar Typhi
ccuugcggugagaaacgcgcc

SEQ ID NO: 1658789 - RNA, 22 nt, Salmonella enterica enterica serovar Typhi
cgaauaccugaaagagcgugcg

SEQ ID NO: 1658790 - RNA, 13 nt, Salmonella enterica enterica serovar Typhi
cgaauacuacugg

SEQ ID NO: 1658791 - RNA, 22 nt, Salmonella enterica enterica serovar Typhi
cgaauaguggcgcgccagcgau

SEQ ID NO: 1658792 - RNA, 18 nt, Salmonella enterica enterica serovar Typhi
cgaauauaacgacagccu

SEQ ID NO: 1658793 - RNA, 18 nt, Salmonella enterica enterica serovar Typhi
cgaauauacgcaccugau

SEQ ID NO: 1658794 - RNA, 19 nt, Salmonella enterica enterica serovar Typhi
cgaauauucauuuccagca

SEQ ID NO: 1658795 - RNA, 21 nt, Salmonella enterica enterica serovar Typhi
cgaagugcagcguuuccagcc

SEQ ID NO: 1658796 - RNA, 19 nt, Salmonella enterica enterica serovar Typhi
cgaagcgucauccggcaau

SEQ ID NO: 1658797 - RNA, 17 nt, Salmonella enterica enterica serovar Typhi
cgaagccgcgggcggua

SEQ ID NO: 1658798 - RNA, 14 nt, Salmonella enterica enterica serovar Typhi
cgaacaugccgccg

SEQ ID NO: 1658799 - RNA, 19 nt, Salmonella enterica enterica serovar Typhi
cgaacauccuugcacgcca

SEQ ID NO: 1658800 - RNA, 13 nt, Salmonella enterica enterica serovar Typhi
cgaacauuucagc

SEQ ID NO: 1658801 - RNA, 21 nt, Salmonella enterica enterica serovar Typhi
cgaaccguggccuccggcaga

SEQ ID NO: 1658802 - RNA, 17 nt, Salmonella enterica enterica serovar Typhi
cgaaccguaaacgccug

SEQ ID NO: 1658803 - RNA, 19 nt, Salmonella enterica enterica serovar Typhi
cgaaccggcaucggcagcg

SEQ ID NO: 1658804 - RNA, 19 nt, Salmonella enterica enterica serovar Typhi
cgaacaggcucagcgccac

SEQ ID NO: 1658805 - RNA, 19 nt, Salmonella enterica enterica serovar Typhi
cgaacagcggcaggcggaa

SEQ ID NO: 1658806 - RNA, 19 nt, Salmonella enterica enterica serovar Typhi
cgaacaguugcagcgccug

SEQ ID NO: 1658807 - RNA, 13 nt, Salmonella enterica enterica serovar Typhi
cgaaauaaucagg

SEQ ID NO: 1658808 - RNA, 14 nt, Salmonella enterica enterica serovar Typhi
cgaaauugccgccc

SEQ ID NO: 1658809 - RNA, 17 nt, Salmonella enterica enterica serovar Typhi
cgaugccuuauccggcc

SEQ ID NO: 1658810 - RNA, 19 nt, Salmonella enterica enterica serovar Typhi
cgaugaucgucgcgaucgc

SEQ ID NO: 1658811 - RNA, 12 nt, Salmonella enterica enterica serovar Typhi
cgaucugaaugc

SEQ ID NO: 1658812 - RNA, 16 nt, Salmonella enterica enterica serovar Typhi
cgaucgccuaauccgc

SEQ ID NO: 1658813 - RNA, 12 nt, Salmonella enterica enterica serovar Typhi
cgaucgauaaag

SEQ ID NO: 1658814 - RNA, 16 nt, Salmonella enterica enterica serovar Typhi
cgaucgagcgcaauac

SEQ ID NO: 1658815 - RNA, 20 nt, Salmonella enterica enterica serovar Typhi
cgaucgaugugauaaaugcg

SEQ ID NO: 1658816 - RNA, 12 nt, Salmonella enterica enterica serovar Typhi
cgaucgcggcaa

SEQ ID NO: 1658817 - RNA, 17 nt, Salmonella enterica enterica serovar Typhi
cgaucgcuaaucaggac

SEQ ID NO: 1658818 - RNA, 18 nt, Salmonella enterica enterica serovar Typhi
cgauccccaacgacagca

SEQ ID NO: 1658819 - RNA, 17 nt, Salmonella enterica enterica serovar Typhi
cgauccauauaaucaaa

SEQ ID NO: 1658820 - RNA, 14 nt, Salmonella enterica enterica serovar Typhi
cgaucaugccgccc

SEQ ID NO: 1658821 - RNA, 18 nt, Salmonella enterica enterica serovar Typhi
cgauccacaaucgucgug

SEQ ID NO: 1658822 - RNA, 22 nt, Salmonella enterica enterica serovar Typhi
cgaucaugagucgcgcgcgcca

SEQ ID NO: 1658823 - RNA, 18 nt, Salmonella enterica enterica serovar Typhi
cgaucccgggcgauaaac

SEQ ID NO: 1658824 - RNA, 12 nt, Salmonella enterica enterica serovar Typhi
cgauccggcagc

SEQ ID NO: 1658825 - RNA, 18 nt, Salmonella enterica enterica serovar Typhi
cgauccgcgagacgccug

SEQ ID NO: 1658826 - RNA, 23 nt, Salmonella enterica enterica serovar Typhi
cgauagcagcgcuuucaccgcgu

SEQ ID NO: 1658827 - RNA, 20 nt, Salmonella enterica enterica serovar Typhi
cgauagcauuuuuacucagc

SEQ ID NO: 1658828 - RNA, 15 nt, Salmonella enterica enterica serovar Typhi
cgauagugaucgccc

SEQ ID NO: 1658829 - RNA, 17 nt, Salmonella enterica enterica serovar Typhi
cgauaguggucgccacg

SEQ ID NO: 1658830 - RNA, 18 nt, Salmonella enterica enterica serovar Typhi
cgauaguguaaacgcgcc

SEQ ID NO: 1658831 - RNA, 15 nt, Salmonella enterica enterica serovar Typhi
cgaucaccacgccuu

SEQ ID NO: 1658832 - RNA, 12 nt, Salmonella enterica enterica serovar Typhi
cgaucaaucacg

SEQ ID NO: 1658833 - RNA, 19 nt, Salmonella enterica enterica serovar Typhi
cgauauaagcgccgucauc

SEQ ID NO: 1658834 - RNA, 14 nt, Salmonella enterica enterica serovar Typhi
cgauacggauagcg

SEQ ID NO: 1658835 - RNA, 16 nt, Salmonella enterica enterica serovar Typhi
cgauagacagcaccau

SEQ ID NO: 1658836 - RNA, 22 nt, Salmonella enterica enterica serovar Typhi
cgauaaucuccgccgugcguuu

SEQ ID NO: 1658837 - RNA, 21 nt, Salmonella enterica enterica serovar Typhi
cgauaaggucgcuauccagca

SEQ ID NO: 1658838 - RNA, 17 nt, Salmonella enterica enterica serovar Typhi
cgauaacccgcgcaugg

SEQ ID NO: 1658839 - RNA, 17 nt, Salmonella enterica enterica serovar Typhi
cgauaacaggaacgccg

SEQ ID NO: 1658840 - RNA, 15 nt, Salmonella enterica enterica serovar Typhi
cgauaacacggcugg

SEQ ID NO: 1658841 - RNA, 12 nt, Salmonella enterica enterica serovar Typhi
cgauaaccgaug

SEQ ID NO: 1658842 - RNA, 13 nt, Salmonella enterica enterica serovar Typhi
cgaucagcgcgua

SEQ ID NO: 1658843 - RNA, 14 nt, Salmonella enterica enterica serovar Typhi
cgaucagcgccacg

SEQ ID NO: 1658844 - RNA, 20 nt, Salmonella enterica enterica serovar Typhi
cgaucacgcgcaggccgauc

SEQ ID NO: 1658845 - RNA, 23 nt, Salmonella enterica enterica serovar Typhi
cgaucacccacaucagcggcaca

SEQ ID NO: 1658846 - RNA, 15 nt, Salmonella enterica enterica serovar Typhi
cgaucacuaccgcca

SEQ ID NO: 1658847 - RNA, 17 nt, Salmonella enterica enterica serovar Typhi
cgaggcguaucccagua

SEQ ID NO: 1658848 - RNA, 21 nt, Salmonella enterica enterica serovar Typhi
cgagcgguuucucgacggugc

SEQ ID NO: 1658849 - RNA, 18 nt, Salmonella enterica enterica serovar Typhi
cgagcuguaccgucccua

SEQ ID NO: 1658850 - RNA, 20 nt, Salmonella enterica enterica serovar Typhi
cgagcugucaccgacacgca

SEQ ID NO: 1658851 - RNA, 15 nt, Salmonella enterica enterica serovar Typhi
cgcagcaagaacaga

SEQ ID NO: 1658852 - RNA, 17 nt, Salmonella enterica enterica serovar Typhi
cgcagagugagcaggcu

SEQ ID NO: 1658853 - RNA, 16 nt, Salmonella enterica enterica serovar Typhi
cgcagacgccgcgguu

SEQ ID NO: 1658854 - RNA, 12 nt, Salmonella enterica enterica serovar Typhi
cgcagaucgccu

SEQ ID NO: 1658855 - RNA, 13 nt, Salmonella enterica enterica serovar Typhi
cgcagauccagca

SEQ ID NO: 1658856 - RNA, 15 nt, Salmonella enterica enterica serovar Typhi
cgcagauacgcguca

SEQ ID NO: 1658857 - RNA, 16 nt, Salmonella enterica enterica serovar Typhi
cgcagaugcccgcaga

SEQ ID NO: 1658858 - RNA, 15 nt, Salmonella enterica enterica serovar Typhi
cgcagcaaacgccau

SEQ ID NO: 1658859 - RNA, 15 nt, Salmonella enterica enterica serovar Typhi
cgcagcaaaucagcu

SEQ ID NO: 1658860 - RNA, 12 nt, Salmonella enterica enterica serovar Typhi
cgcacggcguua

SEQ ID NO: 1658861 - RNA, 20 nt, Salmonella enterica enterica serovar Typhi
cgcaccgucgagaaaccgcu

SEQ ID NO: 1658862 - RNA, 13 nt, Salmonella enterica enterica serovar Typhi
cgcaaauucugua

SEQ ID NO: 1658863 - RNA, 21 nt, Salmonella enterica enterica serovar Typhi
cgcaaauauccuaccacgccg

SEQ ID NO: 1658864 - RNA, 15 nt, Salmonella enterica enterica serovar Typhi
cgcaacucacgccau

SEQ ID NO: 1658865 - RNA, 14 nt, Salmonella enterica enterica serovar Typhi
cgcaagcggcguuc

SEQ ID NO: 1658866 - RNA, 18 nt, Salmonella enterica enterica serovar Typhi
cgauggccagaaugacau

SEQ ID NO: 1658867 - RNA, 19 nt, Salmonella enterica enterica serovar Typhi
cgaugcucagggcauccgc

SEQ ID NO: 1658868 - RNA, 17 nt, Salmonella enterica enterica serovar Typhi
cgauuucauuacgccug

SEQ ID NO: 1658869 - RNA, 21 nt, Salmonella enterica enterica serovar Typhi
cgauuuucccuucugaaauga

SEQ ID NO: 1658870 - RNA, 20 nt, Salmonella enterica enterica serovar Typhi
cgauuuucagcaccuuacga

SEQ ID NO: 1658871 - RNA, 14 nt, Salmonella enterica enterica serovar Typhi
cgcaaucccggaga

SEQ ID NO: 1658872 - RNA, 23 nt, Salmonella enterica enterica serovar Typhi
cgcaaugggggcuugcgccauuc

SEQ ID NO: 1658873 - RNA, 15 nt, Salmonella enterica enterica serovar Typhi
cgcaaucuggcgcaa

SEQ ID NO: 1658874 - RNA, 21 nt, Salmonella enterica enterica serovar Typhi
cgcaaucuuugccgcaaacgc

SEQ ID NO: 1658875 - RNA, 19 nt, Salmonella enterica enterica serovar Typhi
cgcaauacagcccgccagc

SEQ ID NO: 1658876 - RNA, 14 nt, Salmonella enterica enterica serovar Typhi
cgcaauaccggcga

SEQ ID NO: 1658877 - RNA, 13 nt, Salmonella enterica enterica serovar Typhi
cgcacagcgccau

SEQ ID NO: 1658878 - RNA, 13 nt, Salmonella enterica enterica serovar Typhi
cgcacauaaucac

SEQ ID NO: 1658879 - RNA, 22 nt, Salmonella enterica enterica serovar Typhi
cgcacauggaacucugcgacgc

SEQ ID NO: 1658880 - RNA, 21 nt, Salmonella enterica enterica serovar Typhi
cgcaccacugcuguagcgucu

SEQ ID NO: 1658881 - RNA, 17 nt, Salmonella enterica enterica serovar Typhi
cgcacauuuacgccagc

SEQ ID NO: 1658882 - RNA, 20 nt, Salmonella enterica enterica serovar Typhi
cgcacauuuacgccagccag

SEQ ID NO: 1658883 - RNA, 21 nt, Salmonella enterica enterica serovar Typhi
cgcacagagaucgugcauccg

SEQ ID NO: 1658884 - RNA, 21 nt, Salmonella enterica enterica serovar Typhi
cgcaauuuugguaauggcgaa

SEQ ID NO: 1658885 - RNA, 22 nt, Salmonella enterica enterica serovar Typhi
cgcaauucuucuaccagaacga

SEQ ID NO: 1658886 - RNA, 12 nt, Salmonella enterica enterica serovar Typhi
cgccaaccggcu

SEQ ID NO: 1658887 - RNA, 15 nt, Salmonella enterica enterica serovar Typhi
cgccaacguccgccg

SEQ ID NO: 1658888 - RNA, 17 nt, Salmonella enterica enterica serovar Typhi
cgccaacgccggcaaca

SEQ ID NO: 1658889 - RNA, 13 nt, Salmonella enterica enterica serovar Typhi
cgccaacgccagc

SEQ ID NO: 1658890 - RNA, 14 nt, Salmonella enterica enterica serovar Typhi
cgcauguuccgcua

SEQ ID NO: 1658891 - RNA, 21 nt, Salmonella enterica enterica serovar Typhi
cgcaugugagcaucggcgauu

SEQ ID NO: 1658892 - RNA, 15 nt, Salmonella enterica enterica serovar Typhi
cgcauggggagaccc

SEQ ID NO: 1658893 - RNA, 19 nt, Salmonella enterica enterica serovar Typhi
cgccaccacauucaggcgg

SEQ ID NO: 1658894 - RNA, 18 nt, Salmonella enterica enterica serovar Typhi
cgccaccacaaacgccgu

SEQ ID NO: 1658895 - RNA, 18 nt, Salmonella enterica enterica serovar Typhi
cgccacauugaccccaua

SEQ ID NO: 1658896 - RNA, 22 nt, Salmonella enterica enterica serovar Typhi
cgccaccaaaaacgcccccaga

SEQ ID NO: 1658897 - RNA, 15 nt, Salmonella enterica enterica serovar Typhi
cgccacauugcgcgc

SEQ ID NO: 1658898 - RNA, 17 nt, Salmonella enterica enterica serovar Typhi
cgccacaccgagacaga

SEQ ID NO: 1658899 - RNA, 12 nt, Salmonella enterica enterica serovar Typhi
cgcauccggcaa

SEQ ID NO: 1658900 - RNA, 16 nt, Salmonella enterica enterica serovar Typhi
cgcauccgcggcgcuu

SEQ ID NO: 1658901 - RNA, 14 nt, Salmonella enterica enterica serovar Typhi
cgcauccagcguca

SEQ ID NO: 1658902 - RNA, 16 nt, Salmonella enterica enterica serovar Typhi
cgcauccgguaaacgc

SEQ ID NO: 1658903 - RNA, 24 nt, Salmonella enterica enterica serovar Typhi
cgcauccgggaguuucaugccaua

SEQ ID NO: 1658904 - RNA, 14 nt, Salmonella enterica enterica serovar Typhi
cgcauccggccagc

SEQ ID NO: 1658905 - RNA, 13 nt, Salmonella enterica enterica serovar Typhi
cgcauccggcagu

SEQ ID NO: 1658906 - RNA, 21 nt, Salmonella enterica enterica serovar Typhi
cgcaucgcggauggcggcaua

SEQ ID NO: 1658907 - RNA, 20 nt, Salmonella enterica enterica serovar Typhi
cgcaucgccgcaagcggcaa

SEQ ID NO: 1658908 - RNA, 17 nt, Salmonella enterica enterica serovar Typhi
cgcauggcagggcgaua

SEQ ID NO: 1658909 - RNA, 13 nt, Salmonella enterica enterica serovar Typhi
cgcaugaggccug

SEQ ID NO: 1658910 - RNA, 16 nt, Salmonella enterica enterica serovar Typhi
cgcaucguggccgaua

SEQ ID NO: 1658911 - RNA, 20 nt, Salmonella enterica enterica serovar Typhi
cgcaggucuucgucagcgca

SEQ ID NO: 1658912 - RNA, 17 nt, Salmonella enterica enterica serovar Typhi
cgcagguuaaagccucu

SEQ ID NO: 1658913 - RNA, 20 nt, Salmonella enterica enterica serovar Typhi
cgcagggcgucuuauccggc

SEQ ID NO: 1658914 - RNA, 16 nt, Salmonella enterica enterica serovar Typhi
cgcagcccugcgucgc

SEQ ID NO: 1658915 - RNA, 15 nt, Salmonella enterica enterica serovar Typhi
cgcaggacagcgaca

SEQ ID NO: 1658916 - RNA, 21 nt, Salmonella enterica enterica serovar Typhi
cgcaggauaaagaccggcaca

SEQ ID NO: 1658917 - RNA, 21 nt, Salmonella enterica enterica serovar Typhi
cgcaggacuuucgcuucacga

SEQ ID NO: 1658918 - RNA, 22 nt, Salmonella enterica enterica serovar Typhi
cgcaggauaaagaccggcacaa

SEQ ID NO: 1658919 - RNA, 13 nt, Salmonella enterica enterica serovar Typhi
cgcauauccagca

SEQ ID NO: 1658920 - RNA, 19 nt, Salmonella enterica enterica serovar Typhi
cgcauaucccacugcacgc

SEQ ID NO: 1658921 - RNA, 19 nt, Salmonella enterica enterica serovar Typhi
cgcauauguuuaguacgca

SEQ ID NO: 1658922 - RNA, 16 nt, Salmonella enterica enterica serovar Typhi
cgcaucacuggcguau

SEQ ID NO: 1658923 - RNA, 14 nt, Salmonella enterica enterica serovar Typhi
cgcauccagcgcaa

SEQ ID NO: 1658924 - RNA, 12 nt, Salmonella enterica enterica serovar Typhi
cgcauccagcgu

SEQ ID NO: 1658925 - RNA, 13 nt, Salmonella enterica enterica serovar Typhi
cgcauccagcguc

SEQ ID NO: 1658926 - RNA, 13 nt, Salmonella enterica enterica serovar Typhi
cgcauccagccac

SEQ ID NO: 1658927 - RNA, 11 nt, Salmonella enterica enterica serovar Typhi
cgcauccagcg

SEQ ID NO: 1658928 - RNA, 13 nt, Salmonella enterica enterica serovar Typhi
cgcauccagcgca

SEQ ID NO: 1658929 - RNA, 15 nt, Salmonella enterica enterica serovar Typhi
cgcauaccagccaua

SEQ ID NO: 1658930 - RNA, 15 nt, Salmonella enterica enterica serovar Typhi
cgcauaacguugugg

SEQ ID NO: 1658931 - RNA, 15 nt, Salmonella enterica enterica serovar Typhi
cgcauagcggccaga

SEQ ID NO: 1658932 - RNA, 18 nt, Salmonella enterica enterica serovar Typhi
cgcauaggcuuugcugag

SEQ ID NO: 1658933 - RNA, 21 nt, Salmonella enterica enterica serovar Typhi
cgcauagguugauauaaaacg

SEQ ID NO: 1658934 - RNA, 14 nt, Salmonella enterica enterica serovar Typhi
cgcaguaacgucgc

SEQ ID NO: 1658935 - RNA, 21 nt, Salmonella enterica enterica serovar Typhi
cgcagucgauuuaaugccuau

SEQ ID NO: 1658936 - RNA, 20 nt, Salmonella enterica enterica serovar Typhi
cgcaguccagaugcgccaga

SEQ ID NO: 1658937 - RNA, 22 nt, Salmonella enterica enterica serovar Typhi
cgcaguccagaugcgccagauu

SEQ ID NO: 1658938 - RNA, 16 nt, Salmonella enterica enterica serovar Typhi
cgcagucguuccagac

SEQ ID NO: 1658939 - RNA, 23 nt, Salmonella enterica enterica serovar Typhi
cgcaguuguaguagccacagcgg

SEQ ID NO: 1658940 - RNA, 17 nt, Salmonella enterica enterica serovar Typhi
ccguuguugucaauauc

SEQ ID NO: 1658941 - RNA, 23 nt, Salmonella enterica enterica serovar Typhi
ccguuuuuuccagcgccgccaga

SEQ ID NO: 1658942 - RNA, 21 nt, Salmonella enterica enterica serovar Typhi
ccguuucuuuuucgaucagca

SEQ ID NO: 1658943 - RNA, 17 nt, Salmonella enterica enterica serovar Typhi
ccguuggcuuuaugcac

SEQ ID NO: 1658944 - RNA, 16 nt, Salmonella enterica enterica serovar Typhi
ccuaacaggcgcauac

SEQ ID NO: 1658945 - RNA, 22 nt, Salmonella enterica enterica serovar Typhi
ccuacuuuauuuuucgccagau

SEQ ID NO: 1658946 - RNA, 19 nt, Salmonella enterica enterica serovar Typhi
ccuacggcuaccgccuguu

SEQ ID NO: 1658947 - RNA, 20 nt, Salmonella enterica enterica serovar Typhi
ccuacgcaggcuaacgcgcc

SEQ ID NO: 1658948 - RNA, 15 nt, Salmonella enterica enterica serovar Typhi
ccuacgauaucaucg

SEQ ID NO: 1658949 - RNA, 18 nt, Salmonella enterica enterica serovar Typhi
ccguucauaguuugcaua

SEQ ID NO: 1658950 - RNA, 16 nt, Salmonella enterica enterica serovar Typhi
ccguucuuccugggga

SEQ ID NO: 1658951 - RNA, 17 nt, Salmonella enterica enterica serovar Typhi
ccguucugaccugcgca

SEQ ID NO: 1658952 - RNA, 23 nt, Salmonella enterica enterica serovar Typhi
ccguugccacccaaugauccgga

SEQ ID NO: 1658953 - RNA, 17 nt, Salmonella enterica enterica serovar Typhi
ccuccggaugacgccgc

SEQ ID NO: 1658954 - RNA, 22 nt, Salmonella enterica enterica serovar Typhi
ccuccggcagaaaugaccacgu

SEQ ID NO: 1658955 - RNA, 14 nt, Salmonella enterica enterica serovar Typhi
ccuccggcuucagc

SEQ ID NO: 1658956 - RNA, 13 nt, Salmonella enterica enterica serovar Typhi
ccuccggcuaugc

SEQ ID NO: 1658957 - RNA, 18 nt, Salmonella enterica enterica serovar Typhi
ccuccggcgagcgaugcu

SEQ ID NO: 1658958 - RNA, 21 nt, Salmonella enterica enterica serovar Typhi
ccuauuugcuugugacggcaa

SEQ ID NO: 1658959 - RNA, 17 nt, Salmonella enterica enterica serovar Typhi
ccuauugcaacgccgau

SEQ ID NO: 1658960 - RNA, 15 nt, Salmonella enterica enterica serovar Typhi
ccuauaacagcgcug

SEQ ID NO: 1658961 - RNA, 22 nt, Salmonella enterica enterica serovar Typhi
ccucauccgcauagcgcaacgc

SEQ ID NO: 1658962 - RNA, 16 nt, Salmonella enterica enterica serovar Typhi
ccucaucgggacggcg

SEQ ID NO: 1658963 - RNA, 20 nt, Salmonella enterica enterica serovar Typhi
ccucagguaaauccgccagu

SEQ ID NO: 1658964 - RNA, 19 nt, Salmonella enterica enterica serovar Typhi
ccguaaucaucgcgaucgc

SEQ ID NO: 1658965 - RNA, 16 nt, Salmonella enterica enterica serovar Typhi
ccguacuccagcccau

SEQ ID NO: 1658966 - RNA, 18 nt, Salmonella enterica enterica serovar Typhi
ccgucauaaucgcgauac

SEQ ID NO: 1658967 - RNA, 22 nt, Salmonella enterica enterica serovar Typhi
ccgucaggaacggauaacgacg

SEQ ID NO: 1658968 - RNA, 21 nt, Salmonella enterica enterica serovar Typhi
ccgucccacgcgccgccgaac

SEQ ID NO: 1658969 - RNA, 23 nt, Salmonella enterica enterica serovar Typhi
ccgucccagcggaugucggucau

SEQ ID NO: 1658970 - RNA, 22 nt, Salmonella enterica enterica serovar Typhi
ccgugaauaaugaccagcgccc

SEQ ID NO: 1658971 - RNA, 15 nt, Salmonella enterica enterica serovar Typhi
ccggguaaacgccau

SEQ ID NO: 1658972 - RNA, 20 nt, Salmonella enterica enterica serovar Typhi
ccguaaggcgauucaacagg

SEQ ID NO: 1658973 - RNA, 15 nt, Salmonella enterica enterica serovar Typhi
ccguaauaaguauca

SEQ ID NO: 1658974 - RNA, 13 nt, Salmonella enterica enterica serovar Typhi
ccguaacgaacgc

SEQ ID NO: 1658975 - RNA, 16 nt, Salmonella enterica enterica serovar Typhi
ccgguuauaccgccau

SEQ ID NO: 1658976 - RNA, 14 nt, Salmonella enterica enterica serovar Typhi
ccgguggcgcuguc

SEQ ID NO: 1658977 - RNA, 13 nt, Salmonella enterica enterica serovar Typhi
ccggcgcgguauu

SEQ ID NO: 1658978 - RNA, 15 nt, Salmonella enterica enterica serovar Typhi
ccggcgcgcuggugc

SEQ ID NO: 1658979 - RNA, 15 nt, Salmonella enterica enterica serovar Typhi
ccggcgcuuccugca

SEQ ID NO: 1658980 - RNA, 22 nt, Salmonella enterica enterica serovar Typhi
ccggccugcagggaauaagcgc

SEQ ID NO: 1658981 - RNA, 17 nt, Salmonella enterica enterica serovar Typhi
ccggcgaaauagcguuc

SEQ ID NO: 1658982 - RNA, 18 nt, Salmonella enterica enterica serovar Typhi
ccggcgaaaucgugcgcc

SEQ ID NO: 1658983 - RNA, 16 nt, Salmonella enterica enterica serovar Typhi
ccggcgcccauccgcc

SEQ ID NO: 1658984 - RNA, 17 nt, Salmonella enterica enterica serovar Typhi
ccggccucgcccgcgau

SEQ ID NO: 1658985 - RNA, 16 nt, Salmonella enterica enterica serovar Typhi
ccggccuacguuuaug

SEQ ID NO: 1658986 - RNA, 13 nt, Salmonella enterica enterica serovar Typhi
ccggccagcgcca

SEQ ID NO: 1658987 - RNA, 14 nt, Salmonella enterica enterica serovar Typhi
ccggccagcgccag

SEQ ID NO: 1658988 - RNA, 16 nt, Salmonella enterica enterica serovar Typhi
ccgcuuuaucauacca

SEQ ID NO: 1658989 - RNA, 19 nt, Salmonella enterica enterica serovar Typhi
ccgcuuucuucccggcagg

SEQ ID NO: 1658990 - RNA, 18 nt, Salmonella enterica enterica serovar Typhi
ccgcuuuuuccgccgucg

SEQ ID NO: 1658991 - RNA, 21 nt, Salmonella enterica enterica serovar Typhi
ccggcaugccauaaucgauau

SEQ ID NO: 1658992 - RNA, 17 nt, Salmonella enterica enterica serovar Typhi
ccggcauugaaacgcau

SEQ ID NO: 1658993 - RNA, 14 nt, Salmonella enterica enterica serovar Typhi
ccgggauaaucagg

SEQ ID NO: 1658994 - RNA, 13 nt, Salmonella enterica enterica serovar Typhi
ccggcuuauccgg

SEQ ID NO: 1658995 - RNA, 16 nt, Salmonella enterica enterica serovar Typhi
ccggcuuaccggcuau

SEQ ID NO: 1658996 - RNA, 23 nt, Salmonella enterica enterica serovar Typhi
ccgggaucuuuuucagccguuca

SEQ ID NO: 1658997 - RNA, 15 nt, Salmonella enterica enterica serovar Typhi
ccgggauauuuccgc

SEQ ID NO: 1658998 - RNA, 11 nt, Salmonella enterica enterica serovar Typhi
ccgggcaucug

SEQ ID NO: 1658999 - RNA, 18 nt, Salmonella enterica enterica serovar Typhi
ccgggcucacgcuggugc

SEQ ID NO: 1659000 - RNA, 20 nt, Salmonella enterica enterica serovar Typhi
aaauuuucaaccacggauaa

SEQ ID NO: 1659001 - RNA, 17 nt, Salmonella enterica enterica serovar Typhi
ccggggaagcgcgcgca

SEQ ID NO: 1659002 - RNA, 23 nt, Salmonella enterica enterica serovar Typhi
ccggcgggguuuuuuuaugcguu

SEQ ID NO: 1659003 - RNA, 14 nt, Salmonella enterica enterica serovar Typhi
ccggcguagcgcgc

SEQ ID NO: 1659004 - RNA, 13 nt, Salmonella enterica enterica serovar Typhi
ccggcuccggcaa

SEQ ID NO: 1659005 - RNA, 18 nt, Salmonella enterica enterica serovar Typhi
ccggcguuuuagcgccau

SEQ ID NO: 1659006 - RNA, 19 nt, Salmonella enterica enterica serovar Typhi
ccggcuaaaugacgcgcga

SEQ ID NO: 1659007 - RNA, 17 nt, Salmonella enterica enterica serovar Typhi
ccggcguccccguucug

SEQ ID NO: 1659008 - RNA, 18 nt, Salmonella enterica enterica serovar Typhi
ccggcgucgaucagcgcg

SEQ ID NO: 1659009 - RNA, 16 nt, Salmonella enterica enterica serovar Typhi
ccggcguuacuccgcg

SEQ ID NO: 1659010 - RNA, 21 nt, Salmonella enterica enterica serovar Typhi
ccggcgugugucccggacaau

SEQ ID NO: 1659011 - RNA, 15 nt, Salmonella enterica enterica serovar Typhi
ccggcgugaacgccu

SEQ ID NO: 1659012 - RNA, 14 nt, Salmonella enterica enterica serovar Typhi
ccgcuguuaugcac

SEQ ID NO: 1659013 - RNA, 22 nt, Salmonella enterica enterica serovar Typhi
ccgcuguguacgcguucugaau

SEQ ID NO: 1659014 - RNA, 13 nt, Salmonella enterica enterica serovar Typhi
ccgcuuccggcag

SEQ ID NO: 1659015 - RNA, 14 nt, Salmonella enterica enterica serovar Typhi
ccgcuuccggcagg

SEQ ID NO: 1659016 - RNA, 14 nt, Salmonella enterica enterica serovar Typhi
ccgcugucgccaga

SEQ ID NO: 1659017 - RNA, 15 nt, Salmonella enterica enterica serovar Typhi
ccgcuggucaacacg

SEQ ID NO: 1659018 - RNA, 20 nt, Salmonella enterica enterica serovar Typhi
ccgcuggcgcuuugccguuc

SEQ ID NO: 1659019 - RNA, 19 nt, Salmonella enterica enterica serovar Typhi
ccgcuauucaccagcguca

SEQ ID NO: 1659020 - RNA, 22 nt, Salmonella enterica enterica serovar Typhi
ccgcuaugcggcguuaauggcc

SEQ ID NO: 1659021 - RNA, 17 nt, Salmonella enterica enterica serovar Typhi
ccgcuaucgaguugcgc

SEQ ID NO: 1659022 - RNA, 17 nt, Salmonella enterica enterica serovar Typhi
ccgcggauagacgauau

SEQ ID NO: 1659023 - RNA, 16 nt, Salmonella enterica enterica serovar Typhi
ccgcggacuuauuaac

SEQ ID NO: 1659024 - RNA, 23 nt, Salmonella enterica enterica serovar Typhi
aaauucaagccauacgccgcggu

SEQ ID NO: 1659025 - RNA, 19 nt, Salmonella enterica enterica serovar Typhi
ccgcggcauuaauccgugc

SEQ ID NO: 1659026 - RNA, 18 nt, Salmonella enterica enterica serovar Typhi
aaauuaaagauuagcguu

SEQ ID NO: 1659027 - RNA, 11 nt, Salmonella enterica enterica serovar Typhi
aaauuaccgcc

SEQ ID NO: 1659028 - RNA, 21 nt, Salmonella enterica enterica serovar Typhi
ccgcgaugcugcucuccacgc

SEQ ID NO: 1659029 - RNA, 18 nt, Salmonella enterica enterica serovar Typhi
ccgcgaugcaucuugaau

SEQ ID NO: 1659030 - RNA, 11 nt, Salmonella enterica enterica serovar Typhi
ccgcgccggac

SEQ ID NO: 1659031 - RNA, 22 nt, Salmonella enterica enterica serovar Typhi
ccgcgacuuuggcuuuauccgg

SEQ ID NO: 1659032 - RNA, 14 nt, Salmonella enterica enterica serovar Typhi
ccgccugccgauac

SEQ ID NO: 1659033 - RNA, 20 nt, Salmonella enterica enterica serovar Typhi
ccgcgacagucgcagagccc

SEQ ID NO: 1659034 - RNA, 13 nt, Salmonella enterica enterica serovar Typhi
ccgccugccagau

SEQ ID NO: 1659035 - RNA, 20 nt, Salmonella enterica enterica serovar Typhi
ccgccgugauaaauacgcug

SEQ ID NO: 1659036 - RNA, 23 nt, Salmonella enterica enterica serovar Typhi
ccgccgucgugccugacguccac

SEQ ID NO: 1659037 - RNA, 17 nt, Salmonella enterica enterica serovar Typhi
aaauguaggccggauaa

SEQ ID NO: 1659038 - RNA, 15 nt, Salmonella enterica enterica serovar Typhi
aaauggucugccagu

SEQ ID NO: 1659039 - RNA, 18 nt, Salmonella enterica enterica serovar Typhi
aaauggucggucacgcga

SEQ ID NO: 1659040 - RNA, 22 nt, Salmonella enterica enterica serovar Typhi
aaaugacgccggguaaacgcag

SEQ ID NO: 1659041 - RNA, 16 nt, Salmonella enterica enterica serovar Typhi
aaaugaucagacgcau

SEQ ID NO: 1659042 - RNA, 19 nt, Salmonella enterica enterica serovar Typhi
aaaugacgggcgaucgacu

SEQ ID NO: 1659043 - RNA, 17 nt, Salmonella enterica enterica serovar Typhi
ccgccggugacggcgga

SEQ ID NO: 1659044 - RNA, 21 nt, Salmonella enterica enterica serovar Typhi
ccgccggagggcgaacuggcg

SEQ ID NO: 1659045 - RNA, 18 nt, Salmonella enterica enterica serovar Typhi
ccgccaacaccgcaucgc

SEQ ID NO: 1659046 - RNA, 20 nt, Salmonella enterica enterica serovar Typhi
ccgccaaaccggcgaauagc

SEQ ID NO: 1659047 - RNA, 15 nt, Salmonella enterica enterica serovar Typhi
ccgcaucguuaucau

SEQ ID NO: 1659048 - RNA, 16 nt, Salmonella enterica enterica serovar Typhi
ccgcagcgugccuuca

SEQ ID NO: 1659049 - RNA, 16 nt, Salmonella enterica enterica serovar Typhi
ccgcagcgcggccugc

SEQ ID NO: 1659050 - RNA, 15 nt, Salmonella enterica enterica serovar Typhi
ccgccaauauccggc

SEQ ID NO: 1659051 - RNA, 22 nt, Salmonella enterica enterica serovar Typhi
ccgcauucagaaccugcgauac

SEQ ID NO: 1659052 - RNA, 19 nt, Salmonella enterica enterica serovar Typhi
ccgccagaaaagaaccgac

SEQ ID NO: 1659053 - RNA, 20 nt, Salmonella enterica enterica serovar Typhi
ccgccauuuuauccaggcca

SEQ ID NO: 1659054 - RNA, 19 nt, Salmonella enterica enterica serovar Typhi
ccgccagcgugacccagac

SEQ ID NO: 1659055 - RNA, 19 nt, Salmonella enterica enterica serovar Typhi
ccgccaggcauguuaugaa

SEQ ID NO: 1659056 - RNA, 22 nt, Salmonella enterica enterica serovar Typhi
ccgccaggcgagcacaccauau

SEQ ID NO: 1659057 - RNA, 19 nt, Salmonella enterica enterica serovar Typhi
ccgccauugccaguaccga

SEQ ID NO: 1659058 - RNA, 17 nt, Salmonella enterica enterica serovar Typhi
ccgccaucuccggcagc

SEQ ID NO: 1659059 - RNA, 17 nt, Salmonella enterica enterica serovar Typhi
ccgccaucgcugacgau

SEQ ID NO: 1659060 - RNA, 16 nt, Salmonella enterica enterica serovar Typhi
ccgcaacucucgauau

SEQ ID NO: 1659061 - RNA, 12 nt, Salmonella enterica enterica serovar Typhi
ccgcaacgccag

SEQ ID NO: 1659062 - RNA, 23 nt, Salmonella enterica enterica serovar Typhi
ccgauuuugucggaauuuccggg

SEQ ID NO: 1659063 - RNA, 14 nt, Salmonella enterica enterica serovar Typhi
ccgauuuugaacau

SEQ ID NO: 1659064 - RNA, 19 nt, Salmonella enterica enterica serovar Typhi
ccgauuggcaaaauagugc

SEQ ID NO: 1659065 - RNA, 22 nt, Salmonella enterica enterica serovar Typhi
ccgcaaaguggguauauuugcc

SEQ ID NO: 1659066 - RNA, 22 nt, Salmonella enterica enterica serovar Typhi
ccgcaaacagcacgcccugcca

SEQ ID NO: 1659067 - RNA, 15 nt, Salmonella enterica enterica serovar Typhi
ccgcaaggacgccag

SEQ ID NO: 1659068 - RNA, 14 nt, Salmonella enterica enterica serovar Typhi
ccgcacaaacgcuu

SEQ ID NO: 1659069 - RNA, 12 nt, Salmonella enterica enterica serovar Typhi
ccgcagcgccau

SEQ ID NO: 1659070 - RNA, 19 nt, Salmonella enterica enterica serovar Typhi
ccgcagacuuuaaccauuc

SEQ ID NO: 1659071 - RNA, 22 nt, Salmonella enterica enterica serovar Typhi
ccgcagaucugucgccaugacc

SEQ ID NO: 1659072 - RNA, 23 nt, Salmonella enterica enterica serovar Typhi
ccgcagcacccgcucgcugcauu

SEQ ID NO: 1659073 - RNA, 20 nt, Salmonella enterica enterica serovar Typhi
ccgcacgguuagccggaaga

SEQ ID NO: 1659074 - RNA, 20 nt, Salmonella enterica enterica serovar Typhi
ccgcagaaggucacgccggg

SEQ ID NO: 1659075 - RNA, 15 nt, Salmonella enterica enterica serovar Typhi
ccgcacgcgcgccca

SEQ ID NO: 1659076 - RNA, 16 nt, Salmonella enterica enterica serovar Typhi
ccgaaaggaagcgggc

SEQ ID NO: 1659077 - RNA, 18 nt, Salmonella enterica enterica serovar Typhi
ccgaaaugaccaccgcau

SEQ ID NO: 1659078 - RNA, 17 nt, Salmonella enterica enterica serovar Typhi
ccgagccggguuauagc

SEQ ID NO: 1659079 - RNA, 12 nt, Salmonella enterica enterica serovar Typhi
ccgaggcgaaac

SEQ ID NO: 1659080 - RNA, 22 nt, Salmonella enterica enterica serovar Typhi
ccgaggguggacaugauaagcg

SEQ ID NO: 1659081 - RNA, 17 nt, Salmonella enterica enterica serovar Typhi
ccgaguggaaucagcca

SEQ ID NO: 1659082 - RNA, 13 nt, Salmonella enterica enterica serovar Typhi
ccgauaauggcgc

SEQ ID NO: 1659083 - RNA, 21 nt, Salmonella enterica enterica serovar Typhi
ccgauacaggacugacugcug

SEQ ID NO: 1659084 - RNA, 18 nt, Salmonella enterica enterica serovar Typhi
ccgauaagcaagcgccau

SEQ ID NO: 1659085 - RNA, 18 nt, Salmonella enterica enterica serovar Typhi
ccgauaauacgcgcgauu

SEQ ID NO: 1659086 - RNA, 15 nt, Salmonella enterica enterica serovar Typhi
ccgauaaacggcuuu

SEQ ID NO: 1659087 - RNA, 17 nt, Salmonella enterica enterica serovar Typhi
ccgauaagcaagcgcca

SEQ ID NO: 1659088 - RNA, 22 nt, Salmonella enterica enterica serovar Typhi
ccgauacaggacugacugcugu

SEQ ID NO: 1659089 - RNA, 17 nt, Salmonella enterica enterica serovar Typhi
ccgauauggaugcgcug

SEQ ID NO: 1659090 - RNA, 16 nt, Salmonella enterica enterica serovar Typhi
ccgauauggucgcuaa

SEQ ID NO: 1659091 - RNA, 16 nt, Salmonella enterica enterica serovar Typhi
ccgaucaccagcgcau

SEQ ID NO: 1659092 - RNA, 16 nt, Salmonella enterica enterica serovar Typhi
ccgauagcguaaagaa

SEQ ID NO: 1659093 - RNA, 13 nt, Salmonella enterica enterica serovar Typhi
ccgauaccggcaa

SEQ ID NO: 1659094 - RNA, 16 nt, Salmonella enterica enterica serovar Typhi
ccgaugcugaauagcc

SEQ ID NO: 1659095 - RNA, 17 nt, Salmonella enterica enterica serovar Typhi
ccgauggcgcugcguuu

SEQ ID NO: 1659096 - RNA, 21 nt, Salmonella enterica enterica serovar Typhi
ccgaugcucagggcauccgcc

SEQ ID NO: 1659097 - RNA, 15 nt, Salmonella enterica enterica serovar Typhi
ccgaugacccgcaau

SEQ ID NO: 1659098 - RNA, 11 nt, Salmonella enterica enterica serovar Typhi
ccgaugcacau

SEQ ID NO: 1659099 - RNA, 18 nt, Salmonella enterica enterica serovar Typhi
ccgaugccgacggcgcuu

SEQ ID NO: 1659100 - RNA, 22 nt, Salmonella enterica enterica serovar Typhi
ccgaugccgaucaccagcgcau

SEQ ID NO: 1659101 - RNA, 19 nt, Salmonella enterica enterica serovar Typhi
cacuguucaaucaucacga

SEQ ID NO: 1659102 - RNA, 14 nt, Salmonella enterica enterica serovar Typhi
cacuguugccgaca

SEQ ID NO: 1659103 - RNA, 16 nt, Salmonella enterica enterica serovar Typhi
cagaaaaaaaagcgcc

SEQ ID NO: 1659104 - RNA, 13 nt, Salmonella enterica enterica serovar Typhi
cagaaaaccggca

SEQ ID NO: 1659105 - RNA, 16 nt, Salmonella enterica enterica serovar Typhi
cagaagcaaauucagg

SEQ ID NO: 1659106 - RNA, 23 nt, Salmonella enterica enterica serovar Typhi
cagaaauaaaauacgcucaauau

SEQ ID NO: 1659107 - RNA, 18 nt, Salmonella enterica enterica serovar Typhi
cagaaagcggaccaaugc

SEQ ID NO: 1659108 - RNA, 14 nt, Salmonella enterica enterica serovar Typhi
cagaaucagugacc

SEQ ID NO: 1659109 - RNA, 16 nt, Salmonella enterica enterica serovar Typhi
cagaccaccagcgaca

SEQ ID NO: 1659110 - RNA, 18 nt, Salmonella enterica enterica serovar Typhi
cagaccaauagagagcga

SEQ ID NO: 1659111 - RNA, 23 nt, Salmonella enterica enterica serovar Typhi
cagaaggugaguuucgcaucagg

SEQ ID NO: 1659112 - RNA, 13 nt, Salmonella enterica enterica serovar Typhi
cagacccacagcc

SEQ ID NO: 1659113 - RNA, 16 nt, Salmonella enterica enterica serovar Typhi
cagacccacagccggu

SEQ ID NO: 1659114 - RNA, 17 nt, Salmonella enterica enterica serovar Typhi
cagaccauucaaccagc

SEQ ID NO: 1659115 - RNA, 13 nt, Salmonella enterica enterica serovar Typhi
cagacccgcaaua

SEQ ID NO: 1659116 - RNA, 18 nt, Salmonella enterica enterica serovar Typhi
cagaccgacgccaaccgc

SEQ ID NO: 1659117 - RNA, 20 nt, Salmonella enterica enterica serovar Typhi
cagacgccgcgcugcggcgu

SEQ ID NO: 1659118 - RNA, 21 nt, Salmonella enterica enterica serovar Typhi
cagaccuucaacccagcagca

SEQ ID NO: 1659119 - RNA, 16 nt, Salmonella enterica enterica serovar Typhi
cagacgaacggccuga

SEQ ID NO: 1659120 - RNA, 23 nt, Salmonella enterica enterica serovar Typhi
cagaccuuuauaagguuagccag

SEQ ID NO: 1659121 - RNA, 23 nt, Salmonella enterica enterica serovar Typhi
cagaccgccaagcgcggacagca

SEQ ID NO: 1659122 - RNA, 21 nt, Salmonella enterica enterica serovar Typhi
cagaccgggcgaaguuugccg

SEQ ID NO: 1659123 - RNA, 21 nt, Salmonella enterica enterica serovar Typhi
aaagaaccgacugucgaaacc

SEQ ID NO: 1659124 - RNA, 18 nt, Salmonella enterica enterica serovar Typhi
cagacuuuggauaaagcc

SEQ ID NO: 1659125 - RNA, 15 nt, Salmonella enterica enterica serovar Typhi
cacgucgauuuuccc

SEQ ID NO: 1659126 - RNA, 17 nt, Salmonella enterica enterica serovar Typhi
cacgucgucccaggcca

SEQ ID NO: 1659127 - RNA, 18 nt, Salmonella enterica enterica serovar Typhi
cacguuaucugaccuaca

SEQ ID NO: 1659128 - RNA, 18 nt, Salmonella enterica enterica serovar Typhi
cacguagccgucggcuuu

SEQ ID NO: 1659129 - RNA, 14 nt, Salmonella enterica enterica serovar Typhi
cacgucagcgacca

SEQ ID NO: 1659130 - RNA, 21 nt, Salmonella enterica enterica serovar Typhi
cacgucauccggcaagcgcug

SEQ ID NO: 1659131 - RNA, 18 nt, Salmonella enterica enterica serovar Typhi
cacuaagaccagcaucag

SEQ ID NO: 1659132 - RNA, 20 nt, Salmonella enterica enterica serovar Typhi
cacuacacagggucgucaaa

SEQ ID NO: 1659133 - RNA, 15 nt, Salmonella enterica enterica serovar Typhi
cacuaaaaacaggcu

SEQ ID NO: 1659134 - RNA, 16 nt, Salmonella enterica enterica serovar Typhi
cacguuaccggcgguu

SEQ ID NO: 1659135 - RNA, 20 nt, Salmonella enterica enterica serovar Typhi
cacugagcuucaccgccaga

SEQ ID NO: 1659136 - RNA, 17 nt, Salmonella enterica enterica serovar Typhi
cacucugggauuugcga

SEQ ID NO: 1659137 - RNA, 16 nt, Salmonella enterica enterica serovar Typhi
cacucuucaaccggca

SEQ ID NO: 1659138 - RNA, 22 nt, Salmonella enterica enterica serovar Typhi
cacugccgacgcccucaauauc

SEQ ID NO: 1659139 - RNA, 15 nt, Salmonella enterica enterica serovar Typhi
cacugccgccacgcc

SEQ ID NO: 1659140 - RNA, 13 nt, Salmonella enterica enterica serovar Typhi
cacggcauacucc

SEQ ID NO: 1659141 - RNA, 14 nt, Salmonella enterica enterica serovar Typhi
cacggcauucacgu

SEQ ID NO: 1659142 - RNA, 13 nt, Salmonella enterica enterica serovar Typhi
cacggcauucacg

SEQ ID NO: 1659143 - RNA, 20 nt, Salmonella enterica enterica serovar Typhi
cacgcuaugguacggcgugu

SEQ ID NO: 1659144 - RNA, 13 nt, Salmonella enterica enterica serovar Typhi
cacgcuaaagcgc

SEQ ID NO: 1659145 - RNA, 16 nt, Salmonella enterica enterica serovar Typhi
cacgcguuauacgcau

SEQ ID NO: 1659146 - RNA, 16 nt, Salmonella enterica enterica serovar Typhi
caccguuauccggcaa

SEQ ID NO: 1659147 - RNA, 13 nt, Salmonella enterica enterica serovar Typhi
caccguuauccgg

SEQ ID NO: 1659148 - RNA, 21 nt, Salmonella enterica enterica serovar Typhi
caccguuacgaacgaagguca

SEQ ID NO: 1659149 - RNA, 20 nt, Salmonella enterica enterica serovar Typhi
caccguuucuuugcugccgu

SEQ ID NO: 1659150 - RNA, 14 nt, Salmonella enterica enterica serovar Typhi
cacgcggcaucagg

SEQ ID NO: 1659151 - RNA, 20 nt, Salmonella enterica enterica serovar Typhi
cacgcgcgcgcgucaacgcc

SEQ ID NO: 1659152 - RNA, 12 nt, Salmonella enterica enterica serovar Typhi
aaacuggugcag

SEQ ID NO: 1659153 - RNA, 17 nt, Salmonella enterica enterica serovar Typhi
aaacuggagcacgcggu

SEQ ID NO: 1659154 - RNA, 15 nt, Salmonella enterica enterica serovar Typhi
aaacuggcaaauaaa

SEQ ID NO: 1659155 - RNA, 15 nt, Salmonella enterica enterica serovar Typhi
aaacuguucagcggu

SEQ ID NO: 1659156 - RNA, 13 nt, Salmonella enterica enterica serovar Typhi
cacggcuggcaau

SEQ ID NO: 1659157 - RNA, 14 nt, Salmonella enterica enterica serovar Typhi
aaacuucacgucgc

SEQ ID NO: 1659158 - RNA, 20 nt, Salmonella enterica enterica serovar Typhi
aaacuuauuucuaucgcuau

SEQ ID NO: 1659159 - RNA, 15 nt, Salmonella enterica enterica serovar Typhi
aaagaaacgcugauc

SEQ ID NO: 1659160 - RNA, 15 nt, Salmonella enterica enterica serovar Typhi
cacgguuuuacgcug

SEQ ID NO: 1659161 - RNA, 23 nt, Salmonella enterica enterica serovar Typhi
cacgguucacggccaaagcgcga

SEQ ID NO: 1659162 - RNA, 14 nt, Salmonella enterica enterica serovar Typhi
cacggggcggcaau

SEQ ID NO: 1659163 - RNA, 15 nt, Salmonella enterica enterica serovar Typhi
cagcaucacaucaaa

SEQ ID NO: 1659164 - RNA, 20 nt, Salmonella enterica enterica serovar Typhi
cagcaucaauagcagcuuca

SEQ ID NO: 1659165 - RNA, 20 nt, Salmonella enterica enterica serovar Typhi
cagcauaauaaagcagcggc

SEQ ID NO: 1659166 - RNA, 17 nt, Salmonella enterica enterica serovar Typhi
cagcauacgacaucgcc

SEQ ID NO: 1659167 - RNA, 12 nt, Salmonella enterica enterica serovar Typhi
cagcauaccgcc

SEQ ID NO: 1659168 - RNA, 17 nt, Salmonella enterica enterica serovar Typhi
cagcagccgggccagac

SEQ ID NO: 1659169 - RNA, 13 nt, Salmonella enterica enterica serovar Typhi
cagcagcgacgca

SEQ ID NO: 1659170 - RNA, 16 nt, Salmonella enterica enterica serovar Typhi
cagcaucggcagcgcc

SEQ ID NO: 1659171 - RNA, 17 nt, Salmonella enterica enterica serovar Typhi
cagcaucuccuggcgca

SEQ ID NO: 1659172 - RNA, 16 nt, Salmonella enterica enterica serovar Typhi
cagcaucguaccgugc

SEQ ID NO: 1659173 - RNA, 16 nt, Salmonella enterica enterica serovar Typhi
cagcaucgugccggaa

SEQ ID NO: 1659174 - RNA, 18 nt, Salmonella enterica enterica serovar Typhi
cagccaaucauaaacgcc

SEQ ID NO: 1659175 - RNA, 22 nt, Salmonella enterica enterica serovar Typhi
cagccaaucauaaacgccugac

SEQ ID NO: 1659176 - RNA, 17 nt, Salmonella enterica enterica serovar Typhi
cagccacuucuuccagc

SEQ ID NO: 1659177 - RNA, 15 nt, Salmonella enterica enterica serovar Typhi
cagccacacugcugu

SEQ ID NO: 1659178 - RNA, 14 nt, Salmonella enterica enterica serovar Typhi
cagccagacgccag

SEQ ID NO: 1659179 - RNA, 20 nt, Salmonella enterica enterica serovar Typhi
cagccacuucuuccagcggc

SEQ ID NO: 1659180 - RNA, 14 nt, Salmonella enterica enterica serovar Typhi
cagccagccgccaa

SEQ ID NO: 1659181 - RNA, 11 nt, Salmonella enterica enterica serovar Typhi
cagccagcggg

SEQ ID NO: 1659182 - RNA, 18 nt, Salmonella enterica enterica serovar Typhi
cagccaggccgccagcgu

SEQ ID NO: 1659183 - RNA, 17 nt, Salmonella enterica enterica serovar Typhi
cagauacggcgcgucgg

SEQ ID NO: 1659184 - RNA, 22 nt, Salmonella enterica enterica serovar Typhi
cagauagaaugcuucuucgcca

SEQ ID NO: 1659185 - RNA, 14 nt, Salmonella enterica enterica serovar Typhi
cagauaagcgucug

SEQ ID NO: 1659186 - RNA, 14 nt, Salmonella enterica enterica serovar Typhi
cagauaauccagcg

SEQ ID NO: 1659187 - RNA, 18 nt, Salmonella enterica enterica serovar Typhi
cagauagcccgccagcac

SEQ ID NO: 1659188 - RNA, 17 nt, Salmonella enterica enterica serovar Typhi
cagauagcgcugcgcca

SEQ ID NO: 1659189 - RNA, 17 nt, Salmonella enterica enterica serovar Typhi
cagcacacgccugaauu

SEQ ID NO: 1659190 - RNA, 13 nt, Salmonella enterica enterica serovar Typhi
cagcaacgcgcca

SEQ ID NO: 1659191 - RNA, 22 nt, Salmonella enterica enterica serovar Typhi
cagcacaauaccuucugcgccc

SEQ ID NO: 1659192 - RNA, 12 nt, Salmonella enterica enterica serovar Typhi
cagcaccaggau

SEQ ID NO: 1659193 - RNA, 13 nt, Salmonella enterica enterica serovar Typhi
cagcaccagcauu

SEQ ID NO: 1659194 - RNA, 14 nt, Salmonella enterica enterica serovar Typhi
cagcagccagccgu

SEQ ID NO: 1659195 - RNA, 17 nt, Salmonella enterica enterica serovar Typhi
cagccccgggcgacacg

SEQ ID NO: 1659196 - RNA, 22 nt, Salmonella enterica enterica serovar Typhi
cagcccaugaaggagcaaugag

SEQ ID NO: 1659197 - RNA, 18 nt, Salmonella enterica enterica serovar Typhi
cagccccagcgccagccg

SEQ ID NO: 1659198 - RNA, 18 nt, Salmonella enterica enterica serovar Typhi
cagccauucggcugccuu

SEQ ID NO: 1659199 - RNA, 20 nt, Salmonella enterica enterica serovar Typhi
cagccauguagaauagcgcc

SEQ ID NO: 1659200 - RNA, 17 nt, Salmonella enterica enterica serovar Typhi
cagccauucaccacugg

SEQ ID NO: 1659201 - RNA, 19 nt, Salmonella enterica enterica serovar Typhi
cagccaguccuccggcuga

SEQ ID NO: 1659202 - RNA, 17 nt, Salmonella enterica enterica serovar Typhi
cagccaggucugcacca

SEQ ID NO: 1659203 - RNA, 15 nt, Salmonella enterica enterica serovar Typhi
cagccauaaauauug

SEQ ID NO: 1659204 - RNA, 21 nt, Salmonella enterica enterica serovar Typhi
cagccgacuauuccgcaaacg

SEQ ID NO: 1659205 - RNA, 22 nt, Salmonella enterica enterica serovar Typhi
cagccgauagcaccucgcaaua

SEQ ID NO: 1659206 - RNA, 14 nt, Salmonella enterica enterica serovar Typhi
cagccgaucaggcc

SEQ ID NO: 1659207 - RNA, 20 nt, Salmonella enterica enterica serovar Typhi
cagccgacuauuccgcaaac

SEQ ID NO: 1659208 - RNA, 18 nt, Salmonella enterica enterica serovar Typhi
cagcccggacaucauccc

SEQ ID NO: 1659209 - RNA, 13 nt, Salmonella enterica enterica serovar Typhi
cagcgccgccugu

SEQ ID NO: 1659210 - RNA, 15 nt, Salmonella enterica enterica serovar Typhi
cagcgccauaaucca

SEQ ID NO: 1659211 - RNA, 23 nt, Salmonella enterica enterica serovar Typhi
cagcgccauauaaauuucaucca

SEQ ID NO: 1659212 - RNA, 14 nt, Salmonella enterica enterica serovar Typhi
cagcgccauccggc

SEQ ID NO: 1659213 - RNA, 17 nt, Salmonella enterica enterica serovar Typhi
cagcgccauccggcaaa

SEQ ID NO: 1659214 - RNA, 21 nt, Salmonella enterica enterica serovar Typhi
cagcgccauuaacgccaugac

SEQ ID NO: 1659215 - RNA, 16 nt, Salmonella enterica enterica serovar Typhi
cagcgcauaccggcca

SEQ ID NO: 1659216 - RNA, 15 nt, Salmonella enterica enterica serovar Typhi
cagcgcaacgcgcau

SEQ ID NO: 1659217 - RNA, 17 nt, Salmonella enterica enterica serovar Typhi
cagcgauuacgccagac

SEQ ID NO: 1659218 - RNA, 14 nt, Salmonella enterica enterica serovar Typhi
cagcgaugcgcgcg

SEQ ID NO: 1659219 - RNA, 19 nt, Salmonella enterica enterica serovar Typhi
cagccuuccuggucugcca

SEQ ID NO: 1659220 - RNA, 23 nt, Salmonella enterica enterica serovar Typhi
cagccugcuggucugaaucugcu

SEQ ID NO: 1659221 - RNA, 16 nt, Salmonella enterica enterica serovar Typhi
cagccucgcgcauccg

SEQ ID NO: 1659222 - RNA, 15 nt, Salmonella enterica enterica serovar Typhi
cagccuaccugccgc

SEQ ID NO: 1659223 - RNA, 13 nt, Salmonella enterica enterica serovar Typhi
cagccuaccgcuu

SEQ ID NO: 1659224 - RNA, 17 nt, Salmonella enterica enterica serovar Typhi
cagcgacgccagauuau

SEQ ID NO: 1659225 - RNA, 14 nt, Salmonella enterica enterica serovar Typhi
cagcgagacgcugg

SEQ ID NO: 1659226 - RNA, 12 nt, Salmonella enterica enterica serovar Typhi
caggacagcgac

SEQ ID NO: 1659227 - RNA, 20 nt, Salmonella enterica enterica serovar Typhi
caggacauggucaccaugac

SEQ ID NO: 1659228 - RNA, 19 nt, Salmonella enterica enterica serovar Typhi
cagcuuguuauccaucagc

SEQ ID NO: 1659229 - RNA, 12 nt, Salmonella enterica enterica serovar Typhi
caggaacgccau

SEQ ID NO: 1659230 - RNA, 18 nt, Salmonella enterica enterica serovar Typhi
caggaacgcggcgccgaa

SEQ ID NO: 1659231 - RNA, 16 nt, Salmonella enterica enterica serovar Typhi
caggaagccgguguac

SEQ ID NO: 1659232 - RNA, 20 nt, Salmonella enterica enterica serovar Typhi
caggaaggcgugcagcgugc

SEQ ID NO: 1659233 - RNA, 12 nt, Salmonella enterica enterica serovar Typhi
aaagccccggcu

SEQ ID NO: 1659234 - RNA, 14 nt, Salmonella enterica enterica serovar Typhi
aaagccaggccgcc

SEQ ID NO: 1659235 - RNA, 17 nt, Salmonella enterica enterica serovar Typhi
aaagcacuucucgcgca

SEQ ID NO: 1659236 - RNA, 16 nt, Salmonella enterica enterica serovar Typhi
aaagcacuccccggcu

SEQ ID NO: 1659237 - RNA, 22 nt, Salmonella enterica enterica serovar Typhi
caggcaccuguaaccuuaaaag

SEQ ID NO: 1659238 - RNA, 12 nt, Salmonella enterica enterica serovar Typhi
caggcaaucagc

SEQ ID NO: 1659239 - RNA, 15 nt, Salmonella enterica enterica serovar Typhi
caggcauggcagcag

SEQ ID NO: 1659240 - RNA, 13 nt, Salmonella enterica enterica serovar Typhi
caggcaucuucca

SEQ ID NO: 1659241 - RNA, 15 nt, Salmonella enterica enterica serovar Typhi
caggcaucuuccagc

SEQ ID NO: 1659242 - RNA, 19 nt, Salmonella enterica enterica serovar Typhi
caggccaacguaguuauug

SEQ ID NO: 1659243 - RNA, 15 nt, Salmonella enterica enterica serovar Typhi
caggcgagacgcgcc

SEQ ID NO: 1659244 - RNA, 17 nt, Salmonella enterica enterica serovar Typhi
caggccugguuaacaau

SEQ ID NO: 1659245 - RNA, 21 nt, Salmonella enterica enterica serovar Typhi
caggcuggagagcaacgccau

SEQ ID NO: 1659246 - RNA, 17 nt, Salmonella enterica enterica serovar Typhi
caggcucaucagcgcca

SEQ ID NO: 1659247 - RNA, 13 nt, Salmonella enterica enterica serovar Typhi
caggcgcuauucc

SEQ ID NO: 1659248 - RNA, 18 nt, Salmonella enterica enterica serovar Typhi
cagcuugaucaucagggc

SEQ ID NO: 1659249 - RNA, 23 nt, Salmonella enterica enterica serovar Typhi
cagcuucaggcucaucagcgcca

SEQ ID NO: 1659250 - RNA, 16 nt, Salmonella enterica enterica serovar Typhi
cagcuguuuaagcgcc

SEQ ID NO: 1659251 - RNA, 14 nt, Salmonella enterica enterica serovar Typhi
cagcuucgguccgg

SEQ ID NO: 1659252 - RNA, 19 nt, Salmonella enterica enterica serovar Typhi
cagcuucaggcucaucagc

SEQ ID NO: 1659253 - RNA, 17 nt, Salmonella enterica enterica serovar Typhi
cagcuggaaugcccacu

SEQ ID NO: 1659254 - RNA, 19 nt, Salmonella enterica enterica serovar Typhi
cagcucuuugguccauaac

SEQ ID NO: 1659255 - RNA, 17 nt, Salmonella enterica enterica serovar Typhi
cagcugacaaugugccg

SEQ ID NO: 1659256 - RNA, 16 nt, Salmonella enterica enterica serovar Typhi
cagcugaugcgaacgc

SEQ ID NO: 1659257 - RNA, 23 nt, Salmonella enterica enterica serovar Typhi
cagcuccauagaaaucagcaggu

SEQ ID NO: 1659258 - RNA, 21 nt, Salmonella enterica enterica serovar Typhi
cagcucaggguuuucuaccgc

SEQ ID NO: 1659259 - RNA, 14 nt, Salmonella enterica enterica serovar Typhi
cagcucacgcgcca

SEQ ID NO: 1659260 - RNA, 17 nt, Salmonella enterica enterica serovar Typhi
cagcucaucgaaccuau

SEQ ID NO: 1659261 - RNA, 18 nt, Salmonella enterica enterica serovar Typhi
cagcguuuaacugaacau

SEQ ID NO: 1659262 - RNA, 22 nt, Salmonella enterica enterica serovar Typhi
cagcuauuagcguuuuuaccgg

SEQ ID NO: 1659263 - RNA, 14 nt, Salmonella enterica enterica serovar Typhi
cagcucaccagcca

SEQ ID NO: 1659264 - RNA, 16 nt, Salmonella enterica enterica serovar Typhi
cagcgugaagcugccg

SEQ ID NO: 1659265 - RNA, 17 nt, Salmonella enterica enterica serovar Typhi
cagcgugaagcugccgu

SEQ ID NO: 1659266 - RNA, 17 nt, Salmonella enterica enterica serovar Typhi
cagcgccggauaaucca

SEQ ID NO: 1659267 - RNA, 18 nt, Salmonella enterica enterica serovar Typhi
cagcggcgguuauccgcc

SEQ ID NO: 1659268 - RNA, 11 nt, Salmonella enterica enterica serovar Typhi
cagcggcguug

SEQ ID NO: 1659269 - RNA, 17 nt, Salmonella enterica enterica serovar Typhi
cagcgucacaggcuucg

SEQ ID NO: 1659270 - RNA, 13 nt, Salmonella enterica enterica serovar Typhi
cagcgucccggcg

SEQ ID NO: 1659271 - RNA, 20 nt, Salmonella enterica enterica serovar Typhi
cagcgggcugucgcgaaagc

SEQ ID NO: 1659272 - RNA, 13 nt, Salmonella enterica enterica serovar Typhi
caucauugcgcca

SEQ ID NO: 1659273 - RNA, 17 nt, Salmonella enterica enterica serovar Typhi
cauccagacaugcacau

SEQ ID NO: 1659274 - RNA, 14 nt, Salmonella enterica enterica serovar Typhi
cauccagcgaaccu

SEQ ID NO: 1659275 - RNA, 13 nt, Salmonella enterica enterica serovar Typhi
caucccauccggg

SEQ ID NO: 1659276 - RNA, 12 nt, Salmonella enterica enterica serovar Typhi
caucccggcaac

SEQ ID NO: 1659277 - RNA, 13 nt, Salmonella enterica enterica serovar Typhi
caucauccgcgcu

SEQ ID NO: 1659278 - RNA, 15 nt, Salmonella enterica enterica serovar Typhi
caucaucgaacgccg

SEQ ID NO: 1659279 - RNA, 15 nt, Salmonella enterica enterica serovar Typhi
caucaugcagccggc

SEQ ID NO: 1659280 - RNA, 21 nt, Salmonella enterica enterica serovar Typhi
caucauuacaggcgaauagcg

SEQ ID NO: 1659281 - RNA, 18 nt, Salmonella enterica enterica serovar Typhi
caucaccaguugcgaagc

SEQ ID NO: 1659282 - RNA, 14 nt, Salmonella enterica enterica serovar Typhi
cauccugacaggcc

SEQ ID NO: 1659283 - RNA, 15 nt, Salmonella enterica enterica serovar Typhi
cauccugcgcacagc

SEQ ID NO: 1659284 - RNA, 18 nt, Salmonella enterica enterica serovar Typhi
cauccugauuuuacugac

SEQ ID NO: 1659285 - RNA, 14 nt, Salmonella enterica enterica serovar Typhi
cauccgcgaugugu

SEQ ID NO: 1659286 - RNA, 17 nt, Salmonella enterica enterica serovar Typhi
cauccugcgggaugcgu

SEQ ID NO: 1659287 - RNA, 21 nt, Salmonella enterica enterica serovar Typhi
caucgaagagcauaugcgcug

SEQ ID NO: 1659288 - RNA, 17 nt, Salmonella enterica enterica serovar Typhi
caucgcauauugcguau

SEQ ID NO: 1659289 - RNA, 19 nt, Salmonella enterica enterica serovar Typhi
cauaauaagcgcucaggca

SEQ ID NO: 1659290 - RNA, 14 nt, Salmonella enterica enterica serovar Typhi
cauaauaaauaggc

SEQ ID NO: 1659291 - RNA, 21 nt, Salmonella enterica enterica serovar Typhi
cauaagcugcgacaacaaguc

SEQ ID NO: 1659292 - RNA, 20 nt, Salmonella enterica enterica serovar Typhi
cauaaaauccugguaacggc

SEQ ID NO: 1659293 - RNA, 21 nt, Salmonella enterica enterica serovar Typhi
cauaaauagccgaccgccgau

SEQ ID NO: 1659294 - RNA, 18 nt, Salmonella enterica enterica serovar Typhi
cauacagcgauaaccgcc

SEQ ID NO: 1659295 - RNA, 16 nt, Salmonella enterica enterica serovar Typhi
cauacaguggccagac

SEQ ID NO: 1659296 - RNA, 15 nt, Salmonella enterica enterica serovar Typhi
cauaccagcgaaaug

SEQ ID NO: 1659297 - RNA, 19 nt, Salmonella enterica enterica serovar Typhi
cauaaucaguacugcgccc

SEQ ID NO: 1659298 - RNA, 17 nt, Salmonella enterica enterica serovar Typhi
cauaauccagaauacgc

SEQ ID NO: 1659299 - RNA, 12 nt, Salmonella enterica enterica serovar Typhi
cauaaucgcgau

SEQ ID NO: 1659300 - RNA, 22 nt, Salmonella enterica enterica serovar Typhi
cauaaucugugauugaauucac

SEQ ID NO: 1659301 - RNA, 22 nt, Salmonella enterica enterica serovar Typhi
caguuuuucgccaagaucgcca

SEQ ID NO: 1659302 - RNA, 23 nt, Salmonella enterica enterica serovar Typhi
caguugcgcgguuaacagccgcu

SEQ ID NO: 1659303 - RNA, 15 nt, Salmonella enterica enterica serovar Typhi
cauaguuugcauaac

SEQ ID NO: 1659304 - RNA, 15 nt, Salmonella enterica enterica serovar Typhi
cauaguuuuccagcc

SEQ ID NO: 1659305 - RNA, 19 nt, Salmonella enterica enterica serovar Typhi
cauaguuugcauaaccggu

SEQ ID NO: 1659306 - RNA, 20 nt, Salmonella enterica enterica serovar Typhi
cauaguccugccgacaggca

SEQ ID NO: 1659307 - RNA, 22 nt, Salmonella enterica enterica serovar Typhi
cauaggcgacaggcgugauagc

SEQ ID NO: 1659308 - RNA, 17 nt, Salmonella enterica enterica serovar Typhi
cauacaugccugcgcca

SEQ ID NO: 1659309 - RNA, 15 nt, Salmonella enterica enterica serovar Typhi
cauagcgcgaaugau

SEQ ID NO: 1659310 - RNA, 18 nt, Salmonella enterica enterica serovar Typhi
cauagcuuugccacuggc

SEQ ID NO: 1659311 - RNA, 13 nt, Salmonella enterica enterica serovar Typhi
cauagcuaccgcg

SEQ ID NO: 1659312 - RNA, 18 nt, Salmonella enterica enterica serovar Typhi
cauaggcaauauccuccg

SEQ ID NO: 1659313 - RNA, 13 nt, Salmonella enterica enterica serovar Typhi
cauaucugcgccg

SEQ ID NO: 1659314 - RNA, 14 nt, Salmonella enterica enterica serovar Typhi
cauauagccgcgca

SEQ ID NO: 1659315 - RNA, 12 nt, Salmonella enterica enterica serovar Typhi
caucaaacgcag

SEQ ID NO: 1659316 - RNA, 22 nt, Salmonella enterica enterica serovar Typhi
caucaaacgcagcaaacgccau

SEQ ID NO: 1659317 - RNA, 14 nt, Salmonella enterica enterica serovar Typhi
caucaaguaccgug

SEQ ID NO: 1659318 - RNA, 18 nt, Salmonella enterica enterica serovar Typhi
caggguuuaaucacgcca

SEQ ID NO: 1659319 - RNA, 14 nt, Salmonella enterica enterica serovar Typhi
caggguugcguucg

SEQ ID NO: 1659320 - RNA, 16 nt, Salmonella enterica enterica serovar Typhi
caggguuuuacgcugg

SEQ ID NO: 1659321 - RNA, 17 nt, Salmonella enterica enterica serovar Typhi
cagguaauacgcgucug

SEQ ID NO: 1659322 - RNA, 12 nt, Salmonella enterica enterica serovar Typhi
cagguagcgucg

SEQ ID NO: 1659323 - RNA, 18 nt, Salmonella enterica enterica serovar Typhi
cagguaucauaugugccg

SEQ ID NO: 1659324 - RNA, 23 nt, Salmonella enterica enterica serovar Typhi
cagguaucccgccagcggcgcca

SEQ ID NO: 1659325 - RNA, 19 nt, Salmonella enterica enterica serovar Typhi
cagguaugcuucagcguug

SEQ ID NO: 1659326 - RNA, 23 nt, Salmonella enterica enterica serovar Typhi
cagguauuaaauacagagucgcu

SEQ ID NO: 1659327 - RNA, 14 nt, Salmonella enterica enterica serovar Typhi
cagguuaucgccgc

SEQ ID NO: 1659328 - RNA, 16 nt, Salmonella enterica enterica serovar Typhi
cagguuaugcgcgcca

SEQ ID NO: 1659329 - RNA, 17 nt, Salmonella enterica enterica serovar Typhi
caggugugguacggcuu

SEQ ID NO: 1659330 - RNA, 18 nt, Salmonella enterica enterica serovar Typhi
caggugccgacucgcgca

SEQ ID NO: 1659331 - RNA, 20 nt, Salmonella enterica enterica serovar Typhi
caggucgccagaagccgucg

SEQ ID NO: 1659332 - RNA, 18 nt, Salmonella enterica enterica serovar Typhi
caguucgucuuccggaua

SEQ ID NO: 1659333 - RNA, 22 nt, Salmonella enterica enterica serovar Typhi
caguucgccuucuucaucuuca

SEQ ID NO: 1659334 - RNA, 16 nt, Salmonella enterica enterica serovar Typhi
caguucagccgccagu

SEQ ID NO: 1659335 - RNA, 22 nt, Salmonella enterica enterica serovar Typhi
caguucagacaccacgccggaa

SEQ ID NO: 1659336 - RNA, 24 nt, Salmonella enterica enterica serovar Typhi
caguaagggcagccgagacuaucg

SEQ ID NO: 1659337 - RNA, 19 nt, Salmonella enterica enterica serovar Typhi
caguaaaaucggaccuccg

SEQ ID NO: 1659338 - RNA, 16 nt, Salmonella enterica enterica serovar Typhi
caguaaauuaaacagc

SEQ ID NO: 1659339 - RNA, 14 nt, Salmonella enterica enterica serovar Typhi
caguacagcagcga

SEQ ID NO: 1659340 - RNA, 17 nt, Salmonella enterica enterica serovar Typhi
caguaauccggcaacug

SEQ ID NO: 1659341 - RNA, 13 nt, Salmonella enterica enterica serovar Typhi
caguaccagcgag

SEQ ID NO: 1659342 - RNA, 14 nt, Salmonella enterica enterica serovar Typhi
cagucggcgaacuu

SEQ ID NO: 1659343 - RNA, 20 nt, Salmonella enterica enterica serovar Typhi
cagucgcuauggugcggggu

SEQ ID NO: 1659344 - RNA, 21 nt, Salmonella enterica enterica serovar Typhi
cagugacccgccgccagcacc

SEQ ID NO: 1659345 - RNA, 14 nt, Salmonella enterica enterica serovar Typhi
cauguuccggcaga

SEQ ID NO: 1659346 - RNA, 14 nt, Salmonella enterica enterica serovar Typhi
cauguugccaugau

SEQ ID NO: 1659347 - RNA, 13 nt, Salmonella enterica enterica serovar Typhi
cauuaauaccauc

SEQ ID NO: 1659348 - RNA, 20 nt, Salmonella enterica enterica serovar Typhi
cauuaccgaccuguaccgcg

SEQ ID NO: 1659349 - RNA, 14 nt, Salmonella enterica enterica serovar Typhi
cauuagccgccagc

SEQ ID NO: 1659350 - RNA, 15 nt, Salmonella enterica enterica serovar Typhi
cauuauaagcgccaa

SEQ ID NO: 1659351 - RNA, 20 nt, Salmonella enterica enterica serovar Typhi
cauuauaagcgccaacggcc

SEQ ID NO: 1659352 - RNA, 16 nt, Salmonella enterica enterica serovar Typhi
cauguccagaucuuca

SEQ ID NO: 1659353 - RNA, 16 nt, Salmonella enterica enterica serovar Typhi
cauuauuuggauuacg

SEQ ID NO: 1659354 - RNA, 21 nt, Salmonella enterica enterica serovar Typhi
cauuauugcgaaauagcgcgg

SEQ ID NO: 1659355 - RNA, 17 nt, Salmonella enterica enterica serovar Typhi
cauuccggccaucgccg

SEQ ID NO: 1659356 - RNA, 18 nt, Salmonella enterica enterica serovar Typhi
cauucccagcucuuucaa

SEQ ID NO: 1659357 - RNA, 20 nt, Salmonella enterica enterica serovar Typhi
cauuccaggugucacucauc

SEQ ID NO: 1659358 - RNA, 21 nt, Salmonella enterica enterica serovar Typhi
cauucgauaaccgccgacagu

SEQ ID NO: 1659359 - RNA, 16 nt, Salmonella enterica enterica serovar Typhi
cauucgccccagcaua

SEQ ID NO: 1659360 - RNA, 17 nt, Salmonella enterica enterica serovar Typhi
cauucgccagcggaucg

SEQ ID NO: 1659361 - RNA, 17 nt, Salmonella enterica enterica serovar Typhi
cauugcaauaccggcug

SEQ ID NO: 1659362 - RNA, 18 nt, Salmonella enterica enterica serovar Typhi
cauugauuuccgcgcaau

SEQ ID NO: 1659363 - RNA, 16 nt, Salmonella enterica enterica serovar Typhi
cauugccacccauuua

SEQ ID NO: 1659364 - RNA, 23 nt, Salmonella enterica enterica serovar Typhi
cauugcauagaucuuugggccgg

SEQ ID NO: 1659365 - RNA, 21 nt, Salmonella enterica enterica serovar Typhi
cauugccgucaaacgcuauca

SEQ ID NO: 1659366 - RNA, 22 nt, Salmonella enterica enterica serovar Typhi
cauugaccaccauauucgccac

SEQ ID NO: 1659367 - RNA, 16 nt, Salmonella enterica enterica serovar Typhi
caugcggaaucacgca

SEQ ID NO: 1659368 - RNA, 15 nt, Salmonella enterica enterica serovar Typhi
cauggagauccagua

SEQ ID NO: 1659369 - RNA, 20 nt, Salmonella enterica enterica serovar Typhi
cauggauagucaugaaaucu

SEQ ID NO: 1659370 - RNA, 18 nt, Salmonella enterica enterica serovar Typhi
caugcuguuaccguaagc

SEQ ID NO: 1659371 - RNA, 18 nt, Salmonella enterica enterica serovar Typhi
caugcugaugacuaaugg

SEQ ID NO: 1659372 - RNA, 15 nt, Salmonella enterica enterica serovar Typhi
caugcggcgccauca

SEQ ID NO: 1659373 - RNA, 21 nt, Salmonella enterica enterica serovar Typhi
caugcggaaucacgcauaucc

SEQ ID NO: 1659374 - RNA, 15 nt, Salmonella enterica enterica serovar Typhi
cauggugaugaucgc

SEQ ID NO: 1659375 - RNA, 15 nt, Salmonella enterica enterica serovar Typhi
caugggaaauaacgu

SEQ ID NO: 1659376 - RNA, 19 nt, Salmonella enterica enterica serovar Typhi
caugggacgggucuccauc

SEQ ID NO: 1659377 - RNA, 12 nt, Salmonella enterica enterica serovar Typhi
cauggcuauucc

SEQ ID NO: 1659378 - RNA, 17 nt, Salmonella enterica enterica serovar Typhi
cauggcagccccggcau

SEQ ID NO: 1659379 - RNA, 16 nt, Salmonella enterica enterica serovar Typhi
cauugcugucgacaau

SEQ ID NO: 1659380 - RNA, 22 nt, Salmonella enterica enterica serovar Typhi
cauugcuguuaauuucccgcug

SEQ ID NO: 1659381 - RNA, 13 nt, Salmonella enterica enterica serovar Typhi
cauuguuaaucca

SEQ ID NO: 1659382 - RNA, 22 nt, Salmonella enterica enterica serovar Typhi
cauuugucgcuguuaaucucau

SEQ ID NO: 1659383 - RNA, 21 nt, Salmonella enterica enterica serovar Typhi
cauuuguuccucgaaacgcug

SEQ ID NO: 1659384 - RNA, 20 nt, Salmonella enterica enterica serovar Typhi
cauuuuguugcuccagcauc

SEQ ID NO: 1659385 - RNA, 21 nt, Salmonella enterica enterica serovar Typhi
cauuucaagcaggcgaucggc

SEQ ID NO: 1659386 - RNA, 13 nt, Salmonella enterica enterica serovar Typhi
cauuuagcgccug

SEQ ID NO: 1659387 - RNA, 16 nt, Salmonella enterica enterica serovar Typhi
cauuucgcccucgcca

SEQ ID NO: 1659388 - RNA, 14 nt, Salmonella enterica enterica serovar Typhi
cauuuccugcauua

SEQ ID NO: 1659389 - RNA, 15 nt, Salmonella enterica enterica serovar Typhi
cauuuccgcagccaa

SEQ ID NO: 1659390 - RNA, 14 nt, Salmonella enterica enterica serovar Typhi
ccaaaacgaacagg

SEQ ID NO: 1659391 - RNA, 14 nt, Salmonella enterica enterica serovar Typhi
ccaacaaucgcacc

SEQ ID NO: 1659392 - RNA, 21 nt, Salmonella enterica enterica serovar Typhi
ccaacaaggauauccgccagu

SEQ ID NO: 1659393 - RNA, 16 nt, Salmonella enterica enterica serovar Typhi
ccaacaccagccgcau

SEQ ID NO: 1659394 - RNA, 15 nt, Salmonella enterica enterica serovar Typhi
ccaaagaaacgcuga

SEQ ID NO: 1659395 - RNA, 19 nt, Salmonella enterica enterica serovar Typhi
ccaacaaggauauccgcca

SEQ ID NO: 1659396 - RNA, 19 nt, Salmonella enterica enterica serovar Typhi
ccaaaccggcgaauagcgc

SEQ ID NO: 1659397 - RNA, 16 nt, Salmonella enterica enterica serovar Typhi
ccaagcgucagcaugg

SEQ ID NO: 1659398 - RNA, 15 nt, Salmonella enterica enterica serovar Typhi
ccaauaaacgccagg

SEQ ID NO: 1659399 - RNA, 16 nt, Salmonella enterica enterica serovar Typhi
ccaauaacguaaccgc

SEQ ID NO: 1659400 - RNA, 15 nt, Salmonella enterica enterica serovar Typhi
ccaauaccggcguaa

SEQ ID NO: 1659401 - RNA, 19 nt, Salmonella enterica enterica serovar Typhi
ccaauacgaucggcuggaa

SEQ ID NO: 1659402 - RNA, 17 nt, Salmonella enterica enterica serovar Typhi
ccaauaccacaaccgga

SEQ ID NO: 1659403 - RNA, 16 nt, Salmonella enterica enterica serovar Typhi
ccaauacccagcgcca

SEQ ID NO: 1659404 - RNA, 17 nt, Salmonella enterica enterica serovar Typhi
ccaauacccagcgccaa

SEQ ID NO: 1659405 - RNA, 20 nt, Salmonella enterica enterica serovar Typhi
ccaauacccagcgccaacgc

SEQ ID NO: 1659406 - RNA, 22 nt, Salmonella enterica enterica serovar Typhi
ccaauaguuuauugagauaauu

SEQ ID NO: 1659407 - RNA, 20 nt, Salmonella enterica enterica serovar Typhi
ccacaauuguagcugcgcca

SEQ ID NO: 1659408 - RNA, 13 nt, Salmonella enterica enterica serovar Typhi
ccacagcgguaua

SEQ ID NO: 1659409 - RNA, 16 nt, Salmonella enterica enterica serovar Typhi
ccacaguuaacgccaa

SEQ ID NO: 1659410 - RNA, 16 nt, Salmonella enterica enterica serovar Typhi
ccacaccauaccgcuu

SEQ ID NO: 1659411 - RNA, 20 nt, Salmonella enterica enterica serovar Typhi
ccaccagaaucgccagcauc

SEQ ID NO: 1659412 - RNA, 17 nt, Salmonella enterica enterica serovar Typhi
ccacauauaacaaacgc

SEQ ID NO: 1659413 - RNA, 14 nt, Salmonella enterica enterica serovar Typhi
ccacaucagcggca

SEQ ID NO: 1659414 - RNA, 13 nt, Salmonella enterica enterica serovar Typhi
ccaccaccagcgu

SEQ ID NO: 1659415 - RNA, 14 nt, Salmonella enterica enterica serovar Typhi
ccaccaccagcauc

SEQ ID NO: 1659416 - RNA, 19 nt, Salmonella enterica enterica serovar Typhi
ccaccacccagugccacca

SEQ ID NO: 1659417 - RNA, 20 nt, Salmonella enterica enterica serovar Typhi
ccaccaggccugagccgaac

SEQ ID NO: 1659418 - RNA, 14 nt, Salmonella enterica enterica serovar Typhi
ccaccagcagggca

SEQ ID NO: 1659419 - RNA, 22 nt, Salmonella enterica enterica serovar Typhi
ccaccagcuuaucugaccaugc

SEQ ID NO: 1659420 - RNA, 21 nt, Salmonella enterica enterica serovar Typhi
ccaccaucgcauugccggcga

SEQ ID NO: 1659421 - RNA, 17 nt, Salmonella enterica enterica serovar Typhi
ccacgccgcuaucgacc

SEQ ID NO: 1659422 - RNA, 22 nt, Salmonella enterica enterica serovar Typhi
ccacgccuaaacugauagacaa

SEQ ID NO: 1659423 - RNA, 16 nt, Salmonella enterica enterica serovar Typhi
aaauacgcucaauaua

SEQ ID NO: 1659424 - RNA, 13 nt, Salmonella enterica enterica serovar Typhi
aaauaaacagcgc

SEQ ID NO: 1659425 - RNA, 15 nt, Salmonella enterica enterica serovar Typhi
aaagugcugaacaau

SEQ ID NO: 1659426 - RNA, 17 nt, Salmonella enterica enterica serovar Typhi
aaaguuaacacgauaaa

SEQ ID NO: 1659427 - RNA, 15 nt, Salmonella enterica enterica serovar Typhi
ccacgacauccggaa

SEQ ID NO: 1659428 - RNA, 13 nt, Salmonella enterica enterica serovar Typhi
ccaccuucgcgga

SEQ ID NO: 1659429 - RNA, 16 nt, Salmonella enterica enterica serovar Typhi
ccagacccaauaugcc

SEQ ID NO: 1659430 - RNA, 23 nt, Salmonella enterica enterica serovar Typhi
ccagaccccaguaauccggcaac

SEQ ID NO: 1659431 - RNA, 22 nt, Salmonella enterica enterica serovar Typhi
ccagacaucacguucgcgcaua

SEQ ID NO: 1659432 - RNA, 21 nt, Salmonella enterica enterica serovar Typhi
ccagaccacuaacccggcgac

SEQ ID NO: 1659433 - RNA, 20 nt, Salmonella enterica enterica serovar Typhi
ccagacacuggaaacagcca

SEQ ID NO: 1659434 - RNA, 20 nt, Salmonella enterica enterica serovar Typhi
ccagacacggugugccgcca

SEQ ID NO: 1659435 - RNA, 19 nt, Salmonella enterica enterica serovar Typhi
ccagaaucguggcugccac

SEQ ID NO: 1659436 - RNA, 13 nt, Salmonella enterica enterica serovar Typhi
ccagaauccgcgc

SEQ ID NO: 1659437 - RNA, 23 nt, Salmonella enterica enterica serovar Typhi
ccagaccgcuuaacuccggcgac

SEQ ID NO: 1659438 - RNA, 15 nt, Salmonella enterica enterica serovar Typhi
ccagagcgcgcuggc

SEQ ID NO: 1659439 - RNA, 12 nt, Salmonella enterica enterica serovar Typhi
ccagcacauuac

SEQ ID NO: 1659440 - RNA, 23 nt, Salmonella enterica enterica serovar Typhi
ccagcaaugauaacggcgccacg

SEQ ID NO: 1659441 - RNA, 23 nt, Salmonella enterica enterica serovar Typhi
ccagcaaguauuggcugccgaca

SEQ ID NO: 1659442 - RNA, 16 nt, Salmonella enterica enterica serovar Typhi
ccagauaaagcagcga

SEQ ID NO: 1659443 - RNA, 15 nt, Salmonella enterica enterica serovar Typhi
ccagauaaauagcgc

SEQ ID NO: 1659444 - RNA, 18 nt, Salmonella enterica enterica serovar Typhi
ccagauaaauagcgcugg

SEQ ID NO: 1659445 - RNA, 21 nt, Salmonella enterica enterica serovar Typhi
ccagauagcgaucgccgcuau

SEQ ID NO: 1659446 - RNA, 21 nt, Salmonella enterica enterica serovar Typhi
ccagauagcgcugcgccagau

SEQ ID NO: 1659447 - RNA, 20 nt, Salmonella enterica enterica serovar Typhi
ccagauaaugaucaacgcgg

SEQ ID NO: 1659448 - RNA, 12 nt, Salmonella enterica enterica serovar Typhi
ccagauaauagc

SEQ ID NO: 1659449 - RNA, 17 nt, Salmonella enterica enterica serovar Typhi
ccagauauugccgacca

SEQ ID NO: 1659450 - RNA, 20 nt, Salmonella enterica enterica serovar Typhi
ccacugagcuucaccgccag

SEQ ID NO: 1659451 - RNA, 12 nt, Salmonella enterica enterica serovar Typhi
ccacuagcgcuu

SEQ ID NO: 1659452 - RNA, 18 nt, Salmonella enterica enterica serovar Typhi
ccacucacgcucgcggaa

SEQ ID NO: 1659453 - RNA, 18 nt, Salmonella enterica enterica serovar Typhi
ccagaauagcgcagucaa

SEQ ID NO: 1659454 - RNA, 13 nt, Salmonella enterica enterica serovar Typhi
ccacgggcgccac

SEQ ID NO: 1659455 - RNA, 16 nt, Salmonella enterica enterica serovar Typhi
ccagccuaucgccaua

SEQ ID NO: 1659456 - RNA, 20 nt, Salmonella enterica enterica serovar Typhi
ccagccuaccugccgccaua

SEQ ID NO: 1659457 - RNA, 13 nt, Salmonella enterica enterica serovar Typhi
ccagccguuucuu

SEQ ID NO: 1659458 - RNA, 13 nt, Salmonella enterica enterica serovar Typhi
ccagcgauaaacg

SEQ ID NO: 1659459 - RNA, 19 nt, Salmonella enterica enterica serovar Typhi
ccagcgauuacgccagaca

SEQ ID NO: 1659460 - RNA, 24 nt, Salmonella enterica enterica serovar Typhi
ccagcgaugagcgccagcaacagc

SEQ ID NO: 1659461 - RNA, 22 nt, Salmonella enterica enterica serovar Typhi
ccagcgaaaaccagcgccgcca

SEQ ID NO: 1659462 - RNA, 13 nt, Salmonella enterica enterica serovar Typhi
ccagcgccagcgu

SEQ ID NO: 1659463 - RNA, 12 nt, Salmonella enterica enterica serovar Typhi
ccagcgccagaa

SEQ ID NO: 1659464 - RNA, 15 nt, Salmonella enterica enterica serovar Typhi
ccagcgcauugacga

SEQ ID NO: 1659465 - RNA, 12 nt, Salmonella enterica enterica serovar Typhi
ccagcgccggac

SEQ ID NO: 1659466 - RNA, 19 nt, Salmonella enterica enterica serovar Typhi
aaauauuucuuugucgcca

SEQ ID NO: 1659467 - RNA, 12 nt, Salmonella enterica enterica serovar Typhi
aaauauggcggg

SEQ ID NO: 1659468 - RNA, 13 nt, Salmonella enterica enterica serovar Typhi
ccagcgcggcaca

SEQ ID NO: 1659469 - RNA, 13 nt, Salmonella enterica enterica serovar Typhi
ccagcagcagccg

SEQ ID NO: 1659470 - RNA, 22 nt, Salmonella enterica enterica serovar Typhi
aaauagccccggucaacgcgcc

SEQ ID NO: 1659471 - RNA, 19 nt, Salmonella enterica enterica serovar Typhi
aaauagucaguuaacgcgu

SEQ ID NO: 1659472 - RNA, 14 nt, Salmonella enterica enterica serovar Typhi
aaauagcguccagc

SEQ ID NO: 1659473 - RNA, 19 nt, Salmonella enterica enterica serovar Typhi
ccagcaucggcagcgccag

SEQ ID NO: 1659474 - RNA, 15 nt, Salmonella enterica enterica serovar Typhi
ccagcaugcccgcca

SEQ ID NO: 1659475 - RNA, 20 nt, Salmonella enterica enterica serovar Typhi
ccagcaugauaguaucgcug

SEQ ID NO: 1659476 - RNA, 17 nt, Salmonella enterica enterica serovar Typhi
ccagcaugcccgccagc

SEQ ID NO: 1659477 - RNA, 15 nt, Salmonella enterica enterica serovar Typhi
ccagcauuagcgcca

SEQ ID NO: 1659478 - RNA, 17 nt, Salmonella enterica enterica serovar Typhi
cccuccaguagcagcga

SEQ ID NO: 1659479 - RNA, 22 nt, Salmonella enterica enterica serovar Typhi
cccucuuccaucagccaggcgg

SEQ ID NO: 1659480 - RNA, 20 nt, Salmonella enterica enterica serovar Typhi
cccuuacgcuuuauucuguc

SEQ ID NO: 1659481 - RNA, 15 nt, Salmonella enterica enterica serovar Typhi
cccuguaggccugau

SEQ ID NO: 1659482 - RNA, 19 nt, Salmonella enterica enterica serovar Typhi
cccugaugcguauccagcg

SEQ ID NO: 1659483 - RNA, 19 nt, Salmonella enterica enterica serovar Typhi
cccugaccuuccauccaca

SEQ ID NO: 1659484 - RNA, 19 nt, Salmonella enterica enterica serovar Typhi
cccugacaauacugcacgc

SEQ ID NO: 1659485 - RNA, 18 nt, Salmonella enterica enterica serovar Typhi
cccugcgguagcgccgau

SEQ ID NO: 1659486 - RNA, 17 nt, Salmonella enterica enterica serovar Typhi
cccugccaguagauggc

SEQ ID NO: 1659487 - RNA, 13 nt, Salmonella enterica enterica serovar Typhi
cccugcggcugau

SEQ ID NO: 1659488 - RNA, 15 nt, Salmonella enterica enterica serovar Typhi
cccgguaaacgucga

SEQ ID NO: 1659489 - RNA, 16 nt, Salmonella enterica enterica serovar Typhi
cccgguaagaaugcgc

SEQ ID NO: 1659490 - RNA, 18 nt, Salmonella enterica enterica serovar Typhi
cccgguacacuucagcca

SEQ ID NO: 1659491 - RNA, 15 nt, Salmonella enterica enterica serovar Typhi
cccggcgaccgguga

SEQ ID NO: 1659492 - RNA, 17 nt, Salmonella enterica enterica serovar Typhi
cccgcaaaccaggucug

SEQ ID NO: 1659493 - RNA, 13 nt, Salmonella enterica enterica serovar Typhi
cccgccagcacca

SEQ ID NO: 1659494 - RNA, 12 nt, Salmonella enterica enterica serovar Typhi
cccgccgccagc

SEQ ID NO: 1659495 - RNA, 13 nt, Salmonella enterica enterica serovar Typhi
cccgccgccugau

SEQ ID NO: 1659496 - RNA, 21 nt, Salmonella enterica enterica serovar Typhi
cccgccgagaauuucagcacg

SEQ ID NO: 1659497 - RNA, 16 nt, Salmonella enterica enterica serovar Typhi
cccgccagcugcgcgc

SEQ ID NO: 1659498 - RNA, 13 nt, Salmonella enterica enterica serovar Typhi
cccgccugagcgc

SEQ ID NO: 1659499 - RNA, 14 nt, Salmonella enterica enterica serovar Typhi
cccgcuaugaagac

SEQ ID NO: 1659500 - RNA, 16 nt, Salmonella enterica enterica serovar Typhi
cccgcugcgccguucc

SEQ ID NO: 1659501 - RNA, 21 nt, Salmonella enterica enterica serovar Typhi
cccggacgaacaacaucagac

SEQ ID NO: 1659502 - RNA, 22 nt, Salmonella enterica enterica serovar Typhi
cccgauagugcaagcucaucgg

SEQ ID NO: 1659503 - RNA, 19 nt, Salmonella enterica enterica serovar Typhi
cccgacucugacgccggua

SEQ ID NO: 1659504 - RNA, 14 nt, Salmonella enterica enterica serovar Typhi
cccgacgcgccacu

SEQ ID NO: 1659505 - RNA, 16 nt, Salmonella enterica enterica serovar Typhi
cccgacgcuggcgcaa

SEQ ID NO: 1659506 - RNA, 13 nt, Salmonella enterica enterica serovar Typhi
ccccucugauugg

SEQ ID NO: 1659507 - RNA, 19 nt, Salmonella enterica enterica serovar Typhi
ccccucuuccaucagccag

SEQ ID NO: 1659508 - RNA, 13 nt, Salmonella enterica enterica serovar Typhi
ccccuccggccag

SEQ ID NO: 1659509 - RNA, 23 nt, Salmonella enterica enterica serovar Typhi
ccagucauuaauucccgcagcca

SEQ ID NO: 1659510 - RNA, 13 nt, Salmonella enterica enterica serovar Typhi
ccagucgcuccac

SEQ ID NO: 1659511 - RNA, 15 nt, Salmonella enterica enterica serovar Typhi
ccaguucucaaucgc

SEQ ID NO: 1659512 - RNA, 14 nt, Salmonella enterica enterica serovar Typhi
ccaguuaucacggu

SEQ ID NO: 1659513 - RNA, 21 nt, Salmonella enterica enterica serovar Typhi
ccaguucauaagucauccaga

SEQ ID NO: 1659514 - RNA, 13 nt, Salmonella enterica enterica serovar Typhi
ccaguggcgaaac

SEQ ID NO: 1659515 - RNA, 20 nt, Salmonella enterica enterica serovar Typhi
ccaucagcgcgggauaacgc

SEQ ID NO: 1659516 - RNA, 13 nt, Salmonella enterica enterica serovar Typhi
ccaucagcgccag

SEQ ID NO: 1659517 - RNA, 17 nt, Salmonella enterica enterica serovar Typhi
ccaucaacaucaucgga

SEQ ID NO: 1659518 - RNA, 21 nt, Salmonella enterica enterica serovar Typhi
ccauaucgccgcugccgcuau

SEQ ID NO: 1659519 - RNA, 14 nt, Salmonella enterica enterica serovar Typhi
ccauauucacgcag

SEQ ID NO: 1659520 - RNA, 15 nt, Salmonella enterica enterica serovar Typhi
ccauauuuaugcagc

SEQ ID NO: 1659521 - RNA, 16 nt, Salmonella enterica enterica serovar Typhi
ccauauugccgcacau

SEQ ID NO: 1659522 - RNA, 14 nt, Salmonella enterica enterica serovar Typhi
ccaucaaacgcagc

SEQ ID NO: 1659523 - RNA, 15 nt, Salmonella enterica enterica serovar Typhi
ccaucaacagcguga

SEQ ID NO: 1659524 - RNA, 16 nt, Salmonella enterica enterica serovar Typhi
ccauaaagaagcgugc

SEQ ID NO: 1659525 - RNA, 13 nt, Salmonella enterica enterica serovar Typhi
ccauacagcccau

SEQ ID NO: 1659526 - RNA, 20 nt, Salmonella enterica enterica serovar Typhi
ccaguuguuccgcgcugaug

SEQ ID NO: 1659527 - RNA, 13 nt, Salmonella enterica enterica serovar Typhi
ccaguuucucaaa

SEQ ID NO: 1659528 - RNA, 15 nt, Salmonella enterica enterica serovar Typhi
ccauacagcccauac

SEQ ID NO: 1659529 - RNA, 18 nt, Salmonella enterica enterica serovar Typhi
ccauagaaaucagcaggu

SEQ ID NO: 1659530 - RNA, 22 nt, Salmonella enterica enterica serovar Typhi
ccauagcgggcagcauugacca

SEQ ID NO: 1659531 - RNA, 13 nt, Salmonella enterica enterica serovar Typhi
ccaguaauacgcc

SEQ ID NO: 1659532 - RNA, 12 nt, Salmonella enterica enterica serovar Typhi
ccaguaauccgg

SEQ ID NO: 1659533 - RNA, 15 nt, Salmonella enterica enterica serovar Typhi
ccaguaauccggcaa

SEQ ID NO: 1659534 - RNA, 23 nt, Salmonella enterica enterica serovar Typhi
ccaguaaucggcgcgaaacaggu

SEQ ID NO: 1659535 - RNA, 14 nt, Salmonella enterica enterica serovar Typhi
ccaguaaugccaua

SEQ ID NO: 1659536 - RNA, 16 nt, Salmonella enterica enterica serovar Typhi
ccaggucugcgcguuu

SEQ ID NO: 1659537 - RNA, 15 nt, Salmonella enterica enterica serovar Typhi
ccaggcuucaucgga

SEQ ID NO: 1659538 - RNA, 15 nt, Salmonella enterica enterica serovar Typhi
ccagggaaugccaua

SEQ ID NO: 1659539 - RNA, 12 nt, Salmonella enterica enterica serovar Typhi
cccacgccaucg

SEQ ID NO: 1659540 - RNA, 18 nt, Salmonella enterica enterica serovar Typhi
cccacgauguaugccgac

SEQ ID NO: 1659541 - RNA, 13 nt, Salmonella enterica enterica serovar Typhi
cccacuaacugcc

SEQ ID NO: 1659542 - RNA, 12 nt, Salmonella enterica enterica serovar Typhi
cccacuucgccg

SEQ ID NO: 1659543 - RNA, 19 nt, Salmonella enterica enterica serovar Typhi
aaaucggggucuuccagca

SEQ ID NO: 1659544 - RNA, 20 nt, Salmonella enterica enterica serovar Typhi
cccaauguuuuaccggcagc

SEQ ID NO: 1659545 - RNA, 13 nt, Salmonella enterica enterica serovar Typhi
cccaaugccgacg

SEQ ID NO: 1659546 - RNA, 22 nt, Salmonella enterica enterica serovar Typhi
cccaauaccggcguaauugcgc

SEQ ID NO: 1659547 - RNA, 17 nt, Salmonella enterica enterica serovar Typhi
cccagcgcgauacgcag

SEQ ID NO: 1659548 - RNA, 22 nt, Salmonella enterica enterica serovar Typhi
cccagcgccgagaaaaucagug

SEQ ID NO: 1659549 - RNA, 14 nt, Salmonella enterica enterica serovar Typhi
cccagcgaacuggc

SEQ ID NO: 1659550 - RNA, 13 nt, Salmonella enterica enterica serovar Typhi
cccagccagacgc

SEQ ID NO: 1659551 - RNA, 22 nt, Salmonella enterica enterica serovar Typhi
cccagcaaaucgcccaucacau

SEQ ID NO: 1659552 - RNA, 13 nt, Salmonella enterica enterica serovar Typhi
cccagauuacugc

SEQ ID NO: 1659553 - RNA, 18 nt, Salmonella enterica enterica serovar Typhi
ccaucgccagauaaauag

SEQ ID NO: 1659554 - RNA, 12 nt, Salmonella enterica enterica serovar Typhi
ccaucgccugau

SEQ ID NO: 1659555 - RNA, 16 nt, Salmonella enterica enterica serovar Typhi
ccaucggucgcgcgca

SEQ ID NO: 1659556 - RNA, 16 nt, Salmonella enterica enterica serovar Typhi
ccaucguaggcgcaaa

SEQ ID NO: 1659557 - RNA, 23 nt, Salmonella enterica enterica serovar Typhi
ccaucggcaucggucucgcuaua

SEQ ID NO: 1659558 - RNA, 23 nt, Salmonella enterica enterica serovar Typhi
ccaucgcguuguaaucgccugaa

SEQ ID NO: 1659559 - RNA, 16 nt, Salmonella enterica enterica serovar Typhi
ccaucauagcccauac

SEQ ID NO: 1659560 - RNA, 18 nt, Salmonella enterica enterica serovar Typhi
ccaucaggcuuugcgcca

SEQ ID NO: 1659561 - RNA, 18 nt, Salmonella enterica enterica serovar Typhi
ccauccgugcgaugagau

SEQ ID NO: 1659562 - RNA, 18 nt, Salmonella enterica enterica serovar Typhi
ccauccggcaauuaaccg

SEQ ID NO: 1659563 - RNA, 11 nt, Salmonella enterica enterica serovar Typhi
ccauccggcag

SEQ ID NO: 1659564 - RNA, 17 nt, Salmonella enterica enterica serovar Typhi
ccauggcaggcagcaca

SEQ ID NO: 1659565 - RNA, 14 nt, Salmonella enterica enterica serovar Typhi
ccauggagaaacag

SEQ ID NO: 1659566 - RNA, 14 nt, Salmonella enterica enterica serovar Typhi
ccaugauggcguaa

SEQ ID NO: 1659567 - RNA, 15 nt, Salmonella enterica enterica serovar Typhi
ccaugaugagcgcca

SEQ ID NO: 1659568 - RNA, 17 nt, Salmonella enterica enterica serovar Typhi
ccaugaacaccucauau

SEQ ID NO: 1659569 - RNA, 22 nt, Salmonella enterica enterica serovar Typhi
ccaucuccugcgauagcugcug

SEQ ID NO: 1659570 - RNA, 14 nt, Salmonella enterica enterica serovar Typhi
ccaucucuuccgcg

SEQ ID NO: 1659571 - RNA, 14 nt, Salmonella enterica enterica serovar Typhi
caagaucauccggg

SEQ ID NO: 1659572 - RNA, 14 nt, Salmonella enterica enterica serovar Typhi
caagagcagcaacc

SEQ ID NO: 1659573 - RNA, 23 nt, Salmonella enterica enterica serovar Typhi
caagaccgggcugcacgccaucg

SEQ ID NO: 1659574 - RNA, 15 nt, Salmonella enterica enterica serovar Typhi
caagccgccaacgcc

SEQ ID NO: 1659575 - RNA, 19 nt, Salmonella enterica enterica serovar Typhi
caaggcuauuagccaaagc

SEQ ID NO: 1659576 - RNA, 20 nt, Salmonella enterica enterica serovar Typhi
caagcugggcguuacuggcg

SEQ ID NO: 1659577 - RNA, 15 nt, Salmonella enterica enterica serovar Typhi
caacggcaagccggu

SEQ ID NO: 1659578 - RNA, 16 nt, Salmonella enterica enterica serovar Typhi
caacggcacaacggcc

SEQ ID NO: 1659579 - RNA, 19 nt, Salmonella enterica enterica serovar Typhi
caacucuuuacccagcggg

SEQ ID NO: 1659580 - RNA, 16 nt, Salmonella enterica enterica serovar Typhi
caacugaaaccaggca

SEQ ID NO: 1659581 - RNA, 20 nt, Salmonella enterica enterica serovar Typhi
caacguaaauuacuuaugau

SEQ ID NO: 1659582 - RNA, 18 nt, Salmonella enterica enterica serovar Typhi
caacguaaucccgccagc

SEQ ID NO: 1659583 - RNA, 20 nt, Salmonella enterica enterica serovar Typhi
caauggcgacgaucagcgcc

SEQ ID NO: 1659584 - RNA, 20 nt, Salmonella enterica enterica serovar Typhi
caauguucugggaauaggcc

SEQ ID NO: 1659585 - RNA, 18 nt, Salmonella enterica enterica serovar Typhi
caauuuuacagccucucu

SEQ ID NO: 1659586 - RNA, 16 nt, Salmonella enterica enterica serovar Typhi
caaucucgccaaugcc

SEQ ID NO: 1659587 - RNA, 18 nt, Salmonella enterica enterica serovar Typhi
caaugauucaagcgggug

SEQ ID NO: 1659588 - RNA, 16 nt, Salmonella enterica enterica serovar Typhi
caaucuuuacccggcg

SEQ ID NO: 1659589 - RNA, 23 nt, Salmonella enterica enterica serovar Typhi
caauggauuuauggcacaucagg

SEQ ID NO: 1659590 - RNA, 21 nt, Salmonella enterica enterica serovar Typhi
caauagcgcuaaacagcgccg

SEQ ID NO: 1659591 - RNA, 20 nt, Salmonella enterica enterica serovar Typhi
caauagcagcuucacgcgcu

SEQ ID NO: 1659592 - RNA, 20 nt, Salmonella enterica enterica serovar Typhi
caauagagagcgacagcccg

SEQ ID NO: 1659593 - RNA, 21 nt, Salmonella enterica enterica serovar Typhi
caauagaccugaaaucagccu

SEQ ID NO: 1659594 - RNA, 23 nt, Salmonella enterica enterica serovar Typhi
caauaguuaauguugaaccguca

SEQ ID NO: 1659595 - RNA, 14 nt, Salmonella enterica enterica serovar Typhi
caauauaccgucag

SEQ ID NO: 1659596 - RNA, 17 nt, Salmonella enterica enterica serovar Typhi
caauauccgccccgcug

SEQ ID NO: 1659597 - RNA, 20 nt, Salmonella enterica enterica serovar Typhi
caaucagacgccgggccugc

SEQ ID NO: 1659598 - RNA, 19 nt, Salmonella enterica enterica serovar Typhi
caaucgacaaaacacggcu

SEQ ID NO: 1659599 - RNA, 15 nt, Salmonella enterica enterica serovar Typhi
caaucacucucuugu

SEQ ID NO: 1659600 - RNA, 22 nt, Salmonella enterica enterica serovar Typhi
caaucacgccgauaaugcguuu

SEQ ID NO: 1659601 - RNA, 18 nt, Salmonella enterica enterica serovar Typhi
caauaugcgucagcgcgg

SEQ ID NO: 1659602 - RNA, 12 nt, Salmonella enterica enterica serovar Typhi
caauaugcuguu

SEQ ID NO: 1659603 - RNA, 22 nt, Salmonella enterica enterica serovar Typhi
caauaugucuuaaacagcgauc

SEQ ID NO: 1659604 - RNA, 17 nt, Salmonella enterica enterica serovar Typhi
caaccuccacgcccagc

SEQ ID NO: 1659605 - RNA, 14 nt, Salmonella enterica enterica serovar Typhi
caaccggaugccga

SEQ ID NO: 1659606 - RNA, 19 nt, Salmonella enterica enterica serovar Typhi
caaccggaaucgggucagg

SEQ ID NO: 1659607 - RNA, 15 nt, Salmonella enterica enterica serovar Typhi
caaccgcaccggauc

SEQ ID NO: 1659608 - RNA, 14 nt, Salmonella enterica enterica serovar Typhi
caacccgcuaccgc

SEQ ID NO: 1659609 - RNA, 17 nt, Salmonella enterica enterica serovar Typhi
caaccccagacggcggc

SEQ ID NO: 1659610 - RNA, 20 nt, Salmonella enterica enterica serovar Typhi
caacgccgcuuuaccgccuu

SEQ ID NO: 1659611 - RNA, 18 nt, Salmonella enterica enterica serovar Typhi
caacgccgccgacaugac

SEQ ID NO: 1659612 - RNA, 20 nt, Salmonella enterica enterica serovar Typhi
caaccuuugggcagauaucg

SEQ ID NO: 1659613 - RNA, 23 nt, Salmonella enterica enterica serovar Typhi
caaccagcgcggccagaaugccc

SEQ ID NO: 1659614 - RNA, 19 nt, Salmonella enterica enterica serovar Typhi
caaccagugcggcaaccac

SEQ ID NO: 1659615 - RNA, 16 nt, Salmonella enterica enterica serovar Typhi
caaccaaugcaacgcc

SEQ ID NO: 1659616 - RNA, 22 nt, Salmonella enterica enterica serovar Typhi
caacagcgacgccagauuaucg

SEQ ID NO: 1659617 - RNA, 18 nt, Salmonella enterica enterica serovar Typhi
caacacgcgcaccaguuc

SEQ ID NO: 1659618 - RNA, 11 nt, Salmonella enterica enterica serovar Typhi
caacagcgacc

SEQ ID NO: 1659619 - RNA, 15 nt, Salmonella enterica enterica serovar Typhi
auuuacugugaucca

SEQ ID NO: 1659620 - RNA, 20 nt, Salmonella enterica enterica serovar Typhi
auuuacgguuggccagcaug

SEQ ID NO: 1659621 - RNA, 20 nt, Salmonella enterica enterica serovar Typhi
caaauacugcuuuuccggca

SEQ ID NO: 1659622 - RNA, 21 nt, Salmonella enterica enterica serovar Typhi
caaauacugcuuuuccggcag

SEQ ID NO: 1659623 - RNA, 17 nt, Salmonella enterica enterica serovar Typhi
caaauacggaccuggcg

SEQ ID NO: 1659624 - RNA, 22 nt, Salmonella enterica enterica serovar Typhi
caaauaagguggcuaacccgcu

SEQ ID NO: 1659625 - RNA, 18 nt, Salmonella enterica enterica serovar Typhi
caaaguugcccgaugcgc

SEQ ID NO: 1659626 - RNA, 17 nt, Salmonella enterica enterica serovar Typhi
caaaguuaaucagcgcc

SEQ ID NO: 1659627 - RNA, 16 nt, Salmonella enterica enterica serovar Typhi
caaagcgccagauaug

SEQ ID NO: 1659628 - RNA, 20 nt, Salmonella enterica enterica serovar Typhi
caaagccgccauccggccug

SEQ ID NO: 1659629 - RNA, 21 nt, Salmonella enterica enterica serovar Typhi
caaagcguugcaaccccagac

SEQ ID NO: 1659630 - RNA, 15 nt, Salmonella enterica enterica serovar Typhi
caaaugggaucuuca

SEQ ID NO: 1659631 - RNA, 22 nt, Salmonella enterica enterica serovar Typhi
caccacgcccggaucaaacaua

SEQ ID NO: 1659632 - RNA, 21 nt, Salmonella enterica enterica serovar Typhi
caccaaccaggcaaaccagca

SEQ ID NO: 1659633 - RNA, 19 nt, Salmonella enterica enterica serovar Typhi
cacauuucuuuugaucguc

SEQ ID NO: 1659634 - RNA, 16 nt, Salmonella enterica enterica serovar Typhi
caccaaagccaggccg

SEQ ID NO: 1659635 - RNA, 13 nt, Salmonella enterica enterica serovar Typhi
cacauuagcgggc

SEQ ID NO: 1659636 - RNA, 16 nt, Salmonella enterica enterica serovar Typhi
cacaaacuccagacga

SEQ ID NO: 1659637 - RNA, 20 nt, Salmonella enterica enterica serovar Typhi
cacaaaaaaaccgcucaacu

SEQ ID NO: 1659638 - RNA, 22 nt, Salmonella enterica enterica serovar Typhi
cacaaaucuguuaucuggaugu

SEQ ID NO: 1659639 - RNA, 17 nt, Salmonella enterica enterica serovar Typhi
cacaggcgugguggaua

SEQ ID NO: 1659640 - RNA, 18 nt, Salmonella enterica enterica serovar Typhi
cacaucagcaaaugaacc

SEQ ID NO: 1659641 - RNA, 17 nt, Salmonella enterica enterica serovar Typhi
cacauaucgccagccau

SEQ ID NO: 1659642 - RNA, 14 nt, Salmonella enterica enterica serovar Typhi
cacauaagccacuu

SEQ ID NO: 1659643 - RNA, 18 nt, Salmonella enterica enterica serovar Typhi
cacauaaucaccgcaaau

SEQ ID NO: 1659644 - RNA, 15 nt, Salmonella enterica enterica serovar Typhi
cacauaccgucacca

SEQ ID NO: 1659645 - RNA, 18 nt, Salmonella enterica enterica serovar Typhi
cacauaacaaaaccagca

SEQ ID NO: 1659646 - RNA, 12 nt, Salmonella enterica enterica serovar Typhi
cacauaacugag

SEQ ID NO: 1659647 - RNA, 15 nt, Salmonella enterica enterica serovar Typhi
cacaguuaacgccaa

SEQ ID NO: 1659648 - RNA, 12 nt, Salmonella enterica enterica serovar Typhi
caccagcgaucc

SEQ ID NO: 1659649 - RNA, 16 nt, Salmonella enterica enterica serovar Typhi
caccagcgaugcgcgc

SEQ ID NO: 1659650 - RNA, 20 nt, Salmonella enterica enterica serovar Typhi
caccauaauuaccggcacac

SEQ ID NO: 1659651 - RNA, 16 nt, Salmonella enterica enterica serovar Typhi
caccauaaaucauuac

SEQ ID NO: 1659652 - RNA, 19 nt, Salmonella enterica enterica serovar Typhi
cacccgcacuaccagcucg

SEQ ID NO: 1659653 - RNA, 16 nt, Salmonella enterica enterica serovar Typhi
caccauuaucgcuccg

SEQ ID NO: 1659654 - RNA, 17 nt, Salmonella enterica enterica serovar Typhi
caccauaucgcagacca

SEQ ID NO: 1659655 - RNA, 17 nt, Salmonella enterica enterica serovar Typhi
caccauaccgacgacca

SEQ ID NO: 1659656 - RNA, 14 nt, Salmonella enterica enterica serovar Typhi
caccaugcaaaaug

SEQ ID NO: 1659657 - RNA, 15 nt, Salmonella enterica enterica serovar Typhi
caccgggccaaugcc

SEQ ID NO: 1659658 - RNA, 14 nt, Salmonella enterica enterica serovar Typhi
caccggcacaucca

SEQ ID NO: 1659659 - RNA, 15 nt, Salmonella enterica enterica serovar Typhi
caccgccagagcacg

SEQ ID NO: 1659660 - RNA, 15 nt, Salmonella enterica enterica serovar Typhi
caccgccaaacgcgg

SEQ ID NO: 1659661 - RNA, 13 nt, Salmonella enterica enterica serovar Typhi
augaucgacaaug

SEQ ID NO: 1659662 - RNA, 23 nt, Salmonella enterica enterica serovar Typhi
augaucagcgacgguccuggcca

SEQ ID NO: 1659663 - RNA, 16 nt, Salmonella enterica enterica serovar Typhi
augaucagacgcacaa

SEQ ID NO: 1659664 - RNA, 16 nt, Salmonella enterica enterica serovar Typhi
augauaagugauaccg

SEQ ID NO: 1659665 - RNA, 14 nt, Salmonella enterica enterica serovar Typhi
augauaaugccgcu

SEQ ID NO: 1659666 - RNA, 18 nt, Salmonella enterica enterica serovar Typhi
augacgguauucccgguc

SEQ ID NO: 1659667 - RNA, 16 nt, Salmonella enterica enterica serovar Typhi
augacguaagcggcga

SEQ ID NO: 1659668 - RNA, 17 nt, Salmonella enterica enterica serovar Typhi
augacgguucaucgcag

SEQ ID NO: 1659669 - RNA, 22 nt, Salmonella enterica enterica serovar Typhi
augaccccuccggccagcgcca

SEQ ID NO: 1659670 - RNA, 17 nt, Salmonella enterica enterica serovar Typhi
augaccccuccggccag

SEQ ID NO: 1659671 - RNA, 19 nt, Salmonella enterica enterica serovar Typhi
augaauuacagcucauaaa

SEQ ID NO: 1659672 - RNA, 20 nt, Salmonella enterica enterica serovar Typhi
augaccaguacaggcgguaa

SEQ ID NO: 1659673 - RNA, 14 nt, Salmonella enterica enterica serovar Typhi
augaccauucacac

SEQ ID NO: 1659674 - RNA, 18 nt, Salmonella enterica enterica serovar Typhi
aucuuucagcgccggaaa

SEQ ID NO: 1659675 - RNA, 23 nt, Salmonella enterica enterica serovar Typhi
augaaucgcgugcgcugcggcca

SEQ ID NO: 1659676 - RNA, 17 nt, Salmonella enterica enterica serovar Typhi
augaauauuuugcugga

SEQ ID NO: 1659677 - RNA, 22 nt, Salmonella enterica enterica serovar Typhi
aucuccgggaaaaacgugucca

SEQ ID NO: 1659678 - RNA, 19 nt, Salmonella enterica enterica serovar Typhi
aucugcgucaguaccugau

SEQ ID NO: 1659679 - RNA, 16 nt, Salmonella enterica enterica serovar Typhi
aucugcuccgccagca

SEQ ID NO: 1659680 - RNA, 21 nt, Salmonella enterica enterica serovar Typhi
aucuguaauugacgcgucagg

SEQ ID NO: 1659681 - RNA, 22 nt, Salmonella enterica enterica serovar Typhi
aucuguuccacagaucuaucug

SEQ ID NO: 1659682 - RNA, 15 nt, Salmonella enterica enterica serovar Typhi
aucuucacuguuauc

SEQ ID NO: 1659683 - RNA, 18 nt, Salmonella enterica enterica serovar Typhi
aucuucgauaaacucaau

SEQ ID NO: 1659684 - RNA, 13 nt, Salmonella enterica enterica serovar Typhi
aucuuccagcauc

SEQ ID NO: 1659685 - RNA, 22 nt, Salmonella enterica enterica serovar Typhi
aucuucauaaauagccagcauc

SEQ ID NO: 1659686 - RNA, 17 nt, Salmonella enterica enterica serovar Typhi
aucgguaggccggauaa

SEQ ID NO: 1659687 - RNA, 23 nt, Salmonella enterica enterica serovar Typhi
aucgucaaaaccaaacagcgaca

SEQ ID NO: 1659688 - RNA, 18 nt, Salmonella enterica enterica serovar Typhi
aucgucaccaggaugcca

SEQ ID NO: 1659689 - RNA, 18 nt, Salmonella enterica enterica serovar Typhi
aucgguaguguuaucgcc

SEQ ID NO: 1659690 - RNA, 16 nt, Salmonella enterica enterica serovar Typhi
aucgucguuccgccag

SEQ ID NO: 1659691 - RNA, 13 nt, Salmonella enterica enterica serovar Typhi
aucgucguugcug

SEQ ID NO: 1659692 - RNA, 16 nt, Salmonella enterica enterica serovar Typhi
aucguuugcaguuccg

SEQ ID NO: 1659693 - RNA, 18 nt, Salmonella enterica enterica serovar Typhi
aucgugaccaccgccaua

SEQ ID NO: 1659694 - RNA, 17 nt, Salmonella enterica enterica serovar Typhi
aucguugccagcggcca

SEQ ID NO: 1659695 - RNA, 18 nt, Salmonella enterica enterica serovar Typhi
aucgugagcgcgucauca

SEQ ID NO: 1659696 - RNA, 12 nt, Salmonella enterica enterica serovar Typhi
aucuauucagcc

SEQ ID NO: 1659697 - RNA, 17 nt, Salmonella enterica enterica serovar Typhi
aucuacgcuauuuccag

SEQ ID NO: 1659698 - RNA, 20 nt, Salmonella enterica enterica serovar Typhi
aucggauuauuuucacgcca

SEQ ID NO: 1659699 - RNA, 18 nt, Salmonella enterica enterica serovar Typhi
aucggcacgcgaucgcga

SEQ ID NO: 1659700 - RNA, 16 nt, Salmonella enterica enterica serovar Typhi
aucggcaccuggagcg

SEQ ID NO: 1659701 - RNA, 23 nt, Salmonella enterica enterica serovar Typhi
aucggcaugauggcgaacagccc

SEQ ID NO: 1659702 - RNA, 14 nt, Salmonella enterica enterica serovar Typhi
aucggccagcgcca

SEQ ID NO: 1659703 - RNA, 19 nt, Salmonella enterica enterica serovar Typhi
aucggccauauccagccag

SEQ ID NO: 1659704 - RNA, 14 nt, Salmonella enterica enterica serovar Typhi
aucggcguaccgca

SEQ ID NO: 1659705 - RNA, 16 nt, Salmonella enterica enterica serovar Typhi
aucgccugaucgcgca

SEQ ID NO: 1659706 - RNA, 15 nt, Salmonella enterica enterica serovar Typhi
aucgccugauggcgc

SEQ ID NO: 1659707 - RNA, 15 nt, Salmonella enterica enterica serovar Typhi
aucgccugcggcgua

SEQ ID NO: 1659708 - RNA, 21 nt, Salmonella enterica enterica serovar Typhi
aucgcgauuuuuuuccgcccg

SEQ ID NO: 1659709 - RNA, 12 nt, Salmonella enterica enterica serovar Typhi
aucgcgccaucg

SEQ ID NO: 1659710 - RNA, 20 nt, Salmonella enterica enterica serovar Typhi
aucgccgccacauugcgcgc

SEQ ID NO: 1659711 - RNA, 23 nt, Salmonella enterica enterica serovar Typhi
aucgccgccagcucaugcgcggc

SEQ ID NO: 1659712 - RNA, 13 nt, Salmonella enterica enterica serovar Typhi
aucgccgccaucg

SEQ ID NO: 1659713 - RNA, 23 nt, Salmonella enterica enterica serovar Typhi
aucgccgcccgcaugguaaacgc

SEQ ID NO: 1659714 - RNA, 23 nt, Salmonella enterica enterica serovar Typhi
aucgccgucuucuucuucgcgca

SEQ ID NO: 1659715 - RNA, 22 nt, Salmonella enterica enterica serovar Typhi
aucgccgcgccggacuccagca

SEQ ID NO: 1659716 - RNA, 12 nt, Salmonella enterica enterica serovar Typhi
aucgcgcggcga

SEQ ID NO: 1659717 - RNA, 22 nt, Salmonella enterica enterica serovar Typhi
aucgcgccaugauucaucccgc

SEQ ID NO: 1659718 - RNA, 15 nt, Salmonella enterica enterica serovar Typhi
aucgcggccagcaug

SEQ ID NO: 1659719 - RNA, 16 nt, Salmonella enterica enterica serovar Typhi
aucgcguacagcgcca

SEQ ID NO: 1659720 - RNA, 20 nt, Salmonella enterica enterica serovar Typhi
aucggaagacuggcgcagca

SEQ ID NO: 1659721 - RNA, 23 nt, Salmonella enterica enterica serovar Typhi
aucggaaacuauccuggccugau

SEQ ID NO: 1659722 - RNA, 20 nt, Salmonella enterica enterica serovar Typhi
aucgcguuguaaucgccuga

SEQ ID NO: 1659723 - RNA, 17 nt, Salmonella enterica enterica serovar Typhi
aucgcugaccaacguca

SEQ ID NO: 1659724 - RNA, 16 nt, Salmonella enterica enterica serovar Typhi
aucgcugucggucaga

SEQ ID NO: 1659725 - RNA, 23 nt, Salmonella enterica enterica serovar Typhi
aucgaggcuggucgcgauagccg

SEQ ID NO: 1659726 - RNA, 15 nt, Salmonella enterica enterica serovar Typhi
aucgagaagccauca

SEQ ID NO: 1659727 - RNA, 20 nt, Salmonella enterica enterica serovar Typhi
aucgacguugaucgccaucg

SEQ ID NO: 1659728 - RNA, 18 nt, Salmonella enterica enterica serovar Typhi
aucgacggccuugcuggc

SEQ ID NO: 1659729 - RNA, 17 nt, Salmonella enterica enterica serovar Typhi
aucaggcaaugucugcc

SEQ ID NO: 1659730 - RNA, 19 nt, Salmonella enterica enterica serovar Typhi
aucaggcauggcagcaggg

SEQ ID NO: 1659731 - RNA, 19 nt, Salmonella enterica enterica serovar Typhi
aucaggccaagcaacauuu

SEQ ID NO: 1659732 - RNA, 22 nt, Salmonella enterica enterica serovar Typhi
aucgacagggguguuacgccau

SEQ ID NO: 1659733 - RNA, 22 nt, Salmonella enterica enterica serovar Typhi
aucaggccugccugaucgccac

SEQ ID NO: 1659734 - RNA, 19 nt, Salmonella enterica enterica serovar Typhi
aucgauggcagucgcauca

SEQ ID NO: 1659735 - RNA, 22 nt, Salmonella enterica enterica serovar Typhi
aucgcauuaacguccauaccgg

SEQ ID NO: 1659736 - RNA, 18 nt, Salmonella enterica enterica serovar Typhi
aucgcauaaauauccggg

SEQ ID NO: 1659737 - RNA, 22 nt, Salmonella enterica enterica serovar Typhi
aucgccaaaguuaaucagcgaa

SEQ ID NO: 1659738 - RNA, 14 nt, Salmonella enterica enterica serovar Typhi
aucgccagcagcgc

SEQ ID NO: 1659739 - RNA, 12 nt, Salmonella enterica enterica serovar Typhi
aucgccagcuuc

SEQ ID NO: 1659740 - RNA, 15 nt, Salmonella enterica enterica serovar Typhi
aucgccccauuggcg

SEQ ID NO: 1659741 - RNA, 14 nt, Salmonella enterica enterica serovar Typhi
aucgcccaucacau

SEQ ID NO: 1659742 - RNA, 18 nt, Salmonella enterica enterica serovar Typhi
aucgccauuacgccgacg

SEQ ID NO: 1659743 - RNA, 13 nt, Salmonella enterica enterica serovar Typhi
aucgccauuacgc

SEQ ID NO: 1659744 - RNA, 15 nt, Salmonella enterica enterica serovar Typhi
aucgccaucagcgcg

SEQ ID NO: 1659745 - RNA, 17 nt, Salmonella enterica enterica serovar Typhi
aucgccaucagcgcgaa

SEQ ID NO: 1659746 - RNA, 20 nt, Salmonella enterica enterica serovar Typhi
aucgccaucaacuccuccgg

SEQ ID NO: 1659747 - RNA, 23 nt, Salmonella enterica enterica serovar Typhi
auugccggcaucauucugcaggc

SEQ ID NO: 1659748 - RNA, 19 nt, Salmonella enterica enterica serovar Typhi
auugccggauggcggcgua

SEQ ID NO: 1659749 - RNA, 24 nt, Salmonella enterica enterica serovar Typhi
auugccggauggggcauuagccgc

SEQ ID NO: 1659750 - RNA, 20 nt, Salmonella enterica enterica serovar Typhi
auugauuuccgcgcaaucgc

SEQ ID NO: 1659751 - RNA, 21 nt, Salmonella enterica enterica serovar Typhi
auugaucacaaaaucauugcg

SEQ ID NO: 1659752 - RNA, 11 nt, Salmonella enterica enterica serovar Typhi
auuuaccagug

SEQ ID NO: 1659753 - RNA, 15 nt, Salmonella enterica enterica serovar Typhi
auuuaccacgguaac

SEQ ID NO: 1659754 - RNA, 20 nt, Salmonella enterica enterica serovar Typhi
auuggcaaaccccugcucgc

SEQ ID NO: 1659755 - RNA, 19 nt, Salmonella enterica enterica serovar Typhi
auuggcaauuaaaccaccg

SEQ ID NO: 1659756 - RNA, 18 nt, Salmonella enterica enterica serovar Typhi
auugcuuucaauuuccgc

SEQ ID NO: 1659757 - RNA, 15 nt, Salmonella enterica enterica serovar Typhi
auuggggaaccuggc

SEQ ID NO: 1659758 - RNA, 17 nt, Salmonella enterica enterica serovar Typhi
auuccucgaucgccugg

SEQ ID NO: 1659759 - RNA, 22 nt, Salmonella enterica enterica serovar Typhi
auucauuaaaauugaacggacg

SEQ ID NO: 1659760 - RNA, 16 nt, Salmonella enterica enterica serovar Typhi
auuccguuugcgccgg

SEQ ID NO: 1659761 - RNA, 17 nt, Salmonella enterica enterica serovar Typhi
auucggcgcuucgcagc

SEQ ID NO: 1659762 - RNA, 21 nt, Salmonella enterica enterica serovar Typhi
auucgguaagcuuauccugcc

SEQ ID NO: 1659763 - RNA, 22 nt, Salmonella enterica enterica serovar Typhi
auugaguaaauaaaucagcgcg

SEQ ID NO: 1659764 - RNA, 12 nt, Salmonella enterica enterica serovar Typhi
auugaagugcga

SEQ ID NO: 1659765 - RNA, 19 nt, Salmonella enterica enterica serovar Typhi
auucuuuaauuugugccag

SEQ ID NO: 1659766 - RNA, 15 nt, Salmonella enterica enterica serovar Typhi
auucuugccgcaucu

SEQ ID NO: 1659767 - RNA, 21 nt, Salmonella enterica enterica serovar Typhi
auucugcuucgucuucggcga

SEQ ID NO: 1659768 - RNA, 16 nt, Salmonella enterica enterica serovar Typhi
auucugcgaaagccuc

SEQ ID NO: 1659769 - RNA, 13 nt, Salmonella enterica enterica serovar Typhi
auuaucgccauca

SEQ ID NO: 1659770 - RNA, 18 nt, Salmonella enterica enterica serovar Typhi
auuauccacaaacuccag

SEQ ID NO: 1659771 - RNA, 13 nt, Salmonella enterica enterica serovar Typhi
auucaucaaaaug

SEQ ID NO: 1659772 - RNA, 20 nt, Salmonella enterica enterica serovar Typhi
auucauaaugguugugccag

SEQ ID NO: 1659773 - RNA, 15 nt, Salmonella enterica enterica serovar Typhi
auucauagccacagc

SEQ ID NO: 1659774 - RNA, 19 nt, Salmonella enterica enterica serovar Typhi
auucaacagggguuccggc

SEQ ID NO: 1659775 - RNA, 13 nt, Salmonella enterica enterica serovar Typhi
auuagcgccaccg

SEQ ID NO: 1659776 - RNA, 14 nt, Salmonella enterica enterica serovar Typhi
auuagccgccaucc

SEQ ID NO: 1659777 - RNA, 12 nt, Salmonella enterica enterica serovar Typhi
auuagccgccag

SEQ ID NO: 1659778 - RNA, 16 nt, Salmonella enterica enterica serovar Typhi
auuaauacaucacuuu

SEQ ID NO: 1659779 - RNA, 20 nt, Salmonella enterica enterica serovar Typhi
auuaggcguaaaauugccgc

SEQ ID NO: 1659780 - RNA, 16 nt, Salmonella enterica enterica serovar Typhi
auuaguccugccgcua

SEQ ID NO: 1659781 - RNA, 14 nt, Salmonella enterica enterica serovar Typhi
auuaacuccggacg

SEQ ID NO: 1659782 - RNA, 23 nt, Salmonella enterica enterica serovar Typhi
auuaacagcuucaugcgccgcga

SEQ ID NO: 1659783 - RNA, 17 nt, Salmonella enterica enterica serovar Typhi
auuaacagucuaucgcu

SEQ ID NO: 1659784 - RNA, 12 nt, Salmonella enterica enterica serovar Typhi
auuaacagcgcc

SEQ ID NO: 1659785 - RNA, 17 nt, Salmonella enterica enterica serovar Typhi
auguucauaccggauau

SEQ ID NO: 1659786 - RNA, 17 nt, Salmonella enterica enterica serovar Typhi
auguucaauaucaaauu

SEQ ID NO: 1659787 - RNA, 17 nt, Salmonella enterica enterica serovar Typhi
auguuaauuucaucgcc

SEQ ID NO: 1659788 - RNA, 15 nt, Salmonella enterica enterica serovar Typhi
auguuagcaaaaaug

SEQ ID NO: 1659789 - RNA, 17 nt, Salmonella enterica enterica serovar Typhi
augugccacuccgccag

SEQ ID NO: 1659790 - RNA, 19 nt, Salmonella enterica enterica serovar Typhi
auguucgcuucugccgcca

SEQ ID NO: 1659791 - RNA, 17 nt, Salmonella enterica enterica serovar Typhi
auguucuugccgccauc

SEQ ID NO: 1659792 - RNA, 15 nt, Salmonella enterica enterica serovar Typhi
auguuuccguuugua

SEQ ID NO: 1659793 - RNA, 23 nt, Salmonella enterica enterica serovar Typhi
auuaaaagucaacugcucuacca

SEQ ID NO: 1659794 - RNA, 21 nt, Salmonella enterica enterica serovar Typhi
auuaaaugacgcccugcgcca

SEQ ID NO: 1659795 - RNA, 17 nt, Salmonella enterica enterica serovar Typhi
auuaaaguucagccgau

SEQ ID NO: 1659796 - RNA, 20 nt, Salmonella enterica enterica serovar Typhi
augucguuguaguuaucgcc

SEQ ID NO: 1659797 - RNA, 20 nt, Salmonella enterica enterica serovar Typhi
augucgacauaauuuccggc

SEQ ID NO: 1659798 - RNA, 22 nt, Salmonella enterica enterica serovar Typhi
augucggcguaaauccagccuc

SEQ ID NO: 1659799 - RNA, 17 nt, Salmonella enterica enterica serovar Typhi
augucccaucguaacgc

SEQ ID NO: 1659800 - RNA, 19 nt, Salmonella enterica enterica serovar Typhi
auguccgccuaccagcaca

SEQ ID NO: 1659801 - RNA, 15 nt, Salmonella enterica enterica serovar Typhi
auguccgccuaccag

SEQ ID NO: 1659802 - RNA, 20 nt, Salmonella enterica enterica serovar Typhi
auguaguccgggugcaaauc

SEQ ID NO: 1659803 - RNA, 20 nt, Salmonella enterica enterica serovar Typhi
auguagagcggauaagcgca

SEQ ID NO: 1659804 - RNA, 22 nt, Salmonella enterica enterica serovar Typhi
auggucgccuccguaugaccgc

SEQ ID NO: 1659805 - RNA, 21 nt, Salmonella enterica enterica serovar Typhi
auggucuguaccaccagaauc

SEQ ID NO: 1659806 - RNA, 22 nt, Salmonella enterica enterica serovar Typhi
augguguuggcaaucagcggca

SEQ ID NO: 1659807 - RNA, 16 nt, Salmonella enterica enterica serovar Typhi
auggcccaaaagguag

SEQ ID NO: 1659808 - RNA, 20 nt, Salmonella enterica enterica serovar Typhi
auggccuucaaucagcacgc

SEQ ID NO: 1659809 - RNA, 22 nt, Salmonella enterica enterica serovar Typhi
auggccugcucaauacuuuccg

SEQ ID NO: 1659810 - RNA, 18 nt, Salmonella enterica enterica serovar Typhi
auggccagcaccagcauu

SEQ ID NO: 1659811 - RNA, 20 nt, Salmonella enterica enterica serovar Typhi
auggcgcugcgcuuaucaga

SEQ ID NO: 1659812 - RNA, 20 nt, Salmonella enterica enterica serovar Typhi
auggcgcuacgcuuauccgg

SEQ ID NO: 1659813 - RNA, 16 nt, Salmonella enterica enterica serovar Typhi
auggcgcucuuuucca

SEQ ID NO: 1659814 - RNA, 20 nt, Salmonella enterica enterica serovar Typhi
auggcguggcgcuuuccggc

SEQ ID NO: 1659815 - RNA, 20 nt, Salmonella enterica enterica serovar Typhi
auggcggcgaaaugccuuau

SEQ ID NO: 1659816 - RNA, 13 nt, Salmonella enterica enterica serovar Typhi
auggcggcgcaaa

SEQ ID NO: 1659817 - RNA, 17 nt, Salmonella enterica enterica serovar Typhi
auggcuugugaauacca

SEQ ID NO: 1659818 - RNA, 16 nt, Salmonella enterica enterica serovar Typhi
augcgcuuccagcaug

SEQ ID NO: 1659819 - RNA, 13 nt, Salmonella enterica enterica serovar Typhi
augcgcuuuccgc

SEQ ID NO: 1659820 - RNA, 16 nt, Salmonella enterica enterica serovar Typhi
augcggccauccugcg

SEQ ID NO: 1659821 - RNA, 11 nt, Salmonella enterica enterica serovar Typhi
augccuggcag

SEQ ID NO: 1659822 - RNA, 21 nt, Salmonella enterica enterica serovar Typhi
augcgcagcaugaucggcugg

SEQ ID NO: 1659823 - RNA, 16 nt, Salmonella enterica enterica serovar Typhi
augcgcucauaaccgc

SEQ ID NO: 1659824 - RNA, 17 nt, Salmonella enterica enterica serovar Typhi
augcuaaaacagauaac

SEQ ID NO: 1659825 - RNA, 12 nt, Salmonella enterica enterica serovar Typhi
augcuggugcau

SEQ ID NO: 1659826 - RNA, 13 nt, Salmonella enterica enterica serovar Typhi
augcguccgccag

SEQ ID NO: 1659827 - RNA, 20 nt, Salmonella enterica enterica serovar Typhi
augcgucgcauccuuaugca

SEQ ID NO: 1659828 - RNA, 23 nt, Salmonella enterica enterica serovar Typhi
augccgauaauaaacgcgccaag

SEQ ID NO: 1659829 - RNA, 21 nt, Salmonella enterica enterica serovar Typhi
augccgauagucuccgccacc

SEQ ID NO: 1659830 - RNA, 17 nt, Salmonella enterica enterica serovar Typhi
augaugcucgcucauca

SEQ ID NO: 1659831 - RNA, 13 nt, Salmonella enterica enterica serovar Typhi
augauggcuccug

SEQ ID NO: 1659832 - RNA, 15 nt, Salmonella enterica enterica serovar Typhi
augaugauugccgga

SEQ ID NO: 1659833 - RNA, 20 nt, Salmonella enterica enterica serovar Typhi
augccuaacguguuaucgcu

SEQ ID NO: 1659834 - RNA, 15 nt, Salmonella enterica enterica serovar Typhi
augccucuuccggua

SEQ ID NO: 1659835 - RNA, 13 nt, Salmonella enterica enterica serovar Typhi
augccguagcggc

SEQ ID NO: 1659836 - RNA, 20 nt, Salmonella enterica enterica serovar Typhi
augccgcuggcguauucgcc

SEQ ID NO: 1659837 - RNA, 17 nt, Salmonella enterica enterica serovar Typhi
augccgcgucaggagcg

SEQ ID NO: 1659838 - RNA, 22 nt, Salmonella enterica enterica serovar Typhi
aggcgacuaccguucacggcga

SEQ ID NO: 1659839 - RNA, 22 nt, Salmonella enterica enterica serovar Typhi
aggcgaacuucauccacgccga

SEQ ID NO: 1659840 - RNA, 18 nt, Salmonella enterica enterica serovar Typhi
aggcgaaccccaugccga

SEQ ID NO: 1659841 - RNA, 23 nt, Salmonella enterica enterica serovar Typhi
aggcgaccguuccguccgucagg

SEQ ID NO: 1659842 - RNA, 23 nt, Salmonella enterica enterica serovar Typhi
aggcgaaacggcggaaccauuuu

SEQ ID NO: 1659843 - RNA, 20 nt, Salmonella enterica enterica serovar Typhi
aggccugguaagcguagcgc

SEQ ID NO: 1659844 - RNA, 22 nt, Salmonella enterica enterica serovar Typhi
aggccucuaucuucucaggcga

SEQ ID NO: 1659845 - RNA, 18 nt, Salmonella enterica enterica serovar Typhi
aggccugaugagcgcagc

SEQ ID NO: 1659846 - RNA, 20 nt, Salmonella enterica enterica serovar Typhi
aggccugcaucaacaggcga

SEQ ID NO: 1659847 - RNA, 21 nt, Salmonella enterica enterica serovar Typhi
aggccuaucagcgauccgccg

SEQ ID NO: 1659848 - RNA, 23 nt, Salmonella enterica enterica serovar Typhi
aggccuaucagcgauccgccguc

SEQ ID NO: 1659849 - RNA, 12 nt, Salmonella enterica enterica serovar Typhi
aggccuacgcuc

SEQ ID NO: 1659850 - RNA, 14 nt, Salmonella enterica enterica serovar Typhi
aggcgcauaucgcc

SEQ ID NO: 1659851 - RNA, 20 nt, Salmonella enterica enterica serovar Typhi
aggcgcauccgucaggccca

SEQ ID NO: 1659852 - RNA, 18 nt, Salmonella enterica enterica serovar Typhi
aggcgccaguuggcguac

SEQ ID NO: 1659853 - RNA, 21 nt, Salmonella enterica enterica serovar Typhi
aggcgccgcucaucaccagca

SEQ ID NO: 1659854 - RNA, 16 nt, Salmonella enterica enterica serovar Typhi
aggcgcuguacgccuc

SEQ ID NO: 1659855 - RNA, 21 nt, Salmonella enterica enterica serovar Typhi
aggcgcugcguaguaccagua

SEQ ID NO: 1659856 - RNA, 14 nt, Salmonella enterica enterica serovar Typhi
aggcgcuggcgagc

SEQ ID NO: 1659857 - RNA, 17 nt, Salmonella enterica enterica serovar Typhi
aggcgcguuuacuggcg

SEQ ID NO: 1659858 - RNA, 21 nt, Salmonella enterica enterica serovar Typhi
aggcagccggauuuuaaauug

SEQ ID NO: 1659859 - RNA, 17 nt, Salmonella enterica enterica serovar Typhi
agcuggcauaaccgcag

SEQ ID NO: 1659860 - RNA, 16 nt, Salmonella enterica enterica serovar Typhi
aggccagauucaccac

SEQ ID NO: 1659861 - RNA, 21 nt, Salmonella enterica enterica serovar Typhi
aggccacgcagcgcagaccga

SEQ ID NO: 1659862 - RNA, 16 nt, Salmonella enterica enterica serovar Typhi
aggcauggcagcaggg

SEQ ID NO: 1659863 - RNA, 23 nt, Salmonella enterica enterica serovar Typhi
aggcauccagacccacagccggu

SEQ ID NO: 1659864 - RNA, 22 nt, Salmonella enterica enterica serovar Typhi
aggcauacagaugccguccauc

SEQ ID NO: 1659865 - RNA, 14 nt, Salmonella enterica enterica serovar Typhi
aggcaucagauaaa

SEQ ID NO: 1659866 - RNA, 20 nt, Salmonella enterica enterica serovar Typhi
aggccgcgauacccgcgauc

SEQ ID NO: 1659867 - RNA, 20 nt, Salmonella enterica enterica serovar Typhi
aggccgggcaagcgaagcgc

SEQ ID NO: 1659868 - RNA, 15 nt, Salmonella enterica enterica serovar Typhi
aggccggacaggcga

SEQ ID NO: 1659869 - RNA, 19 nt, Salmonella enterica enterica serovar Typhi
aggcuuaacacccggauau

SEQ ID NO: 1659870 - RNA, 13 nt, Salmonella enterica enterica serovar Typhi
agggccaggcgcg

SEQ ID NO: 1659871 - RNA, 14 nt, Salmonella enterica enterica serovar Typhi
agggccaggcgcga

SEQ ID NO: 1659872 - RNA, 17 nt, Salmonella enterica enterica serovar Typhi
agggccgauaccggcaa

SEQ ID NO: 1659873 - RNA, 14 nt, Salmonella enterica enterica serovar Typhi
agggcgagcguagc

SEQ ID NO: 1659874 - RNA, 18 nt, Salmonella enterica enterica serovar Typhi
agggcgugccgugagcgc

SEQ ID NO: 1659875 - RNA, 16 nt, Salmonella enterica enterica serovar Typhi
agggcgugacgcgcca

SEQ ID NO: 1659876 - RNA, 18 nt, Salmonella enterica enterica serovar Typhi
aggcgguuugcaggccgg

SEQ ID NO: 1659877 - RNA, 23 nt, Salmonella enterica enterica serovar Typhi
aggcguagcuggucgccagcgcc

SEQ ID NO: 1659878 - RNA, 21 nt, Salmonella enterica enterica serovar Typhi
aggcguuuacgcugcuauccg

SEQ ID NO: 1659879 - RNA, 13 nt, Salmonella enterica enterica serovar Typhi
aggcuaaauggca

SEQ ID NO: 1659880 - RNA, 12 nt, Salmonella enterica enterica serovar Typhi
aggcugaagcgc

SEQ ID NO: 1659881 - RNA, 15 nt, Salmonella enterica enterica serovar Typhi
aggcucaucagcgcc

SEQ ID NO: 1659882 - RNA, 21 nt, Salmonella enterica enterica serovar Typhi
aggcuccaaguauugauaccu

SEQ ID NO: 1659883 - RNA, 23 nt, Salmonella enterica enterica serovar Typhi
aggcggcgccgcgccgccguagc

SEQ ID NO: 1659884 - RNA, 18 nt, Salmonella enterica enterica serovar Typhi
aggcgguuaacagacccg

SEQ ID NO: 1659885 - RNA, 14 nt, Salmonella enterica enterica serovar Typhi
aggugaaccauuga

SEQ ID NO: 1659886 - RNA, 15 nt, Salmonella enterica enterica serovar Typhi
aggugagggcgucgc

SEQ ID NO: 1659887 - RNA, 20 nt, Salmonella enterica enterica serovar Typhi
aggucggguaagcguagcgc

SEQ ID NO: 1659888 - RNA, 16 nt, Salmonella enterica enterica serovar Typhi
agggugaauaccagcg

SEQ ID NO: 1659889 - RNA, 14 nt, Salmonella enterica enterica serovar Typhi
aggucauugcgcca

SEQ ID NO: 1659890 - RNA, 22 nt, Salmonella enterica enterica serovar Typhi
agguuugacucgcuacgcucgc

SEQ ID NO: 1659891 - RNA, 22 nt, Salmonella enterica enterica serovar Typhi
aggugccuggguuccaggcgga

SEQ ID NO: 1659892 - RNA, 19 nt, Salmonella enterica enterica serovar Typhi
aguaacgcacuuuuccagc

SEQ ID NO: 1659893 - RNA, 19 nt, Salmonella enterica enterica serovar Typhi
aguaacugcccgucggacu

SEQ ID NO: 1659894 - RNA, 19 nt, Salmonella enterica enterica serovar Typhi
aguagacgguaacggcugg

SEQ ID NO: 1659895 - RNA, 18 nt, Salmonella enterica enterica serovar Typhi
aguaugaccccuccggcc

SEQ ID NO: 1659896 - RNA, 18 nt, Salmonella enterica enterica serovar Typhi
aguaugcuuauugucgcc

SEQ ID NO: 1659897 - RNA, 16 nt, Salmonella enterica enterica serovar Typhi
aguauguuaacgccga

SEQ ID NO: 1659898 - RNA, 17 nt, Salmonella enterica enterica serovar Typhi
aguaucgggauggcgau

SEQ ID NO: 1659899 - RNA, 21 nt, Salmonella enterica enterica serovar Typhi
aguauaucggcgaguagcgca

SEQ ID NO: 1659900 - RNA, 21 nt, Salmonella enterica enterica serovar Typhi
aguuccgccagacucagccag

SEQ ID NO: 1659901 - RNA, 22 nt, Salmonella enterica enterica serovar Typhi
aguuccaaucucuuuugcggcg

SEQ ID NO: 1659902 - RNA, 13 nt, Salmonella enterica enterica serovar Typhi
agugugccgucau

SEQ ID NO: 1659903 - RNA, 19 nt, Salmonella enterica enterica serovar Typhi
aguucuggcuuugcgccgg

SEQ ID NO: 1659904 - RNA, 17 nt, Salmonella enterica enterica serovar Typhi
aguugagccauuccagc

SEQ ID NO: 1659905 - RNA, 22 nt, Salmonella enterica enterica serovar Typhi
aguucggcgauuuccagcgccg

SEQ ID NO: 1659906 - RNA, 16 nt, Salmonella enterica enterica serovar Typhi
aguucggagaucagcg

SEQ ID NO: 1659907 - RNA, 17 nt, Salmonella enterica enterica serovar Typhi
aguugcccgaugcgccc

SEQ ID NO: 1659908 - RNA, 13 nt, Salmonella enterica enterica serovar Typhi
aguugccuucgau

SEQ ID NO: 1659909 - RNA, 12 nt, Salmonella enterica enterica serovar Typhi
aguugcgucagc

SEQ ID NO: 1659910 - RNA, 11 nt, Salmonella enterica enterica serovar Typhi
aguuuauccgg

SEQ ID NO: 1659911 - RNA, 20 nt, Salmonella enterica enterica serovar Typhi
aguugccaguacagcagcga

SEQ ID NO: 1659912 - RNA, 15 nt, Salmonella enterica enterica serovar Typhi
agugaguuaagacgc

SEQ ID NO: 1659913 - RNA, 18 nt, Salmonella enterica enterica serovar Typhi
agugauaaagcacagccc

SEQ ID NO: 1659914 - RNA, 14 nt, Salmonella enterica enterica serovar Typhi
aguggacgcgucgc

SEQ ID NO: 1659915 - RNA, 18 nt, Salmonella enterica enterica serovar Typhi
agucuguucguagcccau

SEQ ID NO: 1659916 - RNA, 18 nt, Salmonella enterica enterica serovar Typhi
agugacguggcuucgccg

SEQ ID NO: 1659917 - RNA, 23 nt, Salmonella enterica enterica serovar Typhi
agucagcaacauggauucgcugg

SEQ ID NO: 1659918 - RNA, 20 nt, Salmonella enterica enterica serovar Typhi
agucuccugccaaugaaaua

SEQ ID NO: 1659919 - RNA, 16 nt, Salmonella enterica enterica serovar Typhi
agucaagcuugccgcu

SEQ ID NO: 1659920 - RNA, 17 nt, Salmonella enterica enterica serovar Typhi
agucacaaguaagguag

SEQ ID NO: 1659921 - RNA, 19 nt, Salmonella enterica enterica serovar Typhi
agucaauaaacuggagcac

SEQ ID NO: 1659922 - RNA, 15 nt, Salmonella enterica enterica serovar Typhi
auaacugcgccaucu

SEQ ID NO: 1659923 - RNA, 15 nt, Salmonella enterica enterica serovar Typhi
auaagagggcgccau

SEQ ID NO: 1659924 - RNA, 18 nt, Salmonella enterica enterica serovar Typhi
auaacgcguucuggcgau

SEQ ID NO: 1659925 - RNA, 20 nt, Salmonella enterica enterica serovar Typhi
auaacgugccgaccagcggu

SEQ ID NO: 1659926 - RNA, 13 nt, Salmonella enterica enterica serovar Typhi
auaacagcaccau

SEQ ID NO: 1659927 - RNA, 22 nt, Salmonella enterica enterica serovar Typhi
auaacacggcuggcaaugcgcu

SEQ ID NO: 1659928 - RNA, 15 nt, Salmonella enterica enterica serovar Typhi
auaaccagauggggc

SEQ ID NO: 1659929 - RNA, 22 nt, Salmonella enterica enterica serovar Typhi
aguuuuuaaacaacauaucgcc

SEQ ID NO: 1659930 - RNA, 19 nt, Salmonella enterica enterica serovar Typhi
aguuugucuucgaugcgcu

SEQ ID NO: 1659931 - RNA, 22 nt, Salmonella enterica enterica serovar Typhi
aguuucagcccaaaagcgaccu

SEQ ID NO: 1659932 - RNA, 24 nt, Salmonella enterica enterica serovar Typhi
auacgcaggacuuucgcuucacga

SEQ ID NO: 1659933 - RNA, 18 nt, Salmonella enterica enterica serovar Typhi
auacgauuucucgccauu

SEQ ID NO: 1659934 - RNA, 15 nt, Salmonella enterica enterica serovar Typhi
auacgcauucucgcc

SEQ ID NO: 1659935 - RNA, 14 nt, Salmonella enterica enterica serovar Typhi
auacgaucggcugg

SEQ ID NO: 1659936 - RNA, 17 nt, Salmonella enterica enterica serovar Typhi
auaccuucccgcgauaa

SEQ ID NO: 1659937 - RNA, 17 nt, Salmonella enterica enterica serovar Typhi
auaccguuucaacugcc

SEQ ID NO: 1659938 - RNA, 15 nt, Salmonella enterica enterica serovar Typhi
auaccgaacagaaaa

SEQ ID NO: 1659939 - RNA, 19 nt, Salmonella enterica enterica serovar Typhi
auaccgccauccggcauuc

SEQ ID NO: 1659940 - RNA, 13 nt, Salmonella enterica enterica serovar Typhi
auaccgcaauaaa

SEQ ID NO: 1659941 - RNA, 19 nt, Salmonella enterica enterica serovar Typhi
auaccggccacgagcuguc

SEQ ID NO: 1659942 - RNA, 17 nt, Salmonella enterica enterica serovar Typhi
auaauaugcaacacgcc

SEQ ID NO: 1659943 - RNA, 16 nt, Salmonella enterica enterica serovar Typhi
auaauuugcgccguca

SEQ ID NO: 1659944 - RNA, 15 nt, Salmonella enterica enterica serovar Typhi
auaauaaugaucgcu

SEQ ID NO: 1659945 - RNA, 17 nt, Salmonella enterica enterica serovar Typhi
auaccaaguuuggcaau

SEQ ID NO: 1659946 - RNA, 13 nt, Salmonella enterica enterica serovar Typhi
auacguucgcggg

SEQ ID NO: 1659947 - RNA, 13 nt, Salmonella enterica enterica serovar Typhi
auacgucugcgcu

SEQ ID NO: 1659948 - RNA, 14 nt, Salmonella enterica enterica serovar Typhi
auacggcuuccacu

SEQ ID NO: 1659949 - RNA, 20 nt, Salmonella enterica enterica serovar Typhi
auacgucauaucauccagcc

SEQ ID NO: 1659950 - RNA, 16 nt, Salmonella enterica enterica serovar Typhi
auacuaccgcugcgau

SEQ ID NO: 1659951 - RNA, 23 nt, Salmonella enterica enterica serovar Typhi
auacguucgaacgacucggcgau

SEQ ID NO: 1659952 - RNA, 22 nt, Salmonella enterica enterica serovar Typhi
auacgggagagcguauccagca

SEQ ID NO: 1659953 - RNA, 19 nt, Salmonella enterica enterica serovar Typhi
auacggcggcaaugccgcc

SEQ ID NO: 1659954 - RNA, 14 nt, Salmonella enterica enterica serovar Typhi
auacgccugccugg

SEQ ID NO: 1659955 - RNA, 16 nt, Salmonella enterica enterica serovar Typhi
auacgcccacgcggcg

SEQ ID NO: 1659956 - RNA, 21 nt, Salmonella enterica enterica serovar Typhi
auacgcggcacaaaguccgcc

SEQ ID NO: 1659957 - RNA, 22 nt, Salmonella enterica enterica serovar Typhi
auacugccaaccauuaacuccg

SEQ ID NO: 1659958 - RNA, 18 nt, Salmonella enterica enterica serovar Typhi
auacuggaccccagauaa

SEQ ID NO: 1659959 - RNA, 21 nt, Salmonella enterica enterica serovar Typhi
auacugccgcccaucgccaca

SEQ ID NO: 1659960 - RNA, 17 nt, Salmonella enterica enterica serovar Typhi
auacugucgcgcggcgu

SEQ ID NO: 1659961 - RNA, 14 nt, Salmonella enterica enterica serovar Typhi
auacuuacugcugu

SEQ ID NO: 1659962 - RNA, 12 nt, Salmonella enterica enterica serovar Typhi
auacuuccgcug

SEQ ID NO: 1659963 - RNA, 15 nt, Salmonella enterica enterica serovar Typhi
auagcaccucgcaau

SEQ ID NO: 1659964 - RNA, 14 nt, Salmonella enterica enterica serovar Typhi
auagcaccaggcca

SEQ ID NO: 1659965 - RNA, 18 nt, Salmonella enterica enterica serovar Typhi
auagccagcgauccugcg

SEQ ID NO: 1659966 - RNA, 17 nt, Salmonella enterica enterica serovar Typhi
auagccgacccgcaucg

SEQ ID NO: 1659967 - RNA, 21 nt, Salmonella enterica enterica serovar Typhi
auagccccggucaacgcgccg

SEQ ID NO: 1659968 - RNA, 23 nt, Salmonella enterica enterica serovar Typhi
auagccggauaauuuauccagua

SEQ ID NO: 1659969 - RNA, 17 nt, Salmonella enterica enterica serovar Typhi
auagagagcgacagccc

SEQ ID NO: 1659970 - RNA, 17 nt, Salmonella enterica enterica serovar Typhi
auagacgcccugcaaag

SEQ ID NO: 1659971 - RNA, 16 nt, Salmonella enterica enterica serovar Typhi
auagaacgcucgcgca

SEQ ID NO: 1659972 - RNA, 14 nt, Salmonella enterica enterica serovar Typhi
auaucgacggucag

SEQ ID NO: 1659973 - RNA, 13 nt, Salmonella enterica enterica serovar Typhi
auaucgccgccac

SEQ ID NO: 1659974 - RNA, 12 nt, Salmonella enterica enterica serovar Typhi
auaucggcugcu

SEQ ID NO: 1659975 - RNA, 20 nt, Salmonella enterica enterica serovar Typhi
auaucggcaauauugccgca

SEQ ID NO: 1659976 - RNA, 18 nt, Salmonella enterica enterica serovar Typhi
auaucggccggaugccag

SEQ ID NO: 1659977 - RNA, 19 nt, Salmonella enterica enterica serovar Typhi
auaucuggacgggccgcca

SEQ ID NO: 1659978 - RNA, 13 nt, Salmonella enterica enterica serovar Typhi
auaugcgcaauca

SEQ ID NO: 1659979 - RNA, 16 nt, Salmonella enterica enterica serovar Typhi
auaucuggcgaggcuu

SEQ ID NO: 1659980 - RNA, 14 nt, Salmonella enterica enterica serovar Typhi
auaugcggcgccau

SEQ ID NO: 1659981 - RNA, 16 nt, Salmonella enterica enterica serovar Typhi
auaugcggcgccauca

SEQ ID NO: 1659982 - RNA, 21 nt, Salmonella enterica enterica serovar Typhi
auaugcgucagauguucgcga

SEQ ID NO: 1659983 - RNA, 19 nt, Salmonella enterica enterica serovar Typhi
auaugcguugacccgucca

SEQ ID NO: 1659984 - RNA, 16 nt, Salmonella enterica enterica serovar Typhi
auauagccguggcugg

SEQ ID NO: 1659985 - RNA, 20 nt, Salmonella enterica enterica serovar Typhi
auauagcaacguccgcagcc

SEQ ID NO: 1659986 - RNA, 15 nt, Salmonella enterica enterica serovar Typhi
auauaaauuuggcga

SEQ ID NO: 1659987 - RNA, 17 nt, Salmonella enterica enterica serovar Typhi
auauaacgugccgacca

SEQ ID NO: 1659988 - RNA, 15 nt, Salmonella enterica enterica serovar Typhi
auaguuccacauaaa

SEQ ID NO: 1659989 - RNA, 17 nt, Salmonella enterica enterica serovar Typhi
auaguuuaaauccagcg

SEQ ID NO: 1659990 - RNA, 13 nt, Salmonella enterica enterica serovar Typhi
auagcgccauccu

SEQ ID NO: 1659991 - RNA, 19 nt, Salmonella enterica enterica serovar Typhi
auaggcgcgucauaaccgc

SEQ ID NO: 1659992 - RNA, 22 nt, Salmonella enterica enterica serovar Typhi
auaggcaauauccuccggcgua

SEQ ID NO: 1659993 - RNA, 21 nt, Salmonella enterica enterica serovar Typhi
auagccugauggucgcucugg

SEQ ID NO: 1659994 - RNA, 17 nt, Salmonella enterica enterica serovar Typhi
auagccguagcccuuga

SEQ ID NO: 1659995 - RNA, 21 nt, Salmonella enterica enterica serovar Typhi
auagccuugauccuguaacgc

SEQ ID NO: 1659996 - RNA, 23 nt, Salmonella enterica enterica serovar Typhi
auagcgcugugcuaucaggccua

SEQ ID NO: 1659997 - RNA, 22 nt, Salmonella enterica enterica serovar Typhi
auagcuuuucaagaauuacauc

SEQ ID NO: 1659998 - RNA, 17 nt, Salmonella enterica enterica serovar Typhi
auagcgcugaaguccgc

SEQ ID NO: 1659999 - RNA, 12 nt, Salmonella enterica enterica serovar Typhi
auagcgccaucc

SEQ ID NO: 1660000 - RNA, 22 nt, Salmonella enterica enterica serovar Typhi
aucaacgguacggcauggcguc

SEQ ID NO: 1660001 - RNA, 15 nt, Salmonella enterica enterica serovar Typhi
aucaacaaugucgcc

SEQ ID NO: 1660002 - RNA, 15 nt, Salmonella enterica enterica serovar Typhi
aucaaagcgugauaa

SEQ ID NO: 1660003 - RNA, 20 nt, Salmonella enterica enterica serovar Typhi
aucaaaggcgucgccgaaua

SEQ ID NO: 1660004 - RNA, 23 nt, Salmonella enterica enterica serovar Typhi
aucaaacuugcccagcgccuucu

SEQ ID NO: 1660005 - RNA, 14 nt, Salmonella enterica enterica serovar Typhi
auauguuugcgcgu

SEQ ID NO: 1660006 - RNA, 20 nt, Salmonella enterica enterica serovar Typhi
auaugguauucgugcaucag

SEQ ID NO: 1660007 - RNA, 15 nt, Salmonella enterica enterica serovar Typhi
auauuacuuuccagc

SEQ ID NO: 1660008 - RNA, 15 nt, Salmonella enterica enterica serovar Typhi
auauucaaaauccgc

SEQ ID NO: 1660009 - RNA, 14 nt, Salmonella enterica enterica serovar Typhi
auauuaaaagccgc

SEQ ID NO: 1660010 - RNA, 13 nt, Salmonella enterica enterica serovar Typhi
aucaacugcgcca

SEQ ID NO: 1660011 - RNA, 15 nt, Salmonella enterica enterica serovar Typhi
aucaacugcgccaca

SEQ ID NO: 1660012 - RNA, 18 nt, Salmonella enterica enterica serovar Typhi
aucaauguaaaacgguau

SEQ ID NO: 1660013 - RNA, 17 nt, Salmonella enterica enterica serovar Typhi
aucaagcccagcucagg

SEQ ID NO: 1660014 - RNA, 22 nt, Salmonella enterica enterica serovar Typhi
aucaaugugucauaacgaccaa

SEQ ID NO: 1660015 - RNA, 20 nt, Salmonella enterica enterica serovar Typhi
aucaauguauuguucaugca

SEQ ID NO: 1660016 - RNA, 23 nt, Salmonella enterica enterica serovar Typhi
aucaaugucugauggcgcugcgc

SEQ ID NO: 1660017 - RNA, 21 nt, Salmonella enterica enterica serovar Typhi
aucacaucauuaaagcgcuca

SEQ ID NO: 1660018 - RNA, 21 nt, Salmonella enterica enterica serovar Typhi
aucaauuuugcgccuaccgcc

SEQ ID NO: 1660019 - RNA, 16 nt, Salmonella enterica enterica serovar Typhi
aucacaacgucauccc

SEQ ID NO: 1660020 - RNA, 22 nt, Salmonella enterica enterica serovar Typhi
aucaauuuuucgcccggcucau

SEQ ID NO: 1660021 - RNA, 15 nt, Salmonella enterica enterica serovar Typhi
aucaccauggcgcca

SEQ ID NO: 1660022 - RNA, 22 nt, Salmonella enterica enterica serovar Typhi
aucacccaacguucaugucggc

SEQ ID NO: 1660023 - RNA, 13 nt, Salmonella enterica enterica serovar Typhi
aucaggaaguuga

SEQ ID NO: 1660024 - RNA, 16 nt, Salmonella enterica enterica serovar Typhi
aucaggacauggucac

SEQ ID NO: 1660025 - RNA, 15 nt, Salmonella enterica enterica serovar Typhi
aucagcgcuccgaca

SEQ ID NO: 1660026 - RNA, 22 nt, Salmonella enterica enterica serovar Typhi
aucagcgauugcgccagaccca

SEQ ID NO: 1660027 - RNA, 19 nt, Salmonella enterica enterica serovar Typhi
aucagcgccgucgccauca

SEQ ID NO: 1660028 - RNA, 13 nt, Salmonella enterica enterica serovar Typhi
aucagcgccacca

SEQ ID NO: 1660029 - RNA, 18 nt, Salmonella enterica enterica serovar Typhi
aucagauaggcggcaaau

SEQ ID NO: 1660030 - RNA, 13 nt, Salmonella enterica enterica serovar Typhi
aucagauaaacag

SEQ ID NO: 1660031 - RNA, 13 nt, Salmonella enterica enterica serovar Typhi
aucacuaccgcca

SEQ ID NO: 1660032 - RNA, 18 nt, Salmonella enterica enterica serovar Typhi
aucacuaccgccgcggau

SEQ ID NO: 1660033 - RNA, 17 nt, Salmonella enterica enterica serovar Typhi
agccguaucuuccggug

SEQ ID NO: 1660034 - RNA, 13 nt, Salmonella enterica enterica serovar Typhi
agccguuaccgcc

SEQ ID NO: 1660035 - RNA, 19 nt, Salmonella enterica enterica serovar Typhi
agccuggagagcagcgcca

SEQ ID NO: 1660036 - RNA, 20 nt, Salmonella enterica enterica serovar Typhi
agccuguuccagcugcgaca

SEQ ID NO: 1660037 - RNA, 12 nt, Salmonella enterica enterica serovar Typhi
agccuggucacc

SEQ ID NO: 1660038 - RNA, 20 nt, Salmonella enterica enterica serovar Typhi
agccgcucaggguaaucacc

SEQ ID NO: 1660039 - RNA, 17 nt, Salmonella enterica enterica serovar Typhi
agccgcucaggguaauc

SEQ ID NO: 1660040 - RNA, 16 nt, Salmonella enterica enterica serovar Typhi
agccgguuagccacaa

SEQ ID NO: 1660041 - RNA, 19 nt, Salmonella enterica enterica serovar Typhi
agccgguuagccacaauga

SEQ ID NO: 1660042 - RNA, 13 nt, Salmonella enterica enterica serovar Typhi
agcgaaugcugca

SEQ ID NO: 1660043 - RNA, 13 nt, Salmonella enterica enterica serovar Typhi
aaacgcuggugcu

SEQ ID NO: 1660044 - RNA, 15 nt, Salmonella enterica enterica serovar Typhi
agcgaauggcggcac

SEQ ID NO: 1660045 - RNA, 12 nt, Salmonella enterica enterica serovar Typhi
aaacgccagcga

SEQ ID NO: 1660046 - RNA, 14 nt, Salmonella enterica enterica serovar Typhi
aaacgccucauccg

SEQ ID NO: 1660047 - RNA, 14 nt, Salmonella enterica enterica serovar Typhi
agcgaauagcggca

SEQ ID NO: 1660048 - RNA, 20 nt, Salmonella enterica enterica serovar Typhi
agccuuacaggcgcaucaga

SEQ ID NO: 1660049 - RNA, 12 nt, Salmonella enterica enterica serovar Typhi
aaacgcugcgcu

SEQ ID NO: 1660050 - RNA, 21 nt, Salmonella enterica enterica serovar Typhi
agcgcgccgcagcgccgacgu

SEQ ID NO: 1660051 - RNA, 15 nt, Salmonella enterica enterica serovar Typhi
agcgcgcgcaguuug

SEQ ID NO: 1660052 - RNA, 13 nt, Salmonella enterica enterica serovar Typhi
agcgcgcuggcaa

SEQ ID NO: 1660053 - RNA, 22 nt, Salmonella enterica enterica serovar Typhi
agcgcggagaacgguucaucca

SEQ ID NO: 1660054 - RNA, 19 nt, Salmonella enterica enterica serovar Typhi
agcgcgcggauauggcggc

SEQ ID NO: 1660055 - RNA, 20 nt, Salmonella enterica enterica serovar Typhi
agcgcgcgcgccugaugcgc

SEQ ID NO: 1660056 - RNA, 19 nt, Salmonella enterica enterica serovar Typhi
agcgcgauacgcgacggcg

SEQ ID NO: 1660057 - RNA, 21 nt, Salmonella enterica enterica serovar Typhi
agcgcgaucgccccgaccagg

SEQ ID NO: 1660058 - RNA, 20 nt, Salmonella enterica enterica serovar Typhi
agcgccuuauccggccuacg

SEQ ID NO: 1660059 - RNA, 23 nt, Salmonella enterica enterica serovar Typhi
agcgcgaccaggaaaccgguaaa

SEQ ID NO: 1660060 - RNA, 23 nt, Salmonella enterica enterica serovar Typhi
agcgccaucaggcacggcguaca

SEQ ID NO: 1660061 - RNA, 20 nt, Salmonella enterica enterica serovar Typhi
agcgccaucaggcacggcgu

SEQ ID NO: 1660062 - RNA, 17 nt, Salmonella enterica enterica serovar Typhi
agcgccauauccgcaga

SEQ ID NO: 1660063 - RNA, 12 nt, Salmonella enterica enterica serovar Typhi
agcgccaggcca

SEQ ID NO: 1660064 - RNA, 18 nt, Salmonella enterica enterica serovar Typhi
agcgcagcuugguagcgc

SEQ ID NO: 1660065 - RNA, 15 nt, Salmonella enterica enterica serovar Typhi
agcgcagcggaaagu

SEQ ID NO: 1660066 - RNA, 21 nt, Salmonella enterica enterica serovar Typhi
agcgcagcgccaccgggcaac

SEQ ID NO: 1660067 - RNA, 15 nt, Salmonella enterica enterica serovar Typhi
agcgccuccggguuu

SEQ ID NO: 1660068 - RNA, 21 nt, Salmonella enterica enterica serovar Typhi
agcgccguuaacgcggccgua

SEQ ID NO: 1660069 - RNA, 21 nt, Salmonella enterica enterica serovar Typhi
agcgccugaauguacgcauau

SEQ ID NO: 1660070 - RNA, 19 nt, Salmonella enterica enterica serovar Typhi
agcgccugucgggccuaca

SEQ ID NO: 1660071 - RNA, 16 nt, Salmonella enterica enterica serovar Typhi
agcgcgguggcgcaca

SEQ ID NO: 1660072 - RNA, 15 nt, Salmonella enterica enterica serovar Typhi
agcgcgucagcgccu

SEQ ID NO: 1660073 - RNA, 22 nt, Salmonella enterica enterica serovar Typhi
agcgcguguauuaaaggaucga

SEQ ID NO: 1660074 - RNA, 22 nt, Salmonella enterica enterica serovar Typhi
agcgcguucgccgucacgccga

SEQ ID NO: 1660075 - RNA, 16 nt, Salmonella enterica enterica serovar Typhi
agcgcggccagcgccu

SEQ ID NO: 1660076 - RNA, 19 nt, Salmonella enterica enterica serovar Typhi
agcgcuugauaaugucaac

SEQ ID NO: 1660077 - RNA, 14 nt, Salmonella enterica enterica serovar Typhi
agcgcuugauccag

SEQ ID NO: 1660078 - RNA, 23 nt, Salmonella enterica enterica serovar Typhi
agcgcugugcuaucaggccuaca

SEQ ID NO: 1660079 - RNA, 13 nt, Salmonella enterica enterica serovar Typhi
agcggcagccaug

SEQ ID NO: 1660080 - RNA, 20 nt, Salmonella enterica enterica serovar Typhi
agcggcaguacgagcaucca

SEQ ID NO: 1660081 - RNA, 19 nt, Salmonella enterica enterica serovar Typhi
agcggcgcgccgcucgaca

SEQ ID NO: 1660082 - RNA, 17 nt, Salmonella enterica enterica serovar Typhi
agcguugauaugcucga

SEQ ID NO: 1660083 - RNA, 19 nt, Salmonella enterica enterica serovar Typhi
agcguuuaaaaagcugcau

SEQ ID NO: 1660084 - RNA, 22 nt, Salmonella enterica enterica serovar Typhi
agcguggcgcaaccgauagcua

SEQ ID NO: 1660085 - RNA, 15 nt, Salmonella enterica enterica serovar Typhi
agcguccguucugau

SEQ ID NO: 1660086 - RNA, 14 nt, Salmonella enterica enterica serovar Typhi
agcguccccggcga

SEQ ID NO: 1660087 - RNA, 16 nt, Salmonella enterica enterica serovar Typhi
agcugagcuaaucacc

SEQ ID NO: 1660088 - RNA, 21 nt, Salmonella enterica enterica serovar Typhi
agcugagcgucaggcgcaucc

SEQ ID NO: 1660089 - RNA, 21 nt, Salmonella enterica enterica serovar Typhi
agcugacugcaaaucugccgu

SEQ ID NO: 1660090 - RNA, 17 nt, Salmonella enterica enterica serovar Typhi
agcugaacagucccacc

SEQ ID NO: 1660091 - RNA, 15 nt, Salmonella enterica enterica serovar Typhi
agcucugcgugacgc

SEQ ID NO: 1660092 - RNA, 20 nt, Salmonella enterica enterica serovar Typhi
agcagcuuaucuuuacgcuu

SEQ ID NO: 1660093 - RNA, 12 nt, Salmonella enterica enterica serovar Typhi
agcagcgcauca

SEQ ID NO: 1660094 - RNA, 19 nt, Salmonella enterica enterica serovar Typhi
agcagcgaggugauaauca

SEQ ID NO: 1660095 - RNA, 15 nt, Salmonella enterica enterica serovar Typhi
agcaggguuaugccg

SEQ ID NO: 1660096 - RNA, 13 nt, Salmonella enterica enterica serovar Typhi
agcaucgcauuaa

SEQ ID NO: 1660097 - RNA, 21 nt, Salmonella enterica enterica serovar Typhi
agcauccgcgcaauaugcggc

SEQ ID NO: 1660098 - RNA, 18 nt, Salmonella enterica enterica serovar Typhi
agcaucccgcuggcgcca

SEQ ID NO: 1660099 - RNA, 15 nt, Salmonella enterica enterica serovar Typhi
agcaucaauaucugc

SEQ ID NO: 1660100 - RNA, 14 nt, Salmonella enterica enterica serovar Typhi
agcaucaugucacc

SEQ ID NO: 1660101 - RNA, 20 nt, Salmonella enterica enterica serovar Typhi
agcauccagacccagacaac

SEQ ID NO: 1660102 - RNA, 13 nt, Salmonella enterica enterica serovar Typhi
agcaucugauagc

SEQ ID NO: 1660103 - RNA, 15 nt, Salmonella enterica enterica serovar Typhi
agcaucguuaccgcu

SEQ ID NO: 1660104 - RNA, 23 nt, Salmonella enterica enterica serovar Typhi
agcaucucaauaucguugccgcc

SEQ ID NO: 1660105 - RNA, 19 nt, Salmonella enterica enterica serovar Typhi
agcauuauuuuuaaccgcc

SEQ ID NO: 1660106 - RNA, 12 nt, Salmonella enterica enterica serovar Typhi
agcauuagcgcc

SEQ ID NO: 1660107 - RNA, 14 nt, Salmonella enterica enterica serovar Typhi
agccagauaucgcg

SEQ ID NO: 1660108 - RNA, 14 nt, Salmonella enterica enterica serovar Typhi
agccagagcgcgcu

SEQ ID NO: 1660109 - RNA, 19 nt, Salmonella enterica enterica serovar Typhi
agccagagcgcgcuggcaa

SEQ ID NO: 1660110 - RNA, 14 nt, Salmonella enterica enterica serovar Typhi
agccacccacggca

SEQ ID NO: 1660111 - RNA, 22 nt, Salmonella enterica enterica serovar Typhi
agccacuuaccaaucgcggcga

SEQ ID NO: 1660112 - RNA, 15 nt, Salmonella enterica enterica serovar Typhi
agcauuucgacguca

SEQ ID NO: 1660113 - RNA, 17 nt, Salmonella enterica enterica serovar Typhi
agccacacgacgguauu

SEQ ID NO: 1660114 - RNA, 23 nt, Salmonella enterica enterica serovar Typhi
agcauugccgucaaacgcuauca

SEQ ID NO: 1660115 - RNA, 20 nt, Salmonella enterica enterica serovar Typhi
aaaccguucacgcucacgca

SEQ ID NO: 1660116 - RNA, 20 nt, Salmonella enterica enterica serovar Typhi
aaacgaugaccauaaaugaa

SEQ ID NO: 1660117 - RNA, 21 nt, Salmonella enterica enterica serovar Typhi
aaacgaccaggaucagaccga

SEQ ID NO: 1660118 - RNA, 21 nt, Salmonella enterica enterica serovar Typhi
agccgacgcauuucuccugau

SEQ ID NO: 1660119 - RNA, 14 nt, Salmonella enterica enterica serovar Typhi
agcccaucagcgcc

SEQ ID NO: 1660120 - RNA, 13 nt, Salmonella enterica enterica serovar Typhi
agccagguugcgc

SEQ ID NO: 1660121 - RNA, 18 nt, Salmonella enterica enterica serovar Typhi
agccccuucgcuguccau

SEQ ID NO: 1660122 - RNA, 17 nt, Salmonella enterica enterica serovar Typhi
agcccggcggcgcaucg

SEQ ID NO: 1660123 - RNA, 20 nt, Salmonella enterica enterica serovar Typhi
agcacauaacugagacucag

SEQ ID NO: 1660124 - RNA, 14 nt, Salmonella enterica enterica serovar Typhi
agcaccauuucgcc

SEQ ID NO: 1660125 - RNA, 16 nt, Salmonella enterica enterica serovar Typhi
agcaacaguugcugga

SEQ ID NO: 1660126 - RNA, 14 nt, Salmonella enterica enterica serovar Typhi
acuuuccagcacga

SEQ ID NO: 1660127 - RNA, 22 nt, Salmonella enterica enterica serovar Typhi
agcaaacgaccuuucgccguca

SEQ ID NO: 1660128 - RNA, 16 nt, Salmonella enterica enterica serovar Typhi
agcaaaaucaccauca

SEQ ID NO: 1660129 - RNA, 21 nt, Salmonella enterica enterica serovar Typhi
agcaaacgccauagcaucgac

SEQ ID NO: 1660130 - RNA, 18 nt, Salmonella enterica enterica serovar Typhi
agcaagcgcacgguuaau

SEQ ID NO: 1660131 - RNA, 20 nt, Salmonella enterica enterica serovar Typhi
agcaacguccgcagccgacg

SEQ ID NO: 1660132 - RNA, 16 nt, Salmonella enterica enterica serovar Typhi
agcaacgggcagucug

SEQ ID NO: 1660133 - RNA, 20 nt, Salmonella enterica enterica serovar Typhi
agcaaugcgaauaacaucau

SEQ ID NO: 1660134 - RNA, 20 nt, Salmonella enterica enterica serovar Typhi
agcacaccgccguaaaggga

SEQ ID NO: 1660135 - RNA, 23 nt, Salmonella enterica enterica serovar Typhi
agcaauuucucgcccgccagauc

SEQ ID NO: 1660136 - RNA, 19 nt, Salmonella enterica enterica serovar Typhi
agcagauuuuuauccgucg

SEQ ID NO: 1660137 - RNA, 20 nt, Salmonella enterica enterica serovar Typhi
agcagauuuuucgccaggua

SEQ ID NO: 1660138 - RNA, 16 nt, Salmonella enterica enterica serovar Typhi
agcagcagagccggaa

SEQ ID NO: 1660139 - RNA, 13 nt, Salmonella enterica enterica serovar Typhi
agcagcagccggu

SEQ ID NO: 1660140 - RNA, 12 nt, Salmonella enterica enterica serovar Typhi
agcagauagccc

SEQ ID NO: 1660141 - RNA, 15 nt, Salmonella enterica enterica serovar Typhi
agcagauagcccgcc

SEQ ID NO: 1660142 - RNA, 13 nt, Salmonella enterica enterica serovar Typhi
agcagauaagcga

SEQ ID NO: 1660143 - RNA, 16 nt, Salmonella enterica enterica serovar Typhi
aaacccauauuccugc

SEQ ID NO: 1660144 - RNA, 17 nt, Salmonella enterica enterica serovar Typhi
aaaccccaucccggcaa

SEQ ID NO: 1660145 - RNA, 20 nt, Salmonella enterica enterica serovar Typhi
agcagaggaaaacguugcug

SEQ ID NO: 1660146 - RNA, 18 nt, Salmonella enterica enterica serovar Typhi
agcacgguaacuucgcgg

SEQ ID NO: 1660147 - RNA, 15 nt, Salmonella enterica enterica serovar Typhi
agcacuucagaacgg

SEQ ID NO: 1660148 - RNA, 15 nt, Salmonella enterica enterica serovar Typhi
agcacgcccugccau

SEQ ID NO: 1660149 - RNA, 20 nt, Salmonella enterica enterica serovar Typhi
acuggaauaguuacggacau

SEQ ID NO: 1660150 - RNA, 21 nt, Salmonella enterica enterica serovar Typhi
acuggcaaccagauaauucag

SEQ ID NO: 1660151 - RNA, 15 nt, Salmonella enterica enterica serovar Typhi
acuggcaaucaugcg

SEQ ID NO: 1660152 - RNA, 19 nt, Salmonella enterica enterica serovar Typhi
acuggcagcgccugacggc

SEQ ID NO: 1660153 - RNA, 15 nt, Salmonella enterica enterica serovar Typhi
acugcugcugaaaga

SEQ ID NO: 1660154 - RNA, 15 nt, Salmonella enterica enterica serovar Typhi
acuggcuuuccugau

SEQ ID NO: 1660155 - RNA, 16 nt, Salmonella enterica enterica serovar Typhi
acuggguaugcagugg

SEQ ID NO: 1660156 - RNA, 21 nt, Salmonella enterica enterica serovar Typhi
acugguucaacaucagcgcua

SEQ ID NO: 1660157 - RNA, 16 nt, Salmonella enterica enterica serovar Typhi
acugggcaaucaucag

SEQ ID NO: 1660158 - RNA, 19 nt, Salmonella enterica enterica serovar Typhi
acugggcgcaugaggccug

SEQ ID NO: 1660159 - RNA, 22 nt, Salmonella enterica enterica serovar Typhi
acugccuaaauugacgcugccu

SEQ ID NO: 1660160 - RNA, 19 nt, Salmonella enterica enterica serovar Typhi
acugccugauggcgcuacg

SEQ ID NO: 1660161 - RNA, 14 nt, Salmonella enterica enterica serovar Typhi
acucuucaucgcgc

SEQ ID NO: 1660162 - RNA, 12 nt, Salmonella enterica enterica serovar Typhi
acugcuccggca

SEQ ID NO: 1660163 - RNA, 13 nt, Salmonella enterica enterica serovar Typhi
acuugaucgugcc

SEQ ID NO: 1660164 - RNA, 21 nt, Salmonella enterica enterica serovar Typhi
acuucugacccaaucagacgc

SEQ ID NO: 1660165 - RNA, 19 nt, Salmonella enterica enterica serovar Typhi
acuuuaaagcccagcacgg

SEQ ID NO: 1660166 - RNA, 15 nt, Salmonella enterica enterica serovar Typhi
acuucauccggauaa

SEQ ID NO: 1660167 - RNA, 14 nt, Salmonella enterica enterica serovar Typhi
acuucacccaucgc

SEQ ID NO: 1660168 - RNA, 13 nt, Salmonella enterica enterica serovar Typhi
acuucuccgccau

SEQ ID NO: 1660169 - RNA, 18 nt, Salmonella enterica enterica serovar Typhi
acuucguagacucaggcg

SEQ ID NO: 1660170 - RNA, 17 nt, Salmonella enterica enterica serovar Typhi
acuuauuugcucaguuc

SEQ ID NO: 1660171 - RNA, 21 nt, Salmonella enterica enterica serovar Typhi
acuuauuuguauugacgccga

SEQ ID NO: 1660172 - RNA, 23 nt, Salmonella enterica enterica serovar Typhi
acuguauucgguggaaaccgcag

SEQ ID NO: 1660173 - RNA, 22 nt, Salmonella enterica enterica serovar Typhi
acuguaagccucgcucaccggu

SEQ ID NO: 1660174 - RNA, 15 nt, Salmonella enterica enterica serovar Typhi
acuguaccugaucca

SEQ ID NO: 1660175 - RNA, 18 nt, Salmonella enterica enterica serovar Typhi
acuguaccugauccagcu

SEQ ID NO: 1660176 - RNA, 15 nt, Salmonella enterica enterica serovar Typhi
acucaauauccugcg

SEQ ID NO: 1660177 - RNA, 15 nt, Salmonella enterica enterica serovar Typhi
acucaauaucgacag

SEQ ID NO: 1660178 - RNA, 19 nt, Salmonella enterica enterica serovar Typhi
acucacgacuuucaccaga

SEQ ID NO: 1660179 - RNA, 23 nt, Salmonella enterica enterica serovar Typhi
acucacccaggcgaugcgcggaa

SEQ ID NO: 1660180 - RNA, 13 nt, Salmonella enterica enterica serovar Typhi
acucaccaguccg

SEQ ID NO: 1660181 - RNA, 13 nt, Salmonella enterica enterica serovar Typhi
acucagccagaua

SEQ ID NO: 1660182 - RNA, 14 nt, Salmonella enterica enterica serovar Typhi
acuccaaauaccgg

SEQ ID NO: 1660183 - RNA, 14 nt, Salmonella enterica enterica serovar Typhi
acucauuaccggcu

SEQ ID NO: 1660184 - RNA, 17 nt, Salmonella enterica enterica serovar Typhi
acuccccggcuugcggg

SEQ ID NO: 1660185 - RNA, 20 nt, Salmonella enterica enterica serovar Typhi
acuccagcagacgcugcuuc

SEQ ID NO: 1660186 - RNA, 22 nt, Salmonella enterica enterica serovar Typhi
acuccaucgccugaugaccgcc

SEQ ID NO: 1660187 - RNA, 16 nt, Salmonella enterica enterica serovar Typhi
acucgcugauacgcug

SEQ ID NO: 1660188 - RNA, 13 nt, Salmonella enterica enterica serovar Typhi
acuccggcgacca

SEQ ID NO: 1660189 - RNA, 20 nt, Salmonella enterica enterica serovar Typhi
acgugcgguauaucacgcca

SEQ ID NO: 1660190 - RNA, 17 nt, Salmonella enterica enterica serovar Typhi
acguucuuccagaacgc

SEQ ID NO: 1660191 - RNA, 15 nt, Salmonella enterica enterica serovar Typhi
acguguggcgcugug

SEQ ID NO: 1660192 - RNA, 19 nt, Salmonella enterica enterica serovar Typhi
acgugcgaaccacggcgua

SEQ ID NO: 1660193 - RNA, 19 nt, Salmonella enterica enterica serovar Typhi
acgugccguuuaugaccgc

SEQ ID NO: 1660194 - RNA, 20 nt, Salmonella enterica enterica serovar Typhi
acgucggcgaauuucgcguu

SEQ ID NO: 1660195 - RNA, 20 nt, Salmonella enterica enterica serovar Typhi
acgucagccgggauaaucag

SEQ ID NO: 1660196 - RNA, 18 nt, Salmonella enterica enterica serovar Typhi
acgucaggaaccucgaaa

SEQ ID NO: 1660197 - RNA, 22 nt, Salmonella enterica enterica serovar Typhi
acgucagccgggauaaucaggu

SEQ ID NO: 1660198 - RNA, 15 nt, Salmonella enterica enterica serovar Typhi
acgucaucaugcugc

SEQ ID NO: 1660199 - RNA, 15 nt, Salmonella enterica enterica serovar Typhi
acgucauaucaucca

SEQ ID NO: 1660200 - RNA, 15 nt, Salmonella enterica enterica serovar Typhi
acgucauaacgcgca

SEQ ID NO: 1660201 - RNA, 15 nt, Salmonella enterica enterica serovar Typhi
acgucccaugacgac

SEQ ID NO: 1660202 - RNA, 20 nt, Salmonella enterica enterica serovar Typhi
acggcuggugaucuggccaa

SEQ ID NO: 1660203 - RNA, 18 nt, Salmonella enterica enterica serovar Typhi
acggcuuccacugcggca

SEQ ID NO: 1660204 - RNA, 22 nt, Salmonella enterica enterica serovar Typhi
acgggcagucuggcggcagccg

SEQ ID NO: 1660205 - RNA, 19 nt, Salmonella enterica enterica serovar Typhi
acggcuuuccagcagccag

SEQ ID NO: 1660206 - RNA, 14 nt, Salmonella enterica enterica serovar Typhi
acggcgcuggcgua

SEQ ID NO: 1660207 - RNA, 16 nt, Salmonella enterica enterica serovar Typhi
acggcgucauccugca

SEQ ID NO: 1660208 - RNA, 13 nt, Salmonella enterica enterica serovar Typhi
acggcgcgccaau

SEQ ID NO: 1660209 - RNA, 23 nt, Salmonella enterica enterica serovar Typhi
acggcgcuaagcgcccguagcuc

SEQ ID NO: 1660210 - RNA, 17 nt, Salmonella enterica enterica serovar Typhi
acggccuaagaccagca

SEQ ID NO: 1660211 - RNA, 18 nt, Salmonella enterica enterica serovar Typhi
acggccuucgcagaucgc

SEQ ID NO: 1660212 - RNA, 15 nt, Salmonella enterica enterica serovar Typhi
acggcgacaggcaca

SEQ ID NO: 1660213 - RNA, 16 nt, Salmonella enterica enterica serovar Typhi
acggcgaauacgggau

SEQ ID NO: 1660214 - RNA, 14 nt, Salmonella enterica enterica serovar Typhi
acggcgaccggcaa

SEQ ID NO: 1660215 - RNA, 12 nt, Salmonella enterica enterica serovar Typhi
acggcgaucagc

SEQ ID NO: 1660216 - RNA, 22 nt, Salmonella enterica enterica serovar Typhi
acgcguuucacaucgccaguua

SEQ ID NO: 1660217 - RNA, 19 nt, Salmonella enterica enterica serovar Typhi
acgcuaaagcgcuggcggc

SEQ ID NO: 1660218 - RNA, 18 nt, Salmonella enterica enterica serovar Typhi
acgcucuucgccaaucgc

SEQ ID NO: 1660219 - RNA, 19 nt, Salmonella enterica enterica serovar Typhi
acgcucuuuuccacggcgc

SEQ ID NO: 1660220 - RNA, 13 nt, Salmonella enterica enterica serovar Typhi
aaacaucagcgca

SEQ ID NO: 1660221 - RNA, 14 nt, Salmonella enterica enterica serovar Typhi
aaacaucagcgcau

SEQ ID NO: 1660222 - RNA, 22 nt, Salmonella enterica enterica serovar Typhi
acgcgucuucaucagccagcau

SEQ ID NO: 1660223 - RNA, 21 nt, Salmonella enterica enterica serovar Typhi
acgcgucuguagcgcgcgcca

SEQ ID NO: 1660224 - RNA, 16 nt, Salmonella enterica enterica serovar Typhi
acgcguaggccggaua

SEQ ID NO: 1660225 - RNA, 19 nt, Salmonella enterica enterica serovar Typhi
acgcgucaauuaccguuua

SEQ ID NO: 1660226 - RNA, 21 nt, Salmonella enterica enterica serovar Typhi
acgcgcccaacggaugcgcca

SEQ ID NO: 1660227 - RNA, 15 nt, Salmonella enterica enterica serovar Typhi
acgcgccauccggca

SEQ ID NO: 1660228 - RNA, 23 nt, Salmonella enterica enterica serovar Typhi
acgcgcauuaauaugcgcaauca

SEQ ID NO: 1660229 - RNA, 20 nt, Salmonella enterica enterica serovar Typhi
acgcgcauuaauaugcgcaa

SEQ ID NO: 1660230 - RNA, 19 nt, Salmonella enterica enterica serovar Typhi
acgccuuauccggccuaca

SEQ ID NO: 1660231 - RNA, 20 nt, Salmonella enterica enterica serovar Typhi
acgcgacuuuuuucacccag

SEQ ID NO: 1660232 - RNA, 18 nt, Salmonella enterica enterica serovar Typhi
acgcgagaagcccggcca

SEQ ID NO: 1660233 - RNA, 19 nt, Salmonella enterica enterica serovar Typhi
acgcgagugucauccugcg

SEQ ID NO: 1660234 - RNA, 13 nt, Salmonella enterica enterica serovar Typhi
acgcggcaucagg

SEQ ID NO: 1660235 - RNA, 22 nt, Salmonella enterica enterica serovar Typhi
acgcggccaaaacccaccagca

SEQ ID NO: 1660236 - RNA, 22 nt, Salmonella enterica enterica serovar Typhi
acgcgccgccaacgauacagca

SEQ ID NO: 1660237 - RNA, 14 nt, Salmonella enterica enterica serovar Typhi
acgccgcaaacgcc

SEQ ID NO: 1660238 - RNA, 14 nt, Salmonella enterica enterica serovar Typhi
acgccgccgacaug

SEQ ID NO: 1660239 - RNA, 17 nt, Salmonella enterica enterica serovar Typhi
acgccgccauccggcaa

SEQ ID NO: 1660240 - RNA, 16 nt, Salmonella enterica enterica serovar Typhi
acgccgccauccggca

SEQ ID NO: 1660241 - RNA, 18 nt, Salmonella enterica enterica serovar Typhi
acgccgccauccggcacg

SEQ ID NO: 1660242 - RNA, 18 nt, Salmonella enterica enterica serovar Typhi
acgccgcgcugcggcguc

SEQ ID NO: 1660243 - RNA, 14 nt, Salmonella enterica enterica serovar Typhi
acgccgccuggcau

SEQ ID NO: 1660244 - RNA, 16 nt, Salmonella enterica enterica serovar Typhi
acgcccuucacgccga

SEQ ID NO: 1660245 - RNA, 19 nt, Salmonella enterica enterica serovar Typhi
acgccgaacaacacggcgg

SEQ ID NO: 1660246 - RNA, 18 nt, Salmonella enterica enterica serovar Typhi
acgccgaggcauucagcc

SEQ ID NO: 1660247 - RNA, 15 nt, Salmonella enterica enterica serovar Typhi
acgccgauaaccagc

SEQ ID NO: 1660248 - RNA, 22 nt, Salmonella enterica enterica serovar Typhi
acgccggggauaucaaugcgcg

SEQ ID NO: 1660249 - RNA, 22 nt, Salmonella enterica enterica serovar Typhi
acgccguagcugcgcgccgcaa

SEQ ID NO: 1660250 - RNA, 23 nt, Salmonella enterica enterica serovar Typhi
acgccggucaggauacagccgac

SEQ ID NO: 1660251 - RNA, 11 nt, Salmonella enterica enterica serovar Typhi
acgccgguacu

SEQ ID NO: 1660252 - RNA, 21 nt, Salmonella enterica enterica serovar Typhi
acgccggcgcguaauuccgca

SEQ ID NO: 1660253 - RNA, 12 nt, Salmonella enterica enterica serovar Typhi
acgccugaugcu

SEQ ID NO: 1660254 - RNA, 13 nt, Salmonella enterica enterica serovar Typhi
acgccugaugcug

SEQ ID NO: 1660255 - RNA, 16 nt, Salmonella enterica enterica serovar Typhi
acgccgugcacuucug

SEQ ID NO: 1660256 - RNA, 19 nt, Salmonella enterica enterica serovar Typhi
acgccgugaacgccaaaua

SEQ ID NO: 1660257 - RNA, 15 nt, Salmonella enterica enterica serovar Typhi
acgccgugcggcgug

SEQ ID NO: 1660258 - RNA, 18 nt, Salmonella enterica enterica serovar Typhi
acgccgucgaugauggcg

SEQ ID NO: 1660259 - RNA, 22 nt, Salmonella enterica enterica serovar Typhi
acgccguccagcaccaccugca

SEQ ID NO: 1660260 - RNA, 20 nt, Salmonella enterica enterica serovar Typhi
accugguauuacaacguucg

SEQ ID NO: 1660261 - RNA, 14 nt, Salmonella enterica enterica serovar Typhi
accugguaagcgcc

SEQ ID NO: 1660262 - RNA, 19 nt, Salmonella enterica enterica serovar Typhi
accugguacaccagacgau

SEQ ID NO: 1660263 - RNA, 18 nt, Salmonella enterica enterica serovar Typhi
accuggcguaguacgcgc

SEQ ID NO: 1660264 - RNA, 15 nt, Salmonella enterica enterica serovar Typhi
accugcgcugacggc

SEQ ID NO: 1660265 - RNA, 22 nt, Salmonella enterica enterica serovar Typhi
accugcggccaugaucgccgcc

SEQ ID NO: 1660266 - RNA, 14 nt, Salmonella enterica enterica serovar Typhi
acgaucaugccgcc

SEQ ID NO: 1660267 - RNA, 15 nt, Salmonella enterica enterica serovar Typhi
acgaucguuugccca

SEQ ID NO: 1660268 - RNA, 22 nt, Salmonella enterica enterica serovar Typhi
acgaugauaauacauugccgca

SEQ ID NO: 1660269 - RNA, 12 nt, Salmonella enterica enterica serovar Typhi
acgagcgcguca

SEQ ID NO: 1660270 - RNA, 23 nt, Salmonella enterica enterica serovar Typhi
acgaucaauaaaauuauccaguu

SEQ ID NO: 1660271 - RNA, 16 nt, Salmonella enterica enterica serovar Typhi
acgauaugcauaaucg

SEQ ID NO: 1660272 - RNA, 14 nt, Salmonella enterica enterica serovar Typhi
acgauauagucgcc

SEQ ID NO: 1660273 - RNA, 21 nt, Salmonella enterica enterica serovar Typhi
acgaucaauaaaauuauccag

SEQ ID NO: 1660274 - RNA, 20 nt, Salmonella enterica enterica serovar Typhi
accuuacgcucgcugauggc

SEQ ID NO: 1660275 - RNA, 11 nt, Salmonella enterica enterica serovar Typhi
accuucgcguu

SEQ ID NO: 1660276 - RNA, 15 nt, Salmonella enterica enterica serovar Typhi
accuucaccggauac

SEQ ID NO: 1660277 - RNA, 19 nt, Salmonella enterica enterica serovar Typhi
accuucacccccaucgccc

SEQ ID NO: 1660278 - RNA, 14 nt, Salmonella enterica enterica serovar Typhi
accuucauggcguu

SEQ ID NO: 1660279 - RNA, 14 nt, Salmonella enterica enterica serovar Typhi
acgcagcuucgccg

SEQ ID NO: 1660280 - RNA, 22 nt, Salmonella enterica enterica serovar Typhi
acgcaggcuugcccauucgccg

SEQ ID NO: 1660281 - RNA, 18 nt, Salmonella enterica enterica serovar Typhi
acgcagcacguccagaua

SEQ ID NO: 1660282 - RNA, 11 nt, Salmonella enterica enterica serovar Typhi
acgauggcgau

SEQ ID NO: 1660283 - RNA, 13 nt, Salmonella enterica enterica serovar Typhi
acgcaucccgcca

SEQ ID NO: 1660284 - RNA, 23 nt, Salmonella enterica enterica serovar Typhi
acgcaucaaagccacccacggca

SEQ ID NO: 1660285 - RNA, 20 nt, Salmonella enterica enterica serovar Typhi
acgcauaaugcgccccgcaa

SEQ ID NO: 1660286 - RNA, 16 nt, Salmonella enterica enterica serovar Typhi
acgcauauccagcaga

SEQ ID NO: 1660287 - RNA, 19 nt, Salmonella enterica enterica serovar Typhi
acgcauuucaagcaggcga

SEQ ID NO: 1660288 - RNA, 18 nt, Salmonella enterica enterica serovar Typhi
acgcauugagacaugccg

SEQ ID NO: 1660289 - RNA, 20 nt, Salmonella enterica enterica serovar Typhi
acgcauugagacaugccgcc

SEQ ID NO: 1660290 - RNA, 23 nt, Salmonella enterica enterica serovar Typhi
acgcauugccauguuaauaccag

SEQ ID NO: 1660291 - RNA, 19 nt, Salmonella enterica enterica serovar Typhi
acgccaacguccgccguca

SEQ ID NO: 1660292 - RNA, 20 nt, Salmonella enterica enterica serovar Typhi
acgccaacguccgccgucag

SEQ ID NO: 1660293 - RNA, 23 nt, Salmonella enterica enterica serovar Typhi
acgccaauuccuaucaguacgac

SEQ ID NO: 1660294 - RNA, 16 nt, Salmonella enterica enterica serovar Typhi
acgcccguccggcuuu

SEQ ID NO: 1660295 - RNA, 20 nt, Salmonella enterica enterica serovar Typhi
acgcccugcccaugaagcga

SEQ ID NO: 1660296 - RNA, 15 nt, Salmonella enterica enterica serovar Typhi
acgcccagccgugaa

SEQ ID NO: 1660297 - RNA, 17 nt, Salmonella enterica enterica serovar Typhi
acgcccaucagcauccc

SEQ ID NO: 1660298 - RNA, 23 nt, Salmonella enterica enterica serovar Typhi
acgccagcagcgcgauacgcgac

SEQ ID NO: 1660299 - RNA, 19 nt, Salmonella enterica enterica serovar Typhi
acgccagauaaaucagccc

SEQ ID NO: 1660300 - RNA, 22 nt, Salmonella enterica enterica serovar Typhi
acgcccacgcggcgugcgcugc

SEQ ID NO: 1660301 - RNA, 22 nt, Salmonella enterica enterica serovar Typhi
acgccaucagcaaaauaccggc

SEQ ID NO: 1660302 - RNA, 13 nt, Salmonella enterica enterica serovar Typhi
acgccaucgcggc

SEQ ID NO: 1660303 - RNA, 14 nt, Salmonella enterica enterica serovar Typhi
acgccaucgacaaa

SEQ ID NO: 1660304 - RNA, 16 nt, Salmonella enterica enterica serovar Typhi
acaaacccccagccau

SEQ ID NO: 1660305 - RNA, 19 nt, Salmonella enterica enterica serovar Typhi
acaaaauuuuuuaucaggu

SEQ ID NO: 1660306 - RNA, 12 nt, Salmonella enterica enterica serovar Typhi
acaaacagcgcc

SEQ ID NO: 1660307 - RNA, 12 nt, Salmonella enterica enterica serovar Typhi
acaaacugcgcu

SEQ ID NO: 1660308 - RNA, 23 nt, Salmonella enterica enterica serovar Typhi
acaaacugcgcuagccgccgugu

SEQ ID NO: 1660309 - RNA, 19 nt, Salmonella enterica enterica serovar Typhi
acagcgccgcgcaagcgau

SEQ ID NO: 1660310 - RNA, 22 nt, Salmonella enterica enterica serovar Typhi
acagccgaucaggccgcagacg

SEQ ID NO: 1660311 - RNA, 23 nt, Salmonella enterica enterica serovar Typhi
acagcguguucaugcgcggcgga

SEQ ID NO: 1660312 - RNA, 14 nt, Salmonella enterica enterica serovar Typhi
acagcgcuccacgc

SEQ ID NO: 1660313 - RNA, 17 nt, Salmonella enterica enterica serovar Typhi
acagcgcgcgaauaucg

SEQ ID NO: 1660314 - RNA, 12 nt, Salmonella enterica enterica serovar Typhi
acaggcauuguc

SEQ ID NO: 1660315 - RNA, 15 nt, Salmonella enterica enterica serovar Typhi
acagguacaggccgc

SEQ ID NO: 1660316 - RNA, 17 nt, Salmonella enterica enterica serovar Typhi
acaguacaccugcaggu

SEQ ID NO: 1660317 - RNA, 21 nt, Salmonella enterica enterica serovar Typhi
acagucgcgccgugcccagca

SEQ ID NO: 1660318 - RNA, 22 nt, Salmonella enterica enterica serovar Typhi
acauauaggcauuaauggcgau

SEQ ID NO: 1660319 - RNA, 22 nt, Salmonella enterica enterica serovar Typhi
acaucaugcuugcuuugcggca

SEQ ID NO: 1660320 - RNA, 19 nt, Salmonella enterica enterica serovar Typhi
acauagccgccacccggca

SEQ ID NO: 1660321 - RNA, 21 nt, Salmonella enterica enterica serovar Typhi
acauauagcagcagucucuac

SEQ ID NO: 1660322 - RNA, 23 nt, Salmonella enterica enterica serovar Typhi
acaugccgcuaugcggcguuaau

SEQ ID NO: 1660323 - RNA, 18 nt, Salmonella enterica enterica serovar Typhi
acaugcguaccugcgcgc

SEQ ID NO: 1660324 - RNA, 21 nt, Salmonella enterica enterica serovar Typhi
acaugcuacaggcaaguuuaa

SEQ ID NO: 1660325 - RNA, 14 nt, Salmonella enterica enterica serovar Typhi
acaugcaauaccgg

SEQ ID NO: 1660326 - RNA, 19 nt, Salmonella enterica enterica serovar Typhi
acaugcccaccggaccuaa

SEQ ID NO: 1660327 - RNA, 19 nt, Salmonella enterica enterica serovar Typhi
acaugccgacggagacgau

SEQ ID NO: 1660328 - RNA, 16 nt, Salmonella enterica enterica serovar Typhi
acaugacgccgaaaua

SEQ ID NO: 1660329 - RNA, 15 nt, Salmonella enterica enterica serovar Typhi
acaucuucggcguug

SEQ ID NO: 1660330 - RNA, 14 nt, Salmonella enterica enterica serovar Typhi
acaucccgaauacg

SEQ ID NO: 1660331 - RNA, 17 nt, Salmonella enterica enterica serovar Typhi
acaucgcaaugccacca

SEQ ID NO: 1660332 - RNA, 14 nt, Salmonella enterica enterica serovar Typhi
acaucgcucgcgcc

SEQ ID NO: 1660333 - RNA, 20 nt, Salmonella enterica enterica serovar Typhi
acaucgcccugauggcgcgc

SEQ ID NO: 1660334 - RNA, 17 nt, Salmonella enterica enterica serovar Typhi
acaucguaaaucagcgu

SEQ ID NO: 1660335 - RNA, 20 nt, Salmonella enterica enterica serovar Typhi
accaaaaacgcccccagaua

SEQ ID NO: 1660336 - RNA, 21 nt, Salmonella enterica enterica serovar Typhi
accaaacagcaauuccgccau

SEQ ID NO: 1660337 - RNA, 18 nt, Salmonella enterica enterica serovar Typhi
acauugucgaacugcacg

SEQ ID NO: 1660338 - RNA, 15 nt, Salmonella enterica enterica serovar Typhi
acauuucgucaucgc

SEQ ID NO: 1660339 - RNA, 20 nt, Salmonella enterica enterica serovar Typhi
acauuucccgagccggguua

SEQ ID NO: 1660340 - RNA, 15 nt, Salmonella enterica enterica serovar Typhi
acauucaggcgguaa

SEQ ID NO: 1660341 - RNA, 22 nt, Salmonella enterica enterica serovar Typhi
acauuagagaguaaaaccggca

SEQ ID NO: 1660342 - RNA, 20 nt, Salmonella enterica enterica serovar Typhi
acauuagcggugcgucaugc

SEQ ID NO: 1660343 - RNA, 17 nt, Salmonella enterica enterica serovar Typhi
acauuaacgccgcguuc

SEQ ID NO: 1660344 - RNA, 18 nt, Salmonella enterica enterica serovar Typhi
acauguuuauguagccag

SEQ ID NO: 1660345 - RNA, 20 nt, Salmonella enterica enterica serovar Typhi
accaacgccgcuuuaccgcc

SEQ ID NO: 1660346 - RNA, 23 nt, Salmonella enterica enterica serovar Typhi
accaacggcgacgcccgccaucu

SEQ ID NO: 1660347 - RNA, 12 nt, Salmonella enterica enterica serovar Typhi
accaauauccgc

SEQ ID NO: 1660348 - RNA, 15 nt, Salmonella enterica enterica serovar Typhi
accaauaucgccguu

SEQ ID NO: 1660349 - RNA, 17 nt, Salmonella enterica enterica serovar Typhi
accagcggaauccccgc

SEQ ID NO: 1660350 - RNA, 14 nt, Salmonella enterica enterica serovar Typhi
accagcgcgccaaa

SEQ ID NO: 1660351 - RNA, 15 nt, Salmonella enterica enterica serovar Typhi
accagcgcgccaucc

SEQ ID NO: 1660352 - RNA, 16 nt, Salmonella enterica enterica serovar Typhi
accagcgcaugacggu

SEQ ID NO: 1660353 - RNA, 17 nt, Salmonella enterica enterica serovar Typhi
accagcgcauugacgau

SEQ ID NO: 1660354 - RNA, 13 nt, Salmonella enterica enterica serovar Typhi
accagcgacggcc

SEQ ID NO: 1660355 - RNA, 15 nt, Salmonella enterica enterica serovar Typhi
accagcgacggcgua

SEQ ID NO: 1660356 - RNA, 12 nt, Salmonella enterica enterica serovar Typhi
accagcgcaucu

SEQ ID NO: 1660357 - RNA, 15 nt, Salmonella enterica enterica serovar Typhi
accagccugccgucu

SEQ ID NO: 1660358 - RNA, 22 nt, Salmonella enterica enterica serovar Typhi
accagcccaacggucuuugccg

SEQ ID NO: 1660359 - RNA, 17 nt, Salmonella enterica enterica serovar Typhi
accacgugucccggcgu

SEQ ID NO: 1660360 - RNA, 11 nt, Salmonella enterica enterica serovar Typhi
accagacccgu

SEQ ID NO: 1660361 - RNA, 18 nt, Salmonella enterica enterica serovar Typhi
accagaauacacuucuca

SEQ ID NO: 1660362 - RNA, 13 nt, Salmonella enterica enterica serovar Typhi
accagcaugugcc

SEQ ID NO: 1660363 - RNA, 13 nt, Salmonella enterica enterica serovar Typhi
accagcaguuccg

SEQ ID NO: 1660364 - RNA, 12 nt, Salmonella enterica enterica serovar Typhi
accagcauaaua

SEQ ID NO: 1660365 - RNA, 23 nt, Salmonella enterica enterica serovar Typhi
accagcaucccacgaaugccgau

SEQ ID NO: 1660366 - RNA, 17 nt, Salmonella enterica enterica serovar Typhi
accagcagcgggcuguc

SEQ ID NO: 1660367 - RNA, 17 nt, Salmonella enterica enterica serovar Typhi
accaccaggaacgccau

SEQ ID NO: 1660368 - RNA, 17 nt, Salmonella enterica enterica serovar Typhi
accaauggcgcgucuua

SEQ ID NO: 1660369 - RNA, 20 nt, Salmonella enterica enterica serovar Typhi
accacaucaauagcgcuaca

SEQ ID NO: 1660370 - RNA, 22 nt, Salmonella enterica enterica serovar Typhi
accacccgggaaaaaugacgcc

SEQ ID NO: 1660371 - RNA, 16 nt, Salmonella enterica enterica serovar Typhi
accaccgcgcuagugc

SEQ ID NO: 1660372 - RNA, 17 nt, Salmonella enterica enterica serovar Typhi
accaccgcucguucgau

SEQ ID NO: 1660373 - RNA, 15 nt, Salmonella enterica enterica serovar Typhi
accacguaaugcgcc

SEQ ID NO: 1660374 - RNA, 20 nt, Salmonella enterica enterica serovar Typhi
accacggagagacaguucag

SEQ ID NO: 1660375 - RNA, 20 nt, Salmonella enterica enterica serovar Typhi
accacgccguagcugcgcgc

SEQ ID NO: 1660376 - RNA, 15 nt, Salmonella enterica enterica serovar Typhi
accacgcccuucacg

SEQ ID NO: 1660377 - RNA, 18 nt, Salmonella enterica enterica serovar Typhi
accaccguuuaaucgccc

SEQ ID NO: 1660378 - RNA, 14 nt, Salmonella enterica enterica serovar Typhi
accaccugcuguug

SEQ ID NO: 1660379 - RNA, 14 nt, Salmonella enterica enterica serovar Typhi
accacgccaacguc

SEQ ID NO: 1660380 - RNA, 16 nt, Salmonella enterica enterica serovar Typhi
accacgcagcccguaa

SEQ ID NO: 1660381 - RNA, 17 nt, Salmonella enterica enterica serovar Typhi
accggccacgagcuguc

SEQ ID NO: 1660382 - RNA, 23 nt, Salmonella enterica enterica serovar Typhi
accggccacaauugccagcaggu

SEQ ID NO: 1660383 - RNA, 19 nt, Salmonella enterica enterica serovar Typhi
accggccgccaucgcaauc

SEQ ID NO: 1660384 - RNA, 14 nt, Salmonella enterica enterica serovar Typhi
accggccgccaucg

SEQ ID NO: 1660385 - RNA, 22 nt, Salmonella enterica enterica serovar Typhi
accggcagcggucaucaaugau

SEQ ID NO: 1660386 - RNA, 18 nt, Salmonella enterica enterica serovar Typhi
accggcgacgugacgcgc

SEQ ID NO: 1660387 - RNA, 17 nt, Salmonella enterica enterica serovar Typhi
accggcguaauugcgcc

SEQ ID NO: 1660388 - RNA, 19 nt, Salmonella enterica enterica serovar Typhi
accggcgcgccuuccagca

SEQ ID NO: 1660389 - RNA, 15 nt, Salmonella enterica enterica serovar Typhi
accggcggaauagcu

SEQ ID NO: 1660390 - RNA, 20 nt, Salmonella enterica enterica serovar Typhi
accggcuguauuuucgauaa

SEQ ID NO: 1660391 - RNA, 18 nt, Salmonella enterica enterica serovar Typhi
accggcugugggcguguc

SEQ ID NO: 1660392 - RNA, 13 nt, Salmonella enterica enterica serovar Typhi
accggcuccggca

SEQ ID NO: 1660393 - RNA, 21 nt, Salmonella enterica enterica serovar Typhi
accggcuccggguugccugau

SEQ ID NO: 1660394 - RNA, 14 nt, Salmonella enterica enterica serovar Typhi
accgccauccggca

SEQ ID NO: 1660395 - RNA, 20 nt, Salmonella enterica enterica serovar Typhi
accgccauacggaugccgau

SEQ ID NO: 1660396 - RNA, 16 nt, Salmonella enterica enterica serovar Typhi
accgccaucaaacgca

SEQ ID NO: 1660397 - RNA, 17 nt, Salmonella enterica enterica serovar Typhi
accgccaaacgcgguca

SEQ ID NO: 1660398 - RNA, 14 nt, Salmonella enterica enterica serovar Typhi
accgagcauccgcg

SEQ ID NO: 1660399 - RNA, 14 nt, Salmonella enterica enterica serovar Typhi
accgccgaugcuga

SEQ ID NO: 1660400 - RNA, 20 nt, Salmonella enterica enterica serovar Typhi
accgccuuauccggccuaca

SEQ ID NO: 1660401 - RNA, 16 nt, Salmonella enterica enterica serovar Typhi
accgccguccuggcga

SEQ ID NO: 1660402 - RNA, 16 nt, Salmonella enterica enterica serovar Typhi
accgcguuuugcugau

SEQ ID NO: 1660403 - RNA, 18 nt, Salmonella enterica enterica serovar Typhi
accgcuauucaccagcgu

SEQ ID NO: 1660404 - RNA, 13 nt, Salmonella enterica enterica serovar Typhi
accgcucaauauc

SEQ ID NO: 1660405 - RNA, 18 nt, Salmonella enterica enterica serovar Typhi
accgcgcgcccgacgcgc

SEQ ID NO: 1660406 - RNA, 20 nt, Salmonella enterica enterica serovar Typhi
aaaauggucggucacgcgau

SEQ ID NO: 1660407 - RNA, 19 nt, Salmonella enterica enterica serovar Typhi
acccggcuaaaugacgcgc

SEQ ID NO: 1660408 - RNA, 17 nt, Salmonella enterica enterica serovar Typhi
acccuucuucuggcuca

SEQ ID NO: 1660409 - RNA, 16 nt, Salmonella enterica enterica serovar Typhi
acccuucagauauccc

SEQ ID NO: 1660410 - RNA, 14 nt, Salmonella enterica enterica serovar Typhi
acccuauccgccag

SEQ ID NO: 1660411 - RNA, 23 nt, Salmonella enterica enterica serovar Typhi
acccacaguuucauauccgacag

SEQ ID NO: 1660412 - RNA, 24 nt, Salmonella enterica enterica serovar Typhi
acccaccguaucgacauaguaccc

SEQ ID NO: 1660413 - RNA, 17 nt, Salmonella enterica enterica serovar Typhi
acccacaacgcgccaac

SEQ ID NO: 1660414 - RNA, 13 nt, Salmonella enterica enterica serovar Typhi
acccacagccggu

SEQ ID NO: 1660415 - RNA, 13 nt, Salmonella enterica enterica serovar Typhi
acccagacggcga

SEQ ID NO: 1660416 - RNA, 21 nt, Salmonella enterica enterica serovar Typhi
acccagacugugauggcgguc

SEQ ID NO: 1660417 - RNA, 20 nt, Salmonella enterica enterica serovar Typhi
acccacuucuuccagcgugu

SEQ ID NO: 1660418 - RNA, 20 nt, Salmonella enterica enterica serovar Typhi
acccaggugugcggucgcuu

SEQ ID NO: 1660419 - RNA, 21 nt, Salmonella enterica enterica serovar Typhi
acccagguuugcgcggcgggu

SEQ ID NO: 1660420 - RNA, 19 nt, Salmonella enterica enterica serovar Typhi
acccaggcgucgaacuccg

SEQ ID NO: 1660421 - RNA, 18 nt, Salmonella enterica enterica serovar Typhi
acccaguuuuaagcgcag

SEQ ID NO: 1660422 - RNA, 19 nt, Salmonella enterica enterica serovar Typhi
acccgcacccgaaagucaa

SEQ ID NO: 1660423 - RNA, 13 nt, Salmonella enterica enterica serovar Typhi
acccgcaggccug

SEQ ID NO: 1660424 - RNA, 13 nt, Salmonella enterica enterica serovar Typhi
accccuuccugca

SEQ ID NO: 1660425 - RNA, 19 nt, Salmonella enterica enterica serovar Typhi
accccuucgcccucgccag

SEQ ID NO: 1660426 - RNA, 21 nt, Salmonella enterica enterica serovar Typhi
acccgaacaacaauacgcguc

SEQ ID NO: 1660427 - RNA, 19 nt, Salmonella enterica enterica serovar Typhi
accccauuaugugcgacgu

SEQ ID NO: 1660428 - RNA, 18 nt, Salmonella enterica enterica serovar Typhi
accccaguaauccggcaa

SEQ ID NO: 1660429 - RNA, 13 nt, Salmonella enterica enterica serovar Typhi
accccauggcguc

SEQ ID NO: 1660430 - RNA, 17 nt, Salmonella enterica enterica serovar Typhi
accccaguaauccggca

SEQ ID NO: 1660431 - RNA, 13 nt, Salmonella enterica enterica serovar Typhi
accccgccugacg

SEQ ID NO: 1660432 - RNA, 22 nt, Salmonella enterica enterica serovar Typhi
aagcugcgcggcuuucguaccg

SEQ ID NO: 1660433 - RNA, 12 nt, Salmonella enterica enterica serovar Typhi
aagcugcauaau

SEQ ID NO: 1660434 - RNA, 22 nt, Salmonella enterica enterica serovar Typhi
aagcugagaaaagggcgcacca

SEQ ID NO: 1660435 - RNA, 21 nt, Salmonella enterica enterica serovar Typhi
aagcguuuaauuccaucggca

SEQ ID NO: 1660436 - RNA, 18 nt, Salmonella enterica enterica serovar Typhi
aagcuaauccccagcgcu

SEQ ID NO: 1660437 - RNA, 21 nt, Salmonella enterica enterica serovar Typhi
aagcuacguuugaacagcagu

SEQ ID NO: 1660438 - RNA, 19 nt, Salmonella enterica enterica serovar Typhi
aagcgcucaugccacgcca

SEQ ID NO: 1660439 - RNA, 14 nt, Salmonella enterica enterica serovar Typhi
aagcgccugcugcg

SEQ ID NO: 1660440 - RNA, 16 nt, Salmonella enterica enterica serovar Typhi
aagcgccugcugcgca

SEQ ID NO: 1660441 - RNA, 22 nt, Salmonella enterica enterica serovar Typhi
aagcguaguacguuccagcguu

SEQ ID NO: 1660442 - RNA, 14 nt, Salmonella enterica enterica serovar Typhi
aagcggcagcgcca

SEQ ID NO: 1660443 - RNA, 15 nt, Salmonella enterica enterica serovar Typhi
aagcgucauccggca

SEQ ID NO: 1660444 - RNA, 22 nt, Salmonella enterica enterica serovar Typhi
aagcguuagcgucauccggcau

SEQ ID NO: 1660445 - RNA, 22 nt, Salmonella enterica enterica serovar Typhi
aagcguuguaacaaaccgguaa

SEQ ID NO: 1660446 - RNA, 14 nt, Salmonella enterica enterica serovar Typhi
aagcgugcgccauc

SEQ ID NO: 1660447 - RNA, 20 nt, Salmonella enterica enterica serovar Typhi
aagccugcuucaccgcgcca

SEQ ID NO: 1660448 - RNA, 18 nt, Salmonella enterica enterica serovar Typhi
aagccugggucguugacg

SEQ ID NO: 1660449 - RNA, 23 nt, Salmonella enterica enterica serovar Typhi
aagcccgauaagcaagcgccauc

SEQ ID NO: 1660450 - RNA, 17 nt, Salmonella enterica enterica serovar Typhi
aagcgaauccagcgccg

SEQ ID NO: 1660451 - RNA, 19 nt, Salmonella enterica enterica serovar Typhi
aagccauugccgcgacaaa

SEQ ID NO: 1660452 - RNA, 20 nt, Salmonella enterica enterica serovar Typhi
aagcauggcguuaaugcgcg

SEQ ID NO: 1660453 - RNA, 22 nt, Salmonella enterica enterica serovar Typhi
aagaucguuauccagcagccac

SEQ ID NO: 1660454 - RNA, 14 nt, Salmonella enterica enterica serovar Typhi
aagauagcgggcaa

SEQ ID NO: 1660455 - RNA, 13 nt, Salmonella enterica enterica serovar Typhi
aagcacugcugcu

SEQ ID NO: 1660456 - RNA, 19 nt, Salmonella enterica enterica serovar Typhi
aagcacuucucgcgcauca

SEQ ID NO: 1660457 - RNA, 19 nt, Salmonella enterica enterica serovar Typhi
aagcacuucuccacgcgau

SEQ ID NO: 1660458 - RNA, 11 nt, Salmonella enterica enterica serovar Typhi
aagcaggccga

SEQ ID NO: 1660459 - RNA, 17 nt, Salmonella enterica enterica serovar Typhi
aagagcucgaccaacau

SEQ ID NO: 1660460 - RNA, 21 nt, Salmonella enterica enterica serovar Typhi
aacgugcgguauaucacgcca

SEQ ID NO: 1660461 - RNA, 21 nt, Salmonella enterica enterica serovar Typhi
aacuaacccgcagccggaauc

SEQ ID NO: 1660462 - RNA, 22 nt, Salmonella enterica enterica serovar Typhi
aacguuucauggaaaucaagcg

SEQ ID NO: 1660463 - RNA, 15 nt, Salmonella enterica enterica serovar Typhi
aacguuuuacgcugc

SEQ ID NO: 1660464 - RNA, 16 nt, Salmonella enterica enterica serovar Typhi
aacguuguccagcaga

SEQ ID NO: 1660465 - RNA, 18 nt, Salmonella enterica enterica serovar Typhi
aagcuuucugaauuucac

SEQ ID NO: 1660466 - RNA, 16 nt, Salmonella enterica enterica serovar Typhi
aaggcgcagccgccau

SEQ ID NO: 1660467 - RNA, 17 nt, Salmonella enterica enterica serovar Typhi
aaggcguaaccgccauc

SEQ ID NO: 1660468 - RNA, 22 nt, Salmonella enterica enterica serovar Typhi
aaggcgcuuuuggcgucguuaa

SEQ ID NO: 1660469 - RNA, 17 nt, Salmonella enterica enterica serovar Typhi
aaggcgcuugcgccauc

SEQ ID NO: 1660470 - RNA, 17 nt, Salmonella enterica enterica serovar Typhi
aaggcgcuagccgcauc

SEQ ID NO: 1660471 - RNA, 16 nt, Salmonella enterica enterica serovar Typhi
aagguucccugcgcca

SEQ ID NO: 1660472 - RNA, 17 nt, Salmonella enterica enterica serovar Typhi
aagguuugcugcgucac

SEQ ID NO: 1660473 - RNA, 15 nt, Salmonella enterica enterica serovar Typhi
aaguagcguucgccg

SEQ ID NO: 1660474 - RNA, 13 nt, Salmonella enterica enterica serovar Typhi
aauaccggcauca

SEQ ID NO: 1660475 - RNA, 22 nt, Salmonella enterica enterica serovar Typhi
aauaccuaacucuuccgcaauc

SEQ ID NO: 1660476 - RNA, 16 nt, Salmonella enterica enterica serovar Typhi
aauagaacgucgcgcg

SEQ ID NO: 1660477 - RNA, 19 nt, Salmonella enterica enterica serovar Typhi
aauaccugccugucacgca

SEQ ID NO: 1660478 - RNA, 18 nt, Salmonella enterica enterica serovar Typhi
aauaccuuauucagccca

SEQ ID NO: 1660479 - RNA, 22 nt, Salmonella enterica enterica serovar Typhi
aauaaagagcacuucugacauu

SEQ ID NO: 1660480 - RNA, 13 nt, Salmonella enterica enterica serovar Typhi
aauaacguaaccg

SEQ ID NO: 1660481 - RNA, 14 nt, Salmonella enterica enterica serovar Typhi
aaugucaugcgcca

SEQ ID NO: 1660482 - RNA, 19 nt, Salmonella enterica enterica serovar Typhi
aaugguugucagaucgccc

SEQ ID NO: 1660483 - RNA, 22 nt, Salmonella enterica enterica serovar Typhi
aauggcgacgaucagcgccacg

SEQ ID NO: 1660484 - RNA, 16 nt, Salmonella enterica enterica serovar Typhi
aauggccgcagcgcca

SEQ ID NO: 1660485 - RNA, 20 nt, Salmonella enterica enterica serovar Typhi
aauggauuuauggcacauca

SEQ ID NO: 1660486 - RNA, 13 nt, Salmonella enterica enterica serovar Typhi
aaugcgcacgcca

SEQ ID NO: 1660487 - RNA, 15 nt, Salmonella enterica enterica serovar Typhi
aaugcgacagcgaca

SEQ ID NO: 1660488 - RNA, 15 nt, Salmonella enterica enterica serovar Typhi
aaugccuuaccuggc

SEQ ID NO: 1660489 - RNA, 16 nt, Salmonella enterica enterica serovar Typhi
aaugccuuaugcccgg

SEQ ID NO: 1660490 - RNA, 13 nt, Salmonella enterica enterica serovar Typhi
aaucuggccuacg

SEQ ID NO: 1660491 - RNA, 19 nt, Salmonella enterica enterica serovar Typhi
aaucucgugaucgccaaag

SEQ ID NO: 1660492 - RNA, 23 nt, Salmonella enterica enterica serovar Typhi
aaucuggcgcaaaugggccuacg

SEQ ID NO: 1660493 - RNA, 12 nt, Salmonella enterica enterica serovar Typhi
aaucuucgcggc

SEQ ID NO: 1660494 - RNA, 16 nt, Salmonella enterica enterica serovar Typhi
aaugccggaucaggcg

SEQ ID NO: 1660495 - RNA, 15 nt, Salmonella enterica enterica serovar Typhi
aaugauccgaugcgc

SEQ ID NO: 1660496 - RNA, 17 nt, Salmonella enterica enterica serovar Typhi
aaugugaauccaggcca

SEQ ID NO: 1660497 - RNA, 15 nt, Salmonella enterica enterica serovar Typhi
aauguuagcgucugc

SEQ ID NO: 1660498 - RNA, 23 nt, Salmonella enterica enterica serovar Typhi
aauucuuuaauuugugccagcgu

SEQ ID NO: 1660499 - RNA, 18 nt, Salmonella enterica enterica serovar Typhi
aauucgucgccgccaaag

SEQ ID NO: 1660500 - RNA, 20 nt, Salmonella enterica enterica serovar Typhi
aauucguguuuuugaacauu

SEQ ID NO: 1660501 - RNA, 13 nt, Salmonella enterica enterica serovar Typhi
aauuuaucugcgu

SEQ ID NO: 1660502 - RNA, 22 nt, Salmonella enterica enterica serovar Typhi
aauuuauaagccugagcgcgag

SEQ ID NO: 1660503 - RNA, 19 nt, Salmonella enterica enterica serovar Typhi
aauuucaccaccgguauaa

SEQ ID NO: 1660504 - RNA, 12 nt, Salmonella enterica enterica serovar Typhi
aaucgcguucgc

SEQ ID NO: 1660505 - RNA, 16 nt, Salmonella enterica enterica serovar Typhi
aaucgcuaaggcggca

SEQ ID NO: 1660506 - RNA, 14 nt, Salmonella enterica enterica serovar Typhi
aaucgcguucgcgg

SEQ ID NO: 1660507 - RNA, 14 nt, Salmonella enterica enterica serovar Typhi
aaucgcuuccuggg

SEQ ID NO: 1660508 - RNA, 13 nt, Salmonella enterica enterica serovar Typhi
aaucggcaggcca

SEQ ID NO: 1660509 - RNA, 20 nt, Salmonella enterica enterica serovar Typhi
aaucggcaaauacaucgcca

SEQ ID NO: 1660510 - RNA, 18 nt, Salmonella enterica enterica serovar Typhi
aaucggcgucuugccgca

SEQ ID NO: 1660511 - RNA, 15 nt, Salmonella enterica enterica serovar Typhi
aaucgugcaauccug

SEQ ID NO: 1660512 - RNA, 20 nt, Salmonella enterica enterica serovar Typhi
aaucucacgcucauagccgc

SEQ ID NO: 1660513 - RNA, 23 nt, Salmonella enterica enterica serovar Typhi
aaucucagauaauagcugcggcu

SEQ ID NO: 1660514 - RNA, 17 nt, Salmonella enterica enterica serovar Typhi
aaucgccaucagcgcga

SEQ ID NO: 1660515 - RNA, 22 nt, Salmonella enterica enterica serovar Typhi
aaucgagcccagacuuuccagc

SEQ ID NO: 1660516 - RNA, 22 nt, Salmonella enterica enterica serovar Typhi
aaucgaugccacagcgcauuca

SEQ ID NO: 1660517 - RNA, 16 nt, Salmonella enterica enterica serovar Typhi
aauccugauuaaguuu

SEQ ID NO: 1660518 - RNA, 15 nt, Salmonella enterica enterica serovar Typhi
aauccugcgcuggcu

SEQ ID NO: 1660519 - RNA, 23 nt, Salmonella enterica enterica serovar Typhi
aaucgacagccagcauuuccagc

SEQ ID NO: 1660520 - RNA, 14 nt, Salmonella enterica enterica serovar Typhi
aaucgacaauccgc

SEQ ID NO: 1660521 - RNA, 13 nt, Salmonella enterica enterica serovar Typhi
aauccggcugccu

SEQ ID NO: 1660522 - RNA, 14 nt, Salmonella enterica enterica serovar Typhi
aaucagaauaccgc

SEQ ID NO: 1660523 - RNA, 15 nt, Salmonella enterica enterica serovar Typhi
aaucagcuuugcggc

SEQ ID NO: 1660524 - RNA, 15 nt, Salmonella enterica enterica serovar Typhi
aaucagccgacggcg

SEQ ID NO: 1660525 - RNA, 21 nt, Salmonella enterica enterica serovar Typhi
aaucagcgcggcgugaucaaa

SEQ ID NO: 1660526 - RNA, 17 nt, Salmonella enterica enterica serovar Typhi
aaucaggaaagagccgc

SEQ ID NO: 1660527 - RNA, 15 nt, Salmonella enterica enterica serovar Typhi
aauagcgccauccug

SEQ ID NO: 1660528 - RNA, 21 nt, Salmonella enterica enterica serovar Typhi
aauagcgcugaggcgcuggcu

SEQ ID NO: 1660529 - RNA, 19 nt, Salmonella enterica enterica serovar Typhi
aauagcgccacgcgaugca

SEQ ID NO: 1660530 - RNA, 18 nt, Salmonella enterica enterica serovar Typhi
aauagccccggucaacgc

SEQ ID NO: 1660531 - RNA, 17 nt, Salmonella enterica enterica serovar Typhi
aaucccgcguucgcgca

SEQ ID NO: 1660532 - RNA, 23 nt, Salmonella enterica enterica serovar Typhi
aaucccccggaucaccggcauuu

SEQ ID NO: 1660533 - RNA, 15 nt, Salmonella enterica enterica serovar Typhi
aauccccgaaagccg

SEQ ID NO: 1660534 - RNA, 17 nt, Salmonella enterica enterica serovar Typhi
aauccaucucaggccga

SEQ ID NO: 1660535 - RNA, 15 nt, Salmonella enterica enterica serovar Typhi
aauccauaccugacg

SEQ ID NO: 1660536 - RNA, 16 nt, Salmonella enterica enterica serovar Typhi
aauccagcgcgcugag

SEQ ID NO: 1660537 - RNA, 12 nt, Salmonella enterica enterica serovar Typhi
aaucauccugcg

SEQ ID NO: 1660538 - RNA, 13 nt, Salmonella enterica enterica serovar Typhi
aaucauaaagcgc

SEQ ID NO: 1660539 - RNA, 20 nt, Salmonella enterica enterica serovar Typhi
aacggcaccggaaccggcau

SEQ ID NO: 1660540 - RNA, 19 nt, Salmonella enterica enterica serovar Typhi
aacggaccggcaaucgccu

SEQ ID NO: 1660541 - RNA, 22 nt, Salmonella enterica enterica serovar Typhi
aacgcgagugucauccugcgca

SEQ ID NO: 1660542 - RNA, 14 nt, Salmonella enterica enterica serovar Typhi
aacgcgaugccugg

SEQ ID NO: 1660543 - RNA, 16 nt, Salmonella enterica enterica serovar Typhi
aacgcuuugcgauagc

SEQ ID NO: 1660544 - RNA, 23 nt, Salmonella enterica enterica serovar Typhi
aacgcuuugcgauagcccggcau

SEQ ID NO: 1660545 - RNA, 20 nt, Salmonella enterica enterica serovar Typhi
aacgcuuuagugccgccauu

SEQ ID NO: 1660546 - RNA, 20 nt, Salmonella enterica enterica serovar Typhi
aacguaaucaucaugcugca

SEQ ID NO: 1660547 - RNA, 23 nt, Salmonella enterica enterica serovar Typhi
aacgguuucgauuucuucgaccg

SEQ ID NO: 1660548 - RNA, 19 nt, Salmonella enterica enterica serovar Typhi
aacguaaucaucaugcugc

SEQ ID NO: 1660549 - RNA, 18 nt, Salmonella enterica enterica serovar Typhi
aacgaaacucagcggccc

SEQ ID NO: 1660550 - RNA, 14 nt, Salmonella enterica enterica serovar Typhi
aaccgcucacgguu

SEQ ID NO: 1660551 - RNA, 17 nt, Salmonella enterica enterica serovar Typhi
aaccgccuccaggccgg

SEQ ID NO: 1660552 - RNA, 20 nt, Salmonella enterica enterica serovar Typhi
aaccgcgaucgaugugauaa

SEQ ID NO: 1660553 - RNA, 17 nt, Salmonella enterica enterica serovar Typhi
aacgaucuggucgccaa

SEQ ID NO: 1660554 - RNA, 16 nt, Salmonella enterica enterica serovar Typhi
aacgauaauucgccgg

SEQ ID NO: 1660555 - RNA, 17 nt, Salmonella enterica enterica serovar Typhi
aacgaacgcggaucaga

SEQ ID NO: 1660556 - RNA, 19 nt, Salmonella enterica enterica serovar Typhi
aacgaacugauguuccggc

SEQ ID NO: 1660557 - RNA, 14 nt, Salmonella enterica enterica serovar Typhi
aacgaaucgaaucg

SEQ ID NO: 1660558 - RNA, 21 nt, Salmonella enterica enterica serovar Typhi
aacgccgaccacuucaacgcc

SEQ ID NO: 1660559 - RNA, 15 nt, Salmonella enterica enterica serovar Typhi
aacgccgagccgccc

SEQ ID NO: 1660560 - RNA, 18 nt, Salmonella enterica enterica serovar Typhi
aacgccgggccugccagg

SEQ ID NO: 1660561 - RNA, 20 nt, Salmonella enterica enterica serovar Typhi
aacgccgcuuuaccgccuuc

SEQ ID NO: 1660562 - RNA, 14 nt, Salmonella enterica enterica serovar Typhi
aacgcgacaacgcc

SEQ ID NO: 1660563 - RNA, 18 nt, Salmonella enterica enterica serovar Typhi
aacgcgaccagcgcgcca

SEQ ID NO: 1660564 - RNA, 17 nt, Salmonella enterica enterica serovar Typhi
aacgcgaauccgccaua

SEQ ID NO: 1660565 - RNA, 14 nt, Salmonella enterica enterica serovar Typhi
aacgcacuaccaga

SEQ ID NO: 1660566 - RNA, 13 nt, Salmonella enterica enterica serovar Typhi
aacgcauccagcg

SEQ ID NO: 1660567 - RNA, 14 nt, Salmonella enterica enterica serovar Typhi
aacgcauccagcgu

SEQ ID NO: 1660568 - RNA, 16 nt, Salmonella enterica enterica serovar Typhi
aacgcauccagcguca

SEQ ID NO: 1660569 - RNA, 14 nt, Salmonella enterica enterica serovar Typhi
aacgcaucgcugcg

SEQ ID NO: 1660570 - RNA, 20 nt, Salmonella enterica enterica serovar Typhi
aacgcaucgcugcgcuuaca

SEQ ID NO: 1660571 - RNA, 21 nt, Salmonella enterica enterica serovar Typhi
aacgcaucgcggauggcggca

SEQ ID NO: 1660572 - RNA, 15 nt, Salmonella enterica enterica serovar Typhi
aaccacagugaugac

SEQ ID NO: 1660573 - RNA, 12 nt, Salmonella enterica enterica serovar Typhi
aaccagccgauc

SEQ ID NO: 1660574 - RNA, 20 nt, Salmonella enterica enterica serovar Typhi
aaccaauuuaaaauccggcu

SEQ ID NO: 1660575 - RNA, 15 nt, Salmonella enterica enterica serovar Typhi
aaccaaagcagaggu

SEQ ID NO: 1660576 - RNA, 14 nt, Salmonella enterica enterica serovar Typhi
aacauuucagcgcc

SEQ ID NO: 1660577 - RNA, 22 nt, Salmonella enterica enterica serovar Typhi
aacaucugcguugcgcgcguca

SEQ ID NO: 1660578 - RNA, 14 nt, Salmonella enterica enterica serovar Typhi
aacaugcccaguuu

SEQ ID NO: 1660579 - RNA, 12 nt, Salmonella enterica enterica serovar Typhi
aacaucauuauu

SEQ ID NO: 1660580 - RNA, 15 nt, Salmonella enterica enterica serovar Typhi
aacaucagcgcuacc

SEQ ID NO: 1660581 - RNA, 19 nt, Salmonella enterica enterica serovar Typhi
aacagugggcuaugaagag

SEQ ID NO: 1660582 - RNA, 19 nt, Salmonella enterica enterica serovar Typhi
aaccgauaaucaccagccc

SEQ ID NO: 1660583 - RNA, 19 nt, Salmonella enterica enterica serovar Typhi
aaccgacaauauucgccgc

SEQ ID NO: 1660584 - RNA, 16 nt, Salmonella enterica enterica serovar Typhi
aaccgaugcaaccgcu

SEQ ID NO: 1660585 - RNA, 15 nt, Salmonella enterica enterica serovar Typhi
aaccgaucucccagc

SEQ ID NO: 1660586 - RNA, 15 nt, Salmonella enterica enterica serovar Typhi
aaccgaauucgucca

SEQ ID NO: 1660587 - RNA, 21 nt, Salmonella enterica enterica serovar Typhi
aaccgaacaauaugcgcauca

SEQ ID NO: 1660588 - RNA, 14 nt, Salmonella enterica enterica serovar Typhi
aacccggcugccau

SEQ ID NO: 1660589 - RNA, 18 nt, Salmonella enterica enterica serovar Typhi
aacccggcgaccggugau

SEQ ID NO: 1660590 - RNA, 16 nt, Salmonella enterica enterica serovar Typhi
aacccgcuacgcguga

SEQ ID NO: 1660591 - RNA, 22 nt, Salmonella enterica enterica serovar Typhi
aaccccggcaaaccuaccggca

SEQ ID NO: 1660592 - RNA, 15 nt, Salmonella enterica enterica serovar Typhi
aacccaccagcaggg

SEQ ID NO: 1660593 - RNA, 20 nt, Salmonella enterica enterica serovar Typhi
aacccaccauaggccagcgu

SEQ ID NO: 1660594 - RNA, 17 nt, Salmonella enterica enterica serovar Typhi
aacccgccgccaucaac

SEQ ID NO: 1660595 - RNA, 13 nt, Salmonella enterica enterica serovar Typhi
aacccgccgccau

SEQ ID NO: 1660596 - RNA, 21 nt, Salmonella enterica enterica serovar Typhi
aacccgaucgccauccugcac

SEQ ID NO: 1660597 - RNA, 17 nt, Salmonella enterica enterica serovar Typhi
aaccccugcccgcgauc

SEQ ID NO: 1660598 - RNA, 17 nt, Salmonella enterica enterica serovar Typhi
aaccauuucuccugcau

SEQ ID NO: 1660599 - RNA, 17 nt, Salmonella enterica enterica serovar Typhi
aaacuuauacugauaaa

SEQ ID NO: 1660600 - RNA, 16 nt, Salmonella enterica enterica serovar Typhi
aaagcaauaauccgcu

SEQ ID NO: 1660601 - RNA, 22 nt, Salmonella enterica enterica serovar Typhi
aaacucuuccccgaucagaaaa

SEQ ID NO: 1660602 - RNA, 14 nt, Salmonella enterica enterica serovar Typhi
aaacugcgaugcgc

SEQ ID NO: 1660603 - RNA, 17 nt, Salmonella enterica enterica serovar Typhi
aaacuggcggaacgcau

SEQ ID NO: 1660604 - RNA, 23 nt, Salmonella enterica enterica serovar Typhi
aaacgugcuggauggcagacaaa

SEQ ID NO: 1660605 - RNA, 19 nt, Salmonella enterica enterica serovar Typhi
aaacuaauggcgcagcggu

SEQ ID NO: 1660606 - RNA, 17 nt, Salmonella enterica enterica serovar Typhi
aaacgcccccagauaga

SEQ ID NO: 1660607 - RNA, 18 nt, Salmonella enterica enterica serovar Typhi
aaacgacucaucaguccg

SEQ ID NO: 1660608 - RNA, 16 nt, Salmonella enterica enterica serovar Typhi
aaacgaaucucaucag

SEQ ID NO: 1660609 - RNA, 12 nt, Salmonella enterica enterica serovar Typhi
aaaaaaccguau

SEQ ID NO: 1660610 - RNA, 22 nt, Salmonella enterica enterica serovar Typhi
aaaaauauggucgaaaauaucg

SEQ ID NO: 1660611 - RNA, 17 nt, Salmonella enterica enterica serovar Typhi
aaagcguugcaggcgau

SEQ ID NO: 1660612 - RNA, 17 nt, Salmonella enterica enterica serovar Typhi
aaagcguuggcgugcga

SEQ ID NO: 1660613 - RNA, 23 nt, Salmonella enterica enterica serovar Typhi
aaagcuccggacgcaccagccag

SEQ ID NO: 1660614 - RNA, 17 nt, Salmonella enterica enterica serovar Typhi
aaagcaaucgccagcgc

SEQ ID NO: 1660615 - RNA, 19 nt, Salmonella enterica enterica serovar Typhi
aaaggcgcaacgucgccau

SEQ ID NO: 1660616 - RNA, 20 nt, Salmonella enterica enterica serovar Typhi
aaaguggaaggaagggcgcu

SEQ ID NO: 1660617 - RNA, 15 nt, Salmonella enterica enterica serovar Typhi
aaaggaucgauuaag

SEQ ID NO: 1660618 - RNA, 23 nt, Salmonella enterica enterica serovar Typhi
aaauauccgccaucgacagcgcc

SEQ ID NO: 1660619 - RNA, 22 nt, Salmonella enterica enterica serovar Typhi
aaauaguuacuguuucacgccu

SEQ ID NO: 1660620 - RNA, 22 nt, Salmonella enterica enterica serovar Typhi
aaauagcgguucaaucacgcgu

SEQ ID NO: 1660621 - RNA, 12 nt, Salmonella enterica enterica serovar Typhi
aaauaccagcac

SEQ ID NO: 1660622 - RNA, 23 nt, Salmonella enterica enterica serovar Typhi
aaauacgcggcacguuuuccagg

SEQ ID NO: 1660623 - RNA, 14 nt, Salmonella enterica enterica serovar Typhi
aaauagccagcauc

SEQ ID NO: 1660624 - RNA, 14 nt, Salmonella enterica enterica serovar Typhi
aacagaccgccaug

SEQ ID NO: 1660625 - RNA, 16 nt, Salmonella enterica enterica serovar Typhi
aacagaaaagaucgcu

SEQ ID NO: 1660626 - RNA, 14 nt, Salmonella enterica enterica serovar Typhi
aaaagcgacgcugu

SEQ ID NO: 1660627 - RNA, 16 nt, Salmonella enterica enterica serovar Typhi
aacagcggcaggcgga

SEQ ID NO: 1660628 - RNA, 15 nt, Salmonella enterica enterica serovar Typhi
aacagccagaagccu

SEQ ID NO: 1660629 - RNA, 22 nt, Salmonella enterica enterica serovar Typhi
aacagcuucaugcgccgcgaca

SEQ ID NO: 1660630 - RNA, 18 nt, Salmonella enterica enterica serovar Typhi
aaauugccugauggcgcu

SEQ ID NO: 1660631 - RNA, 22 nt, Salmonella enterica enterica serovar Typhi
aaauugaccucacgcuuaucgc

SEQ ID NO: 1660632 - RNA, 18 nt, Salmonella enterica enterica serovar Typhi
aaauugagaauuauucgu

SEQ ID NO: 1660633 - RNA, 23 nt, Salmonella enterica enterica serovar Typhi
aaauugccugauggcgcugcgcu

SEQ ID NO: 1660634 - RNA, 23 nt, Salmonella enterica enterica serovar Typhi
aaauuccagcaaugagccgucgc

SEQ ID NO: 1660635 - RNA, 15 nt, Salmonella enterica enterica serovar Typhi
aaauggguaucuuca

SEQ ID NO: 1660636 - RNA, 21 nt, Salmonella enterica enterica serovar Typhi
aaaucuggugauaaagcagac

SEQ ID NO: 1660637 - RNA, 21 nt, Salmonella enterica enterica serovar Typhi
aaaugccuguuuauauucugg

SEQ ID NO: 1660638 - RNA, 12 nt, Salmonella enterica enterica serovar Typhi
aaaucagauaac

SEQ ID NO: 1660639 - RNA, 13 nt, Salmonella enterica enterica serovar Typhi
uuuuccagcgcga

SEQ ID NO: 1660640 - RNA, 13 nt, Salmonella enterica enterica serovar Typhi
uuugugugcagga

SEQ ID NO: 1660641 - RNA, 15 nt, Salmonella enterica enterica serovar Typhi
uuuguugccuucgau

SEQ ID NO: 1660642 - RNA, 19 nt, Salmonella enterica enterica serovar Typhi
uuuugucaucgucagcaac

SEQ ID NO: 1660643 - RNA, 12 nt, Salmonella enterica enterica serovar Typhi
uuuuuacgcuua

SEQ ID NO: 1660644 - RNA, 17 nt, Salmonella enterica enterica serovar Typhi
uuugcguacucagcaga

SEQ ID NO: 1660645 - RNA, 21 nt, Salmonella enterica enterica serovar Typhi
uuugcuucaauaaguuagcuu

SEQ ID NO: 1660646 - RNA, 11 nt, Salmonella enterica enterica serovar Typhi
uuugcugcugc

SEQ ID NO: 1660647 - RNA, 18 nt, Salmonella enterica enterica serovar Typhi
uuugaacgagucuuacca

SEQ ID NO: 1660648 - RNA, 10 nt, Salmonella enterica enterica serovar Typhi
uuuccgccau

SEQ ID NO: 1660649 - RNA, 13 nt, Salmonella enterica enterica serovar Typhi
uuuccagugccag

SEQ ID NO: 1660650 - RNA, 19 nt, Salmonella enterica enterica serovar Typhi
uuuccaguugcggcaucag

SEQ ID NO: 1660651 - RNA, 19 nt, Salmonella enterica enterica serovar Typhi
uugucguucacguaaucgc

SEQ ID NO: 1660652 - RNA, 21 nt, Salmonella enterica enterica serovar Typhi
uuguucaaucggauaauccgc

SEQ ID NO: 1660653 - RNA, 16 nt, Salmonella enterica enterica serovar Typhi
uuucagcggcagcucu

SEQ ID NO: 1660654 - RNA, 23 nt, Salmonella enterica enterica serovar Typhi
uuucagaucgccgccgguaacga

SEQ ID NO: 1660655 - RNA, 18 nt, Salmonella enterica enterica serovar Typhi
uuuauggcggggcgcuau

SEQ ID NO: 1660656 - RNA, 11 nt, Salmonella enterica enterica serovar Typhi
uuuaugcgccu

SEQ ID NO: 1660657 - RNA, 21 nt, Salmonella enterica enterica serovar Typhi
uuuaucaaaaagacuccggca

SEQ ID NO: 1660658 - RNA, 15 nt, Salmonella enterica enterica serovar Typhi
uuuauccggcgccau

SEQ ID NO: 1660659 - RNA, 13 nt, Salmonella enterica enterica serovar Typhi
uuuacgccgccau

SEQ ID NO: 1660660 - RNA, 21 nt, Salmonella enterica enterica serovar Typhi
uuggcuggguaaaaucagcgc

SEQ ID NO: 1660661 - RNA, 21 nt, Salmonella enterica enterica serovar Typhi
uuggcucgauuccugacgcac

SEQ ID NO: 1660662 - RNA, 18 nt, Salmonella enterica enterica serovar Typhi
uugggauuacuuccgguu

SEQ ID NO: 1660663 - RNA, 23 nt, Salmonella enterica enterica serovar Typhi
uuguacggaugggguaucgccaa

SEQ ID NO: 1660664 - RNA, 23 nt, Salmonella enterica enterica serovar Typhi
uuguacggcggcauuaaagccgc

SEQ ID NO: 1660665 - RNA, 15 nt, Salmonella enterica enterica serovar Typhi
uugucgcccugcaau

SEQ ID NO: 1660666 - RNA, 20 nt, Salmonella enterica enterica serovar Typhi
uuguaggccggauaaggcgu

SEQ ID NO: 1660667 - RNA, 18 nt, Salmonella enterica enterica serovar Typhi
uuguagcggcaacagcac

SEQ ID NO: 1660668 - RNA, 13 nt, Salmonella enterica enterica serovar Typhi
uuguccugguaca

SEQ ID NO: 1660669 - RNA, 18 nt, Salmonella enterica enterica serovar Typhi
uuggcgauuuucagcacc

SEQ ID NO: 1660670 - RNA, 13 nt, Salmonella enterica enterica serovar Typhi
uuggcgcugccgg

SEQ ID NO: 1660671 - RNA, 15 nt, Salmonella enterica enterica serovar Typhi
uucuuuucaggucug

SEQ ID NO: 1660672 - RNA, 14 nt, Salmonella enterica enterica serovar Typhi
uucuuuaugcgccu

SEQ ID NO: 1660673 - RNA, 15 nt, Salmonella enterica enterica serovar Typhi
uucuuuccugcaaau

SEQ ID NO: 1660674 - RNA, 22 nt, Salmonella enterica enterica serovar Typhi
uggcuaaagcgcugguggccgg

SEQ ID NO: 1660675 - RNA, 22 nt, Salmonella enterica enterica serovar Typhi
uggcuguccuugcgccaucggc

SEQ ID NO: 1660676 - RNA, 21 nt, Salmonella enterica enterica serovar Typhi
ugggaugaccugaaaucgcgc

SEQ ID NO: 1660677 - RNA, 13 nt, Salmonella enterica enterica serovar Typhi
uggcugucuuccg

SEQ ID NO: 1660678 - RNA, 16 nt, Salmonella enterica enterica serovar Typhi
uggcuuaccugcucug

SEQ ID NO: 1660679 - RNA, 14 nt, Salmonella enterica enterica serovar Typhi
ugggcuuaaugcgc

SEQ ID NO: 1660680 - RNA, 21 nt, Salmonella enterica enterica serovar Typhi
ugggcuuuuaaccaugcaauc

SEQ ID NO: 1660681 - RNA, 18 nt, Salmonella enterica enterica serovar Typhi
uggggaaaauaccgguaa

SEQ ID NO: 1660682 - RNA, 19 nt, Salmonella enterica enterica serovar Typhi
ugguaggccugauaagcga

SEQ ID NO: 1660683 - RNA, 23 nt, Salmonella enterica enterica serovar Typhi
ugguagagguugcggauaugcgu

SEQ ID NO: 1660684 - RNA, 15 nt, Salmonella enterica enterica serovar Typhi
uggguaaauccgcga

SEQ ID NO: 1660685 - RNA, 20 nt, Salmonella enterica enterica serovar Typhi
uggggccuaaugagccagau

SEQ ID NO: 1660686 - RNA, 17 nt, Salmonella enterica enterica serovar Typhi
uggcgacuaaccagcgc

SEQ ID NO: 1660687 - RNA, 17 nt, Salmonella enterica enterica serovar Typhi
uggccguuuucccggca

SEQ ID NO: 1660688 - RNA, 20 nt, Salmonella enterica enterica serovar Typhi
uggccucugccaguugcuca

SEQ ID NO: 1660689 - RNA, 14 nt, Salmonella enterica enterica serovar Typhi
uggccucugccagu

SEQ ID NO: 1660690 - RNA, 18 nt, Salmonella enterica enterica serovar Typhi
uggaaaggaugcagcauc

SEQ ID NO: 1660691 - RNA, 19 nt, Salmonella enterica enterica serovar Typhi
uggaaaccgcagaagguca

SEQ ID NO: 1660692 - RNA, 18 nt, Salmonella enterica enterica serovar Typhi
uggaaaauaauaaucguu

SEQ ID NO: 1660693 - RNA, 24 nt, Salmonella enterica enterica serovar Typhi
uggaaacugugcgacaaccugcgc

SEQ ID NO: 1660694 - RNA, 15 nt, Salmonella enterica enterica serovar Typhi
uggaaaacuccagca

SEQ ID NO: 1660695 - RNA, 22 nt, Salmonella enterica enterica serovar Typhi
ugcuuuuaguuguacaaacugu

SEQ ID NO: 1660696 - RNA, 18 nt, Salmonella enterica enterica serovar Typhi
uggccgcgugcucgcggc

SEQ ID NO: 1660697 - RNA, 16 nt, Salmonella enterica enterica serovar Typhi
uggccggucuuaugcu

SEQ ID NO: 1660698 - RNA, 17 nt, Salmonella enterica enterica serovar Typhi
uggcgcucggaugugca

SEQ ID NO: 1660699 - RNA, 21 nt, Salmonella enterica enterica serovar Typhi
uggcggcggacaugguaauaa

SEQ ID NO: 1660700 - RNA, 14 nt, Salmonella enterica enterica serovar Typhi
uggcggcggucgua

SEQ ID NO: 1660701 - RNA, 22 nt, Salmonella enterica enterica serovar Typhi
uggcgauaauagaaccgaauaa

SEQ ID NO: 1660702 - RNA, 20 nt, Salmonella enterica enterica serovar Typhi
uggcgauuuccagcgaauaa

SEQ ID NO: 1660703 - RNA, 16 nt, Salmonella enterica enterica serovar Typhi
uggcgauuuccagcga

SEQ ID NO: 1660704 - RNA, 17 nt, Salmonella enterica enterica serovar Typhi
uguaaaaaauccagcgu

SEQ ID NO: 1660705 - RNA, 16 nt, Salmonella enterica enterica serovar Typhi
uguaaaaaauccagcg

SEQ ID NO: 1660706 - RNA, 21 nt, Salmonella enterica enterica serovar Typhi
uguaaacccgauucugccagu

SEQ ID NO: 1660707 - RNA, 19 nt, Salmonella enterica enterica serovar Typhi
ugguuaucaauaaugcgcu

SEQ ID NO: 1660708 - RNA, 16 nt, Salmonella enterica enterica serovar Typhi
ugguuaacucaagcga

SEQ ID NO: 1660709 - RNA, 15 nt, Salmonella enterica enterica serovar Typhi
ugguuaauuccgcau

SEQ ID NO: 1660710 - RNA, 16 nt, Salmonella enterica enterica serovar Typhi
uggugccaaucuccag

SEQ ID NO: 1660711 - RNA, 16 nt, Salmonella enterica enterica serovar Typhi
uggucugacccgcgaa

SEQ ID NO: 1660712 - RNA, 15 nt, Salmonella enterica enterica serovar Typhi
uggucgguguucaua

SEQ ID NO: 1660713 - RNA, 20 nt, Salmonella enterica enterica serovar Typhi
uggugauagcgcgccagcac

SEQ ID NO: 1660714 - RNA, 16 nt, Salmonella enterica enterica serovar Typhi
uggugauauaaacggg

SEQ ID NO: 1660715 - RNA, 22 nt, Salmonella enterica enterica serovar Typhi
uggucgcgguuuacuucuucag

SEQ ID NO: 1660716 - RNA, 21 nt, Salmonella enterica enterica serovar Typhi
uggucggcaaucaccugcauc

SEQ ID NO: 1660717 - RNA, 13 nt, Salmonella enterica enterica serovar Typhi
uggucggcgacca

SEQ ID NO: 1660718 - RNA, 11 nt, Salmonella enterica enterica serovar Typhi
uggucgcgcca

SEQ ID NO: 1660719 - RNA, 14 nt, Salmonella enterica enterica serovar Typhi
uggucaggcgacca

SEQ ID NO: 1660720 - RNA, 22 nt, Salmonella enterica enterica serovar Typhi
uggucagcucacgcgccagcac

SEQ ID NO: 1660721 - RNA, 20 nt, Salmonella enterica enterica serovar Typhi
uggucaucgcggccagcaug

SEQ ID NO: 1660722 - RNA, 18 nt, Salmonella enterica enterica serovar Typhi
ugguauuucagaccgugc

SEQ ID NO: 1660723 - RNA, 20 nt, Salmonella enterica enterica serovar Typhi
uggucaaggcacaagcgccu

SEQ ID NO: 1660724 - RNA, 20 nt, Salmonella enterica enterica serovar Typhi
uggucacaaaggccagcagc

SEQ ID NO: 1660725 - RNA, 20 nt, Salmonella enterica enterica serovar Typhi
uggucaaaaucgacagcgac

SEQ ID NO: 1660726 - RNA, 18 nt, Salmonella enterica enterica serovar Typhi
uggucagcgaugacgccu

SEQ ID NO: 1660727 - RNA, 14 nt, Salmonella enterica enterica serovar Typhi
uggucagcauaaua

SEQ ID NO: 1660728 - RNA, 22 nt, Salmonella enterica enterica serovar Typhi
uggucagacgcucagccuuaua

SEQ ID NO: 1660729 - RNA, 22 nt, Salmonella enterica enterica serovar Typhi
ugucaaaaaaaggccagucgac

SEQ ID NO: 1660730 - RNA, 17 nt, Salmonella enterica enterica serovar Typhi
uguaugaacugcaucag

SEQ ID NO: 1660731 - RNA, 19 nt, Salmonella enterica enterica serovar Typhi
uguaucgcccugccagcuc

SEQ ID NO: 1660732 - RNA, 20 nt, Salmonella enterica enterica serovar Typhi
uguaggcuuccagaagguag

SEQ ID NO: 1660733 - RNA, 20 nt, Salmonella enterica enterica serovar Typhi
uguaggccugauaagcguag

SEQ ID NO: 1660734 - RNA, 20 nt, Salmonella enterica enterica serovar Typhi
uguaacuucggccagcgagu

SEQ ID NO: 1660735 - RNA, 19 nt, Salmonella enterica enterica serovar Typhi
uguaacuucggccagcgag

SEQ ID NO: 1660736 - RNA, 15 nt, Salmonella enterica enterica serovar Typhi
uguaacucauagacg

SEQ ID NO: 1660737 - RNA, 12 nt, Salmonella enterica enterica serovar Typhi
uguaaaccggcc

SEQ ID NO: 1660738 - RNA, 18 nt, Salmonella enterica enterica serovar Typhi
uguccgucauuuacugcg

SEQ ID NO: 1660739 - RNA, 19 nt, Salmonella enterica enterica serovar Typhi
uguccagucaaaaugucag

SEQ ID NO: 1660740 - RNA, 13 nt, Salmonella enterica enterica serovar Typhi
ugucgaauuccgc

SEQ ID NO: 1660741 - RNA, 21 nt, Salmonella enterica enterica serovar Typhi
ugucggauacggcugucagga

SEQ ID NO: 1660742 - RNA, 17 nt, Salmonella enterica enterica serovar Typhi
ugucgccggggcgcugg

SEQ ID NO: 1660743 - RNA, 18 nt, Salmonella enterica enterica serovar Typhi
ugucuuugcugccgguug

SEQ ID NO: 1660744 - RNA, 22 nt, Salmonella enterica enterica serovar Typhi
ugucguuccacacguccauccg

SEQ ID NO: 1660745 - RNA, 22 nt, Salmonella enterica enterica serovar Typhi
ugucugccucggguggcaucug

SEQ ID NO: 1660746 - RNA, 18 nt, Salmonella enterica enterica serovar Typhi
ugucugcuuugguauccu

SEQ ID NO: 1660747 - RNA, 19 nt, Salmonella enterica enterica serovar Typhi
uucagcgccagauagucac

SEQ ID NO: 1660748 - RNA, 18 nt, Salmonella enterica enterica serovar Typhi
uucagcccguucucgccg

SEQ ID NO: 1660749 - RNA, 22 nt, Salmonella enterica enterica serovar Typhi
uucagcggcuugucauccugcu

SEQ ID NO: 1660750 - RNA, 13 nt, Salmonella enterica enterica serovar Typhi
uucauggucaucg

SEQ ID NO: 1660751 - RNA, 17 nt, Salmonella enterica enterica serovar Typhi
uucaucguucauugcuu

SEQ ID NO: 1660752 - RNA, 13 nt, Salmonella enterica enterica serovar Typhi
uucauccggauaa

SEQ ID NO: 1660753 - RNA, 20 nt, Salmonella enterica enterica serovar Typhi
uuccaggguggcgcuaagac

SEQ ID NO: 1660754 - RNA, 12 nt, Salmonella enterica enterica serovar Typhi
uuccaucggcau

SEQ ID NO: 1660755 - RNA, 13 nt, Salmonella enterica enterica serovar Typhi
uucccacaucgcg

SEQ ID NO: 1660756 - RNA, 19 nt, Salmonella enterica enterica serovar Typhi
uuccccaaugaucaauggc

SEQ ID NO: 1660757 - RNA, 22 nt, Salmonella enterica enterica serovar Typhi
uucccauauuuuuucugccagu

SEQ ID NO: 1660758 - RNA, 23 nt, Salmonella enterica enterica serovar Typhi
uucccauugggccagcagcgcau

SEQ ID NO: 1660759 - RNA, 15 nt, Salmonella enterica enterica serovar Typhi
uucccagucauccgg

SEQ ID NO: 1660760 - RNA, 20 nt, Salmonella enterica enterica serovar Typhi
uuaucgccgaaagcgaucac

SEQ ID NO: 1660761 - RNA, 11 nt, Salmonella enterica enterica serovar Typhi
uuaucgccgau

SEQ ID NO: 1660762 - RNA, 21 nt, Salmonella enterica enterica serovar Typhi
uuaucgguaaugauaucgccc

SEQ ID NO: 1660763 - RNA, 21 nt, Salmonella enterica enterica serovar Typhi
uuauccggccugcgaucugug

SEQ ID NO: 1660764 - RNA, 18 nt, Salmonella enterica enterica serovar Typhi
uuauccucacuugccgag

SEQ ID NO: 1660765 - RNA, 21 nt, Salmonella enterica enterica serovar Typhi
uuauugaccaucgccagccau

SEQ ID NO: 1660766 - RNA, 19 nt, Salmonella enterica enterica serovar Typhi
uuauugaaaagcagccaga

SEQ ID NO: 1660767 - RNA, 13 nt, Salmonella enterica enterica serovar Typhi
uucaaagacgguu

SEQ ID NO: 1660768 - RNA, 16 nt, Salmonella enterica enterica serovar Typhi
uucaaacaucagcgca

SEQ ID NO: 1660769 - RNA, 20 nt, Salmonella enterica enterica serovar Typhi
uucaccgguaucgaucacgc

SEQ ID NO: 1660770 - RNA, 21 nt, Salmonella enterica enterica serovar Typhi
uucacgcagucguuccagacg

SEQ ID NO: 1660771 - RNA, 18 nt, Salmonella enterica enterica serovar Typhi
uucacgcacagaucgucg

SEQ ID NO: 1660772 - RNA, 11 nt, Salmonella enterica enterica serovar Typhi
uucacgccacc

SEQ ID NO: 1660773 - RNA, 15 nt, Salmonella enterica enterica serovar Typhi
uucacgcucacgcag

SEQ ID NO: 1660774 - RNA, 18 nt, Salmonella enterica enterica serovar Typhi
ugugcuuccagcuccauc

SEQ ID NO: 1660775 - RNA, 14 nt, Salmonella enterica enterica serovar Typhi
uguuuaccaucgcg

SEQ ID NO: 1660776 - RNA, 23 nt, Salmonella enterica enterica serovar Typhi
uguuguguuuagcccucuggcaa

SEQ ID NO: 1660777 - RNA, 13 nt, Salmonella enterica enterica serovar Typhi
uguuuaucgggcu

SEQ ID NO: 1660778 - RNA, 23 nt, Salmonella enterica enterica serovar Typhi
uuaaaaaaggcagaagaaucugc

SEQ ID NO: 1660779 - RNA, 13 nt, Salmonella enterica enterica serovar Typhi
uuaaaaaauccug

SEQ ID NO: 1660780 - RNA, 16 nt, Salmonella enterica enterica serovar Typhi
uuaaaauugaacggac

SEQ ID NO: 1660781 - RNA, 16 nt, Salmonella enterica enterica serovar Typhi
uuaaaauccggcugcc

SEQ ID NO: 1660782 - RNA, 22 nt, Salmonella enterica enterica serovar Typhi
uuaaacgauccugacgcaaugg

SEQ ID NO: 1660783 - RNA, 22 nt, Salmonella enterica enterica serovar Typhi
uuaauaccaucuccaucgggcu

SEQ ID NO: 1660784 - RNA, 16 nt, Salmonella enterica enterica serovar Typhi
uuagcguuucaaccgc

SEQ ID NO: 1660785 - RNA, 16 nt, Salmonella enterica enterica serovar Typhi
uuagugacguuaucug

SEQ ID NO: 1660786 - RNA, 12 nt, Salmonella enterica enterica serovar Typhi
uuagugccgcca

SEQ ID NO: 1660787 - RNA, 14 nt, Salmonella enterica enterica serovar Typhi
uuagccaucccggc

SEQ ID NO: 1660788 - RNA, 21 nt, Salmonella enterica enterica serovar Typhi
uuacucccuggugacgcgcau

SEQ ID NO: 1660789 - RNA, 13 nt, Salmonella enterica enterica serovar Typhi
uuauccaacagcg

SEQ ID NO: 1660790 - RNA, 21 nt, Salmonella enterica enterica serovar Typhi
uuacgccgcaaucacuucaua

SEQ ID NO: 1660791 - RNA, 18 nt, Salmonella enterica enterica serovar Typhi
uuacgcucgcugauggcg

SEQ ID NO: 1660792 - RNA, 18 nt, Salmonella enterica enterica serovar Typhi
uuacgcuuccugccguga

SEQ ID NO: 1660793 - RNA, 23 nt, Salmonella enterica enterica serovar Typhi
uuaccuucauuguccucggcaac

SEQ ID NO: 1660794 - RNA, 16 nt, Salmonella enterica enterica serovar Typhi
uuaccggcugccgaua

SEQ ID NO: 1660795 - RNA, 21 nt, Salmonella enterica enterica serovar Typhi
uuaccggacggucggcguaau

SEQ ID NO: 1660796 - RNA, 17 nt, Salmonella enterica enterica serovar Typhi
uuaauucuggcaauaag

SEQ ID NO: 1660797 - RNA, 19 nt, Salmonella enterica enterica serovar Typhi
uucugaagcuaaccgcgca

SEQ ID NO: 1660798 - RNA, 12 nt, Salmonella enterica enterica serovar Typhi
uucucgugcgca

SEQ ID NO: 1660799 - RNA, 16 nt, Salmonella enterica enterica serovar Typhi
uucucguucaacggca

SEQ ID NO: 1660800 - RNA, 16 nt, Salmonella enterica enterica serovar Typhi
uucucuugccugcgca

SEQ ID NO: 1660801 - RNA, 19 nt, Salmonella enterica enterica serovar Typhi
uucuccacgcgaugagcug

SEQ ID NO: 1660802 - RNA, 16 nt, Salmonella enterica enterica serovar Typhi
uucuccugcauuugcg

SEQ ID NO: 1660803 - RNA, 19 nt, Salmonella enterica enterica serovar Typhi
uucucaauacgauauucug

SEQ ID NO: 1660804 - RNA, 15 nt, Salmonella enterica enterica serovar Typhi
uucucaauacgauau

SEQ ID NO: 1660805 - RNA, 20 nt, Salmonella enterica enterica serovar Typhi
uucuucaguuccgccagacu

SEQ ID NO: 1660806 - RNA, 18 nt, Salmonella enterica enterica serovar Typhi
uucuuccagguuaaccca

SEQ ID NO: 1660807 - RNA, 13 nt, Salmonella enterica enterica serovar Typhi
uucuugcccggug

SEQ ID NO: 1660808 - RNA, 16 nt, Salmonella enterica enterica serovar Typhi
uucuggcaacagccau

SEQ ID NO: 1660809 - RNA, 21 nt, Salmonella enterica enterica serovar Typhi
uucuggcgaguuucaccggua

SEQ ID NO: 1660810 - RNA, 15 nt, Salmonella enterica enterica serovar Typhi
uucugcugaugcugg

SEQ ID NO: 1660811 - RNA, 16 nt, Salmonella enterica enterica serovar Typhi
uucugcgucgcgcaug

SEQ ID NO: 1660812 - RNA, 13 nt, Salmonella enterica enterica serovar Typhi
uucuuaaccccuu

SEQ ID NO: 1660813 - RNA, 13 nt, Salmonella enterica enterica serovar Typhi
uucuguaucgcuu

SEQ ID NO: 1660814 - RNA, 12 nt, Salmonella enterica enterica serovar Typhi
uucgucggcaaa

SEQ ID NO: 1660815 - RNA, 15 nt, Salmonella enterica enterica serovar Typhi
uucgugaauaugacg

SEQ ID NO: 1660816 - RNA, 16 nt, Salmonella enterica enterica serovar Typhi
uucguacguuuuucca

SEQ ID NO: 1660817 - RNA, 15 nt, Salmonella enterica enterica serovar Typhi
uucguuaacccggca

SEQ ID NO: 1660818 - RNA, 15 nt, Salmonella enterica enterica serovar Typhi
uucguuaugaauggc

SEQ ID NO: 1660819 - RNA, 13 nt, Salmonella enterica enterica serovar Typhi
uucggcucgacag

SEQ ID NO: 1660820 - RNA, 10 nt, Salmonella enterica enterica serovar Typhi
uucggcgauc

SEQ ID NO: 1660821 - RNA, 20 nt, Salmonella enterica enterica serovar Typhi
uucgccggauggcggcgaug

SEQ ID NO: 1660822 - RNA, 23 nt, Salmonella enterica enterica serovar Typhi
uucgccgccggcgaggauaauac

SEQ ID NO: 1660823 - RNA, 20 nt, Salmonella enterica enterica serovar Typhi
uucgcgcaguucauccacgc

SEQ ID NO: 1660824 - RNA, 19 nt, Salmonella enterica enterica serovar Typhi
uucgccagcgcaucgauau

SEQ ID NO: 1660825 - RNA, 15 nt, Salmonella enterica enterica serovar Typhi
uucgccacgcucacu

SEQ ID NO: 1660826 - RNA, 18 nt, Salmonella enterica enterica serovar Typhi
uucgcccguucugaccag

SEQ ID NO: 1660827 - RNA, 18 nt, Salmonella enterica enterica serovar Typhi
uucgccgagaauccacuc

SEQ ID NO: 1660828 - RNA, 22 nt, Salmonella enterica enterica serovar Typhi
uucgccccacacggccaccaua

SEQ ID NO: 1660829 - RNA, 23 nt, Salmonella enterica enterica serovar Typhi
uucgcccaggcggggagggucag

SEQ ID NO: 1660830 - RNA, 14 nt, Salmonella enterica enterica serovar Typhi
uucgcccggcagga

SEQ ID NO: 1660831 - RNA, 13 nt, Salmonella enterica enterica serovar Typhi
uucgcugauaccg

SEQ ID NO: 1660832 - RNA, 19 nt, Salmonella enterica enterica serovar Typhi
uucgcgucacaaucgcgcc

SEQ ID NO: 1660833 - RNA, 19 nt, Salmonella enterica enterica serovar Typhi
uucggauuauuggucagua

SEQ ID NO: 1660834 - RNA, 19 nt, Salmonella enterica enterica serovar Typhi
uucggauaaacgcugcgca

SEQ ID NO: 1660835 - RNA, 13 nt, Salmonella enterica enterica serovar Typhi
uuccccacgccau

SEQ ID NO: 1660836 - RNA, 18 nt, Salmonella enterica enterica serovar Typhi
uuccgcagccaacaacag

SEQ ID NO: 1660837 - RNA, 18 nt, Salmonella enterica enterica serovar Typhi
uuccgcacgcgcgcccau

SEQ ID NO: 1660838 - RNA, 15 nt, Salmonella enterica enterica serovar Typhi
uuccucgucggcaag

SEQ ID NO: 1660839 - RNA, 19 nt, Salmonella enterica enterica serovar Typhi
uuccugcgccaguugcugg

SEQ ID NO: 1660840 - RNA, 21 nt, Salmonella enterica enterica serovar Typhi
uuccugcggcgguaacgccuu

SEQ ID NO: 1660841 - RNA, 12 nt, Salmonella enterica enterica serovar Typhi
uuccugcugcca

SEQ ID NO: 1660842 - RNA, 13 nt, Salmonella enterica enterica serovar Typhi
uuccugcugcgcc

SEQ ID NO: 1660843 - RNA, 17 nt, Salmonella enterica enterica serovar Typhi
uuccugcugcgccagcg

SEQ ID NO: 1660844 - RNA, 13 nt, Salmonella enterica enterica serovar Typhi
uucgacgcgcgca

SEQ ID NO: 1660845 - RNA, 18 nt, Salmonella enterica enterica serovar Typhi
uucgacgagguuuccggc

SEQ ID NO: 1660846 - RNA, 12 nt, Salmonella enterica enterica serovar Typhi
uucgaaccugcg

SEQ ID NO: 1660847 - RNA, 16 nt, Salmonella enterica enterica serovar Typhi
uuccuucgcuuccugg

SEQ ID NO: 1660848 - RNA, 11 nt, Salmonella enterica enterica serovar Typhi
uucgaauccuc

SEQ ID NO: 1660849 - RNA, 16 nt, Salmonella enterica enterica serovar Typhi
uucgaaccugcgacca

SEQ ID NO: 1660850 - RNA, 20 nt, Salmonella enterica enterica serovar Typhi
uucgaacgacagaauaugca

SEQ ID NO: 1660851 - RNA, 22 nt, Salmonella enterica enterica serovar Typhi
uucgaacgcuagcucaacgccc

SEQ ID NO: 1660852 - RNA, 21 nt, Salmonella enterica enterica serovar Typhi
ucgccgggaugcuuuccgguu

SEQ ID NO: 1660853 - RNA, 17 nt, Salmonella enterica enterica serovar Typhi
ucgcgacguccgccaac

SEQ ID NO: 1660854 - RNA, 14 nt, Salmonella enterica enterica serovar Typhi
ucgcgauccgccag

SEQ ID NO: 1660855 - RNA, 20 nt, Salmonella enterica enterica serovar Typhi
ucgcgauccucauacagccc

SEQ ID NO: 1660856 - RNA, 13 nt, Salmonella enterica enterica serovar Typhi
ucgcgauaacguu

SEQ ID NO: 1660857 - RNA, 12 nt, Salmonella enterica enterica serovar Typhi
ucgcgcagcagg

SEQ ID NO: 1660858 - RNA, 17 nt, Salmonella enterica enterica serovar Typhi
ucgcgcgggaaaucguc

SEQ ID NO: 1660859 - RNA, 18 nt, Salmonella enterica enterica serovar Typhi
ucgcggcauuaaaugcgc

SEQ ID NO: 1660860 - RNA, 14 nt, Salmonella enterica enterica serovar Typhi
ucgcccugcgucgc

SEQ ID NO: 1660861 - RNA, 15 nt, Salmonella enterica enterica serovar Typhi
ucgcccugcgguagc

SEQ ID NO: 1660862 - RNA, 16 nt, Salmonella enterica enterica serovar Typhi
ucgcccggcaugacau

SEQ ID NO: 1660863 - RNA, 16 nt, Salmonella enterica enterica serovar Typhi
ucgcccgcaccgccga

SEQ ID NO: 1660864 - RNA, 21 nt, Salmonella enterica enterica serovar Typhi
ucgacgcgcaucacaaugacc

SEQ ID NO: 1660865 - RNA, 13 nt, Salmonella enterica enterica serovar Typhi
ucgccauccagau

SEQ ID NO: 1660866 - RNA, 17 nt, Salmonella enterica enterica serovar Typhi
ucgccaugcaccacgac

SEQ ID NO: 1660867 - RNA, 15 nt, Salmonella enterica enterica serovar Typhi
ucgccauucccgcga

SEQ ID NO: 1660868 - RNA, 20 nt, Salmonella enterica enterica serovar Typhi
ucgccauucccgcgacguca

SEQ ID NO: 1660869 - RNA, 13 nt, Salmonella enterica enterica serovar Typhi
ucgccgcgccgga

SEQ ID NO: 1660870 - RNA, 23 nt, Salmonella enterica enterica serovar Typhi
ucgccgaucacaaagucagcgcg

SEQ ID NO: 1660871 - RNA, 12 nt, Salmonella enterica enterica serovar Typhi
ucgccgcuaucg

SEQ ID NO: 1660872 - RNA, 23 nt, Salmonella enterica enterica serovar Typhi
ucgccgcgccggacuccagcaac

SEQ ID NO: 1660873 - RNA, 16 nt, Salmonella enterica enterica serovar Typhi
ucgccgcgcggaucgc

SEQ ID NO: 1660874 - RNA, 18 nt, Salmonella enterica enterica serovar Typhi
ucgccggaaagaaacgcc

SEQ ID NO: 1660875 - RNA, 15 nt, Salmonella enterica enterica serovar Typhi
ucgccggaaugcgaa

SEQ ID NO: 1660876 - RNA, 13 nt, Salmonella enterica enterica serovar Typhi
ucgccggauggcg

SEQ ID NO: 1660877 - RNA, 15 nt, Salmonella enterica enterica serovar Typhi
ucgccggauggcggc

SEQ ID NO: 1660878 - RNA, 17 nt, Salmonella enterica enterica serovar Typhi
ucgccggauggcggcga

SEQ ID NO: 1660879 - RNA, 21 nt, Salmonella enterica enterica serovar Typhi
ucggcaaagaccaauaaaacg

SEQ ID NO: 1660880 - RNA, 17 nt, Salmonella enterica enterica serovar Typhi
ucggcaauaaacucccg

SEQ ID NO: 1660881 - RNA, 21 nt, Salmonella enterica enterica serovar Typhi
ucggcaauuuccggcgacgua

SEQ ID NO: 1660882 - RNA, 19 nt, Salmonella enterica enterica serovar Typhi
ucggcagcgccagugacgc

SEQ ID NO: 1660883 - RNA, 15 nt, Salmonella enterica enterica serovar Typhi
ucggaacgcuguaug

SEQ ID NO: 1660884 - RNA, 23 nt, Salmonella enterica enterica serovar Typhi
ucgcuucugccgccaguugcuca

SEQ ID NO: 1660885 - RNA, 21 nt, Salmonella enterica enterica serovar Typhi
ucgcuucggcaauggccagau

SEQ ID NO: 1660886 - RNA, 18 nt, Salmonella enterica enterica serovar Typhi
ucgcuuauuccuccgccg

SEQ ID NO: 1660887 - RNA, 14 nt, Salmonella enterica enterica serovar Typhi
ucgcuugauacgcc

SEQ ID NO: 1660888 - RNA, 18 nt, Salmonella enterica enterica serovar Typhi
ucggaacaguaaagcgca

SEQ ID NO: 1660889 - RNA, 20 nt, Salmonella enterica enterica serovar Typhi
ucggaaaucuguuccagcga

SEQ ID NO: 1660890 - RNA, 13 nt, Salmonella enterica enterica serovar Typhi
ucgcguuguaauc

SEQ ID NO: 1660891 - RNA, 15 nt, Salmonella enterica enterica serovar Typhi
ucgcguuguaaucgc

SEQ ID NO: 1660892 - RNA, 21 nt, Salmonella enterica enterica serovar Typhi
ucgcuacacgcguaaacuucc

SEQ ID NO: 1660893 - RNA, 20 nt, Salmonella enterica enterica serovar Typhi
ucgcuaccacagaaaucgcc

SEQ ID NO: 1660894 - RNA, 18 nt, Salmonella enterica enterica serovar Typhi
ucgcuaauuggcuuaccu

SEQ ID NO: 1660895 - RNA, 12 nt, Salmonella enterica enterica serovar Typhi
ucgcguuacggc

SEQ ID NO: 1660896 - RNA, 20 nt, Salmonella enterica enterica serovar Typhi
ucgcuccucagcgcuuacca

SEQ ID NO: 1660897 - RNA, 16 nt, Salmonella enterica enterica serovar Typhi
ucgcuccggaacgcga

SEQ ID NO: 1660898 - RNA, 21 nt, Salmonella enterica enterica serovar Typhi
ucgcuccucagcgcuuaccac

SEQ ID NO: 1660899 - RNA, 18 nt, Salmonella enterica enterica serovar Typhi
ucgcgguugccgucaaac

SEQ ID NO: 1660900 - RNA, 19 nt, Salmonella enterica enterica serovar Typhi
ucgcgguuuuccgggucca

SEQ ID NO: 1660901 - RNA, 21 nt, Salmonella enterica enterica serovar Typhi
ucgcgugacgcaguaauacgc

SEQ ID NO: 1660902 - RNA, 16 nt, Salmonella enterica enterica serovar Typhi
ucgcgucgccaucagg

SEQ ID NO: 1660903 - RNA, 17 nt, Salmonella enterica enterica serovar Typhi
ucggcggucgcggcaau

SEQ ID NO: 1660904 - RNA, 13 nt, Salmonella enterica enterica serovar Typhi
ucggcgucauccc

SEQ ID NO: 1660905 - RNA, 23 nt, Salmonella enterica enterica serovar Typhi
ucggcgcccggacgaaccuggcg

SEQ ID NO: 1660906 - RNA, 18 nt, Salmonella enterica enterica serovar Typhi
ucggccggauagggcgua

SEQ ID NO: 1660907 - RNA, 20 nt, Salmonella enterica enterica serovar Typhi
ucggccacguccguuacccc

SEQ ID NO: 1660908 - RNA, 17 nt, Salmonella enterica enterica serovar Typhi
ucggccacgggcgcguu

SEQ ID NO: 1660909 - RNA, 17 nt, Salmonella enterica enterica serovar Typhi
ucgucgccuuccagcga

SEQ ID NO: 1660910 - RNA, 11 nt, Salmonella enterica enterica serovar Typhi
ucguccggcug

SEQ ID NO: 1660911 - RNA, 23 nt, Salmonella enterica enterica serovar Typhi
ucgucccgcgaguacgcacaaca

SEQ ID NO: 1660912 - RNA, 13 nt, Salmonella enterica enterica serovar Typhi
ucguccguugcca

SEQ ID NO: 1660913 - RNA, 20 nt, Salmonella enterica enterica serovar Typhi
ucguaccgcguuuaacgcag

SEQ ID NO: 1660914 - RNA, 12 nt, Salmonella enterica enterica serovar Typhi
ucguaauucagc

SEQ ID NO: 1660915 - RNA, 18 nt, Salmonella enterica enterica serovar Typhi
ucguacuaaagagcgccu

SEQ ID NO: 1660916 - RNA, 14 nt, Salmonella enterica enterica serovar Typhi
ucggugcccggcug

SEQ ID NO: 1660917 - RNA, 15 nt, Salmonella enterica enterica serovar Typhi
ucggucagauucaga

SEQ ID NO: 1660918 - RNA, 16 nt, Salmonella enterica enterica serovar Typhi
ucggcgucgcggcaau

SEQ ID NO: 1660919 - RNA, 22 nt, Salmonella enterica enterica serovar Typhi
ucguucgcccuucaucuuccag

SEQ ID NO: 1660920 - RNA, 17 nt, Salmonella enterica enterica serovar Typhi
ucguucugcgucgcgca

SEQ ID NO: 1660921 - RNA, 14 nt, Salmonella enterica enterica serovar Typhi
ucguuaccagcauc

SEQ ID NO: 1660922 - RNA, 23 nt, Salmonella enterica enterica serovar Typhi
ucguuaaaaucggggucuuccag

SEQ ID NO: 1660923 - RNA, 21 nt, Salmonella enterica enterica serovar Typhi
ucguucaacggcaaaucgcgg

SEQ ID NO: 1660924 - RNA, 13 nt, Salmonella enterica enterica serovar Typhi
ucguuagccagau

SEQ ID NO: 1660925 - RNA, 16 nt, Salmonella enterica enterica serovar Typhi
ucguuagccagauggc

SEQ ID NO: 1660926 - RNA, 14 nt, Salmonella enterica enterica serovar Typhi
ucguugccagcggc

SEQ ID NO: 1660927 - RNA, 23 nt, Salmonella enterica enterica serovar Typhi
ucuaucgccagcgcguuuuccau

SEQ ID NO: 1660928 - RNA, 14 nt, Salmonella enterica enterica serovar Typhi
ucuaucgccagcgc

SEQ ID NO: 1660929 - RNA, 14 nt, Salmonella enterica enterica serovar Typhi
ucuaccauaucgcc

SEQ ID NO: 1660930 - RNA, 16 nt, Salmonella enterica enterica serovar Typhi
ucuccuguaaugaggc

SEQ ID NO: 1660931 - RNA, 21 nt, Salmonella enterica enterica serovar Typhi
ucucgugccaguaacguucuu

SEQ ID NO: 1660932 - RNA, 16 nt, Salmonella enterica enterica serovar Typhi
ucucuacacaacgcga

SEQ ID NO: 1660933 - RNA, 12 nt, Salmonella enterica enterica serovar Typhi
ucugauccagcg

SEQ ID NO: 1660934 - RNA, 14 nt, Salmonella enterica enterica serovar Typhi
ucucuucccagcgc

SEQ ID NO: 1660935 - RNA, 13 nt, Salmonella enterica enterica serovar Typhi
ucucuuccgccag

SEQ ID NO: 1660936 - RNA, 16 nt, Salmonella enterica enterica serovar Typhi
ucucuuccgccagcgc

SEQ ID NO: 1660937 - RNA, 16 nt, Salmonella enterica enterica serovar Typhi
ucucuuccgcccagau

SEQ ID NO: 1660938 - RNA, 18 nt, Salmonella enterica enterica serovar Typhi
ucugccagcuuaaaucgc

SEQ ID NO: 1660939 - RNA, 22 nt, Salmonella enterica enterica serovar Typhi
ucugccagcgcccuauccagcg

SEQ ID NO: 1660940 - RNA, 23 nt, Salmonella enterica enterica serovar Typhi
ucugccgacaagguugaucagga

SEQ ID NO: 1660941 - RNA, 22 nt, Salmonella enterica enterica serovar Typhi
ucugcgcuggguuuuuccgcuu

SEQ ID NO: 1660942 - RNA, 19 nt, Salmonella enterica enterica serovar Typhi
ucugcgcaacgcuuccacc

SEQ ID NO: 1660943 - RNA, 19 nt, Salmonella enterica enterica serovar Typhi
ucugcgccaccagcgcagu

SEQ ID NO: 1660944 - RNA, 17 nt, Salmonella enterica enterica serovar Typhi
ucugugccagcccaaua

SEQ ID NO: 1660945 - RNA, 17 nt, Salmonella enterica enterica serovar Typhi
ucuguuuuagcaugaca

SEQ ID NO: 1660946 - RNA, 16 nt, Salmonella enterica enterica serovar Typhi
ucuuaaugccagcggc

SEQ ID NO: 1660947 - RNA, 21 nt, Salmonella enterica enterica serovar Typhi
ucuguaggucggauaaggcgu

SEQ ID NO: 1660948 - RNA, 20 nt, Salmonella enterica enterica serovar Typhi
ucuguaggccugauaagcgc

SEQ ID NO: 1660949 - RNA, 17 nt, Salmonella enterica enterica serovar Typhi
ucuggguuugcagcaga

SEQ ID NO: 1660950 - RNA, 13 nt, Salmonella enterica enterica serovar Typhi
ucugcguugcgcg

SEQ ID NO: 1660951 - RNA, 23 nt, Salmonella enterica enterica serovar Typhi
ucuggcgcagauacgcgucaaag

SEQ ID NO: 1660952 - RNA, 20 nt, Salmonella enterica enterica serovar Typhi
ucuggcgugccgggcuggcg

SEQ ID NO: 1660953 - RNA, 22 nt, Salmonella enterica enterica serovar Typhi
ucuggcccugacgaaauucgcc

SEQ ID NO: 1660954 - RNA, 18 nt, Salmonella enterica enterica serovar Typhi
ucuggcgacuaaccagcg

SEQ ID NO: 1660955 - RNA, 14 nt, Salmonella enterica enterica serovar Typhi
ucuuccugcgguaa

SEQ ID NO: 1660956 - RNA, 12 nt, Salmonella enterica enterica serovar Typhi
ucuuccagcauc

SEQ ID NO: 1660957 - RNA, 15 nt, Salmonella enterica enterica serovar Typhi
ucuuccauucccacc

SEQ ID NO: 1660958 - RNA, 15 nt, Salmonella enterica enterica serovar Typhi
ucuuccaucagccag

SEQ ID NO: 1660959 - RNA, 18 nt, Salmonella enterica enterica serovar Typhi
ucuuccaucagccaggcg

SEQ ID NO: 1660960 - RNA, 19 nt, Salmonella enterica enterica serovar Typhi
ucuucaagguuaugcgcac

SEQ ID NO: 1660961 - RNA, 13 nt, Salmonella enterica enterica serovar Typhi
ucuucaaacggca

SEQ ID NO: 1660962 - RNA, 15 nt, Salmonella enterica enterica serovar Typhi
ucuuauccggccugc

SEQ ID NO: 1660963 - RNA, 18 nt, Salmonella enterica enterica serovar Typhi
ucuucaucagccagcauc

SEQ ID NO: 1660964 - RNA, 15 nt, Salmonella enterica enterica serovar Typhi
ucuucggcauaacgu

SEQ ID NO: 1660965 - RNA, 15 nt, Salmonella enterica enterica serovar Typhi
ucuucgcaaccggua

SEQ ID NO: 1660966 - RNA, 20 nt, Salmonella enterica enterica serovar Typhi
ucuucuccgccugcgguuua

SEQ ID NO: 1660967 - RNA, 17 nt, Salmonella enterica enterica serovar Typhi
ucuucguuagcggcguu

SEQ ID NO: 1660968 - RNA, 15 nt, Salmonella enterica enterica serovar Typhi
ucuucugccagcaac

SEQ ID NO: 1660969 - RNA, 14 nt, Salmonella enterica enterica serovar Typhi
ucuugccgccaucu

SEQ ID NO: 1660970 - RNA, 19 nt, Salmonella enterica enterica serovar Typhi
ucuugcgcagcauaucgcc

SEQ ID NO: 1660971 - RNA, 13 nt, Salmonella enterica enterica serovar Typhi
ucuugcguuaugu

SEQ ID NO: 1660972 - RNA, 20 nt, Salmonella enterica enterica serovar Typhi
ucuuuaaaaucgcgcauggc

SEQ ID NO: 1660973 - RNA, 14 nt, Salmonella enterica enterica serovar Typhi
ucuuuaauacgcgu

SEQ ID NO: 1660974 - RNA, 14 nt, Salmonella enterica enterica serovar Typhi
ucuuuacacucgcg

SEQ ID NO: 1660975 - RNA, 22 nt, Salmonella enterica enterica serovar Typhi
ucuuuucguuucuugauguguc

SEQ ID NO: 1660976 - RNA, 18 nt, Salmonella enterica enterica serovar Typhi
ucuuuacgcuaucgggcg

SEQ ID NO: 1660977 - RNA, 22 nt, Salmonella enterica enterica serovar Typhi
ucuuuacacucgcggauaaugu

SEQ ID NO: 1660978 - RNA, 15 nt, Salmonella enterica enterica serovar Typhi
ucuuuuuauggcggg

SEQ ID NO: 1660979 - RNA, 11 nt, Salmonella enterica enterica serovar Typhi
ugaaacgccga

SEQ ID NO: 1660980 - RNA, 18 nt, Salmonella enterica enterica serovar Typhi
ugaaacgccguuuguuua

SEQ ID NO: 1660981 - RNA, 12 nt, Salmonella enterica enterica serovar Typhi
ugaaacccgcca

SEQ ID NO: 1660982 - RNA, 13 nt, Salmonella enterica enterica serovar Typhi
ugaaaaacgggag

SEQ ID NO: 1660983 - RNA, 17 nt, Salmonella enterica enterica serovar Typhi
ugaacagcgucauccag

SEQ ID NO: 1660984 - RNA, 21 nt, Salmonella enterica enterica serovar Typhi
ugaacauggguuucuugccgg

SEQ ID NO: 1660985 - RNA, 14 nt, Salmonella enterica enterica serovar Typhi
ugauugcaagaaua

SEQ ID NO: 1660986 - RNA, 13 nt, Salmonella enterica enterica serovar Typhi
ugauggucuccag

SEQ ID NO: 1660987 - RNA, 16 nt, Salmonella enterica enterica serovar Typhi
ugaucacuuccgccac

SEQ ID NO: 1660988 - RNA, 19 nt, Salmonella enterica enterica serovar Typhi
ugaucaggaaaucuuccag

SEQ ID NO: 1660989 - RNA, 13 nt, Salmonella enterica enterica serovar Typhi
ugaugaucuucag

SEQ ID NO: 1660990 - RNA, 16 nt, Salmonella enterica enterica serovar Typhi
ugcaacaugcccaguu

SEQ ID NO: 1660991 - RNA, 20 nt, Salmonella enterica enterica serovar Typhi
ugcagaauugauaccacauc

SEQ ID NO: 1660992 - RNA, 17 nt, Salmonella enterica enterica serovar Typhi
ugacuuuccugguaauc

SEQ ID NO: 1660993 - RNA, 17 nt, Salmonella enterica enterica serovar Typhi
ugagauaauaaaugccg

SEQ ID NO: 1660994 - RNA, 18 nt, Salmonella enterica enterica serovar Typhi
ugacguugguuucggcgu

SEQ ID NO: 1660995 - RNA, 19 nt, Salmonella enterica enterica serovar Typhi
ugaagauuauucucgcacu

SEQ ID NO: 1660996 - RNA, 19 nt, Salmonella enterica enterica serovar Typhi
ugaagcagauacugcgcgu

SEQ ID NO: 1660997 - RNA, 13 nt, Salmonella enterica enterica serovar Typhi
ugaacucccggcg

SEQ ID NO: 1660998 - RNA, 20 nt, Salmonella enterica enterica serovar Typhi
ugaguauuaacgugauggcg

SEQ ID NO: 1660999 - RNA, 21 nt, Salmonella enterica enterica serovar Typhi
ugagccuaaaacauuaaucgc

SEQ ID NO: 1661000 - RNA, 21 nt, Salmonella enterica enterica serovar Typhi
ugagcgaacggcuuuccagca

SEQ ID NO: 1661001 - RNA, 18 nt, Salmonella enterica enterica serovar Typhi
ugauaagcgcagcgccau

SEQ ID NO: 1661002 - RNA, 23 nt, Salmonella enterica enterica serovar Typhi
ugauaauaguggugcgcauccgg

SEQ ID NO: 1661003 - RNA, 18 nt, Salmonella enterica enterica serovar Typhi
ugauaagcguagcgccau

SEQ ID NO: 1661004 - RNA, 23 nt, Salmonella enterica enterica serovar Typhi
ugauaaugguuuacccaggaaga

SEQ ID NO: 1661005 - RNA, 18 nt, Salmonella enterica enterica serovar Typhi
ugauacagaaaaccggca

SEQ ID NO: 1661006 - RNA, 20 nt, Salmonella enterica enterica serovar Typhi
ugauaccgauagcgcggaau

SEQ ID NO: 1661007 - RNA, 14 nt, Salmonella enterica enterica serovar Typhi
ugauauaaacgggc

SEQ ID NO: 1661008 - RNA, 14 nt, Salmonella enterica enterica serovar Typhi
ugauauagcgccau

SEQ ID NO: 1661009 - RNA, 22 nt, Salmonella enterica enterica serovar Typhi
ugauauugccgaccgccagcag

SEQ ID NO: 1661010 - RNA, 21 nt, Salmonella enterica enterica serovar Typhi
ugauauugaccaucucuuccg

SEQ ID NO: 1661011 - RNA, 18 nt, Salmonella enterica enterica serovar Typhi
ugauauccacgcgcacca

SEQ ID NO: 1661012 - RNA, 14 nt, Salmonella enterica enterica serovar Typhi
ugccaaucuccagc

SEQ ID NO: 1661013 - RNA, 21 nt, Salmonella enterica enterica serovar Typhi
ugccaaacaucgcucgcgcca

SEQ ID NO: 1661014 - RNA, 14 nt, Salmonella enterica enterica serovar Typhi
ugccaacggcgauc

SEQ ID NO: 1661015 - RNA, 13 nt, Salmonella enterica enterica serovar Typhi
ugcauuacagggc

SEQ ID NO: 1661016 - RNA, 13 nt, Salmonella enterica enterica serovar Typhi
ugcauuaccggga

SEQ ID NO: 1661017 - RNA, 16 nt, Salmonella enterica enterica serovar Typhi
ugcauuccgcgcaaau

SEQ ID NO: 1661018 - RNA, 20 nt, Salmonella enterica enterica serovar Typhi
ugccacuacgcagcuccagc

SEQ ID NO: 1661019 - RNA, 17 nt, Salmonella enterica enterica serovar Typhi
ugccauacacgcggcga

SEQ ID NO: 1661020 - RNA, 23 nt, Salmonella enterica enterica serovar Typhi
ugccaguaaucccggucgcgcca

SEQ ID NO: 1661021 - RNA, 15 nt, Salmonella enterica enterica serovar Typhi
ugcagauuaugccgu

SEQ ID NO: 1661022 - RNA, 15 nt, Salmonella enterica enterica serovar Typhi
ugcagaucaagcggg

SEQ ID NO: 1661023 - RNA, 16 nt, Salmonella enterica enterica serovar Typhi
ugcagcaagcggcugu

SEQ ID NO: 1661024 - RNA, 17 nt, Salmonella enterica enterica serovar Typhi
ugcagcgccauccacgg

SEQ ID NO: 1661025 - RNA, 20 nt, Salmonella enterica enterica serovar Typhi
ugcccuucuuuaauacgcgu

SEQ ID NO: 1661026 - RNA, 18 nt, Salmonella enterica enterica serovar Typhi
ugccauuguuccggcgac

SEQ ID NO: 1661027 - RNA, 16 nt, Salmonella enterica enterica serovar Typhi
ugccauucgcccaguc

SEQ ID NO: 1661028 - RNA, 14 nt, Salmonella enterica enterica serovar Typhi
ugcccgaugcgccc

SEQ ID NO: 1661029 - RNA, 15 nt, Salmonella enterica enterica serovar Typhi
ugcccgauggcgcug

SEQ ID NO: 1661030 - RNA, 18 nt, Salmonella enterica enterica serovar Typhi
ugccaucgacgcgcauca

SEQ ID NO: 1661031 - RNA, 19 nt, Salmonella enterica enterica serovar Typhi
ugccauauuuuuccagcgc

SEQ ID NO: 1661032 - RNA, 12 nt, Salmonella enterica enterica serovar Typhi
ugccgccauccg

SEQ ID NO: 1661033 - RNA, 12 nt, Salmonella enterica enterica serovar Typhi
ugccgauggcua

SEQ ID NO: 1661034 - RNA, 11 nt, Salmonella enterica enterica serovar Typhi
ugcgcuuacca

SEQ ID NO: 1661035 - RNA, 19 nt, Salmonella enterica enterica serovar Typhi
ugcgcuuauccggccuacg

SEQ ID NO: 1661036 - RNA, 20 nt, Salmonella enterica enterica serovar Typhi
ugcgcuuaccgggccuacag

SEQ ID NO: 1661037 - RNA, 14 nt, Salmonella enterica enterica serovar Typhi
ugcgcccguacacc

SEQ ID NO: 1661038 - RNA, 22 nt, Salmonella enterica enterica serovar Typhi
ugcgccccgcaacgccgauaag

SEQ ID NO: 1661039 - RNA, 22 nt, Salmonella enterica enterica serovar Typhi
ugcggaacuaacccgcagccgg

SEQ ID NO: 1661040 - RNA, 15 nt, Salmonella enterica enterica serovar Typhi
ugcgcuucguuaccg

SEQ ID NO: 1661041 - RNA, 19 nt, Salmonella enterica enterica serovar Typhi
ugcggccuuuauccagcgg

SEQ ID NO: 1661042 - RNA, 22 nt, Salmonella enterica enterica serovar Typhi
ugcggcgaaacagaguaacccg

SEQ ID NO: 1661043 - RNA, 18 nt, Salmonella enterica enterica serovar Typhi
ugcggccgaugccguaag

SEQ ID NO: 1661044 - RNA, 15 nt, Salmonella enterica enterica serovar Typhi
ugcggcgcuuccaga

SEQ ID NO: 1661045 - RNA, 19 nt, Salmonella enterica enterica serovar Typhi
ugcgguagcuccagacagg

SEQ ID NO: 1661046 - RNA, 15 nt, Salmonella enterica enterica serovar Typhi
ugcgguaccgcguua

SEQ ID NO: 1661047 - RNA, 17 nt, Salmonella enterica enterica serovar Typhi
ugcggcuucagcgacau

SEQ ID NO: 1661048 - RNA, 16 nt, Salmonella enterica enterica serovar Typhi
ugcggcggacgccggg

SEQ ID NO: 1661049 - RNA, 15 nt, Salmonella enterica enterica serovar Typhi
ugccgucauccagca

SEQ ID NO: 1661050 - RNA, 16 nt, Salmonella enterica enterica serovar Typhi
ugccgcguuacucggc

SEQ ID NO: 1661051 - RNA, 17 nt, Salmonella enterica enterica serovar Typhi
ugccuuccaggcgguga

SEQ ID NO: 1661052 - RNA, 14 nt, Salmonella enterica enterica serovar Typhi
ugccuuucgccagc

SEQ ID NO: 1661053 - RNA, 18 nt, Salmonella enterica enterica serovar Typhi
ugccuuguaagccggaua

SEQ ID NO: 1661054 - RNA, 19 nt, Salmonella enterica enterica serovar Typhi
ugcgaaagccucuuccgcc

SEQ ID NO: 1661055 - RNA, 20 nt, Salmonella enterica enterica serovar Typhi
ugcgaacagcgcuccacgcg

SEQ ID NO: 1661056 - RNA, 23 nt, Salmonella enterica enterica serovar Typhi
ugccuuuuugcagcgcggccagc

SEQ ID NO: 1661057 - RNA, 19 nt, Salmonella enterica enterica serovar Typhi
ugcgccaucauccggcaac

SEQ ID NO: 1661058 - RNA, 12 nt, Salmonella enterica enterica serovar Typhi
ugcgccagcaug

SEQ ID NO: 1661059 - RNA, 20 nt, Salmonella enterica enterica serovar Typhi
ugcgccacguucggcgugua

SEQ ID NO: 1661060 - RNA, 21 nt, Salmonella enterica enterica serovar Typhi
ugcgcccaucaucaucggcac

SEQ ID NO: 1661061 - RNA, 14 nt, Salmonella enterica enterica serovar Typhi
ugcgccccagcaug

SEQ ID NO: 1661062 - RNA, 18 nt, Salmonella enterica enterica serovar Typhi
ugcgccauccaccaggca

SEQ ID NO: 1661063 - RNA, 12 nt, Salmonella enterica enterica serovar Typhi
ugcgcagccagu

SEQ ID NO: 1661064 - RNA, 13 nt, Salmonella enterica enterica serovar Typhi
ugcgccaccagcg

SEQ ID NO: 1661065 - RNA, 23 nt, Salmonella enterica enterica serovar Typhi
ugcgccacgacuaucgucacccu

SEQ ID NO: 1661066 - RNA, 23 nt, Salmonella enterica enterica serovar Typhi
ugcgaagcgcccggaaagugggc

SEQ ID NO: 1661067 - RNA, 22 nt, Salmonella enterica enterica serovar Typhi
ugcgaauaacaucauccggcug

SEQ ID NO: 1661068 - RNA, 16 nt, Salmonella enterica enterica serovar Typhi
ugcgaggugauagccc

SEQ ID NO: 1661069 - RNA, 18 nt, Salmonella enterica enterica serovar Typhi
ugcgauagcccggcaugu

SEQ ID NO: 1661070 - RNA, 15 nt, Salmonella enterica enterica serovar Typhi
ugcgcaauuccagca

SEQ ID NO: 1661071 - RNA, 20 nt, Salmonella enterica enterica serovar Typhi
ugcgcaacguuucuuucauc

SEQ ID NO: 1661072 - RNA, 21 nt, Salmonella enterica enterica serovar Typhi
ugcuuaauauccaguugcgcc

SEQ ID NO: 1661073 - RNA, 22 nt, Salmonella enterica enterica serovar Typhi
ugcuguuucaguaaaucccgca

SEQ ID NO: 1661074 - RNA, 21 nt, Salmonella enterica enterica serovar Typhi
ugcuguuccagugggcggaua

SEQ ID NO: 1661075 - RNA, 23 nt, Salmonella enterica enterica serovar Typhi
ugcuucaccgcgccaaacguggc

SEQ ID NO: 1661076 - RNA, 14 nt, Salmonella enterica enterica serovar Typhi
ugcuuaugaucgcc

SEQ ID NO: 1661077 - RNA, 13 nt, Salmonella enterica enterica serovar Typhi
ugcuuaucacgua

SEQ ID NO: 1661078 - RNA, 17 nt, Salmonella enterica enterica serovar Typhi
ugcuuaucaaguaacgu

SEQ ID NO: 1661079 - RNA, 20 nt, Salmonella enterica enterica serovar Typhi
ugcuuaccuuguucuuccau

SEQ ID NO: 1661080 - RNA, 14 nt, Salmonella enterica enterica serovar Typhi
ugcuggugcaucug

SEQ ID NO: 1661081 - RNA, 13 nt, Salmonella enterica enterica serovar Typhi
ugcuggcggccgu

SEQ ID NO: 1661082 - RNA, 15 nt, Salmonella enterica enterica serovar Typhi
ugcugugacaucgcc

SEQ ID NO: 1661083 - RNA, 22 nt, Salmonella enterica enterica serovar Typhi
ugcuguggauuuauggcgucac

SEQ ID NO: 1661084 - RNA, 23 nt, Salmonella enterica enterica serovar Typhi
ugcugucgcccauugaaaucgcc

SEQ ID NO: 1661085 - RNA, 20 nt, Salmonella enterica enterica serovar Typhi
ugcuggcgaaccaccagccg

SEQ ID NO: 1661086 - RNA, 13 nt, Salmonella enterica enterica serovar Typhi
ugcuggcgcguca

SEQ ID NO: 1661087 - RNA, 14 nt, Salmonella enterica enterica serovar Typhi
ugcugccagcgccg

SEQ ID NO: 1661088 - RNA, 16 nt, Salmonella enterica enterica serovar Typhi
ugcugcaacgacgcgg

SEQ ID NO: 1661089 - RNA, 13 nt, Salmonella enterica enterica serovar Typhi
ugcugauccugua

SEQ ID NO: 1661090 - RNA, 14 nt, Salmonella enterica enterica serovar Typhi
ugcugcgcauccgc

SEQ ID NO: 1661091 - RNA, 17 nt, Salmonella enterica enterica serovar Typhi
ugcugcucgcuaugaaa

SEQ ID NO: 1661092 - RNA, 20 nt, Salmonella enterica enterica serovar Typhi
ugcucuccacgccgcaagga

SEQ ID NO: 1661093 - RNA, 23 nt, Salmonella enterica enterica serovar Typhi
ugcugauaguccaguacccgcac

SEQ ID NO: 1661094 - RNA, 16 nt, Salmonella enterica enterica serovar Typhi
ugcucuucguggaacu

SEQ ID NO: 1661095 - RNA, 21 nt, Salmonella enterica enterica serovar Typhi
ugcguuaccccaucauugacu

SEQ ID NO: 1661096 - RNA, 17 nt, Salmonella enterica enterica serovar Typhi
ugcgucgccccaaucgc

SEQ ID NO: 1661097 - RNA, 20 nt, Salmonella enterica enterica serovar Typhi
ugcgucgcguaccagcgccc

SEQ ID NO: 1661098 - RNA, 17 nt, Salmonella enterica enterica serovar Typhi
ugcguaaaaucagcauc

SEQ ID NO: 1661099 - RNA, 16 nt, Salmonella enterica enterica serovar Typhi
ugcguaaaaucgcagu

SEQ ID NO: 1661100 - RNA, 20 nt, Salmonella enterica enterica serovar Typhi
ugcguaggggcgaccgggcg

SEQ ID NO: 1661101 - RNA, 13 nt, Salmonella enterica enterica serovar Typhi
ugcgucaguaccu

SEQ ID NO: 1661102 - RNA, 14 nt, Salmonella enterica enterica serovar Typhi
ugcguccgccagau

SEQ ID NO: 1661103 - RNA, 22 nt, Salmonella enterica enterica serovar Typhi
ugcggucguauuuaccgcuggc

SEQ ID NO: 1661104 - RNA, 21 nt, Salmonella enterica enterica serovar Typhi
ugcgguggccgacuuaucgac

SEQ ID NO: 1661105 - RNA, 14 nt, Salmonella enterica enterica serovar Typhi
ugcuccugccagau

SEQ ID NO: 1661106 - RNA, 17 nt, Salmonella enterica enterica serovar Typhi
ugcuccugcggcgugga

SEQ ID NO: 1661107 - RNA, 13 nt, Salmonella enterica enterica serovar Typhi
ugcuccggcuuaa

SEQ ID NO: 1661108 - RNA, 18 nt, Salmonella enterica enterica serovar Typhi
ugcucaugcgagguauac

SEQ ID NO: 1661109 - RNA, 14 nt, Salmonella enterica enterica serovar Typhi
ugcuacgcgccagu

SEQ ID NO: 1661110 - RNA, 16 nt, Salmonella enterica enterica serovar Typhi
ugcucaaaggcgcuga

SEQ ID NO: 1661111 - RNA, 17 nt, Salmonella enterica enterica serovar Typhi
ucaggaucaaaaucgcg

SEQ ID NO: 1661112 - RNA, 18 nt, Salmonella enterica enterica serovar Typhi
ucaggauaaaauccugca

SEQ ID NO: 1661113 - RNA, 20 nt, Salmonella enterica enterica serovar Typhi
ucaggcacgugcauaaaacg

SEQ ID NO: 1661114 - RNA, 19 nt, Salmonella enterica enterica serovar Typhi
ucaggcaguuuauccggcg

SEQ ID NO: 1661115 - RNA, 22 nt, Salmonella enterica enterica serovar Typhi
ucaggcauguugcgcaaucacg

SEQ ID NO: 1661116 - RNA, 16 nt, Salmonella enterica enterica serovar Typhi
ucagcucgauccggca

SEQ ID NO: 1661117 - RNA, 15 nt, Salmonella enterica enterica serovar Typhi
ucagcgucggugaag

SEQ ID NO: 1661118 - RNA, 21 nt, Salmonella enterica enterica serovar Typhi
ucagcguaauuaagccgggua

SEQ ID NO: 1661119 - RNA, 19 nt, Salmonella enterica enterica serovar Typhi
ucagccacuucuuccagcg

SEQ ID NO: 1661120 - RNA, 18 nt, Salmonella enterica enterica serovar Typhi
ucagccagcguaccagcg

SEQ ID NO: 1661121 - RNA, 13 nt, Salmonella enterica enterica serovar Typhi
ucagcgcggcaag

SEQ ID NO: 1661122 - RNA, 13 nt, Salmonella enterica enterica serovar Typhi
ucagcgccggauc

SEQ ID NO: 1661123 - RNA, 16 nt, Salmonella enterica enterica serovar Typhi
ucagcaaaauaccggc

SEQ ID NO: 1661124 - RNA, 17 nt, Salmonella enterica enterica serovar Typhi
ucagcaaaauaccggca

SEQ ID NO: 1661125 - RNA, 22 nt, Salmonella enterica enterica serovar Typhi
ucagcaauuaacaaauaaagcg

SEQ ID NO: 1661126 - RNA, 15 nt, Salmonella enterica enterica serovar Typhi
ucagcacaaaauccc

SEQ ID NO: 1661127 - RNA, 16 nt, Salmonella enterica enterica serovar Typhi
ucagcaagcgccagua

SEQ ID NO: 1661128 - RNA, 18 nt, Salmonella enterica enterica serovar Typhi
ucagacguagcgccauca

SEQ ID NO: 1661129 - RNA, 19 nt, Salmonella enterica enterica serovar Typhi
ucagaccagucggacagcg

SEQ ID NO: 1661130 - RNA, 18 nt, Salmonella enterica enterica serovar Typhi
ucacugccgacgcccuca

SEQ ID NO: 1661131 - RNA, 18 nt, Salmonella enterica enterica serovar Typhi
ucacuguuaucgccauua

SEQ ID NO: 1661132 - RNA, 21 nt, Salmonella enterica enterica serovar Typhi
ucacugccguacaaaccgggc

SEQ ID NO: 1661133 - RNA, 17 nt, Salmonella enterica enterica serovar Typhi
ucacgcucgcggaagcg

SEQ ID NO: 1661134 - RNA, 21 nt, Salmonella enterica enterica serovar Typhi
ucacgcucuucgccaaucgcc

SEQ ID NO: 1661135 - RNA, 22 nt, Salmonella enterica enterica serovar Typhi
ucacgcccgccgaaggcaacgc

SEQ ID NO: 1661136 - RNA, 17 nt, Salmonella enterica enterica serovar Typhi
ucacgucagcgaccauu

SEQ ID NO: 1661137 - RNA, 16 nt, Salmonella enterica enterica serovar Typhi
ucacggauccagaacu

SEQ ID NO: 1661138 - RNA, 17 nt, Salmonella enterica enterica serovar Typhi
ucacggccaaagcgcga

SEQ ID NO: 1661139 - RNA, 13 nt, Salmonella enterica enterica serovar Typhi
ucacguaaucgcc

SEQ ID NO: 1661140 - RNA, 19 nt, Salmonella enterica enterica serovar Typhi
ucacggagagucgcaccgc

SEQ ID NO: 1661141 - RNA, 23 nt, Salmonella enterica enterica serovar Typhi
ucacggaauuucucguugguaga

SEQ ID NO: 1661142 - RNA, 13 nt, Salmonella enterica enterica serovar Typhi
uauuuaacgccag

SEQ ID NO: 1661143 - RNA, 17 nt, Salmonella enterica enterica serovar Typhi
uauuucuaucgcuaucg

SEQ ID NO: 1661144 - RNA, 19 nt, Salmonella enterica enterica serovar Typhi
uauuugguaccgccaucgg

SEQ ID NO: 1661145 - RNA, 15 nt, Salmonella enterica enterica serovar Typhi
ucaccgcaugacaau

SEQ ID NO: 1661146 - RNA, 23 nt, Salmonella enterica enterica serovar Typhi
ucaccgcauuaaggguuaaggca

SEQ ID NO: 1661147 - RNA, 12 nt, Salmonella enterica enterica serovar Typhi
ucacgaucgcgg

SEQ ID NO: 1661148 - RNA, 19 nt, Salmonella enterica enterica serovar Typhi
ucacgauaguuugccagag

SEQ ID NO: 1661149 - RNA, 21 nt, Salmonella enterica enterica serovar Typhi
ucaccuuuuuauuuacugccg

SEQ ID NO: 1661150 - RNA, 23 nt, Salmonella enterica enterica serovar Typhi
ucacgaccggcgaacguuggcug

SEQ ID NO: 1661151 - RNA, 22 nt, Salmonella enterica enterica serovar Typhi
ucaccggcauuucaccgucaau

SEQ ID NO: 1661152 - RNA, 20 nt, Salmonella enterica enterica serovar Typhi
ucauugccuguaucgcuauc

SEQ ID NO: 1661153 - RNA, 22 nt, Salmonella enterica enterica serovar Typhi
uccaacagaaggcuucacgcca

SEQ ID NO: 1661154 - RNA, 21 nt, Salmonella enterica enterica serovar Typhi
uccaacaaggauauccgccag

SEQ ID NO: 1661155 - RNA, 14 nt, Salmonella enterica enterica serovar Typhi
ucauucagcgcgau

SEQ ID NO: 1661156 - RNA, 19 nt, Salmonella enterica enterica serovar Typhi
ucauuauucaggccuccug

SEQ ID NO: 1661157 - RNA, 17 nt, Salmonella enterica enterica serovar Typhi
ucauuaugcauugccau

SEQ ID NO: 1661158 - RNA, 12 nt, Salmonella enterica enterica serovar Typhi
ucaucgcgcuga

SEQ ID NO: 1661159 - RNA, 11 nt, Salmonella enterica enterica serovar Typhi
ucauccagcgg

SEQ ID NO: 1661160 - RNA, 23 nt, Salmonella enterica enterica serovar Typhi
ucaugauuucuugagcggcauca

SEQ ID NO: 1661161 - RNA, 17 nt, Salmonella enterica enterica serovar Typhi
ucaugauacccagcguc

SEQ ID NO: 1661162 - RNA, 23 nt, Salmonella enterica enterica serovar Typhi
ucaugaaugccccagcgcugcug

SEQ ID NO: 1661163 - RNA, 13 nt, Salmonella enterica enterica serovar Typhi
ucaucgucagcaa

SEQ ID NO: 1661164 - RNA, 21 nt, Salmonella enterica enterica serovar Typhi
ucaguucggagaucagcggau

SEQ ID NO: 1661165 - RNA, 13 nt, Salmonella enterica enterica serovar Typhi
ucauaaagcgccc

SEQ ID NO: 1661166 - RNA, 17 nt, Salmonella enterica enterica serovar Typhi
ucauaaaugcugucgcc

SEQ ID NO: 1661167 - RNA, 13 nt, Salmonella enterica enterica serovar Typhi
ucauaauaagcgc

SEQ ID NO: 1661168 - RNA, 18 nt, Salmonella enterica enterica serovar Typhi
ucaucaaggaauacgggc

SEQ ID NO: 1661169 - RNA, 13 nt, Salmonella enterica enterica serovar Typhi
ucaucaguaacug

SEQ ID NO: 1661170 - RNA, 18 nt, Salmonella enterica enterica serovar Typhi
ucaucaguuugcgauaag

SEQ ID NO: 1661171 - RNA, 20 nt, Salmonella enterica enterica serovar Typhi
ucaucagggcguaagcgcgu

SEQ ID NO: 1661172 - RNA, 21 nt, Salmonella enterica enterica serovar Typhi
ucaucagggcguaagcgcguu

SEQ ID NO: 1661173 - RNA, 15 nt, Salmonella enterica enterica serovar Typhi
ucaucauaauucagc

SEQ ID NO: 1661174 - RNA, 16 nt, Salmonella enterica enterica serovar Typhi
ucaggcgaucccggcc

SEQ ID NO: 1661175 - RNA, 15 nt, Salmonella enterica enterica serovar Typhi
ucaggccugccugau

SEQ ID NO: 1661176 - RNA, 14 nt, Salmonella enterica enterica serovar Typhi
ucagugauaaagcc

SEQ ID NO: 1661177 - RNA, 13 nt, Salmonella enterica enterica serovar Typhi
uccagaucgccac

SEQ ID NO: 1661178 - RNA, 17 nt, Salmonella enterica enterica serovar Typhi
uccagcacauccucaau

SEQ ID NO: 1661179 - RNA, 20 nt, Salmonella enterica enterica serovar Typhi
uccacgcuauaaaguagcca

SEQ ID NO: 1661180 - RNA, 16 nt, Salmonella enterica enterica serovar Typhi
uccacacguccauccg

SEQ ID NO: 1661181 - RNA, 15 nt, Salmonella enterica enterica serovar Typhi
uccacaaucccggca

SEQ ID NO: 1661182 - RNA, 23 nt, Salmonella enterica enterica serovar Typhi
uccaacaaggauauccgccaguu

SEQ ID NO: 1661183 - RNA, 23 nt, Salmonella enterica enterica serovar Typhi
uccacauaggcguugauggcgua

SEQ ID NO: 1661184 - RNA, 23 nt, Salmonella enterica enterica serovar Typhi
uccacgccgucgaugauggcggc

SEQ ID NO: 1661185 - RNA, 22 nt, Salmonella enterica enterica serovar Typhi
uccacgccgcaaggacgccagu

SEQ ID NO: 1661186 - RNA, 22 nt, Salmonella enterica enterica serovar Typhi
uccagcccgccaauauccggca

SEQ ID NO: 1661187 - RNA, 15 nt, Salmonella enterica enterica serovar Typhi
uccagcauccaugcc

SEQ ID NO: 1661188 - RNA, 15 nt, Salmonella enterica enterica serovar Typhi
uccagcgggccgacg

SEQ ID NO: 1661189 - RNA, 20 nt, Salmonella enterica enterica serovar Typhi
uccagcgguugcgcuucggc

SEQ ID NO: 1661190 - RNA, 18 nt, Salmonella enterica enterica serovar Typhi
uccaggccgucggcgcca

SEQ ID NO: 1661191 - RNA, 19 nt, Salmonella enterica enterica serovar Typhi
uccaggguucacugccagu

SEQ ID NO: 1661192 - RNA, 20 nt, Salmonella enterica enterica serovar Typhi
uccaucgguucucugccauc

SEQ ID NO: 1661193 - RNA, 15 nt, Salmonella enterica enterica serovar Typhi
uccagguuaacccac

SEQ ID NO: 1661194 - RNA, 13 nt, Salmonella enterica enterica serovar Typhi
uccauccggcgua

SEQ ID NO: 1661195 - RNA, 14 nt, Salmonella enterica enterica serovar Typhi
uccgaaauaaaucg

SEQ ID NO: 1661196 - RNA, 20 nt, Salmonella enterica enterica serovar Typhi
uccgaaacaaucaccugaug

SEQ ID NO: 1661197 - RNA, 15 nt, Salmonella enterica enterica serovar Typhi
ucccugacuggcuga

SEQ ID NO: 1661198 - RNA, 22 nt, Salmonella enterica enterica serovar Typhi
uccgcagauccagcacggccuu

SEQ ID NO: 1661199 - RNA, 15 nt, Salmonella enterica enterica serovar Typhi
uccgcaggagagcca

SEQ ID NO: 1661200 - RNA, 17 nt, Salmonella enterica enterica serovar Typhi
uccgcaucagcaacgcg

SEQ ID NO: 1661201 - RNA, 15 nt, Salmonella enterica enterica serovar Typhi
uccgcauagcgcaac

SEQ ID NO: 1661202 - RNA, 21 nt, Salmonella enterica enterica serovar Typhi
uccgccugauaaaacgcaggc

SEQ ID NO: 1661203 - RNA, 16 nt, Salmonella enterica enterica serovar Typhi
uccgccgcaauagcca

SEQ ID NO: 1661204 - RNA, 16 nt, Salmonella enterica enterica serovar Typhi
uccgccgccgccaucg

SEQ ID NO: 1661205 - RNA, 12 nt, Salmonella enterica enterica serovar Typhi
ucccggcgugug

SEQ ID NO: 1661206 - RNA, 20 nt, Salmonella enterica enterica serovar Typhi
ucccgcgcagugcagcggau

SEQ ID NO: 1661207 - RNA, 13 nt, Salmonella enterica enterica serovar Typhi
ucccucuccgccg

SEQ ID NO: 1661208 - RNA, 12 nt, Salmonella enterica enterica serovar Typhi
ucccuauacguu

SEQ ID NO: 1661209 - RNA, 17 nt, Salmonella enterica enterica serovar Typhi
ucccguuucagccccuu

SEQ ID NO: 1661210 - RNA, 13 nt, Salmonella enterica enterica serovar Typhi
ucccgcccgcgua

SEQ ID NO: 1661211 - RNA, 13 nt, Salmonella enterica enterica serovar Typhi
ucccgcagccagc

SEQ ID NO: 1661212 - RNA, 14 nt, Salmonella enterica enterica serovar Typhi
ucccgcacgcuggc

SEQ ID NO: 1661213 - RNA, 21 nt, Salmonella enterica enterica serovar Typhi
uccaugccggcuuuccgcacc

SEQ ID NO: 1661214 - RNA, 20 nt, Salmonella enterica enterica serovar Typhi
uccaugaucgccuggccgau

SEQ ID NO: 1661215 - RNA, 21 nt, Salmonella enterica enterica serovar Typhi
uccaugaugaagauauucacu

SEQ ID NO: 1661216 - RNA, 19 nt, Salmonella enterica enterica serovar Typhi
uccggcacgauaaauugcc

SEQ ID NO: 1661217 - RNA, 19 nt, Salmonella enterica enterica serovar Typhi
uccggcaucucaaggucug

SEQ ID NO: 1661218 - RNA, 19 nt, Salmonella enterica enterica serovar Typhi
uccggaacagggccgcauc

SEQ ID NO: 1661219 - RNA, 12 nt, Salmonella enterica enterica serovar Typhi
uccgcuuccacu

SEQ ID NO: 1661220 - RNA, 20 nt, Salmonella enterica enterica serovar Typhi
uccgcuucaccuuucgccgc

SEQ ID NO: 1661221 - RNA, 19 nt, Salmonella enterica enterica serovar Typhi
uccgcuuuuccugccagca

SEQ ID NO: 1661222 - RNA, 15 nt, Salmonella enterica enterica serovar Typhi
uccgcuguuaugcac

SEQ ID NO: 1661223 - RNA, 19 nt, Salmonella enterica enterica serovar Typhi
uccggcgcggcgcgcaugc

SEQ ID NO: 1661224 - RNA, 14 nt, Salmonella enterica enterica serovar Typhi
uccggcgcugcgcg

SEQ ID NO: 1661225 - RNA, 18 nt, Salmonella enterica enterica serovar Typhi
uccggcgcucacgcugac

SEQ ID NO: 1661226 - RNA, 20 nt, Salmonella enterica enterica serovar Typhi
uccggcgcgagccacgcggc

SEQ ID NO: 1661227 - RNA, 17 nt, Salmonella enterica enterica serovar Typhi
uccggcccgugccagcu

SEQ ID NO: 1661228 - RNA, 19 nt, Salmonella enterica enterica serovar Typhi
uccggcuuauccggccugc

SEQ ID NO: 1661229 - RNA, 22 nt, Salmonella enterica enterica serovar Typhi
uccggcuuaaugcauggcagau

SEQ ID NO: 1661230 - RNA, 16 nt, Salmonella enterica enterica serovar Typhi
uccggcgcuuccugca

SEQ ID NO: 1661231 - RNA, 17 nt, Salmonella enterica enterica serovar Typhi
uccggcgcuggcgcacg

SEQ ID NO: 1661232 - RNA, 18 nt, Salmonella enterica enterica serovar Typhi
uccgguaucaugcugaug

SEQ ID NO: 1661233 - RNA, 15 nt, Salmonella enterica enterica serovar Typhi
uccgguagcgccugu

SEQ ID NO: 1661234 - RNA, 17 nt, Salmonella enterica enterica serovar Typhi
uccucaacagacauauc

SEQ ID NO: 1661235 - RNA, 20 nt, Salmonella enterica enterica serovar Typhi
uccgucaggguaugucggua

SEQ ID NO: 1661236 - RNA, 16 nt, Salmonella enterica enterica serovar Typhi
uccggugugaccagcg

SEQ ID NO: 1661237 - RNA, 14 nt, Salmonella enterica enterica serovar Typhi
uccgguuaauacgc

SEQ ID NO: 1661238 - RNA, 17 nt, Salmonella enterica enterica serovar Typhi
uccggugaagguaauuu

SEQ ID NO: 1661239 - RNA, 19 nt, Salmonella enterica enterica serovar Typhi
ucgacauuagcaucccgca

SEQ ID NO: 1661240 - RNA, 19 nt, Salmonella enterica enterica serovar Typhi
ucgaacgccgccugcgcca

SEQ ID NO: 1661241 - RNA, 19 nt, Salmonella enterica enterica serovar Typhi
ucgacaauaaauugcgacc

SEQ ID NO: 1661242 - RNA, 22 nt, Salmonella enterica enterica serovar Typhi
ucgacaagcuaauccccagcgc

SEQ ID NO: 1661243 - RNA, 15 nt, Salmonella enterica enterica serovar Typhi
ucgacaauccgccac

SEQ ID NO: 1661244 - RNA, 16 nt, Salmonella enterica enterica serovar Typhi
ucgacaauguccgcca

SEQ ID NO: 1661245 - RNA, 12 nt, Salmonella enterica enterica serovar Typhi
ucgaauccagca

SEQ ID NO: 1661246 - RNA, 21 nt, Salmonella enterica enterica serovar Typhi
ucgaaugaggacggcccgcug

SEQ ID NO: 1661247 - RNA, 17 nt, Salmonella enterica enterica serovar Typhi
ucgacaguucccggcaa

SEQ ID NO: 1661248 - RNA, 14 nt, Salmonella enterica enterica serovar Typhi
ucgacagccacacg

SEQ ID NO: 1661249 - RNA, 20 nt, Salmonella enterica enterica serovar Typhi
ucgacagaacggauauccag

SEQ ID NO: 1661250 - RNA, 24 nt, Salmonella enterica enterica serovar Typhi
uccugcauaauccaacgaaacgca

SEQ ID NO: 1661251 - RNA, 22 nt, Salmonella enterica enterica serovar Typhi
uccugauccgccuuacgcaguu

SEQ ID NO: 1661252 - RNA, 15 nt, Salmonella enterica enterica serovar Typhi
uccugauccggcugu

SEQ ID NO: 1661253 - RNA, 14 nt, Salmonella enterica enterica serovar Typhi
uccugcgccagccg

SEQ ID NO: 1661254 - RNA, 18 nt, Salmonella enterica enterica serovar Typhi
uccugcauuugcgcauau

SEQ ID NO: 1661255 - RNA, 11 nt, Salmonella enterica enterica serovar Typhi
uccugccagac

SEQ ID NO: 1661256 - RNA, 19 nt, Salmonella enterica enterica serovar Typhi
uccugcgguaaacgcucgc

SEQ ID NO: 1661257 - RNA, 19 nt, Salmonella enterica enterica serovar Typhi
uccugcgguacggccagcg

SEQ ID NO: 1661258 - RNA, 20 nt, Salmonella enterica enterica serovar Typhi
uccugaccaccggcccgguu

SEQ ID NO: 1661259 - RNA, 17 nt, Salmonella enterica enterica serovar Typhi
uccucuuuucgaacgcc

SEQ ID NO: 1661260 - RNA, 19 nt, Salmonella enterica enterica serovar Typhi
uccucuuuucgaacgccga

SEQ ID NO: 1661261 - RNA, 22 nt, Salmonella enterica enterica serovar Typhi
uccucguugacuucaaucacuu

SEQ ID NO: 1661262 - RNA, 19 nt, Salmonella enterica enterica serovar Typhi
uccucgcaguuaugcgcau

SEQ ID NO: 1661263 - RNA, 20 nt, Salmonella enterica enterica serovar Typhi
ucgaacagguuguugauguu

SEQ ID NO: 1661264 - RNA, 20 nt, Salmonella enterica enterica serovar Typhi
uccuuuaaugaagcaacugu

SEQ ID NO: 1661265 - RNA, 19 nt, Salmonella enterica enterica serovar Typhi
uccuugcggugagaaacgc

SEQ ID NO: 1661266 - RNA, 18 nt, Salmonella enterica enterica serovar Typhi
uccuuauaaugcuuacgg

SEQ ID NO: 1661267 - RNA, 22 nt, Salmonella enterica enterica serovar Typhi
uccuuauuuacgguuggccagc

SEQ ID NO: 1661268 - RNA, 19 nt, Salmonella enterica enterica serovar Typhi
uccuguacaaaaucaucau

SEQ ID NO: 1661269 - RNA, 20 nt, Salmonella enterica enterica serovar Typhi
uaccuauuuguuccggcaag

SEQ ID NO: 1661270 - RNA, 22 nt, Salmonella enterica enterica serovar Typhi
uaccguuugucuucugccagca

SEQ ID NO: 1661271 - RNA, 15 nt, Salmonella enterica enterica serovar Typhi
uaccguuuuccaguc

SEQ ID NO: 1661272 - RNA, 20 nt, Salmonella enterica enterica serovar Typhi
uaccguuuggaucugucgcc

SEQ ID NO: 1661273 - RNA, 20 nt, Salmonella enterica enterica serovar Typhi
uaccaaauauuucuuugucg

SEQ ID NO: 1661274 - RNA, 14 nt, Salmonella enterica enterica serovar Typhi
uacauugccggaug

SEQ ID NO: 1661275 - RNA, 24 nt, Salmonella enterica enterica serovar Typhi
uaccugaagccauccucacgcaac

SEQ ID NO: 1661276 - RNA, 23 nt, Salmonella enterica enterica serovar Typhi
uacgaaccugauuguuuuaccca

SEQ ID NO: 1661277 - RNA, 18 nt, Salmonella enterica enterica serovar Typhi
uacgaaaauacgcggaug

SEQ ID NO: 1661278 - RNA, 20 nt, Salmonella enterica enterica serovar Typhi
uacgacacccgauacacgcc

SEQ ID NO: 1661279 - RNA, 20 nt, Salmonella enterica enterica serovar Typhi
uacgaauuuuaucuuccggc

SEQ ID NO: 1661280 - RNA, 12 nt, Salmonella enterica enterica serovar Typhi
uacgacgcgcca

SEQ ID NO: 1661281 - RNA, 16 nt, Salmonella enterica enterica serovar Typhi
uacggaugcgcggaug

SEQ ID NO: 1661282 - RNA, 16 nt, Salmonella enterica enterica serovar Typhi
uacggcaaacgcuggu

SEQ ID NO: 1661283 - RNA, 17 nt, Salmonella enterica enterica serovar Typhi
uacggcaaacgcuggug

SEQ ID NO: 1661284 - RNA, 20 nt, Salmonella enterica enterica serovar Typhi
uacggccugcgcgauggaug

SEQ ID NO: 1661285 - RNA, 19 nt, Salmonella enterica enterica serovar Typhi
uacgcuccugcgguacggc

SEQ ID NO: 1661286 - RNA, 14 nt, Salmonella enterica enterica serovar Typhi
uacgcuuauugaug

SEQ ID NO: 1661287 - RNA, 14 nt, Salmonella enterica enterica serovar Typhi
uacgcuguaacccg

SEQ ID NO: 1661288 - RNA, 17 nt, Salmonella enterica enterica serovar Typhi
uacgcuacugagcguca

SEQ ID NO: 1661289 - RNA, 19 nt, Salmonella enterica enterica serovar Typhi
uacgcuauaggcgaccgaa

SEQ ID NO: 1661290 - RNA, 23 nt, Salmonella enterica enterica serovar Typhi
uacgcgcucucauaagccgcguu

SEQ ID NO: 1661291 - RNA, 18 nt, Salmonella enterica enterica serovar Typhi
uacgcgauaaaaaacgcc

SEQ ID NO: 1661292 - RNA, 15 nt, Salmonella enterica enterica serovar Typhi
uacgccugucgcaac

SEQ ID NO: 1661293 - RNA, 18 nt, Salmonella enterica enterica serovar Typhi
uacgccugugcuggcgaa

SEQ ID NO: 1661294 - RNA, 13 nt, Salmonella enterica enterica serovar Typhi
uacgccugucgca

SEQ ID NO: 1661295 - RNA, 22 nt, Salmonella enterica enterica serovar Typhi
uacggugaauauuugcgcuagu

SEQ ID NO: 1661296 - RNA, 14 nt, Salmonella enterica enterica serovar Typhi
uacgguaauaacuc

SEQ ID NO: 1661297 - RNA, 22 nt, Salmonella enterica enterica serovar Typhi
uacggguuaggcaagcugguaa

SEQ ID NO: 1661298 - RNA, 15 nt, Salmonella enterica enterica serovar Typhi
uacgguuggccagca

SEQ ID NO: 1661299 - RNA, 16 nt, Salmonella enterica enterica serovar Typhi
uacgggaaugcgucgg

SEQ ID NO: 1661300 - RNA, 20 nt, Salmonella enterica enterica serovar Typhi
uacgggaucgauauaucgcg

SEQ ID NO: 1661301 - RNA, 17 nt, Salmonella enterica enterica serovar Typhi
uacgggcaaagcgacgc

SEQ ID NO: 1661302 - RNA, 12 nt, Salmonella enterica enterica serovar Typhi
uacggcgugaug

SEQ ID NO: 1661303 - RNA, 16 nt, Salmonella enterica enterica serovar Typhi
uacgucgugacccaca

SEQ ID NO: 1661304 - RNA, 14 nt, Salmonella enterica enterica serovar Typhi
uacgugcgaaccac

SEQ ID NO: 1661305 - RNA, 16 nt, Salmonella enterica enterica serovar Typhi
uacuccauucccagcu

SEQ ID NO: 1661306 - RNA, 19 nt, Salmonella enterica enterica serovar Typhi
uacuaacggcgucauccug

SEQ ID NO: 1661307 - RNA, 20 nt, Salmonella enterica enterica serovar Typhi
uagaaaguacaucauuggcc

SEQ ID NO: 1661308 - RNA, 14 nt, Salmonella enterica enterica serovar Typhi
uagaaguuaugcau

SEQ ID NO: 1661309 - RNA, 19 nt, Salmonella enterica enterica serovar Typhi
uagaaaaggucgucaggcc

SEQ ID NO: 1661310 - RNA, 20 nt, Salmonella enterica enterica serovar Typhi
uacuucugacagugacggca

SEQ ID NO: 1661311 - RNA, 20 nt, Salmonella enterica enterica serovar Typhi
uacucuaggcgcugcuggca

SEQ ID NO: 1661312 - RNA, 15 nt, Salmonella enterica enterica serovar Typhi
uacucuuucccggca

SEQ ID NO: 1661313 - RNA, 23 nt, Salmonella enterica enterica serovar Typhi
uacugaacaagcgaucgccagcu

SEQ ID NO: 1661314 - RNA, 21 nt, Salmonella enterica enterica serovar Typhi
uacugugggccguuccgcaac

SEQ ID NO: 1661315 - RNA, 16 nt, Salmonella enterica enterica serovar Typhi
uacuguuuuugcuuua

SEQ ID NO: 1661316 - RNA, 17 nt, Salmonella enterica enterica serovar Typhi
uaggcauuaauggcgau

SEQ ID NO: 1661317 - RNA, 18 nt, Salmonella enterica enterica serovar Typhi
uaggcaaugaucagcgac

SEQ ID NO: 1661318 - RNA, 18 nt, Salmonella enterica enterica serovar Typhi
uagcuguuccgcaacacg

SEQ ID NO: 1661319 - RNA, 22 nt, Salmonella enterica enterica serovar Typhi
uagcuguuguuuaauggcuaac

SEQ ID NO: 1661320 - RNA, 15 nt, Salmonella enterica enterica serovar Typhi
uagcuguuccgcaac

SEQ ID NO: 1661321 - RNA, 20 nt, Salmonella enterica enterica serovar Typhi
uagcuguaauucaugcugua

SEQ ID NO: 1661322 - RNA, 19 nt, Salmonella enterica enterica serovar Typhi
uagcugauaagcuaguaaa

SEQ ID NO: 1661323 - RNA, 16 nt, Salmonella enterica enterica serovar Typhi
uagcguuuuuaccggc

SEQ ID NO: 1661324 - RNA, 14 nt, Salmonella enterica enterica serovar Typhi
uagcugcgccagcg

SEQ ID NO: 1661325 - RNA, 21 nt, Salmonella enterica enterica serovar Typhi
uagcugcuguaaguuuccguc

SEQ ID NO: 1661326 - RNA, 19 nt, Salmonella enterica enterica serovar Typhi
uaggccugguaagcguagc

SEQ ID NO: 1661327 - RNA, 13 nt, Salmonella enterica enterica serovar Typhi
uaggccggaucag

SEQ ID NO: 1661328 - RNA, 20 nt, Salmonella enterica enterica serovar Typhi
uaggccggaugagcguuagc

SEQ ID NO: 1661329 - RNA, 17 nt, Salmonella enterica enterica serovar Typhi
uaggcgccgccgacaau

SEQ ID NO: 1661330 - RNA, 22 nt, Salmonella enterica enterica serovar Typhi
uaggcccgguaagcgcagcgcc

SEQ ID NO: 1661331 - RNA, 20 nt, Salmonella enterica enterica serovar Typhi
uaggcccgguaagcgcuagc

SEQ ID NO: 1661332 - RNA, 19 nt, Salmonella enterica enterica serovar Typhi
uaggcccgguaagcgcagc

SEQ ID NO: 1661333 - RNA, 19 nt, Salmonella enterica enterica serovar Typhi
uaggccgaauaagacgcuu

SEQ ID NO: 1661334 - RNA, 20 nt, Salmonella enterica enterica serovar Typhi
uaggccggauaaggcguuca

SEQ ID NO: 1661335 - RNA, 21 nt, Salmonella enterica enterica serovar Typhi
uaggccggauaaggcgcuagc

SEQ ID NO: 1661336 - RNA, 20 nt, Salmonella enterica enterica serovar Typhi
uaggccggauaaggcguaac

SEQ ID NO: 1661337 - RNA, 11 nt, Salmonella enterica enterica serovar Typhi
uaggccggaua

SEQ ID NO: 1661338 - RNA, 17 nt, Salmonella enterica enterica serovar Typhi
uaggccggauaagcggc

SEQ ID NO: 1661339 - RNA, 13 nt, Salmonella enterica enterica serovar Typhi
uaggcgcgaaaug

SEQ ID NO: 1661340 - RNA, 20 nt, Salmonella enterica enterica serovar Typhi
uagggccgggcagugcucga

SEQ ID NO: 1661341 - RNA, 14 nt, Salmonella enterica enterica serovar Typhi
uagccuugacgcaa

SEQ ID NO: 1661342 - RNA, 16 nt, Salmonella enterica enterica serovar Typhi
uagcgacugauaagcg

SEQ ID NO: 1661343 - RNA, 22 nt, Salmonella enterica enterica serovar Typhi
uagcgacggcgcgccaaacggc

SEQ ID NO: 1661344 - RNA, 22 nt, Salmonella enterica enterica serovar Typhi
uagcgaccagcgucagccagaa

SEQ ID NO: 1661345 - RNA, 20 nt, Salmonella enterica enterica serovar Typhi
uagcgcuccuuuaauucguu

SEQ ID NO: 1661346 - RNA, 16 nt, Salmonella enterica enterica serovar Typhi
uagcgucugcggcuga

SEQ ID NO: 1661347 - RNA, 13 nt, Salmonella enterica enterica serovar Typhi
uagcgugacggca

SEQ ID NO: 1661348 - RNA, 15 nt, Salmonella enterica enterica serovar Typhi
uagcgucauccggca

SEQ ID NO: 1661349 - RNA, 18 nt, Salmonella enterica enterica serovar Typhi
uagcguaaagaaaaugag

SEQ ID NO: 1661350 - RNA, 19 nt, Salmonella enterica enterica serovar Typhi
uagcguacuuucaaauagc

SEQ ID NO: 1661351 - RNA, 20 nt, Salmonella enterica enterica serovar Typhi
uagcgcuuacccgaccgaca

SEQ ID NO: 1661352 - RNA, 13 nt, Salmonella enterica enterica serovar Typhi
uagcgcugcgcca

SEQ ID NO: 1661353 - RNA, 15 nt, Salmonella enterica enterica serovar Typhi
uagcgguuugcaaac

SEQ ID NO: 1661354 - RNA, 23 nt, Salmonella enterica enterica serovar Typhi
uagcguuucgaacucuucgcaac

SEQ ID NO: 1661355 - RNA, 19 nt, Salmonella enterica enterica serovar Typhi
uagcuaucacacauaucgc

SEQ ID NO: 1661356 - RNA, 13 nt, Salmonella enterica enterica serovar Typhi
uagauuaaucacu

SEQ ID NO: 1661357 - RNA, 13 nt, Salmonella enterica enterica serovar Typhi
uagcaaaaaagcg

SEQ ID NO: 1661358 - RNA, 18 nt, Salmonella enterica enterica serovar Typhi
uagccuaucaguccgggc

SEQ ID NO: 1661359 - RNA, 19 nt, Salmonella enterica enterica serovar Typhi
uauucgcugacaucgugua

SEQ ID NO: 1661360 - RNA, 14 nt, Salmonella enterica enterica serovar Typhi
uauucguuccgauc

SEQ ID NO: 1661361 - RNA, 20 nt, Salmonella enterica enterica serovar Typhi
uauuccggcaucguacgggc

SEQ ID NO: 1661362 - RNA, 20 nt, Salmonella enterica enterica serovar Typhi
uauugcuuucaauuuccgca

SEQ ID NO: 1661363 - RNA, 21 nt, Salmonella enterica enterica serovar Typhi
uauugcuguaggcacuuucca

SEQ ID NO: 1661364 - RNA, 13 nt, Salmonella enterica enterica serovar Typhi
uauuccgaauacg

SEQ ID NO: 1661365 - RNA, 13 nt, Salmonella enterica enterica serovar Typhi
uauucagcaaaug

SEQ ID NO: 1661366 - RNA, 23 nt, Salmonella enterica enterica serovar Typhi
uauucacgcagcuuauuggcaau

SEQ ID NO: 1661367 - RNA, 19 nt, Salmonella enterica enterica serovar Typhi
uauucaaaauccgccaccg

SEQ ID NO: 1661368 - RNA, 23 nt, Salmonella enterica enterica serovar Typhi
uauucaauaauauuaucauaaug

SEQ ID NO: 1661369 - RNA, 17 nt, Salmonella enterica enterica serovar Typhi
uaugaaguuucauacgg

SEQ ID NO: 1661370 - RNA, 15 nt, Salmonella enterica enterica serovar Typhi
uaugacguaagcggc

SEQ ID NO: 1661371 - RNA, 15 nt, Salmonella enterica enterica serovar Typhi
uauuaaucuuuacac

SEQ ID NO: 1661372 - RNA, 19 nt, Salmonella enterica enterica serovar Typhi
uauguuaacgccgauuaau

SEQ ID NO: 1661373 - RNA, 15 nt, Salmonella enterica enterica serovar Typhi
uauuaaaaagccagc

SEQ ID NO: 1661374 - RNA, 18 nt, Salmonella enterica enterica serovar Typhi
uaucccaaacgucguaaa

SEQ ID NO: 1661375 - RNA, 15 nt, Salmonella enterica enterica serovar Typhi
uauccaccugaucgu

SEQ ID NO: 1661376 - RNA, 15 nt, Salmonella enterica enterica serovar Typhi
uaucauuaucgccaa

SEQ ID NO: 1661377 - RNA, 16 nt, Salmonella enterica enterica serovar Typhi
uaucaugcugcgguua

SEQ ID NO: 1661378 - RNA, 20 nt, Salmonella enterica enterica serovar Typhi
uaucaggaucaaaaucgcgc

SEQ ID NO: 1661379 - RNA, 22 nt, Salmonella enterica enterica serovar Typhi
uaucaccgccgcccguccgcua

SEQ ID NO: 1661380 - RNA, 18 nt, Salmonella enterica enterica serovar Typhi
uaucaauguuuaaaagcg

SEQ ID NO: 1661381 - RNA, 21 nt, Salmonella enterica enterica serovar Typhi
uaucaccagcgauuacgccag

SEQ ID NO: 1661382 - RNA, 17 nt, Salmonella enterica enterica serovar Typhi
uaucccgcccgaucuca

SEQ ID NO: 1661383 - RNA, 13 nt, Salmonella enterica enterica serovar Typhi
uaucccgguauuc

SEQ ID NO: 1661384 - RNA, 13 nt, Salmonella enterica enterica serovar Typhi
uauccggccuacg

SEQ ID NO: 1661385 - RNA, 13 nt, Salmonella enterica enterica serovar Typhi
uauccggccuaca

SEQ ID NO: 1661386 - RNA, 18 nt, Salmonella enterica enterica serovar Typhi
uauccguguggucgcggc

SEQ ID NO: 1661387 - RNA, 15 nt, Salmonella enterica enterica serovar Typhi
uaucguuuacguuau

SEQ ID NO: 1661388 - RNA, 20 nt, Salmonella enterica enterica serovar Typhi
uaugaaauucuugcccgcug

SEQ ID NO: 1661389 - RNA, 20 nt, Salmonella enterica enterica serovar Typhi
uauaaucaaacccuuccgca

SEQ ID NO: 1661390 - RNA, 18 nt, Salmonella enterica enterica serovar Typhi
uauaagcgccgucauccg

SEQ ID NO: 1661391 - RNA, 21 nt, Salmonella enterica enterica serovar Typhi
uaguuucuggccucuuaucag

SEQ ID NO: 1661392 - RNA, 22 nt, Salmonella enterica enterica serovar Typhi
uauaaaacgggccacugcuggc

SEQ ID NO: 1661393 - RNA, 14 nt, Salmonella enterica enterica serovar Typhi
uauaaacucagcaa

SEQ ID NO: 1661394 - RNA, 15 nt, Salmonella enterica enterica serovar Typhi
uauacgguaauaacu

SEQ ID NO: 1661395 - RNA, 18 nt, Salmonella enterica enterica serovar Typhi
uauaccgcuuuaugcgcu

SEQ ID NO: 1661396 - RNA, 15 nt, Salmonella enterica enterica serovar Typhi
uauagacaccuuaua

SEQ ID NO: 1661397 - RNA, 22 nt, Salmonella enterica enterica serovar Typhi
uauagcagucaggaagaccguu

SEQ ID NO: 1661398 - RNA, 21 nt, Salmonella enterica enterica serovar Typhi
uauagcuaucaacaucgcaaa

SEQ ID NO: 1661399 - RNA, 23 nt, Salmonella enterica enterica serovar Typhi
uauauucgcgaugcucaaccagu

SEQ ID NO: 1661400 - RNA, 18 nt, Salmonella enterica enterica serovar Typhi
uauauucagcaaaugcgc

SEQ ID NO: 1661401 - RNA, 15 nt, Salmonella enterica enterica serovar Typhi
uauauuccagccagg

SEQ ID NO: 1661402 - RNA, 17 nt, Salmonella enterica enterica serovar Typhi
uauaugcaaaacuguag

SEQ ID NO: 1661403 - RNA, 19 nt, Salmonella enterica enterica serovar Typhi
uaguuacgcacgccagaua

SEQ ID NO: 1661404 - RNA, 20 nt, Salmonella enterica enterica serovar Typhi
uaguuaccguaaucaucgcg

SEQ ID NO: 1661405 - RNA, 18 nt, Salmonella enterica enterica serovar Typhi
uaguuggcggugaggcug

SEQ ID NO: 1661406 - RNA, 21 nt, Salmonella enterica enterica serovar Typhi
uagugcugcgcaaauacguug

SEQ ID NO: 1661407 - RNA, 14 nt, Salmonella enterica enterica serovar Typhi
uagucgccgguaag

SEQ ID NO: 1661408 - RNA, 20 nt, Salmonella enterica enterica serovar Typhi
uaguccgccagcaccugaua

SEQ ID NO: 1661409 - RNA, 14 nt, Salmonella enterica enterica serovar Typhi
uagucguccgcgcc

SEQ ID NO: 1661410 - RNA, 20 nt, Salmonella enterica enterica serovar Typhi
uaggucggguaaggcguagc

SEQ ID NO: 1661411 - RNA, 16 nt, Salmonella enterica enterica serovar Typhi
uaggguagaucacgcc

SEQ ID NO: 1661412 - RNA, 19 nt, Salmonella enterica enterica serovar Typhi
uaguaccgaacagccaggc

SEQ ID NO: 1661413 - RNA, 15 nt, Salmonella enterica enterica serovar Typhi
uaguaaucaggcgag

SEQ ID NO: 1661414 - RNA, 17 nt, Salmonella enterica enterica serovar Typhi
uagucauauucacggcc

SEQ ID NO: 1661415 - RNA, 20 nt, Salmonella enterica enterica serovar Typhi
uagucaucgccuucauccgc

SEQ ID NO: 1661416 - RNA, 13 nt, Salmonella enterica enterica serovar Typhi
guugaacaauggu

SEQ ID NO: 1661417 - RNA, 18 nt, Salmonella enterica enterica serovar Typhi
guugaacguuuucugagc

SEQ ID NO: 1661418 - RNA, 17 nt, Salmonella enterica enterica serovar Typhi
guugaaccgucaucagc

SEQ ID NO: 1661419 - RNA, 13 nt, Salmonella enterica enterica serovar Typhi
guugacgggcgac

SEQ ID NO: 1661420 - RNA, 19 nt, Salmonella enterica enterica serovar Typhi
guugacuuaaaaagcggau

SEQ ID NO: 1661421 - RNA, 17 nt, Salmonella enterica enterica serovar Typhi
guucgucuuccggauaa

SEQ ID NO: 1661422 - RNA, 13 nt, Salmonella enterica enterica serovar Typhi
guucugacgcgac

SEQ ID NO: 1661423 - RNA, 22 nt, Salmonella enterica enterica serovar Typhi
guugcuuuauaaaaagcacauc

SEQ ID NO: 1661424 - RNA, 18 nt, Salmonella enterica enterica serovar Typhi
guuggcaacgucuugcca

SEQ ID NO: 1661425 - RNA, 11 nt, Salmonella enterica enterica serovar Typhi
guugccuucga

SEQ ID NO: 1661426 - RNA, 18 nt, Salmonella enterica enterica serovar Typhi
guugcggauaugcgucuu

SEQ ID NO: 1661427 - RNA, 18 nt, Salmonella enterica enterica serovar Typhi
guugauugaaacucgcca

SEQ ID NO: 1661428 - RNA, 20 nt, Salmonella enterica enterica serovar Typhi
guugcaucuuaucaggccga

SEQ ID NO: 1661429 - RNA, 21 nt, Salmonella enterica enterica serovar Typhi
guuuccgcuagggcaucagac

SEQ ID NO: 1661430 - RNA, 17 nt, Salmonella enterica enterica serovar Typhi
guuucgccuaagcccac

SEQ ID NO: 1661431 - RNA, 18 nt, Salmonella enterica enterica serovar Typhi
guuuagccugcgcguaaa

SEQ ID NO: 1661432 - RNA, 15 nt, Salmonella enterica enterica serovar Typhi
guuucauauccgaca

SEQ ID NO: 1661433 - RNA, 10 nt, Salmonella enterica enterica serovar Typhi
guuuauccgg

SEQ ID NO: 1661434 - RNA, 20 nt, Salmonella enterica enterica serovar Typhi
guuuacgcugcuauccggca

SEQ ID NO: 1661435 - RNA, 20 nt, Salmonella enterica enterica serovar Typhi
guuuacgccgccauccggca

SEQ ID NO: 1661436 - RNA, 20 nt, Salmonella enterica enterica serovar Typhi
guuuacaccgccauccggca

SEQ ID NO: 1661437 - RNA, 13 nt, Salmonella enterica enterica serovar Typhi
guuucugauagcc

SEQ ID NO: 1661438 - RNA, 15 nt, Salmonella enterica enterica serovar Typhi
guuucguggcgcugu

SEQ ID NO: 1661439 - RNA, 13 nt, Salmonella enterica enterica serovar Typhi
guuugacggcugc

SEQ ID NO: 1661440 - RNA, 15 nt, Salmonella enterica enterica serovar Typhi
guuugaacagcaguu

SEQ ID NO: 1661441 - RNA, 21 nt, Salmonella enterica enterica serovar Typhi
guuugcccaucauucaacgca

SEQ ID NO: 1661442 - RNA, 18 nt, Salmonella enterica enterica serovar Typhi
guuuggacuaccgguaaa

SEQ ID NO: 1661443 - RNA, 15 nt, Salmonella enterica enterica serovar Typhi
guuuugcucaguaac

SEQ ID NO: 1661444 - RNA, 15 nt, Salmonella enterica enterica serovar Typhi
guuuugauguccaga

SEQ ID NO: 1661445 - RNA, 14 nt, Salmonella enterica enterica serovar Typhi
guuuugcagcgcca

SEQ ID NO: 1661446 - RNA, 15 nt, Salmonella enterica enterica serovar Typhi
guuuuggcagcgccc

SEQ ID NO: 1661447 - RNA, 13 nt, Salmonella enterica enterica serovar Typhi
guuuuccagcauc

SEQ ID NO: 1661448 - RNA, 13 nt, Salmonella enterica enterica serovar Typhi
guuuucugagcgg

SEQ ID NO: 1661449 - RNA, 21 nt, Salmonella enterica enterica serovar Typhi
guuuucugagcggucgugcca

SEQ ID NO: 1661450 - RNA, 17 nt, Salmonella enterica enterica serovar Typhi
guuuucuguacagcguc

SEQ ID NO: 1661451 - RNA, 14 nt, Salmonella enterica enterica serovar Typhi
guuuucgccuuugc

SEQ ID NO: 1661452 - RNA, 13 nt, Salmonella enterica enterica serovar Typhi
guuuuaccggcag

SEQ ID NO: 1661453 - RNA, 18 nt, Salmonella enterica enterica serovar Typhi
guuuuaccgcccgacgga

SEQ ID NO: 1661454 - RNA, 17 nt, Salmonella enterica enterica serovar Typhi
guuuuacuuccuguagc

SEQ ID NO: 1661455 - RNA, 18 nt, Salmonella enterica enterica serovar Typhi
guuugucuucugccagca

SEQ ID NO: 1661456 - RNA, 19 nt, Salmonella enterica enterica serovar Typhi
guuuuaauacacgauaaac

SEQ ID NO: 1661457 - RNA, 14 nt, Salmonella enterica enterica serovar Typhi
uacacuucauccgg

SEQ ID NO: 1661458 - RNA, 16 nt, Salmonella enterica enterica serovar Typhi
uacacgcgaauagcca

SEQ ID NO: 1661459 - RNA, 20 nt, Salmonella enterica enterica serovar Typhi
uacaagaauuuaucgcaaua

SEQ ID NO: 1661460 - RNA, 15 nt, Salmonella enterica enterica serovar Typhi
uacagcguguucaug

SEQ ID NO: 1661461 - RNA, 13 nt, Salmonella enterica enterica serovar Typhi
uacaucgcgcuga

SEQ ID NO: 1661462 - RNA, 18 nt, Salmonella enterica enterica serovar Typhi
uacaggcgguaagcgucg

SEQ ID NO: 1661463 - RNA, 17 nt, Salmonella enterica enterica serovar Typhi
uaaugccuguguaucgc

SEQ ID NO: 1661464 - RNA, 21 nt, Salmonella enterica enterica serovar Typhi
uaaugcgcguugccgccaaca

SEQ ID NO: 1661465 - RNA, 20 nt, Salmonella enterica enterica serovar Typhi
uaaugaaaucgucgccaaca

SEQ ID NO: 1661466 - RNA, 12 nt, Salmonella enterica enterica serovar Typhi
uaauggccuaca

SEQ ID NO: 1661467 - RNA, 20 nt, Salmonella enterica enterica serovar Typhi
uaaugcuuauccggccuaca

SEQ ID NO: 1661468 - RNA, 17 nt, Salmonella enterica enterica serovar Typhi
uaauggaacugccuggc

SEQ ID NO: 1661469 - RNA, 11 nt, Salmonella enterica enterica serovar Typhi
uaauuuccacg

SEQ ID NO: 1661470 - RNA, 16 nt, Salmonella enterica enterica serovar Typhi
uaagagcguuacccag

SEQ ID NO: 1661471 - RNA, 23 nt, Salmonella enterica enterica serovar Typhi
uaagagcguuacccagacagcaa

SEQ ID NO: 1661472 - RNA, 18 nt, Salmonella enterica enterica serovar Typhi
uaagaucuuccggcguca

SEQ ID NO: 1661473 - RNA, 23 nt, Salmonella enterica enterica serovar Typhi
uaagacgcuacgcgucgccaucc

SEQ ID NO: 1661474 - RNA, 18 nt, Salmonella enterica enterica serovar Typhi
uaagaccgguacgcaacg

SEQ ID NO: 1661475 - RNA, 23 nt, Salmonella enterica enterica serovar Typhi
uaaggaugaacucuaugcaaaag

SEQ ID NO: 1661476 - RNA, 16 nt, Salmonella enterica enterica serovar Typhi
uaaguaaggaggaauc

SEQ ID NO: 1661477 - RNA, 23 nt, Salmonella enterica enterica serovar Typhi
uaagcuggcguuaaauauaucug

SEQ ID NO: 1661478 - RNA, 19 nt, Salmonella enterica enterica serovar Typhi
uaaucaccagcccgaaucc

SEQ ID NO: 1661479 - RNA, 15 nt, Salmonella enterica enterica serovar Typhi
uaaucaggguaauaa

SEQ ID NO: 1661480 - RNA, 21 nt, Salmonella enterica enterica serovar Typhi
uaaucaggacaucaaaggcag

SEQ ID NO: 1661481 - RNA, 20 nt, Salmonella enterica enterica serovar Typhi
uaaucaggcauucagcgggu

SEQ ID NO: 1661482 - RNA, 13 nt, Salmonella enterica enterica serovar Typhi
uaaucgucauccc

SEQ ID NO: 1661483 - RNA, 14 nt, Salmonella enterica enterica serovar Typhi
uaaucuggccuacg

SEQ ID NO: 1661484 - RNA, 23 nt, Salmonella enterica enterica serovar Typhi
uaaucugccagcuuaaaucgcgg

SEQ ID NO: 1661485 - RNA, 20 nt, Salmonella enterica enterica serovar Typhi
uaauaaccaauaauugccga

SEQ ID NO: 1661486 - RNA, 16 nt, Salmonella enterica enterica serovar Typhi
uaauauucauaacgcc

SEQ ID NO: 1661487 - RNA, 16 nt, Salmonella enterica enterica serovar Typhi
uaauaccgaaauccgc

SEQ ID NO: 1661488 - RNA, 16 nt, Salmonella enterica enterica serovar Typhi
uaacaguucaaacggc

SEQ ID NO: 1661489 - RNA, 18 nt, Salmonella enterica enterica serovar Typhi
uaacaggcaccagcguau

SEQ ID NO: 1661490 - RNA, 17 nt, Salmonella enterica enterica serovar Typhi
uaacauagcuaccgcgc

SEQ ID NO: 1661491 - RNA, 22 nt, Salmonella enterica enterica serovar Typhi
uaacagcgguauacaccagcuc

SEQ ID NO: 1661492 - RNA, 15 nt, Salmonella enterica enterica serovar Typhi
uaacagcagcagcaa

SEQ ID NO: 1661493 - RNA, 17 nt, Salmonella enterica enterica serovar Typhi
uaaauugccugauggcg

SEQ ID NO: 1661494 - RNA, 18 nt, Salmonella enterica enterica serovar Typhi
uaaauuuccgcagccaga

SEQ ID NO: 1661495 - RNA, 12 nt, Salmonella enterica enterica serovar Typhi
uaaauccagcgc

SEQ ID NO: 1661496 - RNA, 16 nt, Salmonella enterica enterica serovar Typhi
uaaauauugauggacg

SEQ ID NO: 1661497 - RNA, 21 nt, Salmonella enterica enterica serovar Typhi
uaaauuaacgcgaauccgcca

SEQ ID NO: 1661498 - RNA, 19 nt, Salmonella enterica enterica serovar Typhi
uaaccgcgccgcuggcguc

SEQ ID NO: 1661499 - RNA, 16 nt, Salmonella enterica enterica serovar Typhi
uaaccgaugcaaccgc

SEQ ID NO: 1661500 - RNA, 14 nt, Salmonella enterica enterica serovar Typhi
uaacccagugcaau

SEQ ID NO: 1661501 - RNA, 16 nt, Salmonella enterica enterica serovar Typhi
uaacguaaauacccag

SEQ ID NO: 1661502 - RNA, 20 nt, Salmonella enterica enterica serovar Typhi
uaacgcguacccggcuuaca

SEQ ID NO: 1661503 - RNA, 20 nt, Salmonella enterica enterica serovar Typhi
uaacgcuuaugcugccuaca

SEQ ID NO: 1661504 - RNA, 13 nt, Salmonella enterica enterica serovar Typhi
uaacgcugcaaag

SEQ ID NO: 1661505 - RNA, 18 nt, Salmonella enterica enterica serovar Typhi
uaacggcgucauccugca

SEQ ID NO: 1661506 - RNA, 19 nt, Salmonella enterica enterica serovar Typhi
uaacggcgccacgcccacg

SEQ ID NO: 1661507 - RNA, 18 nt, Salmonella enterica enterica serovar Typhi
uaacggcgcgaaagcgcc

SEQ ID NO: 1661508 - RNA, 23 nt, Salmonella enterica enterica serovar Typhi
uaacggcugacgcccaucagcau

SEQ ID NO: 1661509 - RNA, 19 nt, Salmonella enterica enterica serovar Typhi
uaaacaccauacgacgauc

SEQ ID NO: 1661510 - RNA, 15 nt, Salmonella enterica enterica serovar Typhi
uaaaauugaacggac

SEQ ID NO: 1661511 - RNA, 23 nt, Salmonella enterica enterica serovar Typhi
uaaacgcuccggcaggcaaaucu

SEQ ID NO: 1661512 - RNA, 14 nt, Salmonella enterica enterica serovar Typhi
uaaacgccagugga

SEQ ID NO: 1661513 - RNA, 18 nt, Salmonella enterica enterica serovar Typhi
uaaacgccaguggaugcg

SEQ ID NO: 1661514 - RNA, 18 nt, Salmonella enterica enterica serovar Typhi
uaaagcggucuuucaaca

SEQ ID NO: 1661515 - RNA, 13 nt, Salmonella enterica enterica serovar Typhi
uaaaggcgaaacc

SEQ ID NO: 1661516 - RNA, 21 nt, Salmonella enterica enterica serovar Typhi
uaaagcccgucccuuccgcca

SEQ ID NO: 1661517 - RNA, 16 nt, Salmonella enterica enterica serovar Typhi
uaaacggcagccgcca

SEQ ID NO: 1661518 - RNA, 18 nt, Salmonella enterica enterica serovar Typhi
uaaacgggcagagucgau

SEQ ID NO: 1661519 - RNA, 22 nt, Salmonella enterica enterica serovar Typhi
uaaacgggguaaacuucacguc

SEQ ID NO: 1661520 - RNA, 13 nt, Salmonella enterica enterica serovar Typhi
uaaaauggacauu

SEQ ID NO: 1661521 - RNA, 19 nt, Salmonella enterica enterica serovar Typhi
uaaaaugaccgucgaccag

SEQ ID NO: 1661522 - RNA, 19 nt, Salmonella enterica enterica serovar Typhi
uaaaacgcgcccaacggau

SEQ ID NO: 1661523 - RNA, 21 nt, Salmonella enterica enterica serovar Typhi
uaaaacuucccgcgcagugca

SEQ ID NO: 1661524 - RNA, 18 nt, Salmonella enterica enterica serovar Typhi
uaaaacauuccugacauu

SEQ ID NO: 1661525 - RNA, 16 nt, Salmonella enterica enterica serovar Typhi
guuuuuccccaucaug

SEQ ID NO: 1661526 - RNA, 16 nt, Salmonella enterica enterica serovar Typhi
uaaaaaacaggcgcag

SEQ ID NO: 1661527 - RNA, 20 nt, Salmonella enterica enterica serovar Typhi
guccgcauucuugccgcauc

SEQ ID NO: 1661528 - RNA, 18 nt, Salmonella enterica enterica serovar Typhi
gucgcagaugagcgguaa

SEQ ID NO: 1661529 - RNA, 17 nt, Salmonella enterica enterica serovar Typhi
gucgaugauuuucaagc

SEQ ID NO: 1661530 - RNA, 23 nt, Salmonella enterica enterica serovar Typhi
gucggcaauuaacauuucacgau

SEQ ID NO: 1661531 - RNA, 19 nt, Salmonella enterica enterica serovar Typhi
gucgcggauaugcagcagc

SEQ ID NO: 1661532 - RNA, 22 nt, Salmonella enterica enterica serovar Typhi
gucgcggcaucguagucaggca

SEQ ID NO: 1661533 - RNA, 14 nt, Salmonella enterica enterica serovar Typhi
gucgcgucagguuu

SEQ ID NO: 1661534 - RNA, 14 nt, Salmonella enterica enterica serovar Typhi
gucgcguagcgaug

SEQ ID NO: 1661535 - RNA, 15 nt, Salmonella enterica enterica serovar Typhi
gucgcgguuaaggau

SEQ ID NO: 1661536 - RNA, 20 nt, Salmonella enterica enterica serovar Typhi
gucgcgccauguugcguaaa

SEQ ID NO: 1661537 - RNA, 20 nt, Salmonella enterica enterica serovar Typhi
gucgcgcuuucaaucgucag

SEQ ID NO: 1661538 - RNA, 12 nt, Salmonella enterica enterica serovar Typhi
gucgcgcuuacg

SEQ ID NO: 1661539 - RNA, 22 nt, Salmonella enterica enterica serovar Typhi
gucggcgccggcgucgaucagc

SEQ ID NO: 1661540 - RNA, 18 nt, Salmonella enterica enterica serovar Typhi
gucggcgcccagcuuacg

SEQ ID NO: 1661541 - RNA, 15 nt, Salmonella enterica enterica serovar Typhi
gucgggccaaucgga

SEQ ID NO: 1661542 - RNA, 21 nt, Salmonella enterica enterica serovar Typhi
gucggcguugcgcccaggcca

SEQ ID NO: 1661543 - RNA, 13 nt, Salmonella enterica enterica serovar Typhi
gucuauaggccug

SEQ ID NO: 1661544 - RNA, 15 nt, Salmonella enterica enterica serovar Typhi
gucuauugccuaaau

SEQ ID NO: 1661545 - RNA, 20 nt, Salmonella enterica enterica serovar Typhi
gucguuguaguuaucgccga

SEQ ID NO: 1661546 - RNA, 19 nt, Salmonella enterica enterica serovar Typhi
gucguuguaguuaucgccg

SEQ ID NO: 1661547 - RNA, 14 nt, Salmonella enterica enterica serovar Typhi
gucguuucuacaau

SEQ ID NO: 1661548 - RNA, 14 nt, Salmonella enterica enterica serovar Typhi
gucguggcgaucag

SEQ ID NO: 1661549 - RNA, 14 nt, Salmonella enterica enterica serovar Typhi
gucuccgccuggaa

SEQ ID NO: 1661550 - RNA, 22 nt, Salmonella enterica enterica serovar Typhi
gucucccgugacguuuugcgcg

SEQ ID NO: 1661551 - RNA, 18 nt, Salmonella enterica enterica serovar Typhi
gucucucgugcaggccgg

SEQ ID NO: 1661552 - RNA, 15 nt, Salmonella enterica enterica serovar Typhi
gucuccucagcaggc

SEQ ID NO: 1661553 - RNA, 16 nt, Salmonella enterica enterica serovar Typhi
gucugaaaacucacgc

SEQ ID NO: 1661554 - RNA, 13 nt, Salmonella enterica enterica serovar Typhi
gucuuugcugccg

SEQ ID NO: 1661555 - RNA, 17 nt, Salmonella enterica enterica serovar Typhi
gucuuuguugccuucga

SEQ ID NO: 1661556 - RNA, 16 nt, Salmonella enterica enterica serovar Typhi
gugaaacguguuuauc

SEQ ID NO: 1661557 - RNA, 22 nt, Salmonella enterica enterica serovar Typhi
gucuuaaacagcgaucacgccg

SEQ ID NO: 1661558 - RNA, 22 nt, Salmonella enterica enterica serovar Typhi
gucuguaccaccagaaucgcca

SEQ ID NO: 1661559 - RNA, 16 nt, Salmonella enterica enterica serovar Typhi
gucuucgaccgccaua

SEQ ID NO: 1661560 - RNA, 22 nt, Salmonella enterica enterica serovar Typhi
guggauaguguucgcggcuggu

SEQ ID NO: 1661561 - RNA, 22 nt, Salmonella enterica enterica serovar Typhi
guggcaacgcuggcggcguccg

SEQ ID NO: 1661562 - RNA, 13 nt, Salmonella enterica enterica serovar Typhi
guggaaggcauua

SEQ ID NO: 1661563 - RNA, 21 nt, Salmonella enterica enterica serovar Typhi
guggcgagauaagccgucaua

SEQ ID NO: 1661564 - RNA, 22 nt, Salmonella enterica enterica serovar Typhi
guggcgacgccuauucucgccg

SEQ ID NO: 1661565 - RNA, 14 nt, Salmonella enterica enterica serovar Typhi
guggccgacuuauc

SEQ ID NO: 1661566 - RNA, 19 nt, Salmonella enterica enterica serovar Typhi
guggcaccugcuguaucac

SEQ ID NO: 1661567 - RNA, 20 nt, Salmonella enterica enterica serovar Typhi
guggcugaggccgcucgcca

SEQ ID NO: 1661568 - RNA, 23 nt, Salmonella enterica enterica serovar Typhi
guggcgcugcgcuuaccgggccu

SEQ ID NO: 1661569 - RNA, 19 nt, Salmonella enterica enterica serovar Typhi
guggcgcugugcuuacucg

SEQ ID NO: 1661570 - RNA, 18 nt, Salmonella enterica enterica serovar Typhi
guggcgcuucgcuuaccg

SEQ ID NO: 1661571 - RNA, 19 nt, Salmonella enterica enterica serovar Typhi
guggcgcuagcgcuuaccc

SEQ ID NO: 1661572 - RNA, 18 nt, Salmonella enterica enterica serovar Typhi
guggcgcaaccgauagcu

SEQ ID NO: 1661573 - RNA, 17 nt, Salmonella enterica enterica serovar Typhi
gugguaggcuucaaccg

SEQ ID NO: 1661574 - RNA, 16 nt, Salmonella enterica enterica serovar Typhi
guggguuccagcgcca

SEQ ID NO: 1661575 - RNA, 20 nt, Salmonella enterica enterica serovar Typhi
guggucgucagccgugagca

SEQ ID NO: 1661576 - RNA, 21 nt, Salmonella enterica enterica serovar Typhi
guggucauuuuacugcguaau

SEQ ID NO: 1661577 - RNA, 18 nt, Salmonella enterica enterica serovar Typhi
guggucaucgcggccagc

SEQ ID NO: 1661578 - RNA, 18 nt, Salmonella enterica enterica serovar Typhi
gugcgccagccuuauccc

SEQ ID NO: 1661579 - RNA, 15 nt, Salmonella enterica enterica serovar Typhi
gugccugcgcuuacg

SEQ ID NO: 1661580 - RNA, 16 nt, Salmonella enterica enterica serovar Typhi
gugccuguguucgugg

SEQ ID NO: 1661581 - RNA, 20 nt, Salmonella enterica enterica serovar Typhi
gugcggugguauagaauacu

SEQ ID NO: 1661582 - RNA, 14 nt, Salmonella enterica enterica serovar Typhi
gugaugcaucagaa

SEQ ID NO: 1661583 - RNA, 18 nt, Salmonella enterica enterica serovar Typhi
gugaugccaaacaucgcu

SEQ ID NO: 1661584 - RNA, 16 nt, Salmonella enterica enterica serovar Typhi
gugaaccauggcaaca

SEQ ID NO: 1661585 - RNA, 13 nt, Salmonella enterica enterica serovar Typhi
gugaaccgguaaa

SEQ ID NO: 1661586 - RNA, 14 nt, Salmonella enterica enterica serovar Typhi
gugaaccagcaucc

SEQ ID NO: 1661587 - RNA, 19 nt, Salmonella enterica enterica serovar Typhi
gugcauaaagauuggcauc

SEQ ID NO: 1661588 - RNA, 15 nt, Salmonella enterica enterica serovar Typhi
gugcauaaccgcgcc

SEQ ID NO: 1661589 - RNA, 13 nt, Salmonella enterica enterica serovar Typhi
gugcaucggcaca

SEQ ID NO: 1661590 - RNA, 22 nt, Salmonella enterica enterica serovar Typhi
gugcaugggauacgccagcaga

SEQ ID NO: 1661591 - RNA, 23 nt, Salmonella enterica enterica serovar Typhi
gugccauccauauugagcgguag

SEQ ID NO: 1661592 - RNA, 16 nt, Salmonella enterica enterica serovar Typhi
gucaucaccuccagca

SEQ ID NO: 1661593 - RNA, 20 nt, Salmonella enterica enterica serovar Typhi
gucauaucugaugcucgccg

SEQ ID NO: 1661594 - RNA, 18 nt, Salmonella enterica enterica serovar Typhi
gucaucaucaaguaccgu

SEQ ID NO: 1661595 - RNA, 17 nt, Salmonella enterica enterica serovar Typhi
gucauccgguucaccca

SEQ ID NO: 1661596 - RNA, 19 nt, Salmonella enterica enterica serovar Typhi
gucauccgguucauaaucc

SEQ ID NO: 1661597 - RNA, 16 nt, Salmonella enterica enterica serovar Typhi
gucauccggcaagcgc

SEQ ID NO: 1661598 - RNA, 16 nt, Salmonella enterica enterica serovar Typhi
gucaucgcaaauucug

SEQ ID NO: 1661599 - RNA, 17 nt, Salmonella enterica enterica serovar Typhi
gucauuuucuuucauca

SEQ ID NO: 1661600 - RNA, 12 nt, Salmonella enterica enterica serovar Typhi
gucauuaaaaug

SEQ ID NO: 1661601 - RNA, 13 nt, Salmonella enterica enterica serovar Typhi
gucaucggcguug

SEQ ID NO: 1661602 - RNA, 14 nt, Salmonella enterica enterica serovar Typhi
gucagcgcgagcgu

SEQ ID NO: 1661603 - RNA, 22 nt, Salmonella enterica enterica serovar Typhi
gucagcucgguggcgguaucaa

SEQ ID NO: 1661604 - RNA, 16 nt, Salmonella enterica enterica serovar Typhi
gucaggagccaccggc

SEQ ID NO: 1661605 - RNA, 21 nt, Salmonella enterica enterica serovar Typhi
gucagggcgcggcgcaacuuu

SEQ ID NO: 1661606 - RNA, 21 nt, Salmonella enterica enterica serovar Typhi
gucaguacgcccgugacgcca

SEQ ID NO: 1661607 - RNA, 20 nt, Salmonella enterica enterica serovar Typhi
guccaacuggcuuucaucca

SEQ ID NO: 1661608 - RNA, 17 nt, Salmonella enterica enterica serovar Typhi
guccacauccagcgcca

SEQ ID NO: 1661609 - RNA, 17 nt, Salmonella enterica enterica serovar Typhi
guccacaccguuacgac

SEQ ID NO: 1661610 - RNA, 20 nt, Salmonella enterica enterica serovar Typhi
gucccaccagcgcggcacac

SEQ ID NO: 1661611 - RNA, 15 nt, Salmonella enterica enterica serovar Typhi
guccagcgcggguuc

SEQ ID NO: 1661612 - RNA, 19 nt, Salmonella enterica enterica serovar Typhi
guaucuccugaaacccgcc

SEQ ID NO: 1661613 - RNA, 16 nt, Salmonella enterica enterica serovar Typhi
guauuaaggcagccau

SEQ ID NO: 1661614 - RNA, 15 nt, Salmonella enterica enterica serovar Typhi
guaucgcgccgccaa

SEQ ID NO: 1661615 - RNA, 23 nt, Salmonella enterica enterica serovar Typhi
guaucgccggcagacgauagcgg

SEQ ID NO: 1661616 - RNA, 21 nt, Salmonella enterica enterica serovar Typhi
guagggcugccaucaggcagu

SEQ ID NO: 1661617 - RNA, 17 nt, Salmonella enterica enterica serovar Typhi
gucaacuuaaacguucg

SEQ ID NO: 1661618 - RNA, 22 nt, Salmonella enterica enterica serovar Typhi
gucaaacaguuccugugcggaa

SEQ ID NO: 1661619 - RNA, 16 nt, Salmonella enterica enterica serovar Typhi
guauuuuuuagcgcca

SEQ ID NO: 1661620 - RNA, 16 nt, Salmonella enterica enterica serovar Typhi
guauuucgcagcgguc

SEQ ID NO: 1661621 - RNA, 18 nt, Salmonella enterica enterica serovar Typhi
guauucucccgucagcaa

SEQ ID NO: 1661622 - RNA, 17 nt, Salmonella enterica enterica serovar Typhi
gucaaugccuggcagac

SEQ ID NO: 1661623 - RNA, 14 nt, Salmonella enterica enterica serovar Typhi
gucaccaugacgca

SEQ ID NO: 1661624 - RNA, 13 nt, Salmonella enterica enterica serovar Typhi
gucacgauagcgc

SEQ ID NO: 1661625 - RNA, 16 nt, Salmonella enterica enterica serovar Typhi
gucacgauagcgccgg

SEQ ID NO: 1661626 - RNA, 17 nt, Salmonella enterica enterica serovar Typhi
gucaccucuuucgccgc

SEQ ID NO: 1661627 - RNA, 15 nt, Salmonella enterica enterica serovar Typhi
gucaccugauagcgg

SEQ ID NO: 1661628 - RNA, 14 nt, Salmonella enterica enterica serovar Typhi
gucagcagcaccgg

SEQ ID NO: 1661629 - RNA, 17 nt, Salmonella enterica enterica serovar Typhi
gucacguucgucgccgg

SEQ ID NO: 1661630 - RNA, 20 nt, Salmonella enterica enterica serovar Typhi
gucacugaccggcguuuuua

SEQ ID NO: 1661631 - RNA, 13 nt, Salmonella enterica enterica serovar Typhi
gucagcgcauacc

SEQ ID NO: 1661632 - RNA, 16 nt, Salmonella enterica enterica serovar Typhi
guagcgucucaucaaa

SEQ ID NO: 1661633 - RNA, 16 nt, Salmonella enterica enterica serovar Typhi
guagcugagcgucagg

SEQ ID NO: 1661634 - RNA, 15 nt, Salmonella enterica enterica serovar Typhi
guaggccggaucagg

SEQ ID NO: 1661635 - RNA, 20 nt, Salmonella enterica enterica serovar Typhi
guaggccggauaaggcguuu

SEQ ID NO: 1661636 - RNA, 18 nt, Salmonella enterica enterica serovar Typhi
guaggccggauaaggcau

SEQ ID NO: 1661637 - RNA, 18 nt, Salmonella enterica enterica serovar Typhi
guaggccggauaaggcgu

SEQ ID NO: 1661638 - RNA, 16 nt, Salmonella enterica enterica serovar Typhi
guacgggcaaagcgac

SEQ ID NO: 1661639 - RNA, 13 nt, Salmonella enterica enterica serovar Typhi
guacggcgcgaau

SEQ ID NO: 1661640 - RNA, 22 nt, Salmonella enterica enterica serovar Typhi
guaaucacaucauuaaagcgcu

SEQ ID NO: 1661641 - RNA, 19 nt, Salmonella enterica enterica serovar Typhi
guaaugaccacaccgucaa

SEQ ID NO: 1661642 - RNA, 20 nt, Salmonella enterica enterica serovar Typhi
guaaucgaucccgccgcauc

SEQ ID NO: 1661643 - RNA, 11 nt, Salmonella enterica enterica serovar Typhi
guaauccggca

SEQ ID NO: 1661644 - RNA, 22 nt, Salmonella enterica enterica serovar Typhi
guaauccccauaugauugagcg

SEQ ID NO: 1661645 - RNA, 20 nt, Salmonella enterica enterica serovar Typhi
guaaucaucgcgaucgccaa

SEQ ID NO: 1661646 - RNA, 14 nt, Salmonella enterica enterica serovar Typhi
guaagucgaccagu

SEQ ID NO: 1661647 - RNA, 15 nt, Salmonella enterica enterica serovar Typhi
guaagcgcagcgcca

SEQ ID NO: 1661648 - RNA, 21 nt, Salmonella enterica enterica serovar Typhi
guaagcgccugcugcgcaaca

SEQ ID NO: 1661649 - RNA, 19 nt, Salmonella enterica enterica serovar Typhi
guaagcggcggaccagcgu

SEQ ID NO: 1661650 - RNA, 13 nt, Salmonella enterica enterica serovar Typhi
guaaggcagcgau

SEQ ID NO: 1661651 - RNA, 15 nt, Salmonella enterica enterica serovar Typhi
guaauaaagcguagc

SEQ ID NO: 1661652 - RNA, 18 nt, Salmonella enterica enterica serovar Typhi
guaaucaauagcguuaua

SEQ ID NO: 1661653 - RNA, 13 nt, Salmonella enterica enterica serovar Typhi
guagaucacgcca

SEQ ID NO: 1661654 - RNA, 14 nt, Salmonella enterica enterica serovar Typhi
guagaccgcaucga

SEQ ID NO: 1661655 - RNA, 15 nt, Salmonella enterica enterica serovar Typhi
ggugcgacaccacgc

SEQ ID NO: 1661656 - RNA, 17 nt, Salmonella enterica enterica serovar Typhi
gguuugagcaccacgcg

SEQ ID NO: 1661657 - RNA, 15 nt, Salmonella enterica enterica serovar Typhi
gguuugaccagauaa

SEQ ID NO: 1661658 - RNA, 20 nt, Salmonella enterica enterica serovar Typhi
gguuucugaauagaaagucg

SEQ ID NO: 1661659 - RNA, 21 nt, Salmonella enterica enterica serovar Typhi
gguuuauccgcagauccagca

SEQ ID NO: 1661660 - RNA, 20 nt, Salmonella enterica enterica serovar Typhi
gguugcgcccuuccgucagc

SEQ ID NO: 1661661 - RNA, 18 nt, Salmonella enterica enterica serovar Typhi
guaaagcaccaucgcaaa

SEQ ID NO: 1661662 - RNA, 11 nt, Salmonella enterica enterica serovar Typhi
guaaagcgcca

SEQ ID NO: 1661663 - RNA, 12 nt, Salmonella enterica enterica serovar Typhi
guaaagcgccau

SEQ ID NO: 1661664 - RNA, 17 nt, Salmonella enterica enterica serovar Typhi
guaacaucaaguacagc

SEQ ID NO: 1661665 - RNA, 15 nt, Salmonella enterica enterica serovar Typhi
guaaccgccacagca

SEQ ID NO: 1661666 - RNA, 16 nt, Salmonella enterica enterica serovar Typhi
guaaccagucguuauc

SEQ ID NO: 1661667 - RNA, 12 nt, Salmonella enterica enterica serovar Typhi
guaaaaucagcg

SEQ ID NO: 1661668 - RNA, 19 nt, Salmonella enterica enterica serovar Typhi
guaaacaccuuauccggcc

SEQ ID NO: 1661669 - RNA, 16 nt, Salmonella enterica enterica serovar Typhi
guaaacacucaggcag

SEQ ID NO: 1661670 - RNA, 22 nt, Salmonella enterica enterica serovar Typhi
guaaagauuuguuucaucgccu

SEQ ID NO: 1661671 - RNA, 16 nt, Salmonella enterica enterica serovar Typhi
guaaacguuccugcca

SEQ ID NO: 1661672 - RNA, 19 nt, Salmonella enterica enterica serovar Typhi
guaaacucacccaggcgau

SEQ ID NO: 1661673 - RNA, 16 nt, Salmonella enterica enterica serovar Typhi
guaaacuuccgccagc

SEQ ID NO: 1661674 - RNA, 15 nt, Salmonella enterica enterica serovar Typhi
guaaacgcgaccagc

SEQ ID NO: 1661675 - RNA, 21 nt, Salmonella enterica enterica serovar Typhi
guaaaccucuuuggcgcgaac

SEQ ID NO: 1661676 - RNA, 23 nt, Salmonella enterica enterica serovar Typhi
gguuaucgcuugguauggcgcua

SEQ ID NO: 1661677 - RNA, 16 nt, Salmonella enterica enterica serovar Typhi
gguuaucgaauccagc

SEQ ID NO: 1661678 - RNA, 19 nt, Salmonella enterica enterica serovar Typhi
gguuauucgccuuucacgc

SEQ ID NO: 1661679 - RNA, 22 nt, Salmonella enterica enterica serovar Typhi
gguuaucuggcgcaaccggcgu

SEQ ID NO: 1661680 - RNA, 13 nt, Salmonella enterica enterica serovar Typhi
gguucauccagca

SEQ ID NO: 1661681 - RNA, 23 nt, Salmonella enterica enterica serovar Typhi
ggugugguacggcuuucacaccg

SEQ ID NO: 1661682 - RNA, 17 nt, Salmonella enterica enterica serovar Typhi
gguucucugccaucauc

SEQ ID NO: 1661683 - RNA, 20 nt, Salmonella enterica enterica serovar Typhi
gguucugcgaggugauagcc

SEQ ID NO: 1661684 - RNA, 16 nt, Salmonella enterica enterica serovar Typhi
gguugcaauuccgcca

SEQ ID NO: 1661685 - RNA, 23 nt, Salmonella enterica enterica serovar Typhi
ggucucucgugcaggccggauaa

SEQ ID NO: 1661686 - RNA, 22 nt, Salmonella enterica enterica serovar Typhi
ggucggcguugcgcccaggcca

SEQ ID NO: 1661687 - RNA, 21 nt, Salmonella enterica enterica serovar Typhi
ggugaccaggcuucaucggau

SEQ ID NO: 1661688 - RNA, 22 nt, Salmonella enterica enterica serovar Typhi
ggugaaaaaagccggacgggcg

SEQ ID NO: 1661689 - RNA, 23 nt, Salmonella enterica enterica serovar Typhi
ggugaugacgcgcaggccgucaa

SEQ ID NO: 1661690 - RNA, 14 nt, Salmonella enterica enterica serovar Typhi
ggugaucugcgccg

SEQ ID NO: 1661691 - RNA, 23 nt, Salmonella enterica enterica serovar Typhi
ggugcaagcaccuuauccggccu

SEQ ID NO: 1661692 - RNA, 15 nt, Salmonella enterica enterica serovar Typhi
ggugcauuccgcgca

SEQ ID NO: 1661693 - RNA, 19 nt, Salmonella enterica enterica serovar Typhi
ggucagcucacgcgccagc

SEQ ID NO: 1661694 - RNA, 15 nt, Salmonella enterica enterica serovar Typhi
ggucauuuuacugcg

SEQ ID NO: 1661695 - RNA, 17 nt, Salmonella enterica enterica serovar Typhi
ggucauuauucaggccu

SEQ ID NO: 1661696 - RNA, 22 nt, Salmonella enterica enterica serovar Typhi
ggucgcgccaaaagaggcagca

SEQ ID NO: 1661697 - RNA, 14 nt, Salmonella enterica enterica serovar Typhi
ggcgacuuucacga

SEQ ID NO: 1661698 - RNA, 22 nt, Salmonella enterica enterica serovar Typhi
ggcgagaacucgucuuauccga

SEQ ID NO: 1661699 - RNA, 19 nt, Salmonella enterica enterica serovar Typhi
ggcgacuaccucuuauccg

SEQ ID NO: 1661700 - RNA, 17 nt, Salmonella enterica enterica serovar Typhi
ggcgacuggaacaggcc

SEQ ID NO: 1661701 - RNA, 23 nt, Salmonella enterica enterica serovar Typhi
ggcgacuaacgucuuauccggcc

SEQ ID NO: 1661702 - RNA, 17 nt, Salmonella enterica enterica serovar Typhi
ggcgacgaucagcgcca

SEQ ID NO: 1661703 - RNA, 15 nt, Salmonella enterica enterica serovar Typhi
ggcgacgcuuucacc

SEQ ID NO: 1661704 - RNA, 20 nt, Salmonella enterica enterica serovar Typhi
ggcgaccaggaauuuaccgg

SEQ ID NO: 1661705 - RNA, 14 nt, Salmonella enterica enterica serovar Typhi
ggcgaccagcagau

SEQ ID NO: 1661706 - RNA, 17 nt, Salmonella enterica enterica serovar Typhi
ggcgaccaguuauucgg

SEQ ID NO: 1661707 - RNA, 20 nt, Salmonella enterica enterica serovar Typhi
ggcgaccuucacgccgccaa

SEQ ID NO: 1661708 - RNA, 21 nt, Salmonella enterica enterica serovar Typhi
ggcgacaggcgcuuaucgccg

SEQ ID NO: 1661709 - RNA, 13 nt, Salmonella enterica enterica serovar Typhi
ggcgacaucgcca

SEQ ID NO: 1661710 - RNA, 20 nt, Salmonella enterica enterica serovar Typhi
ggcgaacaggcucagcgcca

SEQ ID NO: 1661711 - RNA, 14 nt, Salmonella enterica enterica serovar Typhi
ggcgaacagcccca

SEQ ID NO: 1661712 - RNA, 16 nt, Salmonella enterica enterica serovar Typhi
ggcgagcuuuucgccg

SEQ ID NO: 1661713 - RNA, 18 nt, Salmonella enterica enterica serovar Typhi
ggcgagguuuaccguccg

SEQ ID NO: 1661714 - RNA, 21 nt, Salmonella enterica enterica serovar Typhi
ggcgauaccgguacggaacgu

SEQ ID NO: 1661715 - RNA, 22 nt, Salmonella enterica enterica serovar Typhi
ggcgaguuucugcucgaccguc

SEQ ID NO: 1661716 - RNA, 18 nt, Salmonella enterica enterica serovar Typhi
ggcgauaaaccagcccca

SEQ ID NO: 1661717 - RNA, 18 nt, Salmonella enterica enterica serovar Typhi
ggcgauaaccucucaccg

SEQ ID NO: 1661718 - RNA, 12 nt, Salmonella enterica enterica serovar Typhi
ggcgaucgcaca

SEQ ID NO: 1661719 - RNA, 15 nt, Salmonella enterica enterica serovar Typhi
ggcgauuuccagcgc

SEQ ID NO: 1661720 - RNA, 17 nt, Salmonella enterica enterica serovar Typhi
ggcgauuuccagcgccg

SEQ ID NO: 1661721 - RNA, 13 nt, Salmonella enterica enterica serovar Typhi
ggcgauuuucacc

SEQ ID NO: 1661722 - RNA, 17 nt, Salmonella enterica enterica serovar Typhi
ggcgcacauuuacgcca

SEQ ID NO: 1661723 - RNA, 11 nt, Salmonella enterica enterica serovar Typhi
ggcgcaaaucg

SEQ ID NO: 1661724 - RNA, 23 nt, Salmonella enterica enterica serovar Typhi
ggccggauaagacgcuacgcguc

SEQ ID NO: 1661725 - RNA, 14 nt, Salmonella enterica enterica serovar Typhi
ggccgcguuaucgg

SEQ ID NO: 1661726 - RNA, 19 nt, Salmonella enterica enterica serovar Typhi
ggccggauaaggcguaacc

SEQ ID NO: 1661727 - RNA, 20 nt, Salmonella enterica enterica serovar Typhi
ggccggauagggcguaacac

SEQ ID NO: 1661728 - RNA, 19 nt, Salmonella enterica enterica serovar Typhi
ggccggauaagcggcagcg

SEQ ID NO: 1661729 - RNA, 23 nt, Salmonella enterica enterica serovar Typhi
ggccugaugcgcguuuagcgcca

SEQ ID NO: 1661730 - RNA, 17 nt, Salmonella enterica enterica serovar Typhi
ggccugcaaaccgccuc

SEQ ID NO: 1661731 - RNA, 21 nt, Salmonella enterica enterica serovar Typhi
ggccugauaagcgcagcgcca

SEQ ID NO: 1661732 - RNA, 22 nt, Salmonella enterica enterica serovar Typhi
ggccugauaagcgcagcgccau

SEQ ID NO: 1661733 - RNA, 18 nt, Salmonella enterica enterica serovar Typhi
ggccuugaaguuauccag

SEQ ID NO: 1661734 - RNA, 23 nt, Salmonella enterica enterica serovar Typhi
ggccuugaaguuauccagcgccc

SEQ ID NO: 1661735 - RNA, 14 nt, Salmonella enterica enterica serovar Typhi
ggccuuauccggcc

SEQ ID NO: 1661736 - RNA, 16 nt, Salmonella enterica enterica serovar Typhi
ggccuuauuuuucagc

SEQ ID NO: 1661737 - RNA, 19 nt, Salmonella enterica enterica serovar Typhi
ggccuauagcuaauggcuu

SEQ ID NO: 1661738 - RNA, 21 nt, Salmonella enterica enterica serovar Typhi
ggauguccugcggacgcagcu

SEQ ID NO: 1661739 - RNA, 18 nt, Salmonella enterica enterica serovar Typhi
ggcagauaucgcugacca

SEQ ID NO: 1661740 - RNA, 13 nt, Salmonella enterica enterica serovar Typhi
ggcaggcaaaucu

SEQ ID NO: 1661741 - RNA, 19 nt, Salmonella enterica enterica serovar Typhi
ggcauaaaaaagaggaaug

SEQ ID NO: 1661742 - RNA, 17 nt, Salmonella enterica enterica serovar Typhi
ggcaguaaagaucuggc

SEQ ID NO: 1661743 - RNA, 13 nt, Salmonella enterica enterica serovar Typhi
ggcagugcauaaa

SEQ ID NO: 1661744 - RNA, 16 nt, Salmonella enterica enterica serovar Typhi
ggcagccguuuuccgg

SEQ ID NO: 1661745 - RNA, 16 nt, Salmonella enterica enterica serovar Typhi
ggccaaccugccgaug

SEQ ID NO: 1661746 - RNA, 15 nt, Salmonella enterica enterica serovar Typhi
ggccaagcagcgcca

SEQ ID NO: 1661747 - RNA, 13 nt, Salmonella enterica enterica serovar Typhi
ggccacagcgcca

SEQ ID NO: 1661748 - RNA, 23 nt, Salmonella enterica enterica serovar Typhi
ggcauauggauauucaucgccgu

SEQ ID NO: 1661749 - RNA, 15 nt, Salmonella enterica enterica serovar Typhi
ggcauggcagcaggg

SEQ ID NO: 1661750 - RNA, 22 nt, Salmonella enterica enterica serovar Typhi
ggcaucaagcauaaaccggcgg

SEQ ID NO: 1661751 - RNA, 18 nt, Salmonella enterica enterica serovar Typhi
ggcauuaugggcgugcug

SEQ ID NO: 1661752 - RNA, 14 nt, Salmonella enterica enterica serovar Typhi
ggcauucacgccac

SEQ ID NO: 1661753 - RNA, 15 nt, Salmonella enterica enterica serovar Typhi
ggccaccagcgccag

SEQ ID NO: 1661754 - RNA, 14 nt, Salmonella enterica enterica serovar Typhi
ggccaccagcgcca

SEQ ID NO: 1661755 - RNA, 22 nt, Salmonella enterica enterica serovar Typhi
ggccagauauugccgaccauua

SEQ ID NO: 1661756 - RNA, 19 nt, Salmonella enterica enterica serovar Typhi
ggccagauggcaaacggua

SEQ ID NO: 1661757 - RNA, 18 nt, Salmonella enterica enterica serovar Typhi
ggccaugaucgccgccau

SEQ ID NO: 1661758 - RNA, 18 nt, Salmonella enterica enterica serovar Typhi
ggccaucuuccagcauca

SEQ ID NO: 1661759 - RNA, 15 nt, Salmonella enterica enterica serovar Typhi
ggccauuaccgcccu

SEQ ID NO: 1661760 - RNA, 20 nt, Salmonella enterica enterica serovar Typhi
ggccaguaucgcgccgccaa

SEQ ID NO: 1661761 - RNA, 19 nt, Salmonella enterica enterica serovar Typhi
ggccgagaguccagcgcca

SEQ ID NO: 1661762 - RNA, 16 nt, Salmonella enterica enterica serovar Typhi
ggcggcuuucagcgua

SEQ ID NO: 1661763 - RNA, 15 nt, Salmonella enterica enterica serovar Typhi
ggcggcguuuuccgg

SEQ ID NO: 1661764 - RNA, 23 nt, Salmonella enterica enterica serovar Typhi
ggcggcgugaacgucuuauccgg

SEQ ID NO: 1661765 - RNA, 23 nt, Salmonella enterica enterica serovar Typhi
ggcggcguaaacacguuaucuga

SEQ ID NO: 1661766 - RNA, 11 nt, Salmonella enterica enterica serovar Typhi
ggcggcgggaa

SEQ ID NO: 1661767 - RNA, 23 nt, Salmonella enterica enterica serovar Typhi
ggcggcgcgaacgccuuauccgg

SEQ ID NO: 1661768 - RNA, 18 nt, Salmonella enterica enterica serovar Typhi
ggcggcaaggucugcgcc

SEQ ID NO: 1661769 - RNA, 12 nt, Salmonella enterica enterica serovar Typhi
ggcggcacgcca

SEQ ID NO: 1661770 - RNA, 19 nt, Salmonella enterica enterica serovar Typhi
ggcggccaaccccggcaaa

SEQ ID NO: 1661771 - RNA, 22 nt, Salmonella enterica enterica serovar Typhi
ggcgcuguacgccucuuucagc

SEQ ID NO: 1661772 - RNA, 19 nt, Salmonella enterica enterica serovar Typhi
ggcgcuggugacaucgccg

SEQ ID NO: 1661773 - RNA, 21 nt, Salmonella enterica enterica serovar Typhi
ggcgcugaguuucucccgcca

SEQ ID NO: 1661774 - RNA, 19 nt, Salmonella enterica enterica serovar Typhi
ggcgcugccgcuuauccgg

SEQ ID NO: 1661775 - RNA, 19 nt, Salmonella enterica enterica serovar Typhi
ggcgcuacgcuuaucaggc

SEQ ID NO: 1661776 - RNA, 19 nt, Salmonella enterica enterica serovar Typhi
ggcgcuagccgcauccggc

SEQ ID NO: 1661777 - RNA, 20 nt, Salmonella enterica enterica serovar Typhi
ggcgcuacgcuuaucgggcc

SEQ ID NO: 1661778 - RNA, 17 nt, Salmonella enterica enterica serovar Typhi
ggcgcuacgcuuauccg

SEQ ID NO: 1661779 - RNA, 15 nt, Salmonella enterica enterica serovar Typhi
ggcgcgcuuaucugg

SEQ ID NO: 1661780 - RNA, 15 nt, Salmonella enterica enterica serovar Typhi
ggcguuggcuaucgc

SEQ ID NO: 1661781 - RNA, 20 nt, Salmonella enterica enterica serovar Typhi
ggcuacccagacaagcacau

SEQ ID NO: 1661782 - RNA, 23 nt, Salmonella enterica enterica serovar Typhi
ggcuacagacaucuuugccaaac

SEQ ID NO: 1661783 - RNA, 13 nt, Salmonella enterica enterica serovar Typhi
ggcuaagccagaa

SEQ ID NO: 1661784 - RNA, 19 nt, Salmonella enterica enterica serovar Typhi
ggcguggaaccgccggaga

SEQ ID NO: 1661785 - RNA, 23 nt, Salmonella enterica enterica serovar Typhi
ggcgugauugagcagaucagcac

SEQ ID NO: 1661786 - RNA, 16 nt, Salmonella enterica enterica serovar Typhi
ggcucaucagcgccau

SEQ ID NO: 1661787 - RNA, 15 nt, Salmonella enterica enterica serovar Typhi
ggcucaucagcgcca

SEQ ID NO: 1661788 - RNA, 21 nt, Salmonella enterica enterica serovar Typhi
ggcucagguuauauuccgccu

SEQ ID NO: 1661789 - RNA, 21 nt, Salmonella enterica enterica serovar Typhi
ggcuaccgggcaaacauuagc

SEQ ID NO: 1661790 - RNA, 18 nt, Salmonella enterica enterica serovar Typhi
ggcucagcauagcgcuga

SEQ ID NO: 1661791 - RNA, 20 nt, Salmonella enterica enterica serovar Typhi
ggcuccuguugguuauacgg

SEQ ID NO: 1661792 - RNA, 14 nt, Salmonella enterica enterica serovar Typhi
ggcguaaaucaggc

SEQ ID NO: 1661793 - RNA, 17 nt, Salmonella enterica enterica serovar Typhi
ggcguagcgcgcggaua

SEQ ID NO: 1661794 - RNA, 18 nt, Salmonella enterica enterica serovar Typhi
ggcguacacuucauccgg

SEQ ID NO: 1661795 - RNA, 14 nt, Salmonella enterica enterica serovar Typhi
ggcguaagcgacau

SEQ ID NO: 1661796 - RNA, 22 nt, Salmonella enterica enterica serovar Typhi
ggcgggauuuuaagcauccagg

SEQ ID NO: 1661797 - RNA, 16 nt, Salmonella enterica enterica serovar Typhi
ggcgggcgucaccguc

SEQ ID NO: 1661798 - RNA, 15 nt, Salmonella enterica enterica serovar Typhi
ggcgucauccugcag

SEQ ID NO: 1661799 - RNA, 21 nt, Salmonella enterica enterica serovar Typhi
ggcgucaacguuuuucagccg

SEQ ID NO: 1661800 - RNA, 17 nt, Salmonella enterica enterica serovar Typhi
ggcguaucuuccagcgu

SEQ ID NO: 1661801 - RNA, 13 nt, Salmonella enterica enterica serovar Typhi
ggcguauagccgc

SEQ ID NO: 1661802 - RNA, 23 nt, Salmonella enterica enterica serovar Typhi
ggcgucccuuucccuuccagcga

SEQ ID NO: 1661803 - RNA, 14 nt, Salmonella enterica enterica serovar Typhi
ggggcauuuuccgg

SEQ ID NO: 1661804 - RNA, 15 nt, Salmonella enterica enterica serovar Typhi
gggcuuuuagccgcg

SEQ ID NO: 1661805 - RNA, 13 nt, Salmonella enterica enterica serovar Typhi
gggcuuuauccug

SEQ ID NO: 1661806 - RNA, 15 nt, Salmonella enterica enterica serovar Typhi
ggggauucugccauc

SEQ ID NO: 1661807 - RNA, 15 nt, Salmonella enterica enterica serovar Typhi
gggcuuaaugcgcac

SEQ ID NO: 1661808 - RNA, 21 nt, Salmonella enterica enterica serovar Typhi
gggcguugcugcacgucgcgc

SEQ ID NO: 1661809 - RNA, 14 nt, Salmonella enterica enterica serovar Typhi
ggguaauggucagc

SEQ ID NO: 1661810 - RNA, 17 nt, Salmonella enterica enterica serovar Typhi
gggggaacggcagacag

SEQ ID NO: 1661811 - RNA, 17 nt, Salmonella enterica enterica serovar Typhi
gggucaguacgcgcgua

SEQ ID NO: 1661812 - RNA, 15 nt, Salmonella enterica enterica serovar Typhi
gggucagcguaucca

SEQ ID NO: 1661813 - RNA, 16 nt, Salmonella enterica enterica serovar Typhi
gggaucuucaaugaac

SEQ ID NO: 1661814 - RNA, 18 nt, Salmonella enterica enterica serovar Typhi
gggaucuuaucuuucagc

SEQ ID NO: 1661815 - RNA, 18 nt, Salmonella enterica enterica serovar Typhi
gggauaaugucgacgcgc

SEQ ID NO: 1661816 - RNA, 17 nt, Salmonella enterica enterica serovar Typhi
gggagaaaacgcggccu

SEQ ID NO: 1661817 - RNA, 22 nt, Salmonella enterica enterica serovar Typhi
ggcuucaaucgucguuccgcca

SEQ ID NO: 1661818 - RNA, 15 nt, Salmonella enterica enterica serovar Typhi
ggcuucaaccuccug

SEQ ID NO: 1661819 - RNA, 19 nt, Salmonella enterica enterica serovar Typhi
ggcuuagccgccgugauaa

SEQ ID NO: 1661820 - RNA, 15 nt, Salmonella enterica enterica serovar Typhi
ggcuuagcgccagau

SEQ ID NO: 1661821 - RNA, 20 nt, Salmonella enterica enterica serovar Typhi
ggcuucgccuuauccggccu

SEQ ID NO: 1661822 - RNA, 15 nt, Salmonella enterica enterica serovar Typhi
ggcugugggcguguc

SEQ ID NO: 1661823 - RNA, 17 nt, Salmonella enterica enterica serovar Typhi
gggcauuuuccggcgac

SEQ ID NO: 1661824 - RNA, 14 nt, Salmonella enterica enterica serovar Typhi
gggcaagccagcau

SEQ ID NO: 1661825 - RNA, 15 nt, Salmonella enterica enterica serovar Typhi
gggccauucgccaua

SEQ ID NO: 1661826 - RNA, 19 nt, Salmonella enterica enterica serovar Typhi
gccgugucaucauuacagg

SEQ ID NO: 1661827 - RNA, 19 nt, Salmonella enterica enterica serovar Typhi
gccguuaaucuggccuacg

SEQ ID NO: 1661828 - RNA, 13 nt, Salmonella enterica enterica serovar Typhi
gccguuagcgccu

SEQ ID NO: 1661829 - RNA, 14 nt, Salmonella enterica enterica serovar Typhi
gccguuaccgccga

SEQ ID NO: 1661830 - RNA, 13 nt, Salmonella enterica enterica serovar Typhi
gccguggcgcauc

SEQ ID NO: 1661831 - RNA, 12 nt, Salmonella enterica enterica serovar Typhi
gccuaauccgcc

SEQ ID NO: 1661832 - RNA, 24 nt, Salmonella enterica enterica serovar Typhi
gccuaagaucggguggccuaacgc

SEQ ID NO: 1661833 - RNA, 14 nt, Salmonella enterica enterica serovar Typhi
gccuaagaccagca

SEQ ID NO: 1661834 - RNA, 20 nt, Salmonella enterica enterica serovar Typhi
gccguuuuuaacgccggcaa

SEQ ID NO: 1661835 - RNA, 22 nt, Salmonella enterica enterica serovar Typhi
gccguuuuccggucgcgcaauc

SEQ ID NO: 1661836 - RNA, 14 nt, Salmonella enterica enterica serovar Typhi
gccuaacagcgccg

SEQ ID NO: 1661837 - RNA, 16 nt, Salmonella enterica enterica serovar Typhi
gccguuuuaucgcccg

SEQ ID NO: 1661838 - RNA, 18 nt, Salmonella enterica enterica serovar Typhi
gccguuuuggcagcgccc

SEQ ID NO: 1661839 - RNA, 13 nt, Salmonella enterica enterica serovar Typhi
gccguuuuccggu

SEQ ID NO: 1661840 - RNA, 21 nt, Salmonella enterica enterica serovar Typhi
gccguuccgcaacaagcauca

SEQ ID NO: 1661841 - RNA, 18 nt, Salmonella enterica enterica serovar Typhi
gccguuccguucgcguca

SEQ ID NO: 1661842 - RNA, 17 nt, Salmonella enterica enterica serovar Typhi
gccguuaucggccugcu

SEQ ID NO: 1661843 - RNA, 23 nt, Salmonella enterica enterica serovar Typhi
gccguucaccagccacugcgcca

SEQ ID NO: 1661844 - RNA, 16 nt, Salmonella enterica enterica serovar Typhi
gccguuaucggccugc

SEQ ID NO: 1661845 - RNA, 23 nt, Salmonella enterica enterica serovar Typhi
gccuccaccguuugcagccagau

SEQ ID NO: 1661846 - RNA, 19 nt, Salmonella enterica enterica serovar Typhi
gccucauccgcauagcgca

SEQ ID NO: 1661847 - RNA, 23 nt, Salmonella enterica enterica serovar Typhi
gccuacgugcucucaccaucaua

SEQ ID NO: 1661848 - RNA, 14 nt, Salmonella enterica enterica serovar Typhi
gccuaccagcacau

SEQ ID NO: 1661849 - RNA, 13 nt, Salmonella enterica enterica serovar Typhi
gccuaccgccaua

SEQ ID NO: 1661850 - RNA, 14 nt, Salmonella enterica enterica serovar Typhi
gccuaccaucgcgc

SEQ ID NO: 1661851 - RNA, 13 nt, Salmonella enterica enterica serovar Typhi
gccuacauccggc

SEQ ID NO: 1661852 - RNA, 23 nt, Salmonella enterica enterica serovar Typhi
gccuacggcuaccgccuguuuaa

SEQ ID NO: 1661853 - RNA, 23 nt, Salmonella enterica enterica serovar Typhi
gccuacggucgguuucauaacgc

SEQ ID NO: 1661854 - RNA, 12 nt, Salmonella enterica enterica serovar Typhi
gccguacagccu

SEQ ID NO: 1661855 - RNA, 21 nt, Salmonella enterica enterica serovar Typhi
gccgguuuuagcguauccggc

SEQ ID NO: 1661856 - RNA, 20 nt, Salmonella enterica enterica serovar Typhi
gccgguuucuccagccucgc

SEQ ID NO: 1661857 - RNA, 22 nt, Salmonella enterica enterica serovar Typhi
gccgguugccagggaaugccau

SEQ ID NO: 1661858 - RNA, 19 nt, Salmonella enterica enterica serovar Typhi
gccgguucggcaucgcccg

SEQ ID NO: 1661859 - RNA, 13 nt, Salmonella enterica enterica serovar Typhi
gccgucggcgcca

SEQ ID NO: 1661860 - RNA, 15 nt, Salmonella enterica enterica serovar Typhi
gccguaggcgacgcc

SEQ ID NO: 1661861 - RNA, 12 nt, Salmonella enterica enterica serovar Typhi
gccguaggcaac

SEQ ID NO: 1661862 - RNA, 16 nt, Salmonella enterica enterica serovar Typhi
gccguauaauccagcu

SEQ ID NO: 1661863 - RNA, 23 nt, Salmonella enterica enterica serovar Typhi
gccgucaggucaugaucgauccg

SEQ ID NO: 1661864 - RNA, 20 nt, Salmonella enterica enterica serovar Typhi
gccugauucaccaacugcug

SEQ ID NO: 1661865 - RNA, 23 nt, Salmonella enterica enterica serovar Typhi
gccugauggcgcuucgcuuauca

SEQ ID NO: 1661866 - RNA, 19 nt, Salmonella enterica enterica serovar Typhi
gccugauggcguagcgcca

SEQ ID NO: 1661867 - RNA, 22 nt, Salmonella enterica enterica serovar Typhi
gccugauucgugacaucaagcc

SEQ ID NO: 1661868 - RNA, 20 nt, Salmonella enterica enterica serovar Typhi
gccugaugcugcgcauccgc

SEQ ID NO: 1661869 - RNA, 19 nt, Salmonella enterica enterica serovar Typhi
gccugauggcgcuacgcca

SEQ ID NO: 1661870 - RNA, 23 nt, Salmonella enterica enterica serovar Typhi
gccugauggcgcuacgcuuauca

SEQ ID NO: 1661871 - RNA, 16 nt, Salmonella enterica enterica serovar Typhi
gccugcauacguuuca

SEQ ID NO: 1661872 - RNA, 20 nt, Salmonella enterica enterica serovar Typhi
gccugauaagcguagcgcca

SEQ ID NO: 1661873 - RNA, 16 nt, Salmonella enterica enterica serovar Typhi
gccugauaagcgcagc

SEQ ID NO: 1661874 - RNA, 20 nt, Salmonella enterica enterica serovar Typhi
gccugauaaacguagcguca

SEQ ID NO: 1661875 - RNA, 20 nt, Salmonella enterica enterica serovar Typhi
gccugauaagcauagcgcca

SEQ ID NO: 1661876 - RNA, 22 nt, Salmonella enterica enterica serovar Typhi
gccugauaagcauagcgccauc

SEQ ID NO: 1661877 - RNA, 20 nt, Salmonella enterica enterica serovar Typhi
gccugauaagcgaagcgcca

SEQ ID NO: 1661878 - RNA, 15 nt, Salmonella enterica enterica serovar Typhi
gccugauaagcgcag

SEQ ID NO: 1661879 - RNA, 23 nt, Salmonella enterica enterica serovar Typhi
gccugaugagguuacguucauca

SEQ ID NO: 1661880 - RNA, 13 nt, Salmonella enterica enterica serovar Typhi
gccugaugaccgc

SEQ ID NO: 1661881 - RNA, 16 nt, Salmonella enterica enterica serovar Typhi
gccugaauaaugaccu

SEQ ID NO: 1661882 - RNA, 17 nt, Salmonella enterica enterica serovar Typhi
gccugacuccggguaac

SEQ ID NO: 1661883 - RNA, 17 nt, Salmonella enterica enterica serovar Typhi
gccucguuuugcugcca

SEQ ID NO: 1661884 - RNA, 22 nt, Salmonella enterica enterica serovar Typhi
gccucguguaaggcuuccggca

SEQ ID NO: 1661885 - RNA, 20 nt, Salmonella enterica enterica serovar Typhi
gccucguucccagcgggaac

SEQ ID NO: 1661886 - RNA, 16 nt, Salmonella enterica enterica serovar Typhi
gccucggcgacguccg

SEQ ID NO: 1661887 - RNA, 17 nt, Salmonella enterica enterica serovar Typhi
gccucccccucaaucgg

SEQ ID NO: 1661888 - RNA, 20 nt, Salmonella enterica enterica serovar Typhi
gccugguaagcguagcgcca

SEQ ID NO: 1661889 - RNA, 22 nt, Salmonella enterica enterica serovar Typhi
gccuuaaaaaggacaagcugau

SEQ ID NO: 1661890 - RNA, 22 nt, Salmonella enterica enterica serovar Typhi
gccuuccuccagcaucaggugg

SEQ ID NO: 1661891 - RNA, 18 nt, Salmonella enterica enterica serovar Typhi
gccuuauccggccuacac

SEQ ID NO: 1661892 - RNA, 13 nt, Salmonella enterica enterica serovar Typhi
gccuuauccggcc

SEQ ID NO: 1661893 - RNA, 19 nt, Salmonella enterica enterica serovar Typhi
gccuuauccgaccuacaga

SEQ ID NO: 1661894 - RNA, 12 nt, Salmonella enterica enterica serovar Typhi
gccuuagcgccc

SEQ ID NO: 1661895 - RNA, 17 nt, Salmonella enterica enterica serovar Typhi
gccuuaccgggccuacg

SEQ ID NO: 1661896 - RNA, 22 nt, Salmonella enterica enterica serovar Typhi
gccuuacccaaccgugcuucac

SEQ ID NO: 1661897 - RNA, 15 nt, Salmonella enterica enterica serovar Typhi
gccuuacaggcgcau

SEQ ID NO: 1661898 - RNA, 21 nt, Salmonella enterica enterica serovar Typhi
gccuucgccgcccaaccagcc

SEQ ID NO: 1661899 - RNA, 13 nt, Salmonella enterica enterica serovar Typhi
gccuucggccuga

SEQ ID NO: 1661900 - RNA, 17 nt, Salmonella enterica enterica serovar Typhi
gccugcauuugcuggcg

SEQ ID NO: 1661901 - RNA, 18 nt, Salmonella enterica enterica serovar Typhi
gccugccauagcaucacc

SEQ ID NO: 1661902 - RNA, 14 nt, Salmonella enterica enterica serovar Typhi
gccugcucaucagg

SEQ ID NO: 1661903 - RNA, 15 nt, Salmonella enterica enterica serovar Typhi
gccugcuccgccagg

SEQ ID NO: 1661904 - RNA, 22 nt, Salmonella enterica enterica serovar Typhi
gccuggauaauaagacgccagu

SEQ ID NO: 1661905 - RNA, 18 nt, Salmonella enterica enterica serovar Typhi
gccuggagaucagcaugg

SEQ ID NO: 1661906 - RNA, 19 nt, Salmonella enterica enterica serovar Typhi
gcgaugccuuauccggccu

SEQ ID NO: 1661907 - RNA, 13 nt, Salmonella enterica enterica serovar Typhi
gcgaugauagccg

SEQ ID NO: 1661908 - RNA, 22 nt, Salmonella enterica enterica serovar Typhi
gcgaucugugucguccaggccu

SEQ ID NO: 1661909 - RNA, 20 nt, Salmonella enterica enterica serovar Typhi
gcgaugacggcgcguuaucg

SEQ ID NO: 1661910 - RNA, 19 nt, Salmonella enterica enterica serovar Typhi
gcgaugagcgccagcaaca

SEQ ID NO: 1661911 - RNA, 13 nt, Salmonella enterica enterica serovar Typhi
gcgaugagcgcca

SEQ ID NO: 1661912 - RNA, 14 nt, Salmonella enterica enterica serovar Typhi
gcgaucugucgccg

SEQ ID NO: 1661913 - RNA, 23 nt, Salmonella enterica enterica serovar Typhi
gcgaucccaguugaucggccagc

SEQ ID NO: 1661914 - RNA, 20 nt, Salmonella enterica enterica serovar Typhi
gcgaucccaguugaucggcc

SEQ ID NO: 1661915 - RNA, 22 nt, Salmonella enterica enterica serovar Typhi
gcgaucccggccuucgaacagc

SEQ ID NO: 1661916 - RNA, 14 nt, Salmonella enterica enterica serovar Typhi
gcgauccugcggca

SEQ ID NO: 1661917 - RNA, 12 nt, Salmonella enterica enterica serovar Typhi
gcgaucgcgccg

SEQ ID NO: 1661918 - RNA, 20 nt, Salmonella enterica enterica serovar Typhi
gcgaucgcgccggucgccag

SEQ ID NO: 1661919 - RNA, 11 nt, Salmonella enterica enterica serovar Typhi
gcgaucgccgu

SEQ ID NO: 1661920 - RNA, 22 nt, Salmonella enterica enterica serovar Typhi
gcgaucgccgucguucagccag

SEQ ID NO: 1661921 - RNA, 15 nt, Salmonella enterica enterica serovar Typhi
gcgaucaggcgucag

SEQ ID NO: 1661922 - RNA, 20 nt, Salmonella enterica enterica serovar Typhi
gcgauccagccccagcgcca

SEQ ID NO: 1661923 - RNA, 15 nt, Salmonella enterica enterica serovar Typhi
gcgaucacuaccgcc

SEQ ID NO: 1661924 - RNA, 14 nt, Salmonella enterica enterica serovar Typhi
gcgaucacuucgac

SEQ ID NO: 1661925 - RNA, 22 nt, Salmonella enterica enterica serovar Typhi
gcgcaauauuguuaaccaggcc

SEQ ID NO: 1661926 - RNA, 20 nt, Salmonella enterica enterica serovar Typhi
gcgcaauaugcggcgccauc

SEQ ID NO: 1661927 - RNA, 15 nt, Salmonella enterica enterica serovar Typhi
gcgcaauaugcggcg

SEQ ID NO: 1661928 - RNA, 19 nt, Salmonella enterica enterica serovar Typhi
gcgcacacaauagcaaucu

SEQ ID NO: 1661929 - RNA, 16 nt, Salmonella enterica enterica serovar Typhi
gcgcacaggccuucau

SEQ ID NO: 1661930 - RNA, 21 nt, Salmonella enterica enterica serovar Typhi
gcgcaacgucgccauccggca

SEQ ID NO: 1661931 - RNA, 21 nt, Salmonella enterica enterica serovar Typhi
gcgcaaaaucgcaaacgccag

SEQ ID NO: 1661932 - RNA, 15 nt, Salmonella enterica enterica serovar Typhi
gcgcaaacaacccgg

SEQ ID NO: 1661933 - RNA, 13 nt, Salmonella enterica enterica serovar Typhi
gcgcaaccggcgu

SEQ ID NO: 1661934 - RNA, 14 nt, Salmonella enterica enterica serovar Typhi
gcgaugcugcucca

SEQ ID NO: 1661935 - RNA, 20 nt, Salmonella enterica enterica serovar Typhi
gcgaugcugcuccaucuccg

SEQ ID NO: 1661936 - RNA, 20 nt, Salmonella enterica enterica serovar Typhi
gcgauguauuuauccacgcc

SEQ ID NO: 1661937 - RNA, 20 nt, Salmonella enterica enterica serovar Typhi
gcgaugugcccgagugacug

SEQ ID NO: 1661938 - RNA, 18 nt, Salmonella enterica enterica serovar Typhi
gcgauggugcggcgcacu

SEQ ID NO: 1661939 - RNA, 14 nt, Salmonella enterica enterica serovar Typhi
gcgcaaaagcgcgc

SEQ ID NO: 1661940 - RNA, 14 nt, Salmonella enterica enterica serovar Typhi
gcgauuuucagcac

SEQ ID NO: 1661941 - RNA, 18 nt, Salmonella enterica enterica serovar Typhi
gcgauuuguccgcugcug

SEQ ID NO: 1661942 - RNA, 18 nt, Salmonella enterica enterica serovar Typhi
gcgauugauucaccgaca

SEQ ID NO: 1661943 - RNA, 16 nt, Salmonella enterica enterica serovar Typhi
gcgauuuccagcgccg

SEQ ID NO: 1661944 - RNA, 16 nt, Salmonella enterica enterica serovar Typhi
gcgauuuccuguguua

SEQ ID NO: 1661945 - RNA, 20 nt, Salmonella enterica enterica serovar Typhi
gcgauuuauagagcagcacg

SEQ ID NO: 1661946 - RNA, 18 nt, Salmonella enterica enterica serovar Typhi
gcgauuuauagagcgcca

SEQ ID NO: 1661947 - RNA, 18 nt, Salmonella enterica enterica serovar Typhi
gcgauuccgguuccggcg

SEQ ID NO: 1661948 - RNA, 21 nt, Salmonella enterica enterica serovar Typhi
gcgauguucaugcgcggucau

SEQ ID NO: 1661949 - RNA, 22 nt, Salmonella enterica enterica serovar Typhi
gcgauguuuacugcggcgcaac

SEQ ID NO: 1661950 - RNA, 22 nt, Salmonella enterica enterica serovar Typhi
gcgauguucuugccgccaucuc

SEQ ID NO: 1661951 - RNA, 20 nt, Salmonella enterica enterica serovar Typhi
gcgauguucuugccgccauc

SEQ ID NO: 1661952 - RNA, 19 nt, Salmonella enterica enterica serovar Typhi
gcgagauuacugcgugcug

SEQ ID NO: 1661953 - RNA, 22 nt, Salmonella enterica enterica serovar Typhi
gcgacuaccguucacggcgaua

SEQ ID NO: 1661954 - RNA, 17 nt, Salmonella enterica enterica serovar Typhi
gcgacuaaccagcgcaa

SEQ ID NO: 1661955 - RNA, 18 nt, Salmonella enterica enterica serovar Typhi
gcgacgugacggugaccu

SEQ ID NO: 1661956 - RNA, 12 nt, Salmonella enterica enterica serovar Typhi
gcgacguuaucu

SEQ ID NO: 1661957 - RNA, 17 nt, Salmonella enterica enterica serovar Typhi
gcgacggcguaagcgcu

SEQ ID NO: 1661958 - RNA, 20 nt, Salmonella enterica enterica serovar Typhi
gcgacggcguaagcgcuaug

SEQ ID NO: 1661959 - RNA, 18 nt, Salmonella enterica enterica serovar Typhi
gcgacggcguauucggca

SEQ ID NO: 1661960 - RNA, 16 nt, Salmonella enterica enterica serovar Typhi
gcgacggagcgugcug

SEQ ID NO: 1661961 - RNA, 14 nt, Salmonella enterica enterica serovar Typhi
gccuuuauccagcg

SEQ ID NO: 1661962 - RNA, 19 nt, Salmonella enterica enterica serovar Typhi
gccuuuacccuuacggcca

SEQ ID NO: 1661963 - RNA, 20 nt, Salmonella enterica enterica serovar Typhi
gcgaauaaucccggcgccaa

SEQ ID NO: 1661964 - RNA, 22 nt, Salmonella enterica enterica serovar Typhi
gcgaauaaaauucagcgcagua

SEQ ID NO: 1661965 - RNA, 23 nt, Salmonella enterica enterica serovar Typhi
gcgaagugcagcguuuccagcca

SEQ ID NO: 1661966 - RNA, 13 nt, Salmonella enterica enterica serovar Typhi
gcgaauccagauc

SEQ ID NO: 1661967 - RNA, 15 nt, Salmonella enterica enterica serovar Typhi
gcgaauccagcgccg

SEQ ID NO: 1661968 - RNA, 17 nt, Salmonella enterica enterica serovar Typhi
gcgaauccagaucgccc

SEQ ID NO: 1661969 - RNA, 20 nt, Salmonella enterica enterica serovar Typhi
gcgaaucgacaauccgccac

SEQ ID NO: 1661970 - RNA, 20 nt, Salmonella enterica enterica serovar Typhi
gcgaauccgccauagccggc

SEQ ID NO: 1661971 - RNA, 20 nt, Salmonella enterica enterica serovar Typhi
gcgaauacuguuccaggcga

SEQ ID NO: 1661972 - RNA, 20 nt, Salmonella enterica enterica serovar Typhi
gcgaauaccuaacagccgcg

SEQ ID NO: 1661973 - RNA, 18 nt, Salmonella enterica enterica serovar Typhi
gcgaauaccuucccgcga

SEQ ID NO: 1661974 - RNA, 23 nt, Salmonella enterica enterica serovar Typhi
gcgaaucacauccgccagcgccu

SEQ ID NO: 1661975 - RNA, 23 nt, Salmonella enterica enterica serovar Typhi
gcgaauggccuccagcagcacuu

SEQ ID NO: 1661976 - RNA, 18 nt, Salmonella enterica enterica serovar Typhi
gcgaaucgccucuucgac

SEQ ID NO: 1661977 - RNA, 20 nt, Salmonella enterica enterica serovar Typhi
gcgaaucucgugaucgccaa

SEQ ID NO: 1661978 - RNA, 20 nt, Salmonella enterica enterica serovar Typhi
gcgaauugccgucgccggaa

SEQ ID NO: 1661979 - RNA, 19 nt, Salmonella enterica enterica serovar Typhi
gcgaauuucacgcagcacg

SEQ ID NO: 1661980 - RNA, 14 nt, Salmonella enterica enterica serovar Typhi
gcgaauuucaacgc

SEQ ID NO: 1661981 - RNA, 15 nt, Salmonella enterica enterica serovar Typhi
gcgacaaacagcgcc

SEQ ID NO: 1661982 - RNA, 16 nt, Salmonella enterica enterica serovar Typhi
gcgacaaacagcgccc

SEQ ID NO: 1661983 - RNA, 14 nt, Salmonella enterica enterica serovar Typhi
gcgaaugcgcaauc

SEQ ID NO: 1661984 - RNA, 14 nt, Salmonella enterica enterica serovar Typhi
gcgaaugcgcgcca

SEQ ID NO: 1661985 - RNA, 17 nt, Salmonella enterica enterica serovar Typhi
gcgaauuacuaaucugu

SEQ ID NO: 1661986 - RNA, 14 nt, Salmonella enterica enterica serovar Typhi
gcgacacuccgcgc

SEQ ID NO: 1661987 - RNA, 15 nt, Salmonella enterica enterica serovar Typhi
gcgacagcccggcgu

SEQ ID NO: 1661988 - RNA, 17 nt, Salmonella enterica enterica serovar Typhi
gcgaccacuccggcaua

SEQ ID NO: 1661989 - RNA, 18 nt, Salmonella enterica enterica serovar Typhi
gcgaccagcgucagccag

SEQ ID NO: 1661990 - RNA, 21 nt, Salmonella enterica enterica serovar Typhi
gcgaccagcagcgcggcguac

SEQ ID NO: 1661991 - RNA, 13 nt, Salmonella enterica enterica serovar Typhi
gcgaccggcagcc

SEQ ID NO: 1661992 - RNA, 11 nt, Salmonella enterica enterica serovar Typhi
gcgaccggcac

SEQ ID NO: 1661993 - RNA, 19 nt, Salmonella enterica enterica serovar Typhi
gcgaccgcgccacggccaa

SEQ ID NO: 1661994 - RNA, 13 nt, Salmonella enterica enterica serovar Typhi
gcgcgacauccgc

SEQ ID NO: 1661995 - RNA, 14 nt, Salmonella enterica enterica serovar Typhi
gcgcgauacgcagc

SEQ ID NO: 1661996 - RNA, 16 nt, Salmonella enterica enterica serovar Typhi
gcgcgaucaaucacgc

SEQ ID NO: 1661997 - RNA, 17 nt, Salmonella enterica enterica serovar Typhi
gcgcgauuuucucgcua

SEQ ID NO: 1661998 - RNA, 19 nt, Salmonella enterica enterica serovar Typhi
gcgcgcagaguguaggccu

SEQ ID NO: 1661999 - RNA, 21 nt, Salmonella enterica enterica serovar Typhi
gcgcgcagaccacgaaucagg

SEQ ID NO: 1662000 - RNA, 15 nt, Salmonella enterica enterica serovar Typhi
gcgccgccgaacaga

SEQ ID NO: 1662001 - RNA, 15 nt, Salmonella enterica enterica serovar Typhi
gcgccggcagcaguu

SEQ ID NO: 1662002 - RNA, 12 nt, Salmonella enterica enterica serovar Typhi
gcgccggcagca

SEQ ID NO: 1662003 - RNA, 20 nt, Salmonella enterica enterica serovar Typhi
gcgccguccauaaugacgcu

SEQ ID NO: 1662004 - RNA, 20 nt, Salmonella enterica enterica serovar Typhi
gcgccaacgccacugccaua

SEQ ID NO: 1662005 - RNA, 13 nt, Salmonella enterica enterica serovar Typhi
gcgccaagaccgc

SEQ ID NO: 1662006 - RNA, 16 nt, Salmonella enterica enterica serovar Typhi
gcgccaagaccgccua

SEQ ID NO: 1662007 - RNA, 14 nt, Salmonella enterica enterica serovar Typhi
gcgcauuaacgcca

SEQ ID NO: 1662008 - RNA, 21 nt, Salmonella enterica enterica serovar Typhi
gcgcauguaaccaaagcacca

SEQ ID NO: 1662009 - RNA, 21 nt, Salmonella enterica enterica serovar Typhi
gcgcaugugagcaucggcgau

SEQ ID NO: 1662010 - RNA, 18 nt, Salmonella enterica enterica serovar Typhi
gcgcaugagcaaacugcu

SEQ ID NO: 1662011 - RNA, 13 nt, Salmonella enterica enterica serovar Typhi
gcgccacgcagcg

SEQ ID NO: 1662012 - RNA, 23 nt, Salmonella enterica enterica serovar Typhi
gcgccaccuuaaucgacuucaug

SEQ ID NO: 1662013 - RNA, 22 nt, Salmonella enterica enterica serovar Typhi
gcgccagccauagcagcaaauu

SEQ ID NO: 1662014 - RNA, 15 nt, Salmonella enterica enterica serovar Typhi
gcgccagcccggcga

SEQ ID NO: 1662015 - RNA, 22 nt, Salmonella enterica enterica serovar Typhi
gcgccagccagucgccaggcaa

SEQ ID NO: 1662016 - RNA, 19 nt, Salmonella enterica enterica serovar Typhi
gcgccauaguccauuacgc

SEQ ID NO: 1662017 - RNA, 13 nt, Salmonella enterica enterica serovar Typhi
gcgccaucaggca

SEQ ID NO: 1662018 - RNA, 14 nt, Salmonella enterica enterica serovar Typhi
gcgccauccggcau

SEQ ID NO: 1662019 - RNA, 22 nt, Salmonella enterica enterica serovar Typhi
gcgccagcugcgucaugucguu

SEQ ID NO: 1662020 - RNA, 15 nt, Salmonella enterica enterica serovar Typhi
gcgccagcugcguca

SEQ ID NO: 1662021 - RNA, 12 nt, Salmonella enterica enterica serovar Typhi
gcgcccgccauc

SEQ ID NO: 1662022 - RNA, 21 nt, Salmonella enterica enterica serovar Typhi
gcgccauguucauaccggaua

SEQ ID NO: 1662023 - RNA, 14 nt, Salmonella enterica enterica serovar Typhi
gcgccgcagcgccg

SEQ ID NO: 1662024 - RNA, 19 nt, Salmonella enterica enterica serovar Typhi
gcgccgccauccggcacaa

SEQ ID NO: 1662025 - RNA, 16 nt, Salmonella enterica enterica serovar Typhi
gcgccgccauccggca

SEQ ID NO: 1662026 - RNA, 19 nt, Salmonella enterica enterica serovar Typhi
gcgccgaguagcugagcgu

SEQ ID NO: 1662027 - RNA, 16 nt, Salmonella enterica enterica serovar Typhi
gcggaaccagccaugc

SEQ ID NO: 1662028 - RNA, 14 nt, Salmonella enterica enterica serovar Typhi
gcggaagaggcgcc

SEQ ID NO: 1662029 - RNA, 15 nt, Salmonella enterica enterica serovar Typhi
gcggaagcgaccggc

SEQ ID NO: 1662030 - RNA, 18 nt, Salmonella enterica enterica serovar Typhi
gcggaauaucuucccgac

SEQ ID NO: 1662031 - RNA, 20 nt, Salmonella enterica enterica serovar Typhi
gcggaauaaucagucgcagc

SEQ ID NO: 1662032 - RNA, 17 nt, Salmonella enterica enterica serovar Typhi
gcgcuggcuugaccgcu

SEQ ID NO: 1662033 - RNA, 23 nt, Salmonella enterica enterica serovar Typhi
gcggaaccauuuuccccagaauc

SEQ ID NO: 1662034 - RNA, 14 nt, Salmonella enterica enterica serovar Typhi
gcggacaugcgcau

SEQ ID NO: 1662035 - RNA, 19 nt, Salmonella enterica enterica serovar Typhi
gcggaauugguagacgcgc

SEQ ID NO: 1662036 - RNA, 18 nt, Salmonella enterica enterica serovar Typhi
gcggagccgccauccggc

SEQ ID NO: 1662037 - RNA, 12 nt, Salmonella enterica enterica serovar Typhi
gcggacgcagcu

SEQ ID NO: 1662038 - RNA, 17 nt, Salmonella enterica enterica serovar Typhi
gcggauaccggcgcagc

SEQ ID NO: 1662039 - RNA, 15 nt, Salmonella enterica enterica serovar Typhi
gcggauaugcagcag

SEQ ID NO: 1662040 - RNA, 22 nt, Salmonella enterica enterica serovar Typhi
gcggauauauggcgggaaauca

SEQ ID NO: 1662041 - RNA, 23 nt, Salmonella enterica enterica serovar Typhi
gcggauaacgcggguuagcgccg

SEQ ID NO: 1662042 - RNA, 15 nt, Salmonella enterica enterica serovar Typhi
gcggauaagcccggc

SEQ ID NO: 1662043 - RNA, 19 nt, Salmonella enterica enterica serovar Typhi
gcggauaagcgcagcgcca

SEQ ID NO: 1662044 - RNA, 22 nt, Salmonella enterica enterica serovar Typhi
gcggauaaauagugacgccgcc

SEQ ID NO: 1662045 - RNA, 13 nt, Salmonella enterica enterica serovar Typhi
gcggaucgccauc

SEQ ID NO: 1662046 - RNA, 19 nt, Salmonella enterica enterica serovar Typhi
gcggaugucggucaucagg

SEQ ID NO: 1662047 - RNA, 22 nt, Salmonella enterica enterica serovar Typhi
gcggauggaauuuugcaccauc

SEQ ID NO: 1662048 - RNA, 16 nt, Salmonella enterica enterica serovar Typhi
gcggaucuucaccacg

SEQ ID NO: 1662049 - RNA, 20 nt, Salmonella enterica enterica serovar Typhi
gcggaucgugauaacgcgau

SEQ ID NO: 1662050 - RNA, 19 nt, Salmonella enterica enterica serovar Typhi
gcggcaaaaaacgacgcgc

SEQ ID NO: 1662051 - RNA, 20 nt, Salmonella enterica enterica serovar Typhi
gcggcaaaaaauauagccau

SEQ ID NO: 1662052 - RNA, 16 nt, Salmonella enterica enterica serovar Typhi
gcggcaaucgccucau

SEQ ID NO: 1662053 - RNA, 22 nt, Salmonella enterica enterica serovar Typhi
gcggcaauggccgcagcgccau

SEQ ID NO: 1662054 - RNA, 15 nt, Salmonella enterica enterica serovar Typhi
gcggcaauuuguagc

SEQ ID NO: 1662055 - RNA, 18 nt, Salmonella enterica enterica serovar Typhi
gcggcaaggucugcgccc

SEQ ID NO: 1662056 - RNA, 20 nt, Salmonella enterica enterica serovar Typhi
gcggcaccagcgaugcgcgc

SEQ ID NO: 1662057 - RNA, 19 nt, Salmonella enterica enterica serovar Typhi
gcggcagcuucagccaguc

SEQ ID NO: 1662058 - RNA, 13 nt, Salmonella enterica enterica serovar Typhi
gcgcucuccggca

SEQ ID NO: 1662059 - RNA, 12 nt, Salmonella enterica enterica serovar Typhi
gcgcucgccuga

SEQ ID NO: 1662060 - RNA, 20 nt, Salmonella enterica enterica serovar Typhi
gcgcugcguuuauuaggccu

SEQ ID NO: 1662061 - RNA, 20 nt, Salmonella enterica enterica serovar Typhi
gcgcugcgcuuaucaggccu

SEQ ID NO: 1662062 - RNA, 16 nt, Salmonella enterica enterica serovar Typhi
gcgcugcggcuacacg

SEQ ID NO: 1662063 - RNA, 13 nt, Salmonella enterica enterica serovar Typhi
gcgcucaucaggc

SEQ ID NO: 1662064 - RNA, 19 nt, Salmonella enterica enterica serovar Typhi
gcgcuccaccaaccaggca

SEQ ID NO: 1662065 - RNA, 19 nt, Salmonella enterica enterica serovar Typhi
gcgcuagccgcauccggca

SEQ ID NO: 1662066 - RNA, 18 nt, Salmonella enterica enterica serovar Typhi
gcgcuagcgccacccgac

SEQ ID NO: 1662067 - RNA, 12 nt, Salmonella enterica enterica serovar Typhi
gcgcuaucaggc

SEQ ID NO: 1662068 - RNA, 13 nt, Salmonella enterica enterica serovar Typhi
gcgcguccacggc

SEQ ID NO: 1662069 - RNA, 15 nt, Salmonella enterica enterica serovar Typhi
gcgcuacauccgcca

SEQ ID NO: 1662070 - RNA, 18 nt, Salmonella enterica enterica serovar Typhi
gcgcguguuacugacgac

SEQ ID NO: 1662071 - RNA, 19 nt, Salmonella enterica enterica serovar Typhi
gcgcggcaguucaggcucg

SEQ ID NO: 1662072 - RNA, 16 nt, Salmonella enterica enterica serovar Typhi
gcgcggccccaucagc

SEQ ID NO: 1662073 - RNA, 20 nt, Salmonella enterica enterica serovar Typhi
gcgcgucacaacagccggaa

SEQ ID NO: 1662074 - RNA, 17 nt, Salmonella enterica enterica serovar Typhi
gcgcgguuuauccccgc

SEQ ID NO: 1662075 - RNA, 20 nt, Salmonella enterica enterica serovar Typhi
gcgcggucauucguacguuu

SEQ ID NO: 1662076 - RNA, 19 nt, Salmonella enterica enterica serovar Typhi
gcgcgggcguauagccagg

SEQ ID NO: 1662077 - RNA, 16 nt, Salmonella enterica enterica serovar Typhi
gcgguacgaccggauu

SEQ ID NO: 1662078 - RNA, 16 nt, Salmonella enterica enterica serovar Typhi
gcgguacgccgccauc

SEQ ID NO: 1662079 - RNA, 20 nt, Salmonella enterica enterica serovar Typhi
gcgguacucuuuuuccgcga

SEQ ID NO: 1662080 - RNA, 18 nt, Salmonella enterica enterica serovar Typhi
gcgguagagaacagcauc

SEQ ID NO: 1662081 - RNA, 17 nt, Salmonella enterica enterica serovar Typhi
gcgguagagcgcgguca

SEQ ID NO: 1662082 - RNA, 23 nt, Salmonella enterica enterica serovar Typhi
gcgguauaacugccuuauccggc

SEQ ID NO: 1662083 - RNA, 14 nt, Salmonella enterica enterica serovar Typhi
gcgguauacaccag

SEQ ID NO: 1662084 - RNA, 16 nt, Salmonella enterica enterica serovar Typhi
gcgguauuucgccgcc

SEQ ID NO: 1662085 - RNA, 15 nt, Salmonella enterica enterica serovar Typhi
gcgguaugauacagu

SEQ ID NO: 1662086 - RNA, 23 nt, Salmonella enterica enterica serovar Typhi
gcgguaugcaccucuuuaugcgg

SEQ ID NO: 1662087 - RNA, 17 nt, Salmonella enterica enterica serovar Typhi
gcgguauaucacgccau

SEQ ID NO: 1662088 - RNA, 16 nt, Salmonella enterica enterica serovar Typhi
gcgguauaucacgcca

SEQ ID NO: 1662089 - RNA, 17 nt, Salmonella enterica enterica serovar Typhi
gcgguggguagcggcaa

SEQ ID NO: 1662090 - RNA, 18 nt, Salmonella enterica enterica serovar Typhi
gcgguucaaucacgcgua

SEQ ID NO: 1662091 - RNA, 19 nt, Salmonella enterica enterica serovar Typhi
gcggucgcuuuuugcgcca

SEQ ID NO: 1662092 - RNA, 18 nt, Salmonella enterica enterica serovar Typhi
gcggucggcaggcgguca

SEQ ID NO: 1662093 - RNA, 23 nt, Salmonella enterica enterica serovar Typhi
gcgggugcgcagccccagcgcca

SEQ ID NO: 1662094 - RNA, 22 nt, Salmonella enterica enterica serovar Typhi
gcgggucuggucgcucugcgca

SEQ ID NO: 1662095 - RNA, 21 nt, Salmonella enterica enterica serovar Typhi
gcggguaauuugcgccaucgc

SEQ ID NO: 1662096 - RNA, 13 nt, Salmonella enterica enterica serovar Typhi
gcgguaaucgcgc

SEQ ID NO: 1662097 - RNA, 12 nt, Salmonella enterica enterica serovar Typhi
gcgguaacgccu

SEQ ID NO: 1662098 - RNA, 17 nt, Salmonella enterica enterica serovar Typhi
gcgguaaggcaccgguu

SEQ ID NO: 1662099 - RNA, 19 nt, Salmonella enterica enterica serovar Typhi
gcgguaaacaccaccgguu

SEQ ID NO: 1662100 - RNA, 15 nt, Salmonella enterica enterica serovar Typhi
gcggguucaucgcca

SEQ ID NO: 1662101 - RNA, 16 nt, Salmonella enterica enterica serovar Typhi
gcggguagucccagga

SEQ ID NO: 1662102 - RNA, 21 nt, Salmonella enterica enterica serovar Typhi
gcggguaaacucacccaggcg

SEQ ID NO: 1662103 - RNA, 17 nt, Salmonella enterica enterica serovar Typhi
gcgggguaaacgguaau

SEQ ID NO: 1662104 - RNA, 18 nt, Salmonella enterica enterica serovar Typhi
gcgggcuaugcugaagca

SEQ ID NO: 1662105 - RNA, 22 nt, Salmonella enterica enterica serovar Typhi
gcgggcaaugccaccagcgcca

SEQ ID NO: 1662106 - RNA, 23 nt, Salmonella enterica enterica serovar Typhi
gcgggcaaugccaccagcgccau

SEQ ID NO: 1662107 - RNA, 16 nt, Salmonella enterica enterica serovar Typhi
gcgggaaaagcguccg

SEQ ID NO: 1662108 - RNA, 18 nt, Salmonella enterica enterica serovar Typhi
gcgggaaauaccauccgc

SEQ ID NO: 1662109 - RNA, 15 nt, Salmonella enterica enterica serovar Typhi
gcgggaaaucguccg

SEQ ID NO: 1662110 - RNA, 20 nt, Salmonella enterica enterica serovar Typhi
gcgggaaauaccauccgcgc

SEQ ID NO: 1662111 - RNA, 12 nt, Salmonella enterica enterica serovar Typhi
gcggcugcgccu

SEQ ID NO: 1662112 - RNA, 18 nt, Salmonella enterica enterica serovar Typhi
gcggcuguguccgccaug

SEQ ID NO: 1662113 - RNA, 16 nt, Salmonella enterica enterica serovar Typhi
gcggcuuuacccggcg

SEQ ID NO: 1662114 - RNA, 16 nt, Salmonella enterica enterica serovar Typhi
gcggcgguuauccgcc

SEQ ID NO: 1662115 - RNA, 14 nt, Salmonella enterica enterica serovar Typhi
gcggcgguuauccg

SEQ ID NO: 1662116 - RNA, 22 nt, Salmonella enterica enterica serovar Typhi
gcggcggacaacgcuccagcag

SEQ ID NO: 1662117 - RNA, 20 nt, Salmonella enterica enterica serovar Typhi
gcggcuaaucaccaccucaa

SEQ ID NO: 1662118 - RNA, 15 nt, Salmonella enterica enterica serovar Typhi
gcggcgugaacgccu

SEQ ID NO: 1662119 - RNA, 23 nt, Salmonella enterica enterica serovar Typhi
gcggcguaaacgccuuauccgac

SEQ ID NO: 1662120 - RNA, 17 nt, Salmonella enterica enterica serovar Typhi
gcggcuaccggacugcu

SEQ ID NO: 1662121 - RNA, 20 nt, Salmonella enterica enterica serovar Typhi
gcggcuacgccuuacccgac

SEQ ID NO: 1662122 - RNA, 19 nt, Salmonella enterica enterica serovar Typhi
gcggcuagcgccuuauccg

SEQ ID NO: 1662123 - RNA, 16 nt, Salmonella enterica enterica serovar Typhi
gcggcucauccagcaa

SEQ ID NO: 1662124 - RNA, 22 nt, Salmonella enterica enterica serovar Typhi
gcggcucaccagcugacgcagc

SEQ ID NO: 1662125 - RNA, 19 nt, Salmonella enterica enterica serovar Typhi
gcggcgaagcaucuuuccg

SEQ ID NO: 1662126 - RNA, 14 nt, Salmonella enterica enterica serovar Typhi
gcggcgaaccggca

SEQ ID NO: 1662127 - RNA, 18 nt, Salmonella enterica enterica serovar Typhi
gcggcgcaucgcuuaccg

SEQ ID NO: 1662128 - RNA, 20 nt, Salmonella enterica enterica serovar Typhi
gcggcgaugguugccagcgc

SEQ ID NO: 1662129 - RNA, 18 nt, Salmonella enterica enterica serovar Typhi
gcggcgccgaagcaggcg

SEQ ID NO: 1662130 - RNA, 17 nt, Salmonella enterica enterica serovar Typhi
gcggcgcuauccggcau

SEQ ID NO: 1662131 - RNA, 19 nt, Salmonella enterica enterica serovar Typhi
gcggcgccuuguccggcgu

SEQ ID NO: 1662132 - RNA, 21 nt, Salmonella enterica enterica serovar Typhi
gcgugcuaagcuggauaccgc

SEQ ID NO: 1662133 - RNA, 21 nt, Salmonella enterica enterica serovar Typhi
gcgucucucccucaaccaggg

SEQ ID NO: 1662134 - RNA, 20 nt, Salmonella enterica enterica serovar Typhi
gcgucugagcaucccgguaa

SEQ ID NO: 1662135 - RNA, 16 nt, Salmonella enterica enterica serovar Typhi
gcgucugaaugacgcc

SEQ ID NO: 1662136 - RNA, 23 nt, Salmonella enterica enterica serovar Typhi
gcgucugcaccgguacacacgcg

SEQ ID NO: 1662137 - RNA, 18 nt, Salmonella enterica enterica serovar Typhi
gcgugacgacuaccgccg

SEQ ID NO: 1662138 - RNA, 16 nt, Salmonella enterica enterica serovar Typhi
gcguuccaguaauuuc

SEQ ID NO: 1662139 - RNA, 22 nt, Salmonella enterica enterica serovar Typhi
gcguuaccuauuuguuccggca

SEQ ID NO: 1662140 - RNA, 12 nt, Salmonella enterica enterica serovar Typhi
gcguuacgcgcc

SEQ ID NO: 1662141 - RNA, 20 nt, Salmonella enterica enterica serovar Typhi
gcguuacuggcgaccggcag

SEQ ID NO: 1662142 - RNA, 20 nt, Salmonella enterica enterica serovar Typhi
gcguuaauauccuucagcgu

SEQ ID NO: 1662143 - RNA, 19 nt, Salmonella enterica enterica serovar Typhi
gcguuaacguaaagccauc

SEQ ID NO: 1662144 - RNA, 18 nt, Salmonella enterica enterica serovar Typhi
gcguguugccggaccagc

SEQ ID NO: 1662145 - RNA, 20 nt, Salmonella enterica enterica serovar Typhi
gcgugucagggcggaacagc

SEQ ID NO: 1662146 - RNA, 18 nt, Salmonella enterica enterica serovar Typhi
gcguguagccaaucagcc

SEQ ID NO: 1662147 - RNA, 16 nt, Salmonella enterica enterica serovar Typhi
gcguguauuaaaggau

SEQ ID NO: 1662148 - RNA, 22 nt, Salmonella enterica enterica serovar Typhi
gcgugguaucgcgacagcgcug

SEQ ID NO: 1662149 - RNA, 19 nt, Salmonella enterica enterica serovar Typhi
gcguaaauacggcuuccac

SEQ ID NO: 1662150 - RNA, 15 nt, Salmonella enterica enterica serovar Typhi
gcguaaaucaggcca

SEQ ID NO: 1662151 - RNA, 15 nt, Salmonella enterica enterica serovar Typhi
gcguaacgccuccac

SEQ ID NO: 1662152 - RNA, 20 nt, Salmonella enterica enterica serovar Typhi
gcgguuucuaccacccagcc

SEQ ID NO: 1662153 - RNA, 23 nt, Salmonella enterica enterica serovar Typhi
gcgguuucuaccacccagccaga

SEQ ID NO: 1662154 - RNA, 15 nt, Salmonella enterica enterica serovar Typhi
gcguaaaaaggcgca

SEQ ID NO: 1662155 - RNA, 18 nt, Salmonella enterica enterica serovar Typhi
gcgguucauccugcgcca

SEQ ID NO: 1662156 - RNA, 14 nt, Salmonella enterica enterica serovar Typhi
gcgucgcagugcgc

SEQ ID NO: 1662157 - RNA, 17 nt, Salmonella enterica enterica serovar Typhi
gcgucgaucagcgcgua

SEQ ID NO: 1662158 - RNA, 15 nt, Salmonella enterica enterica serovar Typhi
gcgucgcugauugcc

SEQ ID NO: 1662159 - RNA, 21 nt, Salmonella enterica enterica serovar Typhi
gcucaguugguuagagcacau

SEQ ID NO: 1662160 - RNA, 12 nt, Salmonella enterica enterica serovar Typhi
gcucauccagcg

SEQ ID NO: 1662161 - RNA, 18 nt, Salmonella enterica enterica serovar Typhi
gcucauacgaucgcgcac

SEQ ID NO: 1662162 - RNA, 21 nt, Salmonella enterica enterica serovar Typhi
gcucauagccgcuuuccgccg

SEQ ID NO: 1662163 - RNA, 21 nt, Salmonella enterica enterica serovar Typhi
gcucauauacccugcggcgaa

SEQ ID NO: 1662164 - RNA, 21 nt, Salmonella enterica enterica serovar Typhi
gcucaugauagggcagcaguu

SEQ ID NO: 1662165 - RNA, 22 nt, Salmonella enterica enterica serovar Typhi
gcucaugcgagguauacgccac

SEQ ID NO: 1662166 - RNA, 12 nt, Salmonella enterica enterica serovar Typhi
gcuccagcaguu

SEQ ID NO: 1662167 - RNA, 15 nt, Salmonella enterica enterica serovar Typhi
gcuccagcaucacau

SEQ ID NO: 1662168 - RNA, 13 nt, Salmonella enterica enterica serovar Typhi
gcucagcggcaau

SEQ ID NO: 1662169 - RNA, 16 nt, Salmonella enterica enterica serovar Typhi
gcucagcgcggcagcc

SEQ ID NO: 1662170 - RNA, 16 nt, Salmonella enterica enterica serovar Typhi
gcucagguuauacugu

SEQ ID NO: 1662171 - RNA, 21 nt, Salmonella enterica enterica serovar Typhi
gcucaggguuuucuaccgcag

SEQ ID NO: 1662172 - RNA, 22 nt, Salmonella enterica enterica serovar Typhi
gcucacgcuuuuacaucgcugg

SEQ ID NO: 1662173 - RNA, 20 nt, Salmonella enterica enterica serovar Typhi
gcucagaaccucaucccggc

SEQ ID NO: 1662174 - RNA, 16 nt, Salmonella enterica enterica serovar Typhi
gcuacgcuuauccggc

SEQ ID NO: 1662175 - RNA, 17 nt, Salmonella enterica enterica serovar Typhi
gcuacgcuuauccggcu

SEQ ID NO: 1662176 - RNA, 18 nt, Salmonella enterica enterica serovar Typhi
gcuacgccuuauccggcc

SEQ ID NO: 1662177 - RNA, 20 nt, Salmonella enterica enterica serovar Typhi
gcuacgccuuauccggccua

SEQ ID NO: 1662178 - RNA, 21 nt, Salmonella enterica enterica serovar Typhi
gcuacgcgucgccauccggcg

SEQ ID NO: 1662179 - RNA, 17 nt, Salmonella enterica enterica serovar Typhi
gcuagcgccuuauccgg

SEQ ID NO: 1662180 - RNA, 17 nt, Salmonella enterica enterica serovar Typhi
gcuacugccgccaucgc

SEQ ID NO: 1662181 - RNA, 17 nt, Salmonella enterica enterica serovar Typhi
gcuacugagcgucacgc

SEQ ID NO: 1662182 - RNA, 15 nt, Salmonella enterica enterica serovar Typhi
gcuaccgcguaauga

SEQ ID NO: 1662183 - RNA, 14 nt, Salmonella enterica enterica serovar Typhi
gcuaccgcgcgaac

SEQ ID NO: 1662184 - RNA, 19 nt, Salmonella enterica enterica serovar Typhi
gcuauuuucucuugcucac

SEQ ID NO: 1662185 - RNA, 20 nt, Salmonella enterica enterica serovar Typhi
gcucaacgccuuugcaaucg

SEQ ID NO: 1662186 - RNA, 21 nt, Salmonella enterica enterica serovar Typhi
gcucacauucauugccgccag

SEQ ID NO: 1662187 - RNA, 23 nt, Salmonella enterica enterica serovar Typhi
gcuaugcuccaguuguuccagca

SEQ ID NO: 1662188 - RNA, 23 nt, Salmonella enterica enterica serovar Typhi
gcuaucgcccaaauaguccagca

SEQ ID NO: 1662189 - RNA, 14 nt, Salmonella enterica enterica serovar Typhi
gcuaucgcggauaa

SEQ ID NO: 1662190 - RNA, 15 nt, Salmonella enterica enterica serovar Typhi
gcuauccaucgccgc

SEQ ID NO: 1662191 - RNA, 14 nt, Salmonella enterica enterica serovar Typhi
gcuauagaaugcaa

SEQ ID NO: 1662192 - RNA, 20 nt, Salmonella enterica enterica serovar Typhi
gcuaucacacauaucgccag

SEQ ID NO: 1662193 - RNA, 20 nt, Salmonella enterica enterica serovar Typhi
gcuauccgccgccagccaua

SEQ ID NO: 1662194 - RNA, 14 nt, Salmonella enterica enterica serovar Typhi
gcuaucgaccagca

SEQ ID NO: 1662195 - RNA, 14 nt, Salmonella enterica enterica serovar Typhi
gcuaucccgaugcu

SEQ ID NO: 1662196 - RNA, 16 nt, Salmonella enterica enterica serovar Typhi
gcuaucaggccuacaa

SEQ ID NO: 1662197 - RNA, 16 nt, Salmonella enterica enterica serovar Typhi
gcuauccgccgccagc

SEQ ID NO: 1662198 - RNA, 21 nt, Salmonella enterica enterica serovar Typhi
gcuagcgccuuauccggccua

SEQ ID NO: 1662199 - RNA, 16 nt, Salmonella enterica enterica serovar Typhi
gcuauacgcggcguac

SEQ ID NO: 1662200 - RNA, 22 nt, Salmonella enterica enterica serovar Typhi
gcugaagccugcuucaccgcgc

SEQ ID NO: 1662201 - RNA, 23 nt, Salmonella enterica enterica serovar Typhi
gcugaaaacggcaucaagcccau

SEQ ID NO: 1662202 - RNA, 18 nt, Salmonella enterica enterica serovar Typhi
gcucuuuuccacggcgcu

SEQ ID NO: 1662203 - RNA, 19 nt, Salmonella enterica enterica serovar Typhi
gcugaaaaucaaaucggcg

SEQ ID NO: 1662204 - RNA, 13 nt, Salmonella enterica enterica serovar Typhi
gcugaaagcgccu

SEQ ID NO: 1662205 - RNA, 21 nt, Salmonella enterica enterica serovar Typhi
gcugacggauacgcugcguca

SEQ ID NO: 1662206 - RNA, 15 nt, Salmonella enterica enterica serovar Typhi
gcugacggauacgcu

SEQ ID NO: 1662207 - RNA, 17 nt, Salmonella enterica enterica serovar Typhi
gcugacgcagcaguucc

SEQ ID NO: 1662208 - RNA, 19 nt, Salmonella enterica enterica serovar Typhi
gcugacgcccaucagcauc

SEQ ID NO: 1662209 - RNA, 12 nt, Salmonella enterica enterica serovar Typhi
gcugaauaaccc

SEQ ID NO: 1662210 - RNA, 17 nt, Salmonella enterica enterica serovar Typhi
gcugcaaaucaccacau

SEQ ID NO: 1662211 - RNA, 22 nt, Salmonella enterica enterica serovar Typhi
gcugaucgcgagaguaagccca

SEQ ID NO: 1662212 - RNA, 17 nt, Salmonella enterica enterica serovar Typhi
gcugaucgugauaggcc

SEQ ID NO: 1662213 - RNA, 18 nt, Salmonella enterica enterica serovar Typhi
gcugaggauggcgcggca

SEQ ID NO: 1662214 - RNA, 13 nt, Salmonella enterica enterica serovar Typhi
gcugccagcgccg

SEQ ID NO: 1662215 - RNA, 22 nt, Salmonella enterica enterica serovar Typhi
gcugccgacaacgccuccugcc

SEQ ID NO: 1662216 - RNA, 13 nt, Salmonella enterica enterica serovar Typhi
gcugcccugcggu

SEQ ID NO: 1662217 - RNA, 22 nt, Salmonella enterica enterica serovar Typhi
gcugcaucuuacugaccggccc

SEQ ID NO: 1662218 - RNA, 20 nt, Salmonella enterica enterica serovar Typhi
gcucggcauacaccgccagc

SEQ ID NO: 1662219 - RNA, 22 nt, Salmonella enterica enterica serovar Typhi
gcuccaugaucgccuggccgau

SEQ ID NO: 1662220 - RNA, 20 nt, Salmonella enterica enterica serovar Typhi
gcucuucaggcguauauucg

SEQ ID NO: 1662221 - RNA, 23 nt, Salmonella enterica enterica serovar Typhi
gcucuggacguugagcguuacgg

SEQ ID NO: 1662222 - RNA, 20 nt, Salmonella enterica enterica serovar Typhi
gcucucuuucaccagcgcca

SEQ ID NO: 1662223 - RNA, 18 nt, Salmonella enterica enterica serovar Typhi
gcucguaaagcaucagac

SEQ ID NO: 1662224 - RNA, 23 nt, Salmonella enterica enterica serovar Typhi
gcuggcaacauuaaucuuaucca

SEQ ID NO: 1662225 - RNA, 16 nt, Salmonella enterica enterica serovar Typhi
gcuggauucucuccca

SEQ ID NO: 1662226 - RNA, 15 nt, Salmonella enterica enterica serovar Typhi
gcuggaugcgcaaau

SEQ ID NO: 1662227 - RNA, 16 nt, Salmonella enterica enterica serovar Typhi
gcuggauaccgcgcca

SEQ ID NO: 1662228 - RNA, 19 nt, Salmonella enterica enterica serovar Typhi
gcuggccaaacugcggaau

SEQ ID NO: 1662229 - RNA, 21 nt, Salmonella enterica enterica serovar Typhi
gcugcuuuaaccuggcgcaca

SEQ ID NO: 1662230 - RNA, 17 nt, Salmonella enterica enterica serovar Typhi
gcugcuuaccauacuga

SEQ ID NO: 1662231 - RNA, 20 nt, Salmonella enterica enterica serovar Typhi
gcugcuguggauuuauggcg

SEQ ID NO: 1662232 - RNA, 18 nt, Salmonella enterica enterica serovar Typhi
gcugcucggguaaggcau

SEQ ID NO: 1662233 - RNA, 17 nt, Salmonella enterica enterica serovar Typhi
gcugggccugcuccgua

SEQ ID NO: 1662234 - RNA, 15 nt, Salmonella enterica enterica serovar Typhi
gcuggcguacgccau

SEQ ID NO: 1662235 - RNA, 14 nt, Salmonella enterica enterica serovar Typhi
gcuggcgagcagga

SEQ ID NO: 1662236 - RNA, 15 nt, Salmonella enterica enterica serovar Typhi
gcuggcgaaucgcau

SEQ ID NO: 1662237 - RNA, 12 nt, Salmonella enterica enterica serovar Typhi
gcuggccgguug

SEQ ID NO: 1662238 - RNA, 22 nt, Salmonella enterica enterica serovar Typhi
gcuggugaaacguguuuauccc

SEQ ID NO: 1662239 - RNA, 17 nt, Salmonella enterica enterica serovar Typhi
gcuggugcgaauaagcu

SEQ ID NO: 1662240 - RNA, 17 nt, Salmonella enterica enterica serovar Typhi
gcuguagcugcccggau

SEQ ID NO: 1662241 - RNA, 23 nt, Salmonella enterica enterica serovar Typhi
gcugugcaacaucuuaccggugc

SEQ ID NO: 1662242 - RNA, 12 nt, Salmonella enterica enterica serovar Typhi
gcugucguuuca

SEQ ID NO: 1662243 - RNA, 20 nt, Salmonella enterica enterica serovar Typhi
gcugucagugaaaaaccgau

SEQ ID NO: 1662244 - RNA, 20 nt, Salmonella enterica enterica serovar Typhi
ggaugaggcgcagccgccau

SEQ ID NO: 1662245 - RNA, 16 nt, Salmonella enterica enterica serovar Typhi
ggaucguacaacggau

SEQ ID NO: 1662246 - RNA, 21 nt, Salmonella enterica enterica serovar Typhi
ggaucguacaacggaucgccu

SEQ ID NO: 1662247 - RNA, 17 nt, Salmonella enterica enterica serovar Typhi
ggaugcgcugaauagcg

SEQ ID NO: 1662248 - RNA, 16 nt, Salmonella enterica enterica serovar Typhi
ggauggccucugccag

SEQ ID NO: 1662249 - RNA, 14 nt, Salmonella enterica enterica serovar Typhi
ggaugcgcuaucga

SEQ ID NO: 1662250 - RNA, 16 nt, Salmonella enterica enterica serovar Typhi
ggaugccccaucacgg

SEQ ID NO: 1662251 - RNA, 21 nt, Salmonella enterica enterica serovar Typhi
ggaugcccguagugauagcaa

SEQ ID NO: 1662252 - RNA, 20 nt, Salmonella enterica enterica serovar Typhi
ggauagugauauagcgccau

SEQ ID NO: 1662253 - RNA, 23 nt, Salmonella enterica enterica serovar Typhi
ggaucaaccaccuucaccggaua

SEQ ID NO: 1662254 - RNA, 21 nt, Salmonella enterica enterica serovar Typhi
ggauauucugcacgcacgaca

SEQ ID NO: 1662255 - RNA, 19 nt, Salmonella enterica enterica serovar Typhi
ggaucaucggcucagcaau

SEQ ID NO: 1662256 - RNA, 17 nt, Salmonella enterica enterica serovar Typhi
ggaucggcacacagcca

SEQ ID NO: 1662257 - RNA, 16 nt, Salmonella enterica enterica serovar Typhi
ggauaaacaccggaau

SEQ ID NO: 1662258 - RNA, 14 nt, Salmonella enterica enterica serovar Typhi
ggauaaagaccggc

SEQ ID NO: 1662259 - RNA, 23 nt, Salmonella enterica enterica serovar Typhi
ggauaaagccaauggugcucagc

SEQ ID NO: 1662260 - RNA, 17 nt, Salmonella enterica enterica serovar Typhi
ggauaagcgcagcgcca

SEQ ID NO: 1662261 - RNA, 19 nt, Salmonella enterica enterica serovar Typhi
ggauaagcauuagcgccau

SEQ ID NO: 1662262 - RNA, 18 nt, Salmonella enterica enterica serovar Typhi
ggauaagcgcagcgccau

SEQ ID NO: 1662263 - RNA, 22 nt, Salmonella enterica enterica serovar Typhi
ggauaacggcgcgaaagcgccu

SEQ ID NO: 1662264 - RNA, 18 nt, Salmonella enterica enterica serovar Typhi
ggauaagcaacgcgccau

SEQ ID NO: 1662265 - RNA, 14 nt, Salmonella enterica enterica serovar Typhi
ggauaagcggcagc

SEQ ID NO: 1662266 - RNA, 18 nt, Salmonella enterica enterica serovar Typhi
ggauaagcggcagcgcca

SEQ ID NO: 1662267 - RNA, 13 nt, Salmonella enterica enterica serovar Typhi
ggauaagcguagc

SEQ ID NO: 1662268 - RNA, 23 nt, Salmonella enterica enterica serovar Typhi
ggauaaggcauucacgccaccau

SEQ ID NO: 1662269 - RNA, 22 nt, Salmonella enterica enterica serovar Typhi
ggauaaggcauuucgccgccau

SEQ ID NO: 1662270 - RNA, 20 nt, Salmonella enterica enterica serovar Typhi
ggauaaggccacgccgccau

SEQ ID NO: 1662271 - RNA, 20 nt, Salmonella enterica enterica serovar Typhi
ggauaaggcgcagccgccau

SEQ ID NO: 1662272 - RNA, 17 nt, Salmonella enterica enterica serovar Typhi
ggauacgccagcagaca

SEQ ID NO: 1662273 - RNA, 17 nt, Salmonella enterica enterica serovar Typhi
ggauagcguagcgccau

SEQ ID NO: 1662274 - RNA, 16 nt, Salmonella enterica enterica serovar Typhi
ggauagagaucuuccg

SEQ ID NO: 1662275 - RNA, 20 nt, Salmonella enterica enterica serovar Typhi
ggauaaggcgcuagccgcau

SEQ ID NO: 1662276 - RNA, 18 nt, Salmonella enterica enterica serovar Typhi
ggauaaugucgacgcgcu

SEQ ID NO: 1662277 - RNA, 15 nt, Salmonella enterica enterica serovar Typhi
ggauaccacgcacau

SEQ ID NO: 1662278 - RNA, 23 nt, Salmonella enterica enterica serovar Typhi
ggauaagguguuuacgccgccau

SEQ ID NO: 1662279 - RNA, 23 nt, Salmonella enterica enterica serovar Typhi
ggauaaggcguuuacgccgccau

SEQ ID NO: 1662280 - RNA, 14 nt, Salmonella enterica enterica serovar Typhi
ggauaaggcgugag

SEQ ID NO: 1662281 - RNA, 23 nt, Salmonella enterica enterica serovar Typhi
ggauaaggcguucacgccgccau

SEQ ID NO: 1662282 - RNA, 18 nt, Salmonella enterica enterica serovar Typhi
ggagcgaagaauucgcaa

SEQ ID NO: 1662283 - RNA, 18 nt, Salmonella enterica enterica serovar Typhi
ggagcgaaaaggccuggc

SEQ ID NO: 1662284 - RNA, 21 nt, Salmonella enterica enterica serovar Typhi
ggagcauagauaacuauguga

SEQ ID NO: 1662285 - RNA, 18 nt, Salmonella enterica enterica serovar Typhi
ggagcagacuguaaaucu

SEQ ID NO: 1662286 - RNA, 21 nt, Salmonella enterica enterica serovar Typhi
ggagagcggauaauccgccac

SEQ ID NO: 1662287 - RNA, 23 nt, Salmonella enterica enterica serovar Typhi
ggacauggucaccaugacgcagg

SEQ ID NO: 1662288 - RNA, 12 nt, Salmonella enterica enterica serovar Typhi
ggaccguacuca

SEQ ID NO: 1662289 - RNA, 21 nt, Salmonella enterica enterica serovar Typhi
gcuuuuuugcuggcuggcggu

SEQ ID NO: 1662290 - RNA, 20 nt, Salmonella enterica enterica serovar Typhi
ggaaaacgcgcugauaccgu

SEQ ID NO: 1662291 - RNA, 17 nt, Salmonella enterica enterica serovar Typhi
ggaacggagagcaacau

SEQ ID NO: 1662292 - RNA, 18 nt, Salmonella enterica enterica serovar Typhi
ggaagcugcgcagcacuu

SEQ ID NO: 1662293 - RNA, 23 nt, Salmonella enterica enterica serovar Typhi
ggaacugccuggcucauucuccg

SEQ ID NO: 1662294 - RNA, 22 nt, Salmonella enterica enterica serovar Typhi
ggaacuaacccgcagccggaau

SEQ ID NO: 1662295 - RNA, 21 nt, Salmonella enterica enterica serovar Typhi
ggaacguccaguugucaucgu

SEQ ID NO: 1662296 - RNA, 21 nt, Salmonella enterica enterica serovar Typhi
ggaauccccggcuuccagcgg

SEQ ID NO: 1662297 - RNA, 13 nt, Salmonella enterica enterica serovar Typhi
gcuguuuuccgcu

SEQ ID NO: 1662298 - RNA, 15 nt, Salmonella enterica enterica serovar Typhi
gcuguuuauggcgcu

SEQ ID NO: 1662299 - RNA, 22 nt, Salmonella enterica enterica serovar Typhi
gcuguugguuuauugauaggcc

SEQ ID NO: 1662300 - RNA, 20 nt, Salmonella enterica enterica serovar Typhi
gcuugcaggaugucgauaau

SEQ ID NO: 1662301 - RNA, 19 nt, Salmonella enterica enterica serovar Typhi
gcuugccgggccguagugc

SEQ ID NO: 1662302 - RNA, 17 nt, Salmonella enterica enterica serovar Typhi
gcuugcgccgccauccg

SEQ ID NO: 1662303 - RNA, 20 nt, Salmonella enterica enterica serovar Typhi
gcuugcgccaucauccggca

SEQ ID NO: 1662304 - RNA, 21 nt, Salmonella enterica enterica serovar Typhi
gcuuucauccaauaacguaac

SEQ ID NO: 1662305 - RNA, 13 nt, Salmonella enterica enterica serovar Typhi
gcuuucaauaaau

SEQ ID NO: 1662306 - RNA, 18 nt, Salmonella enterica enterica serovar Typhi
gcuuucacaccguuaucc

SEQ ID NO: 1662307 - RNA, 19 nt, Salmonella enterica enterica serovar Typhi
gcuuuuauguuacccagcc

SEQ ID NO: 1662308 - RNA, 14 nt, Salmonella enterica enterica serovar Typhi
gcuuuucagcgcca

SEQ ID NO: 1662309 - RNA, 19 nt, Salmonella enterica enterica serovar Typhi
gcuuuuaguuacgcacgcc

SEQ ID NO: 1662310 - RNA, 23 nt, Salmonella enterica enterica serovar Typhi
gcuuuucgcuuaaacauauacug

SEQ ID NO: 1662311 - RNA, 21 nt, Salmonella enterica enterica serovar Typhi
gcuuuugaauuugaaggacug

SEQ ID NO: 1662312 - RNA, 22 nt, Salmonella enterica enterica serovar Typhi
gcuuuugccgcgcccagcgccg

SEQ ID NO: 1662313 - RNA, 23 nt, Salmonella enterica enterica serovar Typhi
gcuuuuggcggccagcgugucau

SEQ ID NO: 1662314 - RNA, 15 nt, Salmonella enterica enterica serovar Typhi
gcuuuuuccagcauu

SEQ ID NO: 1662315 - RNA, 15 nt, Salmonella enterica enterica serovar Typhi
ugacaagcagcggaa

SEQ ID NO: 1662316 - RNA, 23 nt, Salmonella enterica enterica serovar Typhi
ugaauuuuagauccccaaacugc

SEQ ID NO: 1662317 - RNA, 19 nt, Salmonella enterica enterica serovar Typhi
ugacacagcguacaauggc

SEQ ID NO: 1662318 - RNA, 19 nt, Salmonella enterica enterica serovar Typhi
ugacacagucauugguaag

SEQ ID NO: 1662319 - RNA, 21 nt, Salmonella enterica enterica serovar Typhi
ugaaucguagcgugcgcaaua

SEQ ID NO: 1662320 - RNA, 15 nt, Salmonella enterica enterica serovar Typhi
ugaaucccgccaucg

SEQ ID NO: 1662321 - RNA, 21 nt, Salmonella enterica enterica serovar Typhi
ugaaucccccugccacaaccg

SEQ ID NO: 1662322 - RNA, 18 nt, Salmonella enterica enterica serovar Typhi
ugaauugcgguuuauccc

SEQ ID NO: 1662323 - RNA, 19 nt, Salmonella enterica enterica serovar Typhi
ugaauguugcucgcggcgu

SEQ ID NO: 1662324 - RNA, 17 nt, Salmonella enterica enterica serovar Typhi
ugacauuuaucuuccgg

SEQ ID NO: 1662325 - RNA, 13 nt, Salmonella enterica enterica serovar Typhi
ugacaucugccgc

SEQ ID NO: 1662326 - RNA, 18 nt, Salmonella enterica enterica serovar Typhi
ugaccagccuaccugccg

SEQ ID NO: 1662327 - RNA, 17 nt, Salmonella enterica enterica serovar Typhi
ugaccaccauauucgcc

SEQ ID NO: 1662328 - RNA, 21 nt, Salmonella enterica enterica serovar Typhi
ugaacucgccucgcugcuguu

SEQ ID NO: 1662329 - RNA, 18 nt, Salmonella enterica enterica serovar Typhi
ugaagauguagucgccuu

SEQ ID NO: 1662330 - RNA, 12 nt, Salmonella enterica enterica serovar Typhi
ugaagacaacgu

SEQ ID NO: 1662331 - RNA, 15 nt, Salmonella enterica enterica serovar Typhi
ugaagcguuccagua

SEQ ID NO: 1662332 - RNA, 15 nt, Salmonella enterica enterica serovar Typhi
ugaagcuaaccgcgc

SEQ ID NO: 1662333 - RNA, 17 nt, Salmonella enterica enterica serovar Typhi
ugaauaucaaaccacgc

SEQ ID NO: 1662334 - RNA, 18 nt, Salmonella enterica enterica serovar Typhi
ugaaucagggaugccccu

SEQ ID NO: 1662335 - RNA, 15 nt, Salmonella enterica enterica serovar Typhi
ugaaguuauccagcg

SEQ ID NO: 1662336 - RNA, 15 nt, Salmonella enterica enterica serovar Typhi
ugaauaaaaccggca

SEQ ID NO: 1662337 - RNA, 12 nt, Salmonella enterica enterica serovar Typhi
ucuuuauucgcg

SEQ ID NO: 1662338 - RNA, 17 nt, Salmonella enterica enterica serovar Typhi
ucuuuggacggcaucag

SEQ ID NO: 1662339 - RNA, 20 nt, Salmonella enterica enterica serovar Typhi
ucuuuuaucguugcuucgcg

SEQ ID NO: 1662340 - RNA, 20 nt, Salmonella enterica enterica serovar Typhi
ucuuuacgcuuauacggcug

SEQ ID NO: 1662341 - RNA, 14 nt, Salmonella enterica enterica serovar Typhi
ugaaaacgaaucuc

SEQ ID NO: 1662342 - RNA, 18 nt, Salmonella enterica enterica serovar Typhi
ugaaaauguaucagacgu

SEQ ID NO: 1662343 - RNA, 24 nt, Salmonella enterica enterica serovar Typhi
ugaaaaccacaaucacagcgcaga

SEQ ID NO: 1662344 - RNA, 13 nt, Salmonella enterica enterica serovar Typhi
ugaaaaaacgggc

SEQ ID NO: 1662345 - RNA, 20 nt, Salmonella enterica enterica serovar Typhi
ucuuccugcugcgccagcgc

SEQ ID NO: 1662346 - RNA, 20 nt, Salmonella enterica enterica serovar Typhi
ucuuccgggcgcgaucuguu

SEQ ID NO: 1662347 - RNA, 16 nt, Salmonella enterica enterica serovar Typhi
ucuuccugcugcgcca

SEQ ID NO: 1662348 - RNA, 20 nt, Salmonella enterica enterica serovar Typhi
ucuuccgcaauaugcgucag

SEQ ID NO: 1662349 - RNA, 15 nt, Salmonella enterica enterica serovar Typhi
ucuguugcgccaggg

SEQ ID NO: 1662350 - RNA, 12 nt, Salmonella enterica enterica serovar Typhi
ucuugcacaaua

SEQ ID NO: 1662351 - RNA, 14 nt, Salmonella enterica enterica serovar Typhi
aauagaacgcucgc

SEQ ID NO: 1662352 - RNA, 18 nt, Salmonella enterica enterica serovar Typhi
ucugucgccaugaccugg

SEQ ID NO: 1662353 - RNA, 23 nt, Salmonella enterica enterica serovar Typhi
ucugucgccgcguaaauccacau

SEQ ID NO: 1662354 - RNA, 23 nt, Salmonella enterica enterica serovar Typhi
aauacguaauaccugaagcccuu

SEQ ID NO: 1662355 - RNA, 20 nt, Salmonella enterica enterica serovar Typhi
ucuguaggccggauaagcgg

SEQ ID NO: 1662356 - RNA, 21 nt, Salmonella enterica enterica serovar Typhi
ucuguaggccggauaaggcgu

SEQ ID NO: 1662357 - RNA, 21 nt, Salmonella enterica enterica serovar Typhi
ucuguccuuucugcugccgca

SEQ ID NO: 1662358 - RNA, 21 nt, Salmonella enterica enterica serovar Typhi
aauacgggcuuaaucaguucg

SEQ ID NO: 1662359 - RNA, 17 nt, Salmonella enterica enterica serovar Typhi
ucugucagaaaucugaa

SEQ ID NO: 1662360 - RNA, 14 nt, Salmonella enterica enterica serovar Typhi
ucugcgcuaagcgu

SEQ ID NO: 1662361 - RNA, 14 nt, Salmonella enterica enterica serovar Typhi
ucuggcgcauaaug

SEQ ID NO: 1662362 - RNA, 15 nt, Salmonella enterica enterica serovar Typhi
ucuggccucuuauca

SEQ ID NO: 1662363 - RNA, 20 nt, Salmonella enterica enterica serovar Typhi
ucuggcgaacgacucacgcg

SEQ ID NO: 1662364 - RNA, 13 nt, Salmonella enterica enterica serovar Typhi
ucuggcugcugau

SEQ ID NO: 1662365 - RNA, 14 nt, Salmonella enterica enterica serovar Typhi
ucuggcggcguaau

SEQ ID NO: 1662366 - RNA, 13 nt, Salmonella enterica enterica serovar Typhi
ucgucauggcgua

SEQ ID NO: 1662367 - RNA, 23 nt, Salmonella enterica enterica serovar Typhi
ucguccguuucccaagucacgcc

SEQ ID NO: 1662368 - RNA, 21 nt, Salmonella enterica enterica serovar Typhi
ucgucacgacggcgaccggca

SEQ ID NO: 1662369 - RNA, 19 nt, Salmonella enterica enterica serovar Typhi
ucgucaaugugaauccagg

SEQ ID NO: 1662370 - RNA, 17 nt, Salmonella enterica enterica serovar Typhi
ucguacauguccagauc

SEQ ID NO: 1662371 - RNA, 17 nt, Salmonella enterica enterica serovar Typhi
ucguaacaggucacgac

SEQ ID NO: 1662372 - RNA, 14 nt, Salmonella enterica enterica serovar Typhi
ucgucgcuaagcgu

SEQ ID NO: 1662373 - RNA, 11 nt, Salmonella enterica enterica serovar Typhi
ucgucgcgcca

SEQ ID NO: 1662374 - RNA, 12 nt, Salmonella enterica enterica serovar Typhi
ucguccugcaau

SEQ ID NO: 1662375 - RNA, 12 nt, Salmonella enterica enterica serovar Typhi
ucgguaagcgca

SEQ ID NO: 1662376 - RNA, 23 nt, Salmonella enterica enterica serovar Typhi
ucgugccaaggcaucugcgcaac

SEQ ID NO: 1662377 - RNA, 18 nt, Salmonella enterica enterica serovar Typhi
ucgugaucgccaaagcgu

SEQ ID NO: 1662378 - RNA, 17 nt, Salmonella enterica enterica serovar Typhi
ucguuugcaguuccgca

SEQ ID NO: 1662379 - RNA, 15 nt, Salmonella enterica enterica serovar Typhi
ucguucauccgucug

SEQ ID NO: 1662380 - RNA, 12 nt, Salmonella enterica enterica serovar Typhi
ucguuaccgggc

SEQ ID NO: 1662381 - RNA, 15 nt, Salmonella enterica enterica serovar Typhi
ucguuauccagcagc

SEQ ID NO: 1662382 - RNA, 17 nt, Salmonella enterica enterica serovar Typhi
ucuaaaucauaccagcg

SEQ ID NO: 1662383 - RNA, 18 nt, Salmonella enterica enterica serovar Typhi
ucuaccacgcugccgccg

SEQ ID NO: 1662384 - RNA, 22 nt, Salmonella enterica enterica serovar Typhi
ucuaccguaggccggauaagcg

SEQ ID NO: 1662385 - RNA, 12 nt, Salmonella enterica enterica serovar Typhi
ucucccagcaug

SEQ ID NO: 1662386 - RNA, 18 nt, Salmonella enterica enterica serovar Typhi
ucuccuccucauucagcg

SEQ ID NO: 1662387 - RNA, 17 nt, Salmonella enterica enterica serovar Typhi
ucuaucuguaacuucgg

SEQ ID NO: 1662388 - RNA, 13 nt, Salmonella enterica enterica serovar Typhi
ugccgccaucgcu

SEQ ID NO: 1662389 - RNA, 13 nt, Salmonella enterica enterica serovar Typhi
ugccgccggacca

SEQ ID NO: 1662390 - RNA, 15 nt, Salmonella enterica enterica serovar Typhi
ugccgcgaucgcggc

SEQ ID NO: 1662391 - RNA, 14 nt, Salmonella enterica enterica serovar Typhi
ugccgcgaucgcgg

SEQ ID NO: 1662392 - RNA, 21 nt, Salmonella enterica enterica serovar Typhi
ugccgcacauguuaaauacgc

SEQ ID NO: 1662393 - RNA, 13 nt, Salmonella enterica enterica serovar Typhi
ugccgcaaaaaug

SEQ ID NO: 1662394 - RNA, 17 nt, Salmonella enterica enterica serovar Typhi
ugccgaugccugcgaga

SEQ ID NO: 1662395 - RNA, 16 nt, Salmonella enterica enterica serovar Typhi
ugccgaugaacgacgc

SEQ ID NO: 1662396 - RNA, 17 nt, Salmonella enterica enterica serovar Typhi
ugccgaugaaagagcgc

SEQ ID NO: 1662397 - RNA, 16 nt, Salmonella enterica enterica serovar Typhi
ugccgaccaaugacgc

SEQ ID NO: 1662398 - RNA, 16 nt, Salmonella enterica enterica serovar Typhi
ugcccucuuccagcgc

SEQ ID NO: 1662399 - RNA, 23 nt, Salmonella enterica enterica serovar Typhi
ugccgaagucaaaggccaguaag

SEQ ID NO: 1662400 - RNA, 21 nt, Salmonella enterica enterica serovar Typhi
ugcaucuuaucaggccgacaa

SEQ ID NO: 1662401 - RNA, 20 nt, Salmonella enterica enterica serovar Typhi
ugccaacauggggagcagca

SEQ ID NO: 1662402 - RNA, 15 nt, Salmonella enterica enterica serovar Typhi
ugcauuguuccugcu

SEQ ID NO: 1662403 - RNA, 16 nt, Salmonella enterica enterica serovar Typhi
ugcauugccgggcuga

SEQ ID NO: 1662404 - RNA, 16 nt, Salmonella enterica enterica serovar Typhi
ugcauuguccgcauuc

SEQ ID NO: 1662405 - RNA, 15 nt, Salmonella enterica enterica serovar Typhi
ugcauucgcccgcaa

SEQ ID NO: 1662406 - RNA, 11 nt, Salmonella enterica enterica serovar Typhi
ugcauuccgcg

SEQ ID NO: 1662407 - RNA, 20 nt, Salmonella enterica enterica serovar Typhi
ugcauccuguaccaccacgc

SEQ ID NO: 1662408 - RNA, 19 nt, Salmonella enterica enterica serovar Typhi
ugcagugaaccaucggcaa

SEQ ID NO: 1662409 - RNA, 13 nt, Salmonella enterica enterica serovar Typhi
ugcaggccggaua

SEQ ID NO: 1662410 - RNA, 18 nt, Salmonella enterica enterica serovar Typhi
ugcaggccggauaagccg

SEQ ID NO: 1662411 - RNA, 16 nt, Salmonella enterica enterica serovar Typhi
ugcccaccuucgcgga

SEQ ID NO: 1662412 - RNA, 16 nt, Salmonella enterica enterica serovar Typhi
ugcccaaccugcgcag

SEQ ID NO: 1662413 - RNA, 14 nt, Salmonella enterica enterica serovar Typhi
ugccaguaccgccg

SEQ ID NO: 1662414 - RNA, 14 nt, Salmonella enterica enterica serovar Typhi
ugccaguacagcag

SEQ ID NO: 1662415 - RNA, 20 nt, Salmonella enterica enterica serovar Typhi
ugccaguacagcagcgacgc

SEQ ID NO: 1662416 - RNA, 17 nt, Salmonella enterica enterica serovar Typhi
ugccaguaacucaucgc

SEQ ID NO: 1662417 - RNA, 12 nt, Salmonella enterica enterica serovar Typhi
ugccaguaacgu

SEQ ID NO: 1662418 - RNA, 15 nt, Salmonella enterica enterica serovar Typhi
ugagaauucugcgcg

SEQ ID NO: 1662419 - RNA, 21 nt, Salmonella enterica enterica serovar Typhi
ugagacgugugauuguggcgu

SEQ ID NO: 1662420 - RNA, 17 nt, Salmonella enterica enterica serovar Typhi
ugacuuguuccagucca

SEQ ID NO: 1662421 - RNA, 15 nt, Salmonella enterica enterica serovar Typhi
ugagaaaauuacgcc

SEQ ID NO: 1662422 - RNA, 12 nt, Salmonella enterica enterica serovar Typhi
ugagaucguuau

SEQ ID NO: 1662423 - RNA, 21 nt, Salmonella enterica enterica serovar Typhi
ugagaugaccauaugcggcau

SEQ ID NO: 1662424 - RNA, 13 nt, Salmonella enterica enterica serovar Typhi
ugaccccggccuc

SEQ ID NO: 1662425 - RNA, 19 nt, Salmonella enterica enterica serovar Typhi
ugaccaguggcguaacgau

SEQ ID NO: 1662426 - RNA, 16 nt, Salmonella enterica enterica serovar Typhi
ugacccacgccagcag

SEQ ID NO: 1662427 - RNA, 16 nt, Salmonella enterica enterica serovar Typhi
ugacugccagguaauc

SEQ ID NO: 1662428 - RNA, 22 nt, Salmonella enterica enterica serovar Typhi
ugacugacacccaucgcgacau

SEQ ID NO: 1662429 - RNA, 23 nt, Salmonella enterica enterica serovar Typhi
ugauacggaaauagcgccauccu

SEQ ID NO: 1662430 - RNA, 21 nt, Salmonella enterica enterica serovar Typhi
ugauacuguacgcccagccgu

SEQ ID NO: 1662431 - RNA, 17 nt, Salmonella enterica enterica serovar Typhi
ugauagccguucuccag

SEQ ID NO: 1662432 - RNA, 19 nt, Salmonella enterica enterica serovar Typhi
ugauagucauugacagcaa

SEQ ID NO: 1662433 - RNA, 19 nt, Salmonella enterica enterica serovar Typhi
ugauauaaaauggcgcaca

SEQ ID NO: 1662434 - RNA, 18 nt, Salmonella enterica enterica serovar Typhi
ugauauaaucgaaucgcc

SEQ ID NO: 1662435 - RNA, 19 nt, Salmonella enterica enterica serovar Typhi
ugauauaaucgaaucgccu

SEQ ID NO: 1662436 - RNA, 23 nt, Salmonella enterica enterica serovar Typhi
ugagucgacugguaggccugaua

SEQ ID NO: 1662437 - RNA, 17 nt, Salmonella enterica enterica serovar Typhi
ugaguaucgggauggcg

SEQ ID NO: 1662438 - RNA, 20 nt, Salmonella enterica enterica serovar Typhi
ugagcucguuauaagcuuua

SEQ ID NO: 1662439 - RNA, 22 nt, Salmonella enterica enterica serovar Typhi
ugagcccuccuccagcgcgucc

SEQ ID NO: 1662440 - RNA, 22 nt, Salmonella enterica enterica serovar Typhi
ugagccuaaaacauuaaucgcc

SEQ ID NO: 1662441 - RNA, 16 nt, Salmonella enterica enterica serovar Typhi
ugagcggauucgacug

SEQ ID NO: 1662442 - RNA, 18 nt, Salmonella enterica enterica serovar Typhi
ugauuuguaggccugaua

SEQ ID NO: 1662443 - RNA, 20 nt, Salmonella enterica enterica serovar Typhi
ugauuucaggugcuuaucug

SEQ ID NO: 1662444 - RNA, 11 nt, Salmonella enterica enterica serovar Typhi
ugcaaacguag

SEQ ID NO: 1662445 - RNA, 22 nt, Salmonella enterica enterica serovar Typhi
ugcaaaccucucccccgccauu

SEQ ID NO: 1662446 - RNA, 21 nt, Salmonella enterica enterica serovar Typhi
ugcaaauccaucucaggccga

SEQ ID NO: 1662447 - RNA, 22 nt, Salmonella enterica enterica serovar Typhi
ugcaacauuacugaccgagauc

SEQ ID NO: 1662448 - RNA, 17 nt, Salmonella enterica enterica serovar Typhi
ugcaauucggcggcaau

SEQ ID NO: 1662449 - RNA, 15 nt, Salmonella enterica enterica serovar Typhi
ugcaauagcgcgucg

SEQ ID NO: 1662450 - RNA, 16 nt, Salmonella enterica enterica serovar Typhi
ugcaauaucgcggcaa

SEQ ID NO: 1662451 - RNA, 11 nt, Salmonella enterica enterica serovar Typhi
ugauccagcga

SEQ ID NO: 1662452 - RNA, 18 nt, Salmonella enterica enterica serovar Typhi
ugaugaucuucagcccgu

SEQ ID NO: 1662453 - RNA, 21 nt, Salmonella enterica enterica serovar Typhi
ugaugcccucuuccagcgcca

SEQ ID NO: 1662454 - RNA, 17 nt, Salmonella enterica enterica serovar Typhi
ugauccguuucagaaag

SEQ ID NO: 1662455 - RNA, 15 nt, Salmonella enterica enterica serovar Typhi
ugaugaucgcgguaa

SEQ ID NO: 1662456 - RNA, 17 nt, Salmonella enterica enterica serovar Typhi
ugauuaauccgcggaua

SEQ ID NO: 1662457 - RNA, 16 nt, Salmonella enterica enterica serovar Typhi
ugauuaacagcgccau

SEQ ID NO: 1662458 - RNA, 22 nt, Salmonella enterica enterica serovar Typhi
ugauugcuggcagaugaacaua

SEQ ID NO: 1662459 - RNA, 14 nt, Salmonella enterica enterica serovar Typhi
ugauucggguaaac

SEQ ID NO: 1662460 - RNA, 19 nt, Salmonella enterica enterica serovar Typhi
ugauugaaacucgccaugc

SEQ ID NO: 1662461 - RNA, 22 nt, Salmonella enterica enterica serovar Typhi
ugauucaucacguucaggcagu

SEQ ID NO: 1662462 - RNA, 20 nt, Salmonella enterica enterica serovar Typhi
ucccaaccaguaugaccguu

SEQ ID NO: 1662463 - RNA, 19 nt, Salmonella enterica enterica serovar Typhi
uccccugcuccugccagau

SEQ ID NO: 1662464 - RNA, 21 nt, Salmonella enterica enterica serovar Typhi
ucccgaugguauuuauucuau

SEQ ID NO: 1662465 - RNA, 15 nt, Salmonella enterica enterica serovar Typhi
ucccgaugccagcaa

SEQ ID NO: 1662466 - RNA, 12 nt, Salmonella enterica enterica serovar Typhi
ucccgaauacgc

SEQ ID NO: 1662467 - RNA, 12 nt, Salmonella enterica enterica serovar Typhi
ucccgaacgaua

SEQ ID NO: 1662468 - RNA, 13 nt, Salmonella enterica enterica serovar Typhi
ucccgcagccacu

SEQ ID NO: 1662469 - RNA, 13 nt, Salmonella enterica enterica serovar Typhi
ucccgcacgcugg

SEQ ID NO: 1662470 - RNA, 15 nt, Salmonella enterica enterica serovar Typhi
uccgccaucgacagc

SEQ ID NO: 1662471 - RNA, 22 nt, Salmonella enterica enterica serovar Typhi
uccgccaugaaaaaaacgcauu

SEQ ID NO: 1662472 - RNA, 14 nt, Salmonella enterica enterica serovar Typhi
uccgccgccgccau

SEQ ID NO: 1662473 - RNA, 15 nt, Salmonella enterica enterica serovar Typhi
uccgcaggcaacaca

SEQ ID NO: 1662474 - RNA, 15 nt, Salmonella enterica enterica serovar Typhi
uccgcagauccagca

SEQ ID NO: 1662475 - RNA, 12 nt, Salmonella enterica enterica serovar Typhi
uccgcagccaga

SEQ ID NO: 1662476 - RNA, 17 nt, Salmonella enterica enterica serovar Typhi
uccgcagccgacgcauu

SEQ ID NO: 1662477 - RNA, 20 nt, Salmonella enterica enterica serovar Typhi
uccgcacgccugcauaaagg

SEQ ID NO: 1662478 - RNA, 11 nt, Salmonella enterica enterica serovar Typhi
uccgauagcga

SEQ ID NO: 1662479 - RNA, 22 nt, Salmonella enterica enterica serovar Typhi
uccgaugcgcuuuacugucgcu

SEQ ID NO: 1662480 - RNA, 21 nt, Salmonella enterica enterica serovar Typhi
uccgauggagugcaaucccgg

SEQ ID NO: 1662481 - RNA, 12 nt, Salmonella enterica enterica serovar Typhi
uccgacgccugu

SEQ ID NO: 1662482 - RNA, 18 nt, Salmonella enterica enterica serovar Typhi
uccgcuuucuucccggca

SEQ ID NO: 1662483 - RNA, 21 nt, Salmonella enterica enterica serovar Typhi
uccggaucaucuuuuaccgcc

SEQ ID NO: 1662484 - RNA, 22 nt, Salmonella enterica enterica serovar Typhi
uccgccggaaacuggcgucaug

SEQ ID NO: 1662485 - RNA, 17 nt, Salmonella enterica enterica serovar Typhi
uccgcgcaauaugcggc

SEQ ID NO: 1662486 - RNA, 14 nt, Salmonella enterica enterica serovar Typhi
uccgcgcaaucgcc

SEQ ID NO: 1662487 - RNA, 17 nt, Salmonella enterica enterica serovar Typhi
uccggcaucuuaaagcg

SEQ ID NO: 1662488 - RNA, 14 nt, Salmonella enterica enterica serovar Typhi
uccggccagcgcca

SEQ ID NO: 1662489 - RNA, 17 nt, Salmonella enterica enterica serovar Typhi
uccggccagcgccagcg

SEQ ID NO: 1662490 - RNA, 21 nt, Salmonella enterica enterica serovar Typhi
uccggcauaauaugcaacacg

SEQ ID NO: 1662491 - RNA, 18 nt, Salmonella enterica enterica serovar Typhi
uccggcugccugccggau

SEQ ID NO: 1662492 - RNA, 17 nt, Salmonella enterica enterica serovar Typhi
uccggcguuuuagcgcc

SEQ ID NO: 1662493 - RNA, 15 nt, Salmonella enterica enterica serovar Typhi
uccggcgauagcggc

SEQ ID NO: 1662494 - RNA, 14 nt, Salmonella enterica enterica serovar Typhi
uccguuagcuggca

SEQ ID NO: 1662495 - RNA, 22 nt, Salmonella enterica enterica serovar Typhi
uccuauuugcuugugacggcaa

SEQ ID NO: 1662496 - RNA, 20 nt, Salmonella enterica enterica serovar Typhi
uccuccgccgauaagcgcug

SEQ ID NO: 1662497 - RNA, 16 nt, Salmonella enterica enterica serovar Typhi
uccuccggcugaagcc

SEQ ID NO: 1662498 - RNA, 17 nt, Salmonella enterica enterica serovar Typhi
uccuccaacgugcagau

SEQ ID NO: 1662499 - RNA, 17 nt, Salmonella enterica enterica serovar Typhi
uccguucaucggcauac

SEQ ID NO: 1662500 - RNA, 14 nt, Salmonella enterica enterica serovar Typhi
uccguuaagcccug

SEQ ID NO: 1662501 - RNA, 22 nt, Salmonella enterica enterica serovar Typhi
ucgacgggacgaauuuccagcg

SEQ ID NO: 1662502 - RNA, 13 nt, Salmonella enterica enterica serovar Typhi
ucgauauaucgcg

SEQ ID NO: 1662503 - RNA, 16 nt, Salmonella enterica enterica serovar Typhi
ucgauggccucaucau

SEQ ID NO: 1662504 - RNA, 22 nt, Salmonella enterica enterica serovar Typhi
ucgaugcggauccggcgcagac

SEQ ID NO: 1662505 - RNA, 19 nt, Salmonella enterica enterica serovar Typhi
ucgaugccacagcgcauuc

SEQ ID NO: 1662506 - RNA, 12 nt, Salmonella enterica enterica serovar Typhi
ucgaugauggcg

SEQ ID NO: 1662507 - RNA, 14 nt, Salmonella enterica enterica serovar Typhi
ucgaugucgucgau

SEQ ID NO: 1662508 - RNA, 12 nt, Salmonella enterica enterica serovar Typhi
ucgauuaaacgc

SEQ ID NO: 1662509 - RNA, 16 nt, Salmonella enterica enterica serovar Typhi
ucgauuuuagcgcauc

SEQ ID NO: 1662510 - RNA, 21 nt, Salmonella enterica enterica serovar Typhi
ucgauuuccgguuccagcggc

SEQ ID NO: 1662511 - RNA, 21 nt, Salmonella enterica enterica serovar Typhi
ucgauuuuguuaugcgcauag

SEQ ID NO: 1662512 - RNA, 12 nt, Salmonella enterica enterica serovar Typhi
ucgcaacgccgc

SEQ ID NO: 1662513 - RNA, 18 nt, Salmonella enterica enterica serovar Typhi
ucgcaaacggaauaaacg

SEQ ID NO: 1662514 - RNA, 15 nt, Salmonella enterica enterica serovar Typhi
ucgcaaacugcgcgc

SEQ ID NO: 1662515 - RNA, 15 nt, Salmonella enterica enterica serovar Typhi
ucgcaaucuccgccg

SEQ ID NO: 1662516 - RNA, 17 nt, Salmonella enterica enterica serovar Typhi
ucgcaaucuggcgcaau

SEQ ID NO: 1662517 - RNA, 14 nt, Salmonella enterica enterica serovar Typhi
ucgcacauaucgca

SEQ ID NO: 1662518 - RNA, 18 nt, Salmonella enterica enterica serovar Typhi
ucgcaagguuagacggcg

SEQ ID NO: 1662519 - RNA, 16 nt, Salmonella enterica enterica serovar Typhi
ucgaaauaaagaaagu

SEQ ID NO: 1662520 - RNA, 15 nt, Salmonella enterica enterica serovar Typhi
ucgaaacgcugcgcu

SEQ ID NO: 1662521 - RNA, 14 nt, Salmonella enterica enterica serovar Typhi
ucgaaaccagcaua

SEQ ID NO: 1662522 - RNA, 23 nt, Salmonella enterica enterica serovar Typhi
ucgaaaccaucgucgucccgcga

SEQ ID NO: 1662523 - RNA, 14 nt, Salmonella enterica enterica serovar Typhi
uccuucuucgccgu

SEQ ID NO: 1662524 - RNA, 18 nt, Salmonella enterica enterica serovar Typhi
uccuuauuaaagccccuu

SEQ ID NO: 1662525 - RNA, 22 nt, Salmonella enterica enterica serovar Typhi
uccuuacagcuucgguccggcg

SEQ ID NO: 1662526 - RNA, 11 nt, Salmonella enterica enterica serovar Typhi
ucgaacgccgc

SEQ ID NO: 1662527 - RNA, 17 nt, Salmonella enterica enterica serovar Typhi
ucgaacuugaccagcac

SEQ ID NO: 1662528 - RNA, 19 nt, Salmonella enterica enterica serovar Typhi
ucgaacucuucgcaaccgg

SEQ ID NO: 1662529 - RNA, 17 nt, Salmonella enterica enterica serovar Typhi
ucgaaucuuauaaaucg

SEQ ID NO: 1662530 - RNA, 14 nt, Salmonella enterica enterica serovar Typhi
ucgacaggcguaaa

SEQ ID NO: 1662531 - RNA, 11 nt, Salmonella enterica enterica serovar Typhi
ucgaccgcaga

SEQ ID NO: 1662532 - RNA, 20 nt, Salmonella enterica enterica serovar Typhi
ucgcccguaccgcggcgcug

SEQ ID NO: 1662533 - RNA, 13 nt, Salmonella enterica enterica serovar Typhi
ucgcccgccagau

SEQ ID NO: 1662534 - RNA, 21 nt, Salmonella enterica enterica serovar Typhi
ucgcccagguuguaucauguu

SEQ ID NO: 1662535 - RNA, 18 nt, Salmonella enterica enterica serovar Typhi
ucgcccggcguaacgcca

SEQ ID NO: 1662536 - RNA, 18 nt, Salmonella enterica enterica serovar Typhi
ucgcagagucgcagcggc

SEQ ID NO: 1662537 - RNA, 21 nt, Salmonella enterica enterica serovar Typhi
ucgccauaaaucagauccacg

SEQ ID NO: 1662538 - RNA, 15 nt, Salmonella enterica enterica serovar Typhi
ucgcagaucgccugg

SEQ ID NO: 1662539 - RNA, 18 nt, Salmonella enterica enterica serovar Typhi
ucgccaucgauagcagcg

SEQ ID NO: 1662540 - RNA, 22 nt, Salmonella enterica enterica serovar Typhi
ucgccggagaaaaagaccgaca

SEQ ID NO: 1662541 - RNA, 21 nt, Salmonella enterica enterica serovar Typhi
ucgccgcgcggaucgccaucg

SEQ ID NO: 1662542 - RNA, 17 nt, Salmonella enterica enterica serovar Typhi
ucgccgcgcgcauaggc

SEQ ID NO: 1662543 - RNA, 14 nt, Salmonella enterica enterica serovar Typhi
ucgccgcaaugacc

SEQ ID NO: 1662544 - RNA, 22 nt, Salmonella enterica enterica serovar Typhi
ucgccgcgauaauaauuaccac

SEQ ID NO: 1662545 - RNA, 17 nt, Salmonella enterica enterica serovar Typhi
ucgcgcaguuccagcgg

SEQ ID NO: 1662546 - RNA, 16 nt, Salmonella enterica enterica serovar Typhi
ucgcgcagcgugaaac

SEQ ID NO: 1662547 - RNA, 19 nt, Salmonella enterica enterica serovar Typhi
ucgcgccggucgccagcau

SEQ ID NO: 1662548 - RNA, 22 nt, Salmonella enterica enterica serovar Typhi
ucgcgcguggugcuuagcuggc

SEQ ID NO: 1662549 - RNA, 22 nt, Salmonella enterica enterica serovar Typhi
ucgcggcaaugaacagcacguu

SEQ ID NO: 1662550 - RNA, 21 nt, Salmonella enterica enterica serovar Typhi
ucgcgcuuucaaucgucagac

SEQ ID NO: 1662551 - RNA, 15 nt, Salmonella enterica enterica serovar Typhi
ucgcgcuuauccgca

SEQ ID NO: 1662552 - RNA, 16 nt, Salmonella enterica enterica serovar Typhi
ucgcgcugcgcaggcg

SEQ ID NO: 1662553 - RNA, 19 nt, Salmonella enterica enterica serovar Typhi
ucgcugugguuuauccgca

SEQ ID NO: 1662554 - RNA, 21 nt, Salmonella enterica enterica serovar Typhi
ucggagagaguauaagcgccg

SEQ ID NO: 1662555 - RNA, 22 nt, Salmonella enterica enterica serovar Typhi
ucggacaacguaccggcaaccg

SEQ ID NO: 1662556 - RNA, 16 nt, Salmonella enterica enterica serovar Typhi
ucggaauuuccgggug

SEQ ID NO: 1662557 - RNA, 18 nt, Salmonella enterica enterica serovar Typhi
ucggcaaaccaugaucgu

SEQ ID NO: 1662558 - RNA, 13 nt, Salmonella enterica enterica serovar Typhi
ucggcaaagccca

SEQ ID NO: 1662559 - RNA, 16 nt, Salmonella enterica enterica serovar Typhi
ucggaugaucgucaac

SEQ ID NO: 1662560 - RNA, 14 nt, Salmonella enterica enterica serovar Typhi
ucggccagcaggcg

SEQ ID NO: 1662561 - RNA, 14 nt, Salmonella enterica enterica serovar Typhi
ucggcggucgcggc

SEQ ID NO: 1662562 - RNA, 13 nt, Salmonella enterica enterica serovar Typhi
ucggcgucgcggc

SEQ ID NO: 1662563 - RNA, 20 nt, Salmonella enterica enterica serovar Typhi
ucggcgcccagcuuacgcgc

SEQ ID NO: 1662564 - RNA, 13 nt, Salmonella enterica enterica serovar Typhi
ucggcgauaaacc

SEQ ID NO: 1662565 - RNA, 23 nt, Salmonella enterica enterica serovar Typhi
uaggcauacacaucuucuacaug

SEQ ID NO: 1662566 - RNA, 15 nt, Salmonella enterica enterica serovar Typhi
uaggauaaaaucgcg

SEQ ID NO: 1662567 - RNA, 13 nt, Salmonella enterica enterica serovar Typhi
aauaaagugcuga

SEQ ID NO: 1662568 - RNA, 16 nt, Salmonella enterica enterica serovar Typhi
aauaaaguuuauuuga

SEQ ID NO: 1662569 - RNA, 22 nt, Salmonella enterica enterica serovar Typhi
aauaaacacuuugcgcggauua

SEQ ID NO: 1662570 - RNA, 14 nt, Salmonella enterica enterica serovar Typhi
aauaaauaauaucg

SEQ ID NO: 1662571 - RNA, 20 nt, Salmonella enterica enterica serovar Typhi
uaggccggauaaggcauuca

SEQ ID NO: 1662572 - RNA, 17 nt, Salmonella enterica enterica serovar Typhi
uaggccagccgacgcuc

SEQ ID NO: 1662573 - RNA, 17 nt, Salmonella enterica enterica serovar Typhi
uaggccggaugagcguu

SEQ ID NO: 1662574 - RNA, 19 nt, Salmonella enterica enterica serovar Typhi
uaggccggauaaggcgcag

SEQ ID NO: 1662575 - RNA, 20 nt, Salmonella enterica enterica serovar Typhi
uaggccggauaaggcgcagc

SEQ ID NO: 1662576 - RNA, 19 nt, Salmonella enterica enterica serovar Typhi
uaggccggauaaggcguua

SEQ ID NO: 1662577 - RNA, 20 nt, Salmonella enterica enterica serovar Typhi
uaggccggauaaggcguuua

SEQ ID NO: 1662578 - RNA, 19 nt, Salmonella enterica enterica serovar Typhi
uaggccggaucaggcguua

SEQ ID NO: 1662579 - RNA, 22 nt, Salmonella enterica enterica serovar Typhi
uaggccugauaagcgcagcgcc

SEQ ID NO: 1662580 - RNA, 15 nt, Salmonella enterica enterica serovar Typhi
uaggccugauaagac

SEQ ID NO: 1662581 - RNA, 19 nt, Salmonella enterica enterica serovar Typhi
uaggccugauaagcgcagc

SEQ ID NO: 1662582 - RNA, 15 nt, Salmonella enterica enterica serovar Typhi
uaggcgccgccgaca

SEQ ID NO: 1662583 - RNA, 17 nt, Salmonella enterica enterica serovar Typhi
uaggcucuaacgcacgg

SEQ ID NO: 1662584 - RNA, 14 nt, Salmonella enterica enterica serovar Typhi
uaggcugaaagcgc

SEQ ID NO: 1662585 - RNA, 19 nt, Salmonella enterica enterica serovar Typhi
uaggcguuagaauaacguu

SEQ ID NO: 1662586 - RNA, 16 nt, Salmonella enterica enterica serovar Typhi
uagcuacgauaaagcu

SEQ ID NO: 1662587 - RNA, 15 nt, Salmonella enterica enterica serovar Typhi
uagcgcugaugcguu

SEQ ID NO: 1662588 - RNA, 18 nt, Salmonella enterica enterica serovar Typhi
uagcgcugaggcgcuggc

SEQ ID NO: 1662589 - RNA, 17 nt, Salmonella enterica enterica serovar Typhi
uagcgugccgacguuca

SEQ ID NO: 1662590 - RNA, 20 nt, Salmonella enterica enterica serovar Typhi
uagcguugauaugcucgaca

SEQ ID NO: 1662591 - RNA, 16 nt, Salmonella enterica enterica serovar Typhi
uagcguuuuauccguu

SEQ ID NO: 1662592 - RNA, 24 nt, Salmonella enterica enterica serovar Typhi
uagcggauugccgcgcucaaucug

SEQ ID NO: 1662593 - RNA, 14 nt, Salmonella enterica enterica serovar Typhi
uagcaccauaaacg

SEQ ID NO: 1662594 - RNA, 16 nt, Salmonella enterica enterica serovar Typhi
uagcaaucauaaagcg

SEQ ID NO: 1662595 - RNA, 18 nt, Salmonella enterica enterica serovar Typhi
uagcaaauugcugauguu

SEQ ID NO: 1662596 - RNA, 15 nt, Salmonella enterica enterica serovar Typhi
uagccgacccgcauc

SEQ ID NO: 1662597 - RNA, 23 nt, Salmonella enterica enterica serovar Typhi
uagccgacggccauaaaccccga

SEQ ID NO: 1662598 - RNA, 13 nt, Salmonella enterica enterica serovar Typhi
uagccuguuauuc

SEQ ID NO: 1662599 - RNA, 16 nt, Salmonella enterica enterica serovar Typhi
uagcgacggcgcgcca

SEQ ID NO: 1662600 - RNA, 12 nt, Salmonella enterica enterica serovar Typhi
uagccguggcug

SEQ ID NO: 1662601 - RNA, 22 nt, Salmonella enterica enterica serovar Typhi
uagccguugucauggcgccacc

SEQ ID NO: 1662602 - RNA, 21 nt, Salmonella enterica enterica serovar Typhi
uagacaguuuuuucguuccag

SEQ ID NO: 1662603 - RNA, 23 nt, Salmonella enterica enterica serovar Typhi
uagacgagcgaaaaacugucgcc

SEQ ID NO: 1662604 - RNA, 14 nt, Salmonella enterica enterica serovar Typhi
uagcaaaaaugccg

SEQ ID NO: 1662605 - RNA, 24 nt, Salmonella enterica enterica serovar Typhi
uagacggccugcaaacgaaucacc

SEQ ID NO: 1662606 - RNA, 17 nt, Salmonella enterica enterica serovar Typhi
uacuggagcucgcgaug

SEQ ID NO: 1662607 - RNA, 16 nt, Salmonella enterica enterica serovar Typhi
uacgguuggccagcau

SEQ ID NO: 1662608 - RNA, 17 nt, Salmonella enterica enterica serovar Typhi
uacguacggauggcguc

SEQ ID NO: 1662609 - RNA, 19 nt, Salmonella enterica enterica serovar Typhi
uacgucgcccucuuuggcg

SEQ ID NO: 1662610 - RNA, 12 nt, Salmonella enterica enterica serovar Typhi
uacguucggacu

SEQ ID NO: 1662611 - RNA, 20 nt, Salmonella enterica enterica serovar Typhi
uacguugauuggcugugaca

SEQ ID NO: 1662612 - RNA, 16 nt, Salmonella enterica enterica serovar Typhi
uacugaccggcccguu

SEQ ID NO: 1662613 - RNA, 18 nt, Salmonella enterica enterica serovar Typhi
uacugauuaauugcgaca

SEQ ID NO: 1662614 - RNA, 20 nt, Salmonella enterica enterica serovar Typhi
uacugccagcgucgcugauu

SEQ ID NO: 1662615 - RNA, 22 nt, Salmonella enterica enterica serovar Typhi
uacgccaucaggcauggcagca

SEQ ID NO: 1662616 - RNA, 23 nt, Salmonella enterica enterica serovar Typhi
uacgcgcguaggucgcgaauagc

SEQ ID NO: 1662617 - RNA, 20 nt, Salmonella enterica enterica serovar Typhi
uacgcgcguucguugaugua

SEQ ID NO: 1662618 - RNA, 16 nt, Salmonella enterica enterica serovar Typhi
uacgccagacagcauu

SEQ ID NO: 1662619 - RNA, 18 nt, Salmonella enterica enterica serovar Typhi
uacgccaaugaacucgcc

SEQ ID NO: 1662620 - RNA, 17 nt, Salmonella enterica enterica serovar Typhi
uacgccacguuaucgcg

SEQ ID NO: 1662621 - RNA, 16 nt, Salmonella enterica enterica serovar Typhi
uacgcgcgcggcguca

SEQ ID NO: 1662622 - RNA, 23 nt, Salmonella enterica enterica serovar Typhi
uacgcgcucaccgacuccucaac

SEQ ID NO: 1662623 - RNA, 18 nt, Salmonella enterica enterica serovar Typhi
uacgcguuucacaaccuc

SEQ ID NO: 1662624 - RNA, 13 nt, Salmonella enterica enterica serovar Typhi
uacgguaaaccag

SEQ ID NO: 1662625 - RNA, 14 nt, Salmonella enterica enterica serovar Typhi
uacggcugucagga

SEQ ID NO: 1662626 - RNA, 14 nt, Salmonella enterica enterica serovar Typhi
uacggcauggcguc

SEQ ID NO: 1662627 - RNA, 14 nt, Salmonella enterica enterica serovar Typhi
uacgcucgcugaug

SEQ ID NO: 1662628 - RNA, 17 nt, Salmonella enterica enterica serovar Typhi
uacgcuauaaaguuccc

SEQ ID NO: 1662629 - RNA, 17 nt, Salmonella enterica enterica serovar Typhi
uacgcuccagcuggcug

SEQ ID NO: 1662630 - RNA, 22 nt, Salmonella enterica enterica serovar Typhi
uaccuugucggguggcgcuagc

SEQ ID NO: 1662631 - RNA, 18 nt, Salmonella enterica enterica serovar Typhi
uaccagcgaaaugcgaau

SEQ ID NO: 1662632 - RNA, 12 nt, Salmonella enterica enterica serovar Typhi
uaccagcggcaa

SEQ ID NO: 1662633 - RNA, 21 nt, Salmonella enterica enterica serovar Typhi
uaccacuuucuugaugucauc

SEQ ID NO: 1662634 - RNA, 19 nt, Salmonella enterica enterica serovar Typhi
uacgaccggucagccgguu

SEQ ID NO: 1662635 - RNA, 16 nt, Salmonella enterica enterica serovar Typhi
uacgagugacauuauu

SEQ ID NO: 1662636 - RNA, 19 nt, Salmonella enterica enterica serovar Typhi
uacgcaccgucgagaaacc

SEQ ID NO: 1662637 - RNA, 13 nt, Salmonella enterica enterica serovar Typhi
uacgaucugacau

SEQ ID NO: 1662638 - RNA, 16 nt, Salmonella enterica enterica serovar Typhi
uacgcaaaaaaagcca

SEQ ID NO: 1662639 - RNA, 16 nt, Salmonella enterica enterica serovar Typhi
ucaacucaugccgcug

SEQ ID NO: 1662640 - RNA, 17 nt, Salmonella enterica enterica serovar Typhi
ucaacguuguccagcgg

SEQ ID NO: 1662641 - RNA, 16 nt, Salmonella enterica enterica serovar Typhi
ucaacguuucgcuauc

SEQ ID NO: 1662642 - RNA, 23 nt, Salmonella enterica enterica serovar Typhi
ucaacuccauaauuugaaucgcc

SEQ ID NO: 1662643 - RNA, 13 nt, Salmonella enterica enterica serovar Typhi
ucaaaugaucguu

SEQ ID NO: 1662644 - RNA, 21 nt, Salmonella enterica enterica serovar Typhi
ucaaccagggucaauacgccg

SEQ ID NO: 1662645 - RNA, 17 nt, Salmonella enterica enterica serovar Typhi
ucaaaucgugugcggua

SEQ ID NO: 1662646 - RNA, 12 nt, Salmonella enterica enterica serovar Typhi
ucaaauacgcua

SEQ ID NO: 1662647 - RNA, 20 nt, Salmonella enterica enterica serovar Typhi
ucaacccuauugccacaaua

SEQ ID NO: 1662648 - RNA, 21 nt, Salmonella enterica enterica serovar Typhi
ucaacccgcuaccgcaauacg

SEQ ID NO: 1662649 - RNA, 16 nt, Salmonella enterica enterica serovar Typhi
ucaaaguuauuuacca

SEQ ID NO: 1662650 - RNA, 22 nt, Salmonella enterica enterica serovar Typhi
ucaaacgugccuggauaaaucg

SEQ ID NO: 1662651 - RNA, 21 nt, Salmonella enterica enterica serovar Typhi
ucaaacuccgcgcuggcaaua

SEQ ID NO: 1662652 - RNA, 20 nt, Salmonella enterica enterica serovar Typhi
ucaaacaggcugucugccau

SEQ ID NO: 1662653 - RNA, 15 nt, Salmonella enterica enterica serovar Typhi
uauugccgcacggua

SEQ ID NO: 1662654 - RNA, 13 nt, Salmonella enterica enterica serovar Typhi
uauuggaaucgcu

SEQ ID NO: 1662655 - RNA, 22 nt, Salmonella enterica enterica serovar Typhi
uauugccacagcgguauaucug

SEQ ID NO: 1662656 - RNA, 24 nt, Salmonella enterica enterica serovar Typhi
uauugcaccugggaaucgugcaau

SEQ ID NO: 1662657 - RNA, 14 nt, Salmonella enterica enterica serovar Typhi
uauugaucacggua

SEQ ID NO: 1662658 - RNA, 22 nt, Salmonella enterica enterica serovar Typhi
ucaauaagcgaauugccgucgc

SEQ ID NO: 1662659 - RNA, 13 nt, Salmonella enterica enterica serovar Typhi
ucaagcgguagcg

SEQ ID NO: 1662660 - RNA, 13 nt, Salmonella enterica enterica serovar Typhi
ucaagcgcaauca

SEQ ID NO: 1662661 - RNA, 23 nt, Salmonella enterica enterica serovar Typhi
ucaagaugcuacccgucgcgccc

SEQ ID NO: 1662662 - RNA, 13 nt, Salmonella enterica enterica serovar Typhi
ucacaaaccagac

SEQ ID NO: 1662663 - RNA, 22 nt, Salmonella enterica enterica serovar Typhi
ucaauuuuacugccuaccgggc

SEQ ID NO: 1662664 - RNA, 11 nt, Salmonella enterica enterica serovar Typhi
ucaauuuccag

SEQ ID NO: 1662665 - RNA, 12 nt, Salmonella enterica enterica serovar Typhi
ucaaucgcgccc

SEQ ID NO: 1662666 - RNA, 18 nt, Salmonella enterica enterica serovar Typhi
ucaaucgucguuccgcca

SEQ ID NO: 1662667 - RNA, 19 nt, Salmonella enterica enterica serovar Typhi
ucaaucgucguuccgccag

SEQ ID NO: 1662668 - RNA, 19 nt, Salmonella enterica enterica serovar Typhi
uaucauagacugcgcuuaa

SEQ ID NO: 1662669 - RNA, 16 nt, Salmonella enterica enterica serovar Typhi
uaucagguaacauauc

SEQ ID NO: 1662670 - RNA, 23 nt, Salmonella enterica enterica serovar Typhi
uaucaguccccacauuacgccca

SEQ ID NO: 1662671 - RNA, 19 nt, Salmonella enterica enterica serovar Typhi
uaucagccauuaaccagau

SEQ ID NO: 1662672 - RNA, 13 nt, Salmonella enterica enterica serovar Typhi
uauauuccgccuc

SEQ ID NO: 1662673 - RNA, 18 nt, Salmonella enterica enterica serovar Typhi
uauccgccagcgcaacgc

SEQ ID NO: 1662674 - RNA, 14 nt, Salmonella enterica enterica serovar Typhi
uauccccgcuggcg

SEQ ID NO: 1662675 - RNA, 19 nt, Salmonella enterica enterica serovar Typhi
uauccguaauaugaugcag

SEQ ID NO: 1662676 - RNA, 20 nt, Salmonella enterica enterica serovar Typhi
uauccggccuauagcuaaug

SEQ ID NO: 1662677 - RNA, 15 nt, Salmonella enterica enterica serovar Typhi
uauccgccauauccc

SEQ ID NO: 1662678 - RNA, 14 nt, Salmonella enterica enterica serovar Typhi
uaucgguaagcgcc

SEQ ID NO: 1662679 - RNA, 17 nt, Salmonella enterica enterica serovar Typhi
uagggcuuacggguuca

SEQ ID NO: 1662680 - RNA, 18 nt, Salmonella enterica enterica serovar Typhi
uagggcgcggcugguaag

SEQ ID NO: 1662681 - RNA, 19 nt, Salmonella enterica enterica serovar Typhi
uagggccgauaccggcaac

SEQ ID NO: 1662682 - RNA, 19 nt, Salmonella enterica enterica serovar Typhi
uaggcuuuucauucagcgc

SEQ ID NO: 1662683 - RNA, 23 nt, Salmonella enterica enterica serovar Typhi
uaggguuaugauuucaggcauuu

SEQ ID NO: 1662684 - RNA, 17 nt, Salmonella enterica enterica serovar Typhi
uaggguguuucgacccc

SEQ ID NO: 1662685 - RNA, 14 nt, Salmonella enterica enterica serovar Typhi
uaggguugccagag

SEQ ID NO: 1662686 - RNA, 16 nt, Salmonella enterica enterica serovar Typhi
uauacacucaaccauc

SEQ ID NO: 1662687 - RNA, 23 nt, Salmonella enterica enterica serovar Typhi
uauaccgucaguaccagcgagau

SEQ ID NO: 1662688 - RNA, 15 nt, Salmonella enterica enterica serovar Typhi
uauaccguuuggcga

SEQ ID NO: 1662689 - RNA, 14 nt, Salmonella enterica enterica serovar Typhi
uauacuccagcaga

SEQ ID NO: 1662690 - RNA, 19 nt, Salmonella enterica enterica serovar Typhi
uaugcaacacgccgaacaa

SEQ ID NO: 1662691 - RNA, 17 nt, Salmonella enterica enterica serovar Typhi
uaugaucgaaaaugcgc

SEQ ID NO: 1662692 - RNA, 13 nt, Salmonella enterica enterica serovar Typhi
uaugccgccaucc

SEQ ID NO: 1662693 - RNA, 21 nt, Salmonella enterica enterica serovar Typhi
uaugcccggaugauuaucauc

SEQ ID NO: 1662694 - RNA, 15 nt, Salmonella enterica enterica serovar Typhi
uaugcaucgcgguca

SEQ ID NO: 1662695 - RNA, 21 nt, Salmonella enterica enterica serovar Typhi
uaugccagauauuuucggcau

SEQ ID NO: 1662696 - RNA, 16 nt, Salmonella enterica enterica serovar Typhi
uauuaaauuccggcuc

SEQ ID NO: 1662697 - RNA, 17 nt, Salmonella enterica enterica serovar Typhi
uaucguuuacguuauca

SEQ ID NO: 1662698 - RNA, 13 nt, Salmonella enterica enterica serovar Typhi
uaucgucaauacg

SEQ ID NO: 1662699 - RNA, 13 nt, Salmonella enterica enterica serovar Typhi
uaucugaccuaca

SEQ ID NO: 1662700 - RNA, 15 nt, Salmonella enterica enterica serovar Typhi
uaucuguaauugacg

SEQ ID NO: 1662701 - RNA, 18 nt, Salmonella enterica enterica serovar Typhi
uaucugcuccgccagcaa

SEQ ID NO: 1662702 - RNA, 20 nt, Salmonella enterica enterica serovar Typhi
uaugagcgggccgucaggcc

SEQ ID NO: 1662703 - RNA, 18 nt, Salmonella enterica enterica serovar Typhi
uaugaccgagucuacauc

SEQ ID NO: 1662704 - RNA, 16 nt, Salmonella enterica enterica serovar Typhi
uaugaaaagcgcgucg

SEQ ID NO: 1662705 - RNA, 14 nt, Salmonella enterica enterica serovar Typhi
uaucuuucagcgcc

SEQ ID NO: 1662706 - RNA, 16 nt, Salmonella enterica enterica serovar Typhi
uaugaaagccaucgcu

SEQ ID NO: 1662707 - RNA, 17 nt, Salmonella enterica enterica serovar Typhi
uaucuucccgauaacug

SEQ ID NO: 1662708 - RNA, 22 nt, Salmonella enterica enterica serovar Typhi
uaucuugagucaaaagauugau

SEQ ID NO: 1662709 - RNA, 22 nt, Salmonella enterica enterica serovar Typhi
ucacuaugcuaauccgcugauu

SEQ ID NO: 1662710 - RNA, 15 nt, Salmonella enterica enterica serovar Typhi
ucacguuuuccaggu

SEQ ID NO: 1662711 - RNA, 13 nt, Salmonella enterica enterica serovar Typhi
ucacuucauccgg

SEQ ID NO: 1662712 - RNA, 16 nt, Salmonella enterica enterica serovar Typhi
ucacuucauccggaua

SEQ ID NO: 1662713 - RNA, 19 nt, Salmonella enterica enterica serovar Typhi
ucacuuuugccgguugcca

SEQ ID NO: 1662714 - RNA, 14 nt, Salmonella enterica enterica serovar Typhi
ucacuuuaccaggc

SEQ ID NO: 1662715 - RNA, 20 nt, Salmonella enterica enterica serovar Typhi
ucagagcguccacgccauca

SEQ ID NO: 1662716 - RNA, 22 nt, Salmonella enterica enterica serovar Typhi
ucagagcgucuuuuauccccac

SEQ ID NO: 1662717 - RNA, 13 nt, Salmonella enterica enterica serovar Typhi
ucagaaauccgcg

SEQ ID NO: 1662718 - RNA, 21 nt, Salmonella enterica enterica serovar Typhi
ucagaaccugcgauaccggac

SEQ ID NO: 1662719 - RNA, 12 nt, Salmonella enterica enterica serovar Typhi
ucagaacgccuu

SEQ ID NO: 1662720 - RNA, 16 nt, Salmonella enterica enterica serovar Typhi
aauaacccggauuguc

SEQ ID NO: 1662721 - RNA, 21 nt, Salmonella enterica enterica serovar Typhi
aauaacgcggcuaaucagggu

SEQ ID NO: 1662722 - RNA, 20 nt, Salmonella enterica enterica serovar Typhi
aauaacgguagagaaugguc

SEQ ID NO: 1662723 - RNA, 22 nt, Salmonella enterica enterica serovar Typhi
ucacgcugacaggauacccggc

SEQ ID NO: 1662724 - RNA, 15 nt, Salmonella enterica enterica serovar Typhi
ucacgcugaugcugu

SEQ ID NO: 1662725 - RNA, 21 nt, Salmonella enterica enterica serovar Typhi
ucacgcugacaggauacccgg

SEQ ID NO: 1662726 - RNA, 21 nt, Salmonella enterica enterica serovar Typhi
ucacggcgauaaaugucagga

SEQ ID NO: 1662727 - RNA, 16 nt, Salmonella enterica enterica serovar Typhi
ucacacauaucgccag

SEQ ID NO: 1662728 - RNA, 15 nt, Salmonella enterica enterica serovar Typhi
ucacaauaacgccgg

SEQ ID NO: 1662729 - RNA, 14 nt, Salmonella enterica enterica serovar Typhi
ucacaaucagccac

SEQ ID NO: 1662730 - RNA, 16 nt, Salmonella enterica enterica serovar Typhi
ucaccgccagcaacgc

SEQ ID NO: 1662731 - RNA, 17 nt, Salmonella enterica enterica serovar Typhi
ucacgcucuucgccaau

SEQ ID NO: 1662732 - RNA, 11 nt, Salmonella enterica enterica serovar Typhi
ucacgccaucg

SEQ ID NO: 1662733 - RNA, 20 nt, Salmonella enterica enterica serovar Typhi
ucaccuucggucccaucgcg

SEQ ID NO: 1662734 - RNA, 19 nt, Salmonella enterica enterica serovar Typhi
ucacgcaaaugcagcggaa

SEQ ID NO: 1662735 - RNA, 18 nt, Salmonella enterica enterica serovar Typhi
ucaccuucugugaaaguu

SEQ ID NO: 1662736 - RNA, 22 nt, Salmonella enterica enterica serovar Typhi
ucaccuugucgagcgcggcauu

SEQ ID NO: 1662737 - RNA, 13 nt, Salmonella enterica enterica serovar Typhi
ucaccucuucgcu

SEQ ID NO: 1662738 - RNA, 14 nt, Salmonella enterica enterica serovar Typhi
ucaccugauagcgg

SEQ ID NO: 1662739 - RNA, 16 nt, Salmonella enterica enterica serovar Typhi
ucaggcaaaaaucggc

SEQ ID NO: 1662740 - RNA, 16 nt, Salmonella enterica enterica serovar Typhi
ucaggaucgccggauu

SEQ ID NO: 1662741 - RNA, 23 nt, Salmonella enterica enterica serovar Typhi
ucaggcaucaacguuguccagcg

SEQ ID NO: 1662742 - RNA, 16 nt, Salmonella enterica enterica serovar Typhi
ucaggcaucagauaaa

SEQ ID NO: 1662743 - RNA, 16 nt, Salmonella enterica enterica serovar Typhi
ucaggaucaauucuga

SEQ ID NO: 1662744 - RNA, 13 nt, Salmonella enterica enterica serovar Typhi
ucaggaucgccgg

SEQ ID NO: 1662745 - RNA, 14 nt, Salmonella enterica enterica serovar Typhi
ucagcggcaacucg

SEQ ID NO: 1662746 - RNA, 20 nt, Salmonella enterica enterica serovar Typhi
ucagcguuucgccguaaaac

SEQ ID NO: 1662747 - RNA, 20 nt, Salmonella enterica enterica serovar Typhi
ucagcgugaugcgauccagc

SEQ ID NO: 1662748 - RNA, 17 nt, Salmonella enterica enterica serovar Typhi
ucagaucgccgccggua

SEQ ID NO: 1662749 - RNA, 21 nt, Salmonella enterica enterica serovar Typhi
aauaauggggauuaucaggau

SEQ ID NO: 1662750 - RNA, 17 nt, Salmonella enterica enterica serovar Typhi
ucagccccagcaccaga

SEQ ID NO: 1662751 - RNA, 23 nt, Salmonella enterica enterica serovar Typhi
ucagcccccaguuuuugaacaua

SEQ ID NO: 1662752 - RNA, 20 nt, Salmonella enterica enterica serovar Typhi
ucagccaggucugcaccacg

SEQ ID NO: 1662753 - RNA, 15 nt, Salmonella enterica enterica serovar Typhi
ucagcaucuuaugcg

SEQ ID NO: 1662754 - RNA, 19 nt, Salmonella enterica enterica serovar Typhi
ucagcgcgagcgugaucuc

SEQ ID NO: 1662755 - RNA, 13 nt, Salmonella enterica enterica serovar Typhi
ucagcgcgccaau

SEQ ID NO: 1662756 - RNA, 17 nt, Salmonella enterica enterica serovar Typhi
ucagcgaauaucucuau

SEQ ID NO: 1662757 - RNA, 19 nt, Salmonella enterica enterica serovar Typhi
uccagauagcgaucgccgc

SEQ ID NO: 1662758 - RNA, 14 nt, Salmonella enterica enterica serovar Typhi
uccagacccacagc

SEQ ID NO: 1662759 - RNA, 19 nt, Salmonella enterica enterica serovar Typhi
uccagaccaccagcgacau

SEQ ID NO: 1662760 - RNA, 17 nt, Salmonella enterica enterica serovar Typhi
uccacaccggcgcauac

SEQ ID NO: 1662761 - RNA, 20 nt, Salmonella enterica enterica serovar Typhi
uccacaaauagcauggcgug

SEQ ID NO: 1662762 - RNA, 13 nt, Salmonella enterica enterica serovar Typhi
uccacaccguuac

SEQ ID NO: 1662763 - RNA, 23 nt, Salmonella enterica enterica serovar Typhi
uccacagguuaucgccgcccguu

SEQ ID NO: 1662764 - RNA, 13 nt, Salmonella enterica enterica serovar Typhi
uccacauccagcg

SEQ ID NO: 1662765 - RNA, 15 nt, Salmonella enterica enterica serovar Typhi
uccacucacccggca

SEQ ID NO: 1662766 - RNA, 18 nt, Salmonella enterica enterica serovar Typhi
uccacucgcucauuugcg

SEQ ID NO: 1662767 - RNA, 20 nt, Salmonella enterica enterica serovar Typhi
uccacuguuggcgaaggcgg

SEQ ID NO: 1662768 - RNA, 23 nt, Salmonella enterica enterica serovar Typhi
uccaggugcugccacaucgccag

SEQ ID NO: 1662769 - RNA, 21 nt, Salmonella enterica enterica serovar Typhi
uccaggucuuccgccgggaua

SEQ ID NO: 1662770 - RNA, 22 nt, Salmonella enterica enterica serovar Typhi
uccagcguaggguagaucacgc

SEQ ID NO: 1662771 - RNA, 17 nt, Salmonella enterica enterica serovar Typhi
uccaguccucgcccacu

SEQ ID NO: 1662772 - RNA, 17 nt, Salmonella enterica enterica serovar Typhi
uccaguaagaucaccuu

SEQ ID NO: 1662773 - RNA, 13 nt, Salmonella enterica enterica serovar Typhi
uccaugccagcgc

SEQ ID NO: 1662774 - RNA, 15 nt, Salmonella enterica enterica serovar Typhi
uccauuggccagaua

SEQ ID NO: 1662775 - RNA, 21 nt, Salmonella enterica enterica serovar Typhi
uccauuaaaugcgccagcggc

SEQ ID NO: 1662776 - RNA, 19 nt, Salmonella enterica enterica serovar Typhi
uccaucgguucucugccau

SEQ ID NO: 1662777 - RNA, 16 nt, Salmonella enterica enterica serovar Typhi
uccauccggguaauuu

SEQ ID NO: 1662778 - RNA, 19 nt, Salmonella enterica enterica serovar Typhi
uccaucaugggcgcggcga

SEQ ID NO: 1662779 - RNA, 18 nt, Salmonella enterica enterica serovar Typhi
ucauaaauagccagcauc

SEQ ID NO: 1662780 - RNA, 13 nt, Salmonella enterica enterica serovar Typhi
ucauaaauugcag

SEQ ID NO: 1662781 - RNA, 13 nt, Salmonella enterica enterica serovar Typhi
ucauaaucaacgu

SEQ ID NO: 1662782 - RNA, 15 nt, Salmonella enterica enterica serovar Typhi
ucauaagucauccag

SEQ ID NO: 1662783 - RNA, 15 nt, Salmonella enterica enterica serovar Typhi
ucauaggugaacaug

SEQ ID NO: 1662784 - RNA, 17 nt, Salmonella enterica enterica serovar Typhi
ucaucgacuucgaaggu

SEQ ID NO: 1662785 - RNA, 16 nt, Salmonella enterica enterica serovar Typhi
ucauccugcucaucga

SEQ ID NO: 1662786 - RNA, 19 nt, Salmonella enterica enterica serovar Typhi
ucauccaccagaauaaagg

SEQ ID NO: 1662787 - RNA, 19 nt, Salmonella enterica enterica serovar Typhi
ucauccaauaacguaaccg

SEQ ID NO: 1662788 - RNA, 18 nt, Salmonella enterica enterica serovar Typhi
ucauccaacugcgccuga

SEQ ID NO: 1662789 - RNA, 16 nt, Salmonella enterica enterica serovar Typhi
ucaucauuacaggcga

SEQ ID NO: 1662790 - RNA, 15 nt, Salmonella enterica enterica serovar Typhi
ucaucagccagcauc

SEQ ID NO: 1662791 - RNA, 23 nt, Salmonella enterica enterica serovar Typhi
ucaucagaucaugaggaugagcg

SEQ ID NO: 1662792 - RNA, 21 nt, Salmonella enterica enterica serovar Typhi
ucaucauggacagauuuccac

SEQ ID NO: 1662793 - RNA, 15 nt, Salmonella enterica enterica serovar Typhi
ucaucaugcugcuga

SEQ ID NO: 1662794 - RNA, 12 nt, Salmonella enterica enterica serovar Typhi
ucaugucgucau

SEQ ID NO: 1662795 - RNA, 15 nt, Salmonella enterica enterica serovar Typhi
ucauggugaugaucg

SEQ ID NO: 1662796 - RNA, 12 nt, Salmonella enterica enterica serovar Typhi
ucaucugccagu

SEQ ID NO: 1662797 - RNA, 20 nt, Salmonella enterica enterica serovar Typhi
ucauuaauuauacugucgcu

SEQ ID NO: 1662798 - RNA, 19 nt, Salmonella enterica enterica serovar Typhi
ucauuacaggcgaauagcg

SEQ ID NO: 1662799 - RNA, 17 nt, Salmonella enterica enterica serovar Typhi
ucauuacgccugucgcg

SEQ ID NO: 1662800 - RNA, 20 nt, Salmonella enterica enterica serovar Typhi
ucauuacgccugucgcgcca

SEQ ID NO: 1662801 - RNA, 21 nt, Salmonella enterica enterica serovar Typhi
ucauucuccgggauagcaauc

SEQ ID NO: 1662802 - RNA, 15 nt, Salmonella enterica enterica serovar Typhi
ucauucagcggcugc

SEQ ID NO: 1662803 - RNA, 15 nt, Salmonella enterica enterica serovar Typhi
ucauucccgccaaua

SEQ ID NO: 1662804 - RNA, 20 nt, Salmonella enterica enterica serovar Typhi
ucauuccugcguugaccagc

SEQ ID NO: 1662805 - RNA, 12 nt, Salmonella enterica enterica serovar Typhi
ucauuuuccaca

SEQ ID NO: 1662806 - RNA, 19 nt, Salmonella enterica enterica serovar Typhi
uaaacccgauucugccagu

SEQ ID NO: 1662807 - RNA, 13 nt, Salmonella enterica enterica serovar Typhi
uaaaccaaagcag

SEQ ID NO: 1662808 - RNA, 22 nt, Salmonella enterica enterica serovar Typhi
uaacagcgccgcgccgauagcg

SEQ ID NO: 1662809 - RNA, 21 nt, Salmonella enterica enterica serovar Typhi
uaacagcgcgaccaggaaacc

SEQ ID NO: 1662810 - RNA, 23 nt, Salmonella enterica enterica serovar Typhi
uaacagcuggcuugccagcagau

SEQ ID NO: 1662811 - RNA, 21 nt, Salmonella enterica enterica serovar Typhi
uaaacgaucgguuaucacggu

SEQ ID NO: 1662812 - RNA, 16 nt, Salmonella enterica enterica serovar Typhi
uaaacgccucauccgg

SEQ ID NO: 1662813 - RNA, 16 nt, Salmonella enterica enterica serovar Typhi
uaaccagaucggcuau

SEQ ID NO: 1662814 - RNA, 20 nt, Salmonella enterica enterica serovar Typhi
uaaccagcgcgccgccaacg

SEQ ID NO: 1662815 - RNA, 17 nt, Salmonella enterica enterica serovar Typhi
uaaccagcucgcugauc

SEQ ID NO: 1662816 - RNA, 21 nt, Salmonella enterica enterica serovar Typhi
uaacaggcgccggggcagcaa

SEQ ID NO: 1662817 - RNA, 14 nt, Salmonella enterica enterica serovar Typhi
uaacagucgcgccg

SEQ ID NO: 1662818 - RNA, 17 nt, Salmonella enterica enterica serovar Typhi
uaacgcggguuagcgcc

SEQ ID NO: 1662819 - RNA, 24 nt, Salmonella enterica enterica serovar Typhi
uaacgcgcuggcggaauaucgcgg

SEQ ID NO: 1662820 - RNA, 15 nt, Salmonella enterica enterica serovar Typhi
uaacggccagaaacc

SEQ ID NO: 1662821 - RNA, 22 nt, Salmonella enterica enterica serovar Typhi
uaacggguuugauugccaucgc

SEQ ID NO: 1662822 - RNA, 23 nt, Salmonella enterica enterica serovar Typhi
uaacggucauaucgucaucgguc

SEQ ID NO: 1662823 - RNA, 21 nt, Salmonella enterica enterica serovar Typhi
uaacguuuaaacucccggcua

SEQ ID NO: 1662824 - RNA, 16 nt, Salmonella enterica enterica serovar Typhi
uaaccggaucggccau

SEQ ID NO: 1662825 - RNA, 20 nt, Salmonella enterica enterica serovar Typhi
uaaccgauuguguguuaaug

SEQ ID NO: 1662826 - RNA, 17 nt, Salmonella enterica enterica serovar Typhi
uaacgccggcaaauagc

SEQ ID NO: 1662827 - RNA, 16 nt, Salmonella enterica enterica serovar Typhi
uaacgccgcguucgcg

SEQ ID NO: 1662828 - RNA, 14 nt, Salmonella enterica enterica serovar Typhi
uaacgcagaagaca

SEQ ID NO: 1662829 - RNA, 12 nt, Salmonella enterica enterica serovar Typhi
uaacgcaaccgu

SEQ ID NO: 1662830 - RNA, 17 nt, Salmonella enterica enterica serovar Typhi
uaacgcauguuccgcua

SEQ ID NO: 1662831 - RNA, 14 nt, Salmonella enterica enterica serovar Typhi
uaagcgacgaaucc

SEQ ID NO: 1662832 - RNA, 14 nt, Salmonella enterica enterica serovar Typhi
uaagcgcagcgcca

SEQ ID NO: 1662833 - RNA, 17 nt, Salmonella enterica enterica serovar Typhi
uaagcgcagcgccaccg

SEQ ID NO: 1662834 - RNA, 19 nt, Salmonella enterica enterica serovar Typhi
uaagcgccugcugcgcaac

SEQ ID NO: 1662835 - RNA, 21 nt, Salmonella enterica enterica serovar Typhi
uaagcgcuuuggucaggcuaa

SEQ ID NO: 1662836 - RNA, 15 nt, Salmonella enterica enterica serovar Typhi
uaaggcguucacgcc

SEQ ID NO: 1662837 - RNA, 17 nt, Salmonella enterica enterica serovar Typhi
uaaggcguuuacgccgc

SEQ ID NO: 1662838 - RNA, 22 nt, Salmonella enterica enterica serovar Typhi
uaaggcgaaaccgcuacccggc

SEQ ID NO: 1662839 - RNA, 15 nt, Salmonella enterica enterica serovar Typhi
uaaggcgcggccuca

SEQ ID NO: 1662840 - RNA, 20 nt, Salmonella enterica enterica serovar Typhi
uaaggcgcuugugauaucug

SEQ ID NO: 1662841 - RNA, 17 nt, Salmonella enterica enterica serovar Typhi
uaagccagacgcgcagc

SEQ ID NO: 1662842 - RNA, 15 nt, Salmonella enterica enterica serovar Typhi
uaagccgcguucugu

SEQ ID NO: 1662843 - RNA, 12 nt, Salmonella enterica enterica serovar Typhi
uaacugucagau

SEQ ID NO: 1662844 - RNA, 16 nt, Salmonella enterica enterica serovar Typhi
uaacuucacgccaucg

SEQ ID NO: 1662845 - RNA, 14 nt, Salmonella enterica enterica serovar Typhi
uaacuucuccgcca

SEQ ID NO: 1662846 - RNA, 20 nt, Salmonella enterica enterica serovar Typhi
uaaggcucucuuaccagccg

SEQ ID NO: 1662847 - RNA, 12 nt, Salmonella enterica enterica serovar Typhi
uaagguugucaa

SEQ ID NO: 1662848 - RNA, 22 nt, Salmonella enterica enterica serovar Typhi
uaaguagccgucagguccgaca

SEQ ID NO: 1662849 - RNA, 19 nt, Salmonella enterica enterica serovar Typhi
uaaguaauuuugcgauggc

SEQ ID NO: 1662850 - RNA, 17 nt, Salmonella enterica enterica serovar Typhi
uaauauugaacgcacuu

SEQ ID NO: 1662851 - RNA, 24 nt, Salmonella enterica enterica serovar Typhi
uaauaugccaggcuuccugcgcug

SEQ ID NO: 1662852 - RNA, 21 nt, Salmonella enterica enterica serovar Typhi
uaauauccaguugcgccagcg

SEQ ID NO: 1662853 - RNA, 13 nt, Salmonella enterica enterica serovar Typhi
uaauaucauccgg

SEQ ID NO: 1662854 - RNA, 14 nt, Salmonella enterica enterica serovar Typhi
uaauuuauuaaccc

SEQ ID NO: 1662855 - RNA, 13 nt, Salmonella enterica enterica serovar Typhi
uaaucaucacgcu

SEQ ID NO: 1662856 - RNA, 14 nt, Salmonella enterica enterica serovar Typhi
uaaucaugaacguu

SEQ ID NO: 1662857 - RNA, 17 nt, Salmonella enterica enterica serovar Typhi
uaaugucaugcgccacg

SEQ ID NO: 1662858 - RNA, 19 nt, Salmonella enterica enterica serovar Typhi
uaauguugaaccgucauca

SEQ ID NO: 1662859 - RNA, 15 nt, Salmonella enterica enterica serovar Typhi
uaauguugccguggc

SEQ ID NO: 1662860 - RNA, 12 nt, Salmonella enterica enterica serovar Typhi
uacaacugucgu

SEQ ID NO: 1662861 - RNA, 18 nt, Salmonella enterica enterica serovar Typhi
uacaagaauuuaucgcaa

SEQ ID NO: 1662862 - RNA, 19 nt, Salmonella enterica enterica serovar Typhi
uacaacgacuacguucauc

SEQ ID NO: 1662863 - RNA, 16 nt, Salmonella enterica enterica serovar Typhi
uacaauggcaggcaua

SEQ ID NO: 1662864 - RNA, 16 nt, Salmonella enterica enterica serovar Typhi
uacaagguauccgcca

SEQ ID NO: 1662865 - RNA, 17 nt, Salmonella enterica enterica serovar Typhi
uacaagguauccgccau

SEQ ID NO: 1662866 - RNA, 20 nt, Salmonella enterica enterica serovar Typhi
uacacgcgaauagccagaca

SEQ ID NO: 1662867 - RNA, 17 nt, Salmonella enterica enterica serovar Typhi
uacaccaacggcgacgc

SEQ ID NO: 1662868 - RNA, 14 nt, Salmonella enterica enterica serovar Typhi
uacaauuucgcaaa

SEQ ID NO: 1662869 - RNA, 14 nt, Salmonella enterica enterica serovar Typhi
uacacagacugcuu

SEQ ID NO: 1662870 - RNA, 22 nt, Salmonella enterica enterica serovar Typhi
uacacaucauuaccauagccgu

SEQ ID NO: 1662871 - RNA, 19 nt, Salmonella enterica enterica serovar Typhi
uacagcguuaacgacgcuc

SEQ ID NO: 1662872 - RNA, 19 nt, Salmonella enterica enterica serovar Typhi
uacagccagguugccagaa

SEQ ID NO: 1662873 - RNA, 17 nt, Salmonella enterica enterica serovar Typhi
uacacuucagccagacg

SEQ ID NO: 1662874 - RNA, 17 nt, Salmonella enterica enterica serovar Typhi
uacagaugaacguaacg

SEQ ID NO: 1662875 - RNA, 20 nt, Salmonella enterica enterica serovar Typhi
uacagacaucaucgaacgcc

SEQ ID NO: 1662876 - RNA, 22 nt, Salmonella enterica enterica serovar Typhi
uacagacaucaucgaacgccgc

SEQ ID NO: 1662877 - RNA, 15 nt, Salmonella enterica enterica serovar Typhi
uaccaccuuaucgag

SEQ ID NO: 1662878 - RNA, 19 nt, Salmonella enterica enterica serovar Typhi
uaccaaucgcggcgacauc

SEQ ID NO: 1662879 - RNA, 12 nt, Salmonella enterica enterica serovar Typhi
uacaugacgcuc

SEQ ID NO: 1662880 - RNA, 12 nt, Salmonella enterica enterica serovar Typhi
uacaucuuccau

SEQ ID NO: 1662881 - RNA, 15 nt, Salmonella enterica enterica serovar Typhi
guugcaguuuacgag

SEQ ID NO: 1662882 - RNA, 20 nt, Salmonella enterica enterica serovar Typhi
guugauuaucacccacagga

SEQ ID NO: 1662883 - RNA, 19 nt, Salmonella enterica enterica serovar Typhi
guugauaugcaguucauca

SEQ ID NO: 1662884 - RNA, 18 nt, Salmonella enterica enterica serovar Typhi
guugaucguaaagcgcau

SEQ ID NO: 1662885 - RNA, 19 nt, Salmonella enterica enterica serovar Typhi
guucuugcugcugcugaug

SEQ ID NO: 1662886 - RNA, 19 nt, Salmonella enterica enterica serovar Typhi
guugaacguuuucugagcg

SEQ ID NO: 1662887 - RNA, 21 nt, Salmonella enterica enterica serovar Typhi
guucuucgccguuaucggccu

SEQ ID NO: 1662888 - RNA, 19 nt, Salmonella enterica enterica serovar Typhi
guugaggaaauucugacgc

SEQ ID NO: 1662889 - RNA, 14 nt, Salmonella enterica enterica serovar Typhi
guugcuccagcauc

SEQ ID NO: 1662890 - RNA, 14 nt, Salmonella enterica enterica serovar Typhi
guugcuacgcgcca

SEQ ID NO: 1662891 - RNA, 18 nt, Salmonella enterica enterica serovar Typhi
guugcguguuguacagca

SEQ ID NO: 1662892 - RNA, 18 nt, Salmonella enterica enterica serovar Typhi
guuggcuugaucaacgcc

SEQ ID NO: 1662893 - RNA, 13 nt, Salmonella enterica enterica serovar Typhi
guuggggucguca

SEQ ID NO: 1662894 - RNA, 19 nt, Salmonella enterica enterica serovar Typhi
guuggcgccaaaaccgcuc

SEQ ID NO: 1662895 - RNA, 19 nt, Salmonella enterica enterica serovar Typhi
guugcccaguacggcgcga

SEQ ID NO: 1662896 - RNA, 18 nt, Salmonella enterica enterica serovar Typhi
guugccaggguucaaccu

SEQ ID NO: 1662897 - RNA, 12 nt, Salmonella enterica enterica serovar Typhi
guugcggcauca

SEQ ID NO: 1662898 - RNA, 18 nt, Salmonella enterica enterica serovar Typhi
uaaaaacggguaggccgg

SEQ ID NO: 1662899 - RNA, 16 nt, Salmonella enterica enterica serovar Typhi
guuuuuuuaugcguuu

SEQ ID NO: 1662900 - RNA, 22 nt, Salmonella enterica enterica serovar Typhi
uaaaaaucauccuucgggcgau

SEQ ID NO: 1662901 - RNA, 23 nt, Salmonella enterica enterica serovar Typhi
uaaaauccggcaggcagccggau

SEQ ID NO: 1662902 - RNA, 12 nt, Salmonella enterica enterica serovar Typhi
uaaaaucgccaa

SEQ ID NO: 1662903 - RNA, 11 nt, Salmonella enterica enterica serovar Typhi
uaaaaucgcgu

SEQ ID NO: 1662904 - RNA, 13 nt, Salmonella enterica enterica serovar Typhi
uaaaauagccauc

SEQ ID NO: 1662905 - RNA, 18 nt, Salmonella enterica enterica serovar Typhi
uaaaaccagggaagcuac

SEQ ID NO: 1662906 - RNA, 21 nt, Salmonella enterica enterica serovar Typhi
uaaaacaccgguugcgcaacc

SEQ ID NO: 1662907 - RNA, 16 nt, Salmonella enterica enterica serovar Typhi
guuuuauaagccgauc

SEQ ID NO: 1662908 - RNA, 14 nt, Salmonella enterica enterica serovar Typhi
guuuuauccguuuc

SEQ ID NO: 1662909 - RNA, 23 nt, Salmonella enterica enterica serovar Typhi
guuuucuauuuucuccggcaguc

SEQ ID NO: 1662910 - RNA, 14 nt, Salmonella enterica enterica serovar Typhi
guuuucgcagaguc

SEQ ID NO: 1662911 - RNA, 22 nt, Salmonella enterica enterica serovar Typhi
guuuuccgguauuuauccagca

SEQ ID NO: 1662912 - RNA, 19 nt, Salmonella enterica enterica serovar Typhi
guuuuuagugacagacauu

SEQ ID NO: 1662913 - RNA, 18 nt, Salmonella enterica enterica serovar Typhi
guuuuucgccgaccaucc

SEQ ID NO: 1662914 - RNA, 12 nt, Salmonella enterica enterica serovar Typhi
guuuugcugaug

SEQ ID NO: 1662915 - RNA, 22 nt, Salmonella enterica enterica serovar Typhi
guuuucugcauuggcgacgaua

SEQ ID NO: 1662916 - RNA, 14 nt, Salmonella enterica enterica serovar Typhi
guuugcgccgguuu

SEQ ID NO: 1662917 - RNA, 19 nt, Salmonella enterica enterica serovar Typhi
guuugcgcuccggcgcugg

SEQ ID NO: 1662918 - RNA, 17 nt, Salmonella enterica enterica serovar Typhi
guuugacgaaaucgcau

SEQ ID NO: 1662919 - RNA, 18 nt, Salmonella enterica enterica serovar Typhi
guuugauaaacugcgcca

SEQ ID NO: 1662920 - RNA, 13 nt, Salmonella enterica enterica serovar Typhi
guuugcagccaga

SEQ ID NO: 1662921 - RNA, 17 nt, Salmonella enterica enterica serovar Typhi
guuucucuuccgccagc

SEQ ID NO: 1662922 - RNA, 20 nt, Salmonella enterica enterica serovar Typhi
guuucuuuuaaggcggcaaa

SEQ ID NO: 1662923 - RNA, 23 nt, Salmonella enterica enterica serovar Typhi
guuguacggaugggguaucgcca

SEQ ID NO: 1662924 - RNA, 15 nt, Salmonella enterica enterica serovar Typhi
guuuccgcguuauca

SEQ ID NO: 1662925 - RNA, 21 nt, Salmonella enterica enterica serovar Typhi
guuucuacaccuucuucgcca

SEQ ID NO: 1662926 - RNA, 20 nt, Salmonella enterica enterica serovar Typhi
guucccuacgcccaggucgc

SEQ ID NO: 1662927 - RNA, 20 nt, Salmonella enterica enterica serovar Typhi
guuccgccccgccuuccgcg

SEQ ID NO: 1662928 - RNA, 21 nt, Salmonella enterica enterica serovar Typhi
guucccaugcuuccagccguu

SEQ ID NO: 1662929 - RNA, 15 nt, Salmonella enterica enterica serovar Typhi
guuccccagccgcuu

SEQ ID NO: 1662930 - RNA, 21 nt, Salmonella enterica enterica serovar Typhi
guuccgccagacucagccagg

SEQ ID NO: 1662931 - RNA, 19 nt, Salmonella enterica enterica serovar Typhi
guucaucuaucgccagcgc

SEQ ID NO: 1662932 - RNA, 12 nt, Salmonella enterica enterica serovar Typhi
guucauucgcca

SEQ ID NO: 1662933 - RNA, 15 nt, Salmonella enterica enterica serovar Typhi
guucauaccggauau

SEQ ID NO: 1662934 - RNA, 16 nt, Salmonella enterica enterica serovar Typhi
guucauaagucaucca

SEQ ID NO: 1662935 - RNA, 15 nt, Salmonella enterica enterica serovar Typhi
guucaucauccugca

SEQ ID NO: 1662936 - RNA, 12 nt, Salmonella enterica enterica serovar Typhi
guucauagccgu

SEQ ID NO: 1662937 - RNA, 20 nt, Salmonella enterica enterica serovar Typhi
guucaucgccacaugcggca

SEQ ID NO: 1662938 - RNA, 22 nt, Salmonella enterica enterica serovar Typhi
guucaucgcuggcguacgccau

SEQ ID NO: 1662939 - RNA, 17 nt, Salmonella enterica enterica serovar Typhi
guguuuacgccgccauc

SEQ ID NO: 1662940 - RNA, 13 nt, Salmonella enterica enterica serovar Typhi
guguugcugccgu

SEQ ID NO: 1662941 - RNA, 22 nt, Salmonella enterica enterica serovar Typhi
guguuucucaacauacgccgcc

SEQ ID NO: 1662942 - RNA, 18 nt, Salmonella enterica enterica serovar Typhi
guguuuggccgccggaaa

SEQ ID NO: 1662943 - RNA, 18 nt, Salmonella enterica enterica serovar Typhi
guuagcgaacguccagcg

SEQ ID NO: 1662944 - RNA, 16 nt, Salmonella enterica enterica serovar Typhi
guuacugcauuccgcg

SEQ ID NO: 1662945 - RNA, 14 nt, Salmonella enterica enterica serovar Typhi
guuaguaguagcug

SEQ ID NO: 1662946 - RNA, 17 nt, Salmonella enterica enterica serovar Typhi
guuagcguaucgacaaa

SEQ ID NO: 1662947 - RNA, 23 nt, Salmonella enterica enterica serovar Typhi
guuagcgagguucccgccgccau

SEQ ID NO: 1662948 - RNA, 17 nt, Salmonella enterica enterica serovar Typhi
guuagcgccauccggca

SEQ ID NO: 1662949 - RNA, 16 nt, Salmonella enterica enterica serovar Typhi
guuaucgaauccagca

SEQ ID NO: 1662950 - RNA, 18 nt, Salmonella enterica enterica serovar Typhi
guucagcucgauccggca

SEQ ID NO: 1662951 - RNA, 14 nt, Salmonella enterica enterica serovar Typhi
guucagccgccagu

SEQ ID NO: 1662952 - RNA, 11 nt, Salmonella enterica enterica serovar Typhi
guucagccagc

SEQ ID NO: 1662953 - RNA, 13 nt, Salmonella enterica enterica serovar Typhi
guucagccgauaa

SEQ ID NO: 1662954 - RNA, 13 nt, Salmonella enterica enterica serovar Typhi
guucagccgccag

SEQ ID NO: 1662955 - RNA, 15 nt, Salmonella enterica enterica serovar Typhi
guucagacguagcgc

SEQ ID NO: 1662956 - RNA, 21 nt, Salmonella enterica enterica serovar Typhi
guucagauggccaaugaugcg

SEQ ID NO: 1662957 - RNA, 21 nt, Salmonella enterica enterica serovar Typhi
guuaugcaaguucgaauagcc

SEQ ID NO: 1662958 - RNA, 20 nt, Salmonella enterica enterica serovar Typhi
guuaugcgcaucaccguuac

SEQ ID NO: 1662959 - RNA, 20 nt, Salmonella enterica enterica serovar Typhi
guucacgccgccauccgaca

SEQ ID NO: 1662960 - RNA, 23 nt, Salmonella enterica enterica serovar Typhi
gugggagguauccuccugccagg

SEQ ID NO: 1662961 - RNA, 14 nt, Salmonella enterica enterica serovar Typhi
guggcaucuuauca

SEQ ID NO: 1662962 - RNA, 17 nt, Salmonella enterica enterica serovar Typhi
guggcaugcccggugau

SEQ ID NO: 1662963 - RNA, 13 nt, Salmonella enterica enterica serovar Typhi
gugguggucaucc

SEQ ID NO: 1662964 - RNA, 15 nt, Salmonella enterica enterica serovar Typhi
guguccaucaggcuu

SEQ ID NO: 1662965 - RNA, 18 nt, Salmonella enterica enterica serovar Typhi
gugucaucauuacaggcg

SEQ ID NO: 1662966 - RNA, 15 nt, Salmonella enterica enterica serovar Typhi
gugguucgccaucca

SEQ ID NO: 1662967 - RNA, 14 nt, Salmonella enterica enterica serovar Typhi
gugucggccggaua

SEQ ID NO: 1662968 - RNA, 23 nt, Salmonella enterica enterica serovar Typhi
guguguuauagcguuuuauccgu

SEQ ID NO: 1662969 - RNA, 23 nt, Salmonella enterica enterica serovar Typhi
guggaugcgcuaucgauggcagu

SEQ ID NO: 1662970 - RNA, 16 nt, Salmonella enterica enterica serovar Typhi
guggauuuauggcguc

SEQ ID NO: 1662971 - RNA, 14 nt, Salmonella enterica enterica serovar Typhi
guggacaucgccau

SEQ ID NO: 1662972 - RNA, 16 nt, Salmonella enterica enterica serovar Typhi
guggaaaacagcgccg

SEQ ID NO: 1662973 - RNA, 13 nt, Salmonella enterica enterica serovar Typhi
gugcgccauccgg

SEQ ID NO: 1662974 - RNA, 16 nt, Salmonella enterica enterica serovar Typhi
gugcgcaauuccagca

SEQ ID NO: 1662975 - RNA, 14 nt, Salmonella enterica enterica serovar Typhi
gugcgacaccacgc

SEQ ID NO: 1662976 - RNA, 21 nt, Salmonella enterica enterica serovar Typhi
gugcgacaacaaugaaacggu

SEQ ID NO: 1662977 - RNA, 13 nt, Salmonella enterica enterica serovar Typhi
gugcgacguaggc

SEQ ID NO: 1662978 - RNA, 17 nt, Salmonella enterica enterica serovar Typhi
gugcgauucagcgcagg

SEQ ID NO: 1662979 - RNA, 13 nt, Salmonella enterica enterica serovar Typhi
gugcggcuuaucg

SEQ ID NO: 1662980 - RNA, 14 nt, Salmonella enterica enterica serovar Typhi
gugcggacguagcg

SEQ ID NO: 1662981 - RNA, 15 nt, Salmonella enterica enterica serovar Typhi
gugccggguucugcg

SEQ ID NO: 1662982 - RNA, 19 nt, Salmonella enterica enterica serovar Typhi
gugccgccaggcaaauucu

SEQ ID NO: 1662983 - RNA, 21 nt, Salmonella enterica enterica serovar Typhi
gugccgauggcgcuccugaau

SEQ ID NO: 1662984 - RNA, 18 nt, Salmonella enterica enterica serovar Typhi
gugaguaacgggcagcgg

SEQ ID NO: 1662985 - RNA, 19 nt, Salmonella enterica enterica serovar Typhi
gugauaagccccuuuacgc

SEQ ID NO: 1662986 - RNA, 16 nt, Salmonella enterica enterica serovar Typhi
gugauaaagcagacca

SEQ ID NO: 1662987 - RNA, 14 nt, Salmonella enterica enterica serovar Typhi
gugauauagcgcca

SEQ ID NO: 1662988 - RNA, 22 nt, Salmonella enterica enterica serovar Typhi
gugauaguggcgucgccauaaa

SEQ ID NO: 1662989 - RNA, 11 nt, Salmonella enterica enterica serovar Typhi
gugcacaggua

SEQ ID NO: 1662990 - RNA, 14 nt, Salmonella enterica enterica serovar Typhi
gugcaucggcacag

SEQ ID NO: 1662991 - RNA, 16 nt, Salmonella enterica enterica serovar Typhi
uggcgcagcaaaccau

SEQ ID NO: 1662992 - RNA, 20 nt, Salmonella enterica enterica serovar Typhi
uggcgccauuggcucggcgu

SEQ ID NO: 1662993 - RNA, 15 nt, Salmonella enterica enterica serovar Typhi
uggcgccacgccacc

SEQ ID NO: 1662994 - RNA, 21 nt, Salmonella enterica enterica serovar Typhi
uggcgcaguuuacgcagcgcc

SEQ ID NO: 1662995 - RNA, 13 nt, Salmonella enterica enterica serovar Typhi
uggcggaaugacc

SEQ ID NO: 1662996 - RNA, 23 nt, Salmonella enterica enterica serovar Typhi
uggcggcauaaaugccuuauccg

SEQ ID NO: 1662997 - RNA, 22 nt, Salmonella enterica enterica serovar Typhi
uggcagggcugaaucggcaccu

SEQ ID NO: 1662998 - RNA, 21 nt, Salmonella enterica enterica serovar Typhi
uggccgugacuuguuccaguc

SEQ ID NO: 1662999 - RNA, 15 nt, Salmonella enterica enterica serovar Typhi
uggccugcugcggua

SEQ ID NO: 1663000 - RNA, 15 nt, Salmonella enterica enterica serovar Typhi
uggccuucauaccgu

SEQ ID NO: 1663001 - RNA, 15 nt, Salmonella enterica enterica serovar Typhi
aauaugcgucagcgc

SEQ ID NO: 1663002 - RNA, 16 nt, Salmonella enterica enterica serovar Typhi
uggcguuccacccagu

SEQ ID NO: 1663003 - RNA, 16 nt, Salmonella enterica enterica serovar Typhi
uggcucaauccaggug

SEQ ID NO: 1663004 - RNA, 19 nt, Salmonella enterica enterica serovar Typhi
uggcuauuuuuugcuggcg

SEQ ID NO: 1663005 - RNA, 17 nt, Salmonella enterica enterica serovar Typhi
uggcuauacgcggcgua

SEQ ID NO: 1663006 - RNA, 19 nt, Salmonella enterica enterica serovar Typhi
uggcuccuguugguuauac

SEQ ID NO: 1663007 - RNA, 22 nt, Salmonella enterica enterica serovar Typhi
uggcucggccugucgcgaccau

SEQ ID NO: 1663008 - RNA, 18 nt, Salmonella enterica enterica serovar Typhi
uggcguagaagcuuacca

SEQ ID NO: 1663009 - RNA, 17 nt, Salmonella enterica enterica serovar Typhi
uggcgugaaccgguaaa

SEQ ID NO: 1663010 - RNA, 15 nt, Salmonella enterica enterica serovar Typhi
uggcguuaacggcgc

SEQ ID NO: 1663011 - RNA, 12 nt, Salmonella enterica enterica serovar Typhi
uggcugccgaca

SEQ ID NO: 1663012 - RNA, 13 nt, Salmonella enterica enterica serovar Typhi
uggcuggcgcuga

SEQ ID NO: 1663013 - RNA, 23 nt, Salmonella enterica enterica serovar Typhi
uggcuguagauacugaccaagcg

SEQ ID NO: 1663014 - RNA, 15 nt, Salmonella enterica enterica serovar Typhi
uggcuugaucaacgc

SEQ ID NO: 1663015 - RNA, 18 nt, Salmonella enterica enterica serovar Typhi
uggcuugaucaacgccgc

SEQ ID NO: 1663016 - RNA, 16 nt, Salmonella enterica enterica serovar Typhi
uggcuuuacgaccgca

SEQ ID NO: 1663017 - RNA, 13 nt, Salmonella enterica enterica serovar Typhi
uggcuuucaccgu

SEQ ID NO: 1663018 - RNA, 14 nt, Salmonella enterica enterica serovar Typhi
ugggaauaggccgc

SEQ ID NO: 1663019 - RNA, 17 nt, Salmonella enterica enterica serovar Typhi
uggcuuuuuccugccau

SEQ ID NO: 1663020 - RNA, 18 nt, Salmonella enterica enterica serovar Typhi
uggcuuuguuaaacguaa

SEQ ID NO: 1663021 - RNA, 16 nt, Salmonella enterica enterica serovar Typhi
ugggcacucgaagaua

SEQ ID NO: 1663022 - RNA, 20 nt, Salmonella enterica enterica serovar Typhi
ugggcauaaucgacaguggc

SEQ ID NO: 1663023 - RNA, 20 nt, Salmonella enterica enterica serovar Typhi
ugggaucgacucauccagca

SEQ ID NO: 1663024 - RNA, 15 nt, Salmonella enterica enterica serovar Typhi
uggguaggccggaua

SEQ ID NO: 1663025 - RNA, 22 nt, Salmonella enterica enterica serovar Typhi
uggguaacgcucuuaccgcuaa

SEQ ID NO: 1663026 - RNA, 19 nt, Salmonella enterica enterica serovar Typhi
ugggccagcagcgcaucau

SEQ ID NO: 1663027 - RNA, 13 nt, Salmonella enterica enterica serovar Typhi
ugggccagcagcg

SEQ ID NO: 1663028 - RNA, 16 nt, Salmonella enterica enterica serovar Typhi
ugguacaucaaaucag

SEQ ID NO: 1663029 - RNA, 12 nt, Salmonella enterica enterica serovar Typhi
ugguaccagauc

SEQ ID NO: 1663030 - RNA, 18 nt, Salmonella enterica enterica serovar Typhi
ugguagagcaucgcggca

SEQ ID NO: 1663031 - RNA, 15 nt, Salmonella enterica enterica serovar Typhi
uggugguugcaucau

SEQ ID NO: 1663032 - RNA, 15 nt, Salmonella enterica enterica serovar Typhi
ugguguaggcguagc

SEQ ID NO: 1663033 - RNA, 22 nt, Salmonella enterica enterica serovar Typhi
ugguggucggcaaucaccugca

SEQ ID NO: 1663034 - RNA, 13 nt, Salmonella enterica enterica serovar Typhi
ugguguuuuccag

SEQ ID NO: 1663035 - RNA, 19 nt, Salmonella enterica enterica serovar Typhi
ugguuaaacacauccggcg

SEQ ID NO: 1663036 - RNA, 16 nt, Salmonella enterica enterica serovar Typhi
uggugauuaacagcgc

SEQ ID NO: 1663037 - RNA, 15 nt, Salmonella enterica enterica serovar Typhi
aaucaauacugccau

SEQ ID NO: 1663038 - RNA, 13 nt, Salmonella enterica enterica serovar Typhi
uggucgcggcuca

SEQ ID NO: 1663039 - RNA, 15 nt, Salmonella enterica enterica serovar Typhi
uguccguuccugccg

SEQ ID NO: 1663040 - RNA, 20 nt, Salmonella enterica enterica serovar Typhi
uguccgcccaguaccagcac

SEQ ID NO: 1663041 - RNA, 17 nt, Salmonella enterica enterica serovar Typhi
ugucccugccagcguaa

SEQ ID NO: 1663042 - RNA, 16 nt, Salmonella enterica enterica serovar Typhi
ugucgaaaccagcaua

SEQ ID NO: 1663043 - RNA, 18 nt, Salmonella enterica enterica serovar Typhi
ugucgaugauauccagca

SEQ ID NO: 1663044 - RNA, 15 nt, Salmonella enterica enterica serovar Typhi
ugguuauccagcaac

SEQ ID NO: 1663045 - RNA, 23 nt, Salmonella enterica enterica serovar Typhi
ugguuccaggcgcgcaccguugc

SEQ ID NO: 1663046 - RNA, 12 nt, Salmonella enterica enterica serovar Typhi
uguaaaagccag

SEQ ID NO: 1663047 - RNA, 18 nt, Salmonella enterica enterica serovar Typhi
aaucacagggggaacauu

SEQ ID NO: 1663048 - RNA, 14 nt, Salmonella enterica enterica serovar Typhi
aaucacaaagccgu

SEQ ID NO: 1663049 - RNA, 22 nt, Salmonella enterica enterica serovar Typhi
aaucaauggccuugccagcgag

SEQ ID NO: 1663050 - RNA, 20 nt, Salmonella enterica enterica serovar Typhi
uguaggccugauaagcgcag

SEQ ID NO: 1663051 - RNA, 20 nt, Salmonella enterica enterica serovar Typhi
uguaggccugguaagcguag

SEQ ID NO: 1663052 - RNA, 16 nt, Salmonella enterica enterica serovar Typhi
uguaaccuuaaaaggc

SEQ ID NO: 1663053 - RNA, 20 nt, Salmonella enterica enterica serovar Typhi
uguaggccugauaagcgaag

SEQ ID NO: 1663054 - RNA, 20 nt, Salmonella enterica enterica serovar Typhi
uguaggccggguaagcguaa

SEQ ID NO: 1663055 - RNA, 15 nt, Salmonella enterica enterica serovar Typhi
ugucaucgccgcuaa

SEQ ID NO: 1663056 - RNA, 16 nt, Salmonella enterica enterica serovar Typhi
ugucaugcgccacgac

SEQ ID NO: 1663057 - RNA, 21 nt, Salmonella enterica enterica serovar Typhi
ugucauuccuuccacgcguac

SEQ ID NO: 1663058 - RNA, 21 nt, Salmonella enterica enterica serovar Typhi
ugucauggcgccaccagcgau

SEQ ID NO: 1663059 - RNA, 17 nt, Salmonella enterica enterica serovar Typhi
uguccaccgauuucauc

SEQ ID NO: 1663060 - RNA, 20 nt, Salmonella enterica enterica serovar Typhi
uguauuaucgaugcgccagu

SEQ ID NO: 1663061 - RNA, 16 nt, Salmonella enterica enterica serovar Typhi
uguaucagcauuuaca

SEQ ID NO: 1663062 - RNA, 20 nt, Salmonella enterica enterica serovar Typhi
ugcgccuggaaaaaagcgcc

SEQ ID NO: 1663063 - RNA, 14 nt, Salmonella enterica enterica serovar Typhi
ugcgccuggcggua

SEQ ID NO: 1663064 - RNA, 22 nt, Salmonella enterica enterica serovar Typhi
ugcgcaucgcuacacgcguaaa

SEQ ID NO: 1663065 - RNA, 14 nt, Salmonella enterica enterica serovar Typhi
ugcgcgccuucgaa

SEQ ID NO: 1663066 - RNA, 21 nt, Salmonella enterica enterica serovar Typhi
ugcgcgcuucuucaugggcgu

SEQ ID NO: 1663067 - RNA, 21 nt, Salmonella enterica enterica serovar Typhi
ugcgcggauuaagcgaaucca

SEQ ID NO: 1663068 - RNA, 20 nt, Salmonella enterica enterica serovar Typhi
ugcgcgccgcccugcaucau

SEQ ID NO: 1663069 - RNA, 19 nt, Salmonella enterica enterica serovar Typhi
ugcgcuuaucagaccgaca

SEQ ID NO: 1663070 - RNA, 18 nt, Salmonella enterica enterica serovar Typhi
ugcggaacaccagcgccg

SEQ ID NO: 1663071 - RNA, 21 nt, Salmonella enterica enterica serovar Typhi
ugcggacggcgucuggugaaa

SEQ ID NO: 1663072 - RNA, 21 nt, Salmonella enterica enterica serovar Typhi
ugcggagagagcaauggcgug

SEQ ID NO: 1663073 - RNA, 19 nt, Salmonella enterica enterica serovar Typhi
ugcggcaucagauggcgau

SEQ ID NO: 1663074 - RNA, 21 nt, Salmonella enterica enterica serovar Typhi
ugccgucaaacaagccgccaa

SEQ ID NO: 1663075 - RNA, 18 nt, Salmonella enterica enterica serovar Typhi
ugccguaggcaacgaccc

SEQ ID NO: 1663076 - RNA, 17 nt, Salmonella enterica enterica serovar Typhi
ugccguauaauccagcu

SEQ ID NO: 1663077 - RNA, 13 nt, Salmonella enterica enterica serovar Typhi
ugccgucaucgac

SEQ ID NO: 1663078 - RNA, 20 nt, Salmonella enterica enterica serovar Typhi
ugccguccauccggcguaau

SEQ ID NO: 1663079 - RNA, 14 nt, Salmonella enterica enterica serovar Typhi
ugccuaaaccgaca

SEQ ID NO: 1663080 - RNA, 21 nt, Salmonella enterica enterica serovar Typhi
ugccuacugcccuacgcuucu

SEQ ID NO: 1663081 - RNA, 19 nt, Salmonella enterica enterica serovar Typhi
ugccucaccccauggcguc

SEQ ID NO: 1663082 - RNA, 15 nt, Salmonella enterica enterica serovar Typhi
ugccucgcgcaccau

SEQ ID NO: 1663083 - RNA, 16 nt, Salmonella enterica enterica serovar Typhi
ugccugacaaugacgc

SEQ ID NO: 1663084 - RNA, 14 nt, Salmonella enterica enterica serovar Typhi
ugccugaaccggug

SEQ ID NO: 1663085 - RNA, 18 nt, Salmonella enterica enterica serovar Typhi
ugcgcagccccagcgcca

SEQ ID NO: 1663086 - RNA, 17 nt, Salmonella enterica enterica serovar Typhi
ugcgcaggaggcuuccg

SEQ ID NO: 1663087 - RNA, 13 nt, Salmonella enterica enterica serovar Typhi
ugccugucacgca

SEQ ID NO: 1663088 - RNA, 14 nt, Salmonella enterica enterica serovar Typhi
ugcgaaucuucauc

SEQ ID NO: 1663089 - RNA, 17 nt, Salmonella enterica enterica serovar Typhi
ugccuguagcagcgcca

SEQ ID NO: 1663090 - RNA, 20 nt, Salmonella enterica enterica serovar Typhi
ugccugauggcguagcgcca

SEQ ID NO: 1663091 - RNA, 22 nt, Salmonella enterica enterica serovar Typhi
ugccugccguuuuuaacgccgg

SEQ ID NO: 1663092 - RNA, 18 nt, Salmonella enterica enterica serovar Typhi
ugccugcguugcuauggc

SEQ ID NO: 1663093 - RNA, 20 nt, Salmonella enterica enterica serovar Typhi
ugccugcugcggauaacguu

SEQ ID NO: 1663094 - RNA, 14 nt, Salmonella enterica enterica serovar Typhi
ugcgacgccaggcg

SEQ ID NO: 1663095 - RNA, 17 nt, Salmonella enterica enterica serovar Typhi
ugcgaggucaccgggcg

SEQ ID NO: 1663096 - RNA, 17 nt, Salmonella enterica enterica serovar Typhi
uggcaguacagggcgau

SEQ ID NO: 1663097 - RNA, 17 nt, Salmonella enterica enterica serovar Typhi
uggcaagcgccagcaug

SEQ ID NO: 1663098 - RNA, 20 nt, Salmonella enterica enterica serovar Typhi
uggcaaaaggggcguuucuc

SEQ ID NO: 1663099 - RNA, 22 nt, Salmonella enterica enterica serovar Typhi
uggcaacccguaccuccagcga

SEQ ID NO: 1663100 - RNA, 20 nt, Salmonella enterica enterica serovar Typhi
uggcaacauagcaucguuac

SEQ ID NO: 1663101 - RNA, 19 nt, Salmonella enterica enterica serovar Typhi
uggauuccuccaauucagg

SEQ ID NO: 1663102 - RNA, 22 nt, Salmonella enterica enterica serovar Typhi
uggauuaucgaaauagcgguga

SEQ ID NO: 1663103 - RNA, 20 nt, Salmonella enterica enterica serovar Typhi
uggauagcaccauaaacggc

SEQ ID NO: 1663104 - RNA, 15 nt, Salmonella enterica enterica serovar Typhi
uggauagucuucaag

SEQ ID NO: 1663105 - RNA, 15 nt, Salmonella enterica enterica serovar Typhi
uggauauucaucgcc

SEQ ID NO: 1663106 - RNA, 13 nt, Salmonella enterica enterica serovar Typhi
uggaugaacucaa

SEQ ID NO: 1663107 - RNA, 22 nt, Salmonella enterica enterica serovar Typhi
uggacguggauauucaucaguu

SEQ ID NO: 1663108 - RNA, 19 nt, Salmonella enterica enterica serovar Typhi
uggagagcagcgccagcga

SEQ ID NO: 1663109 - RNA, 13 nt, Salmonella enterica enterica serovar Typhi
uggauaaccugcc

SEQ ID NO: 1663110 - RNA, 19 nt, Salmonella enterica enterica serovar Typhi
uggauaauugcucugccag

SEQ ID NO: 1663111 - RNA, 16 nt, Salmonella enterica enterica serovar Typhi
uggagcguaagcgcgg

SEQ ID NO: 1663112 - RNA, 16 nt, Salmonella enterica enterica serovar Typhi
ugcuguaggccggaug

SEQ ID NO: 1663113 - RNA, 16 nt, Salmonella enterica enterica serovar Typhi
ugcuguaggccgggua

SEQ ID NO: 1663114 - RNA, 14 nt, Salmonella enterica enterica serovar Typhi
ugcguauccagcgc

SEQ ID NO: 1663115 - RNA, 22 nt, Salmonella enterica enterica serovar Typhi
ugcggcgaagcaucuuuccgga

SEQ ID NO: 1663116 - RNA, 12 nt, Salmonella enterica enterica serovar Typhi
ugcgucagcgcu

SEQ ID NO: 1663117 - RNA, 14 nt, Salmonella enterica enterica serovar Typhi
ugcguauugagcgc

SEQ ID NO: 1663118 - RNA, 11 nt, Salmonella enterica enterica serovar Typhi
ugcgucaacgc

SEQ ID NO: 1663119 - RNA, 14 nt, Salmonella enterica enterica serovar Typhi
ugcuauucagcagu

SEQ ID NO: 1663120 - RNA, 19 nt, Salmonella enterica enterica serovar Typhi
ugcuauaugcaggcauaaa

SEQ ID NO: 1663121 - RNA, 13 nt, Salmonella enterica enterica serovar Typhi
ugcguuguggacg

SEQ ID NO: 1663122 - RNA, 14 nt, Salmonella enterica enterica serovar Typhi
ugcuaauaccggga

SEQ ID NO: 1663123 - RNA, 22 nt, Salmonella enterica enterica serovar Typhi
ugcuaagcuggauaccgcgcca

SEQ ID NO: 1663124 - RNA, 22 nt, Salmonella enterica enterica serovar Typhi
ugcguucuauugucaccgggcg

SEQ ID NO: 1663125 - RNA, 14 nt, Salmonella enterica enterica serovar Typhi
aauauccuccggcg

SEQ ID NO: 1663126 - RNA, 16 nt, Salmonella enterica enterica serovar Typhi
ugcguugucgcugauu

SEQ ID NO: 1663127 - RNA, 13 nt, Salmonella enterica enterica serovar Typhi
ugcguucuuccac

SEQ ID NO: 1663128 - RNA, 14 nt, Salmonella enterica enterica serovar Typhi
ugcguugaccagcg

SEQ ID NO: 1663129 - RNA, 20 nt, Salmonella enterica enterica serovar Typhi
aauauccauuugcgacauca

SEQ ID NO: 1663130 - RNA, 12 nt, Salmonella enterica enterica serovar Typhi
ugcugaacagcc

SEQ ID NO: 1663131 - RNA, 19 nt, Salmonella enterica enterica serovar Typhi
ugcugacacccucugcgcc

SEQ ID NO: 1663132 - RNA, 17 nt, Salmonella enterica enterica serovar Typhi
ugcucuucuuccggcga

SEQ ID NO: 1663133 - RNA, 20 nt, Salmonella enterica enterica serovar Typhi
ugcucggcggucagccacau

SEQ ID NO: 1663134 - RNA, 20 nt, Salmonella enterica enterica serovar Typhi
ugcugcaucuccagcguggc

SEQ ID NO: 1663135 - RNA, 22 nt, Salmonella enterica enterica serovar Typhi
ugcugggcgauagcguaaagua

SEQ ID NO: 1663136 - RNA, 15 nt, Salmonella enterica enterica serovar Typhi
ugcuggugcgccugu

SEQ ID NO: 1663137 - RNA, 23 nt, Salmonella enterica enterica serovar Typhi
uuucuacaccuucuucgccaacu

SEQ ID NO: 1663138 - RNA, 18 nt, Salmonella enterica enterica serovar Typhi
uuucguagggccgcguau

SEQ ID NO: 1663139 - RNA, 23 nt, Salmonella enterica enterica serovar Typhi
uuucuccugcgccagccggauac

SEQ ID NO: 1663140 - RNA, 21 nt, Salmonella enterica enterica serovar Typhi
uuuguugcuccagcaucacau

SEQ ID NO: 1663141 - RNA, 20 nt, Salmonella enterica enterica serovar Typhi
uuuucaaugucgcaaucggc

SEQ ID NO: 1663142 - RNA, 22 nt, Salmonella enterica enterica serovar Typhi
uuuucuaacgaggugacgccau

SEQ ID NO: 1663143 - RNA, 16 nt, Salmonella enterica enterica serovar Typhi
uuuucgauaaucgcgc

SEQ ID NO: 1663144 - RNA, 18 nt, Salmonella enterica enterica serovar Typhi
uuuucgcccccagcacga

SEQ ID NO: 1663145 - RNA, 21 nt, Salmonella enterica enterica serovar Typhi
uuuucgccagguacaucgcgc

SEQ ID NO: 1663146 - RNA, 18 nt, Salmonella enterica enterica serovar Typhi
uuuuccagcguaauccgc

SEQ ID NO: 1663147 - RNA, 17 nt, Salmonella enterica enterica serovar Typhi
aaucuguagauugcgcg

SEQ ID NO: 1663148 - RNA, 17 nt, Salmonella enterica enterica serovar Typhi
aaucugccgucaucgac

SEQ ID NO: 1663149 - RNA, 16 nt, Salmonella enterica enterica serovar Typhi
aaucuuuccagcucca

SEQ ID NO: 1663150 - RNA, 12 nt, Salmonella enterica enterica serovar Typhi
aaugauuuccgc

SEQ ID NO: 1663151 - RNA, 16 nt, Salmonella enterica enterica serovar Typhi
aaugccaccagcgcca

SEQ ID NO: 1663152 - RNA, 23 nt, Salmonella enterica enterica serovar Typhi
aaugccauauuuuuccagcgccu

SEQ ID NO: 1663153 - RNA, 13 nt, Salmonella enterica enterica serovar Typhi
aaugccagcgccg

SEQ ID NO: 1663154 - RNA, 19 nt, Salmonella enterica enterica serovar Typhi
aaugcauugauaggcugcu

SEQ ID NO: 1663155 - RNA, 20 nt, Salmonella enterica enterica serovar Typhi
aaucgccccauuggcgucga

SEQ ID NO: 1663156 - RNA, 17 nt, Salmonella enterica enterica serovar Typhi
aaucgccagcagcgcga

SEQ ID NO: 1663157 - RNA, 23 nt, Salmonella enterica enterica serovar Typhi
aaucgccagcaucggcagcgcca

SEQ ID NO: 1663158 - RNA, 20 nt, Salmonella enterica enterica serovar Typhi
uuuuggcaacggcagccagc

SEQ ID NO: 1663159 - RNA, 15 nt, Salmonella enterica enterica serovar Typhi
uuuuguagacucgcg

SEQ ID NO: 1663160 - RNA, 20 nt, Salmonella enterica enterica serovar Typhi
aaucuccagaccgcugcgga

SEQ ID NO: 1663161 - RNA, 17 nt, Salmonella enterica enterica serovar Typhi
aaucucuucccagcgca

SEQ ID NO: 1663162 - RNA, 23 nt, Salmonella enterica enterica serovar Typhi
aaucgccgcgccggacuccagca

SEQ ID NO: 1663163 - RNA, 17 nt, Salmonella enterica enterica serovar Typhi
aaucucaauaccacgcc

SEQ ID NO: 1663164 - RNA, 22 nt, Salmonella enterica enterica serovar Typhi
aaucucagauaauagcugcggc

SEQ ID NO: 1663165 - RNA, 20 nt, Salmonella enterica enterica serovar Typhi
aaugcguuugauuugcgcgu

SEQ ID NO: 1663166 - RNA, 13 nt, Salmonella enterica enterica serovar Typhi
aaugccgcuggcg

SEQ ID NO: 1663167 - RNA, 20 nt, Salmonella enterica enterica serovar Typhi
aaugcuucuucgccagcuuc

SEQ ID NO: 1663168 - RNA, 18 nt, Salmonella enterica enterica serovar Typhi
aauggaaaauaauaaucg

SEQ ID NO: 1663169 - RNA, 19 nt, Salmonella enterica enterica serovar Typhi
aauuagacaagcaguucug

SEQ ID NO: 1663170 - RNA, 16 nt, Salmonella enterica enterica serovar Typhi
aauuccugacugcgcg

SEQ ID NO: 1663171 - RNA, 14 nt, Salmonella enterica enterica serovar Typhi
aauuccgcauugag

SEQ ID NO: 1663172 - RNA, 22 nt, Salmonella enterica enterica serovar Typhi
aauucacguuccauuucagcga

SEQ ID NO: 1663173 - RNA, 16 nt, Salmonella enterica enterica serovar Typhi
aauuguagcugcgcca

SEQ ID NO: 1663174 - RNA, 19 nt, Salmonella enterica enterica serovar Typhi
aauuuccagaaggugaguu

SEQ ID NO: 1663175 - RNA, 14 nt, Salmonella enterica enterica serovar Typhi
aauuuccagcgggc

SEQ ID NO: 1663176 - RNA, 10 nt, Salmonella enterica enterica serovar Typhi
aauuuccagu

SEQ ID NO: 1663177 - RNA, 21 nt, Salmonella enterica enterica serovar Typhi
aauugagcgcaaaacgcugcu

SEQ ID NO: 1663178 - RNA, 22 nt, Salmonella enterica enterica serovar Typhi
aauucucacagaaucaucaggc

SEQ ID NO: 1663179 - RNA, 14 nt, Salmonella enterica enterica serovar Typhi
aauugccagcaggu

SEQ ID NO: 1663180 - RNA, 21 nt, Salmonella enterica enterica serovar Typhi
aauugccgggugacgcuuacg

SEQ ID NO: 1663181 - RNA, 18 nt, Salmonella enterica enterica serovar Typhi
uugcucucaggcaguaac

SEQ ID NO: 1663182 - RNA, 19 nt, Salmonella enterica enterica serovar Typhi
uugcugcgccagccagacg

SEQ ID NO: 1663183 - RNA, 15 nt, Salmonella enterica enterica serovar Typhi
uugcugcgucacgcg

SEQ ID NO: 1663184 - RNA, 18 nt, Salmonella enterica enterica serovar Typhi
uugcuggugccuuccguc

SEQ ID NO: 1663185 - RNA, 14 nt, Salmonella enterica enterica serovar Typhi
uugcugacaucgcg

SEQ ID NO: 1663186 - RNA, 15 nt, Salmonella enterica enterica serovar Typhi
uugcgucguuccguc

SEQ ID NO: 1663187 - RNA, 18 nt, Salmonella enterica enterica serovar Typhi
uugcggcaucagauggcg

SEQ ID NO: 1663188 - RNA, 20 nt, Salmonella enterica enterica serovar Typhi
uugcggaauacacgaacaca

SEQ ID NO: 1663189 - RNA, 18 nt, Salmonella enterica enterica serovar Typhi
uugcgcucgcgccagaug

SEQ ID NO: 1663190 - RNA, 13 nt, Salmonella enterica enterica serovar Typhi
uugcgcucugcca

SEQ ID NO: 1663191 - RNA, 13 nt, Salmonella enterica enterica serovar Typhi
uugccuuccugau

SEQ ID NO: 1663192 - RNA, 18 nt, Salmonella enterica enterica serovar Typhi
uugccuggguuggucaca

SEQ ID NO: 1663193 - RNA, 20 nt, Salmonella enterica enterica serovar Typhi
uugccugauggcgcugcgcu

SEQ ID NO: 1663194 - RNA, 16 nt, Salmonella enterica enterica serovar Typhi
uugccugcggauuugc

SEQ ID NO: 1663195 - RNA, 19 nt, Salmonella enterica enterica serovar Typhi
uugccugcggauuugcugc

SEQ ID NO: 1663196 - RNA, 20 nt, Salmonella enterica enterica serovar Typhi
uugccugcggauuugcugcu

SEQ ID NO: 1663197 - RNA, 15 nt, Salmonella enterica enterica serovar Typhi
uugcgauuagcccgg

SEQ ID NO: 1663198 - RNA, 19 nt, Salmonella enterica enterica serovar Typhi
uugcgaacauuucagcgcc

SEQ ID NO: 1663199 - RNA, 23 nt, Salmonella enterica enterica serovar Typhi
uugaucacuuuugggccgcguag

SEQ ID NO: 1663200 - RNA, 19 nt, Salmonella enterica enterica serovar Typhi
uugaucguccggcgaugcc

SEQ ID NO: 1663201 - RNA, 13 nt, Salmonella enterica enterica serovar Typhi
uugccugauggcg

SEQ ID NO: 1663202 - RNA, 18 nt, Salmonella enterica enterica serovar Typhi
uuggccggcuucuccacc

SEQ ID NO: 1663203 - RNA, 13 nt, Salmonella enterica enterica serovar Typhi
uuggcccgacaug

SEQ ID NO: 1663204 - RNA, 22 nt, Salmonella enterica enterica serovar Typhi
uuggcaacccguaccuccagcg

SEQ ID NO: 1663205 - RNA, 14 nt, Salmonella enterica enterica serovar Typhi
uuggauuauacauu

SEQ ID NO: 1663206 - RNA, 13 nt, Salmonella enterica enterica serovar Typhi
uuggaggucauua

SEQ ID NO: 1663207 - RNA, 21 nt, Salmonella enterica enterica serovar Typhi
uuggaggucauuauucaggcc

SEQ ID NO: 1663208 - RNA, 16 nt, Salmonella enterica enterica serovar Typhi
uuggacggcgucacca

SEQ ID NO: 1663209 - RNA, 17 nt, Salmonella enterica enterica serovar Typhi
uuggacggaaucucgca

SEQ ID NO: 1663210 - RNA, 17 nt, Salmonella enterica enterica serovar Typhi
uugcuuugcggcauaac

SEQ ID NO: 1663211 - RNA, 14 nt, Salmonella enterica enterica serovar Typhi
uugcuucgccaucu

SEQ ID NO: 1663212 - RNA, 17 nt, Salmonella enterica enterica serovar Typhi
uugcuucguuaccggug

SEQ ID NO: 1663213 - RNA, 19 nt, Salmonella enterica enterica serovar Typhi
uuggcuauacgcggcguac

SEQ ID NO: 1663214 - RNA, 17 nt, Salmonella enterica enterica serovar Typhi
uuggcguaaaucaggcc

SEQ ID NO: 1663215 - RNA, 13 nt, Salmonella enterica enterica serovar Typhi
uuguagcugcgcc

SEQ ID NO: 1663216 - RNA, 23 nt, Salmonella enterica enterica serovar Typhi
aauccgugcccgaaucgccgcuu

SEQ ID NO: 1663217 - RNA, 19 nt, Salmonella enterica enterica serovar Typhi
uuguuuacgcccucaucgg

SEQ ID NO: 1663218 - RNA, 22 nt, Salmonella enterica enterica serovar Typhi
aauccugucgucaccagcaggu

SEQ ID NO: 1663219 - RNA, 19 nt, Salmonella enterica enterica serovar Typhi
uuguaggccugauaagcgc

SEQ ID NO: 1663220 - RNA, 20 nt, Salmonella enterica enterica serovar Typhi
uuuagcguuucaucggugua

SEQ ID NO: 1663221 - RNA, 23 nt, Salmonella enterica enterica serovar Typhi
uuuagccgcaaacuuugcgccau

SEQ ID NO: 1663222 - RNA, 15 nt, Salmonella enterica enterica serovar Typhi
uuuagcaugacaaua

SEQ ID NO: 1663223 - RNA, 23 nt, Salmonella enterica enterica serovar Typhi
uuuacgcuguaacccgccgccau

SEQ ID NO: 1663224 - RNA, 13 nt, Salmonella enterica enterica serovar Typhi
uuuagcauaacgu

SEQ ID NO: 1663225 - RNA, 16 nt, Salmonella enterica enterica serovar Typhi
uuuaaggcugauuccg

SEQ ID NO: 1663226 - RNA, 14 nt, Salmonella enterica enterica serovar Typhi
uuuaauaacggcga

SEQ ID NO: 1663227 - RNA, 17 nt, Salmonella enterica enterica serovar Typhi
uuuaagcuggcgaacgu

SEQ ID NO: 1663228 - RNA, 14 nt, Salmonella enterica enterica serovar Typhi
uuuacugaugccag

SEQ ID NO: 1663229 - RNA, 17 nt, Salmonella enterica enterica serovar Typhi
uuuccacaaucccggca

SEQ ID NO: 1663230 - RNA, 21 nt, Salmonella enterica enterica serovar Typhi
uuucgccagcgcaucgauaua

SEQ ID NO: 1663231 - RNA, 13 nt, Salmonella enterica enterica serovar Typhi
uuucagaucggca

SEQ ID NO: 1663232 - RNA, 15 nt, Salmonella enterica enterica serovar Typhi
uuucaugauauucug

SEQ ID NO: 1663233 - RNA, 18 nt, Salmonella enterica enterica serovar Typhi
uuucaucaaacggauaag

SEQ ID NO: 1663234 - RNA, 22 nt, Salmonella enterica enterica serovar Typhi
uuucacugcgugaugcugcagg

SEQ ID NO: 1663235 - RNA, 20 nt, Salmonella enterica enterica serovar Typhi
uuuaucaacaaauuccggca

SEQ ID NO: 1663236 - RNA, 14 nt, Salmonella enterica enterica serovar Typhi
uuccuguuccugag

SEQ ID NO: 1663237 - RNA, 16 nt, Salmonella enterica enterica serovar Typhi
uuccuggucugccaga

SEQ ID NO: 1663238 - RNA, 20 nt, Salmonella enterica enterica serovar Typhi
uucgagauuuuucugcgcca

SEQ ID NO: 1663239 - RNA, 14 nt, Salmonella enterica enterica serovar Typhi
uucgauggccucau

SEQ ID NO: 1663240 - RNA, 23 nt, Salmonella enterica enterica serovar Typhi
uucgcacgccucuggcguacgca

SEQ ID NO: 1663241 - RNA, 11 nt, Salmonella enterica enterica serovar Typhi
uucgcagcaga

SEQ ID NO: 1663242 - RNA, 22 nt, Salmonella enterica enterica serovar Typhi
uucgcaugaauucaacgucccc

SEQ ID NO: 1663243 - RNA, 18 nt, Salmonella enterica enterica serovar Typhi
uucgccgcguaaucuucg

SEQ ID NO: 1663244 - RNA, 18 nt, Salmonella enterica enterica serovar Typhi
uucgcugauuugcgucaa

SEQ ID NO: 1663245 - RNA, 18 nt, Salmonella enterica enterica serovar Typhi
uucgcugaguggucugga

SEQ ID NO: 1663246 - RNA, 23 nt, Salmonella enterica enterica serovar Typhi
uucgcgaacugcacucggaugua

SEQ ID NO: 1663247 - RNA, 19 nt, Salmonella enterica enterica serovar Typhi
uucgcuaucauagcgguac

SEQ ID NO: 1663248 - RNA, 13 nt, Salmonella enterica enterica serovar Typhi
uucgcguagcgcc

SEQ ID NO: 1663249 - RNA, 16 nt, Salmonella enterica enterica serovar Typhi
uucgcgucacaaucgc

SEQ ID NO: 1663250 - RNA, 23 nt, Salmonella enterica enterica serovar Typhi
uucccagguuuuggucagcucac

SEQ ID NO: 1663251 - RNA, 15 nt, Salmonella enterica enterica serovar Typhi
uucauagaaccacuu

SEQ ID NO: 1663252 - RNA, 18 nt, Salmonella enterica enterica serovar Typhi
uucagcguacagaagguu

SEQ ID NO: 1663253 - RNA, 16 nt, Salmonella enterica enterica serovar Typhi
uucaguacugacgcaa

SEQ ID NO: 1663254 - RNA, 18 nt, Salmonella enterica enterica serovar Typhi
uuccccacgccgaccacc

SEQ ID NO: 1663255 - RNA, 16 nt, Salmonella enterica enterica serovar Typhi
uucccccagauugucg

SEQ ID NO: 1663256 - RNA, 12 nt, Salmonella enterica enterica serovar Typhi
uuccccaucgcg

SEQ ID NO: 1663257 - RNA, 14 nt, Salmonella enterica enterica serovar Typhi
uuccggcaucacau

SEQ ID NO: 1663258 - RNA, 16 nt, Salmonella enterica enterica serovar Typhi
uuccggcagacggcug

SEQ ID NO: 1663259 - RNA, 17 nt, Salmonella enterica enterica serovar Typhi
uuccggcucgccaaacg

SEQ ID NO: 1663260 - RNA, 19 nt, Salmonella enterica enterica serovar Typhi
uuccucgaaacgcugcgcu

SEQ ID NO: 1663261 - RNA, 23 nt, Salmonella enterica enterica serovar Typhi
uucuuuccaguucuggcugcgcu

SEQ ID NO: 1663262 - RNA, 21 nt, Salmonella enterica enterica serovar Typhi
uugaaaaccacaaucacagcg

SEQ ID NO: 1663263 - RNA, 18 nt, Salmonella enterica enterica serovar Typhi
uucugaagcguaacagcg

SEQ ID NO: 1663264 - RNA, 13 nt, Salmonella enterica enterica serovar Typhi
uucugccagguuc

SEQ ID NO: 1663265 - RNA, 15 nt, Salmonella enterica enterica serovar Typhi
aaucaggacaucaaa

SEQ ID NO: 1663266 - RNA, 13 nt, Salmonella enterica enterica serovar Typhi
uucggucaggaua

SEQ ID NO: 1663267 - RNA, 19 nt, Salmonella enterica enterica serovar Typhi
uucucguguagccaguacg

SEQ ID NO: 1663268 - RNA, 23 nt, Salmonella enterica enterica serovar Typhi
uucucugcccccgagccagaacg

SEQ ID NO: 1663269 - RNA, 19 nt, Salmonella enterica enterica serovar Typhi
uucugaacuguaaccggcg

SEQ ID NO: 1663270 - RNA, 17 nt, Salmonella enterica enterica serovar Typhi
uucuauacugcuacgca

SEQ ID NO: 1663271 - RNA, 14 nt, Salmonella enterica enterica serovar Typhi
uugagcagaucagc

SEQ ID NO: 1663272 - RNA, 16 nt, Salmonella enterica enterica serovar Typhi
uugacguuuaccugaa

SEQ ID NO: 1663273 - RNA, 16 nt, Salmonella enterica enterica serovar Typhi
uugacgucgguaauca

SEQ ID NO: 1663274 - RNA, 12 nt, Salmonella enterica enterica serovar Typhi
uugacugccaga

SEQ ID NO: 1663275 - RNA, 19 nt, Salmonella enterica enterica serovar Typhi
uugaucaacgccgcgccau

SEQ ID NO: 1663276 - RNA, 17 nt, Salmonella enterica enterica serovar Typhi
uugacgagucggaucau

SEQ ID NO: 1663277 - RNA, 12 nt, Salmonella enterica enterica serovar Typhi
uugacgaacgcu

SEQ ID NO: 1663278 - RNA, 21 nt, Salmonella enterica enterica serovar Typhi
uugaccggggcgcaauccgcg

SEQ ID NO: 1663279 - RNA, 15 nt, Salmonella enterica enterica serovar Typhi
uugaagcgaccagcg

SEQ ID NO: 1663280 - RNA, 16 nt, Salmonella enterica enterica serovar Typhi
uugaaguuauccagcg

SEQ ID NO: 1663281 - RNA, 17 nt, Salmonella enterica enterica serovar Typhi
uugaacaugcgcagaaa

SEQ ID NO: 1663282 - RNA, 15 nt, Salmonella enterica enterica serovar Typhi
uucaacgcauccagc

SEQ ID NO: 1663283 - RNA, 15 nt, Salmonella enterica enterica serovar Typhi
uucaacaucagcgcu

SEQ ID NO: 1663284 - RNA, 13 nt, Salmonella enterica enterica serovar Typhi
uuauuugauggga

SEQ ID NO: 1663285 - RNA, 21 nt, Salmonella enterica enterica serovar Typhi
uuauuugaauagucaaccguu

SEQ ID NO: 1663286 - RNA, 18 nt, Salmonella enterica enterica serovar Typhi
uuauugccacgccauacg

SEQ ID NO: 1663287 - RNA, 23 nt, Salmonella enterica enterica serovar Typhi
uuauugauccacggaucgacauu

SEQ ID NO: 1663288 - RNA, 16 nt, Salmonella enterica enterica serovar Typhi
uucacccccaucgccc

SEQ ID NO: 1663289 - RNA, 21 nt, Salmonella enterica enterica serovar Typhi
uucaccaccacccgaucgccc

SEQ ID NO: 1663290 - RNA, 15 nt, Salmonella enterica enterica serovar Typhi
uucacaaucagcgca

SEQ ID NO: 1663291 - RNA, 17 nt, Salmonella enterica enterica serovar Typhi
uucacaaccuccacgcc

SEQ ID NO: 1663292 - RNA, 16 nt, Salmonella enterica enterica serovar Typhi
uucaccgcgccaaacg

SEQ ID NO: 1663293 - RNA, 12 nt, Salmonella enterica enterica serovar Typhi
uucaccggauac

SEQ ID NO: 1663294 - RNA, 14 nt, Salmonella enterica enterica serovar Typhi
uucagccagacgcu

SEQ ID NO: 1663295 - RNA, 15 nt, Salmonella enterica enterica serovar Typhi
uucagcauauccagc

SEQ ID NO: 1663296 - RNA, 15 nt, Salmonella enterica enterica serovar Typhi
uucaccguaucgccc

SEQ ID NO: 1663297 - RNA, 18 nt, Salmonella enterica enterica serovar Typhi
uuauucacuggcaacgau

SEQ ID NO: 1663298 - RNA, 17 nt, Salmonella enterica enterica serovar Typhi
uuauucggucagauaaa

SEQ ID NO: 1663299 - RNA, 14 nt, Salmonella enterica enterica serovar Typhi
uuauguuugcugau

SEQ ID NO: 1663300 - RNA, 22 nt, Salmonella enterica enterica serovar Typhi
uuaucucuuuugcuucaauaag

SEQ ID NO: 1663301 - RNA, 19 nt, Salmonella enterica enterica serovar Typhi
uuaucuggcgcaaccggcg

SEQ ID NO: 1663302 - RNA, 17 nt, Salmonella enterica enterica serovar Typhi
uuaucuuccacgguaaa

SEQ ID NO: 1663303 - RNA, 11 nt, Salmonella enterica enterica serovar Typhi
uuaucuuccac

SEQ ID NO: 1663304 - RNA, 18 nt, Salmonella enterica enterica serovar Typhi
uuauccugcaaauagcgc

SEQ ID NO: 1663305 - RNA, 14 nt, Salmonella enterica enterica serovar Typhi
uuaucgccgaucac

SEQ ID NO: 1663306 - RNA, 13 nt, Salmonella enterica enterica serovar Typhi
uuaucguccggca

SEQ ID NO: 1663307 - RNA, 21 nt, Salmonella enterica enterica serovar Typhi
uuaccggugcgauucagcgca

SEQ ID NO: 1663308 - RNA, 20 nt, Salmonella enterica enterica serovar Typhi
uuaccgggcaaacggcacua

SEQ ID NO: 1663309 - RNA, 16 nt, Salmonella enterica enterica serovar Typhi
uuacugaugccagccg

SEQ ID NO: 1663310 - RNA, 13 nt, Salmonella enterica enterica serovar Typhi
uuacugcgaaggc

SEQ ID NO: 1663311 - RNA, 14 nt, Salmonella enterica enterica serovar Typhi
uuacucuuccugcu

SEQ ID NO: 1663312 - RNA, 14 nt, Salmonella enterica enterica serovar Typhi
uuacugacaauaag

SEQ ID NO: 1663313 - RNA, 22 nt, Salmonella enterica enterica serovar Typhi
uuaccuggguagcuucugucug

SEQ ID NO: 1663314 - RNA, 20 nt, Salmonella enterica enterica serovar Typhi
uuagaaaauauauuggccuu

SEQ ID NO: 1663315 - RNA, 13 nt, Salmonella enterica enterica serovar Typhi
uuacuuugcgccc

SEQ ID NO: 1663316 - RNA, 20 nt, Salmonella enterica enterica serovar Typhi
uuauagcaaacccucaucgg

SEQ ID NO: 1663317 - RNA, 15 nt, Salmonella enterica enterica serovar Typhi
ugugucggccggaua

SEQ ID NO: 1663318 - RNA, 21 nt, Salmonella enterica enterica serovar Typhi
ugucggcagcgaguuacguug

SEQ ID NO: 1663319 - RNA, 19 nt, Salmonella enterica enterica serovar Typhi
ugucgcucaucaggcgugc

SEQ ID NO: 1663320 - RNA, 21 nt, Salmonella enterica enterica serovar Typhi
uguuccagauaauccagcguc

SEQ ID NO: 1663321 - RNA, 20 nt, Salmonella enterica enterica serovar Typhi
uguucagcuacuucaggcug

SEQ ID NO: 1663322 - RNA, 22 nt, Salmonella enterica enterica serovar Typhi
uguuccgaaauaaaucgauagc

SEQ ID NO: 1663323 - RNA, 12 nt, Salmonella enterica enterica serovar Typhi
uguuccagguuu

SEQ ID NO: 1663324 - RNA, 10 nt, Salmonella enterica enterica serovar Typhi
uguuccggcg

SEQ ID NO: 1663325 - RNA, 22 nt, Salmonella enterica enterica serovar Typhi
uguuggugcgcguugccaucgg

SEQ ID NO: 1663326 - RNA, 21 nt, Salmonella enterica enterica serovar Typhi
uguuuaccgcgauagaaaguc

SEQ ID NO: 1663327 - RNA, 23 nt, Salmonella enterica enterica serovar Typhi
uguuuaucugaugccugaaggcg

SEQ ID NO: 1663328 - RNA, 22 nt, Salmonella enterica enterica serovar Typhi
uuaaaaagcgcgggcuggccgg

SEQ ID NO: 1663329 - RNA, 23 nt, Salmonella enterica enterica serovar Typhi
uuaacggcccaggcaucgacgcc

SEQ ID NO: 1663330 - RNA, 19 nt, Salmonella enterica enterica serovar Typhi
uuaacgcauguuccgcuac

SEQ ID NO: 1663331 - RNA, 21 nt, Salmonella enterica enterica serovar Typhi
uuaacgcguaaucuuccaccc

SEQ ID NO: 1663332 - RNA, 18 nt, Salmonella enterica enterica serovar Typhi
uuaaaaucugguggccgg

SEQ ID NO: 1663333 - RNA, 17 nt, Salmonella enterica enterica serovar Typhi
uuaacgauaauguuggu

SEQ ID NO: 1663334 - RNA, 20 nt, Salmonella enterica enterica serovar Typhi
uguuugcgcaguugccagua

SEQ ID NO: 1663335 - RNA, 13 nt, Salmonella enterica enterica serovar Typhi
uguuuuaacggaa

SEQ ID NO: 1663336 - RNA, 22 nt, Salmonella enterica enterica serovar Typhi
uguuuguuuaacugaacuuccg

SEQ ID NO: 1663337 - RNA, 14 nt, Salmonella enterica enterica serovar Typhi
uguuuuaccuguuu

SEQ ID NO: 1663338 - RNA, 12 nt, Salmonella enterica enterica serovar Typhi
uguuucgaugua

SEQ ID NO: 1663339 - RNA, 14 nt, Salmonella enterica enterica serovar Typhi
uuaacugcugcgcu

SEQ ID NO: 1663340 - RNA, 19 nt, Salmonella enterica enterica serovar Typhi
uuaaggccgcaaacagcac

SEQ ID NO: 1663341 - RNA, 12 nt, Salmonella enterica enterica serovar Typhi
uuaagcgaaccu

SEQ ID NO: 1663342 - RNA, 21 nt, Salmonella enterica enterica serovar Typhi
uuaaugcucugcugugccagu

SEQ ID NO: 1663343 - RNA, 22 nt, Salmonella enterica enterica serovar Typhi
uuacccuucagauaucccauga

SEQ ID NO: 1663344 - RNA, 17 nt, Salmonella enterica enterica serovar Typhi
acgcggaacuggugaaa

SEQ ID NO: 1663345 - RNA, 17 nt, Salmonella enterica enterica serovar Typhi
acgcgcuuguucgucug

SEQ ID NO: 1663346 - RNA, 23 nt, Salmonella enterica enterica serovar Typhi
acgcggaaucgucacagaccccg

SEQ ID NO: 1663347 - RNA, 20 nt, Salmonella enterica enterica serovar Typhi
acgcggcgcggaagugauaa

SEQ ID NO: 1663348 - RNA, 19 nt, Salmonella enterica enterica serovar Typhi
acgcgguaaauuccgcagg

SEQ ID NO: 1663349 - RNA, 15 nt, Salmonella enterica enterica serovar Typhi
acgcgaagcggcguc

SEQ ID NO: 1663350 - RNA, 21 nt, Salmonella enterica enterica serovar Typhi
acgcgaauagccagacagccc

SEQ ID NO: 1663351 - RNA, 15 nt, Salmonella enterica enterica serovar Typhi
acgcgaauccgccau

SEQ ID NO: 1663352 - RNA, 18 nt, Salmonella enterica enterica serovar Typhi
acgcgaccagacacggug

SEQ ID NO: 1663353 - RNA, 17 nt, Salmonella enterica enterica serovar Typhi
acgcgaauagccagaca

SEQ ID NO: 1663354 - RNA, 14 nt, Salmonella enterica enterica serovar Typhi
acgcgacgcgccag

SEQ ID NO: 1663355 - RNA, 14 nt, Salmonella enterica enterica serovar Typhi
acgcgcugauaccg

SEQ ID NO: 1663356 - RNA, 14 nt, Salmonella enterica enterica serovar Typhi
acgcgcgcggcguc

SEQ ID NO: 1663357 - RNA, 17 nt, Salmonella enterica enterica serovar Typhi
acgccguagcugcgcgc

SEQ ID NO: 1663358 - RNA, 13 nt, Salmonella enterica enterica serovar Typhi
acgccguccagca

SEQ ID NO: 1663359 - RNA, 18 nt, Salmonella enterica enterica serovar Typhi
acgccguccggcgaacaa

SEQ ID NO: 1663360 - RNA, 14 nt, Salmonella enterica enterica serovar Typhi
acgccguccggcga

SEQ ID NO: 1663361 - RNA, 20 nt, Salmonella enterica enterica serovar Typhi
acgccgucgaugauggcggc

SEQ ID NO: 1663362 - RNA, 22 nt, Salmonella enterica enterica serovar Typhi
acgccgucgaugauggcggcua

SEQ ID NO: 1663363 - RNA, 14 nt, Salmonella enterica enterica serovar Typhi
acgccgucgacaaa

SEQ ID NO: 1663364 - RNA, 16 nt, Salmonella enterica enterica serovar Typhi
acgccgugacggcgua

SEQ ID NO: 1663365 - RNA, 19 nt, Salmonella enterica enterica serovar Typhi
acgccgucugguacggcca

SEQ ID NO: 1663366 - RNA, 17 nt, Salmonella enterica enterica serovar Typhi
acgcgaaaauaccccag

SEQ ID NO: 1663367 - RNA, 14 nt, Salmonella enterica enterica serovar Typhi
acgccugccagaua

SEQ ID NO: 1663368 - RNA, 16 nt, Salmonella enterica enterica serovar Typhi
acgccgggccugccag

SEQ ID NO: 1663369 - RNA, 19 nt, Salmonella enterica enterica serovar Typhi
acgccgggugaucgucgaa

SEQ ID NO: 1663370 - RNA, 21 nt, Salmonella enterica enterica serovar Typhi
acgccgggcauuaaugguuau

SEQ ID NO: 1663371 - RNA, 18 nt, Salmonella enterica enterica serovar Typhi
acgcguuucacaucgcca

SEQ ID NO: 1663372 - RNA, 17 nt, Salmonella enterica enterica serovar Typhi
acgcgucuguagcgcgc

SEQ ID NO: 1663373 - RNA, 17 nt, Salmonella enterica enterica serovar Typhi
acgcgugguaucgcgac

SEQ ID NO: 1663374 - RNA, 15 nt, Salmonella enterica enterica serovar Typhi
acgcucacccaguuu

SEQ ID NO: 1663375 - RNA, 15 nt, Salmonella enterica enterica serovar Typhi
acgcucacgcagaua

SEQ ID NO: 1663376 - RNA, 19 nt, Salmonella enterica enterica serovar Typhi
acgcuaccgucgccgacaa

SEQ ID NO: 1663377 - RNA, 18 nt, Salmonella enterica enterica serovar Typhi
acgcuaccgucgacgucu

SEQ ID NO: 1663378 - RNA, 18 nt, Salmonella enterica enterica serovar Typhi
acgcguuuuccagcacca

SEQ ID NO: 1663379 - RNA, 15 nt, Salmonella enterica enterica serovar Typhi
acggacucaggccuu

SEQ ID NO: 1663380 - RNA, 19 nt, Salmonella enterica enterica serovar Typhi
acggacgauggaaccacau

SEQ ID NO: 1663381 - RNA, 15 nt, Salmonella enterica enterica serovar Typhi
acggagauuaacagc

SEQ ID NO: 1663382 - RNA, 20 nt, Salmonella enterica enterica serovar Typhi
acggaauggcacagcgcagc

SEQ ID NO: 1663383 - RNA, 18 nt, Salmonella enterica enterica serovar Typhi
acggaaucucgcacauca

SEQ ID NO: 1663384 - RNA, 20 nt, Salmonella enterica enterica serovar Typhi
acggaagucugaccgucagc

SEQ ID NO: 1663385 - RNA, 23 nt, Salmonella enterica enterica serovar Typhi
acgcuguaacccgccgccaucaa

SEQ ID NO: 1663386 - RNA, 13 nt, Salmonella enterica enterica serovar Typhi
acgcuguaccggc

SEQ ID NO: 1663387 - RNA, 23 nt, Salmonella enterica enterica serovar Typhi
acgcuguaguuccuguagcguga

SEQ ID NO: 1663388 - RNA, 22 nt, Salmonella enterica enterica serovar Typhi
acggaaaugaucagacgcauca

SEQ ID NO: 1663389 - RNA, 22 nt, Salmonella enterica enterica serovar Typhi
acggaaaucacgcaucacuuuu

SEQ ID NO: 1663390 - RNA, 15 nt, Salmonella enterica enterica serovar Typhi
acgcuuuucagcgcc

SEQ ID NO: 1663391 - RNA, 21 nt, Salmonella enterica enterica serovar Typhi
acgcuuuuuugcuggcuggcg

SEQ ID NO: 1663392 - RNA, 14 nt, Salmonella enterica enterica serovar Typhi
acggaaaccagcau

SEQ ID NO: 1663393 - RNA, 17 nt, Salmonella enterica enterica serovar Typhi
acgcugugcgagaccau

SEQ ID NO: 1663394 - RNA, 14 nt, Salmonella enterica enterica serovar Typhi
acgcuguugccgcu

SEQ ID NO: 1663395 - RNA, 16 nt, Salmonella enterica enterica serovar Typhi
acgcugacgcgaucgc

SEQ ID NO: 1663396 - RNA, 18 nt, Salmonella enterica enterica serovar Typhi
acgcugaaaacggcauca

SEQ ID NO: 1663397 - RNA, 20 nt, Salmonella enterica enterica serovar Typhi
acgcugacaggauacccggc

SEQ ID NO: 1663398 - RNA, 19 nt, Salmonella enterica enterica serovar Typhi
acgcugcgcuuauccggcc

SEQ ID NO: 1663399 - RNA, 16 nt, Salmonella enterica enterica serovar Typhi
acgcugcacacgcugg

SEQ ID NO: 1663400 - RNA, 9 nt, Salmonella enterica enterica serovar Typhi
acgcugaug

SEQ ID NO: 1663401 - RNA, 13 nt, Salmonella enterica enterica serovar Typhi
acgcaagcagcac

SEQ ID NO: 1663402 - RNA, 19 nt, Salmonella enterica enterica serovar Typhi
acgcagaagcgcguuggcg

SEQ ID NO: 1663403 - RNA, 23 nt, Salmonella enterica enterica serovar Typhi
acgaugcuugccauauugccgca

SEQ ID NO: 1663404 - RNA, 19 nt, Salmonella enterica enterica serovar Typhi
acgcaacaggccgcaucgg

SEQ ID NO: 1663405 - RNA, 18 nt, Salmonella enterica enterica serovar Typhi
acgauaguuugccagaga

SEQ ID NO: 1663406 - RNA, 19 nt, Salmonella enterica enterica serovar Typhi
acgauauucuguuagcgcc

SEQ ID NO: 1663407 - RNA, 14 nt, Salmonella enterica enterica serovar Typhi
acgauccccgucaa

SEQ ID NO: 1663408 - RNA, 15 nt, Salmonella enterica enterica serovar Typhi
acgaucaugccgccc

SEQ ID NO: 1663409 - RNA, 22 nt, Salmonella enterica enterica serovar Typhi
acgaucccuucaauaucaagau

SEQ ID NO: 1663410 - RNA, 21 nt, Salmonella enterica enterica serovar Typhi
acgaucggcuggaauagacag

SEQ ID NO: 1663411 - RNA, 18 nt, Salmonella enterica enterica serovar Typhi
acgaugcagcaccagaua

SEQ ID NO: 1663412 - RNA, 16 nt, Salmonella enterica enterica serovar Typhi
acgccccacagaccua

SEQ ID NO: 1663413 - RNA, 22 nt, Salmonella enterica enterica serovar Typhi
acgccccccuaccggaaucgcc

SEQ ID NO: 1663414 - RNA, 22 nt, Salmonella enterica enterica serovar Typhi
acgccccgguggcgguaccggc

SEQ ID NO: 1663415 - RNA, 19 nt, Salmonella enterica enterica serovar Typhi
acgccaucgcggcgcaaau

SEQ ID NO: 1663416 - RNA, 15 nt, Salmonella enterica enterica serovar Typhi
acgccaucggcuaag

SEQ ID NO: 1663417 - RNA, 22 nt, Salmonella enterica enterica serovar Typhi
acgcagcuuaaagccaauccag

SEQ ID NO: 1663418 - RNA, 13 nt, Salmonella enterica enterica serovar Typhi
acgcaugaagcgu

SEQ ID NO: 1663419 - RNA, 22 nt, Salmonella enterica enterica serovar Typhi
acgcaugacccaggcaucagau

SEQ ID NO: 1663420 - RNA, 17 nt, Salmonella enterica enterica serovar Typhi
acgcaucguggccgaua

SEQ ID NO: 1663421 - RNA, 16 nt, Salmonella enterica enterica serovar Typhi
acgccaaaccugccac

SEQ ID NO: 1663422 - RNA, 18 nt, Salmonella enterica enterica serovar Typhi
acgcauggcguugcugca

SEQ ID NO: 1663423 - RNA, 16 nt, Salmonella enterica enterica serovar Typhi
acgccagauaaucgcc

SEQ ID NO: 1663424 - RNA, 17 nt, Salmonella enterica enterica serovar Typhi
acgaaagucuguucgua

SEQ ID NO: 1663425 - RNA, 15 nt, Salmonella enterica enterica serovar Typhi
acgaaauagcgcagc

SEQ ID NO: 1663426 - RNA, 14 nt, Salmonella enterica enterica serovar Typhi
acgaaaaaagcgcc

SEQ ID NO: 1663427 - RNA, 22 nt, Salmonella enterica enterica serovar Typhi
accuuuuugauccguuucagaa

SEQ ID NO: 1663428 - RNA, 14 nt, Salmonella enterica enterica serovar Typhi
accuuuugccgccc

SEQ ID NO: 1663429 - RNA, 13 nt, Salmonella enterica enterica serovar Typhi
accuuucugccag

SEQ ID NO: 1663430 - RNA, 18 nt, Salmonella enterica enterica serovar Typhi
acgaacgcuaugcgccag

SEQ ID NO: 1663431 - RNA, 21 nt, Salmonella enterica enterica serovar Typhi
accuguagggcacugggcgau

SEQ ID NO: 1663432 - RNA, 23 nt, Salmonella enterica enterica serovar Typhi
accuguaaccccagcaucugcau

SEQ ID NO: 1663433 - RNA, 19 nt, Salmonella enterica enterica serovar Typhi
accuucggucccaucgcgc

SEQ ID NO: 1663434 - RNA, 23 nt, Salmonella enterica enterica serovar Typhi
accguuggaauaaaucacaacgu

SEQ ID NO: 1663435 - RNA, 17 nt, Salmonella enterica enterica serovar Typhi
accguuuaaacgggcag

SEQ ID NO: 1663436 - RNA, 18 nt, Salmonella enterica enterica serovar Typhi
acgagauacgcuuaauca

SEQ ID NO: 1663437 - RNA, 19 nt, Salmonella enterica enterica serovar Typhi
acgaggccacgcagcgcag

SEQ ID NO: 1663438 - RNA, 13 nt, Salmonella enterica enterica serovar Typhi
acgagugaucccg

SEQ ID NO: 1663439 - RNA, 22 nt, Salmonella enterica enterica serovar Typhi
acgaguuucguuaccccgcagc

SEQ ID NO: 1663440 - RNA, 18 nt, Salmonella enterica enterica serovar Typhi
acgauaaccaugcucagc

SEQ ID NO: 1663441 - RNA, 15 nt, Salmonella enterica enterica serovar Typhi
acgauaaggccaaua

SEQ ID NO: 1663442 - RNA, 23 nt, Salmonella enterica enterica serovar Typhi
acgaagcgggcaauuccggucau

SEQ ID NO: 1663443 - RNA, 16 nt, Salmonella enterica enterica serovar Typhi
acgacacuuuugccga

SEQ ID NO: 1663444 - RNA, 20 nt, Salmonella enterica enterica serovar Typhi
acgacuuauugcaccauuua

SEQ ID NO: 1663445 - RNA, 19 nt, Salmonella enterica enterica serovar Typhi
acgacuuuugcaaucgcag

SEQ ID NO: 1663446 - RNA, 16 nt, Salmonella enterica enterica serovar Typhi
acgacggcgaccggca

SEQ ID NO: 1663447 - RNA, 22 nt, Salmonella enterica enterica serovar Typhi
acgguguuuagacacauugaug

SEQ ID NO: 1663448 - RNA, 17 nt, Salmonella enterica enterica serovar Typhi
acgguuaagccgguaau

SEQ ID NO: 1663449 - RNA, 22 nt, Salmonella enterica enterica serovar Typhi
acggucaggauaaaauccugca

SEQ ID NO: 1663450 - RNA, 18 nt, Salmonella enterica enterica serovar Typhi
acgggcaagguuaugcag

SEQ ID NO: 1663451 - RNA, 15 nt, Salmonella enterica enterica serovar Typhi
acgggcagagucgau

SEQ ID NO: 1663452 - RNA, 14 nt, Salmonella enterica enterica serovar Typhi
acggcuucaaucgu

SEQ ID NO: 1663453 - RNA, 20 nt, Salmonella enterica enterica serovar Typhi
acgggagagcguauccagca

SEQ ID NO: 1663454 - RNA, 12 nt, Salmonella enterica enterica serovar Typhi
acgggaucgcag

SEQ ID NO: 1663455 - RNA, 16 nt, Salmonella enterica enterica serovar Typhi
acggcuccagcgccag

SEQ ID NO: 1663456 - RNA, 18 nt, Salmonella enterica enterica serovar Typhi
acggcaacaguaccugau

SEQ ID NO: 1663457 - RNA, 19 nt, Salmonella enterica enterica serovar Typhi
acggcaaacgcuggugcug

SEQ ID NO: 1663458 - RNA, 13 nt, Salmonella enterica enterica serovar Typhi
acggcuaccugca

SEQ ID NO: 1663459 - RNA, 21 nt, Salmonella enterica enterica serovar Typhi
acguuaucugaccuacaggcc

SEQ ID NO: 1663460 - RNA, 19 nt, Salmonella enterica enterica serovar Typhi
acguuaucgcgcacgcgcc

SEQ ID NO: 1663461 - RNA, 19 nt, Salmonella enterica enterica serovar Typhi
acguuaaagccgaccaucg

SEQ ID NO: 1663462 - RNA, 21 nt, Salmonella enterica enterica serovar Typhi
acguuacgcggcgcgccguaa

SEQ ID NO: 1663463 - RNA, 16 nt, Salmonella enterica enterica serovar Typhi
acgugcaauaucgcgg

SEQ ID NO: 1663464 - RNA, 20 nt, Salmonella enterica enterica serovar Typhi
acuaccaucggcgcuacggc

SEQ ID NO: 1663465 - RNA, 16 nt, Salmonella enterica enterica serovar Typhi
acuacccagaucgccc

SEQ ID NO: 1663466 - RNA, 12 nt, Salmonella enterica enterica serovar Typhi
acuaccgccauc

SEQ ID NO: 1663467 - RNA, 18 nt, Salmonella enterica enterica serovar Typhi
acuaucaugaaugcccca

SEQ ID NO: 1663468 - RNA, 16 nt, Salmonella enterica enterica serovar Typhi
acuacgcggcuacaga

SEQ ID NO: 1663469 - RNA, 16 nt, Salmonella enterica enterica serovar Typhi
acuauggucugaaaga

SEQ ID NO: 1663470 - RNA, 22 nt, Salmonella enterica enterica serovar Typhi
acguugcggcgcguucagcauc

SEQ ID NO: 1663471 - RNA, 15 nt, Salmonella enterica enterica serovar Typhi
acuaagaccagcauc

SEQ ID NO: 1663472 - RNA, 17 nt, Salmonella enterica enterica serovar Typhi
acguugaucgccaucgc

SEQ ID NO: 1663473 - RNA, 23 nt, Salmonella enterica enterica serovar Typhi
acgucaagaucgcgcagcaggcc

SEQ ID NO: 1663474 - RNA, 21 nt, Salmonella enterica enterica serovar Typhi
acgucaaaccccucccggguc

SEQ ID NO: 1663475 - RNA, 19 nt, Salmonella enterica enterica serovar Typhi
acgucagacgaggguaaua

SEQ ID NO: 1663476 - RNA, 13 nt, Salmonella enterica enterica serovar Typhi
acguccgccaaca

SEQ ID NO: 1663477 - RNA, 23 nt, Salmonella enterica enterica serovar Typhi
acgucagcaucuccuggcgcagc

SEQ ID NO: 1663478 - RNA, 18 nt, Salmonella enterica enterica serovar Typhi
acguacccgcucggcaua

SEQ ID NO: 1663479 - RNA, 17 nt, Salmonella enterica enterica serovar Typhi
acgguuuucacuggcau

SEQ ID NO: 1663480 - RNA, 15 nt, Salmonella enterica enterica serovar Typhi
acguaaccggcguuc

SEQ ID NO: 1663481 - RNA, 20 nt, Salmonella enterica enterica serovar Typhi
acgucgcguacaccuuaucu

SEQ ID NO: 1663482 - RNA, 20 nt, Salmonella enterica enterica serovar Typhi
acgucuggaaacccgcucgc

SEQ ID NO: 1663483 - RNA, 14 nt, Salmonella enterica enterica serovar Typhi
acgugacgcgccag

SEQ ID NO: 1663484 - RNA, 14 nt, Salmonella enterica enterica serovar Typhi
acgugacguaucgc

SEQ ID NO: 1663485 - RNA, 15 nt, Salmonella enterica enterica serovar Typhi
acuggcauaccggug

SEQ ID NO: 1663486 - RNA, 17 nt, Salmonella enterica enterica serovar Typhi
acuggcagcgccugacg

SEQ ID NO: 1663487 - RNA, 14 nt, Salmonella enterica enterica serovar Typhi
acuggagaccggcg

SEQ ID NO: 1663488 - RNA, 16 nt, Salmonella enterica enterica serovar Typhi
acuggaucgguugcag

SEQ ID NO: 1663489 - RNA, 14 nt, Salmonella enterica enterica serovar Typhi
acugcguagaucau

SEQ ID NO: 1663490 - RNA, 16 nt, Salmonella enterica enterica serovar Typhi
acugcggcuuacccug

SEQ ID NO: 1663491 - RNA, 13 nt, Salmonella enterica enterica serovar Typhi
acuguaaccggcg

SEQ ID NO: 1663492 - RNA, 18 nt, Salmonella enterica enterica serovar Typhi
acuggccucccaguuccc

SEQ ID NO: 1663493 - RNA, 12 nt, Salmonella enterica enterica serovar Typhi
acucugcgcgua

SEQ ID NO: 1663494 - RNA, 17 nt, Salmonella enterica enterica serovar Typhi
acugauaccccagcgau

SEQ ID NO: 1663495 - RNA, 17 nt, Salmonella enterica enterica serovar Typhi
acucuuccaccauccgc

SEQ ID NO: 1663496 - RNA, 16 nt, Salmonella enterica enterica serovar Typhi
acucaagcgaauccag

SEQ ID NO: 1663497 - RNA, 22 nt, Salmonella enterica enterica serovar Typhi
acuauuuuuuaugugacaauca

SEQ ID NO: 1663498 - RNA, 16 nt, Salmonella enterica enterica serovar Typhi
acucagcuaaaaacag

SEQ ID NO: 1663499 - RNA, 14 nt, Salmonella enterica enterica serovar Typhi
acucaggcgcaucu

SEQ ID NO: 1663500 - RNA, 20 nt, Salmonella enterica enterica serovar Typhi
acucagcacauucagagcgu

SEQ ID NO: 1663501 - RNA, 15 nt, Salmonella enterica enterica serovar Typhi
acucagcggcccaau

SEQ ID NO: 1663502 - RNA, 14 nt, Salmonella enterica enterica serovar Typhi
acuuacgacgcgcc

SEQ ID NO: 1663503 - RNA, 17 nt, Salmonella enterica enterica serovar Typhi
acuuagcccuggccaau

SEQ ID NO: 1663504 - RNA, 22 nt, Salmonella enterica enterica serovar Typhi
acuuauugcaccauuuacagga

SEQ ID NO: 1663505 - RNA, 18 nt, Salmonella enterica enterica serovar Typhi
acuucaauuuuccagaua

SEQ ID NO: 1663506 - RNA, 20 nt, Salmonella enterica enterica serovar Typhi
acuucacaaucagcgcaaua

SEQ ID NO: 1663507 - RNA, 21 nt, Salmonella enterica enterica serovar Typhi
acugugguuaugguugccgca

SEQ ID NO: 1663508 - RNA, 16 nt, Salmonella enterica enterica serovar Typhi
acuguucacgcagcgc

SEQ ID NO: 1663509 - RNA, 13 nt, Salmonella enterica enterica serovar Typhi
acuguucagccag

SEQ ID NO: 1663510 - RNA, 18 nt, Salmonella enterica enterica serovar Typhi
acuguuguucuucauaca

SEQ ID NO: 1663511 - RNA, 21 nt, Salmonella enterica enterica serovar Typhi
acuucauacgaauggguaaua

SEQ ID NO: 1663512 - RNA, 20 nt, Salmonella enterica enterica serovar Typhi
acuuguucaauauuccuggc

SEQ ID NO: 1663513 - RNA, 22 nt, Salmonella enterica enterica serovar Typhi
acuugaucgugccguccggcau

SEQ ID NO: 1663514 - RNA, 14 nt, Salmonella enterica enterica serovar Typhi
acuuuugccgucag

SEQ ID NO: 1663515 - RNA, 20 nt, Salmonella enterica enterica serovar Typhi
acuuugcgcuccugcuccca

SEQ ID NO: 1663516 - RNA, 15 nt, Salmonella enterica enterica serovar Typhi
acuuuguugaucuca

SEQ ID NO: 1663517 - RNA, 14 nt, Salmonella enterica enterica serovar Typhi
acuuuuacccuuca

SEQ ID NO: 1663518 - RNA, 14 nt, Salmonella enterica enterica serovar Typhi
acuuuaccgccguu

SEQ ID NO: 1663519 - RNA, 19 nt, Salmonella enterica enterica serovar Typhi
accgggcagacaugaccgc

SEQ ID NO: 1663520 - RNA, 19 nt, Salmonella enterica enterica serovar Typhi
accggugcgauucagcgca

SEQ ID NO: 1663521 - RNA, 18 nt, Salmonella enterica enterica serovar Typhi
accgucaauaacgggcac

SEQ ID NO: 1663522 - RNA, 13 nt, Salmonella enterica enterica serovar Typhi
accgucaugacgu

SEQ ID NO: 1663523 - RNA, 16 nt, Salmonella enterica enterica serovar Typhi
accgucaguaccagcg

SEQ ID NO: 1663524 - RNA, 22 nt, Salmonella enterica enterica serovar Typhi
accguaaucaucgcgaucgcca

SEQ ID NO: 1663525 - RNA, 15 nt, Salmonella enterica enterica serovar Typhi
accgguuugucauuc

SEQ ID NO: 1663526 - RNA, 13 nt, Salmonella enterica enterica serovar Typhi
accguucacggcg

SEQ ID NO: 1663527 - RNA, 19 nt, Salmonella enterica enterica serovar Typhi
accggcgcgaacggcgggu

SEQ ID NO: 1663528 - RNA, 15 nt, Salmonella enterica enterica serovar Typhi
accggcgccagcucu

SEQ ID NO: 1663529 - RNA, 23 nt, Salmonella enterica enterica serovar Typhi
accggcuguucacguaccaggca

SEQ ID NO: 1663530 - RNA, 17 nt, Salmonella enterica enterica serovar Typhi
accggcagggccaguuc

SEQ ID NO: 1663531 - RNA, 17 nt, Salmonella enterica enterica serovar Typhi
accggacggucggcgua

SEQ ID NO: 1663532 - RNA, 20 nt, Salmonella enterica enterica serovar Typhi
accggccacaauugccagca

SEQ ID NO: 1663533 - RNA, 23 nt, Salmonella enterica enterica serovar Typhi
accggcauuucaccgucaauaac

SEQ ID NO: 1663534 - RNA, 23 nt, Salmonella enterica enterica serovar Typhi
accggcccgggcacgauggccug

SEQ ID NO: 1663535 - RNA, 20 nt, Salmonella enterica enterica serovar Typhi
accggaccuaauagccagcc

SEQ ID NO: 1663536 - RNA, 19 nt, Salmonella enterica enterica serovar Typhi
accgccauccggcgauguc

SEQ ID NO: 1663537 - RNA, 16 nt, Salmonella enterica enterica serovar Typhi
accgcccaacauaacg

SEQ ID NO: 1663538 - RNA, 23 nt, Salmonella enterica enterica serovar Typhi
accgacuaaggggguacgcguaa

SEQ ID NO: 1663539 - RNA, 18 nt, Salmonella enterica enterica serovar Typhi
accgaagaacauaaacag

SEQ ID NO: 1663540 - RNA, 20 nt, Salmonella enterica enterica serovar Typhi
accgagcgcaugguagaagu

SEQ ID NO: 1663541 - RNA, 20 nt, Salmonella enterica enterica serovar Typhi
accgauagagacugccgccg

SEQ ID NO: 1663542 - RNA, 16 nt, Salmonella enterica enterica serovar Typhi
accgaugcccagcuug

SEQ ID NO: 1663543 - RNA, 21 nt, Salmonella enterica enterica serovar Typhi
acccgauagcgccgcgcuauc

SEQ ID NO: 1663544 - RNA, 15 nt, Salmonella enterica enterica serovar Typhi
acccgauaccgccag

SEQ ID NO: 1663545 - RNA, 19 nt, Salmonella enterica enterica serovar Typhi
acccgcucgcccgccgcaa

SEQ ID NO: 1663546 - RNA, 17 nt, Salmonella enterica enterica serovar Typhi
acccgcgcucuccggca

SEQ ID NO: 1663547 - RNA, 15 nt, Salmonella enterica enterica serovar Typhi
acccgcagccggaua

SEQ ID NO: 1663548 - RNA, 15 nt, Salmonella enterica enterica serovar Typhi
acccuucauacugcg

SEQ ID NO: 1663549 - RNA, 20 nt, Salmonella enterica enterica serovar Typhi
acccuguaggccugauaagc

SEQ ID NO: 1663550 - RNA, 19 nt, Salmonella enterica enterica serovar Typhi
acccuauugccacaauauc

SEQ ID NO: 1663551 - RNA, 22 nt, Salmonella enterica enterica serovar Typhi
acccggcugccauuaucaccau

SEQ ID NO: 1663552 - RNA, 22 nt, Salmonella enterica enterica serovar Typhi
acccgcuuacaauuuaucugcg

SEQ ID NO: 1663553 - RNA, 14 nt, Salmonella enterica enterica serovar Typhi
acaucagaaaacag

SEQ ID NO: 1663554 - RNA, 16 nt, Salmonella enterica enterica serovar Typhi
acaucacguucgcgca

SEQ ID NO: 1663555 - RNA, 16 nt, Salmonella enterica enterica serovar Typhi
acaucagagguaauua

SEQ ID NO: 1663556 - RNA, 15 nt, Salmonella enterica enterica serovar Typhi
acaucaucaggccug

SEQ ID NO: 1663557 - RNA, 15 nt, Salmonella enterica enterica serovar Typhi
acaucacguucgcgc

SEQ ID NO: 1663558 - RNA, 14 nt, Salmonella enterica enterica serovar Typhi
acaucaauaaacau

SEQ ID NO: 1663559 - RNA, 16 nt, Salmonella enterica enterica serovar Typhi
acauauuuuucacaca

SEQ ID NO: 1663560 - RNA, 14 nt, Salmonella enterica enterica serovar Typhi
acaguaccuuuacc

SEQ ID NO: 1663561 - RNA, 14 nt, Salmonella enterica enterica serovar Typhi
acaggugcgcugug

SEQ ID NO: 1663562 - RNA, 21 nt, Salmonella enterica enterica serovar Typhi
acauccagcuguuuaagcgcc

SEQ ID NO: 1663563 - RNA, 15 nt, Salmonella enterica enterica serovar Typhi
acaucgcuggcgcgc

SEQ ID NO: 1663564 - RNA, 12 nt, Salmonella enterica enterica serovar Typhi
acaucgcugaua

SEQ ID NO: 1663565 - RNA, 15 nt, Salmonella enterica enterica serovar Typhi
acaucgcucccggca

SEQ ID NO: 1663566 - RNA, 16 nt, Salmonella enterica enterica serovar Typhi
acaucgcucccggcac

SEQ ID NO: 1663567 - RNA, 11 nt, Salmonella enterica enterica serovar Typhi
acaucgccauu

SEQ ID NO: 1663568 - RNA, 11 nt, Salmonella enterica enterica serovar Typhi
acaugccgcca

SEQ ID NO: 1663569 - RNA, 17 nt, Salmonella enterica enterica serovar Typhi
acaugguguuugcggca

SEQ ID NO: 1663570 - RNA, 17 nt, Salmonella enterica enterica serovar Typhi
acaggcggaugaaacag

SEQ ID NO: 1663571 - RNA, 16 nt, Salmonella enterica enterica serovar Typhi
acaggccuuccggcgu

SEQ ID NO: 1663572 - RNA, 14 nt, Salmonella enterica enterica serovar Typhi
acaggcgcaucaga

SEQ ID NO: 1663573 - RNA, 18 nt, Salmonella enterica enterica serovar Typhi
acaggccguucauucgcc

SEQ ID NO: 1663574 - RNA, 15 nt, Salmonella enterica enterica serovar Typhi
acaggcacaacaaua

SEQ ID NO: 1663575 - RNA, 14 nt, Salmonella enterica enterica serovar Typhi
acagcucauaaacg

SEQ ID NO: 1663576 - RNA, 21 nt, Salmonella enterica enterica serovar Typhi
acagcuuaaucaccagcgcau

SEQ ID NO: 1663577 - RNA, 23 nt, Salmonella enterica enterica serovar Typhi
acagcuucaggcucaucagcgcc

SEQ ID NO: 1663578 - RNA, 17 nt, Salmonella enterica enterica serovar Typhi
acagcaaaacgcgcuau

SEQ ID NO: 1663579 - RNA, 18 nt, Salmonella enterica enterica serovar Typhi
acagcaaaacgcgcuauc

SEQ ID NO: 1663580 - RNA, 15 nt, Salmonella enterica enterica serovar Typhi
acagagaaugcgccg

SEQ ID NO: 1663581 - RNA, 16 nt, Salmonella enterica enterica serovar Typhi
acagauacggcgcguc

SEQ ID NO: 1663582 - RNA, 16 nt, Salmonella enterica enterica serovar Typhi
acacggugugccgcca

SEQ ID NO: 1663583 - RNA, 17 nt, Salmonella enterica enterica serovar Typhi
acacggugugccgccau

SEQ ID NO: 1663584 - RNA, 18 nt, Salmonella enterica enterica serovar Typhi
acacauaucgccagccau

SEQ ID NO: 1663585 - RNA, 15 nt, Salmonella enterica enterica serovar Typhi
acaccacgcaggcga

SEQ ID NO: 1663586 - RNA, 13 nt, Salmonella enterica enterica serovar Typhi
aauuuugcauaaa

SEQ ID NO: 1663587 - RNA, 13 nt, Salmonella enterica enterica serovar Typhi
aauuucugcugcc

SEQ ID NO: 1663588 - RNA, 20 nt, Salmonella enterica enterica serovar Typhi
acaccgggagaaaacgcggc

SEQ ID NO: 1663589 - RNA, 18 nt, Salmonella enterica enterica serovar Typhi
acaccggcgccagcucug

SEQ ID NO: 1663590 - RNA, 17 nt, Salmonella enterica enterica serovar Typhi
acaccagucgaccgcag

SEQ ID NO: 1663591 - RNA, 16 nt, Salmonella enterica enterica serovar Typhi
acaccacgccggaauc

SEQ ID NO: 1663592 - RNA, 13 nt, Salmonella enterica enterica serovar Typhi
accaggcggcguu

SEQ ID NO: 1663593 - RNA, 16 nt, Salmonella enterica enterica serovar Typhi
accagcgcuauccagg

SEQ ID NO: 1663594 - RNA, 17 nt, Salmonella enterica enterica serovar Typhi
accagcgcuauccaggc

SEQ ID NO: 1663595 - RNA, 16 nt, Salmonella enterica enterica serovar Typhi
accagcgcggcgccag

SEQ ID NO: 1663596 - RNA, 18 nt, Salmonella enterica enterica serovar Typhi
accagcgcgccauccuga

SEQ ID NO: 1663597 - RNA, 20 nt, Salmonella enterica enterica serovar Typhi
accagcgcgccgccaacgcc

SEQ ID NO: 1663598 - RNA, 13 nt, Salmonella enterica enterica serovar Typhi
accagcgcggcac

SEQ ID NO: 1663599 - RNA, 20 nt, Salmonella enterica enterica serovar Typhi
accaggcggcuuuuucauca

SEQ ID NO: 1663600 - RNA, 18 nt, Salmonella enterica enterica serovar Typhi
accaggguucgcuggcca

SEQ ID NO: 1663601 - RNA, 17 nt, Salmonella enterica enterica serovar Typhi
accaucguugccagcgg

SEQ ID NO: 1663602 - RNA, 14 nt, Salmonella enterica enterica serovar Typhi
accaugauaaccag

SEQ ID NO: 1663603 - RNA, 21 nt, Salmonella enterica enterica serovar Typhi
accaucuggccuacgcgcuca

SEQ ID NO: 1663604 - RNA, 14 nt, Salmonella enterica enterica serovar Typhi
accaucggcgcgua

SEQ ID NO: 1663605 - RNA, 17 nt, Salmonella enterica enterica serovar Typhi
accauugcguauuucac

SEQ ID NO: 1663606 - RNA, 16 nt, Salmonella enterica enterica serovar Typhi
accauugauuuccgcg

SEQ ID NO: 1663607 - RNA, 15 nt, Salmonella enterica enterica serovar Typhi
accauuggcgcguca

SEQ ID NO: 1663608 - RNA, 23 nt, Salmonella enterica enterica serovar Typhi
accauuggcgcgucaucaauauc

SEQ ID NO: 1663609 - RNA, 13 nt, Salmonella enterica enterica serovar Typhi
accauguugcgca

SEQ ID NO: 1663610 - RNA, 20 nt, Salmonella enterica enterica serovar Typhi
accaguggcggggcagaacc

SEQ ID NO: 1663611 - RNA, 21 nt, Salmonella enterica enterica serovar Typhi
accaguuguuccgcgcugaug

SEQ ID NO: 1663612 - RNA, 14 nt, Salmonella enterica enterica serovar Typhi
accauaauuaccgg

SEQ ID NO: 1663613 - RNA, 13 nt, Salmonella enterica enterica serovar Typhi
accauaugcggca

SEQ ID NO: 1663614 - RNA, 18 nt, Salmonella enterica enterica serovar Typhi
accaucaauguugucgca

SEQ ID NO: 1663615 - RNA, 14 nt, Salmonella enterica enterica serovar Typhi
accaauggcgcguc

SEQ ID NO: 1663616 - RNA, 18 nt, Salmonella enterica enterica serovar Typhi
accacaaagcgguaaauc

SEQ ID NO: 1663617 - RNA, 18 nt, Salmonella enterica enterica serovar Typhi
accaauguuaauaagcag

SEQ ID NO: 1663618 - RNA, 14 nt, Salmonella enterica enterica serovar Typhi
acauguucagcgca

SEQ ID NO: 1663619 - RNA, 22 nt, Salmonella enterica enterica serovar Typhi
acauuacccauaucgcggguaa

SEQ ID NO: 1663620 - RNA, 16 nt, Salmonella enterica enterica serovar Typhi
accacaaaggcgcgua

SEQ ID NO: 1663621 - RNA, 21 nt, Salmonella enterica enterica serovar Typhi
accaccgcgcuagugccgcca

SEQ ID NO: 1663622 - RNA, 13 nt, Salmonella enterica enterica serovar Typhi
accacgaaucagg

SEQ ID NO: 1663623 - RNA, 13 nt, Salmonella enterica enterica serovar Typhi
accacgcagccau

SEQ ID NO: 1663624 - RNA, 16 nt, Salmonella enterica enterica serovar Typhi
accacgcccaacgacc

SEQ ID NO: 1663625 - RNA, 16 nt, Salmonella enterica enterica serovar Typhi
accacggauaagccag

SEQ ID NO: 1663626 - RNA, 20 nt, Salmonella enterica enterica serovar Typhi
accacguaacgggauucgcc

SEQ ID NO: 1663627 - RNA, 18 nt, Salmonella enterica enterica serovar Typhi
accagcgccauaauccag

SEQ ID NO: 1663628 - RNA, 17 nt, Salmonella enterica enterica serovar Typhi
accagcgagauaaccgg

SEQ ID NO: 1663629 - RNA, 15 nt, Salmonella enterica enterica serovar Typhi
accagcgaugcgcgc

SEQ ID NO: 1663630 - RNA, 22 nt, Salmonella enterica enterica serovar Typhi
accagcgaugcgcgcgcguuau

SEQ ID NO: 1663631 - RNA, 12 nt, Salmonella enterica enterica serovar Typhi
accagcauaaug

SEQ ID NO: 1663632 - RNA, 15 nt, Salmonella enterica enterica serovar Typhi
accagccacugcgcc

SEQ ID NO: 1663633 - RNA, 19 nt, Salmonella enterica enterica serovar Typhi
accagccccacgguacgac

SEQ ID NO: 1663634 - RNA, 14 nt, Salmonella enterica enterica serovar Typhi
caccgacagcaccg

SEQ ID NO: 1663635 - RNA, 16 nt, Salmonella enterica enterica serovar Typhi
caccgaaacagcacgc

SEQ ID NO: 1663636 - RNA, 14 nt, Salmonella enterica enterica serovar Typhi
cacccacugcacau

SEQ ID NO: 1663637 - RNA, 15 nt, Salmonella enterica enterica serovar Typhi
cacccgcgccagcag

SEQ ID NO: 1663638 - RNA, 22 nt, Salmonella enterica enterica serovar Typhi
cacacucggugcauuugucgcu

SEQ ID NO: 1663639 - RNA, 16 nt, Salmonella enterica enterica serovar Typhi
caccagcgucgcaugg

SEQ ID NO: 1663640 - RNA, 15 nt, Salmonella enterica enterica serovar Typhi
caccagcgcggcaca

SEQ ID NO: 1663641 - RNA, 18 nt, Salmonella enterica enterica serovar Typhi
caccagcgccugcgcugc

SEQ ID NO: 1663642 - RNA, 20 nt, Salmonella enterica enterica serovar Typhi
caccagcgcauugacgauau

SEQ ID NO: 1663643 - RNA, 11 nt, Salmonella enterica enterica serovar Typhi
caccagcgcca

SEQ ID NO: 1663644 - RNA, 13 nt, Salmonella enterica enterica serovar Typhi
caccagcaucacg

SEQ ID NO: 1663645 - RNA, 24 nt, Salmonella enterica enterica serovar Typhi
caccagccccaaaauucacgcuuc

SEQ ID NO: 1663646 - RNA, 21 nt, Salmonella enterica enterica serovar Typhi
caccagcgauuuuuacgccau

SEQ ID NO: 1663647 - RNA, 24 nt, Salmonella enterica enterica serovar Typhi
caccagcgauuacgccagacagca

SEQ ID NO: 1663648 - RNA, 12 nt, Salmonella enterica enterica serovar Typhi
caccggaauuug

SEQ ID NO: 1663649 - RNA, 14 nt, Salmonella enterica enterica serovar Typhi
caccggaccgccga

SEQ ID NO: 1663650 - RNA, 19 nt, Salmonella enterica enterica serovar Typhi
caccgcuuuggcgcccauu

SEQ ID NO: 1663651 - RNA, 20 nt, Salmonella enterica enterica serovar Typhi
caccgcuacaauccaggacg

SEQ ID NO: 1663652 - RNA, 18 nt, Salmonella enterica enterica serovar Typhi
caccggcacauccagcug

SEQ ID NO: 1663653 - RNA, 20 nt, Salmonella enterica enterica serovar Typhi
caccggcccccggccauagc

SEQ ID NO: 1663654 - RNA, 17 nt, Salmonella enterica enterica serovar Typhi
caccggccauugccgcg

SEQ ID NO: 1663655 - RNA, 11 nt, Salmonella enterica enterica serovar Typhi
caccgauaaac

SEQ ID NO: 1663656 - RNA, 18 nt, Salmonella enterica enterica serovar Typhi
caccgccuaggccagugc

SEQ ID NO: 1663657 - RNA, 21 nt, Salmonella enterica enterica serovar Typhi
caccguuuuuuuaugcagccg

SEQ ID NO: 1663658 - RNA, 14 nt, Salmonella enterica enterica serovar Typhi
caccguuuuccagg

SEQ ID NO: 1663659 - RNA, 19 nt, Salmonella enterica enterica serovar Typhi
caccguuuaaaaacaucau

SEQ ID NO: 1663660 - RNA, 23 nt, Salmonella enterica enterica serovar Typhi
caccguuacaaauagcggcacag

SEQ ID NO: 1663661 - RNA, 19 nt, Salmonella enterica enterica serovar Typhi
caccguggugaccgccaga

SEQ ID NO: 1663662 - RNA, 18 nt, Salmonella enterica enterica serovar Typhi
caccgucaacaucauccc

SEQ ID NO: 1663663 - RNA, 21 nt, Salmonella enterica enterica serovar Typhi
caccgucacugaaccugccuu

SEQ ID NO: 1663664 - RNA, 17 nt, Salmonella enterica enterica serovar Typhi
caccguauccggccugc

SEQ ID NO: 1663665 - RNA, 18 nt, Salmonella enterica enterica serovar Typhi
caccgggagaaaacgcgg

SEQ ID NO: 1663666 - RNA, 23 nt, Salmonella enterica enterica serovar Typhi
caauuuccccugcgaacagcgcu

SEQ ID NO: 1663667 - RNA, 17 nt, Salmonella enterica enterica serovar Typhi
caauuguagcugcgcca

SEQ ID NO: 1663668 - RNA, 16 nt, Salmonella enterica enterica serovar Typhi
cacaaucccgccagac

SEQ ID NO: 1663669 - RNA, 13 nt, Salmonella enterica enterica serovar Typhi
cacaauagcgcua

SEQ ID NO: 1663670 - RNA, 17 nt, Salmonella enterica enterica serovar Typhi
cacaaugguggucgcca

SEQ ID NO: 1663671 - RNA, 14 nt, Salmonella enterica enterica serovar Typhi
caaucgagaagcca

SEQ ID NO: 1663672 - RNA, 19 nt, Salmonella enterica enterica serovar Typhi
caauccauuaauggcgcaa

SEQ ID NO: 1663673 - RNA, 23 nt, Salmonella enterica enterica serovar Typhi
caaucccggagagagcaacuggc

SEQ ID NO: 1663674 - RNA, 19 nt, Salmonella enterica enterica serovar Typhi
caaucaccugcaucacgcc

SEQ ID NO: 1663675 - RNA, 21 nt, Salmonella enterica enterica serovar Typhi
caaucacguuuugcagcgcca

SEQ ID NO: 1663676 - RNA, 15 nt, Salmonella enterica enterica serovar Typhi
caaucacguuauagc

SEQ ID NO: 1663677 - RNA, 12 nt, Salmonella enterica enterica serovar Typhi
caaucagauucg

SEQ ID NO: 1663678 - RNA, 15 nt, Salmonella enterica enterica serovar Typhi
caaucagcccaugcc

SEQ ID NO: 1663679 - RNA, 18 nt, Salmonella enterica enterica serovar Typhi
caaucauaaacgccugac

SEQ ID NO: 1663680 - RNA, 13 nt, Salmonella enterica enterica serovar Typhi
caaucauccugau

SEQ ID NO: 1663681 - RNA, 23 nt, Salmonella enterica enterica serovar Typhi
caaucucuuccgcccagauauca

SEQ ID NO: 1663682 - RNA, 21 nt, Salmonella enterica enterica serovar Typhi
caaucugcgucaguaccugau

SEQ ID NO: 1663683 - RNA, 19 nt, Salmonella enterica enterica serovar Typhi
caaugccaccagcgccaua

SEQ ID NO: 1663684 - RNA, 18 nt, Salmonella enterica enterica serovar Typhi
caaugccggacgccacca

SEQ ID NO: 1663685 - RNA, 18 nt, Salmonella enterica enterica serovar Typhi
caaucgucguuccgccag

SEQ ID NO: 1663686 - RNA, 22 nt, Salmonella enterica enterica serovar Typhi
caaucguuaauucauggccauc

SEQ ID NO: 1663687 - RNA, 12 nt, Salmonella enterica enterica serovar Typhi
caaucgucuuca

SEQ ID NO: 1663688 - RNA, 13 nt, Salmonella enterica enterica serovar Typhi
caaucucgccaau

SEQ ID NO: 1663689 - RNA, 13 nt, Salmonella enterica enterica serovar Typhi
caaucgcgguaug

SEQ ID NO: 1663690 - RNA, 14 nt, Salmonella enterica enterica serovar Typhi
caauaaacagcucc

SEQ ID NO: 1663691 - RNA, 19 nt, Salmonella enterica enterica serovar Typhi
caauaacgcauucaccuuc

SEQ ID NO: 1663692 - RNA, 14 nt, Salmonella enterica enterica serovar Typhi
caauaaccgccagc

SEQ ID NO: 1663693 - RNA, 22 nt, Salmonella enterica enterica serovar Typhi
caauaccacgcccgccgccagc

SEQ ID NO: 1663694 - RNA, 14 nt, Salmonella enterica enterica serovar Typhi
caauaccagggcga

SEQ ID NO: 1663695 - RNA, 18 nt, Salmonella enterica enterica serovar Typhi
caauaaugccgccgucgc

SEQ ID NO: 1663696 - RNA, 14 nt, Salmonella enterica enterica serovar Typhi
caauaauggcgcga

SEQ ID NO: 1663697 - RNA, 23 nt, Salmonella enterica enterica serovar Typhi
caauacgcgucagccuaccgcuu

SEQ ID NO: 1663698 - RNA, 20 nt, Salmonella enterica enterica serovar Typhi
caauacuuaaaccugcgccg

SEQ ID NO: 1663699 - RNA, 22 nt, Salmonella enterica enterica serovar Typhi
caauagaccugaaaucagccug

SEQ ID NO: 1663700 - RNA, 20 nt, Salmonella enterica enterica serovar Typhi
caauagaccugaaaucagcc

SEQ ID NO: 1663701 - RNA, 15 nt, Salmonella enterica enterica serovar Typhi
caauagaccagcggc

SEQ ID NO: 1663702 - RNA, 14 nt, Salmonella enterica enterica serovar Typhi
caauacccagcgcc

SEQ ID NO: 1663703 - RNA, 16 nt, Salmonella enterica enterica serovar Typhi
caaggcucaauacgca

SEQ ID NO: 1663704 - RNA, 20 nt, Salmonella enterica enterica serovar Typhi
caagcucauguaaaggcgug

SEQ ID NO: 1663705 - RNA, 14 nt, Salmonella enterica enterica serovar Typhi
caagcgcggcagca

SEQ ID NO: 1663706 - RNA, 18 nt, Salmonella enterica enterica serovar Typhi
caagcugcaucccgguca

SEQ ID NO: 1663707 - RNA, 22 nt, Salmonella enterica enterica serovar Typhi
caagcugguuaaugaccugccg

SEQ ID NO: 1663708 - RNA, 20 nt, Salmonella enterica enterica serovar Typhi
caacguugaaaacggcguuu

SEQ ID NO: 1663709 - RNA, 13 nt, Salmonella enterica enterica serovar Typhi
caacgugcagaug

SEQ ID NO: 1663710 - RNA, 18 nt, Salmonella enterica enterica serovar Typhi
caacguccaguucguucu

SEQ ID NO: 1663711 - RNA, 15 nt, Salmonella enterica enterica serovar Typhi
caacgucaucaugaa

SEQ ID NO: 1663712 - RNA, 14 nt, Salmonella enterica enterica serovar Typhi
caacgucgccaucc

SEQ ID NO: 1663713 - RNA, 17 nt, Salmonella enterica enterica serovar Typhi
caacguccugcggcuuu

SEQ ID NO: 1663714 - RNA, 20 nt, Salmonella enterica enterica serovar Typhi
caacgcuucuggcguaaugc

SEQ ID NO: 1663715 - RNA, 21 nt, Salmonella enterica enterica serovar Typhi
caacgacgucuuucuucgcug

SEQ ID NO: 1663716 - RNA, 17 nt, Salmonella enterica enterica serovar Typhi
caaccugcgcugacggc

SEQ ID NO: 1663717 - RNA, 14 nt, Salmonella enterica enterica serovar Typhi
caaccugcccuuuc

SEQ ID NO: 1663718 - RNA, 15 nt, Salmonella enterica enterica serovar Typhi
caaccugcgaaaagc

SEQ ID NO: 1663719 - RNA, 21 nt, Salmonella enterica enterica serovar Typhi
caaccugccguuuuccagccg

SEQ ID NO: 1663720 - RNA, 14 nt, Salmonella enterica enterica serovar Typhi
caaccgcgcggcgu

SEQ ID NO: 1663721 - RNA, 15 nt, Salmonella enterica enterica serovar Typhi
caacaugcugaccga

SEQ ID NO: 1663722 - RNA, 16 nt, Salmonella enterica enterica serovar Typhi
caacauugccggcauc

SEQ ID NO: 1663723 - RNA, 15 nt, Salmonella enterica enterica serovar Typhi
caacaugaccagcgc

SEQ ID NO: 1663724 - RNA, 21 nt, Salmonella enterica enterica serovar Typhi
caaccccugacgggcgauggc

SEQ ID NO: 1663725 - RNA, 15 nt, Salmonella enterica enterica serovar Typhi
caacaaugcuuucac

SEQ ID NO: 1663726 - RNA, 17 nt, Salmonella enterica enterica serovar Typhi
caacaaaguauaaagcu

SEQ ID NO: 1663727 - RNA, 15 nt, Salmonella enterica enterica serovar Typhi
caacaaauuccggca

SEQ ID NO: 1663728 - RNA, 15 nt, Salmonella enterica enterica serovar Typhi
caaauuugugcuggu

SEQ ID NO: 1663729 - RNA, 20 nt, Salmonella enterica enterica serovar Typhi
caaaucggcgccggcgcguu

SEQ ID NO: 1663730 - RNA, 21 nt, Salmonella enterica enterica serovar Typhi
caaaucugccgucaucgacuu

SEQ ID NO: 1663731 - RNA, 14 nt, Salmonella enterica enterica serovar Typhi
caaaugcccagcuc

SEQ ID NO: 1663732 - RNA, 14 nt, Salmonella enterica enterica serovar Typhi
caaaugaccagauc

SEQ ID NO: 1663733 - RNA, 14 nt, Salmonella enterica enterica serovar Typhi
caaauagcgcugau

SEQ ID NO: 1663734 - RNA, 13 nt, Salmonella enterica enterica serovar Typhi
caaauaccacauc

SEQ ID NO: 1663735 - RNA, 18 nt, Salmonella enterica enterica serovar Typhi
caaacaauuuacgcagcc

SEQ ID NO: 1663736 - RNA, 19 nt, Salmonella enterica enterica serovar Typhi
caaacacaaauuucgagca

SEQ ID NO: 1663737 - RNA, 21 nt, Salmonella enterica enterica serovar Typhi
caaaccagacgcguaaccccu

SEQ ID NO: 1663738 - RNA, 18 nt, Salmonella enterica enterica serovar Typhi
caaaaugcaccggcguua

SEQ ID NO: 1663739 - RNA, 16 nt, Salmonella enterica enterica serovar Typhi
caaaaugucaguaucg

SEQ ID NO: 1663740 - RNA, 21 nt, Salmonella enterica enterica serovar Typhi
caaaauguucauguacgccgc

SEQ ID NO: 1663741 - RNA, 16 nt, Salmonella enterica enterica serovar Typhi
auuguuuaacguuuca

SEQ ID NO: 1663742 - RNA, 18 nt, Salmonella enterica enterica serovar Typhi
auuguugggguuaucgcu

SEQ ID NO: 1663743 - RNA, 23 nt, Salmonella enterica enterica serovar Typhi
caaacugaucgaggacggccuga

SEQ ID NO: 1663744 - RNA, 13 nt, Salmonella enterica enterica serovar Typhi
caaacucagcggc

SEQ ID NO: 1663745 - RNA, 16 nt, Salmonella enterica enterica serovar Typhi
caaaccggcgaauagc

SEQ ID NO: 1663746 - RNA, 14 nt, Salmonella enterica enterica serovar Typhi
caaacccuuccgca

SEQ ID NO: 1663747 - RNA, 16 nt, Salmonella enterica enterica serovar Typhi
caaacccuuccgcauc

SEQ ID NO: 1663748 - RNA, 20 nt, Salmonella enterica enterica serovar Typhi
caaaggcauggcagguaucg

SEQ ID NO: 1663749 - RNA, 21 nt, Salmonella enterica enterica serovar Typhi
caaagcuugcgcagaguaucg

SEQ ID NO: 1663750 - RNA, 20 nt, Salmonella enterica enterica serovar Typhi
caaagcucaacgcaggcugg

SEQ ID NO: 1663751 - RNA, 21 nt, Salmonella enterica enterica serovar Typhi
auguguaauguuuucugccag

SEQ ID NO: 1663752 - RNA, 16 nt, Salmonella enterica enterica serovar Typhi
augugcuuucaucgcc

SEQ ID NO: 1663753 - RNA, 18 nt, Salmonella enterica enterica serovar Typhi
augugcagcauccagcuc

SEQ ID NO: 1663754 - RNA, 16 nt, Salmonella enterica enterica serovar Typhi
auguugccaugaucca

SEQ ID NO: 1663755 - RNA, 21 nt, Salmonella enterica enterica serovar Typhi
auguugccaugauccaucucg

SEQ ID NO: 1663756 - RNA, 22 nt, Salmonella enterica enterica serovar Typhi
augugucuauuuauugaagaug

SEQ ID NO: 1663757 - RNA, 19 nt, Salmonella enterica enterica serovar Typhi
auguuccgcuaccugcgag

SEQ ID NO: 1663758 - RNA, 13 nt, Salmonella enterica enterica serovar Typhi
auguuauaaacuu

SEQ ID NO: 1663759 - RNA, 15 nt, Salmonella enterica enterica serovar Typhi
augucuuuacggaug

SEQ ID NO: 1663760 - RNA, 14 nt, Salmonella enterica enterica serovar Typhi
augugagcgcaucc

SEQ ID NO: 1663761 - RNA, 20 nt, Salmonella enterica enterica serovar Typhi
augugagcgcauccggccag

SEQ ID NO: 1663762 - RNA, 20 nt, Salmonella enterica enterica serovar Typhi
augugaauaugaucugcaca

SEQ ID NO: 1663763 - RNA, 20 nt, Salmonella enterica enterica serovar Typhi
augugaauaugaucugcgca

SEQ ID NO: 1663764 - RNA, 13 nt, Salmonella enterica enterica serovar Typhi
augugaauccagg

SEQ ID NO: 1663765 - RNA, 20 nt, Salmonella enterica enterica serovar Typhi
auguccaccgauuucaucgc

SEQ ID NO: 1663766 - RNA, 14 nt, Salmonella enterica enterica serovar Typhi
auguccagaccaau

SEQ ID NO: 1663767 - RNA, 18 nt, Salmonella enterica enterica serovar Typhi
auguccauccauugcgcc

SEQ ID NO: 1663768 - RNA, 17 nt, Salmonella enterica enterica serovar Typhi
auggcgacgaucagcgc

SEQ ID NO: 1663769 - RNA, 17 nt, Salmonella enterica enterica serovar Typhi
auggcgacgcguagcgu

SEQ ID NO: 1663770 - RNA, 18 nt, Salmonella enterica enterica serovar Typhi
auggcgacgaucagcgcc

SEQ ID NO: 1663771 - RNA, 18 nt, Salmonella enterica enterica serovar Typhi
augggccaaccugccgau

SEQ ID NO: 1663772 - RNA, 17 nt, Salmonella enterica enterica serovar Typhi
augggcgcacagcgcca

SEQ ID NO: 1663773 - RNA, 11 nt, Salmonella enterica enterica serovar Typhi
auguaaaugac

SEQ ID NO: 1663774 - RNA, 22 nt, Salmonella enterica enterica serovar Typhi
augguggucgcggccaccgcca

SEQ ID NO: 1663775 - RNA, 21 nt, Salmonella enterica enterica serovar Typhi
augggguaucgccaagcggua

SEQ ID NO: 1663776 - RNA, 14 nt, Salmonella enterica enterica serovar Typhi
augggucucaucca

SEQ ID NO: 1663777 - RNA, 18 nt, Salmonella enterica enterica serovar Typhi
auggcaaaaacagccggu

SEQ ID NO: 1663778 - RNA, 15 nt, Salmonella enterica enterica serovar Typhi
auggcacgauaacca

SEQ ID NO: 1663779 - RNA, 18 nt, Salmonella enterica enterica serovar Typhi
auggcaggcauagacauc

SEQ ID NO: 1663780 - RNA, 13 nt, Salmonella enterica enterica serovar Typhi
auggccuggagcg

SEQ ID NO: 1663781 - RNA, 21 nt, Salmonella enterica enterica serovar Typhi
augcuuucgcgauaaucaacu

SEQ ID NO: 1663782 - RNA, 15 nt, Salmonella enterica enterica serovar Typhi
auggagcaucagcgc

SEQ ID NO: 1663783 - RNA, 12 nt, Salmonella enterica enterica serovar Typhi
auggaucaucgg

SEQ ID NO: 1663784 - RNA, 23 nt, Salmonella enterica enterica serovar Typhi
auggaugagucuugcgcguccgc

SEQ ID NO: 1663785 - RNA, 20 nt, Salmonella enterica enterica serovar Typhi
augcgccgccuuggcgaccu

SEQ ID NO: 1663786 - RNA, 21 nt, Salmonella enterica enterica serovar Typhi
augcgccgcccaccgccaacc

SEQ ID NO: 1663787 - RNA, 18 nt, Salmonella enterica enterica serovar Typhi
augcgccgcccaccgcca

SEQ ID NO: 1663788 - RNA, 19 nt, Salmonella enterica enterica serovar Typhi
augcgccagccagucgcca

SEQ ID NO: 1663789 - RNA, 12 nt, Salmonella enterica enterica serovar Typhi
augcgccgucag

SEQ ID NO: 1663790 - RNA, 21 nt, Salmonella enterica enterica serovar Typhi
augcgccgucaggcuugccgc

SEQ ID NO: 1663791 - RNA, 12 nt, Salmonella enterica enterica serovar Typhi
augcggcgccau

SEQ ID NO: 1663792 - RNA, 18 nt, Salmonella enterica enterica serovar Typhi
augccaaacaucgcucgc

SEQ ID NO: 1663793 - RNA, 11 nt, Salmonella enterica enterica serovar Typhi
augcauauuca

SEQ ID NO: 1663794 - RNA, 14 nt, Salmonella enterica enterica serovar Typhi
augcauggcagaua

SEQ ID NO: 1663795 - RNA, 21 nt, Salmonella enterica enterica serovar Typhi
augcgccacgacuaucgucac

SEQ ID NO: 1663796 - RNA, 19 nt, Salmonella enterica enterica serovar Typhi
augcugccuacugcccuac

SEQ ID NO: 1663797 - RNA, 13 nt, Salmonella enterica enterica serovar Typhi
augcugaauagcc

SEQ ID NO: 1663798 - RNA, 21 nt, Salmonella enterica enterica serovar Typhi
augcgucguuggcauggucag

SEQ ID NO: 1663799 - RNA, 13 nt, Salmonella enterica enterica serovar Typhi
augcguaccgcua

SEQ ID NO: 1663800 - RNA, 15 nt, Salmonella enterica enterica serovar Typhi
augcugcaccgcauc

SEQ ID NO: 1663801 - RNA, 16 nt, Salmonella enterica enterica serovar Typhi
augcgggggagaugau

SEQ ID NO: 1663802 - RNA, 12 nt, Salmonella enterica enterica serovar Typhi
augcgggcucgu

SEQ ID NO: 1663803 - RNA, 14 nt, Salmonella enterica enterica serovar Typhi
augcggguccugau

SEQ ID NO: 1663804 - RNA, 14 nt, Salmonella enterica enterica serovar Typhi
auucgacaguuccc

SEQ ID NO: 1663805 - RNA, 16 nt, Salmonella enterica enterica serovar Typhi
auucgccagcgugcuu

SEQ ID NO: 1663806 - RNA, 18 nt, Salmonella enterica enterica serovar Typhi
auucgaugguguuaccgc

SEQ ID NO: 1663807 - RNA, 18 nt, Salmonella enterica enterica serovar Typhi
auucgccccacacggcca

SEQ ID NO: 1663808 - RNA, 17 nt, Salmonella enterica enterica serovar Typhi
auuccuggcguaugcuu

SEQ ID NO: 1663809 - RNA, 20 nt, Salmonella enterica enterica serovar Typhi
auuccuccgccgaucagcac

SEQ ID NO: 1663810 - RNA, 20 nt, Salmonella enterica enterica serovar Typhi
auucgcugaauguugcucgc

SEQ ID NO: 1663811 - RNA, 18 nt, Salmonella enterica enterica serovar Typhi
auucgcugacaucgugua

SEQ ID NO: 1663812 - RNA, 16 nt, Salmonella enterica enterica serovar Typhi
auucguuaccagcauc

SEQ ID NO: 1663813 - RNA, 21 nt, Salmonella enterica enterica serovar Typhi
auucgguagcuguaccagauc

SEQ ID NO: 1663814 - RNA, 12 nt, Salmonella enterica enterica serovar Typhi
auucuaugccag

SEQ ID NO: 1663815 - RNA, 16 nt, Salmonella enterica enterica serovar Typhi
auucaggcuuuccacg

SEQ ID NO: 1663816 - RNA, 20 nt, Salmonella enterica enterica serovar Typhi
auucagggaacguugcgcca

SEQ ID NO: 1663817 - RNA, 21 nt, Salmonella enterica enterica serovar Typhi
auucagggaacguugcgccau

SEQ ID NO: 1663818 - RNA, 16 nt, Salmonella enterica enterica serovar Typhi
auucagaaccugcgau

SEQ ID NO: 1663819 - RNA, 16 nt, Salmonella enterica enterica serovar Typhi
auucagaauaugccag

SEQ ID NO: 1663820 - RNA, 17 nt, Salmonella enterica enterica serovar Typhi
auucagagcguccacgc

SEQ ID NO: 1663821 - RNA, 22 nt, Salmonella enterica enterica serovar Typhi
auucauauugcccaucgcgcca

SEQ ID NO: 1663822 - RNA, 13 nt, Salmonella enterica enterica serovar Typhi
auuccggcgcugg

SEQ ID NO: 1663823 - RNA, 21 nt, Salmonella enterica enterica serovar Typhi
auuccgacagugaacggcaua

SEQ ID NO: 1663824 - RNA, 13 nt, Salmonella enterica enterica serovar Typhi
auucccuucucgc

SEQ ID NO: 1663825 - RNA, 16 nt, Salmonella enterica enterica serovar Typhi
auucccggccacaggc

SEQ ID NO: 1663826 - RNA, 13 nt, Salmonella enterica enterica serovar Typhi
auguuggcgcccu

SEQ ID NO: 1663827 - RNA, 14 nt, Salmonella enterica enterica serovar Typhi
auguugcugcaucu

SEQ ID NO: 1663828 - RNA, 16 nt, Salmonella enterica enterica serovar Typhi
auuaaaugacggacca

SEQ ID NO: 1663829 - RNA, 20 nt, Salmonella enterica enterica serovar Typhi
auuaacagcgccaucaggaa

SEQ ID NO: 1663830 - RNA, 17 nt, Salmonella enterica enterica serovar Typhi
auuggcaagaaucacgc

SEQ ID NO: 1663831 - RNA, 20 nt, Salmonella enterica enterica serovar Typhi
auuggcucggcgucaucccg

SEQ ID NO: 1663832 - RNA, 15 nt, Salmonella enterica enterica serovar Typhi
auugucgaauuccgc

SEQ ID NO: 1663833 - RNA, 18 nt, Salmonella enterica enterica serovar Typhi
auugucaccgggcgcugg

SEQ ID NO: 1663834 - RNA, 21 nt, Salmonella enterica enterica serovar Typhi
auuguccgcauucuugccgca

SEQ ID NO: 1663835 - RNA, 14 nt, Salmonella enterica enterica serovar Typhi
auuggcugccgaca

SEQ ID NO: 1663836 - RNA, 16 nt, Salmonella enterica enterica serovar Typhi
auugcgccccagcaca

SEQ ID NO: 1663837 - RNA, 14 nt, Salmonella enterica enterica serovar Typhi
auugcgccagcuuu

SEQ ID NO: 1663838 - RNA, 20 nt, Salmonella enterica enterica serovar Typhi
auugcgacaggcugccgaca

SEQ ID NO: 1663839 - RNA, 17 nt, Salmonella enterica enterica serovar Typhi
auugccuuccaggcggu

SEQ ID NO: 1663840 - RNA, 13 nt, Salmonella enterica enterica serovar Typhi
auugccggccuga

SEQ ID NO: 1663841 - RNA, 20 nt, Salmonella enterica enterica serovar Typhi
auugccgcuuaaauuaccgc

SEQ ID NO: 1663842 - RNA, 18 nt, Salmonella enterica enterica serovar Typhi
auugcgcuaaaauccacg

SEQ ID NO: 1663843 - RNA, 19 nt, Salmonella enterica enterica serovar Typhi
auugcgcuaaaauccacgu

SEQ ID NO: 1663844 - RNA, 14 nt, Salmonella enterica enterica serovar Typhi
auugcugccuuauc

SEQ ID NO: 1663845 - RNA, 21 nt, Salmonella enterica enterica serovar Typhi
auugcucuuuuaucguugcuu

SEQ ID NO: 1663846 - RNA, 18 nt, Salmonella enterica enterica serovar Typhi
auugaguggacaucgcca

SEQ ID NO: 1663847 - RNA, 19 nt, Salmonella enterica enterica serovar Typhi
auucuucuaccagaacgac

SEQ ID NO: 1663848 - RNA, 14 nt, Salmonella enterica enterica serovar Typhi
auugaagugguggc

SEQ ID NO: 1663849 - RNA, 15 nt, Salmonella enterica enterica serovar Typhi
auugaaacgcaucac

SEQ ID NO: 1663850 - RNA, 19 nt, Salmonella enterica enterica serovar Typhi
auugccgaccgccagcaga

SEQ ID NO: 1663851 - RNA, 17 nt, Salmonella enterica enterica serovar Typhi
auugccgaccauuaccc

SEQ ID NO: 1663852 - RNA, 16 nt, Salmonella enterica enterica serovar Typhi
auugccacgaacgaua

SEQ ID NO: 1663853 - RNA, 20 nt, Salmonella enterica enterica serovar Typhi
auugccaugaugagcgccau

SEQ ID NO: 1663854 - RNA, 21 nt, Salmonella enterica enterica serovar Typhi
auugccaggcguuacgcgcca

SEQ ID NO: 1663855 - RNA, 19 nt, Salmonella enterica enterica serovar Typhi
auugccauacacgcggcga

SEQ ID NO: 1663856 - RNA, 20 nt, Salmonella enterica enterica serovar Typhi
auugauuaaucgucaucccg

SEQ ID NO: 1663857 - RNA, 12 nt, Salmonella enterica enterica serovar Typhi
auugauccacgg

SEQ ID NO: 1663858 - RNA, 14 nt, Salmonella enterica enterica serovar Typhi
auugauauuccgcg

SEQ ID NO: 1663859 - RNA, 22 nt, Salmonella enterica enterica serovar Typhi
auugauaccuaaacgcgucaga

SEQ ID NO: 1663860 - RNA, 14 nt, Salmonella enterica enterica serovar Typhi
aucuuuauccugca

SEQ ID NO: 1663861 - RNA, 19 nt, Salmonella enterica enterica serovar Typhi
aucuuuauugaaaagcagc

SEQ ID NO: 1663862 - RNA, 16 nt, Salmonella enterica enterica serovar Typhi
augaaggguaaaacgu

SEQ ID NO: 1663863 - RNA, 16 nt, Salmonella enterica enterica serovar Typhi
augaaucaucgguaaa

SEQ ID NO: 1663864 - RNA, 21 nt, Salmonella enterica enterica serovar Typhi
augacaaagccggauaucgcu

SEQ ID NO: 1663865 - RNA, 20 nt, Salmonella enterica enterica serovar Typhi
augaccacaccgucaacauc

SEQ ID NO: 1663866 - RNA, 15 nt, Salmonella enterica enterica serovar Typhi
augaccauaugcggc

SEQ ID NO: 1663867 - RNA, 23 nt, Salmonella enterica enterica serovar Typhi
augacgaacaggauauuaccgcc

SEQ ID NO: 1663868 - RNA, 18 nt, Salmonella enterica enterica serovar Typhi
augaccguugauucagcg

SEQ ID NO: 1663869 - RNA, 22 nt, Salmonella enterica enterica serovar Typhi
augauaucgccaauggcgucgu

SEQ ID NO: 1663870 - RNA, 23 nt, Salmonella enterica enterica serovar Typhi
augauaucgcgguuacgcccuau

SEQ ID NO: 1663871 - RNA, 20 nt, Salmonella enterica enterica serovar Typhi
augauaucggccggaugcca

SEQ ID NO: 1663872 - RNA, 19 nt, Salmonella enterica enterica serovar Typhi
augauccacaccggcgcau

SEQ ID NO: 1663873 - RNA, 24 nt, Salmonella enterica enterica serovar Typhi
augaucagcgacgguccuggccag

SEQ ID NO: 1663874 - RNA, 19 nt, Salmonella enterica enterica serovar Typhi
augaucgauagcgacggcg

SEQ ID NO: 1663875 - RNA, 14 nt, Salmonella enterica enterica serovar Typhi
augaucgccgccau

SEQ ID NO: 1663876 - RNA, 14 nt, Salmonella enterica enterica serovar Typhi
augaucgucaacga

SEQ ID NO: 1663877 - RNA, 12 nt, Salmonella enterica enterica serovar Typhi
augacgccgucu

SEQ ID NO: 1663878 - RNA, 21 nt, Salmonella enterica enterica serovar Typhi
augacgcccugcgccagcaug

SEQ ID NO: 1663879 - RNA, 14 nt, Salmonella enterica enterica serovar Typhi
augacgccugccag

SEQ ID NO: 1663880 - RNA, 17 nt, Salmonella enterica enterica serovar Typhi
augagucgcgcgcgcca

SEQ ID NO: 1663881 - RNA, 12 nt, Salmonella enterica enterica serovar Typhi
augcagcagcca

SEQ ID NO: 1663882 - RNA, 13 nt, Salmonella enterica enterica serovar Typhi
augcagcagccag

SEQ ID NO: 1663883 - RNA, 23 nt, Salmonella enterica enterica serovar Typhi
augcagcaucaugucacccacgc

SEQ ID NO: 1663884 - RNA, 19 nt, Salmonella enterica enterica serovar Typhi
augaugggcgcacagcgcc

SEQ ID NO: 1663885 - RNA, 20 nt, Salmonella enterica enterica serovar Typhi
augaugggcgcacagcgcca

SEQ ID NO: 1663886 - RNA, 23 nt, Salmonella enterica enterica serovar Typhi
augaugggcgcacagcgccauga

SEQ ID NO: 1663887 - RNA, 20 nt, Salmonella enterica enterica serovar Typhi
augauggggucacagguucg

SEQ ID NO: 1663888 - RNA, 13 nt, Salmonella enterica enterica serovar Typhi
augcaguucauca

SEQ ID NO: 1663889 - RNA, 19 nt, Salmonella enterica enterica serovar Typhi
aucuacuguuauugacgau

SEQ ID NO: 1663890 - RNA, 12 nt, Salmonella enterica enterica serovar Typhi
aucucgccgucg

SEQ ID NO: 1663891 - RNA, 19 nt, Salmonella enterica enterica serovar Typhi
aucuccgccgcuuuaucgu

SEQ ID NO: 1663892 - RNA, 21 nt, Salmonella enterica enterica serovar Typhi
aucuccuccucauucagcggc

SEQ ID NO: 1663893 - RNA, 13 nt, Salmonella enterica enterica serovar Typhi
aucuccuccggcu

SEQ ID NO: 1663894 - RNA, 18 nt, Salmonella enterica enterica serovar Typhi
aucuacaaacgcggacau

SEQ ID NO: 1663895 - RNA, 17 nt, Salmonella enterica enterica serovar Typhi
aucguugcgcgcaauca

SEQ ID NO: 1663896 - RNA, 19 nt, Salmonella enterica enterica serovar Typhi
aucgugccguccggcauca

SEQ ID NO: 1663897 - RNA, 21 nt, Salmonella enterica enterica serovar Typhi
aucgugauaaagcugacgcgc

SEQ ID NO: 1663898 - RNA, 21 nt, Salmonella enterica enterica serovar Typhi
aucgugauaacgcgauggcca

SEQ ID NO: 1663899 - RNA, 16 nt, Salmonella enterica enterica serovar Typhi
aucgugaccaccgcca

SEQ ID NO: 1663900 - RNA, 20 nt, Salmonella enterica enterica serovar Typhi
aucuucuuugacccacgcca

SEQ ID NO: 1663901 - RNA, 12 nt, Salmonella enterica enterica serovar Typhi
aucuuccgccac

SEQ ID NO: 1663902 - RNA, 17 nt, Salmonella enterica enterica serovar Typhi
aucuucauuucauugcg

SEQ ID NO: 1663903 - RNA, 13 nt, Salmonella enterica enterica serovar Typhi
aucuguggcgacg

SEQ ID NO: 1663904 - RNA, 12 nt, Salmonella enterica enterica serovar Typhi
aucugucaugcg

SEQ ID NO: 1663905 - RNA, 20 nt, Salmonella enterica enterica serovar Typhi
aucuggugacgaugauaaca

SEQ ID NO: 1663906 - RNA, 18 nt, Salmonella enterica enterica serovar Typhi
aucuggcgguuugacggc

SEQ ID NO: 1663907 - RNA, 21 nt, Salmonella enterica enterica serovar Typhi
aucugcggucuccugaacgcc

SEQ ID NO: 1663908 - RNA, 15 nt, Salmonella enterica enterica serovar Typhi
aucugcguugcgcgc

SEQ ID NO: 1663909 - RNA, 18 nt, Salmonella enterica enterica serovar Typhi
aucugcgugaugcaucag

SEQ ID NO: 1663910 - RNA, 14 nt, Salmonella enterica enterica serovar Typhi
aucugcuccgccag

SEQ ID NO: 1663911 - RNA, 13 nt, Salmonella enterica enterica serovar Typhi
aucugcuccggcg

SEQ ID NO: 1663912 - RNA, 22 nt, Salmonella enterica enterica serovar Typhi
auccggcacgccaucgccugau

SEQ ID NO: 1663913 - RNA, 14 nt, Salmonella enterica enterica serovar Typhi
auccggcacgguca

SEQ ID NO: 1663914 - RNA, 19 nt, Salmonella enterica enterica serovar Typhi
auccggcugccugccggau

SEQ ID NO: 1663915 - RNA, 23 nt, Salmonella enterica enterica serovar Typhi
auccggcaacacguuugcccgau

SEQ ID NO: 1663916 - RNA, 23 nt, Salmonella enterica enterica serovar Typhi
auccggguaauuuugccaucgcg

SEQ ID NO: 1663917 - RNA, 23 nt, Salmonella enterica enterica serovar Typhi
auccgggaaauggcaauggcggc

SEQ ID NO: 1663918 - RNA, 21 nt, Salmonella enterica enterica serovar Typhi
auccuccggcgcggcgcgcau

SEQ ID NO: 1663919 - RNA, 11 nt, Salmonella enterica enterica serovar Typhi
auccgccaucg

SEQ ID NO: 1663920 - RNA, 14 nt, Salmonella enterica enterica serovar Typhi
auccgccagcgccu

SEQ ID NO: 1663921 - RNA, 20 nt, Salmonella enterica enterica serovar Typhi
auccgauuucaugcgcagca

SEQ ID NO: 1663922 - RNA, 15 nt, Salmonella enterica enterica serovar Typhi
auccgcagauccagc

SEQ ID NO: 1663923 - RNA, 22 nt, Salmonella enterica enterica serovar Typhi
auccgcagauccagcacggccu

SEQ ID NO: 1663924 - RNA, 17 nt, Salmonella enterica enterica serovar Typhi
auccuuccagcccguuc

SEQ ID NO: 1663925 - RNA, 17 nt, Salmonella enterica enterica serovar Typhi
auccuuuguuugccgcg

SEQ ID NO: 1663926 - RNA, 18 nt, Salmonella enterica enterica serovar Typhi
auccugacuauugcugag

SEQ ID NO: 1663927 - RNA, 22 nt, Salmonella enterica enterica serovar Typhi
auccugcguuaacgacccauca

SEQ ID NO: 1663928 - RNA, 21 nt, Salmonella enterica enterica serovar Typhi
auccugcaccgccugcggcau

SEQ ID NO: 1663929 - RNA, 22 nt, Salmonella enterica enterica serovar Typhi
aucgaaggcaucuucagacagu

SEQ ID NO: 1663930 - RNA, 19 nt, Salmonella enterica enterica serovar Typhi
aucgaacgggcgauggugc

SEQ ID NO: 1663931 - RNA, 14 nt, Salmonella enterica enterica serovar Typhi
aucgacaauccgcc

SEQ ID NO: 1663932 - RNA, 18 nt, Salmonella enterica enterica serovar Typhi
aucgaccuuuucccguaa

SEQ ID NO: 1663933 - RNA, 22 nt, Salmonella enterica enterica serovar Typhi
aucgacauuaacaaugccuuau

SEQ ID NO: 1663934 - RNA, 22 nt, Salmonella enterica enterica serovar Typhi
aucgcggcccucuaagcgcuca

SEQ ID NO: 1663935 - RNA, 21 nt, Salmonella enterica enterica serovar Typhi
aucgcugugguuuauccgcag

SEQ ID NO: 1663936 - RNA, 15 nt, Salmonella enterica enterica serovar Typhi
aucggaguccagcaa

SEQ ID NO: 1663937 - RNA, 19 nt, Salmonella enterica enterica serovar Typhi
aucgcuggacgucgucacc

SEQ ID NO: 1663938 - RNA, 18 nt, Salmonella enterica enterica serovar Typhi
aucgcucuauauccugcc

SEQ ID NO: 1663939 - RNA, 23 nt, Salmonella enterica enterica serovar Typhi
aucggccggaugccagucaauaa

SEQ ID NO: 1663940 - RNA, 15 nt, Salmonella enterica enterica serovar Typhi
aucggcgagcggcua

SEQ ID NO: 1663941 - RNA, 17 nt, Salmonella enterica enterica serovar Typhi
aucggcggcaaagccga

SEQ ID NO: 1663942 - RNA, 22 nt, Salmonella enterica enterica serovar Typhi
aucgcccaggccugaugagcgc

SEQ ID NO: 1663943 - RNA, 15 nt, Salmonella enterica enterica serovar Typhi
aucgacguugaucgc

SEQ ID NO: 1663944 - RNA, 15 nt, Salmonella enterica enterica serovar Typhi
aucgacguuguucgc

SEQ ID NO: 1663945 - RNA, 23 nt, Salmonella enterica enterica serovar Typhi
aucgccguauuucacuuuugccg

SEQ ID NO: 1663946 - RNA, 16 nt, Salmonella enterica enterica serovar Typhi
aucgcgcacaugcugu

SEQ ID NO: 1663947 - RNA, 16 nt, Salmonella enterica enterica serovar Typhi
aucgcccggccuccgg

SEQ ID NO: 1663948 - RNA, 19 nt, Salmonella enterica enterica serovar Typhi
agcguuucuacgccauggc

SEQ ID NO: 1663949 - RNA, 18 nt, Salmonella enterica enterica serovar Typhi
agcguguucgcuacguuc

SEQ ID NO: 1663950 - RNA, 14 nt, Salmonella enterica enterica serovar Typhi
agcguugauaugcu

SEQ ID NO: 1663951 - RNA, 19 nt, Salmonella enterica enterica serovar Typhi
agcguuuauguuugcugau

SEQ ID NO: 1663952 - RNA, 19 nt, Salmonella enterica enterica serovar Typhi
agcucaagcccgcgucguu

SEQ ID NO: 1663953 - RNA, 24 nt, Salmonella enterica enterica serovar Typhi
agcuccgcaaagcccaucagcgcc

SEQ ID NO: 1663954 - RNA, 19 nt, Salmonella enterica enterica serovar Typhi
agcuccgcaauuuccugau

SEQ ID NO: 1663955 - RNA, 22 nt, Salmonella enterica enterica serovar Typhi
agcuccauagaaaucagcaggu

SEQ ID NO: 1663956 - RNA, 14 nt, Salmonella enterica enterica serovar Typhi
agcucgauccggca

SEQ ID NO: 1663957 - RNA, 16 nt, Salmonella enterica enterica serovar Typhi
agcucuaccagaccac

SEQ ID NO: 1663958 - RNA, 18 nt, Salmonella enterica enterica serovar Typhi
agcugacggauacgcugc

SEQ ID NO: 1663959 - RNA, 21 nt, Salmonella enterica enterica serovar Typhi
agcucuuucauuucugccugc

SEQ ID NO: 1663960 - RNA, 14 nt, Salmonella enterica enterica serovar Typhi
agcugaaugguaaa

SEQ ID NO: 1663961 - RNA, 17 nt, Salmonella enterica enterica serovar Typhi
agcggcgccaucaccau

SEQ ID NO: 1663962 - RNA, 19 nt, Salmonella enterica enterica serovar Typhi
agcggcugcgccugcgggu

SEQ ID NO: 1663963 - RNA, 16 nt, Salmonella enterica enterica serovar Typhi
agcggcucauccagca

SEQ ID NO: 1663964 - RNA, 15 nt, Salmonella enterica enterica serovar Typhi
agcggcuaaucacca

SEQ ID NO: 1663965 - RNA, 12 nt, Salmonella enterica enterica serovar Typhi
agcgugccgacg

SEQ ID NO: 1663966 - RNA, 22 nt, Salmonella enterica enterica serovar Typhi
agcgugccgacguucaugccga

SEQ ID NO: 1663967 - RNA, 22 nt, Salmonella enterica enterica serovar Typhi
agcgugcguucauggcgcgaca

SEQ ID NO: 1663968 - RNA, 13 nt, Salmonella enterica enterica serovar Typhi
agcguuaaucacc

SEQ ID NO: 1663969 - RNA, 17 nt, Salmonella enterica enterica serovar Typhi
agcgucgccagaccgaa

SEQ ID NO: 1663970 - RNA, 20 nt, Salmonella enterica enterica serovar Typhi
agcgucgcugauugccgcca

SEQ ID NO: 1663971 - RNA, 19 nt, Salmonella enterica enterica serovar Typhi
agcgguaaaaccggucugg

SEQ ID NO: 1663972 - RNA, 22 nt, Salmonella enterica enterica serovar Typhi
agcgguguaaaagccagcaagg

SEQ ID NO: 1663973 - RNA, 18 nt, Salmonella enterica enterica serovar Typhi
agcgcuugauaaugucaa

SEQ ID NO: 1663974 - RNA, 22 nt, Salmonella enterica enterica serovar Typhi
agcgcuuugccgcugcugccuu

SEQ ID NO: 1663975 - RNA, 14 nt, Salmonella enterica enterica serovar Typhi
agcgcgucagcgcc

SEQ ID NO: 1663976 - RNA, 22 nt, Salmonella enterica enterica serovar Typhi
agcgcuacauccgccagccgcc

SEQ ID NO: 1663977 - RNA, 16 nt, Salmonella enterica enterica serovar Typhi
agcgcgauacgcagca

SEQ ID NO: 1663978 - RNA, 21 nt, Salmonella enterica enterica serovar Typhi
agcgcgcgacccagcgcauga

SEQ ID NO: 1663979 - RNA, 21 nt, Salmonella enterica enterica serovar Typhi
agcgcgcgcgccugaugcgcc

SEQ ID NO: 1663980 - RNA, 12 nt, Salmonella enterica enterica serovar Typhi
agcgccagcaug

SEQ ID NO: 1663981 - RNA, 15 nt, Salmonella enterica enterica serovar Typhi
agcgccagauaguca

SEQ ID NO: 1663982 - RNA, 18 nt, Salmonella enterica enterica serovar Typhi
agcgcauugacgauaucg

SEQ ID NO: 1663983 - RNA, 17 nt, Salmonella enterica enterica serovar Typhi
agcgccaauccacgggu

SEQ ID NO: 1663984 - RNA, 20 nt, Salmonella enterica enterica serovar Typhi
agccgcgcauagcuggcgua

SEQ ID NO: 1663985 - RNA, 13 nt, Salmonella enterica enterica serovar Typhi
agccgcgccaucu

SEQ ID NO: 1663986 - RNA, 22 nt, Salmonella enterica enterica serovar Typhi
agccgucgccggccuguuaaug

SEQ ID NO: 1663987 - RNA, 17 nt, Salmonella enterica enterica serovar Typhi
agccgucguugcugucg

SEQ ID NO: 1663988 - RNA, 19 nt, Salmonella enterica enterica serovar Typhi
agccuugauaccgccgcaa

SEQ ID NO: 1663989 - RNA, 23 nt, Salmonella enterica enterica serovar Typhi
agccuuuccgcauggccgcuauc

SEQ ID NO: 1663990 - RNA, 17 nt, Salmonella enterica enterica serovar Typhi
agcgaauacuccugcaa

SEQ ID NO: 1663991 - RNA, 21 nt, Salmonella enterica enterica serovar Typhi
agcgaauuaugacggaugcca

SEQ ID NO: 1663992 - RNA, 22 nt, Salmonella enterica enterica serovar Typhi
agcgaauggcgugaagccauca

SEQ ID NO: 1663993 - RNA, 15 nt, Salmonella enterica enterica serovar Typhi
agcgcagcgccauca

SEQ ID NO: 1663994 - RNA, 22 nt, Salmonella enterica enterica serovar Typhi
agcgcacguuuagcuugcgaag

SEQ ID NO: 1663995 - RNA, 12 nt, Salmonella enterica enterica serovar Typhi
agcgcagcacgu

SEQ ID NO: 1663996 - RNA, 21 nt, Salmonella enterica enterica serovar Typhi
agcgaguuacguugcggcgua

SEQ ID NO: 1663997 - RNA, 14 nt, Salmonella enterica enterica serovar Typhi
agcgacauggcggu

SEQ ID NO: 1663998 - RNA, 18 nt, Salmonella enterica enterica serovar Typhi
agcgagcugguuucaaua

SEQ ID NO: 1663999 - RNA, 17 nt, Salmonella enterica enterica serovar Typhi
agccgccccccgucagg

SEQ ID NO: 1664000 - RNA, 12 nt, Salmonella enterica enterica serovar Typhi
agcccuggccaa

SEQ ID NO: 1664001 - RNA, 22 nt, Salmonella enterica enterica serovar Typhi
agcccucaacauugccggcauc

SEQ ID NO: 1664002 - RNA, 13 nt, Salmonella enterica enterica serovar Typhi
agcccucuggcaa

SEQ ID NO: 1664003 - RNA, 14 nt, Salmonella enterica enterica serovar Typhi
agcccuaccgccac

SEQ ID NO: 1664004 - RNA, 14 nt, Salmonella enterica enterica serovar Typhi
agcccagcacggca

SEQ ID NO: 1664005 - RNA, 19 nt, Salmonella enterica enterica serovar Typhi
agcccaauacgccagccua

SEQ ID NO: 1664006 - RNA, 14 nt, Salmonella enterica enterica serovar Typhi
agccccacgguacg

SEQ ID NO: 1664007 - RNA, 14 nt, Salmonella enterica enterica serovar Typhi
agcccauccgucag

SEQ ID NO: 1664008 - RNA, 16 nt, Salmonella enterica enterica serovar Typhi
agcccaucaccgccag

SEQ ID NO: 1664009 - RNA, 17 nt, Salmonella enterica enterica serovar Typhi
agcccaucaguccccag

SEQ ID NO: 1664010 - RNA, 17 nt, Salmonella enterica enterica serovar Typhi
agcccaucagcgccagc

SEQ ID NO: 1664011 - RNA, 15 nt, Salmonella enterica enterica serovar Typhi
agcccgcccagcauu

SEQ ID NO: 1664012 - RNA, 17 nt, Salmonella enterica enterica serovar Typhi
agccccaggccgguugu

SEQ ID NO: 1664013 - RNA, 17 nt, Salmonella enterica enterica serovar Typhi
agccaacaacaggccgc

SEQ ID NO: 1664014 - RNA, 17 nt, Salmonella enterica enterica serovar Typhi
agccaaaaucgauagcg

SEQ ID NO: 1664015 - RNA, 12 nt, Salmonella enterica enterica serovar Typhi
agccagcaucau

SEQ ID NO: 1664016 - RNA, 15 nt, Salmonella enterica enterica serovar Typhi
agccagcaucgcuaa

SEQ ID NO: 1664017 - RNA, 11 nt, Salmonella enterica enterica serovar Typhi
agccagcacga

SEQ ID NO: 1664018 - RNA, 21 nt, Salmonella enterica enterica serovar Typhi
agccagauggauaaccugccg

SEQ ID NO: 1664019 - RNA, 12 nt, Salmonella enterica enterica serovar Typhi
agccacgucuga

SEQ ID NO: 1664020 - RNA, 20 nt, Salmonella enterica enterica serovar Typhi
agccacguugcgcgcgguca

SEQ ID NO: 1664021 - RNA, 14 nt, Salmonella enterica enterica serovar Typhi
agccagacgcgcag

SEQ ID NO: 1664022 - RNA, 16 nt, Salmonella enterica enterica serovar Typhi
agccagaacucaucuu

SEQ ID NO: 1664023 - RNA, 14 nt, Salmonella enterica enterica serovar Typhi
agccaucccggcga

SEQ ID NO: 1664024 - RNA, 17 nt, Salmonella enterica enterica serovar Typhi
agccaguaagaacgaga

SEQ ID NO: 1664025 - RNA, 23 nt, Salmonella enterica enterica serovar Typhi
agccagccgccaaaaauaucgcc

SEQ ID NO: 1664026 - RNA, 14 nt, Salmonella enterica enterica serovar Typhi
agccaggccgccag

SEQ ID NO: 1664027 - RNA, 15 nt, Salmonella enterica enterica serovar Typhi
agcagcagugaggau

SEQ ID NO: 1664028 - RNA, 16 nt, Salmonella enterica enterica serovar Typhi
agcagcaucccggcaa

SEQ ID NO: 1664029 - RNA, 21 nt, Salmonella enterica enterica serovar Typhi
agcagccaguuauuaaucaag

SEQ ID NO: 1664030 - RNA, 15 nt, Salmonella enterica enterica serovar Typhi
agccaaagcgaggua

SEQ ID NO: 1664031 - RNA, 14 nt, Salmonella enterica enterica serovar Typhi
agcauccuccggcg

SEQ ID NO: 1664032 - RNA, 20 nt, Salmonella enterica enterica serovar Typhi
agcaugaucauacugccgcc

SEQ ID NO: 1664033 - RNA, 18 nt, Salmonella enterica enterica serovar Typhi
agcaugagugauagcgcc

SEQ ID NO: 1664034 - RNA, 22 nt, Salmonella enterica enterica serovar Typhi
agcaucaauaucugcuaccgcc

SEQ ID NO: 1664035 - RNA, 15 nt, Salmonella enterica enterica serovar Typhi
agcauccagaucggc

SEQ ID NO: 1664036 - RNA, 21 nt, Salmonella enterica enterica serovar Typhi
agcauccagcucauguaguca

SEQ ID NO: 1664037 - RNA, 13 nt, Salmonella enterica enterica serovar Typhi
agcaucagcgccg

SEQ ID NO: 1664038 - RNA, 19 nt, Salmonella enterica enterica serovar Typhi
agcaucccgcuggcgccac

SEQ ID NO: 1664039 - RNA, 13 nt, Salmonella enterica enterica serovar Typhi
agcaucauguccc

SEQ ID NO: 1664040 - RNA, 18 nt, Salmonella enterica enterica serovar Typhi
agaggccaccagcgccag

SEQ ID NO: 1664041 - RNA, 18 nt, Salmonella enterica enterica serovar Typhi
agaggcguugccgggcau

SEQ ID NO: 1664042 - RNA, 16 nt, Salmonella enterica enterica serovar Typhi
agaguaggccggauaa

SEQ ID NO: 1664043 - RNA, 19 nt, Salmonella enterica enterica serovar Typhi
agagucacuagcacuacgg

SEQ ID NO: 1664044 - RNA, 14 nt, Salmonella enterica enterica serovar Typhi
agagagauggaaca

SEQ ID NO: 1664045 - RNA, 16 nt, Salmonella enterica enterica serovar Typhi
agacguuuaugccgcc

SEQ ID NO: 1664046 - RNA, 15 nt, Salmonella enterica enterica serovar Typhi
agacguugagcucaa

SEQ ID NO: 1664047 - RNA, 16 nt, Salmonella enterica enterica serovar Typhi
agaaagcgaauggcgu

SEQ ID NO: 1664048 - RNA, 21 nt, Salmonella enterica enterica serovar Typhi
agaaaguaguauccccggcaa

SEQ ID NO: 1664049 - RNA, 15 nt, Salmonella enterica enterica serovar Typhi
agaaacgcuuuccgg

SEQ ID NO: 1664050 - RNA, 23 nt, Salmonella enterica enterica serovar Typhi
agaaacaucaucguuugcgcgca

SEQ ID NO: 1664051 - RNA, 20 nt, Salmonella enterica enterica serovar Typhi
agauggcgucacauggcgaa

SEQ ID NO: 1664052 - RNA, 20 nt, Salmonella enterica enterica serovar Typhi
agaugaaacugcauaucgcc

SEQ ID NO: 1664053 - RNA, 22 nt, Salmonella enterica enterica serovar Typhi
agaugaccguuaguaaucggau

SEQ ID NO: 1664054 - RNA, 17 nt, Salmonella enterica enterica serovar Typhi
agaucugucgccaugac

SEQ ID NO: 1664055 - RNA, 14 nt, Salmonella enterica enterica serovar Typhi
agaucuuccggcgu

SEQ ID NO: 1664056 - RNA, 18 nt, Salmonella enterica enterica serovar Typhi
agaugauaaucauccggg

SEQ ID NO: 1664057 - RNA, 12 nt, Salmonella enterica enterica serovar Typhi
agaucagacgac

SEQ ID NO: 1664058 - RNA, 17 nt, Salmonella enterica enterica serovar Typhi
agaucgagacgcgucag

SEQ ID NO: 1664059 - RNA, 12 nt, Salmonella enterica enterica serovar Typhi
agagucguuacc

SEQ ID NO: 1664060 - RNA, 20 nt, Salmonella enterica enterica serovar Typhi
agaucgccgccgguaacgau

SEQ ID NO: 1664061 - RNA, 17 nt, Salmonella enterica enterica serovar Typhi
agaucggcaugauggcg

SEQ ID NO: 1664062 - RNA, 16 nt, Salmonella enterica enterica serovar Typhi
agcaaaucgcccauca

SEQ ID NO: 1664063 - RNA, 19 nt, Salmonella enterica enterica serovar Typhi
agcaacagcguaccuuuau

SEQ ID NO: 1664064 - RNA, 16 nt, Salmonella enterica enterica serovar Typhi
agcaauauuuuuccgc

SEQ ID NO: 1664065 - RNA, 20 nt, Salmonella enterica enterica serovar Typhi
agcaauggguaggccggaua

SEQ ID NO: 1664066 - RNA, 12 nt, Salmonella enterica enterica serovar Typhi
agcaauggcgug

SEQ ID NO: 1664067 - RNA, 18 nt, Salmonella enterica enterica serovar Typhi
agcacuccccggcuugcg

SEQ ID NO: 1664068 - RNA, 13 nt, Salmonella enterica enterica serovar Typhi
agcagcagcgcaa

SEQ ID NO: 1664069 - RNA, 20 nt, Salmonella enterica enterica serovar Typhi
aggccgguuguuuacacggc

SEQ ID NO: 1664070 - RNA, 16 nt, Salmonella enterica enterica serovar Typhi
aggccuaccagccgag

SEQ ID NO: 1664071 - RNA, 13 nt, Salmonella enterica enterica serovar Typhi
aggccuaccagcc

SEQ ID NO: 1664072 - RNA, 21 nt, Salmonella enterica enterica serovar Typhi
aggccuacaacgacuacguuc

SEQ ID NO: 1664073 - RNA, 16 nt, Salmonella enterica enterica serovar Typhi
aggcgcguuuacuggc

SEQ ID NO: 1664074 - RNA, 13 nt, Salmonella enterica enterica serovar Typhi
agggaagauaucg

SEQ ID NO: 1664075 - RNA, 15 nt, Salmonella enterica enterica serovar Typhi
aggcuuugcgccauc

SEQ ID NO: 1664076 - RNA, 16 nt, Salmonella enterica enterica serovar Typhi
agggagaacucaucuc

SEQ ID NO: 1664077 - RNA, 14 nt, Salmonella enterica enterica serovar Typhi
agggaauaagcgcc

SEQ ID NO: 1664078 - RNA, 13 nt, Salmonella enterica enterica serovar Typhi
aggcucagcgcca

SEQ ID NO: 1664079 - RNA, 21 nt, Salmonella enterica enterica serovar Typhi
aggcguugcuccagcagcgcc

SEQ ID NO: 1664080 - RNA, 20 nt, Salmonella enterica enterica serovar Typhi
aggcuauuuuauucgccauu

SEQ ID NO: 1664081 - RNA, 18 nt, Salmonella enterica enterica serovar Typhi
aggcgugguggauaucca

SEQ ID NO: 1664082 - RNA, 23 nt, Salmonella enterica enterica serovar Typhi
aggcgugcguauugccccgucag

SEQ ID NO: 1664083 - RNA, 19 nt, Salmonella enterica enterica serovar Typhi
aggcguugugcagaaucau

SEQ ID NO: 1664084 - RNA, 18 nt, Salmonella enterica enterica serovar Typhi
aggcguugcuccagcagc

SEQ ID NO: 1664085 - RNA, 18 nt, Salmonella enterica enterica serovar Typhi
aggcguuuugguccgcgc

SEQ ID NO: 1664086 - RNA, 14 nt, Salmonella enterica enterica serovar Typhi
aggcuaaagugcgu

SEQ ID NO: 1664087 - RNA, 18 nt, Salmonella enterica enterica serovar Typhi
aggcggagaaaugcgaca

SEQ ID NO: 1664088 - RNA, 14 nt, Salmonella enterica enterica serovar Typhi
aggcggucaucgcc

SEQ ID NO: 1664089 - RNA, 15 nt, Salmonella enterica enterica serovar Typhi
aggccaucauaccgc

SEQ ID NO: 1664090 - RNA, 21 nt, Salmonella enterica enterica serovar Typhi
aggcauguugcgcaaucacgc

SEQ ID NO: 1664091 - RNA, 16 nt, Salmonella enterica enterica serovar Typhi
aggcaucuuccagcgu

SEQ ID NO: 1664092 - RNA, 19 nt, Salmonella enterica enterica serovar Typhi
aggauuugucucaucugau

SEQ ID NO: 1664093 - RNA, 14 nt, Salmonella enterica enterica serovar Typhi
aggcaucgacgcca

SEQ ID NO: 1664094 - RNA, 15 nt, Salmonella enterica enterica serovar Typhi
aggcauucagcgggu

SEQ ID NO: 1664095 - RNA, 17 nt, Salmonella enterica enterica serovar Typhi
aggccaauuccgccaua

SEQ ID NO: 1664096 - RNA, 18 nt, Salmonella enterica enterica serovar Typhi
aggccggauaaggcgcag

SEQ ID NO: 1664097 - RNA, 16 nt, Salmonella enterica enterica serovar Typhi
aggccgcuuucgcggc

SEQ ID NO: 1664098 - RNA, 17 nt, Salmonella enterica enterica serovar Typhi
aggugauaaucagcgcu

SEQ ID NO: 1664099 - RNA, 15 nt, Salmonella enterica enterica serovar Typhi
aggucggguaagcgu

SEQ ID NO: 1664100 - RNA, 20 nt, Salmonella enterica enterica serovar Typhi
aggucggguaaggcguagcc

SEQ ID NO: 1664101 - RNA, 15 nt, Salmonella enterica enterica serovar Typhi
aggucgucaggccgc

SEQ ID NO: 1664102 - RNA, 13 nt, Salmonella enterica enterica serovar Typhi
aggucggcuccug

SEQ ID NO: 1664103 - RNA, 21 nt, Salmonella enterica enterica serovar Typhi
agggauuuugcuuuuucggca

SEQ ID NO: 1664104 - RNA, 16 nt, Salmonella enterica enterica serovar Typhi
agguacagaugcugua

SEQ ID NO: 1664105 - RNA, 15 nt, Salmonella enterica enterica serovar Typhi
agguaauaucauccg

SEQ ID NO: 1664106 - RNA, 17 nt, Salmonella enterica enterica serovar Typhi
agguaauaucauccggu

SEQ ID NO: 1664107 - RNA, 14 nt, Salmonella enterica enterica serovar Typhi
aguccuuccgccgg

SEQ ID NO: 1664108 - RNA, 22 nt, Salmonella enterica enterica serovar Typhi
aguccugccggacugauaccgc

SEQ ID NO: 1664109 - RNA, 20 nt, Salmonella enterica enterica serovar Typhi
aguccaacaaggauauccgc

SEQ ID NO: 1664110 - RNA, 11 nt, Salmonella enterica enterica serovar Typhi
aguauggcgac

SEQ ID NO: 1664111 - RNA, 15 nt, Salmonella enterica enterica serovar Typhi
aguaugccucgcgca

SEQ ID NO: 1664112 - RNA, 15 nt, Salmonella enterica enterica serovar Typhi
agucagucccgcgcu

SEQ ID NO: 1664113 - RNA, 23 nt, Salmonella enterica enterica serovar Typhi
agucauaauacucaauauccugc

SEQ ID NO: 1664114 - RNA, 15 nt, Salmonella enterica enterica serovar Typhi
aguaauucccggcag

SEQ ID NO: 1664115 - RNA, 14 nt, Salmonella enterica enterica serovar Typhi
aguaauuugaacau

SEQ ID NO: 1664116 - RNA, 20 nt, Salmonella enterica enterica serovar Typhi
aguaauuugaacauauccgc

SEQ ID NO: 1664117 - RNA, 19 nt, Salmonella enterica enterica serovar Typhi
aguaacguuaauacaucau

SEQ ID NO: 1664118 - RNA, 22 nt, Salmonella enterica enterica serovar Typhi
aguaacgggcaucgccgcaacu

SEQ ID NO: 1664119 - RNA, 23 nt, Salmonella enterica enterica serovar Typhi
aguaccggcaggacaaucauaau

SEQ ID NO: 1664120 - RNA, 11 nt, Salmonella enterica enterica serovar Typhi
aguaccugaug

SEQ ID NO: 1664121 - RNA, 17 nt, Salmonella enterica enterica serovar Typhi
aguacaggcauugucac

SEQ ID NO: 1664122 - RNA, 15 nt, Salmonella enterica enterica serovar Typhi
aguaucgcgccgcca

SEQ ID NO: 1664123 - RNA, 21 nt, Salmonella enterica enterica serovar Typhi
aguaucgcucuauauccugcc

SEQ ID NO: 1664124 - RNA, 13 nt, Salmonella enterica enterica serovar Typhi
agguuaugcgcac

SEQ ID NO: 1664125 - RNA, 21 nt, Salmonella enterica enterica serovar Typhi
agguuaucgccgcccguuucc

SEQ ID NO: 1664126 - RNA, 13 nt, Salmonella enterica enterica serovar Typhi
agguuauucgccu

SEQ ID NO: 1664127 - RNA, 16 nt, Salmonella enterica enterica serovar Typhi
agguugcguccgccgc

SEQ ID NO: 1664128 - RNA, 23 nt, Salmonella enterica enterica serovar Typhi
aguaaaaugcccugcuggcgcau

SEQ ID NO: 1664129 - RNA, 16 nt, Salmonella enterica enterica serovar Typhi
agguuucuucaucaaa

SEQ ID NO: 1664130 - RNA, 23 nt, Salmonella enterica enterica serovar Typhi
agugucuucccugaccagcgacg

SEQ ID NO: 1664131 - RNA, 15 nt, Salmonella enterica enterica serovar Typhi
agugucaacugcgcc

SEQ ID NO: 1664132 - RNA, 22 nt, Salmonella enterica enterica serovar Typhi
agucgcauugugccugauggcg

SEQ ID NO: 1664133 - RNA, 12 nt, Salmonella enterica enterica serovar Typhi
aguuccggauac

SEQ ID NO: 1664134 - RNA, 15 nt, Salmonella enterica enterica serovar Typhi
aguugcaagucacca

SEQ ID NO: 1664135 - RNA, 21 nt, Salmonella enterica enterica serovar Typhi
aguugaauaacguguuaugcg

SEQ ID NO: 1664136 - RNA, 13 nt, Salmonella enterica enterica serovar Typhi
auaaaauccugca

SEQ ID NO: 1664137 - RNA, 15 nt, Salmonella enterica enterica serovar Typhi
auaaaauagccuaau

SEQ ID NO: 1664138 - RNA, 22 nt, Salmonella enterica enterica serovar Typhi
auaaaccggcggccuaccaguu

SEQ ID NO: 1664139 - RNA, 21 nt, Salmonella enterica enterica serovar Typhi
auaaacgccaguggaugcgcu

SEQ ID NO: 1664140 - RNA, 22 nt, Salmonella enterica enterica serovar Typhi
auaaacgguucagucagcgcga

SEQ ID NO: 1664141 - RNA, 12 nt, Salmonella enterica enterica serovar Typhi
auaaacucagca

SEQ ID NO: 1664142 - RNA, 20 nt, Salmonella enterica enterica serovar Typhi
auaaagcgaccgaucaucau

SEQ ID NO: 1664143 - RNA, 16 nt, Salmonella enterica enterica serovar Typhi
auaaaggucacaucau

SEQ ID NO: 1664144 - RNA, 23 nt, Salmonella enterica enterica serovar Typhi
auaaaggccggcagccgcugaua

SEQ ID NO: 1664145 - RNA, 20 nt, Salmonella enterica enterica serovar Typhi
auaaagucagacaaguagcc

SEQ ID NO: 1664146 - RNA, 18 nt, Salmonella enterica enterica serovar Typhi
auaaauccccgccgccau

SEQ ID NO: 1664147 - RNA, 14 nt, Salmonella enterica enterica serovar Typhi
auaaaucagcccga

SEQ ID NO: 1664148 - RNA, 20 nt, Salmonella enterica enterica serovar Typhi
auaaauccccgccgccauca

SEQ ID NO: 1664149 - RNA, 18 nt, Salmonella enterica enterica serovar Typhi
auaaaucccgguggggau

SEQ ID NO: 1664150 - RNA, 16 nt, Salmonella enterica enterica serovar Typhi
auaaauacaauucaac

SEQ ID NO: 1664151 - RNA, 19 nt, Salmonella enterica enterica serovar Typhi
auaaaaaaaagccgaccug

SEQ ID NO: 1664152 - RNA, 19 nt, Salmonella enterica enterica serovar Typhi
aguuuuuccuuucugcgcc

SEQ ID NO: 1664153 - RNA, 17 nt, Salmonella enterica enterica serovar Typhi
auaaaaaagcugcgauc

SEQ ID NO: 1664154 - RNA, 15 nt, Salmonella enterica enterica serovar Typhi
auaaaaaaggccgcu

SEQ ID NO: 1664155 - RNA, 22 nt, Salmonella enterica enterica serovar Typhi
auaaaaagccaucccgcugauc

SEQ ID NO: 1664156 - RNA, 14 nt, Salmonella enterica enterica serovar Typhi
auaaaaccggcaua

SEQ ID NO: 1664157 - RNA, 14 nt, Salmonella enterica enterica serovar Typhi
auaaaaagccguga

SEQ ID NO: 1664158 - RNA, 18 nt, Salmonella enterica enterica serovar Typhi
auaaaagcccuuaucgcc

SEQ ID NO: 1664159 - RNA, 17 nt, Salmonella enterica enterica serovar Typhi
aguuuuacugaugccag

SEQ ID NO: 1664160 - RNA, 23 nt, Salmonella enterica enterica serovar Typhi
auaacagacgaaaaaaaagacgc

SEQ ID NO: 1664161 - RNA, 16 nt, Salmonella enterica enterica serovar Typhi
auaacaaaaccagcau

SEQ ID NO: 1664162 - RNA, 18 nt, Salmonella enterica enterica serovar Typhi
auaagcauagcgccauca

SEQ ID NO: 1664163 - RNA, 18 nt, Salmonella enterica enterica serovar Typhi
auaagcgcagcgucauca

SEQ ID NO: 1664164 - RNA, 18 nt, Salmonella enterica enterica serovar Typhi
auaagcgcagcgccaucc

SEQ ID NO: 1664165 - RNA, 19 nt, Salmonella enterica enterica serovar Typhi
auaagcuccgggacauccg

SEQ ID NO: 1664166 - RNA, 14 nt, Salmonella enterica enterica serovar Typhi
auaacaaacgccgc

SEQ ID NO: 1664167 - RNA, 18 nt, Salmonella enterica enterica serovar Typhi
auaaauuuuuuaacagaa

SEQ ID NO: 1664168 - RNA, 13 nt, Salmonella enterica enterica serovar Typhi
auaaucauccgcu

SEQ ID NO: 1664169 - RNA, 19 nt, Salmonella enterica enterica serovar Typhi
auaaucccggcgccaauca

SEQ ID NO: 1664170 - RNA, 20 nt, Salmonella enterica enterica serovar Typhi
auaaggccacgccgccaucc

SEQ ID NO: 1664171 - RNA, 20 nt, Salmonella enterica enterica serovar Typhi
auaaggcgcuugcgccauca

SEQ ID NO: 1664172 - RNA, 20 nt, Salmonella enterica enterica serovar Typhi
auacagaauccggcgcucau

SEQ ID NO: 1664173 - RNA, 13 nt, Salmonella enterica enterica serovar Typhi
auaauggcgccga

SEQ ID NO: 1664174 - RNA, 18 nt, Salmonella enterica enterica serovar Typhi
auaauguuugcgccaucg

SEQ ID NO: 1664175 - RNA, 16 nt, Salmonella enterica enterica serovar Typhi
auaaugcagccauccu

SEQ ID NO: 1664176 - RNA, 13 nt, Salmonella enterica enterica serovar Typhi
auacaucagaaaa

SEQ ID NO: 1664177 - RNA, 15 nt, Salmonella enterica enterica serovar Typhi
auacccggcucccau

SEQ ID NO: 1664178 - RNA, 12 nt, Salmonella enterica enterica serovar Typhi
auaccgccaucc

SEQ ID NO: 1664179 - RNA, 14 nt, Salmonella enterica enterica serovar Typhi
auacgucauaucau

SEQ ID NO: 1664180 - RNA, 19 nt, Salmonella enterica enterica serovar Typhi
auacguccccauccgagcg

SEQ ID NO: 1664181 - RNA, 20 nt, Salmonella enterica enterica serovar Typhi
auagagucgauagaucgcca

SEQ ID NO: 1664182 - RNA, 23 nt, Salmonella enterica enterica serovar Typhi
auagcaccucgcaauauucaugc

SEQ ID NO: 1664183 - RNA, 15 nt, Salmonella enterica enterica serovar Typhi
auagcaggcgauuaa

SEQ ID NO: 1664184 - RNA, 17 nt, Salmonella enterica enterica serovar Typhi
auagcaucguaagccgc

SEQ ID NO: 1664185 - RNA, 18 nt, Salmonella enterica enterica serovar Typhi
auagcaacccacuuucgg

SEQ ID NO: 1664186 - RNA, 17 nt, Salmonella enterica enterica serovar Typhi
auagcaaacccucaucg

SEQ ID NO: 1664187 - RNA, 22 nt, Salmonella enterica enterica serovar Typhi
auagcaauuucagcauccuccg

SEQ ID NO: 1664188 - RNA, 17 nt, Salmonella enterica enterica serovar Typhi
auagcaauacuuuccag

SEQ ID NO: 1664189 - RNA, 21 nt, Salmonella enterica enterica serovar Typhi
auagacuucacuuucccggaa

SEQ ID NO: 1664190 - RNA, 17 nt, Salmonella enterica enterica serovar Typhi
auacucuuucccggcaa

SEQ ID NO: 1664191 - RNA, 22 nt, Salmonella enterica enterica serovar Typhi
auacugaaauuucuuuuccaga

SEQ ID NO: 1664192 - RNA, 22 nt, Salmonella enterica enterica serovar Typhi
auacugaccaacaacagauaua

SEQ ID NO: 1664193 - RNA, 15 nt, Salmonella enterica enterica serovar Typhi
auacuccugccugac

SEQ ID NO: 1664194 - RNA, 22 nt, Salmonella enterica enterica serovar Typhi
auacuccauugucggcagcgag

SEQ ID NO: 1664195 - RNA, 16 nt, Salmonella enterica enterica serovar Typhi
auacucccggcgcugg

SEQ ID NO: 1664196 - RNA, 23 nt, Salmonella enterica enterica serovar Typhi
aucaacgaccaugguucccgcca

SEQ ID NO: 1664197 - RNA, 18 nt, Salmonella enterica enterica serovar Typhi
aucaacgccgcgccauca

SEQ ID NO: 1664198 - RNA, 15 nt, Salmonella enterica enterica serovar Typhi
aucaaaaucaucgcc

SEQ ID NO: 1664199 - RNA, 14 nt, Salmonella enterica enterica serovar Typhi
aucaaagaccuccg

SEQ ID NO: 1664200 - RNA, 13 nt, Salmonella enterica enterica serovar Typhi
auauuuguaucug

SEQ ID NO: 1664201 - RNA, 17 nt, Salmonella enterica enterica serovar Typhi
auauuuuucagcuucug

SEQ ID NO: 1664202 - RNA, 18 nt, Salmonella enterica enterica serovar Typhi
auauuuuucauucgcgcu

SEQ ID NO: 1664203 - RNA, 16 nt, Salmonella enterica enterica serovar Typhi
aucaaucuacuguuau

SEQ ID NO: 1664204 - RNA, 20 nt, Salmonella enterica enterica serovar Typhi
aucaaugcccagcgcaauca

SEQ ID NO: 1664205 - RNA, 19 nt, Salmonella enterica enterica serovar Typhi
aucaaugugcucaaccaug

SEQ ID NO: 1664206 - RNA, 19 nt, Salmonella enterica enterica serovar Typhi
aucacaacgucaucccgaa

SEQ ID NO: 1664207 - RNA, 21 nt, Salmonella enterica enterica serovar Typhi
aucaagcgguagcguuaucca

SEQ ID NO: 1664208 - RNA, 19 nt, Salmonella enterica enterica serovar Typhi
aucaagccuaucaccgcga

SEQ ID NO: 1664209 - RNA, 21 nt, Salmonella enterica enterica serovar Typhi
aucaauaagggucgcgcugua

SEQ ID NO: 1664210 - RNA, 14 nt, Salmonella enterica enterica serovar Typhi
auauccgcugcggu

SEQ ID NO: 1664211 - RNA, 22 nt, Salmonella enterica enterica serovar Typhi
auauccagcucgcgcaggcgga

SEQ ID NO: 1664212 - RNA, 15 nt, Salmonella enterica enterica serovar Typhi
auagcgcagcauugg

SEQ ID NO: 1664213 - RNA, 22 nt, Salmonella enterica enterica serovar Typhi
auagcgacguuaucucgccagg

SEQ ID NO: 1664214 - RNA, 12 nt, Salmonella enterica enterica serovar Typhi
auaucaaugcgc

SEQ ID NO: 1664215 - RNA, 21 nt, Salmonella enterica enterica serovar Typhi
auagcauuuuuacucagcaca

SEQ ID NO: 1664216 - RNA, 14 nt, Salmonella enterica enterica serovar Typhi
auagcgaccagcgu

SEQ ID NO: 1664217 - RNA, 20 nt, Salmonella enterica enterica serovar Typhi
auagccuuuauugaugacau

SEQ ID NO: 1664218 - RNA, 13 nt, Salmonella enterica enterica serovar Typhi
auauuuccgcgau

SEQ ID NO: 1664219 - RNA, 15 nt, Salmonella enterica enterica serovar Typhi
auauuuacugaauaa

SEQ ID NO: 1664220 - RNA, 13 nt, Salmonella enterica enterica serovar Typhi
auaugccugccaa

SEQ ID NO: 1664221 - RNA, 12 nt, Salmonella enterica enterica serovar Typhi
auaugcgcauca

SEQ ID NO: 1664222 - RNA, 18 nt, Salmonella enterica enterica serovar Typhi
auauguggauguaccaga

SEQ ID NO: 1664223 - RNA, 21 nt, Salmonella enterica enterica serovar Typhi
auauccguacauaacagcagc

SEQ ID NO: 1664224 - RNA, 21 nt, Salmonella enterica enterica serovar Typhi
aucagcauuacccccgccaua

SEQ ID NO: 1664225 - RNA, 19 nt, Salmonella enterica enterica serovar Typhi
aucagcgaaggcaacugau

SEQ ID NO: 1664226 - RNA, 19 nt, Salmonella enterica enterica serovar Typhi
aucagcgcggcgugaucaa

SEQ ID NO: 1664227 - RNA, 16 nt, Salmonella enterica enterica serovar Typhi
aucagccagccgccaa

SEQ ID NO: 1664228 - RNA, 15 nt, Salmonella enterica enterica serovar Typhi
aucagccagccgcca

SEQ ID NO: 1664229 - RNA, 18 nt, Salmonella enterica enterica serovar Typhi
aucagcccuaucgcugcg

SEQ ID NO: 1664230 - RNA, 13 nt, Salmonella enterica enterica serovar Typhi
aucacuuccgcca

SEQ ID NO: 1664231 - RNA, 17 nt, Salmonella enterica enterica serovar Typhi
aucacuuacuaagguaa

SEQ ID NO: 1664232 - RNA, 14 nt, Salmonella enterica enterica serovar Typhi
aucagaauauccgg

SEQ ID NO: 1664233 - RNA, 16 nt, Salmonella enterica enterica serovar Typhi
aucacuuuugccguca

SEQ ID NO: 1664234 - RNA, 20 nt, Salmonella enterica enterica serovar Typhi
aucacuuuacccacaucaau

SEQ ID NO: 1664235 - RNA, 22 nt, Salmonella enterica enterica serovar Typhi
aucacuuuacugaauaacagca

SEQ ID NO: 1664236 - RNA, 23 nt, Salmonella enterica enterica serovar Typhi
aucacugcaccucagaccguuag

SEQ ID NO: 1664237 - RNA, 16 nt, Salmonella enterica enterica serovar Typhi
aucacuaccgccauca

SEQ ID NO: 1664238 - RNA, 14 nt, Salmonella enterica enterica serovar Typhi
aucacuaauuugcg

SEQ ID NO: 1664239 - RNA, 19 nt, Salmonella enterica enterica serovar Typhi
aucacuauuugugcggcau

SEQ ID NO: 1664240 - RNA, 16 nt, Salmonella enterica enterica serovar Typhi
aucagacuguuacgcu

SEQ ID NO: 1664241 - RNA, 13 nt, Salmonella enterica enterica serovar Typhi
aucagacgcuuca

SEQ ID NO: 1664242 - RNA, 13 nt, Salmonella enterica enterica serovar Typhi
aucagacgcauca

SEQ ID NO: 1664243 - RNA, 15 nt, Salmonella enterica enterica serovar Typhi
aucagcaacgcgcca

SEQ ID NO: 1664244 - RNA, 22 nt, Salmonella enterica enterica serovar Typhi
aucagauggcgauucauaugcg

SEQ ID NO: 1664245 - RNA, 20 nt, Salmonella enterica enterica serovar Typhi
aucagauugauacggguaau

SEQ ID NO: 1664246 - RNA, 15 nt, Salmonella enterica enterica serovar Typhi
aucagcaaaauaccg

SEQ ID NO: 1664247 - RNA, 22 nt, Salmonella enterica enterica serovar Typhi
aucagcaaaauaccggcagcgg

SEQ ID NO: 1664248 - RNA, 14 nt, Salmonella enterica enterica serovar Typhi
aucagauuuaggau

SEQ ID NO: 1664249 - RNA, 16 nt, Salmonella enterica enterica serovar Typhi
aucacgguacgcauca

SEQ ID NO: 1664250 - RNA, 22 nt, Salmonella enterica enterica serovar Typhi
aucacguguuacgccgcaauca

SEQ ID NO: 1664251 - RNA, 21 nt, Salmonella enterica enterica serovar Typhi
aucacgccacaguauuccggc

SEQ ID NO: 1664252 - RNA, 18 nt, Salmonella enterica enterica serovar Typhi
aucaccuggcagccgcgu

SEQ ID NO: 1664253 - RNA, 23 nt, Salmonella enterica enterica serovar Typhi
aucaccucagguaaauccgccag

SEQ ID NO: 1664254 - RNA, 16 nt, Salmonella enterica enterica serovar Typhi
aucaccugcaucacgc

SEQ ID NO: 1664255 - RNA, 18 nt, Salmonella enterica enterica serovar Typhi
aucacccgcauaugcggc

SEQ ID NO: 1664256 - RNA, 14 nt, Salmonella enterica enterica serovar Typhi
aucaccaucacgau

SEQ ID NO: 1664257 - RNA, 20 nt, Salmonella enterica enterica serovar Typhi
aucaccauaccgacgaccau

SEQ ID NO: 1664258 - RNA, 14 nt, Salmonella enterica enterica serovar Typhi
aucacaaggaauga

SEQ ID NO: 1664259 - RNA, 12 nt, Salmonella enterica enterica serovar Typhi
aucacagacaga

SEQ ID NO: 1664260 - RNA, 14 nt, Salmonella enterica enterica serovar Typhi
aucacauugcccca

SEQ ID NO: 1664261 - RNA, 18 nt, Salmonella enterica enterica serovar Typhi
aucaccagaucggcaucu

SEQ ID NO: 1664262 - RNA, 12 nt, Salmonella enterica enterica serovar Typhi
cccuuccgccau

SEQ ID NO: 1664263 - RNA, 11 nt, Salmonella enterica enterica serovar Typhi
cccuucaggaa

SEQ ID NO: 1664264 - RNA, 23 nt, Salmonella enterica enterica serovar Typhi
cccuucaauaucaagauccaaca

SEQ ID NO: 1664265 - RNA, 16 nt, Salmonella enterica enterica serovar Typhi
cccugcuguuccagug

SEQ ID NO: 1664266 - RNA, 23 nt, Salmonella enterica enterica serovar Typhi
cccuuuucuuuaaacaacgccau

SEQ ID NO: 1664267 - RNA, 12 nt, Salmonella enterica enterica serovar Typhi
ccgaacacgcau

SEQ ID NO: 1664268 - RNA, 11 nt, Salmonella enterica enterica serovar Typhi
cccuauccgcg

SEQ ID NO: 1664269 - RNA, 21 nt, Salmonella enterica enterica serovar Typhi
cccguuugcaguccguccaga

SEQ ID NO: 1664270 - RNA, 17 nt, Salmonella enterica enterica serovar Typhi
cccugagcccacagcgg

SEQ ID NO: 1664271 - RNA, 19 nt, Salmonella enterica enterica serovar Typhi
cccugagcgcuacgccugu

SEQ ID NO: 1664272 - RNA, 21 nt, Salmonella enterica enterica serovar Typhi
cccucgcaccacgacucaaug

SEQ ID NO: 1664273 - RNA, 17 nt, Salmonella enterica enterica serovar Typhi
ccgaccgccagcagagc

SEQ ID NO: 1664274 - RNA, 14 nt, Salmonella enterica enterica serovar Typhi
ccgaccgccgaugc

SEQ ID NO: 1664275 - RNA, 15 nt, Salmonella enterica enterica serovar Typhi
ccgaccgucggcgca

SEQ ID NO: 1664276 - RNA, 17 nt, Salmonella enterica enterica serovar Typhi
ccgaccuguaccgcgac

SEQ ID NO: 1664277 - RNA, 13 nt, Salmonella enterica enterica serovar Typhi
ccgaccagggcau

SEQ ID NO: 1664278 - RNA, 21 nt, Salmonella enterica enterica serovar Typhi
ccgacauagcugaacaauccc

SEQ ID NO: 1664279 - RNA, 22 nt, Salmonella enterica enterica serovar Typhi
ccgacaggguuugccagcacca

SEQ ID NO: 1664280 - RNA, 21 nt, Salmonella enterica enterica serovar Typhi
ccgaccaaugacgcuauccgc

SEQ ID NO: 1664281 - RNA, 21 nt, Salmonella enterica enterica serovar Typhi
ccgacauaggccagccgacgc

SEQ ID NO: 1664282 - RNA, 18 nt, Salmonella enterica enterica serovar Typhi
ccgaagauaaagauauuc

SEQ ID NO: 1664283 - RNA, 18 nt, Salmonella enterica enterica serovar Typhi
cccgcggcgaucaccacg

SEQ ID NO: 1664284 - RNA, 12 nt, Salmonella enterica enterica serovar Typhi
cccgccgccagu

SEQ ID NO: 1664285 - RNA, 12 nt, Salmonella enterica enterica serovar Typhi
cccgccgccauc

SEQ ID NO: 1664286 - RNA, 17 nt, Salmonella enterica enterica serovar Typhi
cccgccgccagcaccgc

SEQ ID NO: 1664287 - RNA, 14 nt, Salmonella enterica enterica serovar Typhi
cccgcacagcacau

SEQ ID NO: 1664288 - RNA, 20 nt, Salmonella enterica enterica serovar Typhi
cccgguaagcgcagcgccac

SEQ ID NO: 1664289 - RNA, 16 nt, Salmonella enterica enterica serovar Typhi
cccgguagcauccgcg

SEQ ID NO: 1664290 - RNA, 18 nt, Salmonella enterica enterica serovar Typhi
cccggcguagcgcguuca

SEQ ID NO: 1664291 - RNA, 23 nt, Salmonella enterica enterica serovar Typhi
cccggcagugcauaaagauuggc

SEQ ID NO: 1664292 - RNA, 22 nt, Salmonella enterica enterica serovar Typhi
cccggcauuucugucugacgac

SEQ ID NO: 1664293 - RNA, 19 nt, Salmonella enterica enterica serovar Typhi
cccggcaauuaccgccagc

SEQ ID NO: 1664294 - RNA, 24 nt, Salmonella enterica enterica serovar Typhi
cccggcaauuaccgccagcggcgu

SEQ ID NO: 1664295 - RNA, 21 nt, Salmonella enterica enterica serovar Typhi
cccggacgaaccuggcgguaa

SEQ ID NO: 1664296 - RNA, 14 nt, Salmonella enterica enterica serovar Typhi
cccggccugacgca

SEQ ID NO: 1664297 - RNA, 21 nt, Salmonella enterica enterica serovar Typhi
cccauauucgucuucaucuuc

SEQ ID NO: 1664298 - RNA, 15 nt, Salmonella enterica enterica serovar Typhi
cccaucagcgccagc

SEQ ID NO: 1664299 - RNA, 18 nt, Salmonella enterica enterica serovar Typhi
cccaucaguccccagcgu

SEQ ID NO: 1664300 - RNA, 21 nt, Salmonella enterica enterica serovar Typhi
cccaucauugacuucaacgca

SEQ ID NO: 1664301 - RNA, 13 nt, Salmonella enterica enterica serovar Typhi
cccaguagcagac

SEQ ID NO: 1664302 - RNA, 22 nt, Salmonella enterica enterica serovar Typhi
cccagguuucaaugccgccgau

SEQ ID NO: 1664303 - RNA, 14 nt, Salmonella enterica enterica serovar Typhi
cccagcgcggccca

SEQ ID NO: 1664304 - RNA, 16 nt, Salmonella enterica enterica serovar Typhi
cccagcgcgaccugca

SEQ ID NO: 1664305 - RNA, 19 nt, Salmonella enterica enterica serovar Typhi
ccauuccgauagcgaaacu

SEQ ID NO: 1664306 - RNA, 12 nt, Salmonella enterica enterica serovar Typhi
ccauuccucacg

SEQ ID NO: 1664307 - RNA, 13 nt, Salmonella enterica enterica serovar Typhi
ccauugccagaua

SEQ ID NO: 1664308 - RNA, 16 nt, Salmonella enterica enterica serovar Typhi
ccauugauaccaauaa

SEQ ID NO: 1664309 - RNA, 18 nt, Salmonella enterica enterica serovar Typhi
ccauugcaauaccggcug

SEQ ID NO: 1664310 - RNA, 13 nt, Salmonella enterica enterica serovar Typhi
cccagaucaggcc

SEQ ID NO: 1664311 - RNA, 12 nt, Salmonella enterica enterica serovar Typhi
cccagaucgccc

SEQ ID NO: 1664312 - RNA, 24 nt, Salmonella enterica enterica serovar Typhi
cccacgggaagaugugccacuccg

SEQ ID NO: 1664313 - RNA, 18 nt, Salmonella enterica enterica serovar Typhi
cccagauaacgcaucaga

SEQ ID NO: 1664314 - RNA, 12 nt, Salmonella enterica enterica serovar Typhi
ccccagcaccga

SEQ ID NO: 1664315 - RNA, 13 nt, Salmonella enterica enterica serovar Typhi
cccaucccggcaa

SEQ ID NO: 1664316 - RNA, 19 nt, Salmonella enterica enterica serovar Typhi
cccauugaaaucgccucau

SEQ ID NO: 1664317 - RNA, 23 nt, Salmonella enterica enterica serovar Typhi
cccaucauugacuucaacgcagg

SEQ ID NO: 1664318 - RNA, 19 nt, Salmonella enterica enterica serovar Typhi
ccccacaaucccgccagac

SEQ ID NO: 1664319 - RNA, 15 nt, Salmonella enterica enterica serovar Typhi
ccccagcgccagccg

SEQ ID NO: 1664320 - RNA, 15 nt, Salmonella enterica enterica serovar Typhi
ccccauucgcguuca

SEQ ID NO: 1664321 - RNA, 16 nt, Salmonella enterica enterica serovar Typhi
ccccaucccagaccau

SEQ ID NO: 1664322 - RNA, 17 nt, Salmonella enterica enterica serovar Typhi
ccccaguaauccggcaa

SEQ ID NO: 1664323 - RNA, 12 nt, Salmonella enterica enterica serovar Typhi
ccccauacgcgc

SEQ ID NO: 1664324 - RNA, 16 nt, Salmonella enterica enterica serovar Typhi
ccccgccgcugaggau

SEQ ID NO: 1664325 - RNA, 17 nt, Salmonella enterica enterica serovar Typhi
ccccggccauagcguga

SEQ ID NO: 1664326 - RNA, 17 nt, Salmonella enterica enterica serovar Typhi
ccccgcaucgcccgcuc

SEQ ID NO: 1664327 - RNA, 15 nt, Salmonella enterica enterica serovar Typhi
ccccgaugucgccac

SEQ ID NO: 1664328 - RNA, 18 nt, Salmonella enterica enterica serovar Typhi
ccccgauaaaccaggcag

SEQ ID NO: 1664329 - RNA, 19 nt, Salmonella enterica enterica serovar Typhi
ccauccggcaaacucagcg

SEQ ID NO: 1664330 - RNA, 11 nt, Salmonella enterica enterica serovar Typhi
ccauccggcac

SEQ ID NO: 1664331 - RNA, 17 nt, Salmonella enterica enterica serovar Typhi
ccaucgacagcgccaua

SEQ ID NO: 1664332 - RNA, 16 nt, Salmonella enterica enterica serovar Typhi
ccaucgauagcagcgc

SEQ ID NO: 1664333 - RNA, 21 nt, Salmonella enterica enterica serovar Typhi
ccaucgccauuacgccgacgu

SEQ ID NO: 1664334 - RNA, 19 nt, Salmonella enterica enterica serovar Typhi
ccaucgcccgggcgauauc

SEQ ID NO: 1664335 - RNA, 14 nt, Salmonella enterica enterica serovar Typhi
ccaucgccgcagag

SEQ ID NO: 1664336 - RNA, 16 nt, Salmonella enterica enterica serovar Typhi
ccauaccuaauagcga

SEQ ID NO: 1664337 - RNA, 18 nt, Salmonella enterica enterica serovar Typhi
ccaguuguuccagcagcu

SEQ ID NO: 1664338 - RNA, 23 nt, Salmonella enterica enterica serovar Typhi
ccauaauuuauccuccgaacagg

SEQ ID NO: 1664339 - RNA, 22 nt, Salmonella enterica enterica serovar Typhi
ccauaauuugauauuuaaucgc

SEQ ID NO: 1664340 - RNA, 20 nt, Salmonella enterica enterica serovar Typhi
ccauacucuauguucaguag

SEQ ID NO: 1664341 - RNA, 16 nt, Salmonella enterica enterica serovar Typhi
ccauacuuacugcugu

SEQ ID NO: 1664342 - RNA, 17 nt, Salmonella enterica enterica serovar Typhi
ccauccaccaggcaugc

SEQ ID NO: 1664343 - RNA, 19 nt, Salmonella enterica enterica serovar Typhi
ccauccaccaggcaugcag

SEQ ID NO: 1664344 - RNA, 13 nt, Salmonella enterica enterica serovar Typhi
ccaucauuaccaa

SEQ ID NO: 1664345 - RNA, 13 nt, Salmonella enterica enterica serovar Typhi
ccaucaugcgcca

SEQ ID NO: 1664346 - RNA, 21 nt, Salmonella enterica enterica serovar Typhi
ccauccauauugagcgguagc

SEQ ID NO: 1664347 - RNA, 21 nt, Salmonella enterica enterica serovar Typhi
ccaucccagguuauucaggug

SEQ ID NO: 1664348 - RNA, 13 nt, Salmonella enterica enterica serovar Typhi
ccaucgcggcgca

SEQ ID NO: 1664349 - RNA, 23 nt, Salmonella enterica enterica serovar Typhi
ccaucgcggcgcaaaucgccauc

SEQ ID NO: 1664350 - RNA, 19 nt, Salmonella enterica enterica serovar Typhi
ccaugacggguaacgccaa

SEQ ID NO: 1664351 - RNA, 13 nt, Salmonella enterica enterica serovar Typhi
ccaugauaaucag

SEQ ID NO: 1664352 - RNA, 14 nt, Salmonella enterica enterica serovar Typhi
ccaugauaaucagc

SEQ ID NO: 1664353 - RNA, 16 nt, Salmonella enterica enterica serovar Typhi
ccaugaguucaauaug

SEQ ID NO: 1664354 - RNA, 22 nt, Salmonella enterica enterica serovar Typhi
ccaugagcgaaacuccagcgau

SEQ ID NO: 1664355 - RNA, 15 nt, Salmonella enterica enterica serovar Typhi
ccauucccagcgccc

SEQ ID NO: 1664356 - RNA, 16 nt, Salmonella enterica enterica serovar Typhi
ccauuacuaacacguu

SEQ ID NO: 1664357 - RNA, 15 nt, Salmonella enterica enterica serovar Typhi
ccauggcccaaaagg

SEQ ID NO: 1664358 - RNA, 21 nt, Salmonella enterica enterica serovar Typhi
ccagguuucuggcaacagcca

SEQ ID NO: 1664359 - RNA, 13 nt, Salmonella enterica enterica serovar Typhi
ccagucgcagcca

SEQ ID NO: 1664360 - RNA, 23 nt, Salmonella enterica enterica serovar Typhi
ccagucggacagcgacacuccgc

SEQ ID NO: 1664361 - RNA, 23 nt, Salmonella enterica enterica serovar Typhi
ccaguucucuucuuugcgcgucu

SEQ ID NO: 1664362 - RNA, 16 nt, Salmonella enterica enterica serovar Typhi
ccaguuauagcgcaga

SEQ ID NO: 1664363 - RNA, 16 nt, Salmonella enterica enterica serovar Typhi
ccagucuuccugcggu

SEQ ID NO: 1664364 - RNA, 17 nt, Salmonella enterica enterica serovar Typhi
ccagucuuccauuacaa

SEQ ID NO: 1664365 - RNA, 23 nt, Salmonella enterica enterica serovar Typhi
ccagugguuccauuccagaacga

SEQ ID NO: 1664366 - RNA, 15 nt, Salmonella enterica enterica serovar Typhi
ccaguguacugccaa

SEQ ID NO: 1664367 - RNA, 21 nt, Salmonella enterica enterica serovar Typhi
ccaguggucguuagccagaug

SEQ ID NO: 1664368 - RNA, 13 nt, Salmonella enterica enterica serovar Typhi
ccaggucaucacc

SEQ ID NO: 1664369 - RNA, 22 nt, Salmonella enterica enterica serovar Typhi
ccaggauccguucaucggcaua

SEQ ID NO: 1664370 - RNA, 13 nt, Salmonella enterica enterica serovar Typhi
ccaggauaucgcg

SEQ ID NO: 1664371 - RNA, 19 nt, Salmonella enterica enterica serovar Typhi
ccagauuacgcauggucaa

SEQ ID NO: 1664372 - RNA, 22 nt, Salmonella enterica enterica serovar Typhi
ccagauuaucggccagcgccag

SEQ ID NO: 1664373 - RNA, 13 nt, Salmonella enterica enterica serovar Typhi
ccagauuacgcau

SEQ ID NO: 1664374 - RNA, 17 nt, Salmonella enterica enterica serovar Typhi
ccagagagaugccgccg

SEQ ID NO: 1664375 - RNA, 14 nt, Salmonella enterica enterica serovar Typhi
ccagcaaaccggca

SEQ ID NO: 1664376 - RNA, 20 nt, Salmonella enterica enterica serovar Typhi
ccagauuuuccaggccgcca

SEQ ID NO: 1664377 - RNA, 18 nt, Salmonella enterica enterica serovar Typhi
ccagcaaaccuuccgcca

SEQ ID NO: 1664378 - RNA, 17 nt, Salmonella enterica enterica serovar Typhi
ccagcaaggagacgccc

SEQ ID NO: 1664379 - RNA, 15 nt, Salmonella enterica enterica serovar Typhi
ccagcaagcggcgau

SEQ ID NO: 1664380 - RNA, 22 nt, Salmonella enterica enterica serovar Typhi
ccagcaccaucuuuuccggcag

SEQ ID NO: 1664381 - RNA, 20 nt, Salmonella enterica enterica serovar Typhi
ccagcacacgcaucccgcca

SEQ ID NO: 1664382 - RNA, 18 nt, Salmonella enterica enterica serovar Typhi
ccagcaaggcugccgcca

SEQ ID NO: 1664383 - RNA, 15 nt, Salmonella enterica enterica serovar Typhi
ccagcaauacccaga

SEQ ID NO: 1664384 - RNA, 12 nt, Salmonella enterica enterica serovar Typhi
ccagcacgccuu

SEQ ID NO: 1664385 - RNA, 16 nt, Salmonella enterica enterica serovar Typhi
ccagcagcagauaagc

SEQ ID NO: 1664386 - RNA, 12 nt, Salmonella enterica enterica serovar Typhi
ccagcaucgacc

SEQ ID NO: 1664387 - RNA, 16 nt, Salmonella enterica enterica serovar Typhi
ccacguaacucggcag

SEQ ID NO: 1664388 - RNA, 18 nt, Salmonella enterica enterica serovar Typhi
ccacguaacucggcagcg

SEQ ID NO: 1664389 - RNA, 14 nt, Salmonella enterica enterica serovar Typhi
ccacgucauccggc

SEQ ID NO: 1664390 - RNA, 13 nt, Salmonella enterica enterica serovar Typhi
ccacggggcaugc

SEQ ID NO: 1664391 - RNA, 12 nt, Salmonella enterica enterica serovar Typhi
ccacgggcgcac

SEQ ID NO: 1664392 - RNA, 16 nt, Salmonella enterica enterica serovar Typhi
ccagaaaaaaaagcgc

SEQ ID NO: 1664393 - RNA, 16 nt, Salmonella enterica enterica serovar Typhi
ccacuguucguccaua

SEQ ID NO: 1664394 - RNA, 18 nt, Salmonella enterica enterica serovar Typhi
ccagaaucaccgacagca

SEQ ID NO: 1664395 - RNA, 15 nt, Salmonella enterica enterica serovar Typhi
ccagacgggccaggc

SEQ ID NO: 1664396 - RNA, 15 nt, Salmonella enterica enterica serovar Typhi
ccagacggcgcuguu

SEQ ID NO: 1664397 - RNA, 22 nt, Salmonella enterica enterica serovar Typhi
ccagacgguaagcguucgcaua

SEQ ID NO: 1664398 - RNA, 22 nt, Salmonella enterica enterica serovar Typhi
ccagaaucccgccuugcggcgc

SEQ ID NO: 1664399 - RNA, 14 nt, Salmonella enterica enterica serovar Typhi
ccagacaagcacau

SEQ ID NO: 1664400 - RNA, 16 nt, Salmonella enterica enterica serovar Typhi
ccagacuuuccagcac

SEQ ID NO: 1664401 - RNA, 22 nt, Salmonella enterica enterica serovar Typhi
ccagacuccuuuuaccggcgaa

SEQ ID NO: 1664402 - RNA, 15 nt, Salmonella enterica enterica serovar Typhi
ccagcucaucgaacc

SEQ ID NO: 1664403 - RNA, 21 nt, Salmonella enterica enterica serovar Typhi
ccagcggaugucggucaucag

SEQ ID NO: 1664404 - RNA, 19 nt, Salmonella enterica enterica serovar Typhi
ccagcuauuuuucaccaua

SEQ ID NO: 1664405 - RNA, 18 nt, Salmonella enterica enterica serovar Typhi
ccagcguugaauaucgua

SEQ ID NO: 1664406 - RNA, 16 nt, Salmonella enterica enterica serovar Typhi
ccagcguuagcgcaaa

SEQ ID NO: 1664407 - RNA, 12 nt, Salmonella enterica enterica serovar Typhi
ccagcuggcugg

SEQ ID NO: 1664408 - RNA, 17 nt, Salmonella enterica enterica serovar Typhi
ccagcgcgccauccuga

SEQ ID NO: 1664409 - RNA, 15 nt, Salmonella enterica enterica serovar Typhi
ccagcgcccccagca

SEQ ID NO: 1664410 - RNA, 21 nt, Salmonella enterica enterica serovar Typhi
ccagcggaauccccgccgcca

SEQ ID NO: 1664411 - RNA, 19 nt, Salmonella enterica enterica serovar Typhi
ccagcgcugagaugaccau

SEQ ID NO: 1664412 - RNA, 19 nt, Salmonella enterica enterica serovar Typhi
ccagccgguguuaaccaga

SEQ ID NO: 1664413 - RNA, 20 nt, Salmonella enterica enterica serovar Typhi
ccagccggaaaagcgcuggc

SEQ ID NO: 1664414 - RNA, 18 nt, Salmonella enterica enterica serovar Typhi
ccagcaucggcagcgcca

SEQ ID NO: 1664415 - RNA, 21 nt, Salmonella enterica enterica serovar Typhi
ccagcgaaaugcgaauccggc

SEQ ID NO: 1664416 - RNA, 16 nt, Salmonella enterica enterica serovar Typhi
ccagcgaaaugcgaau

SEQ ID NO: 1664417 - RNA, 19 nt, Salmonella enterica enterica serovar Typhi
ccagccucgcgcauccggg

SEQ ID NO: 1664418 - RNA, 17 nt, Salmonella enterica enterica serovar Typhi
ccagcgaauccgugcgu

SEQ ID NO: 1664419 - RNA, 19 nt, Salmonella enterica enterica serovar Typhi
ccagcgaugagcgccagca

SEQ ID NO: 1664420 - RNA, 18 nt, Salmonella enterica enterica serovar Typhi
cauucagcggcugcgccu

SEQ ID NO: 1664421 - RNA, 17 nt, Salmonella enterica enterica serovar Typhi
cauucgacgcugaaccu

SEQ ID NO: 1664422 - RNA, 17 nt, Salmonella enterica enterica serovar Typhi
cauuccugcguugacca

SEQ ID NO: 1664423 - RNA, 14 nt, Salmonella enterica enterica serovar Typhi
cauucggcgaaaga

SEQ ID NO: 1664424 - RNA, 13 nt, Salmonella enterica enterica serovar Typhi
cauuaucaccauu

SEQ ID NO: 1664425 - RNA, 13 nt, Salmonella enterica enterica serovar Typhi
cauuaggcguaau

SEQ ID NO: 1664426 - RNA, 16 nt, Salmonella enterica enterica serovar Typhi
cauucaacgggcgaua

SEQ ID NO: 1664427 - RNA, 14 nt, Salmonella enterica enterica serovar Typhi
cauucaacgcauca

SEQ ID NO: 1664428 - RNA, 14 nt, Salmonella enterica enterica serovar Typhi
cauuaaaugcgcca

SEQ ID NO: 1664429 - RNA, 17 nt, Salmonella enterica enterica serovar Typhi
cauuaaccuugcccaug

SEQ ID NO: 1664430 - RNA, 20 nt, Salmonella enterica enterica serovar Typhi
cauuacugaccgagaucagg

SEQ ID NO: 1664431 - RNA, 22 nt, Salmonella enterica enterica serovar Typhi
cauuacugaccgagaucaggcc

SEQ ID NO: 1664432 - RNA, 20 nt, Salmonella enterica enterica serovar Typhi
cauuacccaauaaugaacga

SEQ ID NO: 1664433 - RNA, 22 nt, Salmonella enterica enterica serovar Typhi
cauuaauuucuugcaauagcgc

SEQ ID NO: 1664434 - RNA, 23 nt, Salmonella enterica enterica serovar Typhi
cauuaauaaccccagcugcggca

SEQ ID NO: 1664435 - RNA, 21 nt, Salmonella enterica enterica serovar Typhi
cauuacaggcaucuuccagcg

SEQ ID NO: 1664436 - RNA, 16 nt, Salmonella enterica enterica serovar Typhi
cauuaauaugcgcaau

SEQ ID NO: 1664437 - RNA, 15 nt, Salmonella enterica enterica serovar Typhi
ccaacacggcgcuca

SEQ ID NO: 1664438 - RNA, 21 nt, Salmonella enterica enterica serovar Typhi
ccaacagguuaaucagcacau

SEQ ID NO: 1664439 - RNA, 20 nt, Salmonella enterica enterica serovar Typhi
ccaacauaacgaaauccgcg

SEQ ID NO: 1664440 - RNA, 12 nt, Salmonella enterica enterica serovar Typhi
ccaacagcgcaa

SEQ ID NO: 1664441 - RNA, 19 nt, Salmonella enterica enterica serovar Typhi
cauuuuuucgaugaugaga

SEQ ID NO: 1664442 - RNA, 17 nt, Salmonella enterica enterica serovar Typhi
ccaaaauagauaaucgc

SEQ ID NO: 1664443 - RNA, 18 nt, Salmonella enterica enterica serovar Typhi
cauuuccggcgcggucaa

SEQ ID NO: 1664444 - RNA, 19 nt, Salmonella enterica enterica serovar Typhi
cauuucgccgccauccggc

SEQ ID NO: 1664445 - RNA, 21 nt, Salmonella enterica enterica serovar Typhi
cauuucgccgccucguaucug

SEQ ID NO: 1664446 - RNA, 14 nt, Salmonella enterica enterica serovar Typhi
cauuucaugaccga

SEQ ID NO: 1664447 - RNA, 20 nt, Salmonella enterica enterica serovar Typhi
cauuuagcgccgauuuccac

SEQ ID NO: 1664448 - RNA, 12 nt, Salmonella enterica enterica serovar Typhi
cauuuacgccaa

SEQ ID NO: 1664449 - RNA, 22 nt, Salmonella enterica enterica serovar Typhi
cauugauauagaguccagccau

SEQ ID NO: 1664450 - RNA, 19 nt, Salmonella enterica enterica serovar Typhi
cauugaugccugcccaucu

SEQ ID NO: 1664451 - RNA, 24 nt, Salmonella enterica enterica serovar Typhi
cauugaucauuggggaaccuggca

SEQ ID NO: 1664452 - RNA, 15 nt, Salmonella enterica enterica serovar Typhi
cauugauuuccgcgc

SEQ ID NO: 1664453 - RNA, 17 nt, Salmonella enterica enterica serovar Typhi
cauggccuucaaucagc

SEQ ID NO: 1664454 - RNA, 18 nt, Salmonella enterica enterica serovar Typhi
caugggcgggauccugca

SEQ ID NO: 1664455 - RNA, 17 nt, Salmonella enterica enterica serovar Typhi
cauggcuggcauauugc

SEQ ID NO: 1664456 - RNA, 14 nt, Salmonella enterica enterica serovar Typhi
caugggcaggaaca

SEQ ID NO: 1664457 - RNA, 18 nt, Salmonella enterica enterica serovar Typhi
cauguagaauagcgccgu

SEQ ID NO: 1664458 - RNA, 21 nt, Salmonella enterica enterica serovar Typhi
cauguucaugaaccacgccaa

SEQ ID NO: 1664459 - RNA, 17 nt, Salmonella enterica enterica serovar Typhi
cauguuaaauacgccgc

SEQ ID NO: 1664460 - RNA, 22 nt, Salmonella enterica enterica serovar Typhi
cauguguaauguuuucugccag

SEQ ID NO: 1664461 - RNA, 18 nt, Salmonella enterica enterica serovar Typhi
caugauguucauccauau

SEQ ID NO: 1664462 - RNA, 22 nt, Salmonella enterica enterica serovar Typhi
caugauuaaagccacgucugau

SEQ ID NO: 1664463 - RNA, 22 nt, Salmonella enterica enterica serovar Typhi
caugaugggcgcacagcgccau

SEQ ID NO: 1664464 - RNA, 20 nt, Salmonella enterica enterica serovar Typhi
caugaugggcgcacagcgcc

SEQ ID NO: 1664465 - RNA, 13 nt, Salmonella enterica enterica serovar Typhi
caugcuaaaacag

SEQ ID NO: 1664466 - RNA, 13 nt, Salmonella enterica enterica serovar Typhi
caugccgccagac

SEQ ID NO: 1664467 - RNA, 21 nt, Salmonella enterica enterica serovar Typhi
ccaacauacaugccugcgcca

SEQ ID NO: 1664468 - RNA, 21 nt, Salmonella enterica enterica serovar Typhi
ccaacaucaguucagaaacgg

SEQ ID NO: 1664469 - RNA, 13 nt, Salmonella enterica enterica serovar Typhi
ccaauagcgcuga

SEQ ID NO: 1664470 - RNA, 21 nt, Salmonella enterica enterica serovar Typhi
ccaaucaacgccgccaggaua

SEQ ID NO: 1664471 - RNA, 15 nt, Salmonella enterica enterica serovar Typhi
ccaaucgagaagcca

SEQ ID NO: 1664472 - RNA, 22 nt, Salmonella enterica enterica serovar Typhi
ccacaagagcagcaacccugcc

SEQ ID NO: 1664473 - RNA, 22 nt, Salmonella enterica enterica serovar Typhi
ccacaacgugauaaccaacagg

SEQ ID NO: 1664474 - RNA, 12 nt, Salmonella enterica enterica serovar Typhi
ccacaaccggcu

SEQ ID NO: 1664475 - RNA, 22 nt, Salmonella enterica enterica serovar Typhi
ccaauguuaauaagcagaacgu

SEQ ID NO: 1664476 - RNA, 20 nt, Salmonella enterica enterica serovar Typhi
ccaccacgcccaacgaccau

SEQ ID NO: 1664477 - RNA, 19 nt, Salmonella enterica enterica serovar Typhi
ccacagugacccgccgcca

SEQ ID NO: 1664478 - RNA, 20 nt, Salmonella enterica enterica serovar Typhi
ccacagucgucuggcgcuau

SEQ ID NO: 1664479 - RNA, 17 nt, Salmonella enterica enterica serovar Typhi
ccacaggcagggcgaug

SEQ ID NO: 1664480 - RNA, 18 nt, Salmonella enterica enterica serovar Typhi
ccacaggcagggcgaugc

SEQ ID NO: 1664481 - RNA, 11 nt, Salmonella enterica enterica serovar Typhi
ccacagcgcca

SEQ ID NO: 1664482 - RNA, 20 nt, Salmonella enterica enterica serovar Typhi
ccacacaugcaaaaaagccc

SEQ ID NO: 1664483 - RNA, 20 nt, Salmonella enterica enterica serovar Typhi
ccaccggauggaucaucggc

SEQ ID NO: 1664484 - RNA, 16 nt, Salmonella enterica enterica serovar Typhi
ccaccaggaacgccau

SEQ ID NO: 1664485 - RNA, 18 nt, Salmonella enterica enterica serovar Typhi
ccaccaggaacgccauau

SEQ ID NO: 1664486 - RNA, 15 nt, Salmonella enterica enterica serovar Typhi
ccaccagcggacggc

SEQ ID NO: 1664487 - RNA, 14 nt, Salmonella enterica enterica serovar Typhi
caggcggcguuaua

SEQ ID NO: 1664488 - RNA, 19 nt, Salmonella enterica enterica serovar Typhi
caggcgcuuaucgccguaa

SEQ ID NO: 1664489 - RNA, 18 nt, Salmonella enterica enterica serovar Typhi
caggcgacaugacaucca

SEQ ID NO: 1664490 - RNA, 16 nt, Salmonella enterica enterica serovar Typhi
caggcgaauagcgcgc

SEQ ID NO: 1664491 - RNA, 13 nt, Salmonella enterica enterica serovar Typhi
caggcgacaugac

SEQ ID NO: 1664492 - RNA, 19 nt, Salmonella enterica enterica serovar Typhi
caggcgccaguuggcguac

SEQ ID NO: 1664493 - RNA, 18 nt, Salmonella enterica enterica serovar Typhi
caggccggauaagccgga

SEQ ID NO: 1664494 - RNA, 18 nt, Salmonella enterica enterica serovar Typhi
caggccggacaggcgacg

SEQ ID NO: 1664495 - RNA, 22 nt, Salmonella enterica enterica serovar Typhi
caggcugggcgauaaaccgcug

SEQ ID NO: 1664496 - RNA, 14 nt, Salmonella enterica enterica serovar Typhi
caggcugucugcca

SEQ ID NO: 1664497 - RNA, 21 nt, Salmonella enterica enterica serovar Typhi
caggcuuuccacguucccggu

SEQ ID NO: 1664498 - RNA, 18 nt, Salmonella enterica enterica serovar Typhi
cagggcagcgagcaccga

SEQ ID NO: 1664499 - RNA, 19 nt, Salmonella enterica enterica serovar Typhi
cagggcaacggccagcgca

SEQ ID NO: 1664500 - RNA, 17 nt, Salmonella enterica enterica serovar Typhi
caggcgucaaaacaggu

SEQ ID NO: 1664501 - RNA, 15 nt, Salmonella enterica enterica serovar Typhi
caggcuaaggcgucg

SEQ ID NO: 1664502 - RNA, 15 nt, Salmonella enterica enterica serovar Typhi
caggcguuacagacg

SEQ ID NO: 1664503 - RNA, 19 nt, Salmonella enterica enterica serovar Typhi
caggcgugguggauaucca

SEQ ID NO: 1664504 - RNA, 16 nt, Salmonella enterica enterica serovar Typhi
caggcucaucagcgcc

SEQ ID NO: 1664505 - RNA, 18 nt, Salmonella enterica enterica serovar Typhi
caggcucaucagcgccau

SEQ ID NO: 1664506 - RNA, 14 nt, Salmonella enterica enterica serovar Typhi
caggcucagcgcca

SEQ ID NO: 1664507 - RNA, 20 nt, Salmonella enterica enterica serovar Typhi
cagcuucugauacugcuccg

SEQ ID NO: 1664508 - RNA, 18 nt, Salmonella enterica enterica serovar Typhi
cagcuggcgauauccgug

SEQ ID NO: 1664509 - RNA, 16 nt, Salmonella enterica enterica serovar Typhi
cagcugacgacgccag

SEQ ID NO: 1664510 - RNA, 23 nt, Salmonella enterica enterica serovar Typhi
cagcucugccuguagcagcgcca

SEQ ID NO: 1664511 - RNA, 22 nt, Salmonella enterica enterica serovar Typhi
cagcucugugugacguugccga

SEQ ID NO: 1664512 - RNA, 18 nt, Salmonella enterica enterica serovar Typhi
cagcucguacuccgcgcg

SEQ ID NO: 1664513 - RNA, 19 nt, Salmonella enterica enterica serovar Typhi
caggauauacuucaucagg

SEQ ID NO: 1664514 - RNA, 17 nt, Salmonella enterica enterica serovar Typhi
caggauaaagaccggca

SEQ ID NO: 1664515 - RNA, 12 nt, Salmonella enterica enterica serovar Typhi
caggauaaagac

SEQ ID NO: 1664516 - RNA, 17 nt, Salmonella enterica enterica serovar Typhi
caggcaagacgcaugac

SEQ ID NO: 1664517 - RNA, 22 nt, Salmonella enterica enterica serovar Typhi
caggcaauaaaaaaggcagagc

SEQ ID NO: 1664518 - RNA, 14 nt, Salmonella enterica enterica serovar Typhi
caggcaaagcccca

SEQ ID NO: 1664519 - RNA, 20 nt, Salmonella enterica enterica serovar Typhi
caggauuauuacacacaguc

SEQ ID NO: 1664520 - RNA, 21 nt, Salmonella enterica enterica serovar Typhi
cagcuugccgucacaggcggc

SEQ ID NO: 1664521 - RNA, 14 nt, Salmonella enterica enterica serovar Typhi
cagcuugcuggccg

SEQ ID NO: 1664522 - RNA, 23 nt, Salmonella enterica enterica serovar Typhi
caggacauaaaacaguacgccga

SEQ ID NO: 1664523 - RNA, 14 nt, Salmonella enterica enterica serovar Typhi
caggacaucaaucg

SEQ ID NO: 1664524 - RNA, 15 nt, Salmonella enterica enterica serovar Typhi
caggaaugccacgau

SEQ ID NO: 1664525 - RNA, 20 nt, Salmonella enterica enterica serovar Typhi
caggaauuuaccggugcgga

SEQ ID NO: 1664526 - RNA, 15 nt, Salmonella enterica enterica serovar Typhi
cagcguacaucuucc

SEQ ID NO: 1664527 - RNA, 16 nt, Salmonella enterica enterica serovar Typhi
cagcguacaucuucca

SEQ ID NO: 1664528 - RNA, 15 nt, Salmonella enterica enterica serovar Typhi
cagcguaccgauaau

SEQ ID NO: 1664529 - RNA, 11 nt, Salmonella enterica enterica serovar Typhi
cagcguaacga

SEQ ID NO: 1664530 - RNA, 17 nt, Salmonella enterica enterica serovar Typhi
cagcguauugagcugga

SEQ ID NO: 1664531 - RNA, 16 nt, Salmonella enterica enterica serovar Typhi
cagcguauacgccgga

SEQ ID NO: 1664532 - RNA, 19 nt, Salmonella enterica enterica serovar Typhi
cagcgcgauacgcgacggc

SEQ ID NO: 1664533 - RNA, 13 nt, Salmonella enterica enterica serovar Typhi
cagcuacuggcca

SEQ ID NO: 1664534 - RNA, 19 nt, Salmonella enterica enterica serovar Typhi
cagcuaaaaacagcgcaau

SEQ ID NO: 1664535 - RNA, 15 nt, Salmonella enterica enterica serovar Typhi
cagcuacuucaggcu

SEQ ID NO: 1664536 - RNA, 13 nt, Salmonella enterica enterica serovar Typhi
cagcucgccaugc

SEQ ID NO: 1664537 - RNA, 22 nt, Salmonella enterica enterica serovar Typhi
caguggagaggccaccagcgcc

SEQ ID NO: 1664538 - RNA, 19 nt, Salmonella enterica enterica serovar Typhi
caguguucccugcgcugga

SEQ ID NO: 1664539 - RNA, 16 nt, Salmonella enterica enterica serovar Typhi
cagugauuaugcuccc

SEQ ID NO: 1664540 - RNA, 17 nt, Salmonella enterica enterica serovar Typhi
cagugauuaugcucccg

SEQ ID NO: 1664541 - RNA, 15 nt, Salmonella enterica enterica serovar Typhi
cagugccaguccggu

SEQ ID NO: 1664542 - RNA, 19 nt, Salmonella enterica enterica serovar Typhi
cauaaugaauuuaucccgu

SEQ ID NO: 1664543 - RNA, 19 nt, Salmonella enterica enterica serovar Typhi
cauaaugacguccaggccg

SEQ ID NO: 1664544 - RNA, 21 nt, Salmonella enterica enterica serovar Typhi
cauaccgucgugaaucaucau

SEQ ID NO: 1664545 - RNA, 16 nt, Salmonella enterica enterica serovar Typhi
cauaccgguugcgcgc

SEQ ID NO: 1664546 - RNA, 14 nt, Salmonella enterica enterica serovar Typhi
cauaccggugcgcc

SEQ ID NO: 1664547 - RNA, 14 nt, Salmonella enterica enterica serovar Typhi
cauacgccgccagc

SEQ ID NO: 1664548 - RNA, 19 nt, Salmonella enterica enterica serovar Typhi
cauacgccgcggucgagca

SEQ ID NO: 1664549 - RNA, 12 nt, Salmonella enterica enterica serovar Typhi
cauaaaucagau

SEQ ID NO: 1664550 - RNA, 17 nt, Salmonella enterica enterica serovar Typhi
cauaauaagcgcucagg

SEQ ID NO: 1664551 - RNA, 20 nt, Salmonella enterica enterica serovar Typhi
cauaauaugcaacacgccga

SEQ ID NO: 1664552 - RNA, 21 nt, Salmonella enterica enterica serovar Typhi
cauaauauucauaacgccgau

SEQ ID NO: 1664553 - RNA, 21 nt, Salmonella enterica enterica serovar Typhi
caguuuuuccuuucugcgcca

SEQ ID NO: 1664554 - RNA, 17 nt, Salmonella enterica enterica serovar Typhi
cagugaagaauggcgcc

SEQ ID NO: 1664555 - RNA, 23 nt, Salmonella enterica enterica serovar Typhi
cagugacauuuaucuuccggcau

SEQ ID NO: 1664556 - RNA, 19 nt, Salmonella enterica enterica serovar Typhi
cagucgacaguauagaaau

SEQ ID NO: 1664557 - RNA, 21 nt, Salmonella enterica enterica serovar Typhi
caguccgguggcgaaaacgcu

SEQ ID NO: 1664558 - RNA, 23 nt, Salmonella enterica enterica serovar Typhi
cagucaaaacgacauaaccggca

SEQ ID NO: 1664559 - RNA, 22 nt, Salmonella enterica enterica serovar Typhi
caguauccacgcggugcccugg

SEQ ID NO: 1664560 - RNA, 14 nt, Salmonella enterica enterica serovar Typhi
caguagucgcgcca

SEQ ID NO: 1664561 - RNA, 20 nt, Salmonella enterica enterica serovar Typhi
caguaaucccggucgcgcca

SEQ ID NO: 1664562 - RNA, 22 nt, Salmonella enterica enterica serovar Typhi
caguaacguucuucgauaaagg

SEQ ID NO: 1664563 - RNA, 21 nt, Salmonella enterica enterica serovar Typhi
caguaacacccgcgccuucgc

SEQ ID NO: 1664564 - RNA, 21 nt, Salmonella enterica enterica serovar Typhi
caguaaaagcccgcccagcau

SEQ ID NO: 1664565 - RNA, 17 nt, Salmonella enterica enterica serovar Typhi
caguaaauuaaacagcu

SEQ ID NO: 1664566 - RNA, 18 nt, Salmonella enterica enterica serovar Typhi
caguaacacaaucaggcg

SEQ ID NO: 1664567 - RNA, 17 nt, Salmonella enterica enterica serovar Typhi
caggugcuuaucugagu

SEQ ID NO: 1664568 - RNA, 16 nt, Salmonella enterica enterica serovar Typhi
caggugcuuaucugag

SEQ ID NO: 1664569 - RNA, 21 nt, Salmonella enterica enterica serovar Typhi
cagguuauuugccucuggcca

SEQ ID NO: 1664570 - RNA, 20 nt, Salmonella enterica enterica serovar Typhi
cagguuacucacugccgccc

SEQ ID NO: 1664571 - RNA, 15 nt, Salmonella enterica enterica serovar Typhi
cagguuagcagccac

SEQ ID NO: 1664572 - RNA, 22 nt, Salmonella enterica enterica serovar Typhi
cagguuauuguugcuacgcgcc

SEQ ID NO: 1664573 - RNA, 13 nt, Salmonella enterica enterica serovar Typhi
caggucugcgcgu

SEQ ID NO: 1664574 - RNA, 15 nt, Salmonella enterica enterica serovar Typhi
caggucgccagcggg

SEQ ID NO: 1664575 - RNA, 20 nt, Salmonella enterica enterica serovar Typhi
cauccggcaacuaucaugau

SEQ ID NO: 1664576 - RNA, 15 nt, Salmonella enterica enterica serovar Typhi
cauccggcaauaaug

SEQ ID NO: 1664577 - RNA, 22 nt, Salmonella enterica enterica serovar Typhi
cauccggccuggcgcaacguuu

SEQ ID NO: 1664578 - RNA, 18 nt, Salmonella enterica enterica serovar Typhi
cauccggcauuuaugcug

SEQ ID NO: 1664579 - RNA, 14 nt, Salmonella enterica enterica serovar Typhi
cauccucgccauaa

SEQ ID NO: 1664580 - RNA, 12 nt, Salmonella enterica enterica serovar Typhi
caucgaacgccg

SEQ ID NO: 1664581 - RNA, 18 nt, Salmonella enterica enterica serovar Typhi
caucaggcaucugaaaug

SEQ ID NO: 1664582 - RNA, 18 nt, Salmonella enterica enterica serovar Typhi
cauccagaaggcaaaaug

SEQ ID NO: 1664583 - RNA, 17 nt, Salmonella enterica enterica serovar Typhi
cauccagacagccgacg

SEQ ID NO: 1664584 - RNA, 20 nt, Salmonella enterica enterica serovar Typhi
cauccauugcgccacggaug

SEQ ID NO: 1664585 - RNA, 14 nt, Salmonella enterica enterica serovar Typhi
caucagcacaaaau

SEQ ID NO: 1664586 - RNA, 14 nt, Salmonella enterica enterica serovar Typhi
caucagccagcauc

SEQ ID NO: 1664587 - RNA, 22 nt, Salmonella enterica enterica serovar Typhi
caucagccauuuguuagcguuu

SEQ ID NO: 1664588 - RNA, 10 nt, Salmonella enterica enterica serovar Typhi
caucagcgcu

SEQ ID NO: 1664589 - RNA, 20 nt, Salmonella enterica enterica serovar Typhi
caucacgcgaagcggcguca

SEQ ID NO: 1664590 - RNA, 17 nt, Salmonella enterica enterica serovar Typhi
caucaauaaaaucaccg

SEQ ID NO: 1664591 - RNA, 19 nt, Salmonella enterica enterica serovar Typhi
cauaggccagcgucaccuc

SEQ ID NO: 1664592 - RNA, 14 nt, Salmonella enterica enterica serovar Typhi
cauagcaucguuac

SEQ ID NO: 1664593 - RNA, 15 nt, Salmonella enterica enterica serovar Typhi
cauagcgccccagua

SEQ ID NO: 1664594 - RNA, 18 nt, Salmonella enterica enterica serovar Typhi
cauagcgggagauugaaa

SEQ ID NO: 1664595 - RNA, 15 nt, Salmonella enterica enterica serovar Typhi
cauagcgccaucagg

SEQ ID NO: 1664596 - RNA, 16 nt, Salmonella enterica enterica serovar Typhi
cauagccggcgauagc

SEQ ID NO: 1664597 - RNA, 22 nt, Salmonella enterica enterica serovar Typhi
caucgcuaaccggcggcgucug

SEQ ID NO: 1664598 - RNA, 14 nt, Salmonella enterica enterica serovar Typhi
caucggcacagcca

SEQ ID NO: 1664599 - RNA, 14 nt, Salmonella enterica enterica serovar Typhi
caucggagauuuca

SEQ ID NO: 1664600 - RNA, 22 nt, Salmonella enterica enterica serovar Typhi
caucgcgcaaagccuuuccgca

SEQ ID NO: 1664601 - RNA, 14 nt, Salmonella enterica enterica serovar Typhi
caucgcgaucgcca

SEQ ID NO: 1664602 - RNA, 17 nt, Salmonella enterica enterica serovar Typhi
caucgccugaugaccgc

SEQ ID NO: 1664603 - RNA, 16 nt, Salmonella enterica enterica serovar Typhi
caucgccuuaacucuu

SEQ ID NO: 1664604 - RNA, 14 nt, Salmonella enterica enterica serovar Typhi
caucgcgccaugau

SEQ ID NO: 1664605 - RNA, 16 nt, Salmonella enterica enterica serovar Typhi
caucgccacgauagac

SEQ ID NO: 1664606 - RNA, 20 nt, Salmonella enterica enterica serovar Typhi
caucgcauuaacguccauac

SEQ ID NO: 1664607 - RNA, 19 nt, Salmonella enterica enterica serovar Typhi
caucgcaaauucaucgccg

SEQ ID NO: 1664608 - RNA, 13 nt, Salmonella enterica enterica serovar Typhi
cagcaauacgccc

SEQ ID NO: 1664609 - RNA, 17 nt, Salmonella enterica enterica serovar Typhi
cagcaaggcugccgcca

SEQ ID NO: 1664610 - RNA, 17 nt, Salmonella enterica enterica serovar Typhi
cagcaaguugcgccacu

SEQ ID NO: 1664611 - RNA, 19 nt, Salmonella enterica enterica serovar Typhi
cagcaaguauuggcugccg

SEQ ID NO: 1664612 - RNA, 20 nt, Salmonella enterica enterica serovar Typhi
cagcagccgggccagacgcu

SEQ ID NO: 1664613 - RNA, 19 nt, Salmonella enterica enterica serovar Typhi
cagcagccgguauccagcg

SEQ ID NO: 1664614 - RNA, 18 nt, Salmonella enterica enterica serovar Typhi
cagcacuaacagcagcag

SEQ ID NO: 1664615 - RNA, 16 nt, Salmonella enterica enterica serovar Typhi
cagcccgauacccgcc

SEQ ID NO: 1664616 - RNA, 15 nt, Salmonella enterica enterica serovar Typhi
cagcccccugccagu

SEQ ID NO: 1664617 - RNA, 13 nt, Salmonella enterica enterica serovar Typhi
cagccccaggcca

SEQ ID NO: 1664618 - RNA, 18 nt, Salmonella enterica enterica serovar Typhi
cagccaucuucugcguca

SEQ ID NO: 1664619 - RNA, 15 nt, Salmonella enterica enterica serovar Typhi
cagccauagcgcgcc

SEQ ID NO: 1664620 - RNA, 21 nt, Salmonella enterica enterica serovar Typhi
cagccaguuagcgaucgcgcc

SEQ ID NO: 1664621 - RNA, 21 nt, Salmonella enterica enterica serovar Typhi
cagccaguuggcuucagcaaa

SEQ ID NO: 1664622 - RNA, 22 nt, Salmonella enterica enterica serovar Typhi
cagccauaaucaguacugcgcc

SEQ ID NO: 1664623 - RNA, 16 nt, Salmonella enterica enterica serovar Typhi
cagccacguugcgcgc

SEQ ID NO: 1664624 - RNA, 23 nt, Salmonella enterica enterica serovar Typhi
cagcaugguguguucccgcgcca

SEQ ID NO: 1664625 - RNA, 16 nt, Salmonella enterica enterica serovar Typhi
cagccaaucauaaacg

SEQ ID NO: 1664626 - RNA, 14 nt, Salmonella enterica enterica serovar Typhi
cagccaaucauaaa

SEQ ID NO: 1664627 - RNA, 15 nt, Salmonella enterica enterica serovar Typhi
cagcauuagcgccac

SEQ ID NO: 1664628 - RNA, 23 nt, Salmonella enterica enterica serovar Typhi
cagcauguuucuccugccagcga

SEQ ID NO: 1664629 - RNA, 17 nt, Salmonella enterica enterica serovar Typhi
cagcaucggcagcgcca

SEQ ID NO: 1664630 - RNA, 21 nt, Salmonella enterica enterica serovar Typhi
cagcgcagagugaccagcggu

SEQ ID NO: 1664631 - RNA, 16 nt, Salmonella enterica enterica serovar Typhi
cagcgauuccgucagg

SEQ ID NO: 1664632 - RNA, 17 nt, Salmonella enterica enterica serovar Typhi
cagcgauugcgccagac

SEQ ID NO: 1664633 - RNA, 12 nt, Salmonella enterica enterica serovar Typhi
cagcgcaacgcc

SEQ ID NO: 1664634 - RNA, 19 nt, Salmonella enterica enterica serovar Typhi
cagcgaugagcgccagcaa

SEQ ID NO: 1664635 - RNA, 19 nt, Salmonella enterica enterica serovar Typhi
cagcgaccacgacgccgga

SEQ ID NO: 1664636 - RNA, 16 nt, Salmonella enterica enterica serovar Typhi
cagcgaccacgccacc

SEQ ID NO: 1664637 - RNA, 21 nt, Salmonella enterica enterica serovar Typhi
cagcgacaguaguaucaucca

SEQ ID NO: 1664638 - RNA, 19 nt, Salmonella enterica enterica serovar Typhi
cagccgguuuauccgcaac

SEQ ID NO: 1664639 - RNA, 23 nt, Salmonella enterica enterica serovar Typhi
cagccuaccugccgccauaacgc

SEQ ID NO: 1664640 - RNA, 20 nt, Salmonella enterica enterica serovar Typhi
cagccuauccccgaaaguua

SEQ ID NO: 1664641 - RNA, 16 nt, Salmonella enterica enterica serovar Typhi
cagcgaaagcugccuu

SEQ ID NO: 1664642 - RNA, 17 nt, Salmonella enterica enterica serovar Typhi
cagcgaaaugcgaaucc

SEQ ID NO: 1664643 - RNA, 20 nt, Salmonella enterica enterica serovar Typhi
cagcgccgucgccaucacca

SEQ ID NO: 1664644 - RNA, 14 nt, Salmonella enterica enterica serovar Typhi
cagcgccgccagaa

SEQ ID NO: 1664645 - RNA, 23 nt, Salmonella enterica enterica serovar Typhi
cagcgccgcgccgauagcgucuc

SEQ ID NO: 1664646 - RNA, 18 nt, Salmonella enterica enterica serovar Typhi
cagcgccgucgccaucac

SEQ ID NO: 1664647 - RNA, 19 nt, Salmonella enterica enterica serovar Typhi
cagcgccaugaucgauagc

SEQ ID NO: 1664648 - RNA, 15 nt, Salmonella enterica enterica serovar Typhi
cagcgccaucaggca

SEQ ID NO: 1664649 - RNA, 12 nt, Salmonella enterica enterica serovar Typhi
cagcgccaugaa

SEQ ID NO: 1664650 - RNA, 19 nt, Salmonella enterica enterica serovar Typhi
cagcgcauagcugcccugu

SEQ ID NO: 1664651 - RNA, 13 nt, Salmonella enterica enterica serovar Typhi
cagcgccagcgac

SEQ ID NO: 1664652 - RNA, 18 nt, Salmonella enterica enterica serovar Typhi
cagcgccacccauuuucc

SEQ ID NO: 1664653 - RNA, 16 nt, Salmonella enterica enterica serovar Typhi
caccuccagcgccugu

SEQ ID NO: 1664654 - RNA, 13 nt, Salmonella enterica enterica serovar Typhi
cacgccaucgcgg

SEQ ID NO: 1664655 - RNA, 14 nt, Salmonella enterica enterica serovar Typhi
cacgcggcgcggaa

SEQ ID NO: 1664656 - RNA, 16 nt, Salmonella enterica enterica serovar Typhi
cacgcggcaucaggca

SEQ ID NO: 1664657 - RNA, 15 nt, Salmonella enterica enterica serovar Typhi
cacgccguuugccau

SEQ ID NO: 1664658 - RNA, 13 nt, Salmonella enterica enterica serovar Typhi
cacgccuccauac

SEQ ID NO: 1664659 - RNA, 17 nt, Salmonella enterica enterica serovar Typhi
cacgccuaaugaagcgc

SEQ ID NO: 1664660 - RNA, 12 nt, Salmonella enterica enterica serovar Typhi
cacgcucauagc

SEQ ID NO: 1664661 - RNA, 14 nt, Salmonella enterica enterica serovar Typhi
cacgcguuauacgc

SEQ ID NO: 1664662 - RNA, 15 nt, Salmonella enterica enterica serovar Typhi
cacgcucgcuggugc

SEQ ID NO: 1664663 - RNA, 13 nt, Salmonella enterica enterica serovar Typhi
cacgcugccgccg

SEQ ID NO: 1664664 - RNA, 17 nt, Salmonella enterica enterica serovar Typhi
cacuacggcaaacgcug

SEQ ID NO: 1664665 - RNA, 21 nt, Salmonella enterica enterica serovar Typhi
cacuauaaaaauaccggcauc

SEQ ID NO: 1664666 - RNA, 17 nt, Salmonella enterica enterica serovar Typhi
cacuaccauuuccggcg

SEQ ID NO: 1664667 - RNA, 21 nt, Salmonella enterica enterica serovar Typhi
cacguguguugcgucaacgca

SEQ ID NO: 1664668 - RNA, 22 nt, Salmonella enterica enterica serovar Typhi
cacguuaaacaccucaccggcu

SEQ ID NO: 1664669 - RNA, 15 nt, Salmonella enterica enterica serovar Typhi
cagacgcgcagcacc

SEQ ID NO: 1664670 - RNA, 18 nt, Salmonella enterica enterica serovar Typhi
cagacggcaagcaaccgu

SEQ ID NO: 1664671 - RNA, 23 nt, Salmonella enterica enterica serovar Typhi
cagacggcgcuaauguacgccua

SEQ ID NO: 1664672 - RNA, 15 nt, Salmonella enterica enterica serovar Typhi
cagacgguuaagccg

SEQ ID NO: 1664673 - RNA, 17 nt, Salmonella enterica enterica serovar Typhi
cagacuuagggcggaga

SEQ ID NO: 1664674 - RNA, 18 nt, Salmonella enterica enterica serovar Typhi
cagacgugcaauaucgcg

SEQ ID NO: 1664675 - RNA, 15 nt, Salmonella enterica enterica serovar Typhi
cagacguuuaagcau

SEQ ID NO: 1664676 - RNA, 18 nt, Salmonella enterica enterica serovar Typhi
cagacuaaaaagcgcguc

SEQ ID NO: 1664677 - RNA, 19 nt, Salmonella enterica enterica serovar Typhi
cagacuguaaaucugccgu

SEQ ID NO: 1664678 - RNA, 16 nt, Salmonella enterica enterica serovar Typhi
cagagcaucuaccgca

SEQ ID NO: 1664679 - RNA, 17 nt, Salmonella enterica enterica serovar Typhi
cagagcggggaaacucu

SEQ ID NO: 1664680 - RNA, 14 nt, Salmonella enterica enterica serovar Typhi
cagaguacgucgcc

SEQ ID NO: 1664681 - RNA, 20 nt, Salmonella enterica enterica serovar Typhi
cagaguacuggaauaucuaa

SEQ ID NO: 1664682 - RNA, 21 nt, Salmonella enterica enterica serovar Typhi
cagcaaacgccauagcaucga

SEQ ID NO: 1664683 - RNA, 23 nt, Salmonella enterica enterica serovar Typhi
cagcaaaauuuugcgcagaccgc

SEQ ID NO: 1664684 - RNA, 13 nt, Salmonella enterica enterica serovar Typhi
cagcaaaccgaua

SEQ ID NO: 1664685 - RNA, 15 nt, Salmonella enterica enterica serovar Typhi
cagauuuagguucug

SEQ ID NO: 1664686 - RNA, 13 nt, Salmonella enterica enterica serovar Typhi
cagauuguugccg

SEQ ID NO: 1664687 - RNA, 17 nt, Salmonella enterica enterica serovar Typhi
cagauuguugccgucuu

SEQ ID NO: 1664688 - RNA, 14 nt, Salmonella enterica enterica serovar Typhi
cagaucuaucugaa

SEQ ID NO: 1664689 - RNA, 17 nt, Salmonella enterica enterica serovar Typhi
cagauugccacaggacc

SEQ ID NO: 1664690 - RNA, 22 nt, Salmonella enterica enterica serovar Typhi
cagauuggugaugcgcaacguu

SEQ ID NO: 1664691 - RNA, 22 nt, Salmonella enterica enterica serovar Typhi
cagaucgccacgauugaucuca

SEQ ID NO: 1664692 - RNA, 18 nt, Salmonella enterica enterica serovar Typhi
cagaucggcaugauggcg

SEQ ID NO: 1664693 - RNA, 18 nt, Salmonella enterica enterica serovar Typhi
cagauaacaccagcgauc

SEQ ID NO: 1664694 - RNA, 23 nt, Salmonella enterica enterica serovar Typhi
cagauaacaccagcgauccagau

SEQ ID NO: 1664695 - RNA, 17 nt, Salmonella enterica enterica serovar Typhi
cagauaaagcagcgaca

SEQ ID NO: 1664696 - RNA, 13 nt, Salmonella enterica enterica serovar Typhi
cagauaaccgucg

SEQ ID NO: 1664697 - RNA, 21 nt, Salmonella enterica enterica serovar Typhi
cagauccaucgccugcggcgu

SEQ ID NO: 1664698 - RNA, 19 nt, Salmonella enterica enterica serovar Typhi
cagaucccagguaaccgcu

SEQ ID NO: 1664699 - RNA, 17 nt, Salmonella enterica enterica serovar Typhi
cagaccgucaugacguc

SEQ ID NO: 1664700 - RNA, 19 nt, Salmonella enterica enterica serovar Typhi
cagaccuuaucgcagucag

SEQ ID NO: 1664701 - RNA, 13 nt, Salmonella enterica enterica serovar Typhi
cagaccgccaugc

SEQ ID NO: 1664702 - RNA, 15 nt, Salmonella enterica enterica serovar Typhi
cagaccggagcgugc

SEQ ID NO: 1664703 - RNA, 15 nt, Salmonella enterica enterica serovar Typhi
cagaccggcaaucaa

SEQ ID NO: 1664704 - RNA, 15 nt, Salmonella enterica enterica serovar Typhi
cagaccggcagccug

SEQ ID NO: 1664705 - RNA, 21 nt, Salmonella enterica enterica serovar Typhi
cagaccuuaucgcagucagcc

SEQ ID NO: 1664706 - RNA, 20 nt, Salmonella enterica enterica serovar Typhi
cagacgaaaaaaaagacgcu

SEQ ID NO: 1664707 - RNA, 20 nt, Salmonella enterica enterica serovar Typhi
cagacauauacucuucgcca

SEQ ID NO: 1664708 - RNA, 15 nt, Salmonella enterica enterica serovar Typhi
cagacaggugaacau

SEQ ID NO: 1664709 - RNA, 14 nt, Salmonella enterica enterica serovar Typhi
cagacaucgcgcca

SEQ ID NO: 1664710 - RNA, 18 nt, Salmonella enterica enterica serovar Typhi
cagacaucggagauuuca

SEQ ID NO: 1664711 - RNA, 18 nt, Salmonella enterica enterica serovar Typhi
cagacaugaccgcacagc

SEQ ID NO: 1664712 - RNA, 22 nt, Salmonella enterica enterica serovar Typhi
cagacauuuugaguugccgauc

SEQ ID NO: 1664713 - RNA, 14 nt, Salmonella enterica enterica serovar Typhi
cagacacugcacca

SEQ ID NO: 1664714 - RNA, 13 nt, Salmonella enterica enterica serovar Typhi
cagacacugccac

SEQ ID NO: 1664715 - RNA, 21 nt, Salmonella enterica enterica serovar Typhi
cagacacggugugccgccauc

SEQ ID NO: 1664716 - RNA, 18 nt, Salmonella enterica enterica serovar Typhi
cagacacugccaccgcuc

SEQ ID NO: 1664717 - RNA, 13 nt, Salmonella enterica enterica serovar Typhi
cagacagccgauc

SEQ ID NO: 1664718 - RNA, 15 nt, Salmonella enterica enterica serovar Typhi
cagacaggacgccag

SEQ ID NO: 1664719 - RNA, 23 nt, Salmonella enterica enterica serovar Typhi
cagacagccauauuuaugcagcg

SEQ ID NO: 1664720 - RNA, 18 nt, Salmonella enterica enterica serovar Typhi
cagacagacguugcgcca

SEQ ID NO: 1664721 - RNA, 22 nt, Salmonella enterica enterica serovar Typhi
cagaccccaguaauccggcaac

SEQ ID NO: 1664722 - RNA, 18 nt, Salmonella enterica enterica serovar Typhi
cagaccauucaaccagcc

SEQ ID NO: 1664723 - RNA, 11 nt, Salmonella enterica enterica serovar Typhi
cacuccggcau

SEQ ID NO: 1664724 - RNA, 13 nt, Salmonella enterica enterica serovar Typhi
cagacaagcacau

SEQ ID NO: 1664725 - RNA, 20 nt, Salmonella enterica enterica serovar Typhi
cagacaauuuccgccgccag

SEQ ID NO: 1664726 - RNA, 20 nt, Salmonella enterica enterica serovar Typhi
cagacaaucugugugggcac

SEQ ID NO: 1664727 - RNA, 16 nt, Salmonella enterica enterica serovar Typhi
cagacaacgccgccug

SEQ ID NO: 1664728 - RNA, 16 nt, Salmonella enterica enterica serovar Typhi
cagacaacguccugcg

SEQ ID NO: 1664729 - RNA, 14 nt, Salmonella enterica enterica serovar Typhi
cagaaaaaccuccg

SEQ ID NO: 1664730 - RNA, 16 nt, Salmonella enterica enterica serovar Typhi
cagaacggcagcgucc

SEQ ID NO: 1664731 - RNA, 21 nt, Salmonella enterica enterica serovar Typhi
cagaacggcagcguccgccau

SEQ ID NO: 1664732 - RNA, 17 nt, Salmonella enterica enterica serovar Typhi
gauaugcagcagccagu

SEQ ID NO: 1664733 - RNA, 16 nt, Salmonella enterica enterica serovar Typhi
gauauagcgccaugcg

SEQ ID NO: 1664734 - RNA, 13 nt, Salmonella enterica enterica serovar Typhi
gauauaagcgcca

SEQ ID NO: 1664735 - RNA, 22 nt, Salmonella enterica enterica serovar Typhi
gauauugccgaccgccagcaga

SEQ ID NO: 1664736 - RNA, 14 nt, Salmonella enterica enterica serovar Typhi
gauauucaacagcc

SEQ ID NO: 1664737 - RNA, 13 nt, Salmonella enterica enterica serovar Typhi
gauauucaucgcc

SEQ ID NO: 1664738 - RNA, 13 nt, Salmonella enterica enterica serovar Typhi
gaucagcagaucc

SEQ ID NO: 1664739 - RNA, 18 nt, Salmonella enterica enterica serovar Typhi
gauagcgacggcgcgcca

SEQ ID NO: 1664740 - RNA, 17 nt, Salmonella enterica enterica serovar Typhi
gauagcgaggcagcagg

SEQ ID NO: 1664741 - RNA, 16 nt, Salmonella enterica enterica serovar Typhi
gauagcgaggcguuuu

SEQ ID NO: 1664742 - RNA, 17 nt, Salmonella enterica enterica serovar Typhi
gauagccguucuccagc

SEQ ID NO: 1664743 - RNA, 12 nt, Salmonella enterica enterica serovar Typhi
gauagccgccag

SEQ ID NO: 1664744 - RNA, 13 nt, Salmonella enterica enterica serovar Typhi
gauagcgccgcau

SEQ ID NO: 1664745 - RNA, 19 nt, Salmonella enterica enterica serovar Typhi
gauagcgcagcacgguaac

SEQ ID NO: 1664746 - RNA, 23 nt, Salmonella enterica enterica serovar Typhi
gauagcgccccaaagcgcauccg

SEQ ID NO: 1664747 - RNA, 14 nt, Salmonella enterica enterica serovar Typhi
gauagcggcgcaga

SEQ ID NO: 1664748 - RNA, 21 nt, Salmonella enterica enterica serovar Typhi
gauacgcagcaccgccgcgau

SEQ ID NO: 1664749 - RNA, 15 nt, Salmonella enterica enterica serovar Typhi
gauacgauugcgcgu

SEQ ID NO: 1664750 - RNA, 19 nt, Salmonella enterica enterica serovar Typhi
gauacgauugcgcguguua

SEQ ID NO: 1664751 - RNA, 15 nt, Salmonella enterica enterica serovar Typhi
gauagacaugaccgg

SEQ ID NO: 1664752 - RNA, 18 nt, Salmonella enterica enterica serovar Typhi
gauagagacugccgccgu

SEQ ID NO: 1664753 - RNA, 15 nt, Salmonella enterica enterica serovar Typhi
gauaaaccaggcagc

SEQ ID NO: 1664754 - RNA, 18 nt, Salmonella enterica enterica serovar Typhi
gauaaacgggaaguaagg

SEQ ID NO: 1664755 - RNA, 17 nt, Salmonella enterica enterica serovar Typhi
gauaaagcagcgacaau

SEQ ID NO: 1664756 - RNA, 15 nt, Salmonella enterica enterica serovar Typhi
gauaaagcagcgaca

SEQ ID NO: 1664757 - RNA, 18 nt, Salmonella enterica enterica serovar Typhi
gauaaagcugacgcgccu

SEQ ID NO: 1664758 - RNA, 19 nt, Salmonella enterica enterica serovar Typhi
gauaaaguacggcgcgcca

SEQ ID NO: 1664759 - RNA, 20 nt, Salmonella enterica enterica serovar Typhi
gauacagccgacuauuccgc

SEQ ID NO: 1664760 - RNA, 21 nt, Salmonella enterica enterica serovar Typhi
gauacaagguauccgccauau

SEQ ID NO: 1664761 - RNA, 16 nt, Salmonella enterica enterica serovar Typhi
gauaaagcuucugcgc

SEQ ID NO: 1664762 - RNA, 12 nt, Salmonella enterica enterica serovar Typhi
gauaaaucagcc

SEQ ID NO: 1664763 - RNA, 15 nt, Salmonella enterica enterica serovar Typhi
gauacauggcuauuc

SEQ ID NO: 1664764 - RNA, 14 nt, Salmonella enterica enterica serovar Typhi
gaguuugucaucca

SEQ ID NO: 1664765 - RNA, 16 nt, Salmonella enterica enterica serovar Typhi
gauaaaaaaaguaucc

SEQ ID NO: 1664766 - RNA, 21 nt, Salmonella enterica enterica serovar Typhi
gauaaaaacccaccagcgcca

SEQ ID NO: 1664767 - RNA, 19 nt, Salmonella enterica enterica serovar Typhi
gauaaaauucccggcggaa

SEQ ID NO: 1664768 - RNA, 16 nt, Salmonella enterica enterica serovar Typhi
gauaaacaccggaauu

SEQ ID NO: 1664769 - RNA, 14 nt, Salmonella enterica enterica serovar Typhi
gauaaacagcagcg

SEQ ID NO: 1664770 - RNA, 20 nt, Salmonella enterica enterica serovar Typhi
gagugcuuauguaggccuga

SEQ ID NO: 1664771 - RNA, 20 nt, Salmonella enterica enterica serovar Typhi
gaguguggaaaacagcgccg

SEQ ID NO: 1664772 - RNA, 20 nt, Salmonella enterica enterica serovar Typhi
gaguuaacuucuccgccauc

SEQ ID NO: 1664773 - RNA, 20 nt, Salmonella enterica enterica serovar Typhi
gaguuaaugccaucaucagu

SEQ ID NO: 1664774 - RNA, 12 nt, Salmonella enterica enterica serovar Typhi
gagucguuaucc

SEQ ID NO: 1664775 - RNA, 16 nt, Salmonella enterica enterica serovar Typhi
gagguuuucucaucca

SEQ ID NO: 1664776 - RNA, 20 nt, Salmonella enterica enterica serovar Typhi
gagguuuuucugaugcgccu

SEQ ID NO: 1664777 - RNA, 22 nt, Salmonella enterica enterica serovar Typhi
gaggugcucucccagcugagcu

SEQ ID NO: 1664778 - RNA, 16 nt, Salmonella enterica enterica serovar Typhi
gaggccaccagcgcca

SEQ ID NO: 1664779 - RNA, 17 nt, Salmonella enterica enterica serovar Typhi
gagggcgaacuggcggu

SEQ ID NO: 1664780 - RNA, 21 nt, Salmonella enterica enterica serovar Typhi
gaucuguguacuuuuaacgcc

SEQ ID NO: 1664781 - RNA, 18 nt, Salmonella enterica enterica serovar Typhi
gaucuuaucuuucagcgc

SEQ ID NO: 1664782 - RNA, 18 nt, Salmonella enterica enterica serovar Typhi
gaucuucaucccauccgg

SEQ ID NO: 1664783 - RNA, 14 nt, Salmonella enterica enterica serovar Typhi
gaucucgucgccgg

SEQ ID NO: 1664784 - RNA, 14 nt, Salmonella enterica enterica serovar Typhi
gaucggcuggcgca

SEQ ID NO: 1664785 - RNA, 20 nt, Salmonella enterica enterica serovar Typhi
gaucggcuggguuuccggau

SEQ ID NO: 1664786 - RNA, 17 nt, Salmonella enterica enterica serovar Typhi
gaucggggcgaccggcu

SEQ ID NO: 1664787 - RNA, 20 nt, Salmonella enterica enterica serovar Typhi
gaucggccagcaagcggcga

SEQ ID NO: 1664788 - RNA, 18 nt, Salmonella enterica enterica serovar Typhi
gaucggcaagcaucugau

SEQ ID NO: 1664789 - RNA, 15 nt, Salmonella enterica enterica serovar Typhi
gaucgaucccggcaa

SEQ ID NO: 1664790 - RNA, 15 nt, Salmonella enterica enterica serovar Typhi
gaucgcaaggcgcga

SEQ ID NO: 1664791 - RNA, 17 nt, Salmonella enterica enterica serovar Typhi
gaucgauauccgugcgc

SEQ ID NO: 1664792 - RNA, 20 nt, Salmonella enterica enterica serovar Typhi
gaucgauauccgugcgcaau

SEQ ID NO: 1664793 - RNA, 17 nt, Salmonella enterica enterica serovar Typhi
gauccuggcgaaagcga

SEQ ID NO: 1664794 - RNA, 18 nt, Salmonella enterica enterica serovar Typhi
gauccagcgauugacggu

SEQ ID NO: 1664795 - RNA, 15 nt, Salmonella enterica enterica serovar Typhi
gauccgccgucggca

SEQ ID NO: 1664796 - RNA, 11 nt, Salmonella enterica enterica serovar Typhi
gaucagcgcca

SEQ ID NO: 1664797 - RNA, 19 nt, Salmonella enterica enterica serovar Typhi
gaucagcgccauuaacgcc

SEQ ID NO: 1664798 - RNA, 18 nt, Salmonella enterica enterica serovar Typhi
gaucaggaaaucuuccag

SEQ ID NO: 1664799 - RNA, 20 nt, Salmonella enterica enterica serovar Typhi
gaucaugaggaugagcguuu

SEQ ID NO: 1664800 - RNA, 14 nt, Salmonella enterica enterica serovar Typhi
gaucaguuccggau

SEQ ID NO: 1664801 - RNA, 18 nt, Salmonella enterica enterica serovar Typhi
gaucaguggcgccgcaau

SEQ ID NO: 1664802 - RNA, 20 nt, Salmonella enterica enterica serovar Typhi
gaucaucuucacuucacaaa

SEQ ID NO: 1664803 - RNA, 22 nt, Salmonella enterica enterica serovar Typhi
gaucauccggguuaaaccagcu

SEQ ID NO: 1664804 - RNA, 17 nt, Salmonella enterica enterica serovar Typhi
gaugccguugaccauau

SEQ ID NO: 1664805 - RNA, 20 nt, Salmonella enterica enterica serovar Typhi
gaugcgaaucuucaucgucg

SEQ ID NO: 1664806 - RNA, 18 nt, Salmonella enterica enterica serovar Typhi
gaugcgaguagcaaaucc

SEQ ID NO: 1664807 - RNA, 17 nt, Salmonella enterica enterica serovar Typhi
gaugccuuccacggcga

SEQ ID NO: 1664808 - RNA, 19 nt, Salmonella enterica enterica serovar Typhi
gaugccgccgcaacgcgca

SEQ ID NO: 1664809 - RNA, 18 nt, Salmonella enterica enterica serovar Typhi
gaugcgccccgcuucccg

SEQ ID NO: 1664810 - RNA, 17 nt, Salmonella enterica enterica serovar Typhi
gaugcucagggcauccg

SEQ ID NO: 1664811 - RNA, 22 nt, Salmonella enterica enterica serovar Typhi
gaugcggcuagcgccuuauccg

SEQ ID NO: 1664812 - RNA, 19 nt, Salmonella enterica enterica serovar Typhi
gauggcgcuacgcuuauca

SEQ ID NO: 1664813 - RNA, 18 nt, Salmonella enterica enterica serovar Typhi
gauggcgcgcuuaucugg

SEQ ID NO: 1664814 - RNA, 21 nt, Salmonella enterica enterica serovar Typhi
gauggcgcuaaugcuuauccg

SEQ ID NO: 1664815 - RNA, 19 nt, Salmonella enterica enterica serovar Typhi
gauggcgcgacgcuuauca

SEQ ID NO: 1664816 - RNA, 17 nt, Salmonella enterica enterica serovar Typhi
gauggccaaugaugcgc

SEQ ID NO: 1664817 - RNA, 20 nt, Salmonella enterica enterica serovar Typhi
gauggcacugcgcuuauccg

SEQ ID NO: 1664818 - RNA, 15 nt, Salmonella enterica enterica serovar Typhi
gaugcucgcucauca

SEQ ID NO: 1664819 - RNA, 18 nt, Salmonella enterica enterica serovar Typhi
gauggcaaaaacagccgg

SEQ ID NO: 1664820 - RNA, 20 nt, Salmonella enterica enterica serovar Typhi
gauggccgguuauaccgcca

SEQ ID NO: 1664821 - RNA, 18 nt, Salmonella enterica enterica serovar Typhi
gauggccagcaccagcau

SEQ ID NO: 1664822 - RNA, 23 nt, Salmonella enterica enterica serovar Typhi
gauggcgacuaacgucuuauccg

SEQ ID NO: 1664823 - RNA, 17 nt, Salmonella enterica enterica serovar Typhi
gauucgagcgcagcgag

SEQ ID NO: 1664824 - RNA, 22 nt, Salmonella enterica enterica serovar Typhi
gauuacucucuugccagcgcau

SEQ ID NO: 1664825 - RNA, 21 nt, Salmonella enterica enterica serovar Typhi
gauuccgugguuuguugcgcg

SEQ ID NO: 1664826 - RNA, 17 nt, Salmonella enterica enterica serovar Typhi
gauucgcuacugcaucu

SEQ ID NO: 1664827 - RNA, 13 nt, Salmonella enterica enterica serovar Typhi
gauucgccagcgu

SEQ ID NO: 1664828 - RNA, 18 nt, Salmonella enterica enterica serovar Typhi
gauucgugacaucaagcc

SEQ ID NO: 1664829 - RNA, 19 nt, Salmonella enterica enterica serovar Typhi
gauucgcuggccucggcga

SEQ ID NO: 1664830 - RNA, 13 nt, Salmonella enterica enterica serovar Typhi
gauuggucugauu

SEQ ID NO: 1664831 - RNA, 15 nt, Salmonella enterica enterica serovar Typhi
gauugaaacgaaaac

SEQ ID NO: 1664832 - RNA, 17 nt, Salmonella enterica enterica serovar Typhi
gauuaucguccggcauc

SEQ ID NO: 1664833 - RNA, 18 nt, Salmonella enterica enterica serovar Typhi
gauuagccccagcgccag

SEQ ID NO: 1664834 - RNA, 13 nt, Salmonella enterica enterica serovar Typhi
gauuugcggcaau

SEQ ID NO: 1664835 - RNA, 17 nt, Salmonella enterica enterica serovar Typhi
gauuugacaucaggauu

SEQ ID NO: 1664836 - RNA, 23 nt, Salmonella enterica enterica serovar Typhi
gauuucuuaauuccucagaaucc

SEQ ID NO: 1664837 - RNA, 15 nt, Salmonella enterica enterica serovar Typhi
gauuuaucacguccu

SEQ ID NO: 1664838 - RNA, 20 nt, Salmonella enterica enterica serovar Typhi
gauuuacaaccgcaccggau

SEQ ID NO: 1664839 - RNA, 12 nt, Salmonella enterica enterica serovar Typhi
gauuuacuccaa

SEQ ID NO: 1664840 - RNA, 14 nt, Salmonella enterica enterica serovar Typhi
gauuuccagcgccg

SEQ ID NO: 1664841 - RNA, 14 nt, Salmonella enterica enterica serovar Typhi
gauuucaucaggcu

SEQ ID NO: 1664842 - RNA, 21 nt, Salmonella enterica enterica serovar Typhi
gcaaaccgaauucguccacac

SEQ ID NO: 1664843 - RNA, 19 nt, Salmonella enterica enterica serovar Typhi
gcaaaccccugcucgcgca

SEQ ID NO: 1664844 - RNA, 18 nt, Salmonella enterica enterica serovar Typhi
gcaaacccacccgguaau

SEQ ID NO: 1664845 - RNA, 22 nt, Salmonella enterica enterica serovar Typhi
gcaaaccaucgucggacaacgu

SEQ ID NO: 1664846 - RNA, 20 nt, Salmonella enterica enterica serovar Typhi
gcaaacauagccucaagaga

SEQ ID NO: 1664847 - RNA, 12 nt, Salmonella enterica enterica serovar Typhi
gcaaacagcacg

SEQ ID NO: 1664848 - RNA, 15 nt, Salmonella enterica enterica serovar Typhi
gcaaauuuaagccag

SEQ ID NO: 1664849 - RNA, 21 nt, Salmonella enterica enterica serovar Typhi
gcaaaugucagaucguaugcg

SEQ ID NO: 1664850 - RNA, 17 nt, Salmonella enterica enterica serovar Typhi
gcaaaucugccgucauc

SEQ ID NO: 1664851 - RNA, 15 nt, Salmonella enterica enterica serovar Typhi
gcaaaucuuguaggc

SEQ ID NO: 1664852 - RNA, 19 nt, Salmonella enterica enterica serovar Typhi
gcaaauccaucucaggccg

SEQ ID NO: 1664853 - RNA, 20 nt, Salmonella enterica enterica serovar Typhi
gcaaagucuuuuguauugcg

SEQ ID NO: 1664854 - RNA, 18 nt, Salmonella enterica enterica serovar Typhi
gcaaagcccaucagcgcc

SEQ ID NO: 1664855 - RNA, 19 nt, Salmonella enterica enterica serovar Typhi
gcaaagagguugcugauua

SEQ ID NO: 1664856 - RNA, 18 nt, Salmonella enterica enterica serovar Typhi
gcaaaggaaugcuuuaca

SEQ ID NO: 1664857 - RNA, 20 nt, Salmonella enterica enterica serovar Typhi
gcaaaggaccaacaccagcc

SEQ ID NO: 1664858 - RNA, 22 nt, Salmonella enterica enterica serovar Typhi
gcaagacacagcgucgcgcgau

SEQ ID NO: 1664859 - RNA, 17 nt, Salmonella enterica enterica serovar Typhi
gcaacuucagaauccag

SEQ ID NO: 1664860 - RNA, 16 nt, Salmonella enterica enterica serovar Typhi
gcaagcacuggucaag

SEQ ID NO: 1664861 - RNA, 19 nt, Salmonella enterica enterica serovar Typhi
gcaacugcugcgcgugcug

SEQ ID NO: 1664862 - RNA, 18 nt, Salmonella enterica enterica serovar Typhi
gcaacugauuaaucugcc

SEQ ID NO: 1664863 - RNA, 15 nt, Salmonella enterica enterica serovar Typhi
gcaacugccggcuua

SEQ ID NO: 1664864 - RNA, 20 nt, Salmonella enterica enterica serovar Typhi
gcaagcugcuuuuugagcgg

SEQ ID NO: 1664865 - RNA, 14 nt, Salmonella enterica enterica serovar Typhi
gcaagcgccagcau

SEQ ID NO: 1664866 - RNA, 19 nt, Salmonella enterica enterica serovar Typhi
gcaagccgaacucuuccac

SEQ ID NO: 1664867 - RNA, 13 nt, Salmonella enterica enterica serovar Typhi
gcaauugccgaua

SEQ ID NO: 1664868 - RNA, 17 nt, Salmonella enterica enterica serovar Typhi
gcaaugauaacggcgcc

SEQ ID NO: 1664869 - RNA, 22 nt, Salmonella enterica enterica serovar Typhi
gcaaugauuuuaucaagucgcg

SEQ ID NO: 1664870 - RNA, 18 nt, Salmonella enterica enterica serovar Typhi
gcaaugccaccagcgcca

SEQ ID NO: 1664871 - RNA, 20 nt, Salmonella enterica enterica serovar Typhi
gcaaugccaccagcgccaua

SEQ ID NO: 1664872 - RNA, 12 nt, Salmonella enterica enterica serovar Typhi
gcaaugaccaca

SEQ ID NO: 1664873 - RNA, 13 nt, Salmonella enterica enterica serovar Typhi
gcaaugcccacgc

SEQ ID NO: 1664874 - RNA, 16 nt, Salmonella enterica enterica serovar Typhi
gcaauuccgccaucuc

SEQ ID NO: 1664875 - RNA, 22 nt, Salmonella enterica enterica serovar Typhi
gcaauucagguaauacgcgucu

SEQ ID NO: 1664876 - RNA, 13 nt, Salmonella enterica enterica serovar Typhi
gcaaucagcagcc

SEQ ID NO: 1664877 - RNA, 19 nt, Salmonella enterica enterica serovar Typhi
gcaauaaacaucagccauu

SEQ ID NO: 1664878 - RNA, 18 nt, Salmonella enterica enterica serovar Typhi
gcaagucgcgggcgcuaa

SEQ ID NO: 1664879 - RNA, 14 nt, Salmonella enterica enterica serovar Typhi
gcaaucaugacaga

SEQ ID NO: 1664880 - RNA, 12 nt, Salmonella enterica enterica serovar Typhi
gcaaucaucaga

SEQ ID NO: 1664881 - RNA, 11 nt, Salmonella enterica enterica serovar Typhi
gcaauccgcgc

SEQ ID NO: 1664882 - RNA, 12 nt, Salmonella enterica enterica serovar Typhi
gcaacccggcua

SEQ ID NO: 1664883 - RNA, 23 nt, Salmonella enterica enterica serovar Typhi
gcaacccugccgucucaaccagc

SEQ ID NO: 1664884 - RNA, 18 nt, Salmonella enterica enterica serovar Typhi
gcaaccccuugcggugca

SEQ ID NO: 1664885 - RNA, 17 nt, Salmonella enterica enterica serovar Typhi
gcaacauucugcuucca

SEQ ID NO: 1664886 - RNA, 21 nt, Salmonella enterica enterica serovar Typhi
gcaacauaaauaaacagcgcc

SEQ ID NO: 1664887 - RNA, 15 nt, Salmonella enterica enterica serovar Typhi
gcaacaggccgcauc

SEQ ID NO: 1664888 - RNA, 20 nt, Salmonella enterica enterica serovar Typhi
gcaacagauacggcgcgucg

SEQ ID NO: 1664889 - RNA, 21 nt, Salmonella enterica enterica serovar Typhi
gcaacaacaguugcagcaccu

SEQ ID NO: 1664890 - RNA, 17 nt, Salmonella enterica enterica serovar Typhi
gcaacgaaaaucauccg

SEQ ID NO: 1664891 - RNA, 18 nt, Salmonella enterica enterica serovar Typhi
gcaacgccccgucaccag

SEQ ID NO: 1664892 - RNA, 14 nt, Salmonella enterica enterica serovar Typhi
gcaacggcagccag

SEQ ID NO: 1664893 - RNA, 13 nt, Salmonella enterica enterica serovar Typhi
gcaacgcgccauc

SEQ ID NO: 1664894 - RNA, 17 nt, Salmonella enterica enterica serovar Typhi
gcaacgcgccauccggc

SEQ ID NO: 1664895 - RNA, 15 nt, Salmonella enterica enterica serovar Typhi
gcaacguccgcagcc

SEQ ID NO: 1664896 - RNA, 15 nt, Salmonella enterica enterica serovar Typhi
gcaacguaaucccgc

SEQ ID NO: 1664897 - RNA, 20 nt, Salmonella enterica enterica serovar Typhi
gcaacgggacggcggccagc

SEQ ID NO: 1664898 - RNA, 21 nt, Salmonella enterica enterica serovar Typhi
gcaacguuucuuucaucagau

SEQ ID NO: 1664899 - RNA, 21 nt, Salmonella enterica enterica serovar Typhi
gcacgccguuugccauaucug

SEQ ID NO: 1664900 - RNA, 18 nt, Salmonella enterica enterica serovar Typhi
gcacgcccauauccagcu

SEQ ID NO: 1664901 - RNA, 15 nt, Salmonella enterica enterica serovar Typhi
gcacuuccagccacg

SEQ ID NO: 1664902 - RNA, 14 nt, Salmonella enterica enterica serovar Typhi
gcacuucgcugaua

SEQ ID NO: 1664903 - RNA, 18 nt, Salmonella enterica enterica serovar Typhi
gcacuggcgccugcgccu

SEQ ID NO: 1664904 - RNA, 17 nt, Salmonella enterica enterica serovar Typhi
gcacugaauuuacgccg

SEQ ID NO: 1664905 - RNA, 18 nt, Salmonella enterica enterica serovar Typhi
gcacugauagccgccagu

SEQ ID NO: 1664906 - RNA, 15 nt, Salmonella enterica enterica serovar Typhi
gcagcaaacgccaua

SEQ ID NO: 1664907 - RNA, 23 nt, Salmonella enterica enterica serovar Typhi
gcagcaaaccgauaaucaccagc

SEQ ID NO: 1664908 - RNA, 22 nt, Salmonella enterica enterica serovar Typhi
gcagaugguauaaaucacgcug

SEQ ID NO: 1664909 - RNA, 17 nt, Salmonella enterica enterica serovar Typhi
gcagagauagccagcga

SEQ ID NO: 1664910 - RNA, 18 nt, Salmonella enterica enterica serovar Typhi
gcagacuaaaaagcgcgu

SEQ ID NO: 1664911 - RNA, 14 nt, Salmonella enterica enterica serovar Typhi
gcagcacguccaga

SEQ ID NO: 1664912 - RNA, 20 nt, Salmonella enterica enterica serovar Typhi
gcagcagccgguauccagcg

SEQ ID NO: 1664913 - RNA, 14 nt, Salmonella enterica enterica serovar Typhi
gcacuuuugccagg

SEQ ID NO: 1664914 - RNA, 13 nt, Salmonella enterica enterica serovar Typhi
gcacuuuuaucgg

SEQ ID NO: 1664915 - RNA, 23 nt, Salmonella enterica enterica serovar Typhi
gcagaaaauuaugaauaaccauc

SEQ ID NO: 1664916 - RNA, 22 nt, Salmonella enterica enterica serovar Typhi
gcagaauuaacucaucacagcc

SEQ ID NO: 1664917 - RNA, 17 nt, Salmonella enterica enterica serovar Typhi
gcagaaguaaauccggc

SEQ ID NO: 1664918 - RNA, 22 nt, Salmonella enterica enterica serovar Typhi
gcagaauauuuuucucagccag

SEQ ID NO: 1664919 - RNA, 20 nt, Salmonella enterica enterica serovar Typhi
gcagaagacagaagcugaga

SEQ ID NO: 1664920 - RNA, 20 nt, Salmonella enterica enterica serovar Typhi
gcagaccuguucuguaggcu

SEQ ID NO: 1664921 - RNA, 13 nt, Salmonella enterica enterica serovar Typhi
gcagacaucgcgc

SEQ ID NO: 1664922 - RNA, 15 nt, Salmonella enterica enterica serovar Typhi
gcagacaucgcgcca

SEQ ID NO: 1664923 - RNA, 23 nt, Salmonella enterica enterica serovar Typhi
gcagacaugaccgcacagcagac

SEQ ID NO: 1664924 - RNA, 16 nt, Salmonella enterica enterica serovar Typhi
gcagaccggcagccug

SEQ ID NO: 1664925 - RNA, 14 nt, Salmonella enterica enterica serovar Typhi
gcagaccggcagcc

SEQ ID NO: 1664926 - RNA, 13 nt, Salmonella enterica enterica serovar Typhi
gcagccccggcau

SEQ ID NO: 1664927 - RNA, 23 nt, Salmonella enterica enterica serovar Typhi
gcagcccugcgucgcguaccagc

SEQ ID NO: 1664928 - RNA, 14 nt, Salmonella enterica enterica serovar Typhi
gcagccgacagcgu

SEQ ID NO: 1664929 - RNA, 17 nt, Salmonella enterica enterica serovar Typhi
gcagcgaauagcggcaa

SEQ ID NO: 1664930 - RNA, 16 nt, Salmonella enterica enterica serovar Typhi
gcagcgaugacagcag

SEQ ID NO: 1664931 - RNA, 15 nt, Salmonella enterica enterica serovar Typhi
gcagcgcaucauggu

SEQ ID NO: 1664932 - RNA, 13 nt, Salmonella enterica enterica serovar Typhi
gcagcgcauaggc

SEQ ID NO: 1664933 - RNA, 14 nt, Salmonella enterica enterica serovar Typhi
gcagcgcgauacgc

SEQ ID NO: 1664934 - RNA, 18 nt, Salmonella enterica enterica serovar Typhi
gcagcgcggccagcgccu

SEQ ID NO: 1664935 - RNA, 16 nt, Salmonella enterica enterica serovar Typhi
gcagcgcggccugcgu

SEQ ID NO: 1664936 - RNA, 20 nt, Salmonella enterica enterica serovar Typhi
gcagcggcgguuauccgcca

SEQ ID NO: 1664937 - RNA, 17 nt, Salmonella enterica enterica serovar Typhi
gcagcggcgguuauccg

SEQ ID NO: 1664938 - RNA, 19 nt, Salmonella enterica enterica serovar Typhi
gcaggcaguuuauucagaa

SEQ ID NO: 1664939 - RNA, 17 nt, Salmonella enterica enterica serovar Typhi
gcagguaucguauccgg

SEQ ID NO: 1664940 - RNA, 12 nt, Salmonella enterica enterica serovar Typhi
gcaucaccggau

SEQ ID NO: 1664941 - RNA, 18 nt, Salmonella enterica enterica serovar Typhi
gcaucaaugcccagcgca

SEQ ID NO: 1664942 - RNA, 14 nt, Salmonella enterica enterica serovar Typhi
gcaucaagcccaug

SEQ ID NO: 1664943 - RNA, 19 nt, Salmonella enterica enterica serovar Typhi
gcauagcuggcguagccag

SEQ ID NO: 1664944 - RNA, 12 nt, Salmonella enterica enterica serovar Typhi
gcaucagacggu

SEQ ID NO: 1664945 - RNA, 13 nt, Salmonella enterica enterica serovar Typhi
gcaucccguuaug

SEQ ID NO: 1664946 - RNA, 16 nt, Salmonella enterica enterica serovar Typhi
gcaucccggucaacgu

SEQ ID NO: 1664947 - RNA, 15 nt, Salmonella enterica enterica serovar Typhi
gcaucgauuccgccu

SEQ ID NO: 1664948 - RNA, 16 nt, Salmonella enterica enterica serovar Typhi
gcaucgacgccagcgg

SEQ ID NO: 1664949 - RNA, 17 nt, Salmonella enterica enterica serovar Typhi
gcaucgacguucagcau

SEQ ID NO: 1664950 - RNA, 16 nt, Salmonella enterica enterica serovar Typhi
gcaucgacguucagca

SEQ ID NO: 1664951 - RNA, 18 nt, Salmonella enterica enterica serovar Typhi
gcaucgauauaagcgccg

SEQ ID NO: 1664952 - RNA, 24 nt, Salmonella enterica enterica serovar Typhi
gcaguucugaagcuaaccgcgcaa

SEQ ID NO: 1664953 - RNA, 18 nt, Salmonella enterica enterica serovar Typhi
gcaguuuauccggcgcca

SEQ ID NO: 1664954 - RNA, 20 nt, Salmonella enterica enterica serovar Typhi
gcaguuuauccggcgccaua

SEQ ID NO: 1664955 - RNA, 19 nt, Salmonella enterica enterica serovar Typhi
gcauaaaaccgccgcccau

SEQ ID NO: 1664956 - RNA, 14 nt, Salmonella enterica enterica serovar Typhi
gcauaaaaaaugag

SEQ ID NO: 1664957 - RNA, 15 nt, Salmonella enterica enterica serovar Typhi
gcauaaaaagccauc

SEQ ID NO: 1664958 - RNA, 21 nt, Salmonella enterica enterica serovar Typhi
gcauacacgccgggcacgcug

SEQ ID NO: 1664959 - RNA, 15 nt, Salmonella enterica enterica serovar Typhi
gcauacaccgccagc

SEQ ID NO: 1664960 - RNA, 16 nt, Salmonella enterica enterica serovar Typhi
gcauaaugcagccauc

SEQ ID NO: 1664961 - RNA, 17 nt, Salmonella enterica enterica serovar Typhi
gcauaaauuggcucaga

SEQ ID NO: 1664962 - RNA, 12 nt, Salmonella enterica enterica serovar Typhi
gcauaagcgcga

SEQ ID NO: 1664963 - RNA, 22 nt, Salmonella enterica enterica serovar Typhi
gcauaauaugaugcagacgggc

SEQ ID NO: 1664964 - RNA, 16 nt, Salmonella enterica enterica serovar Typhi
gcauagccccagcgca

SEQ ID NO: 1664965 - RNA, 19 nt, Salmonella enterica enterica serovar Typhi
gcaggucuucgucagcgca

SEQ ID NO: 1664966 - RNA, 17 nt, Salmonella enterica enterica serovar Typhi
gcauuggcaucugucau

SEQ ID NO: 1664967 - RNA, 15 nt, Salmonella enterica enterica serovar Typhi
gcauuucgccgccau

SEQ ID NO: 1664968 - RNA, 22 nt, Salmonella enterica enterica serovar Typhi
gccaaacaucgcucgcgccacg

SEQ ID NO: 1664969 - RNA, 17 nt, Salmonella enterica enterica serovar Typhi
gccaaaaucgauagcgg

SEQ ID NO: 1664970 - RNA, 18 nt, Salmonella enterica enterica serovar Typhi
gccaaaaucgauagcggu

SEQ ID NO: 1664971 - RNA, 19 nt, Salmonella enterica enterica serovar Typhi
gcauuuuuaucaucugcau

SEQ ID NO: 1664972 - RNA, 23 nt, Salmonella enterica enterica serovar Typhi
gcauuuguugagcgcauuugcgg

SEQ ID NO: 1664973 - RNA, 12 nt, Salmonella enterica enterica serovar Typhi
gccaaagcgccc

SEQ ID NO: 1664974 - RNA, 18 nt, Salmonella enterica enterica serovar Typhi
gccaaaguuaaucagcgc

SEQ ID NO: 1664975 - RNA, 14 nt, Salmonella enterica enterica serovar Typhi
gccaaauagcgcca

SEQ ID NO: 1664976 - RNA, 15 nt, Salmonella enterica enterica serovar Typhi
gccaacaacaggccg

SEQ ID NO: 1664977 - RNA, 22 nt, Salmonella enterica enterica serovar Typhi
gccaacauguaauuacggcaca

SEQ ID NO: 1664978 - RNA, 12 nt, Salmonella enterica enterica serovar Typhi
gccaacgccaac

SEQ ID NO: 1664979 - RNA, 15 nt, Salmonella enterica enterica serovar Typhi
gccaacgccagcagc

SEQ ID NO: 1664980 - RNA, 18 nt, Salmonella enterica enterica serovar Typhi
gcauuacccccgccauaa

SEQ ID NO: 1664981 - RNA, 15 nt, Salmonella enterica enterica serovar Typhi
gcauuaccgcuauuc

SEQ ID NO: 1664982 - RNA, 18 nt, Salmonella enterica enterica serovar Typhi
gcauuaauaugcgcaauc

SEQ ID NO: 1664983 - RNA, 17 nt, Salmonella enterica enterica serovar Typhi
gcauuaucgaugcguau

SEQ ID NO: 1664984 - RNA, 15 nt, Salmonella enterica enterica serovar Typhi
gcauucgcagcagac

SEQ ID NO: 1664985 - RNA, 16 nt, Salmonella enterica enterica serovar Typhi
gcauugauaaagcgcu

SEQ ID NO: 1664986 - RNA, 21 nt, Salmonella enterica enterica serovar Typhi
gcauugccaugaugagcgcca

SEQ ID NO: 1664987 - RNA, 18 nt, Salmonella enterica enterica serovar Typhi
gcauggguaaagcccauc

SEQ ID NO: 1664988 - RNA, 19 nt, Salmonella enterica enterica serovar Typhi
gcaugacaauaacggccuc

SEQ ID NO: 1664989 - RNA, 16 nt, Salmonella enterica enterica serovar Typhi
gcaugcggggggcaac

SEQ ID NO: 1664990 - RNA, 14 nt, Salmonella enterica enterica serovar Typhi
gcaucguacgggca

SEQ ID NO: 1664991 - RNA, 13 nt, Salmonella enterica enterica serovar Typhi
gcaucggaaccgg

SEQ ID NO: 1664992 - RNA, 19 nt, Salmonella enterica enterica serovar Typhi
gcaucgcguuauugaccau

SEQ ID NO: 1664993 - RNA, 17 nt, Salmonella enterica enterica serovar Typhi
gcaucggcagcgccagu

SEQ ID NO: 1664994 - RNA, 19 nt, Salmonella enterica enterica serovar Typhi
gcaucugcauaauggcgac

SEQ ID NO: 1664995 - RNA, 22 nt, Salmonella enterica enterica serovar Typhi
gcaucgugguuaauacaucaac

SEQ ID NO: 1664996 - RNA, 13 nt, Salmonella enterica enterica serovar Typhi
gcaucgucugcac

SEQ ID NO: 1664997 - RNA, 20 nt, Salmonella enterica enterica serovar Typhi
gccggaaucgcgauccagcc

SEQ ID NO: 1664998 - RNA, 15 nt, Salmonella enterica enterica serovar Typhi
gccggaagcgcgaau

SEQ ID NO: 1664999 - RNA, 16 nt, Salmonella enterica enterica serovar Typhi
gccggauaaggcguaa

SEQ ID NO: 1665000 - RNA, 14 nt, Salmonella enterica enterica serovar Typhi
gccggauaaggcau

SEQ ID NO: 1665001 - RNA, 16 nt, Salmonella enterica enterica serovar Typhi
gccggagcugauacgg

SEQ ID NO: 1665002 - RNA, 21 nt, Salmonella enterica enterica serovar Typhi
gccggauaagcguagcgccau

SEQ ID NO: 1665003 - RNA, 19 nt, Salmonella enterica enterica serovar Typhi
gccggagaguucauaacgc

SEQ ID NO: 1665004 - RNA, 14 nt, Salmonella enterica enterica serovar Typhi
gccgcuuauccggc

SEQ ID NO: 1665005 - RNA, 20 nt, Salmonella enterica enterica serovar Typhi
gccgcuuugcgaacagcgca

SEQ ID NO: 1665006 - RNA, 15 nt, Salmonella enterica enterica serovar Typhi
gccgcuuucugagcc

SEQ ID NO: 1665007 - RNA, 22 nt, Salmonella enterica enterica serovar Typhi
gccgcuuuuuucagcggcagcu

SEQ ID NO: 1665008 - RNA, 21 nt, Salmonella enterica enterica serovar Typhi
gccggaaagacggcagcgcca

SEQ ID NO: 1665009 - RNA, 22 nt, Salmonella enterica enterica serovar Typhi
gccggauuuuacauagcagcaa

SEQ ID NO: 1665010 - RNA, 18 nt, Salmonella enterica enterica serovar Typhi
gccggaugugagcgcauc

SEQ ID NO: 1665011 - RNA, 21 nt, Salmonella enterica enterica serovar Typhi
gccggauuagcgacagcgcua

SEQ ID NO: 1665012 - RNA, 15 nt, Salmonella enterica enterica serovar Typhi
gccggauaucgcuau

SEQ ID NO: 1665013 - RNA, 19 nt, Salmonella enterica enterica serovar Typhi
gccggauagcguagcgcca

SEQ ID NO: 1665014 - RNA, 20 nt, Salmonella enterica enterica serovar Typhi
gccggauagcguagcgccau

SEQ ID NO: 1665015 - RNA, 17 nt, Salmonella enterica enterica serovar Typhi
gccggauggcaacgcca

SEQ ID NO: 1665016 - RNA, 17 nt, Salmonella enterica enterica serovar Typhi
gccggcaggcagcgcca

SEQ ID NO: 1665017 - RNA, 14 nt, Salmonella enterica enterica serovar Typhi
gccgcugauccgcc

SEQ ID NO: 1665018 - RNA, 15 nt, Salmonella enterica enterica serovar Typhi
gccgcguuuuagcaa

SEQ ID NO: 1665019 - RNA, 21 nt, Salmonella enterica enterica serovar Typhi
gccgcuacguaauucaugcaa

SEQ ID NO: 1665020 - RNA, 14 nt, Salmonella enterica enterica serovar Typhi
gccgcgauacggau

SEQ ID NO: 1665021 - RNA, 19 nt, Salmonella enterica enterica serovar Typhi
gccgcgauagaccacgcca

SEQ ID NO: 1665022 - RNA, 22 nt, Salmonella enterica enterica serovar Typhi
gccgcgcuccaucauaucgcgc

SEQ ID NO: 1665023 - RNA, 18 nt, Salmonella enterica enterica serovar Typhi
gccgcgcuuuuuuaacga

SEQ ID NO: 1665024 - RNA, 24 nt, Salmonella enterica enterica serovar Typhi
gccgcggaccuuuugccgcccagu

SEQ ID NO: 1665025 - RNA, 16 nt, Salmonella enterica enterica serovar Typhi
gccgcgcuuucaguaa

SEQ ID NO: 1665026 - RNA, 15 nt, Salmonella enterica enterica serovar Typhi
gccggccugauaagc

SEQ ID NO: 1665027 - RNA, 14 nt, Salmonella enterica enterica serovar Typhi
gccggcguuccgca

SEQ ID NO: 1665028 - RNA, 14 nt, Salmonella enterica enterica serovar Typhi
gccggcggcggaau

SEQ ID NO: 1665029 - RNA, 18 nt, Salmonella enterica enterica serovar Typhi
gccgcauaauucaucuuc

SEQ ID NO: 1665030 - RNA, 23 nt, Salmonella enterica enterica serovar Typhi
gccgcaucgauaucuuuauucgc

SEQ ID NO: 1665031 - RNA, 16 nt, Salmonella enterica enterica serovar Typhi
gccgcaucggcccugu

SEQ ID NO: 1665032 - RNA, 22 nt, Salmonella enterica enterica serovar Typhi
gccgcauggagcaucagcgccg

SEQ ID NO: 1665033 - RNA, 14 nt, Salmonella enterica enterica serovar Typhi
gccgccaaagcgcc

SEQ ID NO: 1665034 - RNA, 20 nt, Salmonella enterica enterica serovar Typhi
gccgccaaaaauaucgccgu

SEQ ID NO: 1665035 - RNA, 16 nt, Salmonella enterica enterica serovar Typhi
gccgccaacgccagca

SEQ ID NO: 1665036 - RNA, 15 nt, Salmonella enterica enterica serovar Typhi
gccgccauuugcgcg

SEQ ID NO: 1665037 - RNA, 21 nt, Salmonella enterica enterica serovar Typhi
gccgcccaucccuaauaaggu

SEQ ID NO: 1665038 - RNA, 16 nt, Salmonella enterica enterica serovar Typhi
gccgcccauaaucacc

SEQ ID NO: 1665039 - RNA, 15 nt, Salmonella enterica enterica serovar Typhi
gccgccauggcgaau

SEQ ID NO: 1665040 - RNA, 13 nt, Salmonella enterica enterica serovar Typhi
gccgccagaauca

SEQ ID NO: 1665041 - RNA, 13 nt, Salmonella enterica enterica serovar Typhi
gccgccagccauc

SEQ ID NO: 1665042 - RNA, 21 nt, Salmonella enterica enterica serovar Typhi
gccgccaggcauguuaugaau

SEQ ID NO: 1665043 - RNA, 16 nt, Salmonella enterica enterica serovar Typhi
gccgcccuccggcaca

SEQ ID NO: 1665044 - RNA, 14 nt, Salmonella enterica enterica serovar Typhi
gccgcccugcauca

SEQ ID NO: 1665045 - RNA, 13 nt, Salmonella enterica enterica serovar Typhi
gccgccggaaauu

SEQ ID NO: 1665046 - RNA, 14 nt, Salmonella enterica enterica serovar Typhi
gccgcgacgcgcga

SEQ ID NO: 1665047 - RNA, 19 nt, Salmonella enterica enterica serovar Typhi
gccgccgguguuuccguca

SEQ ID NO: 1665048 - RNA, 13 nt, Salmonella enterica enterica serovar Typhi
gccgauuucacgc

SEQ ID NO: 1665049 - RNA, 14 nt, Salmonella enterica enterica serovar Typhi
gccgcaaccgccaa

SEQ ID NO: 1665050 - RNA, 15 nt, Salmonella enterica enterica serovar Typhi
gccgcagcgccauaa

SEQ ID NO: 1665051 - RNA, 14 nt, Salmonella enterica enterica serovar Typhi
gccgcaacggucgg

SEQ ID NO: 1665052 - RNA, 12 nt, Salmonella enterica enterica serovar Typhi
gccgcaacggcu

SEQ ID NO: 1665053 - RNA, 14 nt, Salmonella enterica enterica serovar Typhi
gccgaucagcacca

SEQ ID NO: 1665054 - RNA, 14 nt, Salmonella enterica enterica serovar Typhi
gccgauaccggcaa

SEQ ID NO: 1665055 - RNA, 23 nt, Salmonella enterica enterica serovar Typhi
gccgauaacucuucaucgcgccu

SEQ ID NO: 1665056 - RNA, 21 nt, Salmonella enterica enterica serovar Typhi
gccgauaacucuucaucgcgc

SEQ ID NO: 1665057 - RNA, 19 nt, Salmonella enterica enterica serovar Typhi
gccgagcauuuccgcagcc

SEQ ID NO: 1665058 - RNA, 18 nt, Salmonella enterica enterica serovar Typhi
gccgagaguccagcgcca

SEQ ID NO: 1665059 - RNA, 17 nt, Salmonella enterica enterica serovar Typhi
gccgacggagacgauuc

SEQ ID NO: 1665060 - RNA, 20 nt, Salmonella enterica enterica serovar Typhi
gccgaccgccagcagagcga

SEQ ID NO: 1665061 - RNA, 14 nt, Salmonella enterica enterica serovar Typhi
gccgaccaucgcgc

SEQ ID NO: 1665062 - RNA, 22 nt, Salmonella enterica enterica serovar Typhi
gccgaauagcugauaaacagcu

SEQ ID NO: 1665063 - RNA, 13 nt, Salmonella enterica enterica serovar Typhi
gcccuauccagcg

SEQ ID NO: 1665064 - RNA, 23 nt, Salmonella enterica enterica serovar Typhi
gccgacaaccagcgaaaugacgg

SEQ ID NO: 1665065 - RNA, 20 nt, Salmonella enterica enterica serovar Typhi
gccgaauggcgggccuacgc

SEQ ID NO: 1665066 - RNA, 18 nt, Salmonella enterica enterica serovar Typhi
gccauccaucuccggcau

SEQ ID NO: 1665067 - RNA, 14 nt, Salmonella enterica enterica serovar Typhi
gccaucccggcgac

SEQ ID NO: 1665068 - RNA, 19 nt, Salmonella enterica enterica serovar Typhi
gccaucauuaauuuacuga

SEQ ID NO: 1665069 - RNA, 17 nt, Salmonella enterica enterica serovar Typhi
gccauccaccaggcaug

SEQ ID NO: 1665070 - RNA, 14 nt, Salmonella enterica enterica serovar Typhi
gccaucaguucggc

SEQ ID NO: 1665071 - RNA, 17 nt, Salmonella enterica enterica serovar Typhi
gccaucaggcagauuaa

SEQ ID NO: 1665072 - RNA, 19 nt, Salmonella enterica enterica serovar Typhi
gccaucaggcagauuaauc

SEQ ID NO: 1665073 - RNA, 18 nt, Salmonella enterica enterica serovar Typhi
gccaucaggcaaucuuua

SEQ ID NO: 1665074 - RNA, 18 nt, Salmonella enterica enterica serovar Typhi
gccaucccggcgacagcg

SEQ ID NO: 1665075 - RNA, 22 nt, Salmonella enterica enterica serovar Typhi
gccagucauuaauucccgcagc

SEQ ID NO: 1665076 - RNA, 14 nt, Salmonella enterica enterica serovar Typhi
gccauagcgcuaug

SEQ ID NO: 1665077 - RNA, 18 nt, Salmonella enterica enterica serovar Typhi
gccaucacaccaacgcug

SEQ ID NO: 1665078 - RNA, 22 nt, Salmonella enterica enterica serovar Typhi
gccaucagcaaaauaccggcag

SEQ ID NO: 1665079 - RNA, 20 nt, Salmonella enterica enterica serovar Typhi
gccauauuuuuccagcgccu

SEQ ID NO: 1665080 - RNA, 23 nt, Salmonella enterica enterica serovar Typhi
gccauauaaauuucauccaugcc

SEQ ID NO: 1665081 - RNA, 15 nt, Salmonella enterica enterica serovar Typhi
gccauucgcuuccgc

SEQ ID NO: 1665082 - RNA, 14 nt, Salmonella enterica enterica serovar Typhi
gccaucuuugcacc

SEQ ID NO: 1665083 - RNA, 21 nt, Salmonella enterica enterica serovar Typhi
gccaucuuucuuuucgcguuu

SEQ ID NO: 1665084 - RNA, 13 nt, Salmonella enterica enterica serovar Typhi
gccauugcgacga

SEQ ID NO: 1665085 - RNA, 12 nt, Salmonella enterica enterica serovar Typhi
gccauuuccagc

SEQ ID NO: 1665086 - RNA, 19 nt, Salmonella enterica enterica serovar Typhi
gcccaaauaguccagcauc

SEQ ID NO: 1665087 - RNA, 14 nt, Salmonella enterica enterica serovar Typhi
gcccaacgcaauac

SEQ ID NO: 1665088 - RNA, 21 nt, Salmonella enterica enterica serovar Typhi
gccaguaucgcgccgccaaua

SEQ ID NO: 1665089 - RNA, 16 nt, Salmonella enterica enterica serovar Typhi
gccagguacaucgcgc

SEQ ID NO: 1665090 - RNA, 18 nt, Salmonella enterica enterica serovar Typhi
gccaggcguuacgcgcca

SEQ ID NO: 1665091 - RNA, 15 nt, Salmonella enterica enterica serovar Typhi
gccagggcggaagca

SEQ ID NO: 1665092 - RNA, 14 nt, Salmonella enterica enterica serovar Typhi
gccaggauaucgcc

SEQ ID NO: 1665093 - RNA, 16 nt, Salmonella enterica enterica serovar Typhi
gccaggauaucgcccg

SEQ ID NO: 1665094 - RNA, 14 nt, Salmonella enterica enterica serovar Typhi
gccaggcauccggc

SEQ ID NO: 1665095 - RNA, 18 nt, Salmonella enterica enterica serovar Typhi
gccagcggccagcguacc

SEQ ID NO: 1665096 - RNA, 12 nt, Salmonella enterica enterica serovar Typhi
gccagcgcugag

SEQ ID NO: 1665097 - RNA, 12 nt, Salmonella enterica enterica serovar Typhi
gccagcgugcuu

SEQ ID NO: 1665098 - RNA, 21 nt, Salmonella enterica enterica serovar Typhi
gccagcguaaucggcaggcca

SEQ ID NO: 1665099 - RNA, 15 nt, Salmonella enterica enterica serovar Typhi
gccagcggcgcgaug

SEQ ID NO: 1665100 - RNA, 17 nt, Salmonella enterica enterica serovar Typhi
gccagcgacugguguua

SEQ ID NO: 1665101 - RNA, 22 nt, Salmonella enterica enterica serovar Typhi
gccagcgacaacgcuuccggcg

SEQ ID NO: 1665102 - RNA, 21 nt, Salmonella enterica enterica serovar Typhi
gccagccagucgccaggcaag

SEQ ID NO: 1665103 - RNA, 14 nt, Salmonella enterica enterica serovar Typhi
gccagccagcgcca

SEQ ID NO: 1665104 - RNA, 21 nt, Salmonella enterica enterica serovar Typhi
gccagcaucaugggcucauca

SEQ ID NO: 1665105 - RNA, 15 nt, Salmonella enterica enterica serovar Typhi
gccagcauaccgccc

SEQ ID NO: 1665106 - RNA, 17 nt, Salmonella enterica enterica serovar Typhi
gccagcaguugcagcgu

SEQ ID NO: 1665107 - RNA, 23 nt, Salmonella enterica enterica serovar Typhi
gccagcaucgauuuuucaucuuc

SEQ ID NO: 1665108 - RNA, 16 nt, Salmonella enterica enterica serovar Typhi
gccagcaucggcagcg

SEQ ID NO: 1665109 - RNA, 22 nt, Salmonella enterica enterica serovar Typhi
gccagcaaugccgccgccaggu

SEQ ID NO: 1665110 - RNA, 17 nt, Salmonella enterica enterica serovar Typhi
gccagaucgauacgcca

SEQ ID NO: 1665111 - RNA, 19 nt, Salmonella enterica enterica serovar Typhi
gccagaucgaacagcggca

SEQ ID NO: 1665112 - RNA, 20 nt, Salmonella enterica enterica serovar Typhi
gccagauauuuucggcauac

SEQ ID NO: 1665113 - RNA, 17 nt, Salmonella enterica enterica serovar Typhi
gccagacucaucgccgc

SEQ ID NO: 1665114 - RNA, 17 nt, Salmonella enterica enterica serovar Typhi
gccagacucgcuucacg

SEQ ID NO: 1665115 - RNA, 18 nt, Salmonella enterica enterica serovar Typhi
gccagacucgcuucacgc

SEQ ID NO: 1665116 - RNA, 17 nt, Salmonella enterica enterica serovar Typhi
gccagacccagcgcuaa

SEQ ID NO: 1665117 - RNA, 15 nt, Salmonella enterica enterica serovar Typhi
gccagacucagccag

SEQ ID NO: 1665118 - RNA, 15 nt, Salmonella enterica enterica serovar Typhi
gccagaacgcuguug

SEQ ID NO: 1665119 - RNA, 21 nt, Salmonella enterica enterica serovar Typhi
gccagaauacaccgccuagcg

SEQ ID NO: 1665120 - RNA, 18 nt, Salmonella enterica enterica serovar Typhi
gccagaaugccagcgccg

SEQ ID NO: 1665121 - RNA, 22 nt, Salmonella enterica enterica serovar Typhi
gccagaccaauagagagcgaca

SEQ ID NO: 1665122 - RNA, 16 nt, Salmonella enterica enterica serovar Typhi
gccacuuuuccggcac

SEQ ID NO: 1665123 - RNA, 17 nt, Salmonella enterica enterica serovar Typhi
gccagaaaucgcucaug

SEQ ID NO: 1665124 - RNA, 14 nt, Salmonella enterica enterica serovar Typhi
gccacuccgccagu

SEQ ID NO: 1665125 - RNA, 14 nt, Salmonella enterica enterica serovar Typhi
gccacguugcgcgc

SEQ ID NO: 1665126 - RNA, 13 nt, Salmonella enterica enterica serovar Typhi
gccacgcgacgcc

SEQ ID NO: 1665127 - RNA, 18 nt, Salmonella enterica enterica serovar Typhi
gccacgccgcuccacagc

SEQ ID NO: 1665128 - RNA, 16 nt, Salmonella enterica enterica serovar Typhi
gccacgcagcgcagac

SEQ ID NO: 1665129 - RNA, 17 nt, Salmonella enterica enterica serovar Typhi
gccacgccauacguccg

SEQ ID NO: 1665130 - RNA, 16 nt, Salmonella enterica enterica serovar Typhi
gccaacgccggcaaca

SEQ ID NO: 1665131 - RNA, 13 nt, Salmonella enterica enterica serovar Typhi
gcccgcagaucug

SEQ ID NO: 1665132 - RNA, 21 nt, Salmonella enterica enterica serovar Typhi
gcccgauggcgcugcgcgcau

SEQ ID NO: 1665133 - RNA, 22 nt, Salmonella enterica enterica serovar Typhi
gcccgaaagcaauacuguaagc

SEQ ID NO: 1665134 - RNA, 21 nt, Salmonella enterica enterica serovar Typhi
gcccauuuggcuuaaauaauc

SEQ ID NO: 1665135 - RNA, 17 nt, Salmonella enterica enterica serovar Typhi
gcccauuaauaucagcc

SEQ ID NO: 1665136 - RNA, 13 nt, Salmonella enterica enterica serovar Typhi
gcccagucacggc

SEQ ID NO: 1665137 - RNA, 22 nt, Salmonella enterica enterica serovar Typhi
gccccauuguucuuucauuuua

SEQ ID NO: 1665138 - RNA, 12 nt, Salmonella enterica enterica serovar Typhi
gccccagcgcca

SEQ ID NO: 1665139 - RNA, 13 nt, Salmonella enterica enterica serovar Typhi
gccccagccugga

SEQ ID NO: 1665140 - RNA, 21 nt, Salmonella enterica enterica serovar Typhi
gccccagcgccagcugcguca

SEQ ID NO: 1665141 - RNA, 14 nt, Salmonella enterica enterica serovar Typhi
gccccaccgccaga

SEQ ID NO: 1665142 - RNA, 11 nt, Salmonella enterica enterica serovar Typhi
gcccagcgccg

SEQ ID NO: 1665143 - RNA, 18 nt, Salmonella enterica enterica serovar Typhi
gcccaauggucaucgucg

SEQ ID NO: 1665144 - RNA, 16 nt, Salmonella enterica enterica serovar Typhi
gcccgguaagcgcagc

SEQ ID NO: 1665145 - RNA, 20 nt, Salmonella enterica enterica serovar Typhi
gcccgguaagcgcagcgcca

SEQ ID NO: 1665146 - RNA, 18 nt, Salmonella enterica enterica serovar Typhi
gcccgggcacgauggccu

SEQ ID NO: 1665147 - RNA, 14 nt, Salmonella enterica enterica serovar Typhi
gcccgggcaauuuc

SEQ ID NO: 1665148 - RNA, 15 nt, Salmonella enterica enterica serovar Typhi
gcccggcaugucgcc

SEQ ID NO: 1665149 - RNA, 14 nt, Salmonella enterica enterica serovar Typhi
gcccgcucguuuca

SEQ ID NO: 1665150 - RNA, 14 nt, Salmonella enterica enterica serovar Typhi
gcccgcuuuaccga

SEQ ID NO: 1665151 - RNA, 18 nt, Salmonella enterica enterica serovar Typhi
gcccgcuguccgcccagu

SEQ ID NO: 1665152 - RNA, 20 nt, Salmonella enterica enterica serovar Typhi
cgucccaugacgacagguuu

SEQ ID NO: 1665153 - RNA, 13 nt, Salmonella enterica enterica serovar Typhi
cguccccugcggu

SEQ ID NO: 1665154 - RNA, 19 nt, Salmonella enterica enterica serovar Typhi
cguccaguucguucugcgu

SEQ ID NO: 1665155 - RNA, 19 nt, Salmonella enterica enterica serovar Typhi
cguccaguguccgcuguua

SEQ ID NO: 1665156 - RNA, 14 nt, Salmonella enterica enterica serovar Typhi
cguccauaagcgcg

SEQ ID NO: 1665157 - RNA, 21 nt, Salmonella enterica enterica serovar Typhi
cguccagauaaugaucaacgc

SEQ ID NO: 1665158 - RNA, 24 nt, Salmonella enterica enterica serovar Typhi
cgucauuaugcauugccaugcgac

SEQ ID NO: 1665159 - RNA, 14 nt, Salmonella enterica enterica serovar Typhi
cgucauuuccggcg

SEQ ID NO: 1665160 - RNA, 19 nt, Salmonella enterica enterica serovar Typhi
cgucauuuucuuucaucaa

SEQ ID NO: 1665161 - RNA, 21 nt, Salmonella enterica enterica serovar Typhi
cgucauggcuaaucgccacga

SEQ ID NO: 1665162 - RNA, 22 nt, Salmonella enterica enterica serovar Typhi
cgucaugcuucaccucagcaaa

SEQ ID NO: 1665163 - RNA, 19 nt, Salmonella enterica enterica serovar Typhi
cguccacauccagcgccag

SEQ ID NO: 1665164 - RNA, 13 nt, Salmonella enterica enterica serovar Typhi
cguccagauaaug

SEQ ID NO: 1665165 - RNA, 22 nt, Salmonella enterica enterica serovar Typhi
cguccacggauauuuaccgccg

SEQ ID NO: 1665166 - RNA, 23 nt, Salmonella enterica enterica serovar Typhi
cgucaggcccauuuucggcauca

SEQ ID NO: 1665167 - RNA, 22 nt, Salmonella enterica enterica serovar Typhi
cgucagcccaagcugacggaua

SEQ ID NO: 1665168 - RNA, 14 nt, Salmonella enterica enterica serovar Typhi
cgucauccggcaua

SEQ ID NO: 1665169 - RNA, 17 nt, Salmonella enterica enterica serovar Typhi
cgucaggguaugucggu

SEQ ID NO: 1665170 - RNA, 17 nt, Salmonella enterica enterica serovar Typhi
cgucaucauugcgccaa

SEQ ID NO: 1665171 - RNA, 23 nt, Salmonella enterica enterica serovar Typhi
cgucaucauuaccuuuuccggcg

SEQ ID NO: 1665172 - RNA, 18 nt, Salmonella enterica enterica serovar Typhi
cgucagguuuaaucggcg

SEQ ID NO: 1665173 - RNA, 21 nt, Salmonella enterica enterica serovar Typhi
cgucaggcuugccgcgccaga

SEQ ID NO: 1665174 - RNA, 19 nt, Salmonella enterica enterica serovar Typhi
cgucauccgcguaaucgcg

SEQ ID NO: 1665175 - RNA, 12 nt, Salmonella enterica enterica serovar Typhi
cgucaucccggu

SEQ ID NO: 1665176 - RNA, 19 nt, Salmonella enterica enterica serovar Typhi
cgucauccggcaagcgcug

SEQ ID NO: 1665177 - RNA, 13 nt, Salmonella enterica enterica serovar Typhi
cgucauccuccug

SEQ ID NO: 1665178 - RNA, 21 nt, Salmonella enterica enterica serovar Typhi
cgucgcgcgccgccugcgcca

SEQ ID NO: 1665179 - RNA, 19 nt, Salmonella enterica enterica serovar Typhi
cgucgaccauacgcagcau

SEQ ID NO: 1665180 - RNA, 22 nt, Salmonella enterica enterica serovar Typhi
cgucgaacugaauagucggcug

SEQ ID NO: 1665181 - RNA, 13 nt, Salmonella enterica enterica serovar Typhi
cguccuaccgccg

SEQ ID NO: 1665182 - RNA, 13 nt, Salmonella enterica enterica serovar Typhi
cguaguacgcgcg

SEQ ID NO: 1665183 - RNA, 23 nt, Salmonella enterica enterica serovar Typhi
cgucaaaaccaaacagcgacaca

SEQ ID NO: 1665184 - RNA, 18 nt, Salmonella enterica enterica serovar Typhi
cgucaaaaccaaacagcg

SEQ ID NO: 1665185 - RNA, 18 nt, Salmonella enterica enterica serovar Typhi
cguauugcauaaugccug

SEQ ID NO: 1665186 - RNA, 19 nt, Salmonella enterica enterica serovar Typhi
cguauuaauugcuuugcaa

SEQ ID NO: 1665187 - RNA, 22 nt, Salmonella enterica enterica serovar Typhi
cguauuaagccaacguugaaaa

SEQ ID NO: 1665188 - RNA, 15 nt, Salmonella enterica enterica serovar Typhi
cgucacgccaucagg

SEQ ID NO: 1665189 - RNA, 16 nt, Salmonella enterica enterica serovar Typhi
cgucacccgccggcag

SEQ ID NO: 1665190 - RNA, 15 nt, Salmonella enterica enterica serovar Typhi
cgucaacgaccagaa

SEQ ID NO: 1665191 - RNA, 17 nt, Salmonella enterica enterica serovar Typhi
cgucaacgcuuuuaucg

SEQ ID NO: 1665192 - RNA, 18 nt, Salmonella enterica enterica serovar Typhi
cguaaguuaaaacgccau

SEQ ID NO: 1665193 - RNA, 17 nt, Salmonella enterica enterica serovar Typhi
cguaccgcauacccgac

SEQ ID NO: 1665194 - RNA, 13 nt, Salmonella enterica enterica serovar Typhi
cguagaucgccag

SEQ ID NO: 1665195 - RNA, 17 nt, Salmonella enterica enterica serovar Typhi
cguagauaagcgccacg

SEQ ID NO: 1665196 - RNA, 13 nt, Salmonella enterica enterica serovar Typhi
cguagcgucaaca

SEQ ID NO: 1665197 - RNA, 20 nt, Salmonella enterica enterica serovar Typhi
cguagcgcguucaggguauc

SEQ ID NO: 1665198 - RNA, 22 nt, Salmonella enterica enterica serovar Typhi
cguagcgccaucaggcacaaug

SEQ ID NO: 1665199 - RNA, 11 nt, Salmonella enterica enterica serovar Typhi
cguagcgccau

SEQ ID NO: 1665200 - RNA, 12 nt, Salmonella enterica enterica serovar Typhi
cguaacgccaca

SEQ ID NO: 1665201 - RNA, 19 nt, Salmonella enterica enterica serovar Typhi
cguaacgccgucgacaaag

SEQ ID NO: 1665202 - RNA, 17 nt, Salmonella enterica enterica serovar Typhi
cguaaauaaauaccgca

SEQ ID NO: 1665203 - RNA, 17 nt, Salmonella enterica enterica serovar Typhi
cguaaauacccaggcca

SEQ ID NO: 1665204 - RNA, 18 nt, Salmonella enterica enterica serovar Typhi
cguaaauucccuccagau

SEQ ID NO: 1665205 - RNA, 19 nt, Salmonella enterica enterica serovar Typhi
cguaaauacccaggccauc

SEQ ID NO: 1665206 - RNA, 20 nt, Salmonella enterica enterica serovar Typhi
cguaaauccacauuccagac

SEQ ID NO: 1665207 - RNA, 14 nt, Salmonella enterica enterica serovar Typhi
cguaagaccagauu

SEQ ID NO: 1665208 - RNA, 23 nt, Salmonella enterica enterica serovar Typhi
cguaagcuuucugaauuucacgc

SEQ ID NO: 1665209 - RNA, 14 nt, Salmonella enterica enterica serovar Typhi
cguaagcgacaucu

SEQ ID NO: 1665210 - RNA, 12 nt, Salmonella enterica enterica serovar Typhi
cguaagcgcguu

SEQ ID NO: 1665211 - RNA, 14 nt, Salmonella enterica enterica serovar Typhi
cguaaagccaucca

SEQ ID NO: 1665212 - RNA, 22 nt, Salmonella enterica enterica serovar Typhi
cguaaagcuggccuucagguuu

SEQ ID NO: 1665213 - RNA, 22 nt, Salmonella enterica enterica serovar Typhi
cguaaagggaagaucauuauca

SEQ ID NO: 1665214 - RNA, 17 nt, Salmonella enterica enterica serovar Typhi
cgguugggcagaaacgu

SEQ ID NO: 1665215 - RNA, 13 nt, Salmonella enterica enterica serovar Typhi
cgguuccagcggc

SEQ ID NO: 1665216 - RNA, 17 nt, Salmonella enterica enterica serovar Typhi
cgguucauccugcgcca

SEQ ID NO: 1665217 - RNA, 13 nt, Salmonella enterica enterica serovar Typhi
cgguugcugauaa

SEQ ID NO: 1665218 - RNA, 16 nt, Salmonella enterica enterica serovar Typhi
cgguugccaaugcgga

SEQ ID NO: 1665219 - RNA, 17 nt, Salmonella enterica enterica serovar Typhi
cggugucaaagcgccag

SEQ ID NO: 1665220 - RNA, 19 nt, Salmonella enterica enterica serovar Typhi
cgguguuuagacacauuga

SEQ ID NO: 1665221 - RNA, 12 nt, Salmonella enterica enterica serovar Typhi
cguggcgccacc

SEQ ID NO: 1665222 - RNA, 22 nt, Salmonella enterica enterica serovar Typhi
cguggcgcgaauuuucgauaau

SEQ ID NO: 1665223 - RNA, 12 nt, Salmonella enterica enterica serovar Typhi
cguggugcggga

SEQ ID NO: 1665224 - RNA, 16 nt, Salmonella enterica enterica serovar Typhi
cguguaaggcaaucgc

SEQ ID NO: 1665225 - RNA, 13 nt, Salmonella enterica enterica serovar Typhi
cguucaucaggca

SEQ ID NO: 1665226 - RNA, 16 nt, Salmonella enterica enterica serovar Typhi
cguucagauaggcgcg

SEQ ID NO: 1665227 - RNA, 15 nt, Salmonella enterica enterica serovar Typhi
cguucagcaucggga

SEQ ID NO: 1665228 - RNA, 18 nt, Salmonella enterica enterica serovar Typhi
cguucauccgucuggcga

SEQ ID NO: 1665229 - RNA, 17 nt, Salmonella enterica enterica serovar Typhi
cguucauccaugauggc

SEQ ID NO: 1665230 - RNA, 18 nt, Salmonella enterica enterica serovar Typhi
cguucaucaggcaauaaa

SEQ ID NO: 1665231 - RNA, 12 nt, Salmonella enterica enterica serovar Typhi
cguucugcgcca

SEQ ID NO: 1665232 - RNA, 15 nt, Salmonella enterica enterica serovar Typhi
cguuccccaacagcg

SEQ ID NO: 1665233 - RNA, 20 nt, Salmonella enterica enterica serovar Typhi
cgugugucccggacaaugua

SEQ ID NO: 1665234 - RNA, 19 nt, Salmonella enterica enterica serovar Typhi
cguguuuuuccagcaacgg

SEQ ID NO: 1665235 - RNA, 15 nt, Salmonella enterica enterica serovar Typhi
cguuaacgcagcauc

SEQ ID NO: 1665236 - RNA, 15 nt, Salmonella enterica enterica serovar Typhi
cguuaacggcgccac

SEQ ID NO: 1665237 - RNA, 15 nt, Salmonella enterica enterica serovar Typhi
cguuaacugcugcgc

SEQ ID NO: 1665238 - RNA, 22 nt, Salmonella enterica enterica serovar Typhi
cguuaaauccucccaucgagcc

SEQ ID NO: 1665239 - RNA, 15 nt, Salmonella enterica enterica serovar Typhi
cguuaaauaccagca

SEQ ID NO: 1665240 - RNA, 15 nt, Salmonella enterica enterica serovar Typhi
cguuaccaaucugcg

SEQ ID NO: 1665241 - RNA, 20 nt, Salmonella enterica enterica serovar Typhi
cguuaauuuuccccgcacgc

SEQ ID NO: 1665242 - RNA, 16 nt, Salmonella enterica enterica serovar Typhi
cguuacccaugagcga

SEQ ID NO: 1665243 - RNA, 19 nt, Salmonella enterica enterica serovar Typhi
cguuaaucuggccuacgga

SEQ ID NO: 1665244 - RNA, 17 nt, Salmonella enterica enterica serovar Typhi
cguuaaggccugcgcga

SEQ ID NO: 1665245 - RNA, 16 nt, Salmonella enterica enterica serovar Typhi
cguuaaguagcggaac

SEQ ID NO: 1665246 - RNA, 21 nt, Salmonella enterica enterica serovar Typhi
cguuaccggugauauugccga

SEQ ID NO: 1665247 - RNA, 18 nt, Salmonella enterica enterica serovar Typhi
cguuagccgccauccggc

SEQ ID NO: 1665248 - RNA, 19 nt, Salmonella enterica enterica serovar Typhi
cguuagccgccauccggca

SEQ ID NO: 1665249 - RNA, 15 nt, Salmonella enterica enterica serovar Typhi
cguuagaauaacguu

SEQ ID NO: 1665250 - RNA, 20 nt, Salmonella enterica enterica serovar Typhi
cguuacuguuuuaucaggga

SEQ ID NO: 1665251 - RNA, 15 nt, Salmonella enterica enterica serovar Typhi
cguuauucgaugcgg

SEQ ID NO: 1665252 - RNA, 19 nt, Salmonella enterica enterica serovar Typhi
cguucaacggcaaaucgcg

SEQ ID NO: 1665253 - RNA, 16 nt, Salmonella enterica enterica serovar Typhi
cguucacgaucaccug

SEQ ID NO: 1665254 - RNA, 18 nt, Salmonella enterica enterica serovar Typhi
cguuagcgccauccggca

SEQ ID NO: 1665255 - RNA, 14 nt, Salmonella enterica enterica serovar Typhi
cguuauaaggccug

SEQ ID NO: 1665256 - RNA, 23 nt, Salmonella enterica enterica serovar Typhi
cguuaucguagugccacaacgcc

SEQ ID NO: 1665257 - RNA, 18 nt, Salmonella enterica enterica serovar Typhi
cguuaucugaccuacagg

SEQ ID NO: 1665258 - RNA, 12 nt, Salmonella enterica enterica serovar Typhi
cguuauccagca

SEQ ID NO: 1665259 - RNA, 22 nt, Salmonella enterica enterica serovar Typhi
cgucuguuucaacgcauccagc

SEQ ID NO: 1665260 - RNA, 17 nt, Salmonella enterica enterica serovar Typhi
cgucuguguuuauccgg

SEQ ID NO: 1665261 - RNA, 23 nt, Salmonella enterica enterica serovar Typhi
cgucuucaggucauucaggacgg

SEQ ID NO: 1665262 - RNA, 14 nt, Salmonella enterica enterica serovar Typhi
cgugacccgccagc

SEQ ID NO: 1665263 - RNA, 15 nt, Salmonella enterica enterica serovar Typhi
cgugacccgccagca

SEQ ID NO: 1665264 - RNA, 12 nt, Salmonella enterica enterica serovar Typhi
cgugaccaucgc

SEQ ID NO: 1665265 - RNA, 18 nt, Salmonella enterica enterica serovar Typhi
cgugacaucaagcccaca

SEQ ID NO: 1665266 - RNA, 18 nt, Salmonella enterica enterica serovar Typhi
cgugaauguccugcggca

SEQ ID NO: 1665267 - RNA, 17 nt, Salmonella enterica enterica serovar Typhi
cgucuuccggauaacgc

SEQ ID NO: 1665268 - RNA, 21 nt, Salmonella enterica enterica serovar Typhi
cgucuucaucagccagcaucg

SEQ ID NO: 1665269 - RNA, 15 nt, Salmonella enterica enterica serovar Typhi
cgucucgauacgcug

SEQ ID NO: 1665270 - RNA, 21 nt, Salmonella enterica enterica serovar Typhi
cgucguuguccggcugaagcg

SEQ ID NO: 1665271 - RNA, 18 nt, Salmonella enterica enterica serovar Typhi
cgucgcguucagcgccug

SEQ ID NO: 1665272 - RNA, 21 nt, Salmonella enterica enterica serovar Typhi
cgucguacucaccaguccggc

SEQ ID NO: 1665273 - RNA, 13 nt, Salmonella enterica enterica serovar Typhi
cgugagcgcaucc

SEQ ID NO: 1665274 - RNA, 13 nt, Salmonella enterica enterica serovar Typhi
cgugagcgcguca

SEQ ID NO: 1665275 - RNA, 21 nt, Salmonella enterica enterica serovar Typhi
cgugacuguucacauccagcc

SEQ ID NO: 1665276 - RNA, 19 nt, Salmonella enterica enterica serovar Typhi
cgugagaaguaagcgccag

SEQ ID NO: 1665277 - RNA, 11 nt, Salmonella enterica enterica serovar Typhi
cgugaccugcu

SEQ ID NO: 1665278 - RNA, 19 nt, Salmonella enterica enterica serovar Typhi
cgugccaugaccauucaca

SEQ ID NO: 1665279 - RNA, 21 nt, Salmonella enterica enterica serovar Typhi
cgugcaugggauacgccagca

SEQ ID NO: 1665280 - RNA, 16 nt, Salmonella enterica enterica serovar Typhi
cgugccgaccagcggu

SEQ ID NO: 1665281 - RNA, 15 nt, Salmonella enterica enterica serovar Typhi
cgugcgccauccggc

SEQ ID NO: 1665282 - RNA, 14 nt, Salmonella enterica enterica serovar Typhi
cguggcaaucagca

SEQ ID NO: 1665283 - RNA, 14 nt, Salmonella enterica enterica serovar Typhi
cugacaaucagcac

SEQ ID NO: 1665284 - RNA, 18 nt, Salmonella enterica enterica serovar Typhi
cugacacccucugcgccu

SEQ ID NO: 1665285 - RNA, 20 nt, Salmonella enterica enterica serovar Typhi
cugacagaaauagccgguaa

SEQ ID NO: 1665286 - RNA, 16 nt, Salmonella enterica enterica serovar Typhi
cugacagcgcgcgaau

SEQ ID NO: 1665287 - RNA, 15 nt, Salmonella enterica enterica serovar Typhi
cugacauucagcgcu

SEQ ID NO: 1665288 - RNA, 24 nt, Salmonella enterica enterica serovar Typhi
cugaauauuagaguggccgcgcaa

SEQ ID NO: 1665289 - RNA, 21 nt, Salmonella enterica enterica serovar Typhi
cugaaucucuucccagcgcac

SEQ ID NO: 1665290 - RNA, 14 nt, Salmonella enterica enterica serovar Typhi
cugaaucaguaucc

SEQ ID NO: 1665291 - RNA, 17 nt, Salmonella enterica enterica serovar Typhi
cugaauaacagcaccau

SEQ ID NO: 1665292 - RNA, 22 nt, Salmonella enterica enterica serovar Typhi
cugaaaacggcaucaagcccau

SEQ ID NO: 1665293 - RNA, 20 nt, Salmonella enterica enterica serovar Typhi
cugaaaaaggguaacgggac

SEQ ID NO: 1665294 - RNA, 22 nt, Salmonella enterica enterica serovar Typhi
cucuuucagccgacuaucuucu

SEQ ID NO: 1665295 - RNA, 14 nt, Salmonella enterica enterica serovar Typhi
cucguugcgucgug

SEQ ID NO: 1665296 - RNA, 14 nt, Salmonella enterica enterica serovar Typhi
cucuacucgcggac

SEQ ID NO: 1665297 - RNA, 13 nt, Salmonella enterica enterica serovar Typhi
cucuaucagcgcc

SEQ ID NO: 1665298 - RNA, 15 nt, Salmonella enterica enterica serovar Typhi
cucguaagaggcgug

SEQ ID NO: 1665299 - RNA, 17 nt, Salmonella enterica enterica serovar Typhi
cugaugagcgcagcgac

SEQ ID NO: 1665300 - RNA, 14 nt, Salmonella enterica enterica serovar Typhi
cugcaacagcacca

SEQ ID NO: 1665301 - RNA, 12 nt, Salmonella enterica enterica serovar Typhi
cugcaacuccug

SEQ ID NO: 1665302 - RNA, 19 nt, Salmonella enterica enterica serovar Typhi
cugcaacuccacaaauagc

SEQ ID NO: 1665303 - RNA, 14 nt, Salmonella enterica enterica serovar Typhi
cugcaacgccagau

SEQ ID NO: 1665304 - RNA, 13 nt, Salmonella enterica enterica serovar Typhi
cugcagaaucucu

SEQ ID NO: 1665305 - RNA, 22 nt, Salmonella enterica enterica serovar Typhi
cugcagagcggcaaauucagcg

SEQ ID NO: 1665306 - RNA, 20 nt, Salmonella enterica enterica serovar Typhi
cugaucgccaacgaccggcg

SEQ ID NO: 1665307 - RNA, 16 nt, Salmonella enterica enterica serovar Typhi
cugagcgaauguauaa

SEQ ID NO: 1665308 - RNA, 16 nt, Salmonella enterica enterica serovar Typhi
cugagcgcgagcaugu

SEQ ID NO: 1665309 - RNA, 17 nt, Salmonella enterica enterica serovar Typhi
cugacguagauucugau

SEQ ID NO: 1665310 - RNA, 22 nt, Salmonella enterica enterica serovar Typhi
cugccuuuaacaaauuaaaucc

SEQ ID NO: 1665311 - RNA, 17 nt, Salmonella enterica enterica serovar Typhi
cugccguuugcgccagc

SEQ ID NO: 1665312 - RNA, 21 nt, Salmonella enterica enterica serovar Typhi
cugccgugguccggcgucaac

SEQ ID NO: 1665313 - RNA, 16 nt, Salmonella enterica enterica serovar Typhi
cugccgucaucgacuu

SEQ ID NO: 1665314 - RNA, 15 nt, Salmonella enterica enterica serovar Typhi
cugccgggguaucau

SEQ ID NO: 1665315 - RNA, 16 nt, Salmonella enterica enterica serovar Typhi
cugccguagcguacuu

SEQ ID NO: 1665316 - RNA, 15 nt, Salmonella enterica enterica serovar Typhi
cugccgguucggcau

SEQ ID NO: 1665317 - RNA, 19 nt, Salmonella enterica enterica serovar Typhi
cugccgcaccagucggcaa

SEQ ID NO: 1665318 - RNA, 21 nt, Salmonella enterica enterica serovar Typhi
cugccgauagcaucgcugaug

SEQ ID NO: 1665319 - RNA, 12 nt, Salmonella enterica enterica serovar Typhi
cugccgacaacg

SEQ ID NO: 1665320 - RNA, 12 nt, Salmonella enterica enterica serovar Typhi
cugcccugcggu

SEQ ID NO: 1665321 - RNA, 18 nt, Salmonella enterica enterica serovar Typhi
cugccgcgcccgccaucg

SEQ ID NO: 1665322 - RNA, 17 nt, Salmonella enterica enterica serovar Typhi
cugcagcccuuacgcuu

SEQ ID NO: 1665323 - RNA, 20 nt, Salmonella enterica enterica serovar Typhi
cugcaggccaaauagaacgc

SEQ ID NO: 1665324 - RNA, 16 nt, Salmonella enterica enterica serovar Typhi
cugcagggaauaagcg

SEQ ID NO: 1665325 - RNA, 18 nt, Salmonella enterica enterica serovar Typhi
cugcagggauaugcugau

SEQ ID NO: 1665326 - RNA, 15 nt, Salmonella enterica enterica serovar Typhi
cugcauccuguacca

SEQ ID NO: 1665327 - RNA, 17 nt, Salmonella enterica enterica serovar Typhi
cugcauuaacggcaaca

SEQ ID NO: 1665328 - RNA, 23 nt, Salmonella enterica enterica serovar Typhi
cugcauucuuucaauaauggcgc

SEQ ID NO: 1665329 - RNA, 20 nt, Salmonella enterica enterica serovar Typhi
cugcauguaguaagccauuc

SEQ ID NO: 1665330 - RNA, 16 nt, Salmonella enterica enterica serovar Typhi
cugccauuaucaccau

SEQ ID NO: 1665331 - RNA, 19 nt, Salmonella enterica enterica serovar Typhi
cugccagucugcccggcaa

SEQ ID NO: 1665332 - RNA, 15 nt, Salmonella enterica enterica serovar Typhi
cugccagaccggcga

SEQ ID NO: 1665333 - RNA, 19 nt, Salmonella enterica enterica serovar Typhi
cucgcugauggcgagaagc

SEQ ID NO: 1665334 - RNA, 16 nt, Salmonella enterica enterica serovar Typhi
cucgcugccggaaagc

SEQ ID NO: 1665335 - RNA, 20 nt, Salmonella enterica enterica serovar Typhi
cucgcgacauggcgguaauc

SEQ ID NO: 1665336 - RNA, 15 nt, Salmonella enterica enterica serovar Typhi
cucgcccuugccgcu

SEQ ID NO: 1665337 - RNA, 11 nt, Salmonella enterica enterica serovar Typhi
cucgccgauag

SEQ ID NO: 1665338 - RNA, 15 nt, Salmonella enterica enterica serovar Typhi
cucgaggaacuguuc

SEQ ID NO: 1665339 - RNA, 13 nt, Salmonella enterica enterica serovar Typhi
cucgccagcccga

SEQ ID NO: 1665340 - RNA, 22 nt, Salmonella enterica enterica serovar Typhi
cucgccauaaaucccggcgauu

SEQ ID NO: 1665341 - RNA, 15 nt, Salmonella enterica enterica serovar Typhi
cuccgcccagacaau

SEQ ID NO: 1665342 - RNA, 14 nt, Salmonella enterica enterica serovar Typhi
cuccgccagggcgg

SEQ ID NO: 1665343 - RNA, 18 nt, Salmonella enterica enterica serovar Typhi
cuccgcaguaaucaccgu

SEQ ID NO: 1665344 - RNA, 16 nt, Salmonella enterica enterica serovar Typhi
cuccggcaguccaugc

SEQ ID NO: 1665345 - RNA, 15 nt, Salmonella enterica enterica serovar Typhi
cuccggcagcguauu

SEQ ID NO: 1665346 - RNA, 20 nt, Salmonella enterica enterica serovar Typhi
cuccggcagcguauugagcu

SEQ ID NO: 1665347 - RNA, 14 nt, Salmonella enterica enterica serovar Typhi
cuccuucauccaga

SEQ ID NO: 1665348 - RNA, 16 nt, Salmonella enterica enterica serovar Typhi
cuccggcuaugccgga

SEQ ID NO: 1665349 - RNA, 16 nt, Salmonella enterica enterica serovar Typhi
cuagcgccuuauccgg

SEQ ID NO: 1665350 - RNA, 16 nt, Salmonella enterica enterica serovar Typhi
cuagcgucccggcaau

SEQ ID NO: 1665351 - RNA, 14 nt, Salmonella enterica enterica serovar Typhi
cuauacgcggcgua

SEQ ID NO: 1665352 - RNA, 22 nt, Salmonella enterica enterica serovar Typhi
cuaucacacauaucgccagcca

SEQ ID NO: 1665353 - RNA, 22 nt, Salmonella enterica enterica serovar Typhi
cuaucauacacaucauuaccau

SEQ ID NO: 1665354 - RNA, 23 nt, Salmonella enterica enterica serovar Typhi
cuauccaucgccgcgccgucggg

SEQ ID NO: 1665355 - RNA, 19 nt, Salmonella enterica enterica serovar Typhi
cuaucuggauacgauaagc

SEQ ID NO: 1665356 - RNA, 14 nt, Salmonella enterica enterica serovar Typhi
cuaucuucgauaaa

SEQ ID NO: 1665357 - RNA, 17 nt, Salmonella enterica enterica serovar Typhi
cucaacauacgccgcca

SEQ ID NO: 1665358 - RNA, 16 nt, Salmonella enterica enterica serovar Typhi
cucaacauugccggca

SEQ ID NO: 1665359 - RNA, 23 nt, Salmonella enterica enterica serovar Typhi
cucaaccgcgcggcguucugcgc

SEQ ID NO: 1665360 - RNA, 19 nt, Salmonella enterica enterica serovar Typhi
cuaugcgccaguuguccgc

SEQ ID NO: 1665361 - RNA, 17 nt, Salmonella enterica enterica serovar Typhi
cuaucuuuucaaucagg

SEQ ID NO: 1665362 - RNA, 14 nt, Salmonella enterica enterica serovar Typhi
cucaaucggcgaua

SEQ ID NO: 1665363 - RNA, 22 nt, Salmonella enterica enterica serovar Typhi
cuacaggucggguaagcguagc

SEQ ID NO: 1665364 - RNA, 15 nt, Salmonella enterica enterica serovar Typhi
cguucuuuugaacuu

SEQ ID NO: 1665365 - RNA, 19 nt, Salmonella enterica enterica serovar Typhi
cguugagaaaaccauauaa

SEQ ID NO: 1665366 - RNA, 23 nt, Salmonella enterica enterica serovar Typhi
cuaccggcgguucuuuugcuaac

SEQ ID NO: 1665367 - RNA, 17 nt, Salmonella enterica enterica serovar Typhi
cuacuauuaguucugag

SEQ ID NO: 1665368 - RNA, 16 nt, Salmonella enterica enterica serovar Typhi
cuaccggaaucgccug

SEQ ID NO: 1665369 - RNA, 11 nt, Salmonella enterica enterica serovar Typhi
cuacuuuaucg

SEQ ID NO: 1665370 - RNA, 11 nt, Salmonella enterica enterica serovar Typhi
cucccaacaga

SEQ ID NO: 1665371 - RNA, 17 nt, Salmonella enterica enterica serovar Typhi
cuccagcgccagcucca

SEQ ID NO: 1665372 - RNA, 17 nt, Salmonella enterica enterica serovar Typhi
cuccagcccaucagucc

SEQ ID NO: 1665373 - RNA, 14 nt, Salmonella enterica enterica serovar Typhi
cuccagcagaccgg

SEQ ID NO: 1665374 - RNA, 21 nt, Salmonella enterica enterica serovar Typhi
cuccagcacgcgcugcgccgc

SEQ ID NO: 1665375 - RNA, 22 nt, Salmonella enterica enterica serovar Typhi
cucacgcuggugcuuggcguga

SEQ ID NO: 1665376 - RNA, 21 nt, Salmonella enterica enterica serovar Typhi
cucaccagcugacgcagcagu

SEQ ID NO: 1665377 - RNA, 22 nt, Salmonella enterica enterica serovar Typhi
cucacacauuggcgcggcagga

SEQ ID NO: 1665378 - RNA, 19 nt, Salmonella enterica enterica serovar Typhi
cucacauucauugccgcca

SEQ ID NO: 1665379 - RNA, 13 nt, Salmonella enterica enterica serovar Typhi
cucacgucccguu

SEQ ID NO: 1665380 - RNA, 15 nt, Salmonella enterica enterica serovar Typhi
cucagcgcggcagcc

SEQ ID NO: 1665381 - RNA, 21 nt, Salmonella enterica enterica serovar Typhi
cucaucaguuugcgauaagcg

SEQ ID NO: 1665382 - RNA, 12 nt, Salmonella enterica enterica serovar Typhi
cucagcggccca

SEQ ID NO: 1665383 - RNA, 13 nt, Salmonella enterica enterica serovar Typhi
cucauccagcaac

SEQ ID NO: 1665384 - RNA, 20 nt, Salmonella enterica enterica serovar Typhi
cucauccaacugcgccugaa

SEQ ID NO: 1665385 - RNA, 11 nt, Salmonella enterica enterica serovar Typhi
cucauccagcg

SEQ ID NO: 1665386 - RNA, 19 nt, Salmonella enterica enterica serovar Typhi
gacagcaggaacggcagga

SEQ ID NO: 1665387 - RNA, 23 nt, Salmonella enterica enterica serovar Typhi
gacagcaauguuaaauucagcau

SEQ ID NO: 1665388 - RNA, 13 nt, Salmonella enterica enterica serovar Typhi
gacaccagccguu

SEQ ID NO: 1665389 - RNA, 20 nt, Salmonella enterica enterica serovar Typhi
gacacauucaggcuuuccac

SEQ ID NO: 1665390 - RNA, 16 nt, Salmonella enterica enterica serovar Typhi
gacacccgcagccaga

SEQ ID NO: 1665391 - RNA, 22 nt, Salmonella enterica enterica serovar Typhi
gacagcgcgcgcgacggcagcc

SEQ ID NO: 1665392 - RNA, 18 nt, Salmonella enterica enterica serovar Typhi
gaccacggccacagccau

SEQ ID NO: 1665393 - RNA, 21 nt, Salmonella enterica enterica serovar Typhi
gaccacggccacagccauccg

SEQ ID NO: 1665394 - RNA, 22 nt, Salmonella enterica enterica serovar Typhi
gaccacggccacagccauccga

SEQ ID NO: 1665395 - RNA, 16 nt, Salmonella enterica enterica serovar Typhi
gacauccccgccgaga

SEQ ID NO: 1665396 - RNA, 20 nt, Salmonella enterica enterica serovar Typhi
gacaucagccagccgccaaa

SEQ ID NO: 1665397 - RNA, 14 nt, Salmonella enterica enterica serovar Typhi
gaaucguucgccag

SEQ ID NO: 1665398 - RNA, 20 nt, Salmonella enterica enterica serovar Typhi
gaaucccgccaucguccagc

SEQ ID NO: 1665399 - RNA, 20 nt, Salmonella enterica enterica serovar Typhi
gaauccggcgcucaucagac

SEQ ID NO: 1665400 - RNA, 22 nt, Salmonella enterica enterica serovar Typhi
gaaucaguaacacaaucaggcg

SEQ ID NO: 1665401 - RNA, 12 nt, Salmonella enterica enterica serovar Typhi
gaaucaucagaa

SEQ ID NO: 1665402 - RNA, 11 nt, Salmonella enterica enterica serovar Typhi
gaaucagccag

SEQ ID NO: 1665403 - RNA, 21 nt, Salmonella enterica enterica serovar Typhi
gaaucagaugcucaucaacga

SEQ ID NO: 1665404 - RNA, 23 nt, Salmonella enterica enterica serovar Typhi
gaauaccagaaucaccgacagca

SEQ ID NO: 1665405 - RNA, 21 nt, Salmonella enterica enterica serovar Typhi
gaauaccgauucccagucauc

SEQ ID NO: 1665406 - RNA, 21 nt, Salmonella enterica enterica serovar Typhi
gaaucacauccgccagcgccu

SEQ ID NO: 1665407 - RNA, 14 nt, Salmonella enterica enterica serovar Typhi
gaauaacgccaggu

SEQ ID NO: 1665408 - RNA, 14 nt, Salmonella enterica enterica serovar Typhi
gaauaagccggaug

SEQ ID NO: 1665409 - RNA, 12 nt, Salmonella enterica enterica serovar Typhi
gaauacacaaug

SEQ ID NO: 1665410 - RNA, 20 nt, Salmonella enterica enterica serovar Typhi
gaacucggucaggguaauag

SEQ ID NO: 1665411 - RNA, 16 nt, Salmonella enterica enterica serovar Typhi
gaacucgucuuauccg

SEQ ID NO: 1665412 - RNA, 17 nt, Salmonella enterica enterica serovar Typhi
gaacucgucuuauccga

SEQ ID NO: 1665413 - RNA, 18 nt, Salmonella enterica enterica serovar Typhi
gaacugauguuccggcac

SEQ ID NO: 1665414 - RNA, 12 nt, Salmonella enterica enterica serovar Typhi
gaauggcgccuu

SEQ ID NO: 1665415 - RNA, 20 nt, Salmonella enterica enterica serovar Typhi
gaauggcgggccuacgcgca

SEQ ID NO: 1665416 - RNA, 23 nt, Salmonella enterica enterica serovar Typhi
gacaaccugccguuuuccagccg

SEQ ID NO: 1665417 - RNA, 19 nt, Salmonella enterica enterica serovar Typhi
gaauuucugcugccagcgc

SEQ ID NO: 1665418 - RNA, 21 nt, Salmonella enterica enterica serovar Typhi
gaauuucugcugccagcgccg

SEQ ID NO: 1665419 - RNA, 20 nt, Salmonella enterica enterica serovar Typhi
gaauuugucgucaugcgcca

SEQ ID NO: 1665420 - RNA, 22 nt, Salmonella enterica enterica serovar Typhi
gaauuuaucaauaaccgccagc

SEQ ID NO: 1665421 - RNA, 13 nt, Salmonella enterica enterica serovar Typhi
gaauuuccugcgc

SEQ ID NO: 1665422 - RNA, 17 nt, Salmonella enterica enterica serovar Typhi
gacacauccugcgggau

SEQ ID NO: 1665423 - RNA, 23 nt, Salmonella enterica enterica serovar Typhi
gacaacgccgguacgcagcaggc

SEQ ID NO: 1665424 - RNA, 19 nt, Salmonella enterica enterica serovar Typhi
gacaacgccgccuggcauc

SEQ ID NO: 1665425 - RNA, 15 nt, Salmonella enterica enterica serovar Typhi
gacaacgcuccagca

SEQ ID NO: 1665426 - RNA, 19 nt, Salmonella enterica enterica serovar Typhi
gacaacguaaacggcagcc

SEQ ID NO: 1665427 - RNA, 22 nt, Salmonella enterica enterica serovar Typhi
gacaaggcgguacgccgccauc

SEQ ID NO: 1665428 - RNA, 14 nt, Salmonella enterica enterica serovar Typhi
gaccgucagcagca

SEQ ID NO: 1665429 - RNA, 22 nt, Salmonella enterica enterica serovar Typhi
gaccggucauacugaacaagcg

SEQ ID NO: 1665430 - RNA, 14 nt, Salmonella enterica enterica serovar Typhi
gaccggucagccgg

SEQ ID NO: 1665431 - RNA, 17 nt, Salmonella enterica enterica serovar Typhi
gaccggucagccgguuu

SEQ ID NO: 1665432 - RNA, 17 nt, Salmonella enterica enterica serovar Typhi
gaccgggcugcacgcca

SEQ ID NO: 1665433 - RNA, 15 nt, Salmonella enterica enterica serovar Typhi
gaccgcacagcagac

SEQ ID NO: 1665434 - RNA, 14 nt, Salmonella enterica enterica serovar Typhi
gaccgcagcuuauu

SEQ ID NO: 1665435 - RNA, 14 nt, Salmonella enterica enterica serovar Typhi
gaccagcgacagua

SEQ ID NO: 1665436 - RNA, 18 nt, Salmonella enterica enterica serovar Typhi
gaccagcgugaccgguaa

SEQ ID NO: 1665437 - RNA, 17 nt, Salmonella enterica enterica serovar Typhi
gaccagcaguuccggcg

SEQ ID NO: 1665438 - RNA, 14 nt, Salmonella enterica enterica serovar Typhi
gaccagcaucagaa

SEQ ID NO: 1665439 - RNA, 17 nt, Salmonella enterica enterica serovar Typhi
gaccaggucgccagcgg

SEQ ID NO: 1665440 - RNA, 21 nt, Salmonella enterica enterica serovar Typhi
gaccaguuuuugcgccagcgc

SEQ ID NO: 1665441 - RNA, 20 nt, Salmonella enterica enterica serovar Typhi
gaccauaugcggcaucgucc

SEQ ID NO: 1665442 - RNA, 13 nt, Salmonella enterica enterica serovar Typhi
gaccgagaucagg

SEQ ID NO: 1665443 - RNA, 17 nt, Salmonella enterica enterica serovar Typhi
gacgcuuuucagcgucu

SEQ ID NO: 1665444 - RNA, 16 nt, Salmonella enterica enterica serovar Typhi
gacgcuguucaaagcc

SEQ ID NO: 1665445 - RNA, 21 nt, Salmonella enterica enterica serovar Typhi
gacgcuuacaucgccauccgg

SEQ ID NO: 1665446 - RNA, 20 nt, Salmonella enterica enterica serovar Typhi
gacggagauuaacagcgcga

SEQ ID NO: 1665447 - RNA, 15 nt, Salmonella enterica enterica serovar Typhi
gacgcuccaucacgg

SEQ ID NO: 1665448 - RNA, 23 nt, Salmonella enterica enterica serovar Typhi
gacgcguagcgucuuauccggcc

SEQ ID NO: 1665449 - RNA, 13 nt, Salmonella enterica enterica serovar Typhi
gacgcgccagcgg

SEQ ID NO: 1665450 - RNA, 15 nt, Salmonella enterica enterica serovar Typhi
gacgcgccagcggau

SEQ ID NO: 1665451 - RNA, 14 nt, Salmonella enterica enterica serovar Typhi
gacgcgcaggccgu

SEQ ID NO: 1665452 - RNA, 17 nt, Salmonella enterica enterica serovar Typhi
gacgccguccaggcucg

SEQ ID NO: 1665453 - RNA, 13 nt, Salmonella enterica enterica serovar Typhi
gacgccaggcaga

SEQ ID NO: 1665454 - RNA, 21 nt, Salmonella enterica enterica serovar Typhi
gacgccaggcagauugaggcg

SEQ ID NO: 1665455 - RNA, 14 nt, Salmonella enterica enterica serovar Typhi
gacgaauuuccagc

SEQ ID NO: 1665456 - RNA, 19 nt, Salmonella enterica enterica serovar Typhi
gacgaaucagcgauugcgc

SEQ ID NO: 1665457 - RNA, 12 nt, Salmonella enterica enterica serovar Typhi
gacgcaggccgg

SEQ ID NO: 1665458 - RNA, 22 nt, Salmonella enterica enterica serovar Typhi
gacgcagcucauacccuuccag

SEQ ID NO: 1665459 - RNA, 14 nt, Salmonella enterica enterica serovar Typhi
gacggguaacgcca

SEQ ID NO: 1665460 - RNA, 22 nt, Salmonella enterica enterica serovar Typhi
gacggcguauucggcauagcgc

SEQ ID NO: 1665461 - RNA, 22 nt, Salmonella enterica enterica serovar Typhi
gacggcaacggcgacaagaaua

SEQ ID NO: 1665462 - RNA, 22 nt, Salmonella enterica enterica serovar Typhi
gacgugcaccguaucggcaguc

SEQ ID NO: 1665463 - RNA, 18 nt, Salmonella enterica enterica serovar Typhi
gacgucgccauauccaag

SEQ ID NO: 1665464 - RNA, 13 nt, Salmonella enterica enterica serovar Typhi
gacguuccgcgac

SEQ ID NO: 1665465 - RNA, 15 nt, Salmonella enterica enterica serovar Typhi
gacguuaucucgcca

SEQ ID NO: 1665466 - RNA, 20 nt, Salmonella enterica enterica serovar Typhi
gagauuacugcgugcuggcg

SEQ ID NO: 1665467 - RNA, 18 nt, Salmonella enterica enterica serovar Typhi
gagauucaggccgccagc

SEQ ID NO: 1665468 - RNA, 14 nt, Salmonella enterica enterica serovar Typhi
gagauccaguauau

SEQ ID NO: 1665469 - RNA, 23 nt, Salmonella enterica enterica serovar Typhi
gagaugcaggccaagcagcgcca

SEQ ID NO: 1665470 - RNA, 18 nt, Salmonella enterica enterica serovar Typhi
gagcacguaggccugaua

SEQ ID NO: 1665471 - RNA, 18 nt, Salmonella enterica enterica serovar Typhi
gagagucgauacgcugaa

SEQ ID NO: 1665472 - RNA, 16 nt, Salmonella enterica enterica serovar Typhi
gagagcguauccagca

SEQ ID NO: 1665473 - RNA, 18 nt, Salmonella enterica enterica serovar Typhi
gagagcguauccagcacc

SEQ ID NO: 1665474 - RNA, 15 nt, Salmonella enterica enterica serovar Typhi
gagagaaaaucacgc

SEQ ID NO: 1665475 - RNA, 18 nt, Salmonella enterica enterica serovar Typhi
gagacgguaggccggaua

SEQ ID NO: 1665476 - RNA, 20 nt, Salmonella enterica enterica serovar Typhi
gagacgcguaaaucagauug

SEQ ID NO: 1665477 - RNA, 19 nt, Salmonella enterica enterica serovar Typhi
gagacuacccaucacgccc

SEQ ID NO: 1665478 - RNA, 22 nt, Salmonella enterica enterica serovar Typhi
gagaacggaccggcaaucgccu

SEQ ID NO: 1665479 - RNA, 21 nt, Salmonella enterica enterica serovar Typhi
gagaagcccggccacagcgcc

SEQ ID NO: 1665480 - RNA, 16 nt, Salmonella enterica enterica serovar Typhi
gagaauuauucguguu

SEQ ID NO: 1665481 - RNA, 22 nt, Salmonella enterica enterica serovar Typhi
gagaagcccggccacagcgcca

SEQ ID NO: 1665482 - RNA, 14 nt, Salmonella enterica enterica serovar Typhi
gagaccuaaagucu

SEQ ID NO: 1665483 - RNA, 21 nt, Salmonella enterica enterica serovar Typhi
gagaauuuuuagcgugccgac

SEQ ID NO: 1665484 - RNA, 23 nt, Salmonella enterica enterica serovar Typhi
gacugauaaagcuuucaucuuua

SEQ ID NO: 1665485 - RNA, 14 nt, Salmonella enterica enterica serovar Typhi
gacugauaccgcgu

SEQ ID NO: 1665486 - RNA, 22 nt, Salmonella enterica enterica serovar Typhi
gacucgccguuuuaucgcccgg

SEQ ID NO: 1665487 - RNA, 15 nt, Salmonella enterica enterica serovar Typhi
gacuaaaaagcgcgu

SEQ ID NO: 1665488 - RNA, 16 nt, Salmonella enterica enterica serovar Typhi
gacuacguucaucagg

SEQ ID NO: 1665489 - RNA, 15 nt, Salmonella enterica enterica serovar Typhi
gacuacccaucacgc

SEQ ID NO: 1665490 - RNA, 15 nt, Salmonella enterica enterica serovar Typhi
gacucagcagcgcau

SEQ ID NO: 1665491 - RNA, 12 nt, Salmonella enterica enterica serovar Typhi
gacucagccagg

SEQ ID NO: 1665492 - RNA, 21 nt, Salmonella enterica enterica serovar Typhi
gacucaucuuuuacaggccgg

SEQ ID NO: 1665493 - RNA, 22 nt, Salmonella enterica enterica serovar Typhi
gacuccccacaaucccgccaga

SEQ ID NO: 1665494 - RNA, 10 nt, Salmonella enterica enterica serovar Typhi
gacuccguca

SEQ ID NO: 1665495 - RNA, 13 nt, Salmonella enterica enterica serovar Typhi
gacugugauggcg

SEQ ID NO: 1665496 - RNA, 15 nt, Salmonella enterica enterica serovar Typhi
gacuggaacaggcca

SEQ ID NO: 1665497 - RNA, 22 nt, Salmonella enterica enterica serovar Typhi
gagaaaauuacgcccaucagcc

SEQ ID NO: 1665498 - RNA, 12 nt, Salmonella enterica enterica serovar Typhi
gacuucaacgcc

SEQ ID NO: 1665499 - RNA, 16 nt, Salmonella enterica enterica serovar Typhi
cuguucaucaaagaaa

SEQ ID NO: 1665500 - RNA, 19 nt, Salmonella enterica enterica serovar Typhi
cuguuagggcgcggcuggu

SEQ ID NO: 1665501 - RNA, 23 nt, Salmonella enterica enterica serovar Typhi
cuguuccacagaucuaucugaac

SEQ ID NO: 1665502 - RNA, 23 nt, Salmonella enterica enterica serovar Typhi
cugugcccagagcgacaaugaac

SEQ ID NO: 1665503 - RNA, 19 nt, Salmonella enterica enterica serovar Typhi
cuuagcuggccaaucagcg

SEQ ID NO: 1665504 - RNA, 17 nt, Salmonella enterica enterica serovar Typhi
cuuaguuuucguagggc

SEQ ID NO: 1665505 - RNA, 20 nt, Salmonella enterica enterica serovar Typhi
cuuaacccugccguuugcgc

SEQ ID NO: 1665506 - RNA, 22 nt, Salmonella enterica enterica serovar Typhi
cuuaacccugccguuugcgcca

SEQ ID NO: 1665507 - RNA, 19 nt, Salmonella enterica enterica serovar Typhi
cuuaacagaauugcgccac

SEQ ID NO: 1665508 - RNA, 22 nt, Salmonella enterica enterica serovar Typhi
cuguuuguucgcaaaauagcgg

SEQ ID NO: 1665509 - RNA, 21 nt, Salmonella enterica enterica serovar Typhi
cuuaaaacgauuuggucggcg

SEQ ID NO: 1665510 - RNA, 14 nt, Salmonella enterica enterica serovar Typhi
cuuaaaugccgccg

SEQ ID NO: 1665511 - RNA, 13 nt, Salmonella enterica enterica serovar Typhi
cuuaaacgccgga

SEQ ID NO: 1665512 - RNA, 14 nt, Salmonella enterica enterica serovar Typhi
cuguuucugcgccg

SEQ ID NO: 1665513 - RNA, 15 nt, Salmonella enterica enterica serovar Typhi
cuguagauugcgcgc

SEQ ID NO: 1665514 - RNA, 16 nt, Salmonella enterica enterica serovar Typhi
cugguugcagcgccag

SEQ ID NO: 1665515 - RNA, 14 nt, Salmonella enterica enterica serovar Typhi
cugguugaccggaa

SEQ ID NO: 1665516 - RNA, 22 nt, Salmonella enterica enterica serovar Typhi
cuguaauggcgcucuuuuccag

SEQ ID NO: 1665517 - RNA, 22 nt, Salmonella enterica enterica serovar Typhi
cuguaccguuuuguaggccgga

SEQ ID NO: 1665518 - RNA, 22 nt, Salmonella enterica enterica serovar Typhi
cuguaccugauggacaauccgc

SEQ ID NO: 1665519 - RNA, 21 nt, Salmonella enterica enterica serovar Typhi
cuguaccaccagaaucgccag

SEQ ID NO: 1665520 - RNA, 16 nt, Salmonella enterica enterica serovar Typhi
cuguaaccgcuaucau

SEQ ID NO: 1665521 - RNA, 21 nt, Salmonella enterica enterica serovar Typhi
cuguaaccuuaaaaggcgcuc

SEQ ID NO: 1665522 - RNA, 17 nt, Salmonella enterica enterica serovar Typhi
cuguaacuucacgccau

SEQ ID NO: 1665523 - RNA, 21 nt, Salmonella enterica enterica serovar Typhi
cuguaaaccgccuccaggccg

SEQ ID NO: 1665524 - RNA, 18 nt, Salmonella enterica enterica serovar Typhi
cuuccucauuuuugccca

SEQ ID NO: 1665525 - RNA, 23 nt, Salmonella enterica enterica serovar Typhi
cuuccaugcuauccgccgccagc

SEQ ID NO: 1665526 - RNA, 20 nt, Salmonella enterica enterica serovar Typhi
cuuccugcugcgcuuugucg

SEQ ID NO: 1665527 - RNA, 15 nt, Salmonella enterica enterica serovar Typhi
cuuccugcugcgcca

SEQ ID NO: 1665528 - RNA, 23 nt, Salmonella enterica enterica serovar Typhi
cuuccugccgcgaucgcggcaac

SEQ ID NO: 1665529 - RNA, 16 nt, Salmonella enterica enterica serovar Typhi
cuucgcagaucgccug

SEQ ID NO: 1665530 - RNA, 21 nt, Salmonella enterica enterica serovar Typhi
cuucgauuguugacugccagc

SEQ ID NO: 1665531 - RNA, 11 nt, Salmonella enterica enterica serovar Typhi
cuucggcgaua

SEQ ID NO: 1665532 - RNA, 22 nt, Salmonella enterica enterica serovar Typhi
cuucggaaugacaaacgccacc

SEQ ID NO: 1665533 - RNA, 22 nt, Salmonella enterica enterica serovar Typhi
cuucgccuuucaccagcgccug

SEQ ID NO: 1665534 - RNA, 18 nt, Salmonella enterica enterica serovar Typhi
cuucacuguuaucgccau

SEQ ID NO: 1665535 - RNA, 14 nt, Salmonella enterica enterica serovar Typhi
cuucagccacuggc

SEQ ID NO: 1665536 - RNA, 17 nt, Salmonella enterica enterica serovar Typhi
cuucagaaagcagguuu

SEQ ID NO: 1665537 - RNA, 23 nt, Salmonella enterica enterica serovar Typhi
cuucacccuucuucuggcucaga

SEQ ID NO: 1665538 - RNA, 23 nt, Salmonella enterica enterica serovar Typhi
cuuaucaggccuacauccggcuc

SEQ ID NO: 1665539 - RNA, 15 nt, Salmonella enterica enterica serovar Typhi
cuuaucaaaccagcu

SEQ ID NO: 1665540 - RNA, 22 nt, Salmonella enterica enterica serovar Typhi
cuucaccuucggugaaaucacg

SEQ ID NO: 1665541 - RNA, 19 nt, Salmonella enterica enterica serovar Typhi
cuucaguaauuucgaugau

SEQ ID NO: 1665542 - RNA, 17 nt, Salmonella enterica enterica serovar Typhi
cuucagcgacaucguca

SEQ ID NO: 1665543 - RNA, 21 nt, Salmonella enterica enterica serovar Typhi
cuucagccugugcaaccagcu

SEQ ID NO: 1665544 - RNA, 13 nt, Salmonella enterica enterica serovar Typhi
cuucaggcuguug

SEQ ID NO: 1665545 - RNA, 19 nt, Salmonella enterica enterica serovar Typhi
cuucauggucggacgggcc

SEQ ID NO: 1665546 - RNA, 21 nt, Salmonella enterica enterica serovar Typhi
cuucaugaguaaaugaacguu

SEQ ID NO: 1665547 - RNA, 13 nt, Salmonella enterica enterica serovar Typhi
cuucaucagccag

SEQ ID NO: 1665548 - RNA, 22 nt, Salmonella enterica enterica serovar Typhi
cuuccagcgcgucggccggcac

SEQ ID NO: 1665549 - RNA, 21 nt, Salmonella enterica enterica serovar Typhi
cuggcagguauuaauccugcg

SEQ ID NO: 1665550 - RNA, 15 nt, Salmonella enterica enterica serovar Typhi
cuggaugaggcgcug

SEQ ID NO: 1665551 - RNA, 14 nt, Salmonella enterica enterica serovar Typhi
cuggcacuggcagc

SEQ ID NO: 1665552 - RNA, 15 nt, Salmonella enterica enterica serovar Typhi
cuggaugcugccugc

SEQ ID NO: 1665553 - RNA, 16 nt, Salmonella enterica enterica serovar Typhi
cuggaggaacagcgcc

SEQ ID NO: 1665554 - RNA, 17 nt, Salmonella enterica enterica serovar Typhi
cuggagagcaacgccau

SEQ ID NO: 1665555 - RNA, 20 nt, Salmonella enterica enterica serovar Typhi
cuggagagcagcgccagcga

SEQ ID NO: 1665556 - RNA, 17 nt, Salmonella enterica enterica serovar Typhi
cuggauaccgcgccagc

SEQ ID NO: 1665557 - RNA, 19 nt, Salmonella enterica enterica serovar Typhi
cuggauagcaccauaaacg

SEQ ID NO: 1665558 - RNA, 20 nt, Salmonella enterica enterica serovar Typhi
cuggauaauggcuaugccga

SEQ ID NO: 1665559 - RNA, 15 nt, Salmonella enterica enterica serovar Typhi
cuggauaauaagacg

SEQ ID NO: 1665560 - RNA, 23 nt, Salmonella enterica enterica serovar Typhi
cuggagugacuaaaagacgccau

SEQ ID NO: 1665561 - RNA, 19 nt, Salmonella enterica enterica serovar Typhi
cuggcgaucguucgauagu

SEQ ID NO: 1665562 - RNA, 22 nt, Salmonella enterica enterica serovar Typhi
cuggcgaccgccaccauccggc

SEQ ID NO: 1665563 - RNA, 15 nt, Salmonella enterica enterica serovar Typhi
cugggcugauaggcc

SEQ ID NO: 1665564 - RNA, 13 nt, Salmonella enterica enterica serovar Typhi
cuggggauggccg

SEQ ID NO: 1665565 - RNA, 18 nt, Salmonella enterica enterica serovar Typhi
cuggguuugcagcagagu

SEQ ID NO: 1665566 - RNA, 19 nt, Salmonella enterica enterica serovar Typhi
cugguaacggcacugcuuu

SEQ ID NO: 1665567 - RNA, 19 nt, Salmonella enterica enterica serovar Typhi
cuggguuuccggaucgccg

SEQ ID NO: 1665568 - RNA, 16 nt, Salmonella enterica enterica serovar Typhi
cugggugugaucgccg

SEQ ID NO: 1665569 - RNA, 21 nt, Salmonella enterica enterica serovar Typhi
cuggcguaaaugugcgccagc

SEQ ID NO: 1665570 - RNA, 21 nt, Salmonella enterica enterica serovar Typhi
cuggcuguuccaccaacgacc

SEQ ID NO: 1665571 - RNA, 19 nt, Salmonella enterica enterica serovar Typhi
cugguaagcguagcgccac

SEQ ID NO: 1665572 - RNA, 14 nt, Salmonella enterica enterica serovar Typhi
cugguaagagagcc

SEQ ID NO: 1665573 - RNA, 16 nt, Salmonella enterica enterica serovar Typhi
cugguacguccauccg

SEQ ID NO: 1665574 - RNA, 17 nt, Salmonella enterica enterica serovar Typhi
cugguacguccauccgc

SEQ ID NO: 1665575 - RNA, 19 nt, Salmonella enterica enterica serovar Typhi
cugguggcgagauaagccg

SEQ ID NO: 1665576 - RNA, 13 nt, Salmonella enterica enterica serovar Typhi
gaacgacgcugau

SEQ ID NO: 1665577 - RNA, 13 nt, Salmonella enterica enterica serovar Typhi
gaaccuuaagcgc

SEQ ID NO: 1665578 - RNA, 13 nt, Salmonella enterica enterica serovar Typhi
gaaccuucacgcu

SEQ ID NO: 1665579 - RNA, 23 nt, Salmonella enterica enterica serovar Typhi
gaacgccgccugcgccagcgccg

SEQ ID NO: 1665580 - RNA, 17 nt, Salmonella enterica enterica serovar Typhi
gaacgccgcuagcggcg

SEQ ID NO: 1665581 - RNA, 17 nt, Salmonella enterica enterica serovar Typhi
gaacgccuuauccggcc

SEQ ID NO: 1665582 - RNA, 18 nt, Salmonella enterica enterica serovar Typhi
gaaccgcccaucaacacc

SEQ ID NO: 1665583 - RNA, 20 nt, Salmonella enterica enterica serovar Typhi
gaaccgcccaucaacaccag

SEQ ID NO: 1665584 - RNA, 17 nt, Salmonella enterica enterica serovar Typhi
gaaccgaauaacgccag

SEQ ID NO: 1665585 - RNA, 23 nt, Salmonella enterica enterica serovar Typhi
gaaccgacggugcucaugacauc

SEQ ID NO: 1665586 - RNA, 19 nt, Salmonella enterica enterica serovar Typhi
gaaccggcaucggcagcgu

SEQ ID NO: 1665587 - RNA, 19 nt, Salmonella enterica enterica serovar Typhi
gaaccguaaacgccugcac

SEQ ID NO: 1665588 - RNA, 14 nt, Salmonella enterica enterica serovar Typhi
gaaccgucaucagc

SEQ ID NO: 1665589 - RNA, 18 nt, Salmonella enterica enterica serovar Typhi
gaaccacgcaaaggcguu

SEQ ID NO: 1665590 - RNA, 14 nt, Salmonella enterica enterica serovar Typhi
gaacccaucaggga

SEQ ID NO: 1665591 - RNA, 20 nt, Salmonella enterica enterica serovar Typhi
gaacccaaagccgucggcgc

SEQ ID NO: 1665592 - RNA, 13 nt, Salmonella enterica enterica serovar Typhi
gaacaggcagcgu

SEQ ID NO: 1665593 - RNA, 17 nt, Salmonella enterica enterica serovar Typhi
gaacaggcucagcgcca

SEQ ID NO: 1665594 - RNA, 16 nt, Salmonella enterica enterica serovar Typhi
gaacagcgucauccag

SEQ ID NO: 1665595 - RNA, 18 nt, Salmonella enterica enterica serovar Typhi
gaacaugacguauucacc

SEQ ID NO: 1665596 - RNA, 14 nt, Salmonella enterica enterica serovar Typhi
gaacaugacggcag

SEQ ID NO: 1665597 - RNA, 13 nt, Salmonella enterica enterica serovar Typhi
gaacaucagccag

SEQ ID NO: 1665598 - RNA, 19 nt, Salmonella enterica enterica serovar Typhi
gaacaucgguuuguucaua

SEQ ID NO: 1665599 - RNA, 13 nt, Salmonella enterica enterica serovar Typhi
gaacaguuucgcc

SEQ ID NO: 1665600 - RNA, 17 nt, Salmonella enterica enterica serovar Typhi
gaacauaaaaacgcgcu

SEQ ID NO: 1665601 - RNA, 15 nt, Salmonella enterica enterica serovar Typhi
gaacaguuucgccag

SEQ ID NO: 1665602 - RNA, 20 nt, Salmonella enterica enterica serovar Typhi
gaacaaacagaccgccaugc

SEQ ID NO: 1665603 - RNA, 20 nt, Salmonella enterica enterica serovar Typhi
gaaaucaucaauggcgauuu

SEQ ID NO: 1665604 - RNA, 23 nt, Salmonella enterica enterica serovar Typhi
gaaaucaugccagaauugcacgc

SEQ ID NO: 1665605 - RNA, 23 nt, Salmonella enterica enterica serovar Typhi
gaaauccuggauacguuccagca

SEQ ID NO: 1665606 - RNA, 22 nt, Salmonella enterica enterica serovar Typhi
gaaaucgccgggcuauccggcu

SEQ ID NO: 1665607 - RNA, 21 nt, Salmonella enterica enterica serovar Typhi
gaaaucucgcuaaccaucagc

SEQ ID NO: 1665608 - RNA, 17 nt, Salmonella enterica enterica serovar Typhi
gaaaucugaaugguucc

SEQ ID NO: 1665609 - RNA, 16 nt, Salmonella enterica enterica serovar Typhi
gaaaucuguuccagcg

SEQ ID NO: 1665610 - RNA, 12 nt, Salmonella enterica enterica serovar Typhi
gaaaugcgaauc

SEQ ID NO: 1665611 - RNA, 15 nt, Salmonella enterica enterica serovar Typhi
gaaaugguugcguuu

SEQ ID NO: 1665612 - RNA, 18 nt, Salmonella enterica enterica serovar Typhi
cuugugcuuccagcucca

SEQ ID NO: 1665613 - RNA, 17 nt, Salmonella enterica enterica serovar Typhi
cuuguaaaaaugccugu

SEQ ID NO: 1665614 - RNA, 13 nt, Salmonella enterica enterica serovar Typhi
cuuuacugcgcca

SEQ ID NO: 1665615 - RNA, 14 nt, Salmonella enterica enterica serovar Typhi
cuuuaaucaccaug

SEQ ID NO: 1665616 - RNA, 22 nt, Salmonella enterica enterica serovar Typhi
cuuguuuuaacggaaucagauu

SEQ ID NO: 1665617 - RNA, 22 nt, Salmonella enterica enterica serovar Typhi
cuuuaaacgccagccugugauc

SEQ ID NO: 1665618 - RNA, 17 nt, Salmonella enterica enterica serovar Typhi
cuuuaacgcugcaaagu

SEQ ID NO: 1665619 - RNA, 14 nt, Salmonella enterica enterica serovar Typhi
cuuuaagaacgguu

SEQ ID NO: 1665620 - RNA, 15 nt, Salmonella enterica enterica serovar Typhi
cuucguuauaaggcc

SEQ ID NO: 1665621 - RNA, 17 nt, Salmonella enterica enterica serovar Typhi
cuucgugacccgccagc

SEQ ID NO: 1665622 - RNA, 18 nt, Salmonella enterica enterica serovar Typhi
cuugcuuuagcuugugau

SEQ ID NO: 1665623 - RNA, 15 nt, Salmonella enterica enterica serovar Typhi
cuugcugcugcugau

SEQ ID NO: 1665624 - RNA, 14 nt, Salmonella enterica enterica serovar Typhi
cuugcgccucuggu

SEQ ID NO: 1665625 - RNA, 17 nt, Salmonella enterica enterica serovar Typhi
cuugcgcaucgcaucag

SEQ ID NO: 1665626 - RNA, 21 nt, Salmonella enterica enterica serovar Typhi
cuugcgcguccgccuuugacg

SEQ ID NO: 1665627 - RNA, 17 nt, Salmonella enterica enterica serovar Typhi
gaaaguuuucgccacgu

SEQ ID NO: 1665628 - RNA, 14 nt, Salmonella enterica enterica serovar Typhi
gaaaguuucaggau

SEQ ID NO: 1665629 - RNA, 21 nt, Salmonella enterica enterica serovar Typhi
gaaauaaaucgauagcgauuu

SEQ ID NO: 1665630 - RNA, 19 nt, Salmonella enterica enterica serovar Typhi
gaaaucaaaaggcgacaca

SEQ ID NO: 1665631 - RNA, 16 nt, Salmonella enterica enterica serovar Typhi
gaaaucaucaaucgcu

SEQ ID NO: 1665632 - RNA, 20 nt, Salmonella enterica enterica serovar Typhi
gaaauauuucacguuucauc

SEQ ID NO: 1665633 - RNA, 18 nt, Salmonella enterica enterica serovar Typhi
gaaauauggcacagcacu

SEQ ID NO: 1665634 - RNA, 20 nt, Salmonella enterica enterica serovar Typhi
gaaauagcggaacugcguuu

SEQ ID NO: 1665635 - RNA, 17 nt, Salmonella enterica enterica serovar Typhi
gaaauagccccgucaug

SEQ ID NO: 1665636 - RNA, 16 nt, Salmonella enterica enterica serovar Typhi
gaaagccccugcgcca

SEQ ID NO: 1665637 - RNA, 16 nt, Salmonella enterica enterica serovar Typhi
gaaagcauucgcagca

SEQ ID NO: 1665638 - RNA, 19 nt, Salmonella enterica enterica serovar Typhi
gaaagaaggaugacgacag

SEQ ID NO: 1665639 - RNA, 21 nt, Salmonella enterica enterica serovar Typhi
gaaagacggcagcgccauccg

SEQ ID NO: 1665640 - RNA, 20 nt, Salmonella enterica enterica serovar Typhi
gaaagagauuagaacgcgua

SEQ ID NO: 1665641 - RNA, 19 nt, Salmonella enterica enterica serovar Typhi
gaaagccugauggcgcuuc

SEQ ID NO: 1665642 - RNA, 18 nt, Salmonella enterica enterica serovar Typhi
gaaagaaaacuuuccaac

SEQ ID NO: 1665643 - RNA, 19 nt, Salmonella enterica enterica serovar Typhi
gaaaauuauuuucacgcuc

SEQ ID NO: 1665644 - RNA, 19 nt, Salmonella enterica enterica serovar Typhi
gaaacaacacaaaucgggc

SEQ ID NO: 1665645 - RNA, 23 nt, Salmonella enterica enterica serovar Typhi
gaaaaugcccgacgcgccgccag

SEQ ID NO: 1665646 - RNA, 14 nt, Salmonella enterica enterica serovar Typhi
gaaaagcagccaga

SEQ ID NO: 1665647 - RNA, 18 nt, Salmonella enterica enterica serovar Typhi
gaaaacugggcaaucauc

SEQ ID NO: 1665648 - RNA, 15 nt, Salmonella enterica enterica serovar Typhi
gaaaacgaaucucgc

SEQ ID NO: 1665649 - RNA, 16 nt, Salmonella enterica enterica serovar Typhi
gaaaacuccagcagac

SEQ ID NO: 1665650 - RNA, 21 nt, Salmonella enterica enterica serovar Typhi
cuuuuuuguauuaacggcgcu

SEQ ID NO: 1665651 - RNA, 13 nt, Salmonella enterica enterica serovar Typhi
cuuuuuuaccgga

SEQ ID NO: 1665652 - RNA, 16 nt, Salmonella enterica enterica serovar Typhi
gaaaaccgagcauccg

SEQ ID NO: 1665653 - RNA, 13 nt, Salmonella enterica enterica serovar Typhi
gaaaaccgaugcc

SEQ ID NO: 1665654 - RNA, 19 nt, Salmonella enterica enterica serovar Typhi
cuuuuuauggcccgccagc

SEQ ID NO: 1665655 - RNA, 19 nt, Salmonella enterica enterica serovar Typhi
cuuuuuauggcggggcgcu

SEQ ID NO: 1665656 - RNA, 13 nt, Salmonella enterica enterica serovar Typhi
cuuuuugagcggc

SEQ ID NO: 1665657 - RNA, 16 nt, Salmonella enterica enterica serovar Typhi
cuuuuucccggugcgu

SEQ ID NO: 1665658 - RNA, 17 nt, Salmonella enterica enterica serovar Typhi
cuuuuuccuccugcgga

SEQ ID NO: 1665659 - RNA, 15 nt, Salmonella enterica enterica serovar Typhi
cuuuaugucaguaau

SEQ ID NO: 1665660 - RNA, 20 nt, Salmonella enterica enterica serovar Typhi
cuuuauuuuuaauugcugaa

SEQ ID NO: 1665661 - RNA, 22 nt, Salmonella enterica enterica serovar Typhi
cuuuuaaauuguuauaccgcuu

SEQ ID NO: 1665662 - RNA, 14 nt, Salmonella enterica enterica serovar Typhi
cuuuucagcgccag

SEQ ID NO: 1665663 - RNA, 22 nt, Salmonella enterica enterica serovar Typhi
cuuuucaucaccaucugaccgu

SEQ ID NO: 1665664 - RNA, 14 nt, Salmonella enterica enterica serovar Typhi
cuuuucgaacgccg

SEQ ID NO: 1665665 - RNA, 19 nt, Salmonella enterica enterica serovar Typhi
cuuuugagucgcauccagu

SEQ ID NO: 1665666 - RNA, 13 nt, Salmonella enterica enterica serovar Typhi
cgacauaaccggc

SEQ ID NO: 1665667 - RNA, 19 nt, Salmonella enterica enterica serovar Typhi
cgacauggcgguaaucgcg

SEQ ID NO: 1665668 - RNA, 21 nt, Salmonella enterica enterica serovar Typhi
cgacaugguuaaccaccagcg

SEQ ID NO: 1665669 - RNA, 14 nt, Salmonella enterica enterica serovar Typhi
cgaccagugaacgu

SEQ ID NO: 1665670 - RNA, 18 nt, Salmonella enterica enterica serovar Typhi
cgaccaugguucccgcca

SEQ ID NO: 1665671 - RNA, 21 nt, Salmonella enterica enterica serovar Typhi
cgaccauuuuugacacagcgu

SEQ ID NO: 1665672 - RNA, 18 nt, Salmonella enterica enterica serovar Typhi
cgaccagccugccgucuu

SEQ ID NO: 1665673 - RNA, 15 nt, Salmonella enterica enterica serovar Typhi
cgaaucuaccagauc

SEQ ID NO: 1665674 - RNA, 22 nt, Salmonella enterica enterica serovar Typhi
cgaaucgacaauccgccacgcu

SEQ ID NO: 1665675 - RNA, 12 nt, Salmonella enterica enterica serovar Typhi
cgaagucgagcu

SEQ ID NO: 1665676 - RNA, 19 nt, Salmonella enterica enterica serovar Typhi
cgaagaucguuauccagca

SEQ ID NO: 1665677 - RNA, 16 nt, Salmonella enterica enterica serovar Typhi
cgaaugcgccagcgag

SEQ ID NO: 1665678 - RNA, 14 nt, Salmonella enterica enterica serovar Typhi
cgacaccagcgucg

SEQ ID NO: 1665679 - RNA, 21 nt, Salmonella enterica enterica serovar Typhi
ccuucgacgagguuuccggcg

SEQ ID NO: 1665680 - RNA, 21 nt, Salmonella enterica enterica serovar Typhi
ccuuaugggucacauccagac

SEQ ID NO: 1665681 - RNA, 22 nt, Salmonella enterica enterica serovar Typhi
ccuuaugggucacauccagaca

SEQ ID NO: 1665682 - RNA, 16 nt, Salmonella enterica enterica serovar Typhi
ccuuaaccgggcgcuu

SEQ ID NO: 1665683 - RNA, 12 nt, Salmonella enterica enterica serovar Typhi
ccuuaauccagc

SEQ ID NO: 1665684 - RNA, 15 nt, Salmonella enterica enterica serovar Typhi
ccuuaaugucaucau

SEQ ID NO: 1665685 - RNA, 20 nt, Salmonella enterica enterica serovar Typhi
ccuuaugggucacauccaga

SEQ ID NO: 1665686 - RNA, 13 nt, Salmonella enterica enterica serovar Typhi
ccuuauccggccu

SEQ ID NO: 1665687 - RNA, 16 nt, Salmonella enterica enterica serovar Typhi
ccuuauccggcgugua

SEQ ID NO: 1665688 - RNA, 17 nt, Salmonella enterica enterica serovar Typhi
ccuuauccggcguguaa

SEQ ID NO: 1665689 - RNA, 14 nt, Salmonella enterica enterica serovar Typhi
ccuuaucaggccug

SEQ ID NO: 1665690 - RNA, 21 nt, Salmonella enterica enterica serovar Typhi
ccugucgaucauccacccggc

SEQ ID NO: 1665691 - RNA, 15 nt, Salmonella enterica enterica serovar Typhi
ccuggcagugaucca

SEQ ID NO: 1665692 - RNA, 16 nt, Salmonella enterica enterica serovar Typhi
ccuggaugcugccugc

SEQ ID NO: 1665693 - RNA, 23 nt, Salmonella enterica enterica serovar Typhi
ccuggaugcgcugaauagcgcug

SEQ ID NO: 1665694 - RNA, 15 nt, Salmonella enterica enterica serovar Typhi
ccugugccauacugu

SEQ ID NO: 1665695 - RNA, 14 nt, Salmonella enterica enterica serovar Typhi
ccuguuaauaccgu

SEQ ID NO: 1665696 - RNA, 17 nt, Salmonella enterica enterica serovar Typhi
ccuucucuuuaugcguc

SEQ ID NO: 1665697 - RNA, 17 nt, Salmonella enterica enterica serovar Typhi
ccuucuuccauucccac

SEQ ID NO: 1665698 - RNA, 23 nt, Salmonella enterica enterica serovar Typhi
ccuuugucgaaauugccgcccgu

SEQ ID NO: 1665699 - RNA, 19 nt, Salmonella enterica enterica serovar Typhi
cgaaacuccagcgauaaac

SEQ ID NO: 1665700 - RNA, 20 nt, Salmonella enterica enterica serovar Typhi
ccuuuuuauggcccgccagc

SEQ ID NO: 1665701 - RNA, 11 nt, Salmonella enterica enterica serovar Typhi
cgaacagcgca

SEQ ID NO: 1665702 - RNA, 21 nt, Salmonella enterica enterica serovar Typhi
cgaaccaccguuuaaucgccc

SEQ ID NO: 1665703 - RNA, 17 nt, Salmonella enterica enterica serovar Typhi
cgaacauuucagcgcca

SEQ ID NO: 1665704 - RNA, 22 nt, Salmonella enterica enterica serovar Typhi
cgaacauuacauccucaauguu

SEQ ID NO: 1665705 - RNA, 21 nt, Salmonella enterica enterica serovar Typhi
cgaacggcuuuccagcagcca

SEQ ID NO: 1665706 - RNA, 15 nt, Salmonella enterica enterica serovar Typhi
cgaacugauguuccg

SEQ ID NO: 1665707 - RNA, 19 nt, Salmonella enterica enterica serovar Typhi
cgaagauccgcucacgcca

SEQ ID NO: 1665708 - RNA, 19 nt, Salmonella enterica enterica serovar Typhi
cgaagagcauaugcgcugc

SEQ ID NO: 1665709 - RNA, 17 nt, Salmonella enterica enterica serovar Typhi
cgaagaggaugaaaagu

SEQ ID NO: 1665710 - RNA, 18 nt, Salmonella enterica enterica serovar Typhi
cgaacgccgccugcgcca

SEQ ID NO: 1665711 - RNA, 11 nt, Salmonella enterica enterica serovar Typhi
cgagaucgcca

SEQ ID NO: 1665712 - RNA, 13 nt, Salmonella enterica enterica serovar Typhi
cgagacgguguuu

SEQ ID NO: 1665713 - RNA, 20 nt, Salmonella enterica enterica serovar Typhi
cgagauuuuucugcgccacc

SEQ ID NO: 1665714 - RNA, 18 nt, Salmonella enterica enterica serovar Typhi
cgagcauuuccgcagcca

SEQ ID NO: 1665715 - RNA, 18 nt, Salmonella enterica enterica serovar Typhi
cgagccgucgccggccug

SEQ ID NO: 1665716 - RNA, 14 nt, Salmonella enterica enterica serovar Typhi
cgagcuguaccguc

SEQ ID NO: 1665717 - RNA, 19 nt, Salmonella enterica enterica serovar Typhi
cgagcuauguuuaagccag

SEQ ID NO: 1665718 - RNA, 18 nt, Salmonella enterica enterica serovar Typhi
cgaggcgaaacggcggaa

SEQ ID NO: 1665719 - RNA, 16 nt, Salmonella enterica enterica serovar Typhi
cgaggaacaucagcca

SEQ ID NO: 1665720 - RNA, 17 nt, Salmonella enterica enterica serovar Typhi
cgagcuuuucgccggaa

SEQ ID NO: 1665721 - RNA, 20 nt, Salmonella enterica enterica serovar Typhi
cgacguuaucgccgacaaac

SEQ ID NO: 1665722 - RNA, 12 nt, Salmonella enterica enterica serovar Typhi
cgacgucaacgg

SEQ ID NO: 1665723 - RNA, 17 nt, Salmonella enterica enterica serovar Typhi
cgacggcguauucggca

SEQ ID NO: 1665724 - RNA, 15 nt, Salmonella enterica enterica serovar Typhi
cgacgcgcggcguca

SEQ ID NO: 1665725 - RNA, 14 nt, Salmonella enterica enterica serovar Typhi
cgacgccaaccgcc

SEQ ID NO: 1665726 - RNA, 18 nt, Salmonella enterica enterica serovar Typhi
cgacgccagauagcgucu

SEQ ID NO: 1665727 - RNA, 17 nt, Salmonella enterica enterica serovar Typhi
cgacgcagacaauaaac

SEQ ID NO: 1665728 - RNA, 22 nt, Salmonella enterica enterica serovar Typhi
cgacgauugaccggggcgcaau

SEQ ID NO: 1665729 - RNA, 22 nt, Salmonella enterica enterica serovar Typhi
cgccaucaacuccuccggcgag

SEQ ID NO: 1665730 - RNA, 18 nt, Salmonella enterica enterica serovar Typhi
cgccauaucgccgccaca

SEQ ID NO: 1665731 - RNA, 21 nt, Salmonella enterica enterica serovar Typhi
cgccaucaaacgcagcaaacg

SEQ ID NO: 1665732 - RNA, 16 nt, Salmonella enterica enterica serovar Typhi
cgccauaucgccgcca

SEQ ID NO: 1665733 - RNA, 18 nt, Salmonella enterica enterica serovar Typhi
cgccaucaggcuggguaa

SEQ ID NO: 1665734 - RNA, 15 nt, Salmonella enterica enterica serovar Typhi
cgccaucaggcaugg

SEQ ID NO: 1665735 - RNA, 15 nt, Salmonella enterica enterica serovar Typhi
cgccaucaggcacgg

SEQ ID NO: 1665736 - RNA, 17 nt, Salmonella enterica enterica serovar Typhi
cgccauccaccaggcau

SEQ ID NO: 1665737 - RNA, 18 nt, Salmonella enterica enterica serovar Typhi
cgccauccgacacagcgu

SEQ ID NO: 1665738 - RNA, 21 nt, Salmonella enterica enterica serovar Typhi
cgccauaauacuuaauucaua

SEQ ID NO: 1665739 - RNA, 15 nt, Salmonella enterica enterica serovar Typhi
cgccauagcaucgac

SEQ ID NO: 1665740 - RNA, 16 nt, Salmonella enterica enterica serovar Typhi
cgccauauccgcagac

SEQ ID NO: 1665741 - RNA, 14 nt, Salmonella enterica enterica serovar Typhi
cgccauaacgccgg

SEQ ID NO: 1665742 - RNA, 20 nt, Salmonella enterica enterica serovar Typhi
cgccaguuugcgauccagua

SEQ ID NO: 1665743 - RNA, 15 nt, Salmonella enterica enterica serovar Typhi
cgccaguuggcguac

SEQ ID NO: 1665744 - RNA, 20 nt, Salmonella enterica enterica serovar Typhi
cgccaucggcgcguaaguuu

SEQ ID NO: 1665745 - RNA, 13 nt, Salmonella enterica enterica serovar Typhi
cgccaucggcuuu

SEQ ID NO: 1665746 - RNA, 18 nt, Salmonella enterica enterica serovar Typhi
cgccaucguaugcugucg

SEQ ID NO: 1665747 - RNA, 17 nt, Salmonella enterica enterica serovar Typhi
cgccaucgucgccacca

SEQ ID NO: 1665748 - RNA, 16 nt, Salmonella enterica enterica serovar Typhi
cgccaucugugccagc

SEQ ID NO: 1665749 - RNA, 17 nt, Salmonella enterica enterica serovar Typhi
cgccaucuuccucacag

SEQ ID NO: 1665750 - RNA, 21 nt, Salmonella enterica enterica serovar Typhi
cgccaugaccugggcgccaga

SEQ ID NO: 1665751 - RNA, 22 nt, Salmonella enterica enterica serovar Typhi
cgccaucgcccggccuccggug

SEQ ID NO: 1665752 - RNA, 17 nt, Salmonella enterica enterica serovar Typhi
cgccauccggcggugca

SEQ ID NO: 1665753 - RNA, 14 nt, Salmonella enterica enterica serovar Typhi
cgccauccugccgc

SEQ ID NO: 1665754 - RNA, 15 nt, Salmonella enterica enterica serovar Typhi
cgccauccugccgca

SEQ ID NO: 1665755 - RNA, 15 nt, Salmonella enterica enterica serovar Typhi
cgccauccggcauuu

SEQ ID NO: 1665756 - RNA, 13 nt, Salmonella enterica enterica serovar Typhi
cgccauccggcga

SEQ ID NO: 1665757 - RNA, 14 nt, Salmonella enterica enterica serovar Typhi
cgccauccggcgag

SEQ ID NO: 1665758 - RNA, 15 nt, Salmonella enterica enterica serovar Typhi
cgccauccggcgaga

SEQ ID NO: 1665759 - RNA, 15 nt, Salmonella enterica enterica serovar Typhi
cgccauccggcaaca

SEQ ID NO: 1665760 - RNA, 17 nt, Salmonella enterica enterica serovar Typhi
cgccauccggcaaugau

SEQ ID NO: 1665761 - RNA, 22 nt, Salmonella enterica enterica serovar Typhi
cgccauccggcacggucaauca

SEQ ID NO: 1665762 - RNA, 13 nt, Salmonella enterica enterica serovar Typhi
cgccauccggcau

SEQ ID NO: 1665763 - RNA, 20 nt, Salmonella enterica enterica serovar Typhi
cgccaguucccacagcuuca

SEQ ID NO: 1665764 - RNA, 20 nt, Salmonella enterica enterica serovar Typhi
cgccaguucauucgccacca

SEQ ID NO: 1665765 - RNA, 22 nt, Salmonella enterica enterica serovar Typhi
cgccaggucucauagcgcccca

SEQ ID NO: 1665766 - RNA, 19 nt, Salmonella enterica enterica serovar Typhi
cgccaggucucauagcgcc

SEQ ID NO: 1665767 - RNA, 19 nt, Salmonella enterica enterica serovar Typhi
cgccaguacuuuggccuaa

SEQ ID NO: 1665768 - RNA, 15 nt, Salmonella enterica enterica serovar Typhi
cgccagucaggcgau

SEQ ID NO: 1665769 - RNA, 22 nt, Salmonella enterica enterica serovar Typhi
cgccaggguaucgucaauacgc

SEQ ID NO: 1665770 - RNA, 12 nt, Salmonella enterica enterica serovar Typhi
cgccaacgccac

SEQ ID NO: 1665771 - RNA, 21 nt, Salmonella enterica enterica serovar Typhi
cgccacgcuccuucuucgccg

SEQ ID NO: 1665772 - RNA, 16 nt, Salmonella enterica enterica serovar Typhi
cgccacgccuaaacug

SEQ ID NO: 1665773 - RNA, 18 nt, Salmonella enterica enterica serovar Typhi
cgccaccuuaaucgacuu

SEQ ID NO: 1665774 - RNA, 12 nt, Salmonella enterica enterica serovar Typhi
cgccaaucagca

SEQ ID NO: 1665775 - RNA, 17 nt, Salmonella enterica enterica serovar Typhi
cgccaauaaugccgccg

SEQ ID NO: 1665776 - RNA, 18 nt, Salmonella enterica enterica serovar Typhi
cgccaauaauauugaacg

SEQ ID NO: 1665777 - RNA, 18 nt, Salmonella enterica enterica serovar Typhi
cgccaaucaccgccagca

SEQ ID NO: 1665778 - RNA, 12 nt, Salmonella enterica enterica serovar Typhi
cgccaaucggcg

SEQ ID NO: 1665779 - RNA, 19 nt, Salmonella enterica enterica serovar Typhi
cgccaccucgcgacgguga

SEQ ID NO: 1665780 - RNA, 22 nt, Salmonella enterica enterica serovar Typhi
cgccaaucggcgucuugccgca

SEQ ID NO: 1665781 - RNA, 14 nt, Salmonella enterica enterica serovar Typhi
cgccacgucggaua

SEQ ID NO: 1665782 - RNA, 18 nt, Salmonella enterica enterica serovar Typhi
cgccacggccagcagcca

SEQ ID NO: 1665783 - RNA, 16 nt, Salmonella enterica enterica serovar Typhi
cgccagaauagcgcag

SEQ ID NO: 1665784 - RNA, 21 nt, Salmonella enterica enterica serovar Typhi
cgccacugaauuacugcguaa

SEQ ID NO: 1665785 - RNA, 15 nt, Salmonella enterica enterica serovar Typhi
cgccagcaaugccgc

SEQ ID NO: 1665786 - RNA, 13 nt, Salmonella enterica enterica serovar Typhi
cgccagcaacgcg

SEQ ID NO: 1665787 - RNA, 15 nt, Salmonella enterica enterica serovar Typhi
cgccagacgccauau

SEQ ID NO: 1665788 - RNA, 14 nt, Salmonella enterica enterica serovar Typhi
cgccagacgcgcau

SEQ ID NO: 1665789 - RNA, 15 nt, Salmonella enterica enterica serovar Typhi
cgccagaggcgugca

SEQ ID NO: 1665790 - RNA, 22 nt, Salmonella enterica enterica serovar Typhi
cgccagaggcgugcaugggcag

SEQ ID NO: 1665791 - RNA, 16 nt, Salmonella enterica enterica serovar Typhi
cgccagacucagccag

SEQ ID NO: 1665792 - RNA, 20 nt, Salmonella enterica enterica serovar Typhi
cgccaggccagauggcuuua

SEQ ID NO: 1665793 - RNA, 20 nt, Salmonella enterica enterica serovar Typhi
cgccagcaucggcagcgcca

SEQ ID NO: 1665794 - RNA, 18 nt, Salmonella enterica enterica serovar Typhi
cgccagccacugggugau

SEQ ID NO: 1665795 - RNA, 15 nt, Salmonella enterica enterica serovar Typhi
cgccagccagcgcca

SEQ ID NO: 1665796 - RNA, 12 nt, Salmonella enterica enterica serovar Typhi
cgccagccggaa

SEQ ID NO: 1665797 - RNA, 22 nt, Salmonella enterica enterica serovar Typhi
cgcauucaggcgacggaaacgc

SEQ ID NO: 1665798 - RNA, 17 nt, Salmonella enterica enterica serovar Typhi
cgcaugugagcaucggc

SEQ ID NO: 1665799 - RNA, 23 nt, Salmonella enterica enterica serovar Typhi
cgcauguuccgcuaccugcgagc

SEQ ID NO: 1665800 - RNA, 12 nt, Salmonella enterica enterica serovar Typhi
cgccaaacccga

SEQ ID NO: 1665801 - RNA, 21 nt, Salmonella enterica enterica serovar Typhi
cgccaaacgggcaagccagca

SEQ ID NO: 1665802 - RNA, 15 nt, Salmonella enterica enterica serovar Typhi
cgccaaaccugccac

SEQ ID NO: 1665803 - RNA, 17 nt, Salmonella enterica enterica serovar Typhi
cgccaaaaagugaaucg

SEQ ID NO: 1665804 - RNA, 17 nt, Salmonella enterica enterica serovar Typhi
cgcauucucgccgugac

SEQ ID NO: 1665805 - RNA, 23 nt, Salmonella enterica enterica serovar Typhi
cgccaaagcaaucgccagcgccu

SEQ ID NO: 1665806 - RNA, 18 nt, Salmonella enterica enterica serovar Typhi
cgccaaaguuaaucagcg

SEQ ID NO: 1665807 - RNA, 23 nt, Salmonella enterica enterica serovar Typhi
cgccaaccucccaaccaguauga

SEQ ID NO: 1665808 - RNA, 11 nt, Salmonella enterica enterica serovar Typhi
cgcauccagcc

SEQ ID NO: 1665809 - RNA, 14 nt, Salmonella enterica enterica serovar Typhi
cgcauccagggagu

SEQ ID NO: 1665810 - RNA, 18 nt, Salmonella enterica enterica serovar Typhi
cgcaucagaccuccgcca

SEQ ID NO: 1665811 - RNA, 22 nt, Salmonella enterica enterica serovar Typhi
cgcaucagaaaaaccuccggcu

SEQ ID NO: 1665812 - RNA, 22 nt, Salmonella enterica enterica serovar Typhi
cgcaucacgcgaagcggcguca

SEQ ID NO: 1665813 - RNA, 19 nt, Salmonella enterica enterica serovar Typhi
cgcaugauauaaaauggcg

SEQ ID NO: 1665814 - RNA, 18 nt, Salmonella enterica enterica serovar Typhi
cgcauaaugagcgcuuga

SEQ ID NO: 1665815 - RNA, 13 nt, Salmonella enterica enterica serovar Typhi
cgcauaccagcca

SEQ ID NO: 1665816 - RNA, 18 nt, Salmonella enterica enterica serovar Typhi
cgcauaccgaacagaaaa

SEQ ID NO: 1665817 - RNA, 13 nt, Salmonella enterica enterica serovar Typhi
cgcaguuccagcg

SEQ ID NO: 1665818 - RNA, 14 nt, Salmonella enterica enterica serovar Typhi
cgcaguuuacgcag

SEQ ID NO: 1665819 - RNA, 13 nt, Salmonella enterica enterica serovar Typhi
cgcauagcugccc

SEQ ID NO: 1665820 - RNA, 13 nt, Salmonella enterica enterica serovar Typhi
cgcauagcggcca

SEQ ID NO: 1665821 - RNA, 17 nt, Salmonella enterica enterica serovar Typhi
cgcauagaauuucaggg

SEQ ID NO: 1665822 - RNA, 15 nt, Salmonella enterica enterica serovar Typhi
cgcauacuaccgcug

SEQ ID NO: 1665823 - RNA, 14 nt, Salmonella enterica enterica serovar Typhi
cgcauaccagccau

SEQ ID NO: 1665824 - RNA, 22 nt, Salmonella enterica enterica serovar Typhi
cgcauacgccccgguggcggua

SEQ ID NO: 1665825 - RNA, 15 nt, Salmonella enterica enterica serovar Typhi
cgcauauuccggcga

SEQ ID NO: 1665826 - RNA, 20 nt, Salmonella enterica enterica serovar Typhi
cgcaucaaugcccagcgcaa

SEQ ID NO: 1665827 - RNA, 19 nt, Salmonella enterica enterica serovar Typhi
cgcaucaacgccaggcaga

SEQ ID NO: 1665828 - RNA, 15 nt, Salmonella enterica enterica serovar Typhi
cgcauaguccugccg

SEQ ID NO: 1665829 - RNA, 15 nt, Salmonella enterica enterica serovar Typhi
cgcauauccagcaga

SEQ ID NO: 1665830 - RNA, 14 nt, Salmonella enterica enterica serovar Typhi
cgcauaucccacug

SEQ ID NO: 1665831 - RNA, 14 nt, Salmonella enterica enterica serovar Typhi
cgcaguacggcgca

SEQ ID NO: 1665832 - RNA, 17 nt, Salmonella enterica enterica serovar Typhi
cgcagugaccagcauca

SEQ ID NO: 1665833 - RNA, 12 nt, Salmonella enterica enterica serovar Typhi
cgcaguucaaua

SEQ ID NO: 1665834 - RNA, 15 nt, Salmonella enterica enterica serovar Typhi
cgcaguuaugcgcau

SEQ ID NO: 1665835 - RNA, 22 nt, Salmonella enterica enterica serovar Typhi
cgcagucagccuugaccgccug

SEQ ID NO: 1665836 - RNA, 14 nt, Salmonella enterica enterica serovar Typhi
cgcagcgugaaacg

SEQ ID NO: 1665837 - RNA, 17 nt, Salmonella enterica enterica serovar Typhi
cgcagcgugaaacgccc

SEQ ID NO: 1665838 - RNA, 14 nt, Salmonella enterica enterica serovar Typhi
cgcagcugguugau

SEQ ID NO: 1665839 - RNA, 14 nt, Salmonella enterica enterica serovar Typhi
cgcagagauagcca

SEQ ID NO: 1665840 - RNA, 18 nt, Salmonella enterica enterica serovar Typhi
cgcagaucguauccagcg

SEQ ID NO: 1665841 - RNA, 21 nt, Salmonella enterica enterica serovar Typhi
cgcagauaucuuccagcgcgu

SEQ ID NO: 1665842 - RNA, 17 nt, Salmonella enterica enterica serovar Typhi
cgcagaugcccgcagau

SEQ ID NO: 1665843 - RNA, 17 nt, Salmonella enterica enterica serovar Typhi
cgcagccgcaaucagcg

SEQ ID NO: 1665844 - RNA, 17 nt, Salmonella enterica enterica serovar Typhi
cgcagccgccauccggc

SEQ ID NO: 1665845 - RNA, 15 nt, Salmonella enterica enterica serovar Typhi
cgcacauaaucaccg

SEQ ID NO: 1665846 - RNA, 17 nt, Salmonella enterica enterica serovar Typhi
cgcaaucuuugccgcaa

SEQ ID NO: 1665847 - RNA, 17 nt, Salmonella enterica enterica serovar Typhi
cgcaaucuggcggacaa

SEQ ID NO: 1665848 - RNA, 22 nt, Salmonella enterica enterica serovar Typhi
cgcaaugcgcuugcuccgcaga

SEQ ID NO: 1665849 - RNA, 12 nt, Salmonella enterica enterica serovar Typhi
cgcacaaacgcu

SEQ ID NO: 1665850 - RNA, 13 nt, Salmonella enterica enterica serovar Typhi
cgcaauuccagca

SEQ ID NO: 1665851 - RNA, 15 nt, Salmonella enterica enterica serovar Typhi
cgcacaccagcgcau

SEQ ID NO: 1665852 - RNA, 20 nt, Salmonella enterica enterica serovar Typhi
cgcaauacagcccgccagca

SEQ ID NO: 1665853 - RNA, 16 nt, Salmonella enterica enterica serovar Typhi
cgcaauaacgccgaua

SEQ ID NO: 1665854 - RNA, 20 nt, Salmonella enterica enterica serovar Typhi
cgcaacuucugcuggcggaa

SEQ ID NO: 1665855 - RNA, 20 nt, Salmonella enterica enterica serovar Typhi
cgcaauaaacacgauggcaa

SEQ ID NO: 1665856 - RNA, 17 nt, Salmonella enterica enterica serovar Typhi
cgcaacgucgccauccg

SEQ ID NO: 1665857 - RNA, 15 nt, Salmonella enterica enterica serovar Typhi
cgcaacgucagcgau

SEQ ID NO: 1665858 - RNA, 11 nt, Salmonella enterica enterica serovar Typhi
cgcaaacugcc

SEQ ID NO: 1665859 - RNA, 13 nt, Salmonella enterica enterica serovar Typhi
cgcaaacaguuca

SEQ ID NO: 1665860 - RNA, 12 nt, Salmonella enterica enterica serovar Typhi
cgcaaaaucgca

SEQ ID NO: 1665861 - RNA, 17 nt, Salmonella enterica enterica serovar Typhi
cgcaaaaucgcaaacgc

SEQ ID NO: 1665862 - RNA, 14 nt, Salmonella enterica enterica serovar Typhi
cgcaaaaccuucau

SEQ ID NO: 1665863 - RNA, 18 nt, Salmonella enterica enterica serovar Typhi
cgauuguguguuaauggc

SEQ ID NO: 1665864 - RNA, 19 nt, Salmonella enterica enterica serovar Typhi
cgauucgagcgcagcgaga

SEQ ID NO: 1665865 - RNA, 16 nt, Salmonella enterica enterica serovar Typhi
cgauucgcaugaauuc

SEQ ID NO: 1665866 - RNA, 16 nt, Salmonella enterica enterica serovar Typhi
cgaugcucaaccagua

SEQ ID NO: 1665867 - RNA, 14 nt, Salmonella enterica enterica serovar Typhi
cgauagaucgccac

SEQ ID NO: 1665868 - RNA, 22 nt, Salmonella enterica enterica serovar Typhi
cgauaauuuuaccuucgcguuu

SEQ ID NO: 1665869 - RNA, 18 nt, Salmonella enterica enterica serovar Typhi
cgauagcguuuuccagcu

SEQ ID NO: 1665870 - RNA, 19 nt, Salmonella enterica enterica serovar Typhi
cgauagcgacggcgcgcca

SEQ ID NO: 1665871 - RNA, 14 nt, Salmonella enterica enterica serovar Typhi
cgauaggcgcguca

SEQ ID NO: 1665872 - RNA, 22 nt, Salmonella enterica enterica serovar Typhi
cgauaguggcgaucugaaugcc

SEQ ID NO: 1665873 - RNA, 22 nt, Salmonella enterica enterica serovar Typhi
cgauaucgccuggugugaacau

SEQ ID NO: 1665874 - RNA, 13 nt, Salmonella enterica enterica serovar Typhi
cgauaucgauaau

SEQ ID NO: 1665875 - RNA, 17 nt, Salmonella enterica enterica serovar Typhi
cgauauccgugccgccg

SEQ ID NO: 1665876 - RNA, 13 nt, Salmonella enterica enterica serovar Typhi
cgauauaagcgcc

SEQ ID NO: 1665877 - RNA, 21 nt, Salmonella enterica enterica serovar Typhi
cgauauagcgcauagcggcca

SEQ ID NO: 1665878 - RNA, 22 nt, Salmonella enterica enterica serovar Typhi
cgauaaacaguuugugccgcca

SEQ ID NO: 1665879 - RNA, 17 nt, Salmonella enterica enterica serovar Typhi
cgauaaaccagccccac

SEQ ID NO: 1665880 - RNA, 16 nt, Salmonella enterica enterica serovar Typhi
cgauaaaccgcugcca

SEQ ID NO: 1665881 - RNA, 20 nt, Salmonella enterica enterica serovar Typhi
cgauaacacggcuggcaaug

SEQ ID NO: 1665882 - RNA, 17 nt, Salmonella enterica enterica serovar Typhi
cgauaaccaccagcgga

SEQ ID NO: 1665883 - RNA, 19 nt, Salmonella enterica enterica serovar Typhi
cgauaaacucaaucaggcu

SEQ ID NO: 1665884 - RNA, 16 nt, Salmonella enterica enterica serovar Typhi
cgauaaagaacgcgcc

SEQ ID NO: 1665885 - RNA, 16 nt, Salmonella enterica enterica serovar Typhi
cgauaaauaccguaau

SEQ ID NO: 1665886 - RNA, 15 nt, Salmonella enterica enterica serovar Typhi
cgauaagcaagcgcc

SEQ ID NO: 1665887 - RNA, 17 nt, Salmonella enterica enterica serovar Typhi
cgauaagcaagcgccau

SEQ ID NO: 1665888 - RNA, 18 nt, Salmonella enterica enterica serovar Typhi
cgauaagcuuccgccaug

SEQ ID NO: 1665889 - RNA, 22 nt, Salmonella enterica enterica serovar Typhi
cgauaauacgcgcgauuacgcg

SEQ ID NO: 1665890 - RNA, 14 nt, Salmonella enterica enterica serovar Typhi
cgauaauacgcgcg

SEQ ID NO: 1665891 - RNA, 18 nt, Salmonella enterica enterica serovar Typhi
cgaucccaguugaucggc

SEQ ID NO: 1665892 - RNA, 21 nt, Salmonella enterica enterica serovar Typhi
cgaucaucguaccaauaccca

SEQ ID NO: 1665893 - RNA, 22 nt, Salmonella enterica enterica serovar Typhi
cgaucaucccgcccagcaacac

SEQ ID NO: 1665894 - RNA, 17 nt, Salmonella enterica enterica serovar Typhi
cgaucaguggcgccgca

SEQ ID NO: 1665895 - RNA, 20 nt, Salmonella enterica enterica serovar Typhi
cgaucaucccgcccagcaac

SEQ ID NO: 1665896 - RNA, 13 nt, Salmonella enterica enterica serovar Typhi
cgaucagcgccac

SEQ ID NO: 1665897 - RNA, 20 nt, Salmonella enterica enterica serovar Typhi
cgaucacggcgaaucgccug

SEQ ID NO: 1665898 - RNA, 14 nt, Salmonella enterica enterica serovar Typhi
cgaucacgccgucc

SEQ ID NO: 1665899 - RNA, 14 nt, Salmonella enterica enterica serovar Typhi
cgaucaccagcgca

SEQ ID NO: 1665900 - RNA, 14 nt, Salmonella enterica enterica serovar Typhi
cgaucgguuaucac

SEQ ID NO: 1665901 - RNA, 20 nt, Salmonella enterica enterica serovar Typhi
cgaucggcuuguuaugcgga

SEQ ID NO: 1665902 - RNA, 20 nt, Salmonella enterica enterica serovar Typhi
cgaucgccagcuacgacaag

SEQ ID NO: 1665903 - RNA, 23 nt, Salmonella enterica enterica serovar Typhi
cgaucgcgauucgcccacggaug

SEQ ID NO: 1665904 - RNA, 15 nt, Salmonella enterica enterica serovar Typhi
cgaucgcuaaucagg

SEQ ID NO: 1665905 - RNA, 17 nt, Salmonella enterica enterica serovar Typhi
cgaugaacaucgacaag

SEQ ID NO: 1665906 - RNA, 22 nt, Salmonella enterica enterica serovar Typhi
cgaugaaaggucgaaaacggcc

SEQ ID NO: 1665907 - RNA, 13 nt, Salmonella enterica enterica serovar Typhi
cgaugacagcagg

SEQ ID NO: 1665908 - RNA, 23 nt, Salmonella enterica enterica serovar Typhi
cgaugacagcaggaacggcagga

SEQ ID NO: 1665909 - RNA, 18 nt, Salmonella enterica enterica serovar Typhi
cgaugauauccagcacgc

SEQ ID NO: 1665910 - RNA, 13 nt, Salmonella enterica enterica serovar Typhi
cgaugagcgccag

SEQ ID NO: 1665911 - RNA, 20 nt, Salmonella enterica enterica serovar Typhi
cgaugaucgucgcgaucgcg

SEQ ID NO: 1665912 - RNA, 21 nt, Salmonella enterica enterica serovar Typhi
ccgcuuauuugccuaacgggc

SEQ ID NO: 1665913 - RNA, 23 nt, Salmonella enterica enterica serovar Typhi
ccgcuucaccuuucgccgccaga

SEQ ID NO: 1665914 - RNA, 22 nt, Salmonella enterica enterica serovar Typhi
ccgcuucaaaacagaaccccau

SEQ ID NO: 1665915 - RNA, 14 nt, Salmonella enterica enterica serovar Typhi
ccgcuucacauacc

SEQ ID NO: 1665916 - RNA, 21 nt, Salmonella enterica enterica serovar Typhi
ccgcugucgccagaauguuau

SEQ ID NO: 1665917 - RNA, 11 nt, Salmonella enterica enterica serovar Typhi
ccgcugcggaa

SEQ ID NO: 1665918 - RNA, 22 nt, Salmonella enterica enterica serovar Typhi
ccgcuucguaaaacucaugacc

SEQ ID NO: 1665919 - RNA, 23 nt, Salmonella enterica enterica serovar Typhi
ccgcuuuaucguaaccgaugugc

SEQ ID NO: 1665920 - RNA, 21 nt, Salmonella enterica enterica serovar Typhi
ccggaaagacggcagcgccau

SEQ ID NO: 1665921 - RNA, 22 nt, Salmonella enterica enterica serovar Typhi
ccggaaaggauauaagcgccau

SEQ ID NO: 1665922 - RNA, 14 nt, Salmonella enterica enterica serovar Typhi
ccggaaauaacguu

SEQ ID NO: 1665923 - RNA, 22 nt, Salmonella enterica enterica serovar Typhi
ccggaaauggucgcuccggaac

SEQ ID NO: 1665924 - RNA, 18 nt, Salmonella enterica enterica serovar Typhi
ccggaacaaaagaaagca

SEQ ID NO: 1665925 - RNA, 13 nt, Salmonella enterica enterica serovar Typhi
ccggaacagaagc

SEQ ID NO: 1665926 - RNA, 17 nt, Salmonella enterica enterica serovar Typhi
ccggaaccguucucaau

SEQ ID NO: 1665927 - RNA, 13 nt, Salmonella enterica enterica serovar Typhi
ccgcuccagaagc

SEQ ID NO: 1665928 - RNA, 13 nt, Salmonella enterica enterica serovar Typhi
ccgcuauuaccag

SEQ ID NO: 1665929 - RNA, 23 nt, Salmonella enterica enterica serovar Typhi
ccgcugcaaaucaccacauggcc

SEQ ID NO: 1665930 - RNA, 14 nt, Salmonella enterica enterica serovar Typhi
ccgcugaucgccgg

SEQ ID NO: 1665931 - RNA, 13 nt, Salmonella enterica enterica serovar Typhi
ccgcugaucgccg

SEQ ID NO: 1665932 - RNA, 14 nt, Salmonella enterica enterica serovar Typhi
ccgcguaaucgcga

SEQ ID NO: 1665933 - RNA, 14 nt, Salmonella enterica enterica serovar Typhi
ccgcgcccugcgga

SEQ ID NO: 1665934 - RNA, 19 nt, Salmonella enterica enterica serovar Typhi
ccggcacaaugcccggcau

SEQ ID NO: 1665935 - RNA, 20 nt, Salmonella enterica enterica serovar Typhi
ccggcaaacccuuaacuggc

SEQ ID NO: 1665936 - RNA, 17 nt, Salmonella enterica enterica serovar Typhi
ccggcaaaccuaccggc

SEQ ID NO: 1665937 - RNA, 23 nt, Salmonella enterica enterica serovar Typhi
ccggcaaaggaauuacgggcgau

SEQ ID NO: 1665938 - RNA, 14 nt, Salmonella enterica enterica serovar Typhi
ccggcaaaggaauu

SEQ ID NO: 1665939 - RNA, 16 nt, Salmonella enterica enterica serovar Typhi
ccggcagccgcugaua

SEQ ID NO: 1665940 - RNA, 18 nt, Salmonella enterica enterica serovar Typhi
ccggcagcguaacgauau

SEQ ID NO: 1665941 - RNA, 19 nt, Salmonella enterica enterica serovar Typhi
ccggcaggcucaccagccc

SEQ ID NO: 1665942 - RNA, 14 nt, Salmonella enterica enterica serovar Typhi
ccggcaggcgucau

SEQ ID NO: 1665943 - RNA, 22 nt, Salmonella enterica enterica serovar Typhi
ccggauaacggcgcgaaagcgc

SEQ ID NO: 1665944 - RNA, 22 nt, Salmonella enterica enterica serovar Typhi
ccggauaaggcgcuugcgccau

SEQ ID NO: 1665945 - RNA, 21 nt, Salmonella enterica enterica serovar Typhi
ccggauaagcauuagcgccau

SEQ ID NO: 1665946 - RNA, 20 nt, Salmonella enterica enterica serovar Typhi
ccggauaagcgcagcgccau

SEQ ID NO: 1665947 - RNA, 23 nt, Salmonella enterica enterica serovar Typhi
ccggauaauuuauccaguaacgc

SEQ ID NO: 1665948 - RNA, 20 nt, Salmonella enterica enterica serovar Typhi
ccggauaagcguagcgccau

SEQ ID NO: 1665949 - RNA, 20 nt, Salmonella enterica enterica serovar Typhi
ccggauaagcgugagcgcau

SEQ ID NO: 1665950 - RNA, 19 nt, Salmonella enterica enterica serovar Typhi
ccggauagcguagcgccau

SEQ ID NO: 1665951 - RNA, 15 nt, Salmonella enterica enterica serovar Typhi
ccggaucaccggcau

SEQ ID NO: 1665952 - RNA, 19 nt, Salmonella enterica enterica serovar Typhi
ccggaucgaucccggcaaa

SEQ ID NO: 1665953 - RNA, 13 nt, Salmonella enterica enterica serovar Typhi
ccggaucgcguuu

SEQ ID NO: 1665954 - RNA, 22 nt, Salmonella enterica enterica serovar Typhi
ccggauggcggcugcgccuuau

SEQ ID NO: 1665955 - RNA, 17 nt, Salmonella enterica enterica serovar Typhi
ccggcaaaaaucagccc

SEQ ID NO: 1665956 - RNA, 23 nt, Salmonella enterica enterica serovar Typhi
ccggauggcggcgugaacgccuu

SEQ ID NO: 1665957 - RNA, 21 nt, Salmonella enterica enterica serovar Typhi
ccggaugaccagaacauggcc

SEQ ID NO: 1665958 - RNA, 22 nt, Salmonella enterica enterica serovar Typhi
ccggaugaggacauaaacgccu

SEQ ID NO: 1665959 - RNA, 22 nt, Salmonella enterica enterica serovar Typhi
ccggaugaggcgcagccgccau

SEQ ID NO: 1665960 - RNA, 18 nt, Salmonella enterica enterica serovar Typhi
ccggagaguucauaacgc

SEQ ID NO: 1665961 - RNA, 18 nt, Salmonella enterica enterica serovar Typhi
ccggagaccggcgaaauc

SEQ ID NO: 1665962 - RNA, 15 nt, Salmonella enterica enterica serovar Typhi
ccggagaccggcgaa

SEQ ID NO: 1665963 - RNA, 17 nt, Salmonella enterica enterica serovar Typhi
ccggacuccagcaacgc

SEQ ID NO: 1665964 - RNA, 15 nt, Salmonella enterica enterica serovar Typhi
ccgcaaacuggccac

SEQ ID NO: 1665965 - RNA, 18 nt, Salmonella enterica enterica serovar Typhi
ccgcaaacggaauagcgc

SEQ ID NO: 1665966 - RNA, 22 nt, Salmonella enterica enterica serovar Typhi
ccgcaaacgccgugaacgccaa

SEQ ID NO: 1665967 - RNA, 12 nt, Salmonella enterica enterica serovar Typhi
ccgaugccgccg

SEQ ID NO: 1665968 - RNA, 19 nt, Salmonella enterica enterica serovar Typhi
ccgacgauaaacagauaug

SEQ ID NO: 1665969 - RNA, 19 nt, Salmonella enterica enterica serovar Typhi
ccgcagaccggaugauggc

SEQ ID NO: 1665970 - RNA, 23 nt, Salmonella enterica enterica serovar Typhi
ccgcaauaacgccgauaaccagc

SEQ ID NO: 1665971 - RNA, 16 nt, Salmonella enterica enterica serovar Typhi
ccgcaauaacgccgau

SEQ ID NO: 1665972 - RNA, 23 nt, Salmonella enterica enterica serovar Typhi
ccgcaacguccucuuucgacauu

SEQ ID NO: 1665973 - RNA, 23 nt, Salmonella enterica enterica serovar Typhi
ccgcagcgccugcgccgcaggaa

SEQ ID NO: 1665974 - RNA, 13 nt, Salmonella enterica enterica serovar Typhi
ccgcagcgccaua

SEQ ID NO: 1665975 - RNA, 22 nt, Salmonella enterica enterica serovar Typhi
ccgccaaagcaaaccaucgucg

SEQ ID NO: 1665976 - RNA, 13 nt, Salmonella enterica enterica serovar Typhi
ccgccaacgccaa

SEQ ID NO: 1665977 - RNA, 15 nt, Salmonella enterica enterica serovar Typhi
ccgccaacgccaaca

SEQ ID NO: 1665978 - RNA, 23 nt, Salmonella enterica enterica serovar Typhi
ccgccaacgccaacauagccaca

SEQ ID NO: 1665979 - RNA, 14 nt, Salmonella enterica enterica serovar Typhi
ccgccaaugaccau

SEQ ID NO: 1665980 - RNA, 15 nt, Salmonella enterica enterica serovar Typhi
ccgccaccaccgauc

SEQ ID NO: 1665981 - RNA, 20 nt, Salmonella enterica enterica serovar Typhi
ccgccaugaaaaaaacgcau

SEQ ID NO: 1665982 - RNA, 16 nt, Salmonella enterica enterica serovar Typhi
ccgccauagccggcga

SEQ ID NO: 1665983 - RNA, 11 nt, Salmonella enterica enterica serovar Typhi
ccgccaucgua

SEQ ID NO: 1665984 - RNA, 22 nt, Salmonella enterica enterica serovar Typhi
ccgccaguuguucaacauagua

SEQ ID NO: 1665985 - RNA, 15 nt, Salmonella enterica enterica serovar Typhi
ccgccagcaguugca

SEQ ID NO: 1665986 - RNA, 13 nt, Salmonella enterica enterica serovar Typhi
ccgccauuugcgc

SEQ ID NO: 1665987 - RNA, 17 nt, Salmonella enterica enterica serovar Typhi
ccgcccagagaauauug

SEQ ID NO: 1665988 - RNA, 13 nt, Salmonella enterica enterica serovar Typhi
ccgcccagaacgg

SEQ ID NO: 1665989 - RNA, 13 nt, Salmonella enterica enterica serovar Typhi
ccgcccaggccug

SEQ ID NO: 1665990 - RNA, 16 nt, Salmonella enterica enterica serovar Typhi
ccgccgacaugacggu

SEQ ID NO: 1665991 - RNA, 12 nt, Salmonella enterica enterica serovar Typhi
ccgccgcgguga

SEQ ID NO: 1665992 - RNA, 14 nt, Salmonella enterica enterica serovar Typhi
ccgccgucaggcua

SEQ ID NO: 1665993 - RNA, 22 nt, Salmonella enterica enterica serovar Typhi
ccgcgaugaucgucgcgaucgc

SEQ ID NO: 1665994 - RNA, 18 nt, Salmonella enterica enterica serovar Typhi
ccguccggcuuuuuucac

SEQ ID NO: 1665995 - RNA, 15 nt, Salmonella enterica enterica serovar Typhi
ccguagcgacgccau

SEQ ID NO: 1665996 - RNA, 19 nt, Salmonella enterica enterica serovar Typhi
ccguaggccggauaagacg

SEQ ID NO: 1665997 - RNA, 19 nt, Salmonella enterica enterica serovar Typhi
ccguaucacuaauuugcga

SEQ ID NO: 1665998 - RNA, 16 nt, Salmonella enterica enterica serovar Typhi
ccgucacccgcguauc

SEQ ID NO: 1665999 - RNA, 20 nt, Salmonella enterica enterica serovar Typhi
ccggucuacaagugauacgg

SEQ ID NO: 1666000 - RNA, 14 nt, Salmonella enterica enterica serovar Typhi
ccggucuggcucac

SEQ ID NO: 1666001 - RNA, 23 nt, Salmonella enterica enterica serovar Typhi
ccgguggucuguucgagggcgau

SEQ ID NO: 1666002 - RNA, 19 nt, Salmonella enterica enterica serovar Typhi
ccgguuauaccgccauccg

SEQ ID NO: 1666003 - RNA, 23 nt, Salmonella enterica enterica serovar Typhi
ccggucgccguuaacuggcgcau

SEQ ID NO: 1666004 - RNA, 21 nt, Salmonella enterica enterica serovar Typhi
ccgguagguuaaauagcaggc

SEQ ID NO: 1666005 - RNA, 20 nt, Salmonella enterica enterica serovar Typhi
ccgguauccgcauucuaaau

SEQ ID NO: 1666006 - RNA, 14 nt, Salmonella enterica enterica serovar Typhi
ccggucaagcgcaa

SEQ ID NO: 1666007 - RNA, 16 nt, Salmonella enterica enterica serovar Typhi
ccgggcucacgcuggu

SEQ ID NO: 1666008 - RNA, 14 nt, Salmonella enterica enterica serovar Typhi
ccggguuaaaucgc

SEQ ID NO: 1666009 - RNA, 19 nt, Salmonella enterica enterica serovar Typhi
ccgguaagcgcagcgccac

SEQ ID NO: 1666010 - RNA, 22 nt, Salmonella enterica enterica serovar Typhi
ccgguaauaauuagcauccagc

SEQ ID NO: 1666011 - RNA, 13 nt, Salmonella enterica enterica serovar Typhi
ccgguagcguggu

SEQ ID NO: 1666012 - RNA, 14 nt, Salmonella enterica enterica serovar Typhi
ccgguagcauccgc

SEQ ID NO: 1666013 - RNA, 17 nt, Salmonella enterica enterica serovar Typhi
ccgguagcauccgcgau

SEQ ID NO: 1666014 - RNA, 15 nt, Salmonella enterica enterica serovar Typhi
ccgggauaaucaggu

SEQ ID NO: 1666015 - RNA, 17 nt, Salmonella enterica enterica serovar Typhi
ccggcuuaccagcgggc

SEQ ID NO: 1666016 - RNA, 18 nt, Salmonella enterica enterica serovar Typhi
ccggcuuaggcaggggau

SEQ ID NO: 1666017 - RNA, 23 nt, Salmonella enterica enterica serovar Typhi
ccggcuccgaccaucgccgcgaa

SEQ ID NO: 1666018 - RNA, 23 nt, Salmonella enterica enterica serovar Typhi
ccggcgugaaagcgcuugauaau

SEQ ID NO: 1666019 - RNA, 23 nt, Salmonella enterica enterica serovar Typhi
ccggcguauugguacaacgcccu

SEQ ID NO: 1666020 - RNA, 21 nt, Salmonella enterica enterica serovar Typhi
ccgggcaguacgcacguuuug

SEQ ID NO: 1666021 - RNA, 14 nt, Salmonella enterica enterica serovar Typhi
ccgggcacgauggc

SEQ ID NO: 1666022 - RNA, 18 nt, Salmonella enterica enterica serovar Typhi
ccggcgccagaagcuggc

SEQ ID NO: 1666023 - RNA, 15 nt, Salmonella enterica enterica serovar Typhi
ccggcgcgacgccgc

SEQ ID NO: 1666024 - RNA, 21 nt, Salmonella enterica enterica serovar Typhi
ccggcgccuguuaauaccgug

SEQ ID NO: 1666025 - RNA, 19 nt, Salmonella enterica enterica serovar Typhi
ccggcgcguuaauaccgug

SEQ ID NO: 1666026 - RNA, 19 nt, Salmonella enterica enterica serovar Typhi
ccggcgcucagccagaaac

SEQ ID NO: 1666027 - RNA, 15 nt, Salmonella enterica enterica serovar Typhi
ccggcgcuaaccagc

SEQ ID NO: 1666028 - RNA, 20 nt, Salmonella enterica enterica serovar Typhi
ccggcgcguuaauaccgugc

SEQ ID NO: 1666029 - RNA, 16 nt, Salmonella enterica enterica serovar Typhi
ccggcggcgacuggcu

SEQ ID NO: 1666030 - RNA, 15 nt, Salmonella enterica enterica serovar Typhi
ccucggcaacauacc

SEQ ID NO: 1666031 - RNA, 17 nt, Salmonella enterica enterica serovar Typhi
ccucguccugauccggc

SEQ ID NO: 1666032 - RNA, 14 nt, Salmonella enterica enterica serovar Typhi
ccucguucggcgca

SEQ ID NO: 1666033 - RNA, 17 nt, Salmonella enterica enterica serovar Typhi
ccugaccgggcucacgc

SEQ ID NO: 1666034 - RNA, 24 nt, Salmonella enterica enterica serovar Typhi
ccugacggugcgcgacgccgaguu

SEQ ID NO: 1666035 - RNA, 13 nt, Salmonella enterica enterica serovar Typhi
ccugacgggcauu

SEQ ID NO: 1666036 - RNA, 19 nt, Salmonella enterica enterica serovar Typhi
ccugacgcugcgccuggau

SEQ ID NO: 1666037 - RNA, 15 nt, Salmonella enterica enterica serovar Typhi
ccugacgaauagcgc

SEQ ID NO: 1666038 - RNA, 20 nt, Salmonella enterica enterica serovar Typhi
ccugcaacucaaaauaacgc

SEQ ID NO: 1666039 - RNA, 23 nt, Salmonella enterica enterica serovar Typhi
ccugcaacgcuuuagugccgcca

SEQ ID NO: 1666040 - RNA, 23 nt, Salmonella enterica enterica serovar Typhi
ccugcaaggcaucgucggcgauu

SEQ ID NO: 1666041 - RNA, 15 nt, Salmonella enterica enterica serovar Typhi
ccugcaacagcacca

SEQ ID NO: 1666042 - RNA, 14 nt, Salmonella enterica enterica serovar Typhi
ccugcaaauagcgc

SEQ ID NO: 1666043 - RNA, 15 nt, Salmonella enterica enterica serovar Typhi
ccugcacgccgguuc

SEQ ID NO: 1666044 - RNA, 13 nt, Salmonella enterica enterica serovar Typhi
ccugcucaaucgc

SEQ ID NO: 1666045 - RNA, 16 nt, Salmonella enterica enterica serovar Typhi
ccugcguuugcggauc

SEQ ID NO: 1666046 - RNA, 22 nt, Salmonella enterica enterica serovar Typhi
ccugcuucagacaacgccgccu

SEQ ID NO: 1666047 - RNA, 22 nt, Salmonella enterica enterica serovar Typhi
ccugcugagugacgggcuggcg

SEQ ID NO: 1666048 - RNA, 18 nt, Salmonella enterica enterica serovar Typhi
ccugcugcgccagcgcau

SEQ ID NO: 1666049 - RNA, 23 nt, Salmonella enterica enterica serovar Typhi
ccugcugggucugcugggcgauu

SEQ ID NO: 1666050 - RNA, 16 nt, Salmonella enterica enterica serovar Typhi
ccugcuugucgaucau

SEQ ID NO: 1666051 - RNA, 14 nt, Salmonella enterica enterica serovar Typhi
ccuggaugcgcuga

SEQ ID NO: 1666052 - RNA, 17 nt, Salmonella enterica enterica serovar Typhi
ccuggauagcaauuuca

SEQ ID NO: 1666053 - RNA, 24 nt, Salmonella enterica enterica serovar Typhi
ccuggagugacuaaaagacgccau

SEQ ID NO: 1666054 - RNA, 18 nt, Salmonella enterica enterica serovar Typhi
ccuggagagcagcgccag

SEQ ID NO: 1666055 - RNA, 18 nt, Salmonella enterica enterica serovar Typhi
ccuggaggaacagcgccg

SEQ ID NO: 1666056 - RNA, 14 nt, Salmonella enterica enterica serovar Typhi
ccugcgccguuucu

SEQ ID NO: 1666057 - RNA, 20 nt, Salmonella enterica enterica serovar Typhi
ccugcgccaggauaucgccc

SEQ ID NO: 1666058 - RNA, 12 nt, Salmonella enterica enterica serovar Typhi
ccugcgccagcg

SEQ ID NO: 1666059 - RNA, 15 nt, Salmonella enterica enterica serovar Typhi
ccugcgguagcgccg

SEQ ID NO: 1666060 - RNA, 14 nt, Salmonella enterica enterica serovar Typhi
ccugcgcugacggc

SEQ ID NO: 1666061 - RNA, 15 nt, Salmonella enterica enterica serovar Typhi
ccugcgcgccuugcg

SEQ ID NO: 1666062 - RNA, 12 nt, Salmonella enterica enterica serovar Typhi
ccugcgcgccaa

SEQ ID NO: 1666063 - RNA, 23 nt, Salmonella enterica enterica serovar Typhi
ccgugucaucauuacaggcgaau

SEQ ID NO: 1666064 - RNA, 17 nt, Salmonella enterica enterica serovar Typhi
ccguuuaaaagcggaua

SEQ ID NO: 1666065 - RNA, 14 nt, Salmonella enterica enterica serovar Typhi
ccguuucagaaaga

SEQ ID NO: 1666066 - RNA, 23 nt, Salmonella enterica enterica serovar Typhi
ccguuuguacaucuacuucagca

SEQ ID NO: 1666067 - RNA, 23 nt, Salmonella enterica enterica serovar Typhi
ccguuuuuuuaugcagccgauag

SEQ ID NO: 1666068 - RNA, 23 nt, Salmonella enterica enterica serovar Typhi
ccuaucaggaucaaaaucgcgcc

SEQ ID NO: 1666069 - RNA, 21 nt, Salmonella enterica enterica serovar Typhi
ccuaaggucacgccggaaauc

SEQ ID NO: 1666070 - RNA, 23 nt, Salmonella enterica enterica serovar Typhi
ccuaagccggcaggcagcgccag

SEQ ID NO: 1666071 - RNA, 13 nt, Salmonella enterica enterica serovar Typhi
ccucaaccaacgg

SEQ ID NO: 1666072 - RNA, 18 nt, Salmonella enterica enterica serovar Typhi
ccuaucgcugcgcugcgg

SEQ ID NO: 1666073 - RNA, 15 nt, Salmonella enterica enterica serovar Typhi
ccucacaaacggcau

SEQ ID NO: 1666074 - RNA, 14 nt, Salmonella enterica enterica serovar Typhi
ccucacgcgucaca

SEQ ID NO: 1666075 - RNA, 17 nt, Salmonella enterica enterica serovar Typhi
ccucaccguccgccagg

SEQ ID NO: 1666076 - RNA, 11 nt, Salmonella enterica enterica serovar Typhi
ccucagcaggc

SEQ ID NO: 1666077 - RNA, 17 nt, Salmonella enterica enterica serovar Typhi
ccucacuggagacggau

SEQ ID NO: 1666078 - RNA, 16 nt, Salmonella enterica enterica serovar Typhi
ccgucgugccugcggu

SEQ ID NO: 1666079 - RNA, 13 nt, Salmonella enterica enterica serovar Typhi
ccgugcacgcugc

SEQ ID NO: 1666080 - RNA, 18 nt, Salmonella enterica enterica serovar Typhi
ccguggugaccgccagau

SEQ ID NO: 1666081 - RNA, 13 nt, Salmonella enterica enterica serovar Typhi
ccgucgcgcuuac

SEQ ID NO: 1666082 - RNA, 18 nt, Salmonella enterica enterica serovar Typhi
ccgucggggauggcggau

SEQ ID NO: 1666083 - RNA, 23 nt, Salmonella enterica enterica serovar Typhi
cgccgaauagaguaauacaucca

SEQ ID NO: 1666084 - RNA, 15 nt, Salmonella enterica enterica serovar Typhi
cgcccuucacgccga

SEQ ID NO: 1666085 - RNA, 16 nt, Salmonella enterica enterica serovar Typhi
cgccgaacacgcauaa

SEQ ID NO: 1666086 - RNA, 20 nt, Salmonella enterica enterica serovar Typhi
cgcccuguauacaggcaugg

SEQ ID NO: 1666087 - RNA, 20 nt, Salmonella enterica enterica serovar Typhi
cgcccuguggaaacuccagc

SEQ ID NO: 1666088 - RNA, 12 nt, Salmonella enterica enterica serovar Typhi
cgcccugaaagc

SEQ ID NO: 1666089 - RNA, 18 nt, Salmonella enterica enterica serovar Typhi
cgcccugcccaugaagcg

SEQ ID NO: 1666090 - RNA, 22 nt, Salmonella enterica enterica serovar Typhi
cgccgaguagcugagcgucagg

SEQ ID NO: 1666091 - RNA, 22 nt, Salmonella enterica enterica serovar Typhi
cgccaugccaucggccagcagg

SEQ ID NO: 1666092 - RNA, 20 nt, Salmonella enterica enterica serovar Typhi
cgcccgaucguccgccuccg

SEQ ID NO: 1666093 - RNA, 24 nt, Salmonella enterica enterica serovar Typhi
cgcccgaucucauaaacgccugga

SEQ ID NO: 1666094 - RNA, 18 nt, Salmonella enterica enterica serovar Typhi
cgcccguuuuuuccagcg

SEQ ID NO: 1666095 - RNA, 18 nt, Salmonella enterica enterica serovar Typhi
cgcccguagcgacgccau

SEQ ID NO: 1666096 - RNA, 14 nt, Salmonella enterica enterica serovar Typhi
cgcccgucaaugcg

SEQ ID NO: 1666097 - RNA, 15 nt, Salmonella enterica enterica serovar Typhi
cgcccucgccagcaa

SEQ ID NO: 1666098 - RNA, 12 nt, Salmonella enterica enterica serovar Typhi
cgcccguacaga

SEQ ID NO: 1666099 - RNA, 14 nt, Salmonella enterica enterica serovar Typhi
cgccgcggcgguua

SEQ ID NO: 1666100 - RNA, 13 nt, Salmonella enterica enterica serovar Typhi
cgccgcgcuaucg

SEQ ID NO: 1666101 - RNA, 23 nt, Salmonella enterica enterica serovar Typhi
cgccgcgccguuuagcacguugg

SEQ ID NO: 1666102 - RNA, 15 nt, Salmonella enterica enterica serovar Typhi
cgccggacuccagca

SEQ ID NO: 1666103 - RNA, 20 nt, Salmonella enterica enterica serovar Typhi
cgccggcaaagguugccgca

SEQ ID NO: 1666104 - RNA, 13 nt, Salmonella enterica enterica serovar Typhi
cgccggacgccac

SEQ ID NO: 1666105 - RNA, 20 nt, Salmonella enterica enterica serovar Typhi
cgccgcuaugcaauuguucc

SEQ ID NO: 1666106 - RNA, 18 nt, Salmonella enterica enterica serovar Typhi
cgccgcguaaauccacau

SEQ ID NO: 1666107 - RNA, 18 nt, Salmonella enterica enterica serovar Typhi
cgccgccgggccgccgau

SEQ ID NO: 1666108 - RNA, 15 nt, Salmonella enterica enterica serovar Typhi
cgccgccugcacggc

SEQ ID NO: 1666109 - RNA, 14 nt, Salmonella enterica enterica serovar Typhi
cgccgcccgccuga

SEQ ID NO: 1666110 - RNA, 21 nt, Salmonella enterica enterica serovar Typhi
cgccgcgaccagcagcaucac

SEQ ID NO: 1666111 - RNA, 21 nt, Salmonella enterica enterica serovar Typhi
cgccgcgcaguuuuuauccuc

SEQ ID NO: 1666112 - RNA, 20 nt, Salmonella enterica enterica serovar Typhi
cgccgccauccggcacgguc

SEQ ID NO: 1666113 - RNA, 20 nt, Salmonella enterica enterica serovar Typhi
cgccgcccaacgcggcuuua

SEQ ID NO: 1666114 - RNA, 18 nt, Salmonella enterica enterica serovar Typhi
cgccgccauccgacaacc

SEQ ID NO: 1666115 - RNA, 21 nt, Salmonella enterica enterica serovar Typhi
cgccgccaagauuaagaccgu

SEQ ID NO: 1666116 - RNA, 15 nt, Salmonella enterica enterica serovar Typhi
cgccgccaacgccaa

SEQ ID NO: 1666117 - RNA, 13 nt, Salmonella enterica enterica serovar Typhi
cgccgcaucgcgg

SEQ ID NO: 1666118 - RNA, 21 nt, Salmonella enterica enterica serovar Typhi
cgccgcauugguaaagccggu

SEQ ID NO: 1666119 - RNA, 19 nt, Salmonella enterica enterica serovar Typhi
cgcgcaaagccuuuccgca

SEQ ID NO: 1666120 - RNA, 12 nt, Salmonella enterica enterica serovar Typhi
cgcgauccgcca

SEQ ID NO: 1666121 - RNA, 16 nt, Salmonella enterica enterica serovar Typhi
cgcgauccgccagcgu

SEQ ID NO: 1666122 - RNA, 21 nt, Salmonella enterica enterica serovar Typhi
cgcgauccagccccagcgcca

SEQ ID NO: 1666123 - RNA, 12 nt, Salmonella enterica enterica serovar Typhi
cgcgagcagcca

SEQ ID NO: 1666124 - RNA, 18 nt, Salmonella enterica enterica serovar Typhi
cgcgagugucauccugcg

SEQ ID NO: 1666125 - RNA, 19 nt, Salmonella enterica enterica serovar Typhi
cgcgauaacguuaccgcag

SEQ ID NO: 1666126 - RNA, 19 nt, Salmonella enterica enterica serovar Typhi
cgcgaucaaucacgccgau

SEQ ID NO: 1666127 - RNA, 20 nt, Salmonella enterica enterica serovar Typhi
cgcgauauccaccaccugau

SEQ ID NO: 1666128 - RNA, 20 nt, Salmonella enterica enterica serovar Typhi
cgcgauagaccacgccauca

SEQ ID NO: 1666129 - RNA, 17 nt, Salmonella enterica enterica serovar Typhi
cgcgauacccgcgauca

SEQ ID NO: 1666130 - RNA, 16 nt, Salmonella enterica enterica serovar Typhi
cgcgauacugccgccc

SEQ ID NO: 1666131 - RNA, 15 nt, Salmonella enterica enterica serovar Typhi
cgcgaaacaggucgg

SEQ ID NO: 1666132 - RNA, 19 nt, Salmonella enterica enterica serovar Typhi
cgccuuucuccauggucag

SEQ ID NO: 1666133 - RNA, 18 nt, Salmonella enterica enterica serovar Typhi
cgcgaaacugcugccgca

SEQ ID NO: 1666134 - RNA, 15 nt, Salmonella enterica enterica serovar Typhi
cgccugcuucacgua

SEQ ID NO: 1666135 - RNA, 23 nt, Salmonella enterica enterica serovar Typhi
cgccuuucagacuucaacgccgc

SEQ ID NO: 1666136 - RNA, 17 nt, Salmonella enterica enterica serovar Typhi
cgcgaauaguggcgcgc

SEQ ID NO: 1666137 - RNA, 14 nt, Salmonella enterica enterica serovar Typhi
cgcgaauauacgca

SEQ ID NO: 1666138 - RNA, 18 nt, Salmonella enterica enterica serovar Typhi
cgcgaaucgcuucacggc

SEQ ID NO: 1666139 - RNA, 16 nt, Salmonella enterica enterica serovar Typhi
cgcgacagcgcugcgg

SEQ ID NO: 1666140 - RNA, 12 nt, Salmonella enterica enterica serovar Typhi
cgcgacagcgcu

SEQ ID NO: 1666141 - RNA, 14 nt, Salmonella enterica enterica serovar Typhi
cgcgacguccgcca

SEQ ID NO: 1666142 - RNA, 13 nt, Salmonella enterica enterica serovar Typhi
cgcgagaaguucu

SEQ ID NO: 1666143 - RNA, 19 nt, Salmonella enterica enterica serovar Typhi
cgcgagaagcccggccaca

SEQ ID NO: 1666144 - RNA, 19 nt, Salmonella enterica enterica serovar Typhi
cgcgacuuggaaaguugcg

SEQ ID NO: 1666145 - RNA, 21 nt, Salmonella enterica enterica serovar Typhi
cgcgacgacgccagccagcca

SEQ ID NO: 1666146 - RNA, 16 nt, Salmonella enterica enterica serovar Typhi
cgcgacgccugggcga

SEQ ID NO: 1666147 - RNA, 16 nt, Salmonella enterica enterica serovar Typhi
cgcgacgcgccagcca

SEQ ID NO: 1666148 - RNA, 22 nt, Salmonella enterica enterica serovar Typhi
cgcgacaucguuuccagcgaau

SEQ ID NO: 1666149 - RNA, 14 nt, Salmonella enterica enterica serovar Typhi
cgcgacauggcggu

SEQ ID NO: 1666150 - RNA, 20 nt, Salmonella enterica enterica serovar Typhi
cgccugauccggccuacaag

SEQ ID NO: 1666151 - RNA, 11 nt, Salmonella enterica enterica serovar Typhi
cgccugcugca

SEQ ID NO: 1666152 - RNA, 14 nt, Salmonella enterica enterica serovar Typhi
cgccugcugccagc

SEQ ID NO: 1666153 - RNA, 24 nt, Salmonella enterica enterica serovar Typhi
cgccuccggggaagcgcgcgcaca

SEQ ID NO: 1666154 - RNA, 19 nt, Salmonella enterica enterica serovar Typhi
cgccucaaggaagagaucg

SEQ ID NO: 1666155 - RNA, 23 nt, Salmonella enterica enterica serovar Typhi
cgccgugaauuucugcugccagc

SEQ ID NO: 1666156 - RNA, 14 nt, Salmonella enterica enterica serovar Typhi
cgccgugaacgcca

SEQ ID NO: 1666157 - RNA, 15 nt, Salmonella enterica enterica serovar Typhi
cgccgugaacgccaa

SEQ ID NO: 1666158 - RNA, 19 nt, Salmonella enterica enterica serovar Typhi
cgccgugauaaauacgcug

SEQ ID NO: 1666159 - RNA, 17 nt, Salmonella enterica enterica serovar Typhi
cgccuaccagcacauga

SEQ ID NO: 1666160 - RNA, 13 nt, Salmonella enterica enterica serovar Typhi
cgccuaaugaagc

SEQ ID NO: 1666161 - RNA, 21 nt, Salmonella enterica enterica serovar Typhi
cgccuaggccagugccaagca

SEQ ID NO: 1666162 - RNA, 16 nt, Salmonella enterica enterica serovar Typhi
cgccuaacagcgccgc

SEQ ID NO: 1666163 - RNA, 22 nt, Salmonella enterica enterica serovar Typhi
cgccuaagaucggguggccuaa

SEQ ID NO: 1666164 - RNA, 21 nt, Salmonella enterica enterica serovar Typhi
cgccguuaaccgucuggcugc

SEQ ID NO: 1666165 - RNA, 15 nt, Salmonella enterica enterica serovar Typhi
cgccgugcggcgugu

SEQ ID NO: 1666166 - RNA, 21 nt, Salmonella enterica enterica serovar Typhi
cgccgugcucacuaggcguua

SEQ ID NO: 1666167 - RNA, 17 nt, Salmonella enterica enterica serovar Typhi
cgccgguagccagccaa

SEQ ID NO: 1666168 - RNA, 24 nt, Salmonella enterica enterica serovar Typhi
cgccggggauaucaaugcgcguaa

SEQ ID NO: 1666169 - RNA, 22 nt, Salmonella enterica enterica serovar Typhi
cgccggcaguccuugcagccag

SEQ ID NO: 1666170 - RNA, 19 nt, Salmonella enterica enterica serovar Typhi
cgccgguugcgcugguugg

SEQ ID NO: 1666171 - RNA, 20 nt, Salmonella enterica enterica serovar Typhi
cgccgguuuauccccgcugg

SEQ ID NO: 1666172 - RNA, 14 nt, Salmonella enterica enterica serovar Typhi
cgccgguuuauccc

SEQ ID NO: 1666173 - RNA, 22 nt, Salmonella enterica enterica serovar Typhi
cgccguaaaacaacagcggcgu

SEQ ID NO: 1666174 - RNA, 23 nt, Salmonella enterica enterica serovar Typhi
cgccguacacguauaaacgccgc

SEQ ID NO: 1666175 - RNA, 20 nt, Salmonella enterica enterica serovar Typhi
cgccgucacaaagcccaccg

SEQ ID NO: 1666176 - RNA, 21 nt, Salmonella enterica enterica serovar Typhi
cgccguagcugcgcgccgcaa

SEQ ID NO: 1666177 - RNA, 16 nt, Salmonella enterica enterica serovar Typhi
cgccguagcugcgcgc

SEQ ID NO: 1666178 - RNA, 14 nt, Salmonella enterica enterica serovar Typhi
cgccguacuccagc

SEQ ID NO: 1666179 - RNA, 14 nt, Salmonella enterica enterica serovar Typhi
cgccgucauccgcg

SEQ ID NO: 1666180 - RNA, 15 nt, Salmonella enterica enterica serovar Typhi
cgccguccagcacca

SEQ ID NO: 1666181 - RNA, 18 nt, Salmonella enterica enterica serovar Typhi
cgcgccuggaucugcgca

SEQ ID NO: 1666182 - RNA, 19 nt, Salmonella enterica enterica serovar Typhi
cgcgccuggaucugcgcau

SEQ ID NO: 1666183 - RNA, 15 nt, Salmonella enterica enterica serovar Typhi
cgcgccugacgcgga

SEQ ID NO: 1666184 - RNA, 16 nt, Salmonella enterica enterica serovar Typhi
cgcgcgccacgcaugg

SEQ ID NO: 1666185 - RNA, 21 nt, Salmonella enterica enterica serovar Typhi
cgcgcgaauaucgcugccggu

SEQ ID NO: 1666186 - RNA, 13 nt, Salmonella enterica enterica serovar Typhi
cgcgcgccgauaa

SEQ ID NO: 1666187 - RNA, 21 nt, Salmonella enterica enterica serovar Typhi
cgcgcucuuccgccagcgcca

SEQ ID NO: 1666188 - RNA, 13 nt, Salmonella enterica enterica serovar Typhi
cgcgcucuccggc

SEQ ID NO: 1666189 - RNA, 15 nt, Salmonella enterica enterica serovar Typhi
cgcgcucuccggcac

SEQ ID NO: 1666190 - RNA, 16 nt, Salmonella enterica enterica serovar Typhi
cgcgcuauuccaguuu

SEQ ID NO: 1666191 - RNA, 15 nt, Salmonella enterica enterica serovar Typhi
cgcgcguuaugccga

SEQ ID NO: 1666192 - RNA, 17 nt, Salmonella enterica enterica serovar Typhi
cgcggaugguggcguaa

SEQ ID NO: 1666193 - RNA, 13 nt, Salmonella enterica enterica serovar Typhi
cgcggaucggcac

SEQ ID NO: 1666194 - RNA, 14 nt, Salmonella enterica enterica serovar Typhi
cgcggaucggcaca

SEQ ID NO: 1666195 - RNA, 16 nt, Salmonella enterica enterica serovar Typhi
cgcggauagucauaau

SEQ ID NO: 1666196 - RNA, 17 nt, Salmonella enterica enterica serovar Typhi
cgcggauaugcagcagc

SEQ ID NO: 1666197 - RNA, 13 nt, Salmonella enterica enterica serovar Typhi
cgcggaaucguca

SEQ ID NO: 1666198 - RNA, 14 nt, Salmonella enterica enterica serovar Typhi
cgcggacgccacca

SEQ ID NO: 1666199 - RNA, 17 nt, Salmonella enterica enterica serovar Typhi
cgcgcuguauaaucccg

SEQ ID NO: 1666200 - RNA, 19 nt, Salmonella enterica enterica serovar Typhi
cgcggaagaaauagaacag

SEQ ID NO: 1666201 - RNA, 18 nt, Salmonella enterica enterica serovar Typhi
cgcggaagcgaccggcgu

SEQ ID NO: 1666202 - RNA, 21 nt, Salmonella enterica enterica serovar Typhi
cgcggcgugaugccagccaua

SEQ ID NO: 1666203 - RNA, 22 nt, Salmonella enterica enterica serovar Typhi
cgcggcccauucaacgggcgau

SEQ ID NO: 1666204 - RNA, 23 nt, Salmonella enterica enterica serovar Typhi
cgcggcgcaacuuuuucgaugau

SEQ ID NO: 1666205 - RNA, 13 nt, Salmonella enterica enterica serovar Typhi
cgcgguaacgccu

SEQ ID NO: 1666206 - RNA, 21 nt, Salmonella enterica enterica serovar Typhi
cgcgggcgauuaucucgauau

SEQ ID NO: 1666207 - RNA, 16 nt, Salmonella enterica enterica serovar Typhi
cgcggcugccgucgau

SEQ ID NO: 1666208 - RNA, 19 nt, Salmonella enterica enterica serovar Typhi
cgcugaugacgcgccggau

SEQ ID NO: 1666209 - RNA, 14 nt, Salmonella enterica enterica serovar Typhi
cgcugaccgccgga

SEQ ID NO: 1666210 - RNA, 23 nt, Salmonella enterica enterica serovar Typhi
cgcugcauccuguaccaccacgc

SEQ ID NO: 1666211 - RNA, 21 nt, Salmonella enterica enterica serovar Typhi
cgcucgcggcagauaucgcug

SEQ ID NO: 1666212 - RNA, 14 nt, Salmonella enterica enterica serovar Typhi
cgcucucagcgucg

SEQ ID NO: 1666213 - RNA, 22 nt, Salmonella enterica enterica serovar Typhi
cgcucucgccgcgcuccaucau

SEQ ID NO: 1666214 - RNA, 22 nt, Salmonella enterica enterica serovar Typhi
cgcucucuucgugacccgccag

SEQ ID NO: 1666215 - RNA, 23 nt, Salmonella enterica enterica serovar Typhi
cgcucucuuucaccagcgccaga

SEQ ID NO: 1666216 - RNA, 15 nt, Salmonella enterica enterica serovar Typhi
cgcucuuuacauaau

SEQ ID NO: 1666217 - RNA, 21 nt, Salmonella enterica enterica serovar Typhi
cgcugaaaacggcaucaagcc

SEQ ID NO: 1666218 - RNA, 15 nt, Salmonella enterica enterica serovar Typhi
cgcuacaauccagga

SEQ ID NO: 1666219 - RNA, 13 nt, Salmonella enterica enterica serovar Typhi
cgcuacagggcgu

SEQ ID NO: 1666220 - RNA, 21 nt, Salmonella enterica enterica serovar Typhi
cgcuacauccgccagccgcca

SEQ ID NO: 1666221 - RNA, 15 nt, Salmonella enterica enterica serovar Typhi
cgcuaagccagccaa

SEQ ID NO: 1666222 - RNA, 13 nt, Salmonella enterica enterica serovar Typhi
cgcuaaaccggcg

SEQ ID NO: 1666223 - RNA, 13 nt, Salmonella enterica enterica serovar Typhi
cgcguggcaucuu

SEQ ID NO: 1666224 - RNA, 19 nt, Salmonella enterica enterica serovar Typhi
cgcgugcgcugcggccaga

SEQ ID NO: 1666225 - RNA, 18 nt, Salmonella enterica enterica serovar Typhi
cgcgguuaacagccgcug

SEQ ID NO: 1666226 - RNA, 18 nt, Salmonella enterica enterica serovar Typhi
cgcucaagcggcaccaca

SEQ ID NO: 1666227 - RNA, 19 nt, Salmonella enterica enterica serovar Typhi
cgcuaucugcuccgccagc

SEQ ID NO: 1666228 - RNA, 21 nt, Salmonella enterica enterica serovar Typhi
cgcuauuaccccgcggcaugg

SEQ ID NO: 1666229 - RNA, 23 nt, Salmonella enterica enterica serovar Typhi
cgcucacauucauugccgccagu

SEQ ID NO: 1666230 - RNA, 13 nt, Salmonella enterica enterica serovar Typhi
cgcucacgcagau

SEQ ID NO: 1666231 - RNA, 15 nt, Salmonella enterica enterica serovar Typhi
cgcucagcaucgcau

SEQ ID NO: 1666232 - RNA, 19 nt, Salmonella enterica enterica serovar Typhi
cgcuagcuuaucgggccua

SEQ ID NO: 1666233 - RNA, 16 nt, Salmonella enterica enterica serovar Typhi
cgcuaucugacagcca

SEQ ID NO: 1666234 - RNA, 18 nt, Salmonella enterica enterica serovar Typhi
cgcuauggugcgggguuu

SEQ ID NO: 1666235 - RNA, 20 nt, Salmonella enterica enterica serovar Typhi
cgcuauccggcccauuuggc

SEQ ID NO: 1666236 - RNA, 15 nt, Salmonella enterica enterica serovar Typhi
cgcuacggcguuuca

SEQ ID NO: 1666237 - RNA, 19 nt, Salmonella enterica enterica serovar Typhi
cgcuacguuuaucaggccu

SEQ ID NO: 1666238 - RNA, 18 nt, Salmonella enterica enterica serovar Typhi
cgcuacuccgcccuaauc

SEQ ID NO: 1666239 - RNA, 22 nt, Salmonella enterica enterica serovar Typhi
cgcuacugugggccguuccgca

SEQ ID NO: 1666240 - RNA, 12 nt, Salmonella enterica enterica serovar Typhi
cgcuaccgcaau

SEQ ID NO: 1666241 - RNA, 14 nt, Salmonella enterica enterica serovar Typhi
cgcuacccggcaca

SEQ ID NO: 1666242 - RNA, 20 nt, Salmonella enterica enterica serovar Typhi
cgcuacgcuuaucaggccua

SEQ ID NO: 1666243 - RNA, 18 nt, Salmonella enterica enterica serovar Typhi
cgcuacgcuuaucgggcc

SEQ ID NO: 1666244 - RNA, 17 nt, Salmonella enterica enterica serovar Typhi
cgcuucuucaugggcgu

SEQ ID NO: 1666245 - RNA, 23 nt, Salmonella enterica enterica serovar Typhi
cgcuucuucggcagcuuccagca

SEQ ID NO: 1666246 - RNA, 14 nt, Salmonella enterica enterica serovar Typhi
cgcuucugccgcca

SEQ ID NO: 1666247 - RNA, 17 nt, Salmonella enterica enterica serovar Typhi
cgcuuugucaccggagu

SEQ ID NO: 1666248 - RNA, 20 nt, Salmonella enterica enterica serovar Typhi
cgcuuugcuuauccggccua

SEQ ID NO: 1666249 - RNA, 22 nt, Salmonella enterica enterica serovar Typhi
cgcuuugcuuauccggccuaca

SEQ ID NO: 1666250 - RNA, 14 nt, Salmonella enterica enterica serovar Typhi
cgcuuucgcggccu

SEQ ID NO: 1666251 - RNA, 19 nt, Salmonella enterica enterica serovar Typhi
cgcuuugcggcuaucuucu

SEQ ID NO: 1666252 - RNA, 20 nt, Salmonella enterica enterica serovar Typhi
cgcuuuuaucggcgucgcgg

SEQ ID NO: 1666253 - RNA, 16 nt, Salmonella enterica enterica serovar Typhi
cgcuuuucagcgccag

SEQ ID NO: 1666254 - RNA, 18 nt, Salmonella enterica enterica serovar Typhi
cgcuuuuuugcuggcugg

SEQ ID NO: 1666255 - RNA, 14 nt, Salmonella enterica enterica serovar Typhi
cgcuuuaagcgcug

SEQ ID NO: 1666256 - RNA, 14 nt, Salmonella enterica enterica serovar Typhi
cgcuuuacaugacg

SEQ ID NO: 1666257 - RNA, 14 nt, Salmonella enterica enterica serovar Typhi
cgcuuucauacgac

SEQ ID NO: 1666258 - RNA, 18 nt, Salmonella enterica enterica serovar Typhi
cgcuuuccaguugcggca

SEQ ID NO: 1666259 - RNA, 21 nt, Salmonella enterica enterica serovar Typhi
cggaagcgaauggcggcacua

SEQ ID NO: 1666260 - RNA, 21 nt, Salmonella enterica enterica serovar Typhi
cggaauagagauagaacgguu

SEQ ID NO: 1666261 - RNA, 21 nt, Salmonella enterica enterica serovar Typhi
cggaauaccgucaaaacgcgc

SEQ ID NO: 1666262 - RNA, 16 nt, Salmonella enterica enterica serovar Typhi
cggaaguauacaucca

SEQ ID NO: 1666263 - RNA, 21 nt, Salmonella enterica enterica serovar Typhi
cggaacuuuaucaccagcgau

SEQ ID NO: 1666264 - RNA, 17 nt, Salmonella enterica enterica serovar Typhi
cggaacagggccgcauc

SEQ ID NO: 1666265 - RNA, 20 nt, Salmonella enterica enterica serovar Typhi
cggaaccgcguuugcgucgu

SEQ ID NO: 1666266 - RNA, 13 nt, Salmonella enterica enterica serovar Typhi
cggaacagcgggg

SEQ ID NO: 1666267 - RNA, 22 nt, Salmonella enterica enterica serovar Typhi
cggaaaugaucagacgcaucag

SEQ ID NO: 1666268 - RNA, 20 nt, Salmonella enterica enterica serovar Typhi
cgcuuuuuuaaacgccugau

SEQ ID NO: 1666269 - RNA, 14 nt, Salmonella enterica enterica serovar Typhi
cggaaaaucugcgc

SEQ ID NO: 1666270 - RNA, 18 nt, Salmonella enterica enterica serovar Typhi
cggaaaaaaauuucugcc

SEQ ID NO: 1666271 - RNA, 20 nt, Salmonella enterica enterica serovar Typhi
cggaaaauggguaucgccuu

SEQ ID NO: 1666272 - RNA, 16 nt, Salmonella enterica enterica serovar Typhi
cggaaaccccagguca

SEQ ID NO: 1666273 - RNA, 14 nt, Salmonella enterica enterica serovar Typhi
cggaaaccaguuca

SEQ ID NO: 1666274 - RNA, 23 nt, Salmonella enterica enterica serovar Typhi
cggaaagaagcaggguauugacg

SEQ ID NO: 1666275 - RNA, 20 nt, Salmonella enterica enterica serovar Typhi
cggaaagacggcagcgccau

SEQ ID NO: 1666276 - RNA, 15 nt, Salmonella enterica enterica serovar Typhi
cgcuguuaugcacgc

SEQ ID NO: 1666277 - RNA, 19 nt, Salmonella enterica enterica serovar Typhi
cgcuuaucaggccuacaac

SEQ ID NO: 1666278 - RNA, 17 nt, Salmonella enterica enterica serovar Typhi
cgcuuaucaggccuaca

SEQ ID NO: 1666279 - RNA, 17 nt, Salmonella enterica enterica serovar Typhi
cgcuuacugugccgccg

SEQ ID NO: 1666280 - RNA, 22 nt, Salmonella enterica enterica serovar Typhi
cgcuuauccggcuuauccggcc

SEQ ID NO: 1666281 - RNA, 21 nt, Salmonella enterica enterica serovar Typhi
cgcuuauccggcuuauccggc

SEQ ID NO: 1666282 - RNA, 12 nt, Salmonella enterica enterica serovar Typhi
cgcuuauccgcu

SEQ ID NO: 1666283 - RNA, 19 nt, Salmonella enterica enterica serovar Typhi
cgcuuauccggccuacaga

SEQ ID NO: 1666284 - RNA, 20 nt, Salmonella enterica enterica serovar Typhi
cgcuuaucaggccuacaacg

SEQ ID NO: 1666285 - RNA, 21 nt, Salmonella enterica enterica serovar Typhi
cgcuuaucaggccuacauccg

SEQ ID NO: 1666286 - RNA, 17 nt, Salmonella enterica enterica serovar Typhi
cgcuuaucaggccuacg

SEQ ID NO: 1666287 - RNA, 23 nt, Salmonella enterica enterica serovar Typhi
cgcuuaauaauaagcggccuaua

SEQ ID NO: 1666288 - RNA, 13 nt, Salmonella enterica enterica serovar Typhi
cgcuuacccagca

SEQ ID NO: 1666289 - RNA, 17 nt, Salmonella enterica enterica serovar Typhi
cgcuuaacuccggcgac

SEQ ID NO: 1666290 - RNA, 16 nt, Salmonella enterica enterica serovar Typhi
cgcuucgaugcguuca

SEQ ID NO: 1666291 - RNA, 20 nt, Salmonella enterica enterica serovar Typhi
cgcuucgcuugcccggccua

SEQ ID NO: 1666292 - RNA, 19 nt, Salmonella enterica enterica serovar Typhi
cgcuucgcuuauccggccu

SEQ ID NO: 1666293 - RNA, 20 nt, Salmonella enterica enterica serovar Typhi
cgcuucgcuuauccggccua

SEQ ID NO: 1666294 - RNA, 20 nt, Salmonella enterica enterica serovar Typhi
cgcuucgcuuaucuggccua

SEQ ID NO: 1666295 - RNA, 20 nt, Salmonella enterica enterica serovar Typhi
cgcuucgcuuaccaggccua

SEQ ID NO: 1666296 - RNA, 17 nt, Salmonella enterica enterica serovar Typhi
cgcuucgcuuauccggc

SEQ ID NO: 1666297 - RNA, 19 nt, Salmonella enterica enterica serovar Typhi
cgcuuauuccuccgccgau

SEQ ID NO: 1666298 - RNA, 23 nt, Salmonella enterica enterica serovar Typhi
cgcuucacgcgcggcuacugcca

SEQ ID NO: 1666299 - RNA, 18 nt, Salmonella enterica enterica serovar Typhi
cgcuucccgaugccagca

SEQ ID NO: 1666300 - RNA, 15 nt, Salmonella enterica enterica serovar Typhi
cgcugcgcaccugca

SEQ ID NO: 1666301 - RNA, 14 nt, Salmonella enterica enterica serovar Typhi
cgcugcgccagauc

SEQ ID NO: 1666302 - RNA, 17 nt, Salmonella enterica enterica serovar Typhi
cgcugcgccgcgccacc

SEQ ID NO: 1666303 - RNA, 17 nt, Salmonella enterica enterica serovar Typhi
cgcuggcgccaccgcug

SEQ ID NO: 1666304 - RNA, 20 nt, Salmonella enterica enterica serovar Typhi
cgcugucagugaaaaaccga

SEQ ID NO: 1666305 - RNA, 18 nt, Salmonella enterica enterica serovar Typhi
cgcuguccagauagggcc

SEQ ID NO: 1666306 - RNA, 18 nt, Salmonella enterica enterica serovar Typhi
cgcugucguuccacacgu

SEQ ID NO: 1666307 - RNA, 18 nt, Salmonella enterica enterica serovar Typhi
cgcuggucagcgcgccaa

SEQ ID NO: 1666308 - RNA, 22 nt, Salmonella enterica enterica serovar Typhi
cgcuggguaauagaugcgucgc

SEQ ID NO: 1666309 - RNA, 16 nt, Salmonella enterica enterica serovar Typhi
cgcuggguuuuuccgc

SEQ ID NO: 1666310 - RNA, 21 nt, Salmonella enterica enterica serovar Typhi
cggcgauuugccccggcgcug

SEQ ID NO: 1666311 - RNA, 13 nt, Salmonella enterica enterica serovar Typhi
cggcgccagccac

SEQ ID NO: 1666312 - RNA, 16 nt, Salmonella enterica enterica serovar Typhi
cggcgcgaucaucgca

SEQ ID NO: 1666313 - RNA, 19 nt, Salmonella enterica enterica serovar Typhi
cggcgcgcaguauugccga

SEQ ID NO: 1666314 - RNA, 17 nt, Salmonella enterica enterica serovar Typhi
cggcgcgcucuacguug

SEQ ID NO: 1666315 - RNA, 15 nt, Salmonella enterica enterica serovar Typhi
cggcgcgcgcgguuc

SEQ ID NO: 1666316 - RNA, 21 nt, Salmonella enterica enterica serovar Typhi
cggcgacggacucgcgcagaa

SEQ ID NO: 1666317 - RNA, 11 nt, Salmonella enterica enterica serovar Typhi
cggcgaaucgc

SEQ ID NO: 1666318 - RNA, 20 nt, Salmonella enterica enterica serovar Typhi
cggcgaaucgcagagcguaa

SEQ ID NO: 1666319 - RNA, 16 nt, Salmonella enterica enterica serovar Typhi
cggcgacaucgccaaa

SEQ ID NO: 1666320 - RNA, 17 nt, Salmonella enterica enterica serovar Typhi
cggcgaaauauuaucgc

SEQ ID NO: 1666321 - RNA, 21 nt, Salmonella enterica enterica serovar Typhi
cggccugucuccucagcaggc

SEQ ID NO: 1666322 - RNA, 12 nt, Salmonella enterica enterica serovar Typhi
cggccugcgcca

SEQ ID NO: 1666323 - RNA, 23 nt, Salmonella enterica enterica serovar Typhi
cggcauguucacaucgcucagaa

SEQ ID NO: 1666324 - RNA, 15 nt, Salmonella enterica enterica serovar Typhi
cggccacagcgccag

SEQ ID NO: 1666325 - RNA, 15 nt, Salmonella enterica enterica serovar Typhi
cggccacaggcgucg

SEQ ID NO: 1666326 - RNA, 16 nt, Salmonella enterica enterica serovar Typhi
cggccacagccauccg

SEQ ID NO: 1666327 - RNA, 15 nt, Salmonella enterica enterica serovar Typhi
cggcauuauaagcgc

SEQ ID NO: 1666328 - RNA, 23 nt, Salmonella enterica enterica serovar Typhi
cggcauuaugcaggcgucgggca

SEQ ID NO: 1666329 - RNA, 16 nt, Salmonella enterica enterica serovar Typhi
cggcagggcagcgagc

SEQ ID NO: 1666330 - RNA, 17 nt, Salmonella enterica enterica serovar Typhi
cggcaggcuggcgguaa

SEQ ID NO: 1666331 - RNA, 17 nt, Salmonella enterica enterica serovar Typhi
cggcaucggcagcguca

SEQ ID NO: 1666332 - RNA, 18 nt, Salmonella enterica enterica serovar Typhi
cggccagauaacgcgcau

SEQ ID NO: 1666333 - RNA, 17 nt, Salmonella enterica enterica serovar Typhi
cggccagauggcaaacg

SEQ ID NO: 1666334 - RNA, 14 nt, Salmonella enterica enterica serovar Typhi
cggccagcagccau

SEQ ID NO: 1666335 - RNA, 15 nt, Salmonella enterica enterica serovar Typhi
cggccacgcgcguca

SEQ ID NO: 1666336 - RNA, 16 nt, Salmonella enterica enterica serovar Typhi
cggccauuaccaguac

SEQ ID NO: 1666337 - RNA, 22 nt, Salmonella enterica enterica serovar Typhi
cggccaggcaaagauccaccag

SEQ ID NO: 1666338 - RNA, 14 nt, Salmonella enterica enterica serovar Typhi
cggccagcgccagc

SEQ ID NO: 1666339 - RNA, 13 nt, Salmonella enterica enterica serovar Typhi
cggccagcgccag

SEQ ID NO: 1666340 - RNA, 12 nt, Salmonella enterica enterica serovar Typhi
cggccagcgcag

SEQ ID NO: 1666341 - RNA, 17 nt, Salmonella enterica enterica serovar Typhi
cggcaauuuccggcgac

SEQ ID NO: 1666342 - RNA, 21 nt, Salmonella enterica enterica serovar Typhi
cggcaauggccgcagcgccau

SEQ ID NO: 1666343 - RNA, 21 nt, Salmonella enterica enterica serovar Typhi
cggcaauuaaccgauaacgcg

SEQ ID NO: 1666344 - RNA, 17 nt, Salmonella enterica enterica serovar Typhi
cggcaauuaccgccagc

SEQ ID NO: 1666345 - RNA, 20 nt, Salmonella enterica enterica serovar Typhi
cggcaauuaccgccagcggc

SEQ ID NO: 1666346 - RNA, 21 nt, Salmonella enterica enterica serovar Typhi
cggcacauugucagcugaaca

SEQ ID NO: 1666347 - RNA, 17 nt, Salmonella enterica enterica serovar Typhi
cggcagcaauacgcccg

SEQ ID NO: 1666348 - RNA, 18 nt, Salmonella enterica enterica serovar Typhi
cggcagauaucgcugacc

SEQ ID NO: 1666349 - RNA, 15 nt, Salmonella enterica enterica serovar Typhi
cggcagccagcguau

SEQ ID NO: 1666350 - RNA, 12 nt, Salmonella enterica enterica serovar Typhi
cggcagcgccag

SEQ ID NO: 1666351 - RNA, 20 nt, Salmonella enterica enterica serovar Typhi
cggagguuuucucauccagc

SEQ ID NO: 1666352 - RNA, 18 nt, Salmonella enterica enterica serovar Typhi
cggaguagacccacauau

SEQ ID NO: 1666353 - RNA, 19 nt, Salmonella enterica enterica serovar Typhi
cggauaaauagugacgccg

SEQ ID NO: 1666354 - RNA, 22 nt, Salmonella enterica enterica serovar Typhi
cggauacaagguauccgccaua

SEQ ID NO: 1666355 - RNA, 14 nt, Salmonella enterica enterica serovar Typhi
cggaucaggcguug

SEQ ID NO: 1666356 - RNA, 23 nt, Salmonella enterica enterica serovar Typhi
cggauagaugaagacaacgucgc

SEQ ID NO: 1666357 - RNA, 19 nt, Salmonella enterica enterica serovar Typhi
cggauaccggcgcagcauc

SEQ ID NO: 1666358 - RNA, 16 nt, Salmonella enterica enterica serovar Typhi
cggauccggcgcagac

SEQ ID NO: 1666359 - RNA, 14 nt, Salmonella enterica enterica serovar Typhi
cggcaaccagccca

SEQ ID NO: 1666360 - RNA, 18 nt, Salmonella enterica enterica serovar Typhi
cggcaaauacaucgccac

SEQ ID NO: 1666361 - RNA, 13 nt, Salmonella enterica enterica serovar Typhi
cggcaaacgcugg

SEQ ID NO: 1666362 - RNA, 19 nt, Salmonella enterica enterica serovar Typhi
cggcaaagauaaucugaau

SEQ ID NO: 1666363 - RNA, 18 nt, Salmonella enterica enterica serovar Typhi
cggcaaaccuaccggcau

SEQ ID NO: 1666364 - RNA, 23 nt, Salmonella enterica enterica serovar Typhi
cggcaaaauuaccaggcgguaug

SEQ ID NO: 1666365 - RNA, 15 nt, Salmonella enterica enterica serovar Typhi
cggcaaaaacgccgg

SEQ ID NO: 1666366 - RNA, 18 nt, Salmonella enterica enterica serovar Typhi
cggcaaaacgccgcagaa

SEQ ID NO: 1666367 - RNA, 17 nt, Salmonella enterica enterica serovar Typhi
cggauugugaaauucga

SEQ ID NO: 1666368 - RNA, 18 nt, Salmonella enterica enterica serovar Typhi
cggauuuagcggcagcca

SEQ ID NO: 1666369 - RNA, 16 nt, Salmonella enterica enterica serovar Typhi
cggauuaaagacgccg

SEQ ID NO: 1666370 - RNA, 11 nt, Salmonella enterica enterica serovar Typhi
cggaugccagu

SEQ ID NO: 1666371 - RNA, 15 nt, Salmonella enterica enterica serovar Typhi
cggauggcggcguga

SEQ ID NO: 1666372 - RNA, 22 nt, Salmonella enterica enterica serovar Typhi
cggauggcggcuaacgccugau

SEQ ID NO: 1666373 - RNA, 20 nt, Salmonella enterica enterica serovar Typhi
cggaugcagucugguaacgc

SEQ ID NO: 1666374 - RNA, 17 nt, Salmonella enterica enterica serovar Typhi
cgggccugugccugaca

SEQ ID NO: 1666375 - RNA, 19 nt, Salmonella enterica enterica serovar Typhi
cgggccuguguaggccgga

SEQ ID NO: 1666376 - RNA, 15 nt, Salmonella enterica enterica serovar Typhi
cgggcugaacgccag

SEQ ID NO: 1666377 - RNA, 14 nt, Salmonella enterica enterica serovar Typhi
cgggcucguugcgu

SEQ ID NO: 1666378 - RNA, 16 nt, Salmonella enterica enterica serovar Typhi
cggggaucgguuuauc

SEQ ID NO: 1666379 - RNA, 20 nt, Salmonella enterica enterica serovar Typhi
cgggggcgaucagcagguca

SEQ ID NO: 1666380 - RNA, 14 nt, Salmonella enterica enterica serovar Typhi
cgggugcagcguca

SEQ ID NO: 1666381 - RNA, 15 nt, Salmonella enterica enterica serovar Typhi
cggguccugaucggc

SEQ ID NO: 1666382 - RNA, 12 nt, Salmonella enterica enterica serovar Typhi
cgggugcggcgc

SEQ ID NO: 1666383 - RNA, 23 nt, Salmonella enterica enterica serovar Typhi
cgggugcgcagccccagcgccag

SEQ ID NO: 1666384 - RNA, 15 nt, Salmonella enterica enterica serovar Typhi
cggguuagacucagc

SEQ ID NO: 1666385 - RNA, 22 nt, Salmonella enterica enterica serovar Typhi
cggguuucugaauagaaagucg

SEQ ID NO: 1666386 - RNA, 23 nt, Salmonella enterica enterica serovar Typhi
cggguuuucaauaaucaucaggc

SEQ ID NO: 1666387 - RNA, 21 nt, Salmonella enterica enterica serovar Typhi
cgguaaaccuguuuguuuauu

SEQ ID NO: 1666388 - RNA, 17 nt, Salmonella enterica enterica serovar Typhi
cgguaaacgcucgccgu

SEQ ID NO: 1666389 - RNA, 21 nt, Salmonella enterica enterica serovar Typhi
cgguaaagacaccguucuggc

SEQ ID NO: 1666390 - RNA, 16 nt, Salmonella enterica enterica serovar Typhi
cgguaaauuucaaccc

SEQ ID NO: 1666391 - RNA, 15 nt, Salmonella enterica enterica serovar Typhi
cgguaagccaccaga

SEQ ID NO: 1666392 - RNA, 18 nt, Salmonella enterica enterica serovar Typhi
cgguaagaaugcgcguca

SEQ ID NO: 1666393 - RNA, 20 nt, Salmonella enterica enterica serovar Typhi
cgguaauuccuuuacgccca

SEQ ID NO: 1666394 - RNA, 18 nt, Salmonella enterica enterica serovar Typhi
cgguaaucgccugccagc

SEQ ID NO: 1666395 - RNA, 16 nt, Salmonella enterica enterica serovar Typhi
cgguaaucccuucacg

SEQ ID NO: 1666396 - RNA, 14 nt, Salmonella enterica enterica serovar Typhi
cgguagcugcgcca

SEQ ID NO: 1666397 - RNA, 16 nt, Salmonella enterica enterica serovar Typhi
cggucagcggcggaaa

SEQ ID NO: 1666398 - RNA, 19 nt, Salmonella enterica enterica serovar Typhi
cggucaggggucagcguau

SEQ ID NO: 1666399 - RNA, 18 nt, Salmonella enterica enterica serovar Typhi
cggucauaaccggccgau

SEQ ID NO: 1666400 - RNA, 15 nt, Salmonella enterica enterica serovar Typhi
cggucauccagcggu

SEQ ID NO: 1666401 - RNA, 14 nt, Salmonella enterica enterica serovar Typhi
cggucaguacgccc

SEQ ID NO: 1666402 - RNA, 23 nt, Salmonella enterica enterica serovar Typhi
cggucgacagccacacgccacaa

SEQ ID NO: 1666403 - RNA, 15 nt, Salmonella enterica enterica serovar Typhi
cggucuggcgcauaa

SEQ ID NO: 1666404 - RNA, 14 nt, Salmonella enterica enterica serovar Typhi
cggucggcgcguca

SEQ ID NO: 1666405 - RNA, 21 nt, Salmonella enterica enterica serovar Typhi
cgggacauguucagcgcagaa

SEQ ID NO: 1666406 - RNA, 13 nt, Salmonella enterica enterica serovar Typhi
cgggacauccgga

SEQ ID NO: 1666407 - RNA, 23 nt, Salmonella enterica enterica serovar Typhi
cggcugaguucaggcacgugcau

SEQ ID NO: 1666408 - RNA, 19 nt, Salmonella enterica enterica serovar Typhi
cggcugacgcccaucagca

SEQ ID NO: 1666409 - RNA, 16 nt, Salmonella enterica enterica serovar Typhi
cggcugacgcccauca

SEQ ID NO: 1666410 - RNA, 16 nt, Salmonella enterica enterica serovar Typhi
cggcugaccugaacgc

SEQ ID NO: 1666411 - RNA, 15 nt, Salmonella enterica enterica serovar Typhi
cggcuucuccaccau

SEQ ID NO: 1666412 - RNA, 19 nt, Salmonella enterica enterica serovar Typhi
cgggacuucaggcauccag

SEQ ID NO: 1666413 - RNA, 21 nt, Salmonella enterica enterica serovar Typhi
cgggagauuaggguucacggc

SEQ ID NO: 1666414 - RNA, 17 nt, Salmonella enterica enterica serovar Typhi
cgggacggcggccagca

SEQ ID NO: 1666415 - RNA, 17 nt, Salmonella enterica enterica serovar Typhi
cgggauaauauugccau

SEQ ID NO: 1666416 - RNA, 20 nt, Salmonella enterica enterica serovar Typhi
cgggauagcacuacccagau

SEQ ID NO: 1666417 - RNA, 21 nt, Salmonella enterica enterica serovar Typhi
cgggaucgauauaucgcguca

SEQ ID NO: 1666418 - RNA, 14 nt, Salmonella enterica enterica serovar Typhi
cgggccugccaggu

SEQ ID NO: 1666419 - RNA, 14 nt, Salmonella enterica enterica serovar Typhi
cgggcauaaccucu

SEQ ID NO: 1666420 - RNA, 14 nt, Salmonella enterica enterica serovar Typhi
cgggcaauacgcug

SEQ ID NO: 1666421 - RNA, 20 nt, Salmonella enterica enterica serovar Typhi
cggcucgcacauaucgcaau

SEQ ID NO: 1666422 - RNA, 20 nt, Salmonella enterica enterica serovar Typhi
cggcucgcuguucgccagac

SEQ ID NO: 1666423 - RNA, 18 nt, Salmonella enterica enterica serovar Typhi
cggcuacggaguucgccg

SEQ ID NO: 1666424 - RNA, 16 nt, Salmonella enterica enterica serovar Typhi
cggcgucaaaucgccg

SEQ ID NO: 1666425 - RNA, 22 nt, Salmonella enterica enterica serovar Typhi
cggcgucuucauccucgccaua

SEQ ID NO: 1666426 - RNA, 21 nt, Salmonella enterica enterica serovar Typhi
cggcggcuugccuucauccgc

SEQ ID NO: 1666427 - RNA, 18 nt, Salmonella enterica enterica serovar Typhi
cggcggcuuuaaugccgc

SEQ ID NO: 1666428 - RNA, 16 nt, Salmonella enterica enterica serovar Typhi
cggcguaaaacuggcu

SEQ ID NO: 1666429 - RNA, 20 nt, Salmonella enterica enterica serovar Typhi
cggcgguucauccugcgcca

SEQ ID NO: 1666430 - RNA, 18 nt, Salmonella enterica enterica serovar Typhi
aaaagcccgcccagcauu

SEQ ID NO: 1666431 - RNA, 14 nt, Salmonella enterica enterica serovar Typhi
aaaaguauggcggu

SEQ ID NO: 1666432 - RNA, 13 nt, Salmonella enterica enterica serovar Typhi
aaaauaauccgcu

SEQ ID NO: 1666433 - RNA, 15 nt, Salmonella enterica enterica serovar Typhi
aaaauagcuggcugu

SEQ ID NO: 1666434 - RNA, 21 nt, Salmonella enterica enterica serovar Typhi
aaaaucugcgccaaucgcgau

SEQ ID NO: 1666435 - RNA, 19 nt, Salmonella enterica enterica serovar Typhi
aaaaacagguugcguaacg

SEQ ID NO: 1666436 - RNA, 18 nt, Salmonella enterica enterica serovar Typhi
aaaaaaacaucgcugaua

SEQ ID NO: 1666437 - RNA, 13 nt, Salmonella enterica enterica serovar Typhi
aaaaacggcuuua

SEQ ID NO: 1666438 - RNA, 14 nt, Salmonella enterica enterica serovar Typhi
aaaacggaacaccg

SEQ ID NO: 1666439 - RNA, 16 nt, Salmonella enterica enterica serovar Typhi
aaaaccggcaaauacc

SEQ ID NO: 1666440 - RNA, 23 nt, Salmonella enterica enterica serovar Typhi
aaaacauggggaguaaagcagcu

SEQ ID NO: 1666441 - RNA, 18 nt, Salmonella enterica enterica serovar Typhi
aaaaccagaauuuccaga

SEQ ID NO: 1666442 - RNA, 13 nt, Salmonella enterica enterica serovar Typhi
aaaacagccgcca

SEQ ID NO: 1666443 - RNA, 19 nt, Salmonella enterica enterica serovar Typhi
aaaaauuucugccgacaag

SEQ ID NO: 1666444 - RNA, 22 nt, Salmonella enterica enterica serovar Typhi
aaaaagccagggaaauggcgaa

SEQ ID NO: 1666445 - RNA, 17 nt, Salmonella enterica enterica serovar Typhi
aaaaagcugcgaucaag

SEQ ID NO: 1666446 - RNA, 20 nt, Salmonella enterica enterica serovar Typhi
aaaaauagcauuaagcugau

SEQ ID NO: 1666447 - RNA, 20 nt, Salmonella enterica enterica serovar Typhi
aaacgcgucuucaucagcca

SEQ ID NO: 1666448 - RNA, 20 nt, Salmonella enterica enterica serovar Typhi
aaacgcgguaagcuguuccg

SEQ ID NO: 1666449 - RNA, 15 nt, Salmonella enterica enterica serovar Typhi
aaacgccgaagccag

SEQ ID NO: 1666450 - RNA, 14 nt, Salmonella enterica enterica serovar Typhi
aaagcagcggcggu

SEQ ID NO: 1666451 - RNA, 18 nt, Salmonella enterica enterica serovar Typhi
aaagccaauccagaauac

SEQ ID NO: 1666452 - RNA, 20 nt, Salmonella enterica enterica serovar Typhi
aaaggggaucguguaacaau

SEQ ID NO: 1666453 - RNA, 19 nt, Salmonella enterica enterica serovar Typhi
aaaguaccaaaacagaaaa

SEQ ID NO: 1666454 - RNA, 18 nt, Salmonella enterica enterica serovar Typhi
aaagccgccauccggcau

SEQ ID NO: 1666455 - RNA, 16 nt, Salmonella enterica enterica serovar Typhi
aaagcccgcccagcau

SEQ ID NO: 1666456 - RNA, 22 nt, Salmonella enterica enterica serovar Typhi
aaagccccggcucaagccaggu

SEQ ID NO: 1666457 - RNA, 18 nt, Salmonella enterica enterica serovar Typhi
aaagcccaucaccgccag

SEQ ID NO: 1666458 - RNA, 16 nt, Salmonella enterica enterica serovar Typhi
aaagccaggccgccag

SEQ ID NO: 1666459 - RNA, 16 nt, Salmonella enterica enterica serovar Typhi
aaagcccaucagcgcc

SEQ ID NO: 1666460 - RNA, 18 nt, Salmonella enterica enterica serovar Typhi
aaagcgaauacuccugca

SEQ ID NO: 1666461 - RNA, 13 nt, Salmonella enterica enterica serovar Typhi
aaagccgcgcggu

SEQ ID NO: 1666462 - RNA, 20 nt, Salmonella enterica enterica serovar Typhi
aaagcgcuacagggcguuuu

SEQ ID NO: 1666463 - RNA, 19 nt, Salmonella enterica enterica serovar Typhi
aaaccacaaucacagcgca

SEQ ID NO: 1666464 - RNA, 22 nt, Salmonella enterica enterica serovar Typhi
aaacagaccggagcgugcuuca

SEQ ID NO: 1666465 - RNA, 13 nt, Salmonella enterica enterica serovar Typhi
aaacacucaggca

SEQ ID NO: 1666466 - RNA, 14 nt, Salmonella enterica enterica serovar Typhi
aaacaccucagcca

SEQ ID NO: 1666467 - RNA, 11 nt, Salmonella enterica enterica serovar Typhi
aaaccgaucuc

SEQ ID NO: 1666468 - RNA, 18 nt, Salmonella enterica enterica serovar Typhi
aaacccgcagccggauag

SEQ ID NO: 1666469 - RNA, 19 nt, Salmonella enterica enterica serovar Typhi
aaaccacagugaugacggc

SEQ ID NO: 1666470 - RNA, 21 nt, Salmonella enterica enterica serovar Typhi
aaaccaggcacugcaggcggg

SEQ ID NO: 1666471 - RNA, 16 nt, Salmonella enterica enterica serovar Typhi
aaaccaucuugcguua

SEQ ID NO: 1666472 - RNA, 19 nt, Salmonella enterica enterica serovar Typhi
aaaccuaccggcauaguac

SEQ ID NO: 1666473 - RNA, 12 nt, Salmonella enterica enterica serovar Typhi
aaaccuccggcu

SEQ ID NO: 1666474 - RNA, 17 nt, Salmonella enterica enterica serovar Typhi
aaaccguccacauccag

SEQ ID NO: 1666475 - RNA, 15 nt, Salmonella enterica enterica serovar Typhi
aaaccuaccggcaua

SEQ ID NO: 1666476 - RNA, 18 nt, Salmonella enterica enterica serovar Typhi
aaaacuggugcaggcggu

SEQ ID NO: 1666477 - RNA, 18 nt, Salmonella enterica enterica serovar Typhi
aaauuagccaguucgccu

SEQ ID NO: 1666478 - RNA, 20 nt, Salmonella enterica enterica serovar Typhi
aaauuugucagacaugauaa

SEQ ID NO: 1666479 - RNA, 20 nt, Salmonella enterica enterica serovar Typhi
aaaagaagcuguaacacugc

SEQ ID NO: 1666480 - RNA, 19 nt, Salmonella enterica enterica serovar Typhi
aaaagacgcuuuucagcgu

SEQ ID NO: 1666481 - RNA, 17 nt, Salmonella enterica enterica serovar Typhi
aacaaacauaagcaaau

SEQ ID NO: 1666482 - RNA, 18 nt, Salmonella enterica enterica serovar Typhi
aacaacacgaucgaugcc

SEQ ID NO: 1666483 - RNA, 14 nt, Salmonella enterica enterica serovar Typhi
aacaacaggccgcc

SEQ ID NO: 1666484 - RNA, 21 nt, Salmonella enterica enterica serovar Typhi
aacaaccagaauaauggggau

SEQ ID NO: 1666485 - RNA, 22 nt, Salmonella enterica enterica serovar Typhi
aacaccgccgcgcugaucgcca

SEQ ID NO: 1666486 - RNA, 12 nt, Salmonella enterica enterica serovar Typhi
aaaugacgcgcg

SEQ ID NO: 1666487 - RNA, 21 nt, Salmonella enterica enterica serovar Typhi
aaaugaggacacaguaaugag

SEQ ID NO: 1666488 - RNA, 23 nt, Salmonella enterica enterica serovar Typhi
aaaugacgcccugcgccagcaug

SEQ ID NO: 1666489 - RNA, 13 nt, Salmonella enterica enterica serovar Typhi
aaaucgucgccaa

SEQ ID NO: 1666490 - RNA, 13 nt, Salmonella enterica enterica serovar Typhi
aaauccuccggcg

SEQ ID NO: 1666491 - RNA, 23 nt, Salmonella enterica enterica serovar Typhi
aaaucgaugaucgaggcgugcga

SEQ ID NO: 1666492 - RNA, 12 nt, Salmonella enterica enterica serovar Typhi
aaaucgccauca

SEQ ID NO: 1666493 - RNA, 14 nt, Salmonella enterica enterica serovar Typhi
aaaucgacagccag

SEQ ID NO: 1666494 - RNA, 12 nt, Salmonella enterica enterica serovar Typhi
aaaacaagcagu

SEQ ID NO: 1666495 - RNA, 20 nt, Salmonella enterica enterica serovar Typhi
aaaacaagugcagaagcaau

SEQ ID NO: 1666496 - RNA, 15 nt, Salmonella enterica enterica serovar Typhi
aaauaaggcugcgcg

SEQ ID NO: 1666497 - RNA, 15 nt, Salmonella enterica enterica serovar Typhi
aaaguuucaggauaa

SEQ ID NO: 1666498 - RNA, 20 nt, Salmonella enterica enterica serovar Typhi
aaaucagugaacacccugcc

SEQ ID NO: 1666499 - RNA, 16 nt, Salmonella enterica enterica serovar Typhi
acaaaucaaacucacc

SEQ ID NO: 1666500 - RNA, 12 nt, Salmonella enterica enterica serovar Typhi
acaaagccgacg

SEQ ID NO: 1666501 - RNA, 17 nt, Salmonella enterica enterica serovar Typhi
acaaaaggauacagcgc

SEQ ID NO: 1666502 - RNA, 15 nt, Salmonella enterica enterica serovar Typhi
aauuuccgcagccag

SEQ ID NO: 1666503 - RNA, 13 nt, Salmonella enterica enterica serovar Typhi
acaacacggcggc

SEQ ID NO: 1666504 - RNA, 20 nt, Salmonella enterica enterica serovar Typhi
acaacacgcuuuucagcgcc

SEQ ID NO: 1666505 - RNA, 23 nt, Salmonella enterica enterica serovar Typhi
acaaauuccggcacaaccuggcu

SEQ ID NO: 1666506 - RNA, 14 nt, Salmonella enterica enterica serovar Typhi
acaaauucgcuaau

SEQ ID NO: 1666507 - RNA, 11 nt, Salmonella enterica enterica serovar Typhi
acaacgcuucu

SEQ ID NO: 1666508 - RNA, 20 nt, Salmonella enterica enterica serovar Typhi
acaacgccgguacgcagcag

SEQ ID NO: 1666509 - RNA, 17 nt, Salmonella enterica enterica serovar Typhi
acaacgccgccuggcau

SEQ ID NO: 1666510 - RNA, 19 nt, Salmonella enterica enterica serovar Typhi
acaacgccaucagccgcgc

SEQ ID NO: 1666511 - RNA, 13 nt, Salmonella enterica enterica serovar Typhi
acaacgagauuca

SEQ ID NO: 1666512 - RNA, 21 nt, Salmonella enterica enterica serovar Typhi
acaagguugaucaggaaguug

SEQ ID NO: 1666513 - RNA, 21 nt, Salmonella enterica enterica serovar Typhi
acaagccgccaacgccagcag

SEQ ID NO: 1666514 - RNA, 20 nt, Salmonella enterica enterica serovar Typhi
acaagccgccaacgccagca

SEQ ID NO: 1666515 - RNA, 17 nt, Salmonella enterica enterica serovar Typhi
acaaucauaauaaacug

SEQ ID NO: 1666516 - RNA, 14 nt, Salmonella enterica enterica serovar Typhi
acaaucagcgcaau

SEQ ID NO: 1666517 - RNA, 15 nt, Salmonella enterica enterica serovar Typhi
acaauacucacuauc

SEQ ID NO: 1666518 - RNA, 22 nt, Salmonella enterica enterica serovar Typhi
acacagaugacaaagccggaua

SEQ ID NO: 1666519 - RNA, 14 nt, Salmonella enterica enterica serovar Typhi
acacacgcgcugac

SEQ ID NO: 1666520 - RNA, 18 nt, Salmonella enterica enterica serovar Typhi
acaauggcgacgaucagc

SEQ ID NO: 1666521 - RNA, 21 nt, Salmonella enterica enterica serovar Typhi
acaauggcgacgaucagcgcc

SEQ ID NO: 1666522 - RNA, 14 nt, Salmonella enterica enterica serovar Typhi
acaaugcccggcau

SEQ ID NO: 1666523 - RNA, 18 nt, Salmonella enterica enterica serovar Typhi
acaauccgccacgcucgc

SEQ ID NO: 1666524 - RNA, 21 nt, Salmonella enterica enterica serovar Typhi
acaauccgacgcucaaccggu

SEQ ID NO: 1666525 - RNA, 13 nt, Salmonella enterica enterica serovar Typhi
acaaucgcguuuu

SEQ ID NO: 1666526 - RNA, 13 nt, Salmonella enterica enterica serovar Typhi
aaugccaugcugg

SEQ ID NO: 1666527 - RNA, 14 nt, Salmonella enterica enterica serovar Typhi
aaugcccaggcggc

SEQ ID NO: 1666528 - RNA, 21 nt, Salmonella enterica enterica serovar Typhi
aaugcccgacgcgccgccagc

SEQ ID NO: 1666529 - RNA, 14 nt, Salmonella enterica enterica serovar Typhi
aaugcccagcgccg

SEQ ID NO: 1666530 - RNA, 22 nt, Salmonella enterica enterica serovar Typhi
aaugcacauuagcaauugccau

SEQ ID NO: 1666531 - RNA, 21 nt, Salmonella enterica enterica serovar Typhi
aaucuuuacacucgcggauaa

SEQ ID NO: 1666532 - RNA, 14 nt, Salmonella enterica enterica serovar Typhi
aaucuugcguacca

SEQ ID NO: 1666533 - RNA, 13 nt, Salmonella enterica enterica serovar Typhi
aaugaagcgcguu

SEQ ID NO: 1666534 - RNA, 21 nt, Salmonella enterica enterica serovar Typhi
aaugacgggcuacgucgucga

SEQ ID NO: 1666535 - RNA, 17 nt, Salmonella enterica enterica serovar Typhi
aaugacgcccugcgcca

SEQ ID NO: 1666536 - RNA, 14 nt, Salmonella enterica enterica serovar Typhi
aaugaccagcgccc

SEQ ID NO: 1666537 - RNA, 13 nt, Salmonella enterica enterica serovar Typhi
aauggucgcgcca

SEQ ID NO: 1666538 - RNA, 21 nt, Salmonella enterica enterica serovar Typhi
aauguuuaaucggccagcgaa

SEQ ID NO: 1666539 - RNA, 14 nt, Salmonella enterica enterica serovar Typhi
aauggcuuuguccg

SEQ ID NO: 1666540 - RNA, 20 nt, Salmonella enterica enterica serovar Typhi
aauugccugauggcgcugcg

SEQ ID NO: 1666541 - RNA, 21 nt, Salmonella enterica enterica serovar Typhi
aauugauuagcuuuaauccgu

SEQ ID NO: 1666542 - RNA, 23 nt, Salmonella enterica enterica serovar Typhi
aauugcuaccucguaucccgccu

SEQ ID NO: 1666543 - RNA, 22 nt, Salmonella enterica enterica serovar Typhi
acaccgccuagcgucccggcaa

SEQ ID NO: 1666544 - RNA, 21 nt, Salmonella enterica enterica serovar Typhi
acaccgccuagcgucccggca

SEQ ID NO: 1666545 - RNA, 14 nt, Salmonella enterica enterica serovar Typhi
acaccggccugccu

SEQ ID NO: 1666546 - RNA, 18 nt, Salmonella enterica enterica serovar Typhi
acaccggccauugccgcg

SEQ ID NO: 1666547 - RNA, 14 nt, Salmonella enterica enterica serovar Typhi
acaccggaagugaa

SEQ ID NO: 1666548 - RNA, 23 nt, Salmonella enterica enterica serovar Typhi
acaccagaucauuaccugucgcc

SEQ ID NO: 1666549 - RNA, 13 nt, Salmonella enterica enterica serovar Typhi
acaccauuucaca

SEQ ID NO: 1666550 - RNA, 16 nt, Salmonella enterica enterica serovar Typhi
aaaaguaccagcgcga

SEQ ID NO: 1666551 - RNA, 13 nt, Salmonella enterica enterica serovar Typhi
aaaauaacgcgau

SEQ ID NO: 1666552 - RNA, 18 nt, Salmonella enterica enterica serovar Typhi
acacgccuuccuccagca

SEQ ID NO: 1666553 - RNA, 16 nt, Salmonella enterica enterica serovar Typhi
acacggggcgguaccg

SEQ ID NO: 1666554 - RNA, 20 nt, Salmonella enterica enterica serovar Typhi
acaccuuuggggaaagguaa

SEQ ID NO: 1666555 - RNA, 18 nt, Salmonella enterica enterica serovar Typhi
acacgauagugaucgccc

SEQ ID NO: 1666556 - RNA, 17 nt, Salmonella enterica enterica serovar Typhi
acacgauccccaucgau

SEQ ID NO: 1666557 - RNA, 16 nt, Salmonella enterica enterica serovar Typhi
acaggugaacauuaca

SEQ ID NO: 1666558 - RNA, 16 nt, Salmonella enterica enterica serovar Typhi
acagcuugaucaucag

SEQ ID NO: 1666559 - RNA, 19 nt, Salmonella enterica enterica serovar Typhi
acaggcgcagggcauuauu

SEQ ID NO: 1666560 - RNA, 15 nt, Salmonella enterica enterica serovar Typhi
acaggcgcauacgau

SEQ ID NO: 1666561 - RNA, 19 nt, Salmonella enterica enterica serovar Typhi
acaggcgacgccgccaucc

SEQ ID NO: 1666562 - RNA, 20 nt, Salmonella enterica enterica serovar Typhi
acagcguauuaagccaacgu

SEQ ID NO: 1666563 - RNA, 20 nt, Salmonella enterica enterica serovar Typhi
acagcgucauccaguguuaa

SEQ ID NO: 1666564 - RNA, 14 nt, Salmonella enterica enterica serovar Typhi
acagcguaaauaag

SEQ ID NO: 1666565 - RNA, 15 nt, Salmonella enterica enterica serovar Typhi
acagcggcaggcgga

SEQ ID NO: 1666566 - RNA, 14 nt, Salmonella enterica enterica serovar Typhi
acagcgacacuccg

SEQ ID NO: 1666567 - RNA, 13 nt, Salmonella enterica enterica serovar Typhi
acagcgaucacgc

SEQ ID NO: 1666568 - RNA, 12 nt, Salmonella enterica enterica serovar Typhi
acacucgcggau

SEQ ID NO: 1666569 - RNA, 23 nt, Salmonella enterica enterica serovar Typhi
acacuccggcgcgcgcgccaucg

SEQ ID NO: 1666570 - RNA, 12 nt, Salmonella enterica enterica serovar Typhi
acacguaacaac

SEQ ID NO: 1666571 - RNA, 15 nt, Salmonella enterica enterica serovar Typhi
acagaagcgccuguc

SEQ ID NO: 1666572 - RNA, 14 nt, Salmonella enterica enterica serovar Typhi
acagaaucgcgaua

SEQ ID NO: 1666573 - RNA, 23 nt, Salmonella enterica enterica serovar Typhi
acagauucccagugcgcggucau

SEQ ID NO: 1666574 - RNA, 13 nt, Salmonella enterica enterica serovar Typhi
acagcaauaucag

SEQ ID NO: 1666575 - RNA, 13 nt, Salmonella enterica enterica serovar Typhi
acagcaauaaaag

SEQ ID NO: 1666576 - RNA, 19 nt, Salmonella enterica enterica serovar Typhi
acagauagcccugagccca

SEQ ID NO: 1666577 - RNA, 19 nt, Salmonella enterica enterica serovar Typhi
acagaggaugccugcgcau

SEQ ID NO: 1666578 - RNA, 16 nt, Salmonella enterica enterica serovar Typhi
acagauuuaauaaucg

SEQ ID NO: 1666579 - RNA, 20 nt, Salmonella enterica enterica serovar Typhi
acagauaugaaaugagacca

SEQ ID NO: 1666580 - RNA, 16 nt, Salmonella enterica enterica serovar Typhi
acagacgacuccaaua

SEQ ID NO: 1666581 - RNA, 14 nt, Salmonella enterica enterica serovar Typhi
acagaauuaacgca

SEQ ID NO: 1666582 - RNA, 19 nt, Salmonella enterica enterica serovar Typhi
acagaccuaaauaagcgcc

SEQ ID NO: 1666583 - RNA, 12 nt, Salmonella enterica enterica serovar Typhi
aaggucacgccg

SEQ ID NO: 1666584 - RNA, 11 nt, Salmonella enterica enterica serovar Typhi
aaggucgauau

SEQ ID NO: 1666585 - RNA, 19 nt, Salmonella enterica enterica serovar Typhi
aaggcgaacuccagcgcga

SEQ ID NO: 1666586 - RNA, 20 nt, Salmonella enterica enterica serovar Typhi
aaggcguuugcgccgccauc

SEQ ID NO: 1666587 - RNA, 20 nt, Salmonella enterica enterica serovar Typhi
aaggcuaccgguugcguagc

SEQ ID NO: 1666588 - RNA, 16 nt, Salmonella enterica enterica serovar Typhi
aaggcaacgccgccag

SEQ ID NO: 1666589 - RNA, 20 nt, Salmonella enterica enterica serovar Typhi
aagcguagcgccaucaggca

SEQ ID NO: 1666590 - RNA, 19 nt, Salmonella enterica enterica serovar Typhi
aaggcauuucgccgccauc

SEQ ID NO: 1666591 - RNA, 16 nt, Salmonella enterica enterica serovar Typhi
aaggcauucaggccgg

SEQ ID NO: 1666592 - RNA, 19 nt, Salmonella enterica enterica serovar Typhi
aaggcaucgucggcgauug

SEQ ID NO: 1666593 - RNA, 14 nt, Salmonella enterica enterica serovar Typhi
aaggcaucugcgca

SEQ ID NO: 1666594 - RNA, 20 nt, Salmonella enterica enterica serovar Typhi
aagcggcgucacguucgucg

SEQ ID NO: 1666595 - RNA, 15 nt, Salmonella enterica enterica serovar Typhi
aagcgguuaucggca

SEQ ID NO: 1666596 - RNA, 16 nt, Salmonella enterica enterica serovar Typhi
aagcguaacagcgcua

SEQ ID NO: 1666597 - RNA, 16 nt, Salmonella enterica enterica serovar Typhi
aagcguagccgcgcca

SEQ ID NO: 1666598 - RNA, 19 nt, Salmonella enterica enterica serovar Typhi
aagcguagcgcauccggca

SEQ ID NO: 1666599 - RNA, 13 nt, Salmonella enterica enterica serovar Typhi
aagcguagcgcca

SEQ ID NO: 1666600 - RNA, 21 nt, Salmonella enterica enterica serovar Typhi
aagcgguaguuaagcgucagc

SEQ ID NO: 1666601 - RNA, 13 nt, Salmonella enterica enterica serovar Typhi
aagcgcagcguca

SEQ ID NO: 1666602 - RNA, 15 nt, Salmonella enterica enterica serovar Typhi
aagcgccaucaggca

SEQ ID NO: 1666603 - RNA, 20 nt, Salmonella enterica enterica serovar Typhi
aagccguuuuggcagcgccc

SEQ ID NO: 1666604 - RNA, 21 nt, Salmonella enterica enterica serovar Typhi
aagcgauauucaacagcccga

SEQ ID NO: 1666605 - RNA, 13 nt, Salmonella enterica enterica serovar Typhi
aagcgauccggca

SEQ ID NO: 1666606 - RNA, 20 nt, Salmonella enterica enterica serovar Typhi
aagcgauuuauccaccgcca

SEQ ID NO: 1666607 - RNA, 14 nt, Salmonella enterica enterica serovar Typhi
aagcgcaguguuaa

SEQ ID NO: 1666608 - RNA, 15 nt, Salmonella enterica enterica serovar Typhi
aagccgacccgcauc

SEQ ID NO: 1666609 - RNA, 19 nt, Salmonella enterica enterica serovar Typhi
aagccgccauccggcauuu

SEQ ID NO: 1666610 - RNA, 19 nt, Salmonella enterica enterica serovar Typhi
aagccggcaggcagcgcca

SEQ ID NO: 1666611 - RNA, 17 nt, Salmonella enterica enterica serovar Typhi
aagccagacgcgcagca

SEQ ID NO: 1666612 - RNA, 16 nt, Salmonella enterica enterica serovar Typhi
aagagacacgcugacc

SEQ ID NO: 1666613 - RNA, 23 nt, Salmonella enterica enterica serovar Typhi
aagagagccuuacaggcgcauca

SEQ ID NO: 1666614 - RNA, 16 nt, Salmonella enterica enterica serovar Typhi
aagacugcuccggcaa

SEQ ID NO: 1666615 - RNA, 21 nt, Salmonella enterica enterica serovar Typhi
aagacgcuacgcgucgccauc

SEQ ID NO: 1666616 - RNA, 20 nt, Salmonella enterica enterica serovar Typhi
aagacgcuuacaucgccauc

SEQ ID NO: 1666617 - RNA, 14 nt, Salmonella enterica enterica serovar Typhi
aaguucagccgaua

SEQ ID NO: 1666618 - RNA, 16 nt, Salmonella enterica enterica serovar Typhi
aaguuauccagcgccc

SEQ ID NO: 1666619 - RNA, 19 nt, Salmonella enterica enterica serovar Typhi
aaguucucguucaacggca

SEQ ID NO: 1666620 - RNA, 23 nt, Salmonella enterica enterica serovar Typhi
aauaauugcgguggcgcaaaucg

SEQ ID NO: 1666621 - RNA, 20 nt, Salmonella enterica enterica serovar Typhi
aauaacgaacugauggcgcu

SEQ ID NO: 1666622 - RNA, 12 nt, Salmonella enterica enterica serovar Typhi
aauacguaaacc

SEQ ID NO: 1666623 - RNA, 18 nt, Salmonella enterica enterica serovar Typhi
aauacgcuccagcuggcu

SEQ ID NO: 1666624 - RNA, 20 nt, Salmonella enterica enterica serovar Typhi
aauacgcuccagcuggcugg

SEQ ID NO: 1666625 - RNA, 12 nt, Salmonella enterica enterica serovar Typhi
aauacgcggcac

SEQ ID NO: 1666626 - RNA, 21 nt, Salmonella enterica enterica serovar Typhi
aauacugcaacggcgaggugc

SEQ ID NO: 1666627 - RNA, 15 nt, Salmonella enterica enterica serovar Typhi
aauacucuucacgca

SEQ ID NO: 1666628 - RNA, 13 nt, Salmonella enterica enterica serovar Typhi
aauacuuccugcu

SEQ ID NO: 1666629 - RNA, 16 nt, Salmonella enterica enterica serovar Typhi
aauaucggcgucaacg

SEQ ID NO: 1666630 - RNA, 12 nt, Salmonella enterica enterica serovar Typhi
aauauccugcgg

SEQ ID NO: 1666631 - RNA, 18 nt, Salmonella enterica enterica serovar Typhi
aaucaacgccgccaggau

SEQ ID NO: 1666632 - RNA, 13 nt, Salmonella enterica enterica serovar Typhi
aaucaaccauaca

SEQ ID NO: 1666633 - RNA, 21 nt, Salmonella enterica enterica serovar Typhi
aaucaagccuaucaccgcgau

SEQ ID NO: 1666634 - RNA, 16 nt, Salmonella enterica enterica serovar Typhi
aaucaaaaacaucgcu

SEQ ID NO: 1666635 - RNA, 12 nt, Salmonella enterica enterica serovar Typhi
aauauucgcgcc

SEQ ID NO: 1666636 - RNA, 19 nt, Salmonella enterica enterica serovar Typhi
aauauucgcuucuucggca

SEQ ID NO: 1666637 - RNA, 15 nt, Salmonella enterica enterica serovar Typhi
aauauuuaacacauu

SEQ ID NO: 1666638 - RNA, 16 nt, Salmonella enterica enterica serovar Typhi
aauaugcgucagcgcg

SEQ ID NO: 1666639 - RNA, 17 nt, Salmonella enterica enterica serovar Typhi
aauaugcggcgccauca

SEQ ID NO: 1666640 - RNA, 15 nt, Salmonella enterica enterica serovar Typhi
aacacggacucgccu

SEQ ID NO: 1666641 - RNA, 20 nt, Salmonella enterica enterica serovar Typhi
aacacguuaucugaccuaca

SEQ ID NO: 1666642 - RNA, 20 nt, Salmonella enterica enterica serovar Typhi
aacaccuuauccggccuaca

SEQ ID NO: 1666643 - RNA, 20 nt, Salmonella enterica enterica serovar Typhi
aacacuaccgggcagcaucu

SEQ ID NO: 1666644 - RNA, 19 nt, Salmonella enterica enterica serovar Typhi
aaccgcuuuuccugcugcc

SEQ ID NO: 1666645 - RNA, 13 nt, Salmonella enterica enterica serovar Typhi
aaccuaucaggcg

SEQ ID NO: 1666646 - RNA, 21 nt, Salmonella enterica enterica serovar Typhi
aaccguuuuaccuucugccgc

SEQ ID NO: 1666647 - RNA, 16 nt, Salmonella enterica enterica serovar Typhi
aaccugguauuacaac

SEQ ID NO: 1666648 - RNA, 23 nt, Salmonella enterica enterica serovar Typhi
aaccggucucuuaaugccagcgg

SEQ ID NO: 1666649 - RNA, 17 nt, Salmonella enterica enterica serovar Typhi
aaccgucuggcugccau

SEQ ID NO: 1666650 - RNA, 13 nt, Salmonella enterica enterica serovar Typhi
aaccgucggcaau

SEQ ID NO: 1666651 - RNA, 17 nt, Salmonella enterica enterica serovar Typhi
aaccguggccuccggca

SEQ ID NO: 1666652 - RNA, 17 nt, Salmonella enterica enterica serovar Typhi
aacgcguacggcuucaa

SEQ ID NO: 1666653 - RNA, 17 nt, Salmonella enterica enterica serovar Typhi
aacgcgcucgccagcgc

SEQ ID NO: 1666654 - RNA, 20 nt, Salmonella enterica enterica serovar Typhi
aacgccugcuccguccacgc

SEQ ID NO: 1666655 - RNA, 18 nt, Salmonella enterica enterica serovar Typhi
aacgcuguaccggcaggu

SEQ ID NO: 1666656 - RNA, 17 nt, Salmonella enterica enterica serovar Typhi
aacgcugcgccgcgcca

SEQ ID NO: 1666657 - RNA, 14 nt, Salmonella enterica enterica serovar Typhi
aacgcugcgcaaca

SEQ ID NO: 1666658 - RNA, 15 nt, Salmonella enterica enterica serovar Typhi
aacgcucgcgcauga

SEQ ID NO: 1666659 - RNA, 21 nt, Salmonella enterica enterica serovar Typhi
aacgcucaguacgcugccauc

SEQ ID NO: 1666660 - RNA, 22 nt, Salmonella enterica enterica serovar Typhi
aacgcguuaaucacuaccugca

SEQ ID NO: 1666661 - RNA, 15 nt, Salmonella enterica enterica serovar Typhi
aacgccagugccugg

SEQ ID NO: 1666662 - RNA, 20 nt, Salmonella enterica enterica serovar Typhi
aacgccgaccacuucaacgc

SEQ ID NO: 1666663 - RNA, 14 nt, Salmonella enterica enterica serovar Typhi
aacgccgugaacgc

SEQ ID NO: 1666664 - RNA, 16 nt, Salmonella enterica enterica serovar Typhi
aacgccguuaccagca

SEQ ID NO: 1666665 - RNA, 22 nt, Salmonella enterica enterica serovar Typhi
aaccuguuaugaaacccgccac

SEQ ID NO: 1666666 - RNA, 22 nt, Salmonella enterica enterica serovar Typhi
aacgacgacgcagcuucgccgc

SEQ ID NO: 1666667 - RNA, 13 nt, Salmonella enterica enterica serovar Typhi
aacggcgagcuuu

SEQ ID NO: 1666668 - RNA, 12 nt, Salmonella enterica enterica serovar Typhi
aacggccagcgc

SEQ ID NO: 1666669 - RNA, 13 nt, Salmonella enterica enterica serovar Typhi
aacggcgccagcu

SEQ ID NO: 1666670 - RNA, 23 nt, Salmonella enterica enterica serovar Typhi
aacucuggaucaguuccggauua

SEQ ID NO: 1666671 - RNA, 21 nt, Salmonella enterica enterica serovar Typhi
aacugaccgauacgaucgucu

SEQ ID NO: 1666672 - RNA, 16 nt, Salmonella enterica enterica serovar Typhi
aacucgccaugccauc

SEQ ID NO: 1666673 - RNA, 14 nt, Salmonella enterica enterica serovar Typhi
aacugccgcugacc

SEQ ID NO: 1666674 - RNA, 23 nt, Salmonella enterica enterica serovar Typhi
aacugcaccuuuuuuuccagcgu

SEQ ID NO: 1666675 - RNA, 22 nt, Salmonella enterica enterica serovar Typhi
aacuguuuuaccaaaucaauag

SEQ ID NO: 1666676 - RNA, 24 nt, Salmonella enterica enterica serovar Typhi
aacuucacauuuuuaucagcuauu

SEQ ID NO: 1666677 - RNA, 14 nt, Salmonella enterica enterica serovar Typhi
aacuguucagcggu

SEQ ID NO: 1666678 - RNA, 17 nt, Salmonella enterica enterica serovar Typhi
aacuuaaacgccggauu

SEQ ID NO: 1666679 - RNA, 18 nt, Salmonella enterica enterica serovar Typhi
aacugggugugaucgccg

SEQ ID NO: 1666680 - RNA, 23 nt, Salmonella enterica enterica serovar Typhi
aagaaggguauagagcaggucaa

SEQ ID NO: 1666681 - RNA, 13 nt, Salmonella enterica enterica serovar Typhi
aagaauacccuuu

SEQ ID NO: 1666682 - RNA, 12 nt, Salmonella enterica enterica serovar Typhi
aagacagcaggc

SEQ ID NO: 1666683 - RNA, 23 nt, Salmonella enterica enterica serovar Typhi
aagacagguuuacguagcagcgc

SEQ ID NO: 1666684 - RNA, 14 nt, Salmonella enterica enterica serovar Typhi
aagaacagcgucgc

SEQ ID NO: 1666685 - RNA, 17 nt, Salmonella enterica enterica serovar Typhi
aacuuuuucuuaagcug

SEQ ID NO: 1666686 - RNA, 22 nt, Salmonella enterica enterica serovar Typhi
aagaaacgccgcgcaaagcaau

SEQ ID NO: 1666687 - RNA, 19 nt, Salmonella enterica enterica serovar Typhi
aacuuugcgccauuucaau

SEQ ID NO: 1666688 - RNA, 22 nt, Salmonella enterica enterica serovar Typhi
aaacaagccgccaacgccagca

SEQ ID NO: 1666689 - RNA, 22 nt, Salmonella enterica enterica serovar Typhi
acgacgcgguacccaccucuga

SEQ ID NO: 1666690 - RNA, 19 nt, Salmonella enterica enterica serovar Typhi
acgacgcugccacaauggc

SEQ ID NO: 1666691 - RNA, 15 nt, Salmonella enterica enterica serovar Typhi
acgacgggaaaaagc

SEQ ID NO: 1666692 - RNA, 14 nt, Salmonella enterica enterica serovar Typhi
acgacugaguauug

SEQ ID NO: 1666693 - RNA, 12 nt, Salmonella enterica enterica serovar Typhi
aaacacagccau

SEQ ID NO: 1666694 - RNA, 17 nt, Salmonella enterica enterica serovar Typhi
acgaucccuucaauauc

SEQ ID NO: 1666695 - RNA, 12 nt, Salmonella enterica enterica serovar Typhi
acgauacgucau

SEQ ID NO: 1666696 - RNA, 21 nt, Salmonella enterica enterica serovar Typhi
acgauaauguuuuacgauggu

SEQ ID NO: 1666697 - RNA, 22 nt, Salmonella enterica enterica serovar Typhi
acgauaauaucgucaccaggau

SEQ ID NO: 1666698 - RNA, 13 nt, Salmonella enterica enterica serovar Typhi
acgaucgcgcaca

SEQ ID NO: 1666699 - RNA, 18 nt, Salmonella enterica enterica serovar Typhi
acgaucgccuaauccgcc

SEQ ID NO: 1666700 - RNA, 19 nt, Salmonella enterica enterica serovar Typhi
acgauguaaaaccuggcac

SEQ ID NO: 1666701 - RNA, 20 nt, Salmonella enterica enterica serovar Typhi
acgaucgguuaucacgguau

SEQ ID NO: 1666702 - RNA, 20 nt, Salmonella enterica enterica serovar Typhi
acgaugugcauaaccgcgcc

SEQ ID NO: 1666703 - RNA, 14 nt, Salmonella enterica enterica serovar Typhi
acgaugucaucgcc

SEQ ID NO: 1666704 - RNA, 14 nt, Salmonella enterica enterica serovar Typhi
acgcaaugccugac

SEQ ID NO: 1666705 - RNA, 22 nt, Salmonella enterica enterica serovar Typhi
acgcaacaggccgcaucgggaa

SEQ ID NO: 1666706 - RNA, 19 nt, Salmonella enterica enterica serovar Typhi
acgcaaaccgcuuucauca

SEQ ID NO: 1666707 - RNA, 13 nt, Salmonella enterica enterica serovar Typhi
acgcaaaucaccg

SEQ ID NO: 1666708 - RNA, 17 nt, Salmonella enterica enterica serovar Typhi
acgaaucaggauauucg

SEQ ID NO: 1666709 - RNA, 17 nt, Salmonella enterica enterica serovar Typhi
acgaauaagaaucagau

SEQ ID NO: 1666710 - RNA, 11 nt, Salmonella enterica enterica serovar Typhi
acgaaggucag

SEQ ID NO: 1666711 - RNA, 12 nt, Salmonella enterica enterica serovar Typhi
acgaagcgcaaa

SEQ ID NO: 1666712 - RNA, 21 nt, Salmonella enterica enterica serovar Typhi
acgacacccgauacacgccga

SEQ ID NO: 1666713 - RNA, 23 nt, Salmonella enterica enterica serovar Typhi
acgacgaggggcuuugugccgca

SEQ ID NO: 1666714 - RNA, 19 nt, Salmonella enterica enterica serovar Typhi
accuuugggcagauaucgg

SEQ ID NO: 1666715 - RNA, 22 nt, Salmonella enterica enterica serovar Typhi
acgaaaccggcggcgacuggcu

SEQ ID NO: 1666716 - RNA, 14 nt, Salmonella enterica enterica serovar Typhi
acgaaacgcaucgu

SEQ ID NO: 1666717 - RNA, 13 nt, Salmonella enterica enterica serovar Typhi
acgaaacucagcg

SEQ ID NO: 1666718 - RNA, 13 nt, Salmonella enterica enterica serovar Typhi
acgaacacggcgu

SEQ ID NO: 1666719 - RNA, 17 nt, Salmonella enterica enterica serovar Typhi
acgaagaucgucgauca

SEQ ID NO: 1666720 - RNA, 14 nt, Salmonella enterica enterica serovar Typhi
accugcaucacgcc

SEQ ID NO: 1666721 - RNA, 23 nt, Salmonella enterica enterica serovar Typhi
accugcaaaaacgccagaccgac

SEQ ID NO: 1666722 - RNA, 17 nt, Salmonella enterica enterica serovar Typhi
accugauugauacgcgc

SEQ ID NO: 1666723 - RNA, 18 nt, Salmonella enterica enterica serovar Typhi
accguuccguccgucagg

SEQ ID NO: 1666724 - RNA, 16 nt, Salmonella enterica enterica serovar Typhi
accguugcgcccauca

SEQ ID NO: 1666725 - RNA, 14 nt, Salmonella enterica enterica serovar Typhi
accucaucaaacag

SEQ ID NO: 1666726 - RNA, 17 nt, Salmonella enterica enterica serovar Typhi
accuccaaagcgcuaca

SEQ ID NO: 1666727 - RNA, 20 nt, Salmonella enterica enterica serovar Typhi
accuaucaggcguugaccgc

SEQ ID NO: 1666728 - RNA, 18 nt, Salmonella enterica enterica serovar Typhi
accucagguaaauccgcc

SEQ ID NO: 1666729 - RNA, 12 nt, Salmonella enterica enterica serovar Typhi
accucaugcgcc

SEQ ID NO: 1666730 - RNA, 21 nt, Salmonella enterica enterica serovar Typhi
accguuuuguaggccggauaa

SEQ ID NO: 1666731 - RNA, 15 nt, Salmonella enterica enterica serovar Typhi
accuacccucaacgc

SEQ ID NO: 1666732 - RNA, 22 nt, Salmonella enterica enterica serovar Typhi
accucgguauguccugccgcaa

SEQ ID NO: 1666733 - RNA, 16 nt, Salmonella enterica enterica serovar Typhi
accugacggcagccac

SEQ ID NO: 1666734 - RNA, 19 nt, Salmonella enterica enterica serovar Typhi
accugaaccagcgccgucu

SEQ ID NO: 1666735 - RNA, 14 nt, Salmonella enterica enterica serovar Typhi
accugaauauucgg

SEQ ID NO: 1666736 - RNA, 14 nt, Salmonella enterica enterica serovar Typhi
accucggcuugcuu

SEQ ID NO: 1666737 - RNA, 20 nt, Salmonella enterica enterica serovar Typhi
accucgcuucccugacgcgc

SEQ ID NO: 1666738 - RNA, 14 nt, Salmonella enterica enterica serovar Typhi
accuccuucgcgcc

SEQ ID NO: 1666739 - RNA, 23 nt, Salmonella enterica enterica serovar Typhi
accgguuuguuauugaucacggu

SEQ ID NO: 1666740 - RNA, 13 nt, Salmonella enterica enterica serovar Typhi
accguaaccgcag

SEQ ID NO: 1666741 - RNA, 15 nt, Salmonella enterica enterica serovar Typhi
accguaaucaucgcg

SEQ ID NO: 1666742 - RNA, 18 nt, Salmonella enterica enterica serovar Typhi
accguagugacacgguca

SEQ ID NO: 1666743 - RNA, 13 nt, Salmonella enterica enterica serovar Typhi
accgucaccacgc

SEQ ID NO: 1666744 - RNA, 17 nt, Salmonella enterica enterica serovar Typhi
accgucaccacgcgcga

SEQ ID NO: 1666745 - RNA, 17 nt, Salmonella enterica enterica serovar Typhi
accgucaaaacgcgcau

SEQ ID NO: 1666746 - RNA, 14 nt, Salmonella enterica enterica serovar Typhi
accguagaucgcca

SEQ ID NO: 1666747 - RNA, 13 nt, Salmonella enterica enterica serovar Typhi
accgucaucgccc

SEQ ID NO: 1666748 - RNA, 20 nt, Salmonella enterica enterica serovar Typhi
accgucagauucugcgguaa

SEQ ID NO: 1666749 - RNA, 17 nt, Salmonella enterica enterica serovar Typhi
accgucgaucucggcca

SEQ ID NO: 1666750 - RNA, 17 nt, Salmonella enterica enterica serovar Typhi
accgucggcgcaaccau

SEQ ID NO: 1666751 - RNA, 18 nt, Salmonella enterica enterica serovar Typhi
accgugauuuuuaccgcc

SEQ ID NO: 1666752 - RNA, 21 nt, Salmonella enterica enterica serovar Typhi
accgugauuuuuaccgccggu

SEQ ID NO: 1666753 - RNA, 19 nt, Salmonella enterica enterica serovar Typhi
accgugaugcggacgcuga

SEQ ID NO: 1666754 - RNA, 19 nt, Salmonella enterica enterica serovar Typhi
accggggcgcucgccugau

SEQ ID NO: 1666755 - RNA, 16 nt, Salmonella enterica enterica serovar Typhi
accggcaaccgguacu

SEQ ID NO: 1666756 - RNA, 14 nt, Salmonella enterica enterica serovar Typhi
accggcaauauccg

SEQ ID NO: 1666757 - RNA, 17 nt, Salmonella enterica enterica serovar Typhi
accgggccugaugcgcg

SEQ ID NO: 1666758 - RNA, 14 nt, Salmonella enterica enterica serovar Typhi
accggucagccggu

SEQ ID NO: 1666759 - RNA, 18 nt, Salmonella enterica enterica serovar Typhi
accgguaaucccuucacg

SEQ ID NO: 1666760 - RNA, 21 nt, Salmonella enterica enterica serovar Typhi
accgguaucgaucacgcgcag

SEQ ID NO: 1666761 - RNA, 15 nt, Salmonella enterica enterica serovar Typhi
accgcuucgcauugc

SEQ ID NO: 1666762 - RNA, 24 nt, Salmonella enterica enterica serovar Typhi
accgcuuuaucauaccagugcaga

SEQ ID NO: 1666763 - RNA, 16 nt, Salmonella enterica enterica serovar Typhi
accggauggaucaucg

SEQ ID NO: 1666764 - RNA, 18 nt, Salmonella enterica enterica serovar Typhi
accgcuuaacagcguaca

SEQ ID NO: 1666765 - RNA, 13 nt, Salmonella enterica enterica serovar Typhi
accgcugcgcuca

SEQ ID NO: 1666766 - RNA, 15 nt, Salmonella enterica enterica serovar Typhi
accgccugcgcugau

SEQ ID NO: 1666767 - RNA, 22 nt, Salmonella enterica enterica serovar Typhi
accgcgacuuggaaaguugcgc

SEQ ID NO: 1666768 - RNA, 20 nt, Salmonella enterica enterica serovar Typhi
accgcccgccgggcgucacc

SEQ ID NO: 1666769 - RNA, 14 nt, Salmonella enterica enterica serovar Typhi
accgcaucacgcga

SEQ ID NO: 1666770 - RNA, 15 nt, Salmonella enterica enterica serovar Typhi
accgcaucacgcgaa

SEQ ID NO: 1666771 - RNA, 14 nt, Salmonella enterica enterica serovar Typhi
accgcaucacggca

SEQ ID NO: 1666772 - RNA, 20 nt, Salmonella enterica enterica serovar Typhi
accgcauacccgacacggcu

SEQ ID NO: 1666773 - RNA, 22 nt, Salmonella enterica enterica serovar Typhi
accgcaucaaugcccagcgcaa

SEQ ID NO: 1666774 - RNA, 14 nt, Salmonella enterica enterica serovar Typhi
accgcagauaacag

SEQ ID NO: 1666775 - RNA, 15 nt, Salmonella enterica enterica serovar Typhi
accgcaucggcauca

SEQ ID NO: 1666776 - RNA, 11 nt, Salmonella enterica enterica serovar Typhi
accgaugcagc

SEQ ID NO: 1666777 - RNA, 15 nt, Salmonella enterica enterica serovar Typhi
acccgcuuccaguuu

SEQ ID NO: 1666778 - RNA, 20 nt, Salmonella enterica enterica serovar Typhi
acccgcuucacgaagcgggu

SEQ ID NO: 1666779 - RNA, 17 nt, Salmonella enterica enterica serovar Typhi
accgacaauauucgccg

SEQ ID NO: 1666780 - RNA, 17 nt, Salmonella enterica enterica serovar Typhi
acauaauauuccagcgu

SEQ ID NO: 1666781 - RNA, 14 nt, Salmonella enterica enterica serovar Typhi
acauaaauccggau

SEQ ID NO: 1666782 - RNA, 18 nt, Salmonella enterica enterica serovar Typhi
acaguucagacaccacgc

SEQ ID NO: 1666783 - RNA, 15 nt, Salmonella enterica enterica serovar Typhi
acaguuucauauccg

SEQ ID NO: 1666784 - RNA, 13 nt, Salmonella enterica enterica serovar Typhi
accagguaauccg

SEQ ID NO: 1666785 - RNA, 15 nt, Salmonella enterica enterica serovar Typhi
accauccggcgcugc

SEQ ID NO: 1666786 - RNA, 23 nt, Salmonella enterica enterica serovar Typhi
accaucgcaaauucaucgccgcc

SEQ ID NO: 1666787 - RNA, 15 nt, Salmonella enterica enterica serovar Typhi
accaucgcauugccg

SEQ ID NO: 1666788 - RNA, 14 nt, Salmonella enterica enterica serovar Typhi
accaucgcguugua

SEQ ID NO: 1666789 - RNA, 14 nt, Salmonella enterica enterica serovar Typhi
accaucgcgccgcu

SEQ ID NO: 1666790 - RNA, 15 nt, Salmonella enterica enterica serovar Typhi
accaucggcgcuacg

SEQ ID NO: 1666791 - RNA, 16 nt, Salmonella enterica enterica serovar Typhi
accaucuuuuccggca

SEQ ID NO: 1666792 - RNA, 15 nt, Salmonella enterica enterica serovar Typhi
accaugauaaccagc

SEQ ID NO: 1666793 - RNA, 14 nt, Salmonella enterica enterica serovar Typhi
aaaauagcccggcu

SEQ ID NO: 1666794 - RNA, 24 nt, Salmonella enterica enterica serovar Typhi
aaaauaucggccugaaugcucuca

SEQ ID NO: 1666795 - RNA, 18 nt, Salmonella enterica enterica serovar Typhi
accauacuaaugcugccc

SEQ ID NO: 1666796 - RNA, 16 nt, Salmonella enterica enterica serovar Typhi
accauacugaccaaca

SEQ ID NO: 1666797 - RNA, 14 nt, Salmonella enterica enterica serovar Typhi
accauaauuuccgg

SEQ ID NO: 1666798 - RNA, 14 nt, Salmonella enterica enterica serovar Typhi
accauaugcggcau

SEQ ID NO: 1666799 - RNA, 14 nt, Salmonella enterica enterica serovar Typhi
accauaucaaacag

SEQ ID NO: 1666800 - RNA, 23 nt, Salmonella enterica enterica serovar Typhi
accauauucccacaguuaacgcc

SEQ ID NO: 1666801 - RNA, 22 nt, Salmonella enterica enterica serovar Typhi
accauuuauuuaggugcuugag

SEQ ID NO: 1666802 - RNA, 22 nt, Salmonella enterica enterica serovar Typhi
accauucugggaggugaaggau

SEQ ID NO: 1666803 - RNA, 22 nt, Salmonella enterica enterica serovar Typhi
accauucuucaacaaucguuaa

SEQ ID NO: 1666804 - RNA, 13 nt, Salmonella enterica enterica serovar Typhi
acccaucaauaac

SEQ ID NO: 1666805 - RNA, 15 nt, Salmonella enterica enterica serovar Typhi
acccgcaaugugcag

SEQ ID NO: 1666806 - RNA, 19 nt, Salmonella enterica enterica serovar Typhi
acccgcaaacuaauggcgc

SEQ ID NO: 1666807 - RNA, 12 nt, Salmonella enterica enterica serovar Typhi
acccgaugcgag

SEQ ID NO: 1666808 - RNA, 20 nt, Salmonella enterica enterica serovar Typhi
acccgauagcgccgcgcuau

SEQ ID NO: 1666809 - RNA, 21 nt, Salmonella enterica enterica serovar Typhi
acgguacuauuaccgcaucga

SEQ ID NO: 1666810 - RNA, 15 nt, Salmonella enterica enterica serovar Typhi
acggucagcggcgga

SEQ ID NO: 1666811 - RNA, 21 nt, Salmonella enterica enterica serovar Typhi
acgguaagcguucgcauacgc

SEQ ID NO: 1666812 - RNA, 16 nt, Salmonella enterica enterica serovar Typhi
acgguaauugacgcgu

SEQ ID NO: 1666813 - RNA, 15 nt, Salmonella enterica enterica serovar Typhi
acggguuaauggcag

SEQ ID NO: 1666814 - RNA, 23 nt, Salmonella enterica enterica serovar Typhi
acggucggcguaauguugcugca

SEQ ID NO: 1666815 - RNA, 22 nt, Salmonella enterica enterica serovar Typhi
acggucgauuucgcgauaauag

SEQ ID NO: 1666816 - RNA, 23 nt, Salmonella enterica enterica serovar Typhi
acggugguaaaucagaauaccgc

SEQ ID NO: 1666817 - RNA, 13 nt, Salmonella enterica enterica serovar Typhi
acgguugaagcga

SEQ ID NO: 1666818 - RNA, 17 nt, Salmonella enterica enterica serovar Typhi
acggugugccgccauca

SEQ ID NO: 1666819 - RNA, 12 nt, Salmonella enterica enterica serovar Typhi
acggcguagcga

SEQ ID NO: 1666820 - RNA, 19 nt, Salmonella enterica enterica serovar Typhi
acggcgucaccaccgcagg

SEQ ID NO: 1666821 - RNA, 15 nt, Salmonella enterica enterica serovar Typhi
acggcggccagcauu

SEQ ID NO: 1666822 - RNA, 22 nt, Salmonella enterica enterica serovar Typhi
acuaccugcacuuuaagcggca

SEQ ID NO: 1666823 - RNA, 21 nt, Salmonella enterica enterica serovar Typhi
acuacccaucacgcccuguaa

SEQ ID NO: 1666824 - RNA, 22 nt, Salmonella enterica enterica serovar Typhi
acuaccagcucgcgcaguucca

SEQ ID NO: 1666825 - RNA, 18 nt, Salmonella enterica enterica serovar Typhi
acuaccaucggcgcuacg

SEQ ID NO: 1666826 - RNA, 17 nt, Salmonella enterica enterica serovar Typhi
acuaccgcaaugggggc

SEQ ID NO: 1666827 - RNA, 21 nt, Salmonella enterica enterica serovar Typhi
acguuaaagccgaccaucgcg

SEQ ID NO: 1666828 - RNA, 14 nt, Salmonella enterica enterica serovar Typhi
acguuaggcgcaaa

SEQ ID NO: 1666829 - RNA, 22 nt, Salmonella enterica enterica serovar Typhi
acguucagguuuuuuucaucgc

SEQ ID NO: 1666830 - RNA, 16 nt, Salmonella enterica enterica serovar Typhi
acguuauuggcaggau

SEQ ID NO: 1666831 - RNA, 15 nt, Salmonella enterica enterica serovar Typhi
acguuucgcuaucgc

SEQ ID NO: 1666832 - RNA, 22 nt, Salmonella enterica enterica serovar Typhi
acguuuauucuuuucaggucug

SEQ ID NO: 1666833 - RNA, 14 nt, Salmonella enterica enterica serovar Typhi
acuaaaacaccggu

SEQ ID NO: 1666834 - RNA, 19 nt, Salmonella enterica enterica serovar Typhi
acguuuuuccauucacaca

SEQ ID NO: 1666835 - RNA, 19 nt, Salmonella enterica enterica serovar Typhi
acgugauaaccaacaggag

SEQ ID NO: 1666836 - RNA, 23 nt, Salmonella enterica enterica serovar Typhi
acgucguuguccggcugaagcgg

SEQ ID NO: 1666837 - RNA, 14 nt, Salmonella enterica enterica serovar Typhi
acguggcuucgccg

SEQ ID NO: 1666838 - RNA, 20 nt, Salmonella enterica enterica serovar Typhi
acguaggccugauaagcgca

SEQ ID NO: 1666839 - RNA, 14 nt, Salmonella enterica enterica serovar Typhi
acguagcgcauugc

SEQ ID NO: 1666840 - RNA, 23 nt, Salmonella enterica enterica serovar Typhi
acgcucacuuuucuuuccugcaa

SEQ ID NO: 1666841 - RNA, 13 nt, Salmonella enterica enterica serovar Typhi
acgcugauagcca

SEQ ID NO: 1666842 - RNA, 13 nt, Salmonella enterica enterica serovar Typhi
acgcggcgugcgc

SEQ ID NO: 1666843 - RNA, 13 nt, Salmonella enterica enterica serovar Typhi
acgcgcuggcgga

SEQ ID NO: 1666844 - RNA, 21 nt, Salmonella enterica enterica serovar Typhi
acgcgcuuuuuucguaauuaa

SEQ ID NO: 1666845 - RNA, 15 nt, Salmonella enterica enterica serovar Typhi
acgcgcuccagcaac

SEQ ID NO: 1666846 - RNA, 14 nt, Salmonella enterica enterica serovar Typhi
acgcggcguaccgc

SEQ ID NO: 1666847 - RNA, 19 nt, Salmonella enterica enterica serovar Typhi
acgcggacgccaccacagu

SEQ ID NO: 1666848 - RNA, 20 nt, Salmonella enterica enterica serovar Typhi
aaacagcggcacuucgauaa

SEQ ID NO: 1666849 - RNA, 16 nt, Salmonella enterica enterica serovar Typhi
aaacauaagcaaaucc

SEQ ID NO: 1666850 - RNA, 17 nt, Salmonella enterica enterica serovar Typhi
acgcagaucguauccag

SEQ ID NO: 1666851 - RNA, 16 nt, Salmonella enterica enterica serovar Typhi
acgcgaccagacacgg

SEQ ID NO: 1666852 - RNA, 16 nt, Salmonella enterica enterica serovar Typhi
acggaccggcaaucgc

SEQ ID NO: 1666853 - RNA, 22 nt, Salmonella enterica enterica serovar Typhi
acggagaugaucguuuccagca

SEQ ID NO: 1666854 - RNA, 15 nt, Salmonella enterica enterica serovar Typhi
acggaaggaaauaac

SEQ ID NO: 1666855 - RNA, 14 nt, Salmonella enterica enterica serovar Typhi
acggaaauagcgcc

SEQ ID NO: 1666856 - RNA, 16 nt, Salmonella enterica enterica serovar Typhi
acgcuugcccgguucg

SEQ ID NO: 1666857 - RNA, 20 nt, Salmonella enterica enterica serovar Typhi
acgcuuuacgcuuaucccag

SEQ ID NO: 1666858 - RNA, 14 nt, Salmonella enterica enterica serovar Typhi
acggaaaccagaua

SEQ ID NO: 1666859 - RNA, 20 nt, Salmonella enterica enterica serovar Typhi
acgcuuuucagcgccagaua

SEQ ID NO: 1666860 - RNA, 23 nt, Salmonella enterica enterica serovar Typhi
acgcuuauucggucugacggccu

SEQ ID NO: 1666861 - RNA, 19 nt, Salmonella enterica enterica serovar Typhi
acgcuuaugcugccuacaa

SEQ ID NO: 1666862 - RNA, 18 nt, Salmonella enterica enterica serovar Typhi
acgcuucacgucagcgac

SEQ ID NO: 1666863 - RNA, 21 nt, Salmonella enterica enterica serovar Typhi
acgcugcgcguucugcuccag

SEQ ID NO: 1666864 - RNA, 22 nt, Salmonella enterica enterica serovar Typhi
acgcugcauauaacuuucaaua

SEQ ID NO: 1666865 - RNA, 14 nt, Salmonella enterica enterica serovar Typhi
acgcugcaucguuu

SEQ ID NO: 1666866 - RNA, 20 nt, Salmonella enterica enterica serovar Typhi
acgcuguagcuggcugccgu

SEQ ID NO: 1666867 - RNA, 14 nt, Salmonella enterica enterica serovar Typhi
acgcuguucgcaac

SEQ ID NO: 1666868 - RNA, 20 nt, Salmonella enterica enterica serovar Typhi
acgcuuacccggccuacauu

SEQ ID NO: 1666869 - RNA, 23 nt, Salmonella enterica enterica serovar Typhi
acgcuuaucaggccuacauccgg

SEQ ID NO: 1666870 - RNA, 19 nt, Salmonella enterica enterica serovar Typhi
acgcuuaucgggccuacga

SEQ ID NO: 1666871 - RNA, 19 nt, Salmonella enterica enterica serovar Typhi
acgcuuaucaggccuacaa

SEQ ID NO: 1666872 - RNA, 20 nt, Salmonella enterica enterica serovar Typhi
acgcuuaucaggccuacaac

SEQ ID NO: 1666873 - RNA, 20 nt, Salmonella enterica enterica serovar Typhi
acgcuuaucaggccuacauc

SEQ ID NO: 1666874 - RNA, 12 nt, Salmonella enterica enterica serovar Typhi
acggcauauucc

SEQ ID NO: 1666875 - RNA, 21 nt, Salmonella enterica enterica serovar Typhi
acggcaguacacgcaucgggu

SEQ ID NO: 1666876 - RNA, 15 nt, Salmonella enterica enterica serovar Typhi
acggccaauccugca

SEQ ID NO: 1666877 - RNA, 16 nt, Salmonella enterica enterica serovar Typhi
acggccaccaggccug

SEQ ID NO: 1666878 - RNA, 18 nt, Salmonella enterica enterica serovar Typhi
acggccacgcgcgucagg

SEQ ID NO: 1666879 - RNA, 22 nt, Salmonella enterica enterica serovar Typhi
acggcaacugaaaacaggccug

SEQ ID NO: 1666880 - RNA, 17 nt, Salmonella enterica enterica serovar Typhi
acggcaaacgcuggugc

SEQ ID NO: 1666881 - RNA, 15 nt, Salmonella enterica enterica serovar Typhi
acggaugcgccaucc

SEQ ID NO: 1666882 - RNA, 12 nt, Salmonella enterica enterica serovar Typhi
acggauaagcca

SEQ ID NO: 1666883 - RNA, 18 nt, Salmonella enterica enterica serovar Typhi
acggauacguucgcgggu

SEQ ID NO: 1666884 - RNA, 19 nt, Salmonella enterica enterica serovar Typhi
acggauacgcugcgucagg

SEQ ID NO: 1666885 - RNA, 16 nt, Salmonella enterica enterica serovar Typhi
agacgcccgcaaaagc

SEQ ID NO: 1666886 - RNA, 16 nt, Salmonella enterica enterica serovar Typhi
agaccggcacaaccgu

SEQ ID NO: 1666887 - RNA, 19 nt, Salmonella enterica enterica serovar Typhi
agaccggcagccugccgca

SEQ ID NO: 1666888 - RNA, 18 nt, Salmonella enterica enterica serovar Typhi
agaccggcaucucaucuu

SEQ ID NO: 1666889 - RNA, 18 nt, Salmonella enterica enterica serovar Typhi
agacacuggaaacagcca

SEQ ID NO: 1666890 - RNA, 13 nt, Salmonella enterica enterica serovar Typhi
agacaacauccca

SEQ ID NO: 1666891 - RNA, 21 nt, Salmonella enterica enterica serovar Typhi
agacauuccauuggccagaua

SEQ ID NO: 1666892 - RNA, 19 nt, Salmonella enterica enterica serovar Typhi
agacauucgcgcacggcgc

SEQ ID NO: 1666893 - RNA, 12 nt, Salmonella enterica enterica serovar Typhi
agacacuuuccg

SEQ ID NO: 1666894 - RNA, 23 nt, Salmonella enterica enterica serovar Typhi
agaccacgaaucaggauauucgc

SEQ ID NO: 1666895 - RNA, 12 nt, Salmonella enterica enterica serovar Typhi
agaccacuauag

SEQ ID NO: 1666896 - RNA, 23 nt, Salmonella enterica enterica serovar Typhi
agaccacgccaucaacagcggag

SEQ ID NO: 1666897 - RNA, 16 nt, Salmonella enterica enterica serovar Typhi
agaccauccaugaaau

SEQ ID NO: 1666898 - RNA, 11 nt, Salmonella enterica enterica serovar Typhi
agacccggcau

SEQ ID NO: 1666899 - RNA, 13 nt, Salmonella enterica enterica serovar Typhi
agacccggcauug

SEQ ID NO: 1666900 - RNA, 14 nt, Salmonella enterica enterica serovar Typhi
agacuaaaaagcgc

SEQ ID NO: 1666901 - RNA, 15 nt, Salmonella enterica enterica serovar Typhi
agacguugaacggcg

SEQ ID NO: 1666902 - RNA, 18 nt, Salmonella enterica enterica serovar Typhi
agacgguuucagugauaa

SEQ ID NO: 1666903 - RNA, 23 nt, Salmonella enterica enterica serovar Typhi
agacggugaaucagauaacugag

SEQ ID NO: 1666904 - RNA, 22 nt, Salmonella enterica enterica serovar Typhi
agacggcggcuuaccgaaucuu

SEQ ID NO: 1666905 - RNA, 13 nt, Salmonella enterica enterica serovar Typhi
agagcguauccag

SEQ ID NO: 1666906 - RNA, 18 nt, Salmonella enterica enterica serovar Typhi
agagccggaaccuguccu

SEQ ID NO: 1666907 - RNA, 16 nt, Salmonella enterica enterica serovar Typhi
agagcauaugcgcugc

SEQ ID NO: 1666908 - RNA, 15 nt, Salmonella enterica enterica serovar Typhi
agagcaucgcggcau

SEQ ID NO: 1666909 - RNA, 20 nt, Salmonella enterica enterica serovar Typhi
agagcaacgccaucagcaaa

SEQ ID NO: 1666910 - RNA, 19 nt, Salmonella enterica enterica serovar Typhi
agagauauaccagccguug

SEQ ID NO: 1666911 - RNA, 15 nt, Salmonella enterica enterica serovar Typhi
agagaucgaccggau

SEQ ID NO: 1666912 - RNA, 15 nt, Salmonella enterica enterica serovar Typhi
agagaauggccagca

SEQ ID NO: 1666913 - RNA, 18 nt, Salmonella enterica enterica serovar Typhi
agagaauuuuuagcgugc

SEQ ID NO: 1666914 - RNA, 17 nt, Salmonella enterica enterica serovar Typhi
agagaagucugagcgca

SEQ ID NO: 1666915 - RNA, 21 nt, Salmonella enterica enterica serovar Typhi
agagaaccugaacaauaaucg

SEQ ID NO: 1666916 - RNA, 21 nt, Salmonella enterica enterica serovar Typhi
agacuguaaaucugccgucau

SEQ ID NO: 1666917 - RNA, 12 nt, Salmonella enterica enterica serovar Typhi
agacuucaacgc

SEQ ID NO: 1666918 - RNA, 16 nt, Salmonella enterica enterica serovar Typhi
agacuggcggugcggu

SEQ ID NO: 1666919 - RNA, 16 nt, Salmonella enterica enterica serovar Typhi
agaugccggagcgaug

SEQ ID NO: 1666920 - RNA, 22 nt, Salmonella enterica enterica serovar Typhi
agaugcggcgccaacgcgcuac

SEQ ID NO: 1666921 - RNA, 23 nt, Salmonella enterica enterica serovar Typhi
agaugcggcgccaacgcgcuacc

SEQ ID NO: 1666922 - RNA, 17 nt, Salmonella enterica enterica serovar Typhi
agaugaucguuuccagc

SEQ ID NO: 1666923 - RNA, 22 nt, Salmonella enterica enterica serovar Typhi
agaugacaaagccggauaucgc

SEQ ID NO: 1666924 - RNA, 13 nt, Salmonella enterica enterica serovar Typhi
agauguugccgua

SEQ ID NO: 1666925 - RNA, 19 nt, Salmonella enterica enterica serovar Typhi
agauccggacugauaguca

SEQ ID NO: 1666926 - RNA, 16 nt, Salmonella enterica enterica serovar Typhi
agauccuuaacgucaa

SEQ ID NO: 1666927 - RNA, 23 nt, Salmonella enterica enterica serovar Typhi
agaucguaagaauaaucauccgc

SEQ ID NO: 1666928 - RNA, 16 nt, Salmonella enterica enterica serovar Typhi
agaucgugcauccgga

SEQ ID NO: 1666929 - RNA, 18 nt, Salmonella enterica enterica serovar Typhi
agaucguuauccagcagc

SEQ ID NO: 1666930 - RNA, 18 nt, Salmonella enterica enterica serovar Typhi
agaucuucacgcgucagg

SEQ ID NO: 1666931 - RNA, 21 nt, Salmonella enterica enterica serovar Typhi
agauaaaacugcugacaauca

SEQ ID NO: 1666932 - RNA, 15 nt, Salmonella enterica enterica serovar Typhi
agauaaccgggaaua

SEQ ID NO: 1666933 - RNA, 16 nt, Salmonella enterica enterica serovar Typhi
agauaacgcgcauaau

SEQ ID NO: 1666934 - RNA, 12 nt, Salmonella enterica enterica serovar Typhi
agauaacgcuau

SEQ ID NO: 1666935 - RNA, 19 nt, Salmonella enterica enterica serovar Typhi
agaggucagaauaacucag

SEQ ID NO: 1666936 - RNA, 15 nt, Salmonella enterica enterica serovar Typhi
agagcguauccagca

SEQ ID NO: 1666937 - RNA, 20 nt, Salmonella enterica enterica serovar Typhi
agaucauuaccugucgccca

SEQ ID NO: 1666938 - RNA, 17 nt, Salmonella enterica enterica serovar Typhi
agaucccagggcggcgu

SEQ ID NO: 1666939 - RNA, 22 nt, Salmonella enterica enterica serovar Typhi
agauauuccagcgacaucgcau

SEQ ID NO: 1666940 - RNA, 20 nt, Salmonella enterica enterica serovar Typhi
agauaauccagcgucgccag

SEQ ID NO: 1666941 - RNA, 17 nt, Salmonella enterica enterica serovar Typhi
agauaauccagcgucgc

SEQ ID NO: 1666942 - RNA, 18 nt, Salmonella enterica enterica serovar Typhi
agauauucacuauaugcc

SEQ ID NO: 1666943 - RNA, 20 nt, Salmonella enterica enterica serovar Typhi
agauagcugcuuaccauacu

SEQ ID NO: 1666944 - RNA, 18 nt, Salmonella enterica enterica serovar Typhi
acuuuuacccuucagaua

SEQ ID NO: 1666945 - RNA, 23 nt, Salmonella enterica enterica serovar Typhi
acuuuugaacauaaagucagaca

SEQ ID NO: 1666946 - RNA, 12 nt, Salmonella enterica enterica serovar Typhi
agaaaagcagag

SEQ ID NO: 1666947 - RNA, 18 nt, Salmonella enterica enterica serovar Typhi
agaaaaaccuccggcuau

SEQ ID NO: 1666948 - RNA, 17 nt, Salmonella enterica enterica serovar Typhi
agaaaaacaucauggcu

SEQ ID NO: 1666949 - RNA, 22 nt, Salmonella enterica enterica serovar Typhi
acuuccagcgcgccgucaucgc

SEQ ID NO: 1666950 - RNA, 16 nt, Salmonella enterica enterica serovar Typhi
acuuccggcugcggaa

SEQ ID NO: 1666951 - RNA, 18 nt, Salmonella enterica enterica serovar Typhi
acuuccgccaccaccgau

SEQ ID NO: 1666952 - RNA, 22 nt, Salmonella enterica enterica serovar Typhi
acuuuggccuaacagucgcgcc

SEQ ID NO: 1666953 - RNA, 19 nt, Salmonella enterica enterica serovar Typhi
acuucgcaguuggugacau

SEQ ID NO: 1666954 - RNA, 17 nt, Salmonella enterica enterica serovar Typhi
acuuugaccagcaucgc

SEQ ID NO: 1666955 - RNA, 17 nt, Salmonella enterica enterica serovar Typhi
agaaaaucccgaacaug

SEQ ID NO: 1666956 - RNA, 18 nt, Salmonella enterica enterica serovar Typhi
agaaacggaaaucacgca

SEQ ID NO: 1666957 - RNA, 17 nt, Salmonella enterica enterica serovar Typhi
agaaccaacgucaucau

SEQ ID NO: 1666958 - RNA, 11 nt, Salmonella enterica enterica serovar Typhi
agaacgcucgc

SEQ ID NO: 1666959 - RNA, 14 nt, Salmonella enterica enterica serovar Typhi
agaacgcucgcgca

SEQ ID NO: 1666960 - RNA, 22 nt, Salmonella enterica enterica serovar Typhi
agaauauuggcgaggaacauca

SEQ ID NO: 1666961 - RNA, 21 nt, Salmonella enterica enterica serovar Typhi
agaauagcgccguggccgaua

SEQ ID NO: 1666962 - RNA, 14 nt, Salmonella enterica enterica serovar Typhi
agaauagccggaua

SEQ ID NO: 1666963 - RNA, 23 nt, Salmonella enterica enterica serovar Typhi
agaaugccagcgccgucauggca

SEQ ID NO: 1666964 - RNA, 14 nt, Salmonella enterica enterica serovar Typhi
agaaucgccagcau

SEQ ID NO: 1666965 - RNA, 16 nt, Salmonella enterica enterica serovar Typhi
acugauguuccggcac

SEQ ID NO: 1666966 - RNA, 23 nt, Salmonella enterica enterica serovar Typhi
acugaucccacuuaggcagccag

SEQ ID NO: 1666967 - RNA, 19 nt, Salmonella enterica enterica serovar Typhi
acugcacgccaggguaaua

SEQ ID NO: 1666968 - RNA, 20 nt, Salmonella enterica enterica serovar Typhi
acugcacuuccugcgucagg

SEQ ID NO: 1666969 - RNA, 16 nt, Salmonella enterica enterica serovar Typhi
acugcaacgccagaug

SEQ ID NO: 1666970 - RNA, 13 nt, Salmonella enterica enterica serovar Typhi
acugcagcgcguc

SEQ ID NO: 1666971 - RNA, 14 nt, Salmonella enterica enterica serovar Typhi
acugcaucugcggu

SEQ ID NO: 1666972 - RNA, 13 nt, Salmonella enterica enterica serovar Typhi
acugccgccaucg

SEQ ID NO: 1666973 - RNA, 16 nt, Salmonella enterica enterica serovar Typhi
acugaacaucgccguu

SEQ ID NO: 1666974 - RNA, 16 nt, Salmonella enterica enterica serovar Typhi
acucuuuuuccgcgag

SEQ ID NO: 1666975 - RNA, 21 nt, Salmonella enterica enterica serovar Typhi
acuaucaauauuggugucgua

SEQ ID NO: 1666976 - RNA, 19 nt, Salmonella enterica enterica serovar Typhi
acugagcgucacgccauca

SEQ ID NO: 1666977 - RNA, 12 nt, Salmonella enterica enterica serovar Typhi
acugacugcugu

SEQ ID NO: 1666978 - RNA, 18 nt, Salmonella enterica enterica serovar Typhi
acugacguugcgaaucag

SEQ ID NO: 1666979 - RNA, 15 nt, Salmonella enterica enterica serovar Typhi
acugacacccaucgc

SEQ ID NO: 1666980 - RNA, 19 nt, Salmonella enterica enterica serovar Typhi
acugaccgcguuuaucgcg

SEQ ID NO: 1666981 - RNA, 21 nt, Salmonella enterica enterica serovar Typhi
acuuagcgccggaauggcgac

SEQ ID NO: 1666982 - RNA, 21 nt, Salmonella enterica enterica serovar Typhi
acuggcgccuuuuggcagcag

SEQ ID NO: 1666983 - RNA, 18 nt, Salmonella enterica enterica serovar Typhi
acugcggcauuacgcgcc

SEQ ID NO: 1666984 - RNA, 16 nt, Salmonella enterica enterica serovar Typhi
acugcgccauuaacgc

SEQ ID NO: 1666985 - RNA, 20 nt, Salmonella enterica enterica serovar Typhi
acugcgcccgcucugcgcca

SEQ ID NO: 1666986 - RNA, 14 nt, Salmonella enterica enterica serovar Typhi
acugccgcccaucg

SEQ ID NO: 1666987 - RNA, 19 nt, Salmonella enterica enterica serovar Typhi
gccagcaucggcagcgcca

SEQ ID NO: 1666988 - RNA, 16 nt, Salmonella enterica enterica serovar Typhi
gccagcaacgcgcuaa

SEQ ID NO: 1666989 - RNA, 22 nt, Salmonella enterica enterica serovar Typhi
gccagauuaucggccagcgcca

SEQ ID NO: 1666990 - RNA, 14 nt, Salmonella enterica enterica serovar Typhi
gccagcaacagcgu

SEQ ID NO: 1666991 - RNA, 22 nt, Salmonella enterica enterica serovar Typhi
gccagcaaaaucaccaucacga

SEQ ID NO: 1666992 - RNA, 21 nt, Salmonella enterica enterica serovar Typhi
gccagcaaggcaagaaaguca

SEQ ID NO: 1666993 - RNA, 19 nt, Salmonella enterica enterica serovar Typhi
gccagccgauuuuucggca

SEQ ID NO: 1666994 - RNA, 20 nt, Salmonella enterica enterica serovar Typhi
gccagcgaaaaccagcgccg

SEQ ID NO: 1666995 - RNA, 21 nt, Salmonella enterica enterica serovar Typhi
gccagccugaacaucuuccag

SEQ ID NO: 1666996 - RNA, 14 nt, Salmonella enterica enterica serovar Typhi
gccaggccgccagc

SEQ ID NO: 1666997 - RNA, 23 nt, Salmonella enterica enterica serovar Typhi
gccagucgauguggccuuccucg

SEQ ID NO: 1666998 - RNA, 14 nt, Salmonella enterica enterica serovar Typhi
gccaguacagcacg

SEQ ID NO: 1666999 - RNA, 23 nt, Salmonella enterica enterica serovar Typhi
gccaguccgguggcgaaaacgcu

SEQ ID NO: 1667000 - RNA, 22 nt, Salmonella enterica enterica serovar Typhi
gccaguaaucccggucgcgcca

SEQ ID NO: 1667001 - RNA, 17 nt, Salmonella enterica enterica serovar Typhi
gccagguuuucaggccg

SEQ ID NO: 1667002 - RNA, 17 nt, Salmonella enterica enterica serovar Typhi
gccagcuacgacaagcu

SEQ ID NO: 1667003 - RNA, 17 nt, Salmonella enterica enterica serovar Typhi
gcagucuggcggcagcc

SEQ ID NO: 1667004 - RNA, 23 nt, Salmonella enterica enterica serovar Typhi
gcagugacauuuaucuuccggca

SEQ ID NO: 1667005 - RNA, 19 nt, Salmonella enterica enterica serovar Typhi
gccaacuuuuugcgcaaua

SEQ ID NO: 1667006 - RNA, 14 nt, Salmonella enterica enterica serovar Typhi
gcaguccguccaga

SEQ ID NO: 1667007 - RNA, 13 nt, Salmonella enterica enterica serovar Typhi
gccacagcggaau

SEQ ID NO: 1667008 - RNA, 12 nt, Salmonella enterica enterica serovar Typhi
gccacagccauc

SEQ ID NO: 1667009 - RNA, 16 nt, Salmonella enterica enterica serovar Typhi
gccaauuccgccauaa

SEQ ID NO: 1667010 - RNA, 19 nt, Salmonella enterica enterica serovar Typhi
gccaccacagucaucgcgc

SEQ ID NO: 1667011 - RNA, 20 nt, Salmonella enterica enterica serovar Typhi
gccacaggcggcauggguaa

SEQ ID NO: 1667012 - RNA, 18 nt, Salmonella enterica enterica serovar Typhi
gccacagcgguuagcggc

SEQ ID NO: 1667013 - RNA, 16 nt, Salmonella enterica enterica serovar Typhi
gccaccagcguaccgg

SEQ ID NO: 1667014 - RNA, 21 nt, Salmonella enterica enterica serovar Typhi
gccaccagcgccagcggcugc

SEQ ID NO: 1667015 - RNA, 15 nt, Salmonella enterica enterica serovar Typhi
gccaccagcgccaua

SEQ ID NO: 1667016 - RNA, 17 nt, Salmonella enterica enterica serovar Typhi
gccaccauccgacaaca

SEQ ID NO: 1667017 - RNA, 22 nt, Salmonella enterica enterica serovar Typhi
gccaccgggcagugcaacggcu

SEQ ID NO: 1667018 - RNA, 12 nt, Salmonella enterica enterica serovar Typhi
gccaccgccagc

SEQ ID NO: 1667019 - RNA, 21 nt, Salmonella enterica enterica serovar Typhi
gccacccggcuuuuuauuuac

SEQ ID NO: 1667020 - RNA, 17 nt, Salmonella enterica enterica serovar Typhi
gcccacaaccgacgcac

SEQ ID NO: 1667021 - RNA, 19 nt, Salmonella enterica enterica serovar Typhi
gcccaacaucaguucagaa

SEQ ID NO: 1667022 - RNA, 19 nt, Salmonella enterica enterica serovar Typhi
gcccaacggaugcgccauc

SEQ ID NO: 1667023 - RNA, 19 nt, Salmonella enterica enterica serovar Typhi
gcccaccggcgagcgcgau

SEQ ID NO: 1667024 - RNA, 12 nt, Salmonella enterica enterica serovar Typhi
gcccaccgccaa

SEQ ID NO: 1667025 - RNA, 21 nt, Salmonella enterica enterica serovar Typhi
gccaugauucaucccgcugug

SEQ ID NO: 1667026 - RNA, 19 nt, Salmonella enterica enterica serovar Typhi
gccaugcuauucagcaguu

SEQ ID NO: 1667027 - RNA, 18 nt, Salmonella enterica enterica serovar Typhi
gccaugaugagcgccaua

SEQ ID NO: 1667028 - RNA, 19 nt, Salmonella enterica enterica serovar Typhi
gccaugaugagcgccauau

SEQ ID NO: 1667029 - RNA, 22 nt, Salmonella enterica enterica serovar Typhi
aagaccagauuaaucagcagau

SEQ ID NO: 1667030 - RNA, 21 nt, Salmonella enterica enterica serovar Typhi
gccauguuaauaccagcgcca

SEQ ID NO: 1667031 - RNA, 20 nt, Salmonella enterica enterica serovar Typhi
gccauuaucgaucugagcgc

SEQ ID NO: 1667032 - RNA, 22 nt, Salmonella enterica enterica serovar Typhi
gccauugcuuuuggcaacggca

SEQ ID NO: 1667033 - RNA, 19 nt, Salmonella enterica enterica serovar Typhi
gccauuggcucggcgucau

SEQ ID NO: 1667034 - RNA, 19 nt, Salmonella enterica enterica serovar Typhi
gccauuguucgcgcgucca

SEQ ID NO: 1667035 - RNA, 13 nt, Salmonella enterica enterica serovar Typhi
gccauuuacgcca

SEQ ID NO: 1667036 - RNA, 15 nt, Salmonella enterica enterica serovar Typhi
gcccaccuucgcgga

SEQ ID NO: 1667037 - RNA, 20 nt, Salmonella enterica enterica serovar Typhi
gcccagaaagaucagcagaa

SEQ ID NO: 1667038 - RNA, 19 nt, Salmonella enterica enterica serovar Typhi
gcccagcucuuuaggcagg

SEQ ID NO: 1667039 - RNA, 23 nt, Salmonella enterica enterica serovar Typhi
gcccagcucaugauagggcagca

SEQ ID NO: 1667040 - RNA, 17 nt, Salmonella enterica enterica serovar Typhi
gcccagccauaauggau

SEQ ID NO: 1667041 - RNA, 16 nt, Salmonella enterica enterica serovar Typhi
gcccagcccggaaaua

SEQ ID NO: 1667042 - RNA, 19 nt, Salmonella enterica enterica serovar Typhi
gcccagcgcgaccugcauc

SEQ ID NO: 1667043 - RNA, 16 nt, Salmonella enterica enterica serovar Typhi
gcccagcgccgucaua

SEQ ID NO: 1667044 - RNA, 23 nt, Salmonella enterica enterica serovar Typhi
gcccagcgccgugucaucauuac

SEQ ID NO: 1667045 - RNA, 13 nt, Salmonella enterica enterica serovar Typhi
gcccagcgcaauc

SEQ ID NO: 1667046 - RNA, 21 nt, Salmonella enterica enterica serovar Typhi
gccccagcauauuuuccggcg

SEQ ID NO: 1667047 - RNA, 16 nt, Salmonella enterica enterica serovar Typhi
gcccaucgccagggcu

SEQ ID NO: 1667048 - RNA, 20 nt, Salmonella enterica enterica serovar Typhi
gcccauaccccacgccauaa

SEQ ID NO: 1667049 - RNA, 20 nt, Salmonella enterica enterica serovar Typhi
gcccaguuucaucaucgccg

SEQ ID NO: 1667050 - RNA, 17 nt, Salmonella enterica enterica serovar Typhi
gcccaucagcaucccac

SEQ ID NO: 1667051 - RNA, 19 nt, Salmonella enterica enterica serovar Typhi
gcccaucaucaucggcaca

SEQ ID NO: 1667052 - RNA, 15 nt, Salmonella enterica enterica serovar Typhi
gccccgacaucagau

SEQ ID NO: 1667053 - RNA, 17 nt, Salmonella enterica enterica serovar Typhi
gcccgcuaacggcacca

SEQ ID NO: 1667054 - RNA, 13 nt, Salmonella enterica enterica serovar Typhi
gcccgaucguccg

SEQ ID NO: 1667055 - RNA, 18 nt, Salmonella enterica enterica serovar Typhi
gcccgauacccgcccaga

SEQ ID NO: 1667056 - RNA, 20 nt, Salmonella enterica enterica serovar Typhi
gcccgauaagcaagcgccau

SEQ ID NO: 1667057 - RNA, 16 nt, Salmonella enterica enterica serovar Typhi
gcccgauaaaucgcau

SEQ ID NO: 1667058 - RNA, 23 nt, Salmonella enterica enterica serovar Typhi
gccccucgucuucgaccgccaua

SEQ ID NO: 1667059 - RNA, 12 nt, Salmonella enterica enterica serovar Typhi
gccccugacgcu

SEQ ID NO: 1667060 - RNA, 19 nt, Salmonella enterica enterica serovar Typhi
gccgcuaaaacacccgcaa

SEQ ID NO: 1667061 - RNA, 18 nt, Salmonella enterica enterica serovar Typhi
gccgcuacugccgccauc

SEQ ID NO: 1667062 - RNA, 14 nt, Salmonella enterica enterica serovar Typhi
gccgcuauccucgc

SEQ ID NO: 1667063 - RNA, 23 nt, Salmonella enterica enterica serovar Typhi
gccgcuaugacgaagcugaguau

SEQ ID NO: 1667064 - RNA, 23 nt, Salmonella enterica enterica serovar Typhi
gccgcucccgcauggacaaggau

SEQ ID NO: 1667065 - RNA, 13 nt, Salmonella enterica enterica serovar Typhi
gccgcucacguuc

SEQ ID NO: 1667066 - RNA, 19 nt, Salmonella enterica enterica serovar Typhi
gccgcucaucaccagcagc

SEQ ID NO: 1667067 - RNA, 13 nt, Salmonella enterica enterica serovar Typhi
gccgcucgccugc

SEQ ID NO: 1667068 - RNA, 12 nt, Salmonella enterica enterica serovar Typhi
gccgcgcugauc

SEQ ID NO: 1667069 - RNA, 16 nt, Salmonella enterica enterica serovar Typhi
gccgcgcccugcggaa

SEQ ID NO: 1667070 - RNA, 19 nt, Salmonella enterica enterica serovar Typhi
gccgcgccuaccagcgcua

SEQ ID NO: 1667071 - RNA, 17 nt, Salmonella enterica enterica serovar Typhi
gccgccgucaucugcgc

SEQ ID NO: 1667072 - RNA, 18 nt, Salmonella enterica enterica serovar Typhi
gccgccgucaucugcgcc

SEQ ID NO: 1667073 - RNA, 21 nt, Salmonella enterica enterica serovar Typhi
gccgccgggcgauuauaaggu

SEQ ID NO: 1667074 - RNA, 21 nt, Salmonella enterica enterica serovar Typhi
gccgccgccuaccauaaugau

SEQ ID NO: 1667075 - RNA, 20 nt, Salmonella enterica enterica serovar Typhi
gccgcgcaguuucuuaccua

SEQ ID NO: 1667076 - RNA, 14 nt, Salmonella enterica enterica serovar Typhi
gccgcgcaagcgau

SEQ ID NO: 1667077 - RNA, 22 nt, Salmonella enterica enterica serovar Typhi
gccgcgaagcguuccgccacua

SEQ ID NO: 1667078 - RNA, 22 nt, Salmonella enterica enterica serovar Typhi
gccgcgaauaaaggcgcuguug

SEQ ID NO: 1667079 - RNA, 16 nt, Salmonella enterica enterica serovar Typhi
gccgcgaccagcagca

SEQ ID NO: 1667080 - RNA, 16 nt, Salmonella enterica enterica serovar Typhi
gccgccuggcgcgacu

SEQ ID NO: 1667081 - RNA, 16 nt, Salmonella enterica enterica serovar Typhi
gccgccucccccucaa

SEQ ID NO: 1667082 - RNA, 17 nt, Salmonella enterica enterica serovar Typhi
gccgccuaucgccagca

SEQ ID NO: 1667083 - RNA, 15 nt, Salmonella enterica enterica serovar Typhi
gccgccuaucgccag

SEQ ID NO: 1667084 - RNA, 12 nt, Salmonella enterica enterica serovar Typhi
gccgccugcgcc

SEQ ID NO: 1667085 - RNA, 15 nt, Salmonella enterica enterica serovar Typhi
gcccuuucagagcgu

SEQ ID NO: 1667086 - RNA, 19 nt, Salmonella enterica enterica serovar Typhi
gcccuuccagcagccagcc

SEQ ID NO: 1667087 - RNA, 19 nt, Salmonella enterica enterica serovar Typhi
gccgaauauugcgccacgc

SEQ ID NO: 1667088 - RNA, 19 nt, Salmonella enterica enterica serovar Typhi
gccgacaugcuccugcauc

SEQ ID NO: 1667089 - RNA, 15 nt, Salmonella enterica enterica serovar Typhi
gccgaccagcgucuu

SEQ ID NO: 1667090 - RNA, 17 nt, Salmonella enterica enterica serovar Typhi
gccgacccgcaucgccg

SEQ ID NO: 1667091 - RNA, 12 nt, Salmonella enterica enterica serovar Typhi
gccgaccgccga

SEQ ID NO: 1667092 - RNA, 13 nt, Salmonella enterica enterica serovar Typhi
gccgacaucgcca

SEQ ID NO: 1667093 - RNA, 15 nt, Salmonella enterica enterica serovar Typhi
gcccgcucugcgcca

SEQ ID NO: 1667094 - RNA, 21 nt, Salmonella enterica enterica serovar Typhi
gcccucgggucgaauuccagu

SEQ ID NO: 1667095 - RNA, 20 nt, Salmonella enterica enterica serovar Typhi
gcccugagcccacagcggau

SEQ ID NO: 1667096 - RNA, 17 nt, Salmonella enterica enterica serovar Typhi
gcccugauggcgcgcca

SEQ ID NO: 1667097 - RNA, 16 nt, Salmonella enterica enterica serovar Typhi
gcccucuuuuagcaau

SEQ ID NO: 1667098 - RNA, 17 nt, Salmonella enterica enterica serovar Typhi
gcccucuuccagcgcca

SEQ ID NO: 1667099 - RNA, 20 nt, Salmonella enterica enterica serovar Typhi
gcccucuucuucuuccguca

SEQ ID NO: 1667100 - RNA, 13 nt, Salmonella enterica enterica serovar Typhi
gcccuggguugcc

SEQ ID NO: 1667101 - RNA, 15 nt, Salmonella enterica enterica serovar Typhi
gcccuuccagcagcc

SEQ ID NO: 1667102 - RNA, 14 nt, Salmonella enterica enterica serovar Typhi
gcccuuccagcagc

SEQ ID NO: 1667103 - RNA, 17 nt, Salmonella enterica enterica serovar Typhi
gcccuuccgucagcguc

SEQ ID NO: 1667104 - RNA, 22 nt, Salmonella enterica enterica serovar Typhi
gcccuguggaaacuccagcggc

SEQ ID NO: 1667105 - RNA, 15 nt, Salmonella enterica enterica serovar Typhi
gcccuguuucgcagg

SEQ ID NO: 1667106 - RNA, 15 nt, Salmonella enterica enterica serovar Typhi
gcccugcccgccagg

SEQ ID NO: 1667107 - RNA, 15 nt, Salmonella enterica enterica serovar Typhi
gccgcacgcaccgua

SEQ ID NO: 1667108 - RNA, 17 nt, Salmonella enterica enterica serovar Typhi
aagcaccgccagcgccg

SEQ ID NO: 1667109 - RNA, 18 nt, Salmonella enterica enterica serovar Typhi
gccgcaacccgauaagcu

SEQ ID NO: 1667110 - RNA, 16 nt, Salmonella enterica enterica serovar Typhi
gccgauggucgcgcca

SEQ ID NO: 1667111 - RNA, 21 nt, Salmonella enterica enterica serovar Typhi
gccgaugcugaauagccagcc

SEQ ID NO: 1667112 - RNA, 14 nt, Salmonella enterica enterica serovar Typhi
gccgcaucgccaua

SEQ ID NO: 1667113 - RNA, 14 nt, Salmonella enterica enterica serovar Typhi
gccgcauccccaua

SEQ ID NO: 1667114 - RNA, 21 nt, Salmonella enterica enterica serovar Typhi
gccgcauccccauagacagua

SEQ ID NO: 1667115 - RNA, 15 nt, Salmonella enterica enterica serovar Typhi
gccgcacuccccaga

SEQ ID NO: 1667116 - RNA, 12 nt, Salmonella enterica enterica serovar Typhi
gccgcagcgccg

SEQ ID NO: 1667117 - RNA, 18 nt, Salmonella enterica enterica serovar Typhi
gccgaucaccagcgcauc

SEQ ID NO: 1667118 - RNA, 17 nt, Salmonella enterica enterica serovar Typhi
gccgaucaccagcgcau

SEQ ID NO: 1667119 - RNA, 22 nt, Salmonella enterica enterica serovar Typhi
gccgagucgguaagucugauaa

SEQ ID NO: 1667120 - RNA, 17 nt, Salmonella enterica enterica serovar Typhi
gccgagucgaucgucgg

SEQ ID NO: 1667121 - RNA, 21 nt, Salmonella enterica enterica serovar Typhi
gccgagcgguaagagccagac

SEQ ID NO: 1667122 - RNA, 19 nt, Salmonella enterica enterica serovar Typhi
aagauuagccccagcgcca

SEQ ID NO: 1667123 - RNA, 19 nt, Salmonella enterica enterica serovar Typhi
aagaugugccacuccgcca

SEQ ID NO: 1667124 - RNA, 17 nt, Salmonella enterica enterica serovar Typhi
gcacaaugcccggcaua

SEQ ID NO: 1667125 - RNA, 12 nt, Salmonella enterica enterica serovar Typhi
gcacacagcgcu

SEQ ID NO: 1667126 - RNA, 13 nt, Salmonella enterica enterica serovar Typhi
gcacaaucgccag

SEQ ID NO: 1667127 - RNA, 12 nt, Salmonella enterica enterica serovar Typhi
gcacacaggccg

SEQ ID NO: 1667128 - RNA, 15 nt, Salmonella enterica enterica serovar Typhi
gcaauuguugcgcca

SEQ ID NO: 1667129 - RNA, 16 nt, Salmonella enterica enterica serovar Typhi
gcaauucggacacgcu

SEQ ID NO: 1667130 - RNA, 13 nt, Salmonella enterica enterica serovar Typhi
gcaacagcguacc

SEQ ID NO: 1667131 - RNA, 22 nt, Salmonella enterica enterica serovar Typhi
gcacaggcgcggagacgugacc

SEQ ID NO: 1667132 - RNA, 20 nt, Salmonella enterica enterica serovar Typhi
gcacagcgcuaucaggcacu

SEQ ID NO: 1667133 - RNA, 12 nt, Salmonella enterica enterica serovar Typhi
gcacaucagcaa

SEQ ID NO: 1667134 - RNA, 23 nt, Salmonella enterica enterica serovar Typhi
gcacauccucaaugguuucacgc

SEQ ID NO: 1667135 - RNA, 20 nt, Salmonella enterica enterica serovar Typhi
gcaccaccaggaacgccaua

SEQ ID NO: 1667136 - RNA, 15 nt, Salmonella enterica enterica serovar Typhi
gcaccaccaggaacg

SEQ ID NO: 1667137 - RNA, 17 nt, Salmonella enterica enterica serovar Typhi
gcaccacgcaaaccgcu

SEQ ID NO: 1667138 - RNA, 17 nt, Salmonella enterica enterica serovar Typhi
gcaccagaccgacaagc

SEQ ID NO: 1667139 - RNA, 17 nt, Salmonella enterica enterica serovar Typhi
gcaccggaaccggcauc

SEQ ID NO: 1667140 - RNA, 19 nt, Salmonella enterica enterica serovar Typhi
gcaccgccuugcccguauu

SEQ ID NO: 1667141 - RNA, 14 nt, Salmonella enterica enterica serovar Typhi
gcaccauucuucaa

SEQ ID NO: 1667142 - RNA, 13 nt, Salmonella enterica enterica serovar Typhi
gcaccugggcaau

SEQ ID NO: 1667143 - RNA, 20 nt, Salmonella enterica enterica serovar Typhi
gcaccugggaaucgugcaau

SEQ ID NO: 1667144 - RNA, 19 nt, Salmonella enterica enterica serovar Typhi
gcacgcgccgaaugcguuu

SEQ ID NO: 1667145 - RNA, 20 nt, Salmonella enterica enterica serovar Typhi
gcacgcgccgaaugcguuuu

SEQ ID NO: 1667146 - RNA, 12 nt, Salmonella enterica enterica serovar Typhi
gcacgccagcgg

SEQ ID NO: 1667147 - RNA, 17 nt, Salmonella enterica enterica serovar Typhi
gcacgcccgcauucaua

SEQ ID NO: 1667148 - RNA, 18 nt, Salmonella enterica enterica serovar Typhi
gcacguccagauacgcgc

SEQ ID NO: 1667149 - RNA, 23 nt, Salmonella enterica enterica serovar Typhi
gcacguaguaaugcauggucgcc

SEQ ID NO: 1667150 - RNA, 23 nt, Salmonella enterica enterica serovar Typhi
gcacgguuaaugaaaucgucgcc

SEQ ID NO: 1667151 - RNA, 17 nt, Salmonella enterica enterica serovar Typhi
gcacggucaaucaucag

SEQ ID NO: 1667152 - RNA, 16 nt, Salmonella enterica enterica serovar Typhi
gcagcaaugugcgcca

SEQ ID NO: 1667153 - RNA, 17 nt, Salmonella enterica enterica serovar Typhi
gcagcaagaauaccacu

SEQ ID NO: 1667154 - RNA, 16 nt, Salmonella enterica enterica serovar Typhi
gcagcaaacgccauag

SEQ ID NO: 1667155 - RNA, 16 nt, Salmonella enterica enterica serovar Typhi
gcagauuuuuauccgu

SEQ ID NO: 1667156 - RNA, 21 nt, Salmonella enterica enterica serovar Typhi
gcagauagcaaaaaagcgccu

SEQ ID NO: 1667157 - RNA, 16 nt, Salmonella enterica enterica serovar Typhi
gcagaguccagcggca

SEQ ID NO: 1667158 - RNA, 14 nt, Salmonella enterica enterica serovar Typhi
gcagauacgcguca

SEQ ID NO: 1667159 - RNA, 15 nt, Salmonella enterica enterica serovar Typhi
gcagacauucgcgca

SEQ ID NO: 1667160 - RNA, 14 nt, Salmonella enterica enterica serovar Typhi
gcagacauucgcgc

SEQ ID NO: 1667161 - RNA, 16 nt, Salmonella enterica enterica serovar Typhi
gcagacaauaaacggu

SEQ ID NO: 1667162 - RNA, 20 nt, Salmonella enterica enterica serovar Typhi
gcagacaauuuccgccgcca

SEQ ID NO: 1667163 - RNA, 20 nt, Salmonella enterica enterica serovar Typhi
gcagaaauaaaauacuucca

SEQ ID NO: 1667164 - RNA, 15 nt, Salmonella enterica enterica serovar Typhi
gcacuuuucccgcca

SEQ ID NO: 1667165 - RNA, 22 nt, Salmonella enterica enterica serovar Typhi
gcagaacaaacagaccgccaug

SEQ ID NO: 1667166 - RNA, 16 nt, Salmonella enterica enterica serovar Typhi
gcacuuucagaccacu

SEQ ID NO: 1667167 - RNA, 18 nt, Salmonella enterica enterica serovar Typhi
gcacuuuaagcggcagcu

SEQ ID NO: 1667168 - RNA, 12 nt, Salmonella enterica enterica serovar Typhi
gcacugcugcug

SEQ ID NO: 1667169 - RNA, 19 nt, Salmonella enterica enterica serovar Typhi
gcacuucacccaucgccag

SEQ ID NO: 1667170 - RNA, 17 nt, Salmonella enterica enterica serovar Typhi
gcacuacggcaaacgcu

SEQ ID NO: 1667171 - RNA, 13 nt, Salmonella enterica enterica serovar Typhi
gcacucagaaaau

SEQ ID NO: 1667172 - RNA, 21 nt, Salmonella enterica enterica serovar Typhi
gcacuacggcaaacgcuggug

SEQ ID NO: 1667173 - RNA, 17 nt, Salmonella enterica enterica serovar Typhi
gcagcguaauacaggcg

SEQ ID NO: 1667174 - RNA, 14 nt, Salmonella enterica enterica serovar Typhi
gcaggacagcgaca

SEQ ID NO: 1667175 - RNA, 15 nt, Salmonella enterica enterica serovar Typhi
gcaggacaaccccua

SEQ ID NO: 1667176 - RNA, 12 nt, Salmonella enterica enterica serovar Typhi
gcaggaggcgcg

SEQ ID NO: 1667177 - RNA, 21 nt, Salmonella enterica enterica serovar Typhi
gcagcuuagcaaucugacgca

SEQ ID NO: 1667178 - RNA, 16 nt, Salmonella enterica enterica serovar Typhi
gcagcuucacgcgcug

SEQ ID NO: 1667179 - RNA, 15 nt, Salmonella enterica enterica serovar Typhi
gcagcuucgccgcgu

SEQ ID NO: 1667180 - RNA, 13 nt, Salmonella enterica enterica serovar Typhi
gcagcgccgccug

SEQ ID NO: 1667181 - RNA, 18 nt, Salmonella enterica enterica serovar Typhi
gcagcgcugagucauccu

SEQ ID NO: 1667182 - RNA, 19 nt, Salmonella enterica enterica serovar Typhi
gcagcggcgacaccagcgu

SEQ ID NO: 1667183 - RNA, 13 nt, Salmonella enterica enterica serovar Typhi
gcagcggcgguua

SEQ ID NO: 1667184 - RNA, 18 nt, Salmonella enterica enterica serovar Typhi
gcagccgggccagacgcu

SEQ ID NO: 1667185 - RNA, 12 nt, Salmonella enterica enterica serovar Typhi
gcagccggauag

SEQ ID NO: 1667186 - RNA, 13 nt, Salmonella enterica enterica serovar Typhi
gcagccgcugaua

SEQ ID NO: 1667187 - RNA, 13 nt, Salmonella enterica enterica serovar Typhi
gcaggcagcgcca

SEQ ID NO: 1667188 - RNA, 18 nt, Salmonella enterica enterica serovar Typhi
gcaggccauaaaacgggc

SEQ ID NO: 1667189 - RNA, 12 nt, Salmonella enterica enterica serovar Typhi
gcaggccggaua

SEQ ID NO: 1667190 - RNA, 20 nt, Salmonella enterica enterica serovar Typhi
gcaggccggauaaggcauuu

SEQ ID NO: 1667191 - RNA, 21 nt, Salmonella enterica enterica serovar Typhi
gcaggcuggagagcaacgcca

SEQ ID NO: 1667192 - RNA, 18 nt, Salmonella enterica enterica serovar Typhi
gcaggcgggugcgcagcc

SEQ ID NO: 1667193 - RNA, 14 nt, Salmonella enterica enterica serovar Typhi
gcaguaacgcauac

SEQ ID NO: 1667194 - RNA, 18 nt, Salmonella enterica enterica serovar Typhi
gcagguuaaacagacaau

SEQ ID NO: 1667195 - RNA, 13 nt, Salmonella enterica enterica serovar Typhi
gcaguacggcgca

SEQ ID NO: 1667196 - RNA, 21 nt, Salmonella enterica enterica serovar Typhi
gcaguacgcgcaaccgcauca

SEQ ID NO: 1667197 - RNA, 22 nt, Salmonella enterica enterica serovar Typhi
gcaggucuucgucagcgcauac

SEQ ID NO: 1667198 - RNA, 19 nt, Salmonella enterica enterica serovar Typhi
gcagggucaggaacugcgg

SEQ ID NO: 1667199 - RNA, 15 nt, Salmonella enterica enterica serovar Typhi
gcagggcaugauuac

SEQ ID NO: 1667200 - RNA, 14 nt, Salmonella enterica enterica serovar Typhi
gcagggcagacgcc

SEQ ID NO: 1667201 - RNA, 23 nt, Salmonella enterica enterica serovar Typhi
gaggcuaccguucagaucgccaa

SEQ ID NO: 1667202 - RNA, 13 nt, Salmonella enterica enterica serovar Typhi
gaggguguucacg

SEQ ID NO: 1667203 - RNA, 18 nt, Salmonella enterica enterica serovar Typhi
gagguuuucucauccagc

SEQ ID NO: 1667204 - RNA, 15 nt, Salmonella enterica enterica serovar Typhi
gaguaaaaccggcac

SEQ ID NO: 1667205 - RNA, 17 nt, Salmonella enterica enterica serovar Typhi
gagguuuccggcgggag

SEQ ID NO: 1667206 - RNA, 13 nt, Salmonella enterica enterica serovar Typhi
gagguugcggaua

SEQ ID NO: 1667207 - RNA, 17 nt, Salmonella enterica enterica serovar Typhi
gaggauaaaaucgccaa

SEQ ID NO: 1667208 - RNA, 23 nt, Salmonella enterica enterica serovar Typhi
gaggcaucgcccuguaagaggca

SEQ ID NO: 1667209 - RNA, 14 nt, Salmonella enterica enterica serovar Typhi
gagcuggauaagcu

SEQ ID NO: 1667210 - RNA, 22 nt, Salmonella enterica enterica serovar Typhi
gagcuggcacgcgaugucggga

SEQ ID NO: 1667211 - RNA, 16 nt, Salmonella enterica enterica serovar Typhi
gagcucuaccagacca

SEQ ID NO: 1667212 - RNA, 12 nt, Salmonella enterica enterica serovar Typhi
gagcucagucca

SEQ ID NO: 1667213 - RNA, 14 nt, Salmonella enterica enterica serovar Typhi
gagcgggccgucag

SEQ ID NO: 1667214 - RNA, 21 nt, Salmonella enterica enterica serovar Typhi
aacugccggauggcgcugccg

SEQ ID NO: 1667215 - RNA, 16 nt, Salmonella enterica enterica serovar Typhi
gagcgguaagagccag

SEQ ID NO: 1667216 - RNA, 19 nt, Salmonella enterica enterica serovar Typhi
aacugcauaucgccgcuuu

SEQ ID NO: 1667217 - RNA, 21 nt, Salmonella enterica enterica serovar Typhi
aacugcagcgcgucgaccaua

SEQ ID NO: 1667218 - RNA, 18 nt, Salmonella enterica enterica serovar Typhi
aacugcaaaucuucggca

SEQ ID NO: 1667219 - RNA, 14 nt, Salmonella enterica enterica serovar Typhi
gagcggcucaucca

SEQ ID NO: 1667220 - RNA, 21 nt, Salmonella enterica enterica serovar Typhi
gagcggcuacgccugauaagc

SEQ ID NO: 1667221 - RNA, 13 nt, Salmonella enterica enterica serovar Typhi
gagcggccagcgg

SEQ ID NO: 1667222 - RNA, 21 nt, Salmonella enterica enterica serovar Typhi
aacucggaggcggcguaacgg

SEQ ID NO: 1667223 - RNA, 13 nt, Salmonella enterica enterica serovar Typhi
gagcgcguccaga

SEQ ID NO: 1667224 - RNA, 20 nt, Salmonella enterica enterica serovar Typhi
gagcgaacaguacggucagg

SEQ ID NO: 1667225 - RNA, 14 nt, Salmonella enterica enterica serovar Typhi
gagccuuacaggcg

SEQ ID NO: 1667226 - RNA, 15 nt, Salmonella enterica enterica serovar Typhi
gagccuugcgggaua

SEQ ID NO: 1667227 - RNA, 20 nt, Salmonella enterica enterica serovar Typhi
gagcgaaaaggccuggcuga

SEQ ID NO: 1667228 - RNA, 14 nt, Salmonella enterica enterica serovar Typhi
gaucaaucacgccg

SEQ ID NO: 1667229 - RNA, 18 nt, Salmonella enterica enterica serovar Typhi
gaucaauaacgccgguuc

SEQ ID NO: 1667230 - RNA, 20 nt, Salmonella enterica enterica serovar Typhi
gauauugucgaauuccgccu

SEQ ID NO: 1667231 - RNA, 15 nt, Salmonella enterica enterica serovar Typhi
gaucagcacgcgccg

SEQ ID NO: 1667232 - RNA, 14 nt, Salmonella enterica enterica serovar Typhi
gauagcgcuuucca

SEQ ID NO: 1667233 - RNA, 20 nt, Salmonella enterica enterica serovar Typhi
gauagcgcgccagcaccagg

SEQ ID NO: 1667234 - RNA, 16 nt, Salmonella enterica enterica serovar Typhi
gauauaaaacgggcca

SEQ ID NO: 1667235 - RNA, 18 nt, Salmonella enterica enterica serovar Typhi
gauaguugagcagcgcga

SEQ ID NO: 1667236 - RNA, 16 nt, Salmonella enterica enterica serovar Typhi
gauagcguuuuccagc

SEQ ID NO: 1667237 - RNA, 17 nt, Salmonella enterica enterica serovar Typhi
gauagcgguuugcaaac

SEQ ID NO: 1667238 - RNA, 16 nt, Salmonella enterica enterica serovar Typhi
gauagcuacgauaaag

SEQ ID NO: 1667239 - RNA, 19 nt, Salmonella enterica enterica serovar Typhi
gauaguguaaacgcgccau

SEQ ID NO: 1667240 - RNA, 21 nt, Salmonella enterica enterica serovar Typhi
gauagcggcuucgccagaucc

SEQ ID NO: 1667241 - RNA, 17 nt, Salmonella enterica enterica serovar Typhi
gauagcgggcaaugcca

SEQ ID NO: 1667242 - RNA, 14 nt, Salmonella enterica enterica serovar Typhi
gauagcgucaacgc

SEQ ID NO: 1667243 - RNA, 18 nt, Salmonella enterica enterica serovar Typhi
gauauucccguuccagcu

SEQ ID NO: 1667244 - RNA, 12 nt, Salmonella enterica enterica serovar Typhi
gauauagcgcca

SEQ ID NO: 1667245 - RNA, 16 nt, Salmonella enterica enterica serovar Typhi
gauaucaaacacaaau

SEQ ID NO: 1667246 - RNA, 13 nt, Salmonella enterica enterica serovar Typhi
gauauccagcaua

SEQ ID NO: 1667247 - RNA, 20 nt, Salmonella enterica enterica serovar Typhi
gauaucauucucuacgccca

SEQ ID NO: 1667248 - RNA, 23 nt, Salmonella enterica enterica serovar Typhi
gauacuaaagggaucuuccugcg

SEQ ID NO: 1667249 - RNA, 14 nt, Salmonella enterica enterica serovar Typhi
gauacguucauccu

SEQ ID NO: 1667250 - RNA, 22 nt, Salmonella enterica enterica serovar Typhi
gauacugcgcucuaucaccgcc

SEQ ID NO: 1667251 - RNA, 18 nt, Salmonella enterica enterica serovar Typhi
gauacugcuccggcgcga

SEQ ID NO: 1667252 - RNA, 18 nt, Salmonella enterica enterica serovar Typhi
gauacggaaauagcgcca

SEQ ID NO: 1667253 - RNA, 19 nt, Salmonella enterica enterica serovar Typhi
gauacgcugcgucaggcga

SEQ ID NO: 1667254 - RNA, 18 nt, Salmonella enterica enterica serovar Typhi
gauacggcgagaccauau

SEQ ID NO: 1667255 - RNA, 17 nt, Salmonella enterica enterica serovar Typhi
gauacggcuccagcaca

SEQ ID NO: 1667256 - RNA, 17 nt, Salmonella enterica enterica serovar Typhi
gauaccagucgacagua

SEQ ID NO: 1667257 - RNA, 22 nt, Salmonella enterica enterica serovar Typhi
gauaaggcgcagccgccauccg

SEQ ID NO: 1667258 - RNA, 22 nt, Salmonella enterica enterica serovar Typhi
gauaaggcggagccgccauccg

SEQ ID NO: 1667259 - RNA, 22 nt, Salmonella enterica enterica serovar Typhi
gauaaggcguaaccgccauccg

SEQ ID NO: 1667260 - RNA, 23 nt, Salmonella enterica enterica serovar Typhi
gauaagcgugagcgcauccggca

SEQ ID NO: 1667261 - RNA, 19 nt, Salmonella enterica enterica serovar Typhi
gauaagcgugcgccauccg

SEQ ID NO: 1667262 - RNA, 13 nt, Salmonella enterica enterica serovar Typhi
gauacagcagcac

SEQ ID NO: 1667263 - RNA, 15 nt, Salmonella enterica enterica serovar Typhi
gauacagcagcaccu

SEQ ID NO: 1667264 - RNA, 21 nt, Salmonella enterica enterica serovar Typhi
gauaaguccuaacaccugcca

SEQ ID NO: 1667265 - RNA, 16 nt, Salmonella enterica enterica serovar Typhi
gauaaggcguucacgc

SEQ ID NO: 1667266 - RNA, 17 nt, Salmonella enterica enterica serovar Typhi
gauaaggcguucacgcc

SEQ ID NO: 1667267 - RNA, 22 nt, Salmonella enterica enterica serovar Typhi
gagucgacugguaggccugaua

SEQ ID NO: 1667268 - RNA, 15 nt, Salmonella enterica enterica serovar Typhi
gagucgcgcgcgcca

SEQ ID NO: 1667269 - RNA, 17 nt, Salmonella enterica enterica serovar Typhi
gauaacggaugacagca

SEQ ID NO: 1667270 - RNA, 16 nt, Salmonella enterica enterica serovar Typhi
gauaacgcgcuggcgg

SEQ ID NO: 1667271 - RNA, 12 nt, Salmonella enterica enterica serovar Typhi
gauaacggcgca

SEQ ID NO: 1667272 - RNA, 23 nt, Salmonella enterica enterica serovar Typhi
gauaagcgcagcgccauccggca

SEQ ID NO: 1667273 - RNA, 19 nt, Salmonella enterica enterica serovar Typhi
gauaagcguagcgcauccg

SEQ ID NO: 1667274 - RNA, 22 nt, Salmonella enterica enterica serovar Typhi
gauaagcguagcgcauccggca

SEQ ID NO: 1667275 - RNA, 20 nt, Salmonella enterica enterica serovar Typhi
gauaagcgccacgucggcga

SEQ ID NO: 1667276 - RNA, 16 nt, Salmonella enterica enterica serovar Typhi
gauaagcguagcgcca

SEQ ID NO: 1667277 - RNA, 23 nt, Salmonella enterica enterica serovar Typhi
gauaagcguagcgccaucaggcu

SEQ ID NO: 1667278 - RNA, 20 nt, Salmonella enterica enterica serovar Typhi
gauaagcguagcgccauccg

SEQ ID NO: 1667279 - RNA, 20 nt, Salmonella enterica enterica serovar Typhi
gauaagcgugagcgcauccg

SEQ ID NO: 1667280 - RNA, 20 nt, Salmonella enterica enterica serovar Typhi
gauaaccccguucgacaacg

SEQ ID NO: 1667281 - RNA, 20 nt, Salmonella enterica enterica serovar Typhi
gauaaccaggucaccggaaa

SEQ ID NO: 1667282 - RNA, 19 nt, Salmonella enterica enterica serovar Typhi
gauaaccgcguucauacgc

SEQ ID NO: 1667283 - RNA, 11 nt, Salmonella enterica enterica serovar Typhi
gauaaccagaa

SEQ ID NO: 1667284 - RNA, 19 nt, Salmonella enterica enterica serovar Typhi
gauaacaguauuuguucag

SEQ ID NO: 1667285 - RNA, 20 nt, Salmonella enterica enterica serovar Typhi
gauaaauguuuacuucgcuu

SEQ ID NO: 1667286 - RNA, 20 nt, Salmonella enterica enterica serovar Typhi
gaucaggcaaaaaucggccu

SEQ ID NO: 1667287 - RNA, 20 nt, Salmonella enterica enterica serovar Typhi
gaucaguucuugcaggcagg

SEQ ID NO: 1667288 - RNA, 21 nt, Salmonella enterica enterica serovar Typhi
gaucaugagucgcgcgcgcca

SEQ ID NO: 1667289 - RNA, 20 nt, Salmonella enterica enterica serovar Typhi
gauccuguucaaacaucagc

SEQ ID NO: 1667290 - RNA, 22 nt, Salmonella enterica enterica serovar Typhi
gauccugcguuaacgacccauc

SEQ ID NO: 1667291 - RNA, 21 nt, Salmonella enterica enterica serovar Typhi
gaucgacaaugaucagacgca

SEQ ID NO: 1667292 - RNA, 14 nt, Salmonella enterica enterica serovar Typhi
gaucgaaucucccg

SEQ ID NO: 1667293 - RNA, 23 nt, Salmonella enterica enterica serovar Typhi
gaucgacauaagaguccauucgg

SEQ ID NO: 1667294 - RNA, 22 nt, Salmonella enterica enterica serovar Typhi
gauggcggcgaugccuuauccg

SEQ ID NO: 1667295 - RNA, 20 nt, Salmonella enterica enterica serovar Typhi
gaugggccgaguaauccgua

SEQ ID NO: 1667296 - RNA, 19 nt, Salmonella enterica enterica serovar Typhi
gauggcgcuucgcuuacca

SEQ ID NO: 1667297 - RNA, 20 nt, Salmonella enterica enterica serovar Typhi
gauggcgcugcgcuuaucag

SEQ ID NO: 1667298 - RNA, 20 nt, Salmonella enterica enterica serovar Typhi
gauggcgcugcgcuuauccg

SEQ ID NO: 1667299 - RNA, 20 nt, Salmonella enterica enterica serovar Typhi
gauggcgcuucgcuuaucag

SEQ ID NO: 1667300 - RNA, 16 nt, Salmonella enterica enterica serovar Typhi
gauggcgcuaagccag

SEQ ID NO: 1667301 - RNA, 21 nt, Salmonella enterica enterica serovar Typhi
gauggcgcugccgcuuauccg

SEQ ID NO: 1667302 - RNA, 17 nt, Salmonella enterica enterica serovar Typhi
gauggcgcgcuuaucug

SEQ ID NO: 1667303 - RNA, 20 nt, Salmonella enterica enterica serovar Typhi
gauggcgcugcgcuuaccca

SEQ ID NO: 1667304 - RNA, 13 nt, Salmonella enterica enterica serovar Typhi
gauggccucauca

SEQ ID NO: 1667305 - RNA, 13 nt, Salmonella enterica enterica serovar Typhi
gauggucgcgcca

SEQ ID NO: 1667306 - RNA, 18 nt, Salmonella enterica enterica serovar Typhi
gauguaugaacugcauca

SEQ ID NO: 1667307 - RNA, 14 nt, Salmonella enterica enterica serovar Typhi
gauguauuuaucca

SEQ ID NO: 1667308 - RNA, 13 nt, Salmonella enterica enterica serovar Typhi
gaugucauccggu

SEQ ID NO: 1667309 - RNA, 23 nt, Salmonella enterica enterica serovar Typhi
gaugucggcuuacgccuuauccg

SEQ ID NO: 1667310 - RNA, 14 nt, Salmonella enterica enterica serovar Typhi
gaugcgcugcuaaa

SEQ ID NO: 1667311 - RNA, 21 nt, Salmonella enterica enterica serovar Typhi
gaugcggacgcugacgccagg

SEQ ID NO: 1667312 - RNA, 13 nt, Salmonella enterica enterica serovar Typhi
gaugcgcuuuacu

SEQ ID NO: 1667313 - RNA, 15 nt, Salmonella enterica enterica serovar Typhi
aacuuauccgccauc

SEQ ID NO: 1667314 - RNA, 13 nt, Salmonella enterica enterica serovar Typhi
gaugcgccauccc

SEQ ID NO: 1667315 - RNA, 23 nt, Salmonella enterica enterica serovar Typhi
gauggcacugcgcuuauccggcc

SEQ ID NO: 1667316 - RNA, 13 nt, Salmonella enterica enterica serovar Typhi
gaugcuaucgcgg

SEQ ID NO: 1667317 - RNA, 20 nt, Salmonella enterica enterica serovar Typhi
gaugcuaucgcggauaagcc

SEQ ID NO: 1667318 - RNA, 15 nt, Salmonella enterica enterica serovar Typhi
aacuugauuccuggc

SEQ ID NO: 1667319 - RNA, 16 nt, Salmonella enterica enterica serovar Typhi
aacuucgcgguuagaa

SEQ ID NO: 1667320 - RNA, 17 nt, Salmonella enterica enterica serovar Typhi
gaugcucgccgucggca

SEQ ID NO: 1667321 - RNA, 16 nt, Salmonella enterica enterica serovar Typhi
gcaaagacaggugacc

SEQ ID NO: 1667322 - RNA, 13 nt, Salmonella enterica enterica serovar Typhi
gcaaaucgccauc

SEQ ID NO: 1667323 - RNA, 13 nt, Salmonella enterica enterica serovar Typhi
gcaaauaauacca

SEQ ID NO: 1667324 - RNA, 23 nt, Salmonella enterica enterica serovar Typhi
gcaaaucgcgguaaaaagcugau

SEQ ID NO: 1667325 - RNA, 19 nt, Salmonella enterica enterica serovar Typhi
gcaaaucugccgucaucga

SEQ ID NO: 1667326 - RNA, 22 nt, Salmonella enterica enterica serovar Typhi
gcaaaugucagaucguaugcgc

SEQ ID NO: 1667327 - RNA, 19 nt, Salmonella enterica enterica serovar Typhi
gcaaauucgucgccgccaa

SEQ ID NO: 1667328 - RNA, 21 nt, Salmonella enterica enterica serovar Typhi
gcaacagcacgggaugcgccg

SEQ ID NO: 1667329 - RNA, 21 nt, Salmonella enterica enterica serovar Typhi
gcaacacuuugcgcugcgcau

SEQ ID NO: 1667330 - RNA, 19 nt, Salmonella enterica enterica serovar Typhi
gcaaaccgauaaucaccag

SEQ ID NO: 1667331 - RNA, 16 nt, Salmonella enterica enterica serovar Typhi
gauuuuuuaucucgcc

SEQ ID NO: 1667332 - RNA, 20 nt, Salmonella enterica enterica serovar Typhi
gauuuuucaucuucaguaag

SEQ ID NO: 1667333 - RNA, 23 nt, Salmonella enterica enterica serovar Typhi
gcaaacuucacauuuuuaucagc

SEQ ID NO: 1667334 - RNA, 21 nt, Salmonella enterica enterica serovar Typhi
gcaaacugcucauuauggacg

SEQ ID NO: 1667335 - RNA, 20 nt, Salmonella enterica enterica serovar Typhi
gcaaaccgauaaucaccagc

SEQ ID NO: 1667336 - RNA, 19 nt, Salmonella enterica enterica serovar Typhi
gauuucacgaucaucgcau

SEQ ID NO: 1667337 - RNA, 19 nt, Salmonella enterica enterica serovar Typhi
gauuuaucacccagagauu

SEQ ID NO: 1667338 - RNA, 18 nt, Salmonella enterica enterica serovar Typhi
gauuuucauuuagcgccu

SEQ ID NO: 1667339 - RNA, 15 nt, Salmonella enterica enterica serovar Typhi
gauuuugcguuacug

SEQ ID NO: 1667340 - RNA, 15 nt, Salmonella enterica enterica serovar Typhi
gauuuguuucaucgc

SEQ ID NO: 1667341 - RNA, 17 nt, Salmonella enterica enterica serovar Typhi
gauucgcccacggauga

SEQ ID NO: 1667342 - RNA, 20 nt, Salmonella enterica enterica serovar Typhi
gauucgcuaauaauucugua

SEQ ID NO: 1667343 - RNA, 17 nt, Salmonella enterica enterica serovar Typhi
gauugccggaagcggac

SEQ ID NO: 1667344 - RNA, 12 nt, Salmonella enterica enterica serovar Typhi
gauguucaacgu

SEQ ID NO: 1667345 - RNA, 15 nt, Salmonella enterica enterica serovar Typhi
gauuaaucagcagau

SEQ ID NO: 1667346 - RNA, 15 nt, Salmonella enterica enterica serovar Typhi
gauuaaggcguuauc

SEQ ID NO: 1667347 - RNA, 15 nt, Salmonella enterica enterica serovar Typhi
gauuaacagcgccau

SEQ ID NO: 1667348 - RNA, 21 nt, Salmonella enterica enterica serovar Typhi
gauuaacccggucauccagcg

SEQ ID NO: 1667349 - RNA, 19 nt, Salmonella enterica enterica serovar Typhi
gauucaaccaaugcaacgc

SEQ ID NO: 1667350 - RNA, 20 nt, Salmonella enterica enterica serovar Typhi
gauucagguuuugcugauca

SEQ ID NO: 1667351 - RNA, 21 nt, Salmonella enterica enterica serovar Typhi
gauucaguaagaggguggcga

SEQ ID NO: 1667352 - RNA, 16 nt, Salmonella enterica enterica serovar Typhi
gauucaggccgccagc

SEQ ID NO: 1667353 - RNA, 16 nt, Salmonella enterica enterica serovar Typhi
aacugcucguaaagca

SEQ ID NO: 1667354 - RNA, 17 nt, Salmonella enterica enterica serovar Typhi
aacuggcaaucaugcgc

SEQ ID NO: 1667355 - RNA, 13 nt, Salmonella enterica enterica serovar Typhi
aacuggcgcaucu

SEQ ID NO: 1667356 - RNA, 15 nt, Salmonella enterica enterica serovar Typhi
aacuggaagcgauca

SEQ ID NO: 1667357 - RNA, 17 nt, Salmonella enterica enterica serovar Typhi
aacuggaagcgaucaag

SEQ ID NO: 1667358 - RNA, 12 nt, Salmonella enterica enterica serovar Typhi
gaugaagcgcau

SEQ ID NO: 1667359 - RNA, 20 nt, Salmonella enterica enterica serovar Typhi
aacugcgaguucaccaguuu

SEQ ID NO: 1667360 - RNA, 14 nt, Salmonella enterica enterica serovar Typhi
gaugaaaucaccca

SEQ ID NO: 1667361 - RNA, 13 nt, Salmonella enterica enterica serovar Typhi
gaugacguccaga

SEQ ID NO: 1667362 - RNA, 22 nt, Salmonella enterica enterica serovar Typhi
gaugacgcuucgcuuauccggc

SEQ ID NO: 1667363 - RNA, 13 nt, Salmonella enterica enterica serovar Typhi
gaugagcgcgaaa

SEQ ID NO: 1667364 - RNA, 21 nt, Salmonella enterica enterica serovar Typhi
gaugagcguuagcgccauccg

SEQ ID NO: 1667365 - RNA, 21 nt, Salmonella enterica enterica serovar Typhi
gaucugacauuugcaucaaac

SEQ ID NO: 1667366 - RNA, 17 nt, Salmonella enterica enterica serovar Typhi
gaucuucaucccauccg

SEQ ID NO: 1667367 - RNA, 14 nt, Salmonella enterica enterica serovar Typhi
gaucgccgccgaau

SEQ ID NO: 1667368 - RNA, 21 nt, Salmonella enterica enterica serovar Typhi
gaucgccgucguucagccagc

SEQ ID NO: 1667369 - RNA, 18 nt, Salmonella enterica enterica serovar Typhi
gaugcacggaugcaucau

SEQ ID NO: 1667370 - RNA, 15 nt, Salmonella enterica enterica serovar Typhi
gaugccccaucacgg

SEQ ID NO: 1667371 - RNA, 23 nt, Salmonella enterica enterica serovar Typhi
gaugccaaacaucgcucgcgcca

SEQ ID NO: 1667372 - RNA, 22 nt, Salmonella enterica enterica serovar Typhi
aacugggugcggcgaacgucgc

SEQ ID NO: 1667373 - RNA, 21 nt, Salmonella enterica enterica serovar Typhi
aacugguuaccacaauaaucg

SEQ ID NO: 1667374 - RNA, 22 nt, Salmonella enterica enterica serovar Typhi
gaugaucgucgcgaucgcgcca

SEQ ID NO: 1667375 - RNA, 11 nt, Salmonella enterica enterica serovar Typhi
gaugccguaag

SEQ ID NO: 1667376 - RNA, 19 nt, Salmonella enterica enterica serovar Typhi
gaugccuuguaagccggau

SEQ ID NO: 1667377 - RNA, 20 nt, Salmonella enterica enterica serovar Typhi
gaugccuuguaagccggaua

SEQ ID NO: 1667378 - RNA, 21 nt, Salmonella enterica enterica serovar Typhi
cguccauuucaaugcauacug

SEQ ID NO: 1667379 - RNA, 16 nt, Salmonella enterica enterica serovar Typhi
cgucaucgggcuguua

SEQ ID NO: 1667380 - RNA, 13 nt, Salmonella enterica enterica serovar Typhi
cgucaugccgcca

SEQ ID NO: 1667381 - RNA, 21 nt, Salmonella enterica enterica serovar Typhi
cgucacgaaugucgcgucagg

SEQ ID NO: 1667382 - RNA, 19 nt, Salmonella enterica enterica serovar Typhi
cgucacgaaugucgcguca

SEQ ID NO: 1667383 - RNA, 18 nt, Salmonella enterica enterica serovar Typhi
cgucaccugauagcgggu

SEQ ID NO: 1667384 - RNA, 17 nt, Salmonella enterica enterica serovar Typhi
cgucacgccgacgaccg

SEQ ID NO: 1667385 - RNA, 17 nt, Salmonella enterica enterica serovar Typhi
cgucacgcaugucguau

SEQ ID NO: 1667386 - RNA, 18 nt, Salmonella enterica enterica serovar Typhi
cgucacgcguucgaccgu

SEQ ID NO: 1667387 - RNA, 18 nt, Salmonella enterica enterica serovar Typhi
cgucaucgcccagguugu

SEQ ID NO: 1667388 - RNA, 13 nt, Salmonella enterica enterica serovar Typhi
cgucgacagcgcc

SEQ ID NO: 1667389 - RNA, 21 nt, Salmonella enterica enterica serovar Typhi
cgucgcucuuuucaggcgcug

SEQ ID NO: 1667390 - RNA, 18 nt, Salmonella enterica enterica serovar Typhi
cgucgccggaaugcgaau

SEQ ID NO: 1667391 - RNA, 14 nt, Salmonella enterica enterica serovar Typhi
cgucgccagcgucu

SEQ ID NO: 1667392 - RNA, 18 nt, Salmonella enterica enterica serovar Typhi
cgucgaggaagcugcgca

SEQ ID NO: 1667393 - RNA, 19 nt, Salmonella enterica enterica serovar Typhi
cgguuugcaggccggauaa

SEQ ID NO: 1667394 - RNA, 16 nt, Salmonella enterica enterica serovar Typhi
cgguuucgcggcguuc

SEQ ID NO: 1667395 - RNA, 17 nt, Salmonella enterica enterica serovar Typhi
cgguuugcgccuacgau

SEQ ID NO: 1667396 - RNA, 19 nt, Salmonella enterica enterica serovar Typhi
cgguuaugaccaauggcgc

SEQ ID NO: 1667397 - RNA, 15 nt, Salmonella enterica enterica serovar Typhi
cgguuaugcgauuuc

SEQ ID NO: 1667398 - RNA, 19 nt, Salmonella enterica enterica serovar Typhi
cgguuaucggcaaacgggc

SEQ ID NO: 1667399 - RNA, 20 nt, Salmonella enterica enterica serovar Typhi
cgguuauccgccagcgcaac

SEQ ID NO: 1667400 - RNA, 21 nt, Salmonella enterica enterica serovar Typhi
cgguuauaccgccauccggca

SEQ ID NO: 1667401 - RNA, 18 nt, Salmonella enterica enterica serovar Typhi
cgguuagccacaaugaca

SEQ ID NO: 1667402 - RNA, 16 nt, Salmonella enterica enterica serovar Typhi
cgguuauaccgccauc

SEQ ID NO: 1667403 - RNA, 16 nt, Salmonella enterica enterica serovar Typhi
cgguucgccgcgcgca

SEQ ID NO: 1667404 - RNA, 19 nt, Salmonella enterica enterica serovar Typhi
cguaccugucguacgccua

SEQ ID NO: 1667405 - RNA, 18 nt, Salmonella enterica enterica serovar Typhi
cguaccuucauguugcgg

SEQ ID NO: 1667406 - RNA, 18 nt, Salmonella enterica enterica serovar Typhi
cguacgggcaaagcgacg

SEQ ID NO: 1667407 - RNA, 15 nt, Salmonella enterica enterica serovar Typhi
cguaccuccagcgac

SEQ ID NO: 1667408 - RNA, 16 nt, Salmonella enterica enterica serovar Typhi
cguacuuucgccaguu

SEQ ID NO: 1667409 - RNA, 16 nt, Salmonella enterica enterica serovar Typhi
cguacucuaggcgcug

SEQ ID NO: 1667410 - RNA, 22 nt, Salmonella enterica enterica serovar Typhi
cguacuaaagagcgccugaccg

SEQ ID NO: 1667411 - RNA, 20 nt, Salmonella enterica enterica serovar Typhi
cguacguuuuuccauucaca

SEQ ID NO: 1667412 - RNA, 15 nt, Salmonella enterica enterica serovar Typhi
cguaacucggcagcg

SEQ ID NO: 1667413 - RNA, 18 nt, Salmonella enterica enterica serovar Typhi
cguaauuucauagaccgc

SEQ ID NO: 1667414 - RNA, 13 nt, Salmonella enterica enterica serovar Typhi
cguacagcgccau

SEQ ID NO: 1667415 - RNA, 19 nt, Salmonella enterica enterica serovar Typhi
aacccgauaagcuuccgcc

SEQ ID NO: 1667416 - RNA, 20 nt, Salmonella enterica enterica serovar Typhi
cguagcguucauucccgcca

SEQ ID NO: 1667417 - RNA, 20 nt, Salmonella enterica enterica serovar Typhi
cguagcguaaugcagcgucu

SEQ ID NO: 1667418 - RNA, 11 nt, Salmonella enterica enterica serovar Typhi
cguagcgcguu

SEQ ID NO: 1667419 - RNA, 21 nt, Salmonella enterica enterica serovar Typhi
aacccagcaaaucgcccauca

SEQ ID NO: 1667420 - RNA, 12 nt, Salmonella enterica enterica serovar Typhi
cguagcgccaac

SEQ ID NO: 1667421 - RNA, 14 nt, Salmonella enterica enterica serovar Typhi
cguagcgccauccg

SEQ ID NO: 1667422 - RNA, 15 nt, Salmonella enterica enterica serovar Typhi
aacccauauuccugc

SEQ ID NO: 1667423 - RNA, 17 nt, Salmonella enterica enterica serovar Typhi
aacccauauuccugcgg

SEQ ID NO: 1667424 - RNA, 22 nt, Salmonella enterica enterica serovar Typhi
cguagauauuccccacgccgac

SEQ ID NO: 1667425 - RNA, 12 nt, Salmonella enterica enterica serovar Typhi
cguagaucgcca

SEQ ID NO: 1667426 - RNA, 20 nt, Salmonella enterica enterica serovar Typhi
cguaggccgaauaagacgcu

SEQ ID NO: 1667427 - RNA, 19 nt, Salmonella enterica enterica serovar Typhi
cguaggccggauaagcgca

SEQ ID NO: 1667428 - RNA, 20 nt, Salmonella enterica enterica serovar Typhi
cguaggccggauaagacgcg

SEQ ID NO: 1667429 - RNA, 20 nt, Salmonella enterica enterica serovar Typhi
cguaggccugauaagacgca

SEQ ID NO: 1667430 - RNA, 19 nt, Salmonella enterica enterica serovar Typhi
cguaggccugauaagcgca

SEQ ID NO: 1667431 - RNA, 18 nt, Salmonella enterica enterica serovar Typhi
cguaggccggauaaggcg

SEQ ID NO: 1667432 - RNA, 13 nt, Salmonella enterica enterica serovar Typhi
cguaguacguucc

SEQ ID NO: 1667433 - RNA, 15 nt, Salmonella enterica enterica serovar Typhi
cguaggcgcaaaccg

SEQ ID NO: 1667434 - RNA, 13 nt, Salmonella enterica enterica serovar Typhi
cguaguaagcgga

SEQ ID NO: 1667435 - RNA, 22 nt, Salmonella enterica enterica serovar Typhi
cguaucucgcgguugacgcugc

SEQ ID NO: 1667436 - RNA, 15 nt, Salmonella enterica enterica serovar Typhi
aacccgccgccauca

SEQ ID NO: 1667437 - RNA, 12 nt, Salmonella enterica enterica serovar Typhi
cgucaaaccggc

SEQ ID NO: 1667438 - RNA, 17 nt, Salmonella enterica enterica serovar Typhi
cgucaaaacaggucugu

SEQ ID NO: 1667439 - RNA, 13 nt, Salmonella enterica enterica serovar Typhi
cgucaaaacgcgc

SEQ ID NO: 1667440 - RNA, 19 nt, Salmonella enterica enterica serovar Typhi
cgucaccguauugccaucg

SEQ ID NO: 1667441 - RNA, 22 nt, Salmonella enterica enterica serovar Typhi
aaccgcgcggcguucugcgcca

SEQ ID NO: 1667442 - RNA, 14 nt, Salmonella enterica enterica serovar Typhi
aaccgccagucacc

SEQ ID NO: 1667443 - RNA, 18 nt, Salmonella enterica enterica serovar Typhi
aaccgcccgcggcgauca

SEQ ID NO: 1667444 - RNA, 16 nt, Salmonella enterica enterica serovar Typhi
cguggcgaucaguggc

SEQ ID NO: 1667445 - RNA, 16 nt, Salmonella enterica enterica serovar Typhi
cguggcgcaaccgaua

SEQ ID NO: 1667446 - RNA, 22 nt, Salmonella enterica enterica serovar Typhi
cguggucuccgccuggaaccca

SEQ ID NO: 1667447 - RNA, 15 nt, Salmonella enterica enterica serovar Typhi
cgugcgccgacaucg

SEQ ID NO: 1667448 - RNA, 17 nt, Salmonella enterica enterica serovar Typhi
cgugcucucaccaucau

SEQ ID NO: 1667449 - RNA, 13 nt, Salmonella enterica enterica serovar Typhi
cgugccuuccgca

SEQ ID NO: 1667450 - RNA, 18 nt, Salmonella enterica enterica serovar Typhi
cgugccggaagcgauugu

SEQ ID NO: 1667451 - RNA, 23 nt, Salmonella enterica enterica serovar Typhi
cgugccggaugauguuuauccgg

SEQ ID NO: 1667452 - RNA, 14 nt, Salmonella enterica enterica serovar Typhi
cgugccguccggca

SEQ ID NO: 1667453 - RNA, 19 nt, Salmonella enterica enterica serovar Typhi
cguguugcagcccaccggc

SEQ ID NO: 1667454 - RNA, 22 nt, Salmonella enterica enterica serovar Typhi
cguuaaaauaccgccugccgau

SEQ ID NO: 1667455 - RNA, 13 nt, Salmonella enterica enterica serovar Typhi
cguuaaacugcgc

SEQ ID NO: 1667456 - RNA, 16 nt, Salmonella enterica enterica serovar Typhi
cguuaaccagcggcga

SEQ ID NO: 1667457 - RNA, 22 nt, Salmonella enterica enterica serovar Typhi
cguuaaauagccccaacgcgcu

SEQ ID NO: 1667458 - RNA, 20 nt, Salmonella enterica enterica serovar Typhi
cguuaaauccucccaucgag

SEQ ID NO: 1667459 - RNA, 14 nt, Salmonella enterica enterica serovar Typhi
cguguucagguugg

SEQ ID NO: 1667460 - RNA, 20 nt, Salmonella enterica enterica serovar Typhi
cguguugauuaaugcgauaa

SEQ ID NO: 1667461 - RNA, 16 nt, Salmonella enterica enterica serovar Typhi
cguggugacacaauau

SEQ ID NO: 1667462 - RNA, 21 nt, Salmonella enterica enterica serovar Typhi
cguucaccagccacugcgcca

SEQ ID NO: 1667463 - RNA, 15 nt, Salmonella enterica enterica serovar Typhi
cguucacguaaucgc

SEQ ID NO: 1667464 - RNA, 22 nt, Salmonella enterica enterica serovar Typhi
cguucagcauauccagcgccug

SEQ ID NO: 1667465 - RNA, 12 nt, Salmonella enterica enterica serovar Typhi
cguucagcaucg

SEQ ID NO: 1667466 - RNA, 13 nt, Salmonella enterica enterica serovar Typhi
cguuaucucgcca

SEQ ID NO: 1667467 - RNA, 17 nt, Salmonella enterica enterica serovar Typhi
cguuaucugaccuacag

SEQ ID NO: 1667468 - RNA, 18 nt, Salmonella enterica enterica serovar Typhi
cguuaauccaaauccgca

SEQ ID NO: 1667469 - RNA, 21 nt, Salmonella enterica enterica serovar Typhi
cguuaaguagcggaaccagcc

SEQ ID NO: 1667470 - RNA, 14 nt, Salmonella enterica enterica serovar Typhi
cguuacaaauagcg

SEQ ID NO: 1667471 - RNA, 13 nt, Salmonella enterica enterica serovar Typhi
cguuaccagcauc

SEQ ID NO: 1667472 - RNA, 15 nt, Salmonella enterica enterica serovar Typhi
cguucuucgauaaag

SEQ ID NO: 1667473 - RNA, 21 nt, Salmonella enterica enterica serovar Typhi
cguucuugcccgguggcgcug

SEQ ID NO: 1667474 - RNA, 16 nt, Salmonella enterica enterica serovar Typhi
cguucugucgauaaac

SEQ ID NO: 1667475 - RNA, 18 nt, Salmonella enterica enterica serovar Typhi
cguucccgaaaauccgga

SEQ ID NO: 1667476 - RNA, 13 nt, Salmonella enterica enterica serovar Typhi
cguuccgccagau

SEQ ID NO: 1667477 - RNA, 14 nt, Salmonella enterica enterica serovar Typhi
cguugauggcguaa

SEQ ID NO: 1667478 - RNA, 24 nt, Salmonella enterica enterica serovar Typhi
cguugaccagccuaccugccgcca

SEQ ID NO: 1667479 - RNA, 21 nt, Salmonella enterica enterica serovar Typhi
cguugaauauuggcaucaagc

SEQ ID NO: 1667480 - RNA, 21 nt, Salmonella enterica enterica serovar Typhi
cgugauuuuggccucauccgc

SEQ ID NO: 1667481 - RNA, 19 nt, Salmonella enterica enterica serovar Typhi
cgugauaaagcugacgcgc

SEQ ID NO: 1667482 - RNA, 13 nt, Salmonella enterica enterica serovar Typhi
cgugacggcggaa

SEQ ID NO: 1667483 - RNA, 21 nt, Salmonella enterica enterica serovar Typhi
cgugaccgguaagcccauggc

SEQ ID NO: 1667484 - RNA, 16 nt, Salmonella enterica enterica serovar Typhi
cgugacuguucacauc

SEQ ID NO: 1667485 - RNA, 18 nt, Salmonella enterica enterica serovar Typhi
cgugagaaguaagcgcca

SEQ ID NO: 1667486 - RNA, 18 nt, Salmonella enterica enterica serovar Typhi
cgugagagaaaaucacgc

SEQ ID NO: 1667487 - RNA, 16 nt, Salmonella enterica enterica serovar Typhi
cgugagccggacacug

SEQ ID NO: 1667488 - RNA, 17 nt, Salmonella enterica enterica serovar Typhi
cgugagcuacagcguua

SEQ ID NO: 1667489 - RNA, 15 nt, Salmonella enterica enterica serovar Typhi
cgugaggcugaagcg

SEQ ID NO: 1667490 - RNA, 15 nt, Salmonella enterica enterica serovar Typhi
cgugagcgcgccgca

SEQ ID NO: 1667491 - RNA, 14 nt, Salmonella enterica enterica serovar Typhi
cgugcagaugguau

SEQ ID NO: 1667492 - RNA, 18 nt, Salmonella enterica enterica serovar Typhi
cgugcagcgugccgggau

SEQ ID NO: 1667493 - RNA, 22 nt, Salmonella enterica enterica serovar Typhi
cgucguuaacaucaucaggccu

SEQ ID NO: 1667494 - RNA, 20 nt, Salmonella enterica enterica serovar Typhi
cgucguuggcauggucagca

SEQ ID NO: 1667495 - RNA, 15 nt, Salmonella enterica enterica serovar Typhi
cgucugaugaauacg

SEQ ID NO: 1667496 - RNA, 14 nt, Salmonella enterica enterica serovar Typhi
cgucugauucaggu

SEQ ID NO: 1667497 - RNA, 14 nt, Salmonella enterica enterica serovar Typhi
cgucuggcgaaaac

SEQ ID NO: 1667498 - RNA, 14 nt, Salmonella enterica enterica serovar Typhi
cgucgugauagcca

SEQ ID NO: 1667499 - RNA, 16 nt, Salmonella enterica enterica serovar Typhi
cgugaaauauccuccg

SEQ ID NO: 1667500 - RNA, 17 nt, Salmonella enterica enterica serovar Typhi
cgugaacacgccccaca

SEQ ID NO: 1667501 - RNA, 13 nt, Salmonella enterica enterica serovar Typhi
cgugaacgccaaa

SEQ ID NO: 1667502 - RNA, 13 nt, Salmonella enterica enterica serovar Typhi
cgucuugccgcaa

SEQ ID NO: 1667503 - RNA, 18 nt, Salmonella enterica enterica serovar Typhi
cgucuucaucaacgucaa

SEQ ID NO: 1667504 - RNA, 20 nt, Salmonella enterica enterica serovar Typhi
cgucuuaaugcucuccagca

SEQ ID NO: 1667505 - RNA, 19 nt, Salmonella enterica enterica serovar Typhi
cgucugguacggccaccag

SEQ ID NO: 1667506 - RNA, 23 nt, Salmonella enterica enterica serovar Typhi
cgucuggugauccagcguagcgg

SEQ ID NO: 1667507 - RNA, 15 nt, Salmonella enterica enterica serovar Typhi
cgugaccccaggcau

SEQ ID NO: 1667508 - RNA, 21 nt, Salmonella enterica enterica serovar Typhi
cgugaauaaugaccagcgccc

SEQ ID NO: 1667509 - RNA, 20 nt, Salmonella enterica enterica serovar Typhi
cgugaaucaucaucauccgc

SEQ ID NO: 1667510 - RNA, 18 nt, Salmonella enterica enterica serovar Typhi
cgugacaccgguuugcgc

SEQ ID NO: 1667511 - RNA, 18 nt, Salmonella enterica enterica serovar Typhi
cgugaauugcgguuuauc

SEQ ID NO: 1667512 - RNA, 13 nt, Salmonella enterica enterica serovar Typhi
cgugaauggucac

SEQ ID NO: 1667513 - RNA, 11 nt, Salmonella enterica enterica serovar Typhi
cugcagccaua

SEQ ID NO: 1667514 - RNA, 13 nt, Salmonella enterica enterica serovar Typhi
cugcacuuccagc

SEQ ID NO: 1667515 - RNA, 18 nt, Salmonella enterica enterica serovar Typhi
cugcaccuuuuuuuccag

SEQ ID NO: 1667516 - RNA, 16 nt, Salmonella enterica enterica serovar Typhi
cugcacgaaauguaga

SEQ ID NO: 1667517 - RNA, 20 nt, Salmonella enterica enterica serovar Typhi
cugcaccuuuuuuuccagcg

SEQ ID NO: 1667518 - RNA, 17 nt, Salmonella enterica enterica serovar Typhi
cugauuucgccccacug

SEQ ID NO: 1667519 - RNA, 15 nt, Salmonella enterica enterica serovar Typhi
cugauuuucuccagc

SEQ ID NO: 1667520 - RNA, 22 nt, Salmonella enterica enterica serovar Typhi
cugaugguuucggcaugccacu

SEQ ID NO: 1667521 - RNA, 13 nt, Salmonella enterica enterica serovar Typhi
cugaucggccagc

SEQ ID NO: 1667522 - RNA, 13 nt, Salmonella enterica enterica serovar Typhi
cugaugaccgccg

SEQ ID NO: 1667523 - RNA, 13 nt, Salmonella enterica enterica serovar Typhi
cugaugaauacgc

SEQ ID NO: 1667524 - RNA, 18 nt, Salmonella enterica enterica serovar Typhi
cugaugccgucgacgccg

SEQ ID NO: 1667525 - RNA, 19 nt, Salmonella enterica enterica serovar Typhi
cugaugccugaaggcgcua

SEQ ID NO: 1667526 - RNA, 13 nt, Salmonella enterica enterica serovar Typhi
cugaugcaggcaa

SEQ ID NO: 1667527 - RNA, 16 nt, Salmonella enterica enterica serovar Typhi
cugaugauagcgccau

SEQ ID NO: 1667528 - RNA, 16 nt, Salmonella enterica enterica serovar Typhi
cugaugcuggcgccau

SEQ ID NO: 1667529 - RNA, 13 nt, Salmonella enterica enterica serovar Typhi
cugaugcucgccg

SEQ ID NO: 1667530 - RNA, 13 nt, Salmonella enterica enterica serovar Typhi
cugaugcugcgca

SEQ ID NO: 1667531 - RNA, 22 nt, Salmonella enterica enterica serovar Typhi
cugaugcgcguuuagcgccagc

SEQ ID NO: 1667532 - RNA, 17 nt, Salmonella enterica enterica serovar Typhi
cugauggcguggcgcag

SEQ ID NO: 1667533 - RNA, 18 nt, Salmonella enterica enterica serovar Typhi
cugauggcgcuacgcuua

SEQ ID NO: 1667534 - RNA, 13 nt, Salmonella enterica enterica serovar Typhi
cugcaucuccagc

SEQ ID NO: 1667535 - RNA, 19 nt, Salmonella enterica enterica serovar Typhi
cugcaucgugagcgcguca

SEQ ID NO: 1667536 - RNA, 15 nt, Salmonella enterica enterica serovar Typhi
cugcauuugcugccg

SEQ ID NO: 1667537 - RNA, 20 nt, Salmonella enterica enterica serovar Typhi
cugcauuauccacgaucccg

SEQ ID NO: 1667538 - RNA, 22 nt, Salmonella enterica enterica serovar Typhi
cugccacgcuuuuccuuccagc

SEQ ID NO: 1667539 - RNA, 22 nt, Salmonella enterica enterica serovar Typhi
cugccaccgcuccgcgcauccg

SEQ ID NO: 1667540 - RNA, 18 nt, Salmonella enterica enterica serovar Typhi
cugcauaaauaucugcau

SEQ ID NO: 1667541 - RNA, 15 nt, Salmonella enterica enterica serovar Typhi
cugcauaauccaacg

SEQ ID NO: 1667542 - RNA, 16 nt, Salmonella enterica enterica serovar Typhi
cugcagggugaagaug

SEQ ID NO: 1667543 - RNA, 18 nt, Salmonella enterica enterica serovar Typhi
cugcagggaauaagcgcc

SEQ ID NO: 1667544 - RNA, 17 nt, Salmonella enterica enterica serovar Typhi
cugcagggaauaagcgc

SEQ ID NO: 1667545 - RNA, 15 nt, Salmonella enterica enterica serovar Typhi
cugcagcuccgcaau

SEQ ID NO: 1667546 - RNA, 13 nt, Salmonella enterica enterica serovar Typhi
cugccaucaggca

SEQ ID NO: 1667547 - RNA, 22 nt, Salmonella enterica enterica serovar Typhi
cugccauuucugcucacgguuu

SEQ ID NO: 1667548 - RNA, 15 nt, Salmonella enterica enterica serovar Typhi
cugccagcgaaccgc

SEQ ID NO: 1667549 - RNA, 20 nt, Salmonella enterica enterica serovar Typhi
cugccagcaacggcgggaua

SEQ ID NO: 1667550 - RNA, 20 nt, Salmonella enterica enterica serovar Typhi
cugccagaacgcuguugccg

SEQ ID NO: 1667551 - RNA, 17 nt, Salmonella enterica enterica serovar Typhi
cucuuuuuccgccugau

SEQ ID NO: 1667552 - RNA, 15 nt, Salmonella enterica enterica serovar Typhi
cugaaaacaggccug

SEQ ID NO: 1667553 - RNA, 13 nt, Salmonella enterica enterica serovar Typhi
cucuuuaaagcgc

SEQ ID NO: 1667554 - RNA, 15 nt, Salmonella enterica enterica serovar Typhi
cucuggcgacgccaa

SEQ ID NO: 1667555 - RNA, 22 nt, Salmonella enterica enterica serovar Typhi
cucuggcgacgccaaucggcgu

SEQ ID NO: 1667556 - RNA, 15 nt, Salmonella enterica enterica serovar Typhi
cucuuccagcgucuc

SEQ ID NO: 1667557 - RNA, 22 nt, Salmonella enterica enterica serovar Typhi
cucuuauugcucuuccggcaua

SEQ ID NO: 1667558 - RNA, 17 nt, Salmonella enterica enterica serovar Typhi
cucggcgucaucccggu

SEQ ID NO: 1667559 - RNA, 19 nt, Salmonella enterica enterica serovar Typhi
cucuaauucccaguaaccu

SEQ ID NO: 1667560 - RNA, 19 nt, Salmonella enterica enterica serovar Typhi
cucuacgccggcgcguaau

SEQ ID NO: 1667561 - RNA, 19 nt, Salmonella enterica enterica serovar Typhi
cucucaccaucauaaagcc

SEQ ID NO: 1667562 - RNA, 13 nt, Salmonella enterica enterica serovar Typhi
cucucauauucca

SEQ ID NO: 1667563 - RNA, 20 nt, Salmonella enterica enterica serovar Typhi
cucugauuucgacgauaaaa

SEQ ID NO: 1667564 - RNA, 19 nt, Salmonella enterica enterica serovar Typhi
cucugcugugccaguaccg

SEQ ID NO: 1667565 - RNA, 15 nt, Salmonella enterica enterica serovar Typhi
cugaaccaacagcug

SEQ ID NO: 1667566 - RNA, 13 nt, Salmonella enterica enterica serovar Typhi
cugaaccagcgcc

SEQ ID NO: 1667567 - RNA, 22 nt, Salmonella enterica enterica serovar Typhi
cugaagccagcaaucagcccau

SEQ ID NO: 1667568 - RNA, 22 nt, Salmonella enterica enterica serovar Typhi
cugaagcugccgucccagcgga

SEQ ID NO: 1667569 - RNA, 12 nt, Salmonella enterica enterica serovar Typhi
cugaaggcgcuc

SEQ ID NO: 1667570 - RNA, 20 nt, Salmonella enterica enterica serovar Typhi
cugaauaaauaguauaacga

SEQ ID NO: 1667571 - RNA, 22 nt, Salmonella enterica enterica serovar Typhi
cugaaucagauacggcuccagc

SEQ ID NO: 1667572 - RNA, 17 nt, Salmonella enterica enterica serovar Typhi
cugaauagucggcugcu

SEQ ID NO: 1667573 - RNA, 16 nt, Salmonella enterica enterica serovar Typhi
cugacgccugaaaugc

SEQ ID NO: 1667574 - RNA, 14 nt, Salmonella enterica enterica serovar Typhi
cugacgcugcgccu

SEQ ID NO: 1667575 - RNA, 19 nt, Salmonella enterica enterica serovar Typhi
cugacuuacaggcuggaaa

SEQ ID NO: 1667576 - RNA, 15 nt, Salmonella enterica enterica serovar Typhi
cugacuauugcugag

SEQ ID NO: 1667577 - RNA, 15 nt, Salmonella enterica enterica serovar Typhi
cugacucaucacauc

SEQ ID NO: 1667578 - RNA, 16 nt, Salmonella enterica enterica serovar Typhi
cugaccgagaucaggc

SEQ ID NO: 1667579 - RNA, 18 nt, Salmonella enterica enterica serovar Typhi
cugaccgccccguaucau

SEQ ID NO: 1667580 - RNA, 19 nt, Salmonella enterica enterica serovar Typhi
cugacgcagcaguuccccg

SEQ ID NO: 1667581 - RNA, 18 nt, Salmonella enterica enterica serovar Typhi
cugacgcccaucagcauc

SEQ ID NO: 1667582 - RNA, 16 nt, Salmonella enterica enterica serovar Typhi
cugacgaguggcggac

SEQ ID NO: 1667583 - RNA, 17 nt, Salmonella enterica enterica serovar Typhi
cugaccuuaauccagca

SEQ ID NO: 1667584 - RNA, 21 nt, Salmonella enterica enterica serovar Typhi
cugacgaaagucauccaguac

SEQ ID NO: 1667585 - RNA, 21 nt, Salmonella enterica enterica serovar Typhi
cugauacggaaauagcgccau

SEQ ID NO: 1667586 - RNA, 17 nt, Salmonella enterica enterica serovar Typhi
cugauaagcgcagcgcc

SEQ ID NO: 1667587 - RNA, 19 nt, Salmonella enterica enterica serovar Typhi
cugauaagcauagcgccau

SEQ ID NO: 1667588 - RNA, 18 nt, Salmonella enterica enterica serovar Typhi
cugauaagcgaagcgcca

SEQ ID NO: 1667589 - RNA, 12 nt, Salmonella enterica enterica serovar Typhi
cugauaagcgca

SEQ ID NO: 1667590 - RNA, 19 nt, Salmonella enterica enterica serovar Typhi
cugauaagcgcagcgccau

SEQ ID NO: 1667591 - RNA, 12 nt, Salmonella enterica enterica serovar Typhi
cugauagcccau

SEQ ID NO: 1667592 - RNA, 21 nt, Salmonella enterica enterica serovar Typhi
cugauagcauuguauccagcc

SEQ ID NO: 1667593 - RNA, 16 nt, Salmonella enterica enterica serovar Typhi
cugauagugaucgcca

SEQ ID NO: 1667594 - RNA, 20 nt, Salmonella enterica enterica serovar Typhi
cugauaguuuaaauccagcg

SEQ ID NO: 1667595 - RNA, 13 nt, Salmonella enterica enterica serovar Typhi
cugaucaaggcgc

SEQ ID NO: 1667596 - RNA, 17 nt, Salmonella enterica enterica serovar Typhi
cugauauuuuuacugau

SEQ ID NO: 1667597 - RNA, 23 nt, Salmonella enterica enterica serovar Typhi
cugagauggcacgauaaccagau

SEQ ID NO: 1667598 - RNA, 18 nt, Salmonella enterica enterica serovar Typhi
cugagaugaccauaugcg

SEQ ID NO: 1667599 - RNA, 21 nt, Salmonella enterica enterica serovar Typhi
cugagaugaccauaugcggca

SEQ ID NO: 1667600 - RNA, 14 nt, Salmonella enterica enterica serovar Typhi
cugaggcgacaauc

SEQ ID NO: 1667601 - RNA, 19 nt, Salmonella enterica enterica serovar Typhi
cugagcugguguaauugcg

SEQ ID NO: 1667602 - RNA, 19 nt, Salmonella enterica enterica serovar Typhi
cugagcgcgagcaugugua

SEQ ID NO: 1667603 - RNA, 19 nt, Salmonella enterica enterica serovar Typhi
cugagcggcucauccagca

SEQ ID NO: 1667604 - RNA, 23 nt, Salmonella enterica enterica serovar Typhi
cugagcgcgcagcugggccugcu

SEQ ID NO: 1667605 - RNA, 16 nt, Salmonella enterica enterica serovar Typhi
cugagcgcgccaugag

SEQ ID NO: 1667606 - RNA, 22 nt, Salmonella enterica enterica serovar Typhi
cucaaugaacaguuucgccagc

SEQ ID NO: 1667607 - RNA, 17 nt, Salmonella enterica enterica serovar Typhi
cucaauggcgcgccagc

SEQ ID NO: 1667608 - RNA, 18 nt, Salmonella enterica enterica serovar Typhi
cucacgcccgcggcauga

SEQ ID NO: 1667609 - RNA, 22 nt, Salmonella enterica enterica serovar Typhi
cucaccuuuuuauuuacugccg

SEQ ID NO: 1667610 - RNA, 22 nt, Salmonella enterica enterica serovar Typhi
cucacgggcguagucagcgacg

SEQ ID NO: 1667611 - RNA, 19 nt, Salmonella enterica enterica serovar Typhi
cucacgcuuauccggccua

SEQ ID NO: 1667612 - RNA, 21 nt, Salmonella enterica enterica serovar Typhi
cucacuaucacacuggcgaua

SEQ ID NO: 1667613 - RNA, 17 nt, Salmonella enterica enterica serovar Typhi
cucacuuuucuuuccug

SEQ ID NO: 1667614 - RNA, 19 nt, Salmonella enterica enterica serovar Typhi
cucagcuaaaaacagcgca

SEQ ID NO: 1667615 - RNA, 16 nt, Salmonella enterica enterica serovar Typhi
cucagaucggcagaca

SEQ ID NO: 1667616 - RNA, 18 nt, Salmonella enterica enterica serovar Typhi
cucagcaucgcauuaacg

SEQ ID NO: 1667617 - RNA, 14 nt, Salmonella enterica enterica serovar Typhi
cucauugaucaguu

SEQ ID NO: 1667618 - RNA, 13 nt, Salmonella enterica enterica serovar Typhi
cucaggacgccag

SEQ ID NO: 1667619 - RNA, 19 nt, Salmonella enterica enterica serovar Typhi
cuccauagaaaucagcagg

SEQ ID NO: 1667620 - RNA, 14 nt, Salmonella enterica enterica serovar Typhi
cuccagaccgcugc

SEQ ID NO: 1667621 - RNA, 17 nt, Salmonella enterica enterica serovar Typhi
cuauuccucgaucgccu

SEQ ID NO: 1667622 - RNA, 17 nt, Salmonella enterica enterica serovar Typhi
cuauuucuuagcgccag

SEQ ID NO: 1667623 - RNA, 14 nt, Salmonella enterica enterica serovar Typhi
cucaagcggcacca

SEQ ID NO: 1667624 - RNA, 16 nt, Salmonella enterica enterica serovar Typhi
cucaagcuguagcguu

SEQ ID NO: 1667625 - RNA, 17 nt, Salmonella enterica enterica serovar Typhi
cucaagcccgcgucguu

SEQ ID NO: 1667626 - RNA, 22 nt, Salmonella enterica enterica serovar Typhi
cucaacguuguguccagggugu

SEQ ID NO: 1667627 - RNA, 19 nt, Salmonella enterica enterica serovar Typhi
cucaacauugccggcauca

SEQ ID NO: 1667628 - RNA, 16 nt, Salmonella enterica enterica serovar Typhi
cuaugccaggcgcaac

SEQ ID NO: 1667629 - RNA, 16 nt, Salmonella enterica enterica serovar Typhi
cuaugcuuauccggcc

SEQ ID NO: 1667630 - RNA, 22 nt, Salmonella enterica enterica serovar Typhi
cuaugcuccaguuguuccagca

SEQ ID NO: 1667631 - RNA, 14 nt, Salmonella enterica enterica serovar Typhi
cuauccagucagcg

SEQ ID NO: 1667632 - RNA, 16 nt, Salmonella enterica enterica serovar Typhi
cuauccagucagcguu

SEQ ID NO: 1667633 - RNA, 23 nt, Salmonella enterica enterica serovar Typhi
cuaucugcuucuggcuugcgcua

SEQ ID NO: 1667634 - RNA, 19 nt, Salmonella enterica enterica serovar Typhi
cuaucuucaauacgaaaac

SEQ ID NO: 1667635 - RNA, 15 nt, Salmonella enterica enterica serovar Typhi
cuacguucaucaggc

SEQ ID NO: 1667636 - RNA, 13 nt, Salmonella enterica enterica serovar Typhi
cuacguaauucau

SEQ ID NO: 1667637 - RNA, 23 nt, Salmonella enterica enterica serovar Typhi
cguugcgacaaccuguaggccgg

SEQ ID NO: 1667638 - RNA, 19 nt, Salmonella enterica enterica serovar Typhi
cguugccgccgucgccgaa

SEQ ID NO: 1667639 - RNA, 22 nt, Salmonella enterica enterica serovar Typhi
cuauauguccuuuacugcgcca

SEQ ID NO: 1667640 - RNA, 20 nt, Salmonella enterica enterica serovar Typhi
cuaucaggauucgacggcca

SEQ ID NO: 1667641 - RNA, 15 nt, Salmonella enterica enterica serovar Typhi
cuaucaguacgaccc

SEQ ID NO: 1667642 - RNA, 23 nt, Salmonella enterica enterica serovar Typhi
cuaucagguaacauaucgacaua

SEQ ID NO: 1667643 - RNA, 19 nt, Salmonella enterica enterica serovar Typhi
cuauccaccccuugcgcgu

SEQ ID NO: 1667644 - RNA, 23 nt, Salmonella enterica enterica serovar Typhi
cuauagcccacgcauaaugagcg

SEQ ID NO: 1667645 - RNA, 14 nt, Salmonella enterica enterica serovar Typhi
cuccuccagcgcgu

SEQ ID NO: 1667646 - RNA, 21 nt, Salmonella enterica enterica serovar Typhi
cuccugcgauagcugcugacg

SEQ ID NO: 1667647 - RNA, 15 nt, Salmonella enterica enterica serovar Typhi
cuccugcgccagccg

SEQ ID NO: 1667648 - RNA, 17 nt, Salmonella enterica enterica serovar Typhi
cuccuggaugcgcugaa

SEQ ID NO: 1667649 - RNA, 16 nt, Salmonella enterica enterica serovar Typhi
cuccaucuccggcagc

SEQ ID NO: 1667650 - RNA, 12 nt, Salmonella enterica enterica serovar Typhi
cuccaucgccug

SEQ ID NO: 1667651 - RNA, 13 nt, Salmonella enterica enterica serovar Typhi
cuccggaagcaua

SEQ ID NO: 1667652 - RNA, 21 nt, Salmonella enterica enterica serovar Typhi
cuccggcuuaaugcauggcag

SEQ ID NO: 1667653 - RNA, 23 nt, Salmonella enterica enterica serovar Typhi
cuccgggauagcaaucucgccaa

SEQ ID NO: 1667654 - RNA, 16 nt, Salmonella enterica enterica serovar Typhi
cuccggcacauucacc

SEQ ID NO: 1667655 - RNA, 21 nt, Salmonella enterica enterica serovar Typhi
cucgcagguacgacacccgau

SEQ ID NO: 1667656 - RNA, 18 nt, Salmonella enterica enterica serovar Typhi
cucgcccgugcauccccu

SEQ ID NO: 1667657 - RNA, 13 nt, Salmonella enterica enterica serovar Typhi
cucgcccgccaga

SEQ ID NO: 1667658 - RNA, 16 nt, Salmonella enterica enterica serovar Typhi
cucgcgcagauagagc

SEQ ID NO: 1667659 - RNA, 19 nt, Salmonella enterica enterica serovar Typhi
cucgccguuuuaucgcccg

SEQ ID NO: 1667660 - RNA, 22 nt, Salmonella enterica enterica serovar Typhi
aacggaauggcacagcgcagca

SEQ ID NO: 1667661 - RNA, 17 nt, Salmonella enterica enterica serovar Typhi
aacggacgugcgcuuca

SEQ ID NO: 1667662 - RNA, 17 nt, Salmonella enterica enterica serovar Typhi
aacggauugugaaauuc

SEQ ID NO: 1667663 - RNA, 21 nt, Salmonella enterica enterica serovar Typhi
gaccgccgaugcugaauagcc

SEQ ID NO: 1667664 - RNA, 15 nt, Salmonella enterica enterica serovar Typhi
gaccgcgaucgcugg

SEQ ID NO: 1667665 - RNA, 16 nt, Salmonella enterica enterica serovar Typhi
gaccggcgcagcgccc

SEQ ID NO: 1667666 - RNA, 11 nt, Salmonella enterica enterica serovar Typhi
gacccggcauu

SEQ ID NO: 1667667 - RNA, 23 nt, Salmonella enterica enterica serovar Typhi
aacgcggcgccgaagcaggcgga

SEQ ID NO: 1667668 - RNA, 20 nt, Salmonella enterica enterica serovar Typhi
aacgcguacggcuucaaucg

SEQ ID NO: 1667669 - RNA, 16 nt, Salmonella enterica enterica serovar Typhi
aacgcguccaacuggc

SEQ ID NO: 1667670 - RNA, 20 nt, Salmonella enterica enterica serovar Typhi
aacgcgucuucaucagccag

SEQ ID NO: 1667671 - RNA, 13 nt, Salmonella enterica enterica serovar Typhi
aacgcuaugcgcc

SEQ ID NO: 1667672 - RNA, 16 nt, Salmonella enterica enterica serovar Typhi
gacccacagccgguua

SEQ ID NO: 1667673 - RNA, 15 nt, Salmonella enterica enterica serovar Typhi
gacccgccgccagca

SEQ ID NO: 1667674 - RNA, 21 nt, Salmonella enterica enterica serovar Typhi
gaccagccuaccugccgccau

SEQ ID NO: 1667675 - RNA, 15 nt, Salmonella enterica enterica serovar Typhi
gaccagcgacggcca

SEQ ID NO: 1667676 - RNA, 15 nt, Salmonella enterica enterica serovar Typhi
gaccagcaucgccgg

SEQ ID NO: 1667677 - RNA, 22 nt, Salmonella enterica enterica serovar Typhi
aacgccuccugccgaugccgcc

SEQ ID NO: 1667678 - RNA, 22 nt, Salmonella enterica enterica serovar Typhi
aacgccguacuccagcccauca

SEQ ID NO: 1667679 - RNA, 16 nt, Salmonella enterica enterica serovar Typhi
gaccaucucuuccgcg

SEQ ID NO: 1667680 - RNA, 15 nt, Salmonella enterica enterica serovar Typhi
gaccagcgcgccaaa

SEQ ID NO: 1667681 - RNA, 14 nt, Salmonella enterica enterica serovar Typhi
aacgccagcagcgc

SEQ ID NO: 1667682 - RNA, 21 nt, Salmonella enterica enterica serovar Typhi
aacgccagaccgacgccaacc

SEQ ID NO: 1667683 - RNA, 14 nt, Salmonella enterica enterica serovar Typhi
aacgccacugccau

SEQ ID NO: 1667684 - RNA, 23 nt, Salmonella enterica enterica serovar Typhi
aacgaugaccauaaaugaaaugc

SEQ ID NO: 1667685 - RNA, 16 nt, Salmonella enterica enterica serovar Typhi
aacgauguaucgcgcg

SEQ ID NO: 1667686 - RNA, 22 nt, Salmonella enterica enterica serovar Typhi
aacgcccccugccagcgcugag

SEQ ID NO: 1667687 - RNA, 22 nt, Salmonella enterica enterica serovar Typhi
aacgccaugcucauccaacugc

SEQ ID NO: 1667688 - RNA, 14 nt, Salmonella enterica enterica serovar Typhi
aacgccgcguucgc

SEQ ID NO: 1667689 - RNA, 16 nt, Salmonella enterica enterica serovar Typhi
aacgccgccugcgcca

SEQ ID NO: 1667690 - RNA, 18 nt, Salmonella enterica enterica serovar Typhi
aacgccgccgacaugacg

SEQ ID NO: 1667691 - RNA, 13 nt, Salmonella enterica enterica serovar Typhi
aacgccgccagcu

SEQ ID NO: 1667692 - RNA, 18 nt, Salmonella enterica enterica serovar Typhi
gaccagacacggugugcc

SEQ ID NO: 1667693 - RNA, 14 nt, Salmonella enterica enterica serovar Typhi
aacgaucauugacg

SEQ ID NO: 1667694 - RNA, 13 nt, Salmonella enterica enterica serovar Typhi
gaccacccgcgac

SEQ ID NO: 1667695 - RNA, 20 nt, Salmonella enterica enterica serovar Typhi
gacaucggagauuucauccu

SEQ ID NO: 1667696 - RNA, 21 nt, Salmonella enterica enterica serovar Typhi
gaaugcucucauauuccagcc

SEQ ID NO: 1667697 - RNA, 17 nt, Salmonella enterica enterica serovar Typhi
gaaugcugacgcguuuu

SEQ ID NO: 1667698 - RNA, 15 nt, Salmonella enterica enterica serovar Typhi
gaaugcgccgucagg

SEQ ID NO: 1667699 - RNA, 11 nt, Salmonella enterica enterica serovar Typhi
gaaugcgaaua

SEQ ID NO: 1667700 - RNA, 13 nt, Salmonella enterica enterica serovar Typhi
gaauuuacgggcg

SEQ ID NO: 1667701 - RNA, 16 nt, Salmonella enterica enterica serovar Typhi
gacaaagcguggggaa

SEQ ID NO: 1667702 - RNA, 21 nt, Salmonella enterica enterica serovar Typhi
gacaaagccggauaucgcuau

SEQ ID NO: 1667703 - RNA, 16 nt, Salmonella enterica enterica serovar Typhi
gacaacguaaacggca

SEQ ID NO: 1667704 - RNA, 19 nt, Salmonella enterica enterica serovar Typhi
gacaaucuccuccggcuuc

SEQ ID NO: 1667705 - RNA, 15 nt, Salmonella enterica enterica serovar Typhi
gacaaugauuugcaa

SEQ ID NO: 1667706 - RNA, 20 nt, Salmonella enterica enterica serovar Typhi
gacaacacauccgcagcgaa

SEQ ID NO: 1667707 - RNA, 22 nt, Salmonella enterica enterica serovar Typhi
gaacugauuuguaggccugaua

SEQ ID NO: 1667708 - RNA, 22 nt, Salmonella enterica enterica serovar Typhi
gaacugcgaaaucaccgacagg

SEQ ID NO: 1667709 - RNA, 17 nt, Salmonella enterica enterica serovar Typhi
gaacugauguuccggca

SEQ ID NO: 1667710 - RNA, 17 nt, Salmonella enterica enterica serovar Typhi
gaaguuauccagcgccc

SEQ ID NO: 1667711 - RNA, 15 nt, Salmonella enterica enterica serovar Typhi
gaauaacccgcagcc

SEQ ID NO: 1667712 - RNA, 13 nt, Salmonella enterica enterica serovar Typhi
gaauaaacgguaa

SEQ ID NO: 1667713 - RNA, 19 nt, Salmonella enterica enterica serovar Typhi
gaauauugcgccacgcugu

SEQ ID NO: 1667714 - RNA, 23 nt, Salmonella enterica enterica serovar Typhi
gaauauggaaaggaugcagcauc

SEQ ID NO: 1667715 - RNA, 21 nt, Salmonella enterica enterica serovar Typhi
gaauaucggguauccauugcc

SEQ ID NO: 1667716 - RNA, 18 nt, Salmonella enterica enterica serovar Typhi
gaauaucggcgucaacgu

SEQ ID NO: 1667717 - RNA, 17 nt, Salmonella enterica enterica serovar Typhi
gaauauaacgacagccu

SEQ ID NO: 1667718 - RNA, 16 nt, Salmonella enterica enterica serovar Typhi
gaauacaaaaaagccg

SEQ ID NO: 1667719 - RNA, 20 nt, Salmonella enterica enterica serovar Typhi
gaauaguggcgcgccagcga

SEQ ID NO: 1667720 - RNA, 21 nt, Salmonella enterica enterica serovar Typhi
gaauaauguugguauauucga

SEQ ID NO: 1667721 - RNA, 19 nt, Salmonella enterica enterica serovar Typhi
gaauaagcugaaugguaaa

SEQ ID NO: 1667722 - RNA, 19 nt, Salmonella enterica enterica serovar Typhi
gaaucgcagagcguaauuc

SEQ ID NO: 1667723 - RNA, 14 nt, Salmonella enterica enterica serovar Typhi
gaaucgccagcauc

SEQ ID NO: 1667724 - RNA, 17 nt, Salmonella enterica enterica serovar Typhi
gaaucacauccgccagc

SEQ ID NO: 1667725 - RNA, 20 nt, Salmonella enterica enterica serovar Typhi
gacacgcgcgcugcgccugg

SEQ ID NO: 1667726 - RNA, 18 nt, Salmonella enterica enterica serovar Typhi
gacaccagcgucgcaugg

SEQ ID NO: 1667727 - RNA, 18 nt, Salmonella enterica enterica serovar Typhi
gacacagcguuuaacuga

SEQ ID NO: 1667728 - RNA, 20 nt, Salmonella enterica enterica serovar Typhi
gacacaacggcacaacggcc

SEQ ID NO: 1667729 - RNA, 17 nt, Salmonella enterica enterica serovar Typhi
gacaauguccgccagac

SEQ ID NO: 1667730 - RNA, 18 nt, Salmonella enterica enterica serovar Typhi
gacacaaaucuguuaucu

SEQ ID NO: 1667731 - RNA, 17 nt, Salmonella enterica enterica serovar Typhi
gacaucacguucgcgca

SEQ ID NO: 1667732 - RNA, 16 nt, Salmonella enterica enterica serovar Typhi
gacaucgcaaugccac

SEQ ID NO: 1667733 - RNA, 14 nt, Salmonella enterica enterica serovar Typhi
gacagacgcaucuu

SEQ ID NO: 1667734 - RNA, 23 nt, Salmonella enterica enterica serovar Typhi
gacagcaaguugcgccacugcca

SEQ ID NO: 1667735 - RNA, 16 nt, Salmonella enterica enterica serovar Typhi
aacgguucauccagca

SEQ ID NO: 1667736 - RNA, 14 nt, Salmonella enterica enterica serovar Typhi
gacgaucagcgcca

SEQ ID NO: 1667737 - RNA, 20 nt, Salmonella enterica enterica serovar Typhi
aacguaaacggcagccgcca

SEQ ID NO: 1667738 - RNA, 20 nt, Salmonella enterica enterica serovar Typhi
aacguaacuugauuccuggc

SEQ ID NO: 1667739 - RNA, 13 nt, Salmonella enterica enterica serovar Typhi
aacguagcgcguc

SEQ ID NO: 1667740 - RNA, 18 nt, Salmonella enterica enterica serovar Typhi
aacguaccgaugacggca

SEQ ID NO: 1667741 - RNA, 19 nt, Salmonella enterica enterica serovar Typhi
aacguaaauacccaggcca

SEQ ID NO: 1667742 - RNA, 22 nt, Salmonella enterica enterica serovar Typhi
aacguaaauacccaggccauca

SEQ ID NO: 1667743 - RNA, 14 nt, Salmonella enterica enterica serovar Typhi
aacguagcgucauc

SEQ ID NO: 1667744 - RNA, 21 nt, Salmonella enterica enterica serovar Typhi
aacgucaccucaucaacgcca

SEQ ID NO: 1667745 - RNA, 17 nt, Salmonella enterica enterica serovar Typhi
gaccugauugaccagca

SEQ ID NO: 1667746 - RNA, 12 nt, Salmonella enterica enterica serovar Typhi
aacggccagcaa

SEQ ID NO: 1667747 - RNA, 15 nt, Salmonella enterica enterica serovar Typhi
gaccuucauggcguu

SEQ ID NO: 1667748 - RNA, 18 nt, Salmonella enterica enterica serovar Typhi
gaccuucaacccagcagc

SEQ ID NO: 1667749 - RNA, 22 nt, Salmonella enterica enterica serovar Typhi
gaccuuauucccauuccugcaa

SEQ ID NO: 1667750 - RNA, 13 nt, Salmonella enterica enterica serovar Typhi
gacgaaucagcga

SEQ ID NO: 1667751 - RNA, 13 nt, Salmonella enterica enterica serovar Typhi
gacgaauaaggaa

SEQ ID NO: 1667752 - RNA, 16 nt, Salmonella enterica enterica serovar Typhi
gacgcagcuucgccgc

SEQ ID NO: 1667753 - RNA, 22 nt, Salmonella enterica enterica serovar Typhi
gacgcauugagacaugccgcca

SEQ ID NO: 1667754 - RNA, 12 nt, Salmonella enterica enterica serovar Typhi
gacgccagccga

SEQ ID NO: 1667755 - RNA, 12 nt, Salmonella enterica enterica serovar Typhi
gacgccaggcag

SEQ ID NO: 1667756 - RNA, 12 nt, Salmonella enterica enterica serovar Typhi
gacgccaggcgc

SEQ ID NO: 1667757 - RNA, 23 nt, Salmonella enterica enterica serovar Typhi
gacgauuugcgcucgcgccagau

SEQ ID NO: 1667758 - RNA, 15 nt, Salmonella enterica enterica serovar Typhi
gacgcacaaucgccg

SEQ ID NO: 1667759 - RNA, 16 nt, Salmonella enterica enterica serovar Typhi
gacgcacaaucgccgu

SEQ ID NO: 1667760 - RNA, 19 nt, Salmonella enterica enterica serovar Typhi
gacgcaccagccaggcgau

SEQ ID NO: 1667761 - RNA, 21 nt, Salmonella enterica enterica serovar Typhi
gacgccggguaaacgcagcgu

SEQ ID NO: 1667762 - RNA, 22 nt, Salmonella enterica enterica serovar Typhi
gacgccugcauaaugccggauc

SEQ ID NO: 1667763 - RNA, 13 nt, Salmonella enterica enterica serovar Typhi
gacgccuuccacu

SEQ ID NO: 1667764 - RNA, 17 nt, Salmonella enterica enterica serovar Typhi
gacgggaaaaagcgcgc

SEQ ID NO: 1667765 - RNA, 19 nt, Salmonella enterica enterica serovar Typhi
gacgggauuaaaugacgcc

SEQ ID NO: 1667766 - RNA, 19 nt, Salmonella enterica enterica serovar Typhi
gacgggggcgaucagcagg

SEQ ID NO: 1667767 - RNA, 18 nt, Salmonella enterica enterica serovar Typhi
aacgugccgaccagcggu

SEQ ID NO: 1667768 - RNA, 15 nt, Salmonella enterica enterica serovar Typhi
aacguccagcggcca

SEQ ID NO: 1667769 - RNA, 23 nt, Salmonella enterica enterica serovar Typhi
aacgucauugcgaucuccuuuaa

SEQ ID NO: 1667770 - RNA, 15 nt, Salmonella enterica enterica serovar Typhi
gacggcggccagcau

SEQ ID NO: 1667771 - RNA, 15 nt, Salmonella enterica enterica serovar Typhi
gacgcugcgcggcga

SEQ ID NO: 1667772 - RNA, 20 nt, Salmonella enterica enterica serovar Typhi
gacgcugcgcuuauccggcc

SEQ ID NO: 1667773 - RNA, 20 nt, Salmonella enterica enterica serovar Typhi
gacgcuccaucacgguaaac

SEQ ID NO: 1667774 - RNA, 17 nt, Salmonella enterica enterica serovar Typhi
gacgcugauagccacgg

SEQ ID NO: 1667775 - RNA, 17 nt, Salmonella enterica enterica serovar Typhi
gacgcuuacaucgccau

SEQ ID NO: 1667776 - RNA, 16 nt, Salmonella enterica enterica serovar Typhi
gacgcuucgcccguuc

SEQ ID NO: 1667777 - RNA, 11 nt, Salmonella enterica enterica serovar Typhi
gacggaucugg

SEQ ID NO: 1667778 - RNA, 12 nt, Salmonella enterica enterica serovar Typhi
gacggcaucagg

SEQ ID NO: 1667779 - RNA, 13 nt, Salmonella enterica enterica serovar Typhi
gacggcagcgcca

SEQ ID NO: 1667780 - RNA, 14 nt, Salmonella enterica enterica serovar Typhi
gacgcgccagccag

SEQ ID NO: 1667781 - RNA, 21 nt, Salmonella enterica enterica serovar Typhi
gacgcgauauuacuccagcgu

SEQ ID NO: 1667782 - RNA, 16 nt, Salmonella enterica enterica serovar Typhi
gacgcgguuaucucua

SEQ ID NO: 1667783 - RNA, 17 nt, Salmonella enterica enterica serovar Typhi
gacgcguaggccggaua

SEQ ID NO: 1667784 - RNA, 20 nt, Salmonella enterica enterica serovar Typhi
gacgcgguuaucucuauuga

SEQ ID NO: 1667785 - RNA, 15 nt, Salmonella enterica enterica serovar Typhi
gacgcggcuuauccg

SEQ ID NO: 1667786 - RNA, 21 nt, Salmonella enterica enterica serovar Typhi
gacgcuacgcgucgccauccg

SEQ ID NO: 1667787 - RNA, 17 nt, Salmonella enterica enterica serovar Typhi
gacgcguuuuccagcac

SEQ ID NO: 1667788 - RNA, 18 nt, Salmonella enterica enterica serovar Typhi
gacgcuaacgcuuauccg

SEQ ID NO: 1667789 - RNA, 15 nt, Salmonella enterica enterica serovar Typhi
cuuccaguagccuau

SEQ ID NO: 1667790 - RNA, 21 nt, Salmonella enterica enterica serovar Typhi
cuuccaguaguaaaccgguug

SEQ ID NO: 1667791 - RNA, 21 nt, Salmonella enterica enterica serovar Typhi
cuuccgcgguacgaaucgccg

SEQ ID NO: 1667792 - RNA, 14 nt, Salmonella enterica enterica serovar Typhi
cuucgaaacgaucg

SEQ ID NO: 1667793 - RNA, 13 nt, Salmonella enterica enterica serovar Typhi
cuucgcuggcgga

SEQ ID NO: 1667794 - RNA, 15 nt, Salmonella enterica enterica serovar Typhi
cuucgccaaucgccg

SEQ ID NO: 1667795 - RNA, 17 nt, Salmonella enterica enterica serovar Typhi
cuucgccaaucgccgcc

SEQ ID NO: 1667796 - RNA, 22 nt, Salmonella enterica enterica serovar Typhi
cuucauuggcgucugcuggcca

SEQ ID NO: 1667797 - RNA, 20 nt, Salmonella enterica enterica serovar Typhi
cuucaugccgaacagguuau

SEQ ID NO: 1667798 - RNA, 17 nt, Salmonella enterica enterica serovar Typhi
cuuccagcagccagccg

SEQ ID NO: 1667799 - RNA, 19 nt, Salmonella enterica enterica serovar Typhi
cuuccagaauggaacaaua

SEQ ID NO: 1667800 - RNA, 23 nt, Salmonella enterica enterica serovar Typhi
cuucaggcuguugcgcauucagg

SEQ ID NO: 1667801 - RNA, 22 nt, Salmonella enterica enterica serovar Typhi
cuucaggcuguugcgcauucag

SEQ ID NO: 1667802 - RNA, 12 nt, Salmonella enterica enterica serovar Typhi
cuucaucaucau

SEQ ID NO: 1667803 - RNA, 23 nt, Salmonella enterica enterica serovar Typhi
cuucauaaauagccagcaucaug

SEQ ID NO: 1667804 - RNA, 16 nt, Salmonella enterica enterica serovar Typhi
cuucaucguuacgcag

SEQ ID NO: 1667805 - RNA, 15 nt, Salmonella enterica enterica serovar Typhi
cuucauccggcguug

SEQ ID NO: 1667806 - RNA, 16 nt, Salmonella enterica enterica serovar Typhi
cuucaucccauccggg

SEQ ID NO: 1667807 - RNA, 19 nt, Salmonella enterica enterica serovar Typhi
cuucaaccuuuaucuguug

SEQ ID NO: 1667808 - RNA, 20 nt, Salmonella enterica enterica serovar Typhi
cuucaagcuggugcuuuaug

SEQ ID NO: 1667809 - RNA, 17 nt, Salmonella enterica enterica serovar Typhi
cuucaacagcucgccau

SEQ ID NO: 1667810 - RNA, 18 nt, Salmonella enterica enterica serovar Typhi
cuucaacccagcagcaga

SEQ ID NO: 1667811 - RNA, 22 nt, Salmonella enterica enterica serovar Typhi
cuuaugaaaccccaaaucagca

SEQ ID NO: 1667812 - RNA, 12 nt, Salmonella enterica enterica serovar Typhi
cuuauuacgcaa

SEQ ID NO: 1667813 - RNA, 21 nt, Salmonella enterica enterica serovar Typhi
cuucaaucgucguuccgccag

SEQ ID NO: 1667814 - RNA, 15 nt, Salmonella enterica enterica serovar Typhi
cuucagccagacgcu

SEQ ID NO: 1667815 - RNA, 15 nt, Salmonella enterica enterica serovar Typhi
cuucagcguugcuau

SEQ ID NO: 1667816 - RNA, 13 nt, Salmonella enterica enterica serovar Typhi
cuucaggagaccu

SEQ ID NO: 1667817 - RNA, 16 nt, Salmonella enterica enterica serovar Typhi
cuguaccuuaaccggg

SEQ ID NO: 1667818 - RNA, 15 nt, Salmonella enterica enterica serovar Typhi
cuguauaaauaaccg

SEQ ID NO: 1667819 - RNA, 14 nt, Salmonella enterica enterica serovar Typhi
cuguagggucgccg

SEQ ID NO: 1667820 - RNA, 12 nt, Salmonella enterica enterica serovar Typhi
cugugaucgaau

SEQ ID NO: 1667821 - RNA, 15 nt, Salmonella enterica enterica serovar Typhi
cugucgcucgcggca

SEQ ID NO: 1667822 - RNA, 16 nt, Salmonella enterica enterica serovar Typhi
cugucaucaaugagcg

SEQ ID NO: 1667823 - RNA, 17 nt, Salmonella enterica enterica serovar Typhi
cugucgccgcguaaauc

SEQ ID NO: 1667824 - RNA, 13 nt, Salmonella enterica enterica serovar Typhi
cugucaucaucaa

SEQ ID NO: 1667825 - RNA, 16 nt, Salmonella enterica enterica serovar Typhi
cuguuucaacgcaucc

SEQ ID NO: 1667826 - RNA, 21 nt, Salmonella enterica enterica serovar Typhi
cuguuuguuuauugugcacag

SEQ ID NO: 1667827 - RNA, 16 nt, Salmonella enterica enterica serovar Typhi
cuguuuccaguuaccg

SEQ ID NO: 1667828 - RNA, 16 nt, Salmonella enterica enterica serovar Typhi
cuguucaagcaauaau

SEQ ID NO: 1667829 - RNA, 15 nt, Salmonella enterica enterica serovar Typhi
cuguuaugggucgcu

SEQ ID NO: 1667830 - RNA, 18 nt, Salmonella enterica enterica serovar Typhi
cugugcuaugauaagccu

SEQ ID NO: 1667831 - RNA, 19 nt, Salmonella enterica enterica serovar Typhi
cuguggaaacuccagcggc

SEQ ID NO: 1667832 - RNA, 23 nt, Salmonella enterica enterica serovar Typhi
aaccggcguuccgcccaggcggg

SEQ ID NO: 1667833 - RNA, 13 nt, Salmonella enterica enterica serovar Typhi
aaccggccccauc

SEQ ID NO: 1667834 - RNA, 22 nt, Salmonella enterica enterica serovar Typhi
aaccggcccagcuuaguaaccc

SEQ ID NO: 1667835 - RNA, 22 nt, Salmonella enterica enterica serovar Typhi
cuuaucguuaaggccugcgcga

SEQ ID NO: 1667836 - RNA, 13 nt, Salmonella enterica enterica serovar Typhi
cuuaucuugcgca

SEQ ID NO: 1667837 - RNA, 19 nt, Salmonella enterica enterica serovar Typhi
cuuaucuuucagcgccgga

SEQ ID NO: 1667838 - RNA, 20 nt, Salmonella enterica enterica serovar Typhi
cuuaaacgccggauuccaga

SEQ ID NO: 1667839 - RNA, 23 nt, Salmonella enterica enterica serovar Typhi
cuuaaaccaccauacccaguagc

SEQ ID NO: 1667840 - RNA, 15 nt, Salmonella enterica enterica serovar Typhi
cuuaaaccugcgccg

SEQ ID NO: 1667841 - RNA, 22 nt, Salmonella enterica enterica serovar Typhi
cuuaacgcccgcgucuucaucg

SEQ ID NO: 1667842 - RNA, 20 nt, Salmonella enterica enterica serovar Typhi
cuggcggaauccaucccccu

SEQ ID NO: 1667843 - RNA, 14 nt, Salmonella enterica enterica serovar Typhi
cuggcucggccugu

SEQ ID NO: 1667844 - RNA, 16 nt, Salmonella enterica enterica serovar Typhi
cuggguugauaccgga

SEQ ID NO: 1667845 - RNA, 13 nt, Salmonella enterica enterica serovar Typhi
cuggucacgguuu

SEQ ID NO: 1667846 - RNA, 15 nt, Salmonella enterica enterica serovar Typhi
cuggucagcgcgcca

SEQ ID NO: 1667847 - RNA, 17 nt, Salmonella enterica enterica serovar Typhi
cuggucaggugauugcc

SEQ ID NO: 1667848 - RNA, 15 nt, Salmonella enterica enterica serovar Typhi
cugggaauaggccgc

SEQ ID NO: 1667849 - RNA, 18 nt, Salmonella enterica enterica serovar Typhi
cuggaucauacauaaccg

SEQ ID NO: 1667850 - RNA, 20 nt, Salmonella enterica enterica serovar Typhi
cuggagguuauccugaaagg

SEQ ID NO: 1667851 - RNA, 23 nt, Salmonella enterica enterica serovar Typhi
cuggauagcaccauaaacggcac

SEQ ID NO: 1667852 - RNA, 14 nt, Salmonella enterica enterica serovar Typhi
cugcccguuacgca

SEQ ID NO: 1667853 - RNA, 13 nt, Salmonella enterica enterica serovar Typhi
cuggccacgccga

SEQ ID NO: 1667854 - RNA, 21 nt, Salmonella enterica enterica serovar Typhi
cuggcgaaagcgaccggcacu

SEQ ID NO: 1667855 - RNA, 18 nt, Salmonella enterica enterica serovar Typhi
cuggcgagaauagaagcc

SEQ ID NO: 1667856 - RNA, 20 nt, Salmonella enterica enterica serovar Typhi
cuggcgcaacuggcgccgga

SEQ ID NO: 1667857 - RNA, 14 nt, Salmonella enterica enterica serovar Typhi
cuggcgcccgguuc

SEQ ID NO: 1667858 - RNA, 22 nt, Salmonella enterica enterica serovar Typhi
cuuuacuguugccuuugcgcgc

SEQ ID NO: 1667859 - RNA, 17 nt, Salmonella enterica enterica serovar Typhi
cuuuacuucuuugcgau

SEQ ID NO: 1667860 - RNA, 12 nt, Salmonella enterica enterica serovar Typhi
cuuuagggcgcu

SEQ ID NO: 1667861 - RNA, 14 nt, Salmonella enterica enterica serovar Typhi
cuuuacaccccacu

SEQ ID NO: 1667862 - RNA, 19 nt, Salmonella enterica enterica serovar Typhi
cuuuacccuuacggccacu

SEQ ID NO: 1667863 - RNA, 18 nt, Salmonella enterica enterica serovar Typhi
cuuuaaucaccugccagg

SEQ ID NO: 1667864 - RNA, 19 nt, Salmonella enterica enterica serovar Typhi
cuugugcaguggccagaau

SEQ ID NO: 1667865 - RNA, 19 nt, Salmonella enterica enterica serovar Typhi
cuuuaaaugccuguuuaua

SEQ ID NO: 1667866 - RNA, 14 nt, Salmonella enterica enterica serovar Typhi
cuuuaaauucagca

SEQ ID NO: 1667867 - RNA, 23 nt, Salmonella enterica enterica serovar Typhi
aaccgucgggcgucgccugccag

SEQ ID NO: 1667868 - RNA, 16 nt, Salmonella enterica enterica serovar Typhi
aaccguucuuccuggg

SEQ ID NO: 1667869 - RNA, 16 nt, Salmonella enterica enterica serovar Typhi
aaccguugcgcccauc

SEQ ID NO: 1667870 - RNA, 17 nt, Salmonella enterica enterica serovar Typhi
aaccguugcgcccauca

SEQ ID NO: 1667871 - RNA, 20 nt, Salmonella enterica enterica serovar Typhi
cuuucagaccaaauucagcg

SEQ ID NO: 1667872 - RNA, 21 nt, Salmonella enterica enterica serovar Typhi
aaccgucggcgccggcgucga

SEQ ID NO: 1667873 - RNA, 21 nt, Salmonella enterica enterica serovar Typhi
aaccguccacauccagcgcca

SEQ ID NO: 1667874 - RNA, 15 nt, Salmonella enterica enterica serovar Typhi
cuuucaccagcgcca

SEQ ID NO: 1667875 - RNA, 16 nt, Salmonella enterica enterica serovar Typhi
cuuucaccagcgccag

SEQ ID NO: 1667876 - RNA, 16 nt, Salmonella enterica enterica serovar Typhi
cuuucacgaaaccggc

SEQ ID NO: 1667877 - RNA, 20 nt, Salmonella enterica enterica serovar Typhi
cuuucacgaaaccggcgaug

SEQ ID NO: 1667878 - RNA, 21 nt, Salmonella enterica enterica serovar Typhi
cuuuaucacuccuuaggccgu

SEQ ID NO: 1667879 - RNA, 23 nt, Salmonella enterica enterica serovar Typhi
cuuuaucaaacaaaccaaacuga

SEQ ID NO: 1667880 - RNA, 21 nt, Salmonella enterica enterica serovar Typhi
cuucgguuucguuaaucggca

SEQ ID NO: 1667881 - RNA, 14 nt, Salmonella enterica enterica serovar Typhi
cuucguuggcgcug

SEQ ID NO: 1667882 - RNA, 17 nt, Salmonella enterica enterica serovar Typhi
cuucguuagcggcguug

SEQ ID NO: 1667883 - RNA, 23 nt, Salmonella enterica enterica serovar Typhi
cuugcuggguuaacgcgccaucu

SEQ ID NO: 1667884 - RNA, 17 nt, Salmonella enterica enterica serovar Typhi
cuuggcguuaaagacgc

SEQ ID NO: 1667885 - RNA, 21 nt, Salmonella enterica enterica serovar Typhi
cuuggcguuaaagacgccagu

SEQ ID NO: 1667886 - RNA, 14 nt, Salmonella enterica enterica serovar Typhi
cuuucugguaaccg

SEQ ID NO: 1667887 - RNA, 23 nt, Salmonella enterica enterica serovar Typhi
cuuucugagccgcccggcgcgcu

SEQ ID NO: 1667888 - RNA, 18 nt, Salmonella enterica enterica serovar Typhi
cuuucgacagucgguaac

SEQ ID NO: 1667889 - RNA, 13 nt, Salmonella enterica enterica serovar Typhi
cuuuccugcaaau

SEQ ID NO: 1667890 - RNA, 15 nt, Salmonella enterica enterica serovar Typhi
cuuuccguacgguuu

SEQ ID NO: 1667891 - RNA, 17 nt, Salmonella enterica enterica serovar Typhi
cuuuccagcucaaccgc

SEQ ID NO: 1667892 - RNA, 17 nt, Salmonella enterica enterica serovar Typhi
cuuucauucgucaaauu

SEQ ID NO: 1667893 - RNA, 15 nt, Salmonella enterica enterica serovar Typhi
cuuuccagucaacga

SEQ ID NO: 1667894 - RNA, 22 nt, Salmonella enterica enterica serovar Typhi
cuuugucaccggaguuaccauc

SEQ ID NO: 1667895 - RNA, 17 nt, Salmonella enterica enterica serovar Typhi
cuuuggacggcaucagg

SEQ ID NO: 1667896 - RNA, 18 nt, Salmonella enterica enterica serovar Typhi
cuuugcuuauccggccua

SEQ ID NO: 1667897 - RNA, 22 nt, Salmonella enterica enterica serovar Typhi
cuuuggcgcccauuucguuaau

SEQ ID NO: 1667898 - RNA, 16 nt, Salmonella enterica enterica serovar Typhi
cuuugcuuauccggcc

SEQ ID NO: 1667899 - RNA, 17 nt, Salmonella enterica enterica serovar Typhi
cuuugcgauuuguccgc

SEQ ID NO: 1667900 - RNA, 18 nt, Salmonella enterica enterica serovar Typhi
cuuugaaaaucacaucgc

SEQ ID NO: 1667901 - RNA, 17 nt, Salmonella enterica enterica serovar Typhi
cuuugcccgucgccgau

SEQ ID NO: 1667902 - RNA, 18 nt, Salmonella enterica enterica serovar Typhi
cuuuuggcgacaggcgcu

SEQ ID NO: 1667903 - RNA, 14 nt, Salmonella enterica enterica serovar Typhi
cuuuugauacucug

SEQ ID NO: 1667904 - RNA, 16 nt, Salmonella enterica enterica serovar Typhi
cuuuugcuacgucgcc

SEQ ID NO: 1667905 - RNA, 19 nt, Salmonella enterica enterica serovar Typhi
cuuuuccucgucauaucug

SEQ ID NO: 1667906 - RNA, 13 nt, Salmonella enterica enterica serovar Typhi
gaaaacuccagca

SEQ ID NO: 1667907 - RNA, 20 nt, Salmonella enterica enterica serovar Typhi
gaaaacgggugaucugcgcc

SEQ ID NO: 1667908 - RNA, 22 nt, Salmonella enterica enterica serovar Typhi
gaaaacgcccgccgcgaccagc

SEQ ID NO: 1667909 - RNA, 23 nt, Salmonella enterica enterica serovar Typhi
gaaaacgcccgccgcgaccagca

SEQ ID NO: 1667910 - RNA, 16 nt, Salmonella enterica enterica serovar Typhi
gaaaaccguccacauc

SEQ ID NO: 1667911 - RNA, 18 nt, Salmonella enterica enterica serovar Typhi
gaaaaccguacucgcugg

SEQ ID NO: 1667912 - RNA, 22 nt, Salmonella enterica enterica serovar Typhi
gaaaaauaagagggcgccaugc

SEQ ID NO: 1667913 - RNA, 20 nt, Salmonella enterica enterica serovar Typhi
gaaaacaucgcuccggcauc

SEQ ID NO: 1667914 - RNA, 14 nt, Salmonella enterica enterica serovar Typhi
gaaaaaagcagcau

SEQ ID NO: 1667915 - RNA, 15 nt, Salmonella enterica enterica serovar Typhi
gaaaaaagcagcauc

SEQ ID NO: 1667916 - RNA, 17 nt, Salmonella enterica enterica serovar Typhi
cuuuuugcgacacgcug

SEQ ID NO: 1667917 - RNA, 18 nt, Salmonella enterica enterica serovar Typhi
gaacgcugguuucggcau

SEQ ID NO: 1667918 - RNA, 21 nt, Salmonella enterica enterica serovar Typhi
gaacggggaccaugauaucgc

SEQ ID NO: 1667919 - RNA, 22 nt, Salmonella enterica enterica serovar Typhi
gaacucagcuaaaaacagcgca

SEQ ID NO: 1667920 - RNA, 18 nt, Salmonella enterica enterica serovar Typhi
gaaccauggcaacaugga

SEQ ID NO: 1667921 - RNA, 13 nt, Salmonella enterica enterica serovar Typhi
gaaccagcggcac

SEQ ID NO: 1667922 - RNA, 17 nt, Salmonella enterica enterica serovar Typhi
gaacagcgucgccaaua

SEQ ID NO: 1667923 - RNA, 13 nt, Salmonella enterica enterica serovar Typhi
gaaccgacggugc

SEQ ID NO: 1667924 - RNA, 14 nt, Salmonella enterica enterica serovar Typhi
aaccucucaccgcc

SEQ ID NO: 1667925 - RNA, 16 nt, Salmonella enterica enterica serovar Typhi
aaccucuuuuuccgcc

SEQ ID NO: 1667926 - RNA, 18 nt, Salmonella enterica enterica serovar Typhi
gaaaaguguguaccagca

SEQ ID NO: 1667927 - RNA, 21 nt, Salmonella enterica enterica serovar Typhi
gaaaagcgggggcgacagccc

SEQ ID NO: 1667928 - RNA, 16 nt, Salmonella enterica enterica serovar Typhi
gaaaagcgcuggcugg

SEQ ID NO: 1667929 - RNA, 21 nt, Salmonella enterica enterica serovar Typhi
gaaaagccggaugugagcgca

SEQ ID NO: 1667930 - RNA, 14 nt, Salmonella enterica enterica serovar Typhi
gaaaagccggaaua

SEQ ID NO: 1667931 - RNA, 18 nt, Salmonella enterica enterica serovar Typhi
aaccuguaggccggauaa

SEQ ID NO: 1667932 - RNA, 21 nt, Salmonella enterica enterica serovar Typhi
aaccuguucagccguuucaac

SEQ ID NO: 1667933 - RNA, 15 nt, Salmonella enterica enterica serovar Typhi
gaaaauauacaccug

SEQ ID NO: 1667934 - RNA, 22 nt, Salmonella enterica enterica serovar Typhi
aaccuuuuuauggcccgccagc

SEQ ID NO: 1667935 - RNA, 19 nt, Salmonella enterica enterica serovar Typhi
gaaaaugcccgacgcgccg

SEQ ID NO: 1667936 - RNA, 18 nt, Salmonella enterica enterica serovar Typhi
gaaaaucuggcgagagca

SEQ ID NO: 1667937 - RNA, 14 nt, Salmonella enterica enterica serovar Typhi
gaaaauccggaauc

SEQ ID NO: 1667938 - RNA, 16 nt, Salmonella enterica enterica serovar Typhi
gaaacaggcugacaaa

SEQ ID NO: 1667939 - RNA, 22 nt, Salmonella enterica enterica serovar Typhi
gaaaccagauaucccgccaaac

SEQ ID NO: 1667940 - RNA, 20 nt, Salmonella enterica enterica serovar Typhi
gaaacaagaagcacgacaca

SEQ ID NO: 1667941 - RNA, 15 nt, Salmonella enterica enterica serovar Typhi
gaaaauuccuggauu

SEQ ID NO: 1667942 - RNA, 14 nt, Salmonella enterica enterica serovar Typhi
gaaacccgccaccg

SEQ ID NO: 1667943 - RNA, 21 nt, Salmonella enterica enterica serovar Typhi
gaaacgguuaaaaacagccag

SEQ ID NO: 1667944 - RNA, 17 nt, Salmonella enterica enterica serovar Typhi
gaaacguagcguucauu

SEQ ID NO: 1667945 - RNA, 21 nt, Salmonella enterica enterica serovar Typhi
gaaauaccuaacucuuccgca

SEQ ID NO: 1667946 - RNA, 19 nt, Salmonella enterica enterica serovar Typhi
gaaaugcagggauccugua

SEQ ID NO: 1667947 - RNA, 15 nt, Salmonella enterica enterica serovar Typhi
gaaaucaagcgguuu

SEQ ID NO: 1667948 - RNA, 15 nt, Salmonella enterica enterica serovar Typhi
gaaauauuucacguu

SEQ ID NO: 1667949 - RNA, 21 nt, Salmonella enterica enterica serovar Typhi
gaacaaagccccgggcgcugg

SEQ ID NO: 1667950 - RNA, 17 nt, Salmonella enterica enterica serovar Typhi
gaaauguaggccggaua

SEQ ID NO: 1667951 - RNA, 16 nt, Salmonella enterica enterica serovar Typhi
gaaauuccuuccggcg

SEQ ID NO: 1667952 - RNA, 13 nt, Salmonella enterica enterica serovar Typhi
gaaauuaaucagg

SEQ ID NO: 1667953 - RNA, 17 nt, Salmonella enterica enterica serovar Typhi
gaaaugucuggcgcuaa

SEQ ID NO: 1667954 - RNA, 13 nt, Salmonella enterica enterica serovar Typhi
gcgcggucaacgu

SEQ ID NO: 1667955 - RNA, 15 nt, Salmonella enterica enterica serovar Typhi
gcgcgguuuccggua

SEQ ID NO: 1667956 - RNA, 13 nt, Salmonella enterica enterica serovar Typhi
gcgcguauccgcc

SEQ ID NO: 1667957 - RNA, 14 nt, Salmonella enterica enterica serovar Typhi
gcgcgucagcgccu

SEQ ID NO: 1667958 - RNA, 17 nt, Salmonella enterica enterica serovar Typhi
gcgcggcguucugcgcc

SEQ ID NO: 1667959 - RNA, 18 nt, Salmonella enterica enterica serovar Typhi
gcgcggcggguugaugau

SEQ ID NO: 1667960 - RNA, 17 nt, Salmonella enterica enterica serovar Typhi
gcgcggcgaaauaggcc

SEQ ID NO: 1667961 - RNA, 17 nt, Salmonella enterica enterica serovar Typhi
gcgcggccugcgccagg

SEQ ID NO: 1667962 - RNA, 23 nt, Salmonella enterica enterica serovar Typhi
gcgcguccacggcgggacgcugc

SEQ ID NO: 1667963 - RNA, 20 nt, Salmonella enterica enterica serovar Typhi
gcgcguccgccuuugacgcc

SEQ ID NO: 1667964 - RNA, 18 nt, Salmonella enterica enterica serovar Typhi
gcgcgucgaaugacgcgc

SEQ ID NO: 1667965 - RNA, 15 nt, Salmonella enterica enterica serovar Typhi
gcgcguuuagcgcca

SEQ ID NO: 1667966 - RNA, 15 nt, Salmonella enterica enterica serovar Typhi
gcgcguucgccguca

SEQ ID NO: 1667967 - RNA, 22 nt, Salmonella enterica enterica serovar Typhi
gcgcuccagaccaccagcgaca

SEQ ID NO: 1667968 - RNA, 12 nt, Salmonella enterica enterica serovar Typhi
gcgcucaucagg

SEQ ID NO: 1667969 - RNA, 15 nt, Salmonella enterica enterica serovar Typhi
gcgcucaucaggccu

SEQ ID NO: 1667970 - RNA, 22 nt, Salmonella enterica enterica serovar Typhi
gcgcucagggucagaauacaga

SEQ ID NO: 1667971 - RNA, 20 nt, Salmonella enterica enterica serovar Typhi
gcgcucauacgaucgcgcac

SEQ ID NO: 1667972 - RNA, 20 nt, Salmonella enterica enterica serovar Typhi
gcgcucaugcgccuggcggu

SEQ ID NO: 1667973 - RNA, 18 nt, Salmonella enterica enterica serovar Typhi
gcgcuccgacaaacuuca

SEQ ID NO: 1667974 - RNA, 14 nt, Salmonella enterica enterica serovar Typhi
gcgcuccgacugaa

SEQ ID NO: 1667975 - RNA, 14 nt, Salmonella enterica enterica serovar Typhi
gcgcuauccggcau

SEQ ID NO: 1667976 - RNA, 13 nt, Salmonella enterica enterica serovar Typhi
gcgcuauccggcc

SEQ ID NO: 1667977 - RNA, 14 nt, Salmonella enterica enterica serovar Typhi
gcgcucaaucagaa

SEQ ID NO: 1667978 - RNA, 23 nt, Salmonella enterica enterica serovar Typhi
gcgcuaucaggaagaacacgccg

SEQ ID NO: 1667979 - RNA, 15 nt, Salmonella enterica enterica serovar Typhi
gcgcuaucaggcacu

SEQ ID NO: 1667980 - RNA, 13 nt, Salmonella enterica enterica serovar Typhi
gcgcuauccggca

SEQ ID NO: 1667981 - RNA, 21 nt, Salmonella enterica enterica serovar Typhi
gcgcucacgcuuauccggccu

SEQ ID NO: 1667982 - RNA, 19 nt, Salmonella enterica enterica serovar Typhi
gcgcucaccuccgccacua

SEQ ID NO: 1667983 - RNA, 13 nt, Salmonella enterica enterica serovar Typhi
gcgcuaaaccggc

SEQ ID NO: 1667984 - RNA, 12 nt, Salmonella enterica enterica serovar Typhi
gcgcuaccagcg

SEQ ID NO: 1667985 - RNA, 15 nt, Salmonella enterica enterica serovar Typhi
gcgcuaacggcggua

SEQ ID NO: 1667986 - RNA, 13 nt, Salmonella enterica enterica serovar Typhi
gcgcuacauccgc

SEQ ID NO: 1667987 - RNA, 19 nt, Salmonella enterica enterica serovar Typhi
gcgcuagcgcuuacccgac

SEQ ID NO: 1667988 - RNA, 22 nt, Salmonella enterica enterica serovar Typhi
gcgcuagcuuaucgggccuacc

SEQ ID NO: 1667989 - RNA, 20 nt, Salmonella enterica enterica serovar Typhi
gcgcuacgcuuaucaggccu

SEQ ID NO: 1667990 - RNA, 18 nt, Salmonella enterica enterica serovar Typhi
gcgcgcgaugguaggccu

SEQ ID NO: 1667991 - RNA, 14 nt, Salmonella enterica enterica serovar Typhi
gcgcgccugccgcc

SEQ ID NO: 1667992 - RNA, 13 nt, Salmonella enterica enterica serovar Typhi
gcgcggcagccgg

SEQ ID NO: 1667993 - RNA, 15 nt, Salmonella enterica enterica serovar Typhi
gcgcggcagaccggc

SEQ ID NO: 1667994 - RNA, 16 nt, Salmonella enterica enterica serovar Typhi
gcgcggcaucauuuac

SEQ ID NO: 1667995 - RNA, 14 nt, Salmonella enterica enterica serovar Typhi
gcgcggcaucgccg

SEQ ID NO: 1667996 - RNA, 16 nt, Salmonella enterica enterica serovar Typhi
gcgcgcuggugucgcc

SEQ ID NO: 1667997 - RNA, 13 nt, Salmonella enterica enterica serovar Typhi
gcgcgcugagcgg

SEQ ID NO: 1667998 - RNA, 22 nt, Salmonella enterica enterica serovar Typhi
gcgcgccagcgauuccgucagg

SEQ ID NO: 1667999 - RNA, 20 nt, Salmonella enterica enterica serovar Typhi
gcgcgccagcgauuccguca

SEQ ID NO: 1668000 - RNA, 21 nt, Salmonella enterica enterica serovar Typhi
gcgcgcccaguccuuccggcg

SEQ ID NO: 1668001 - RNA, 18 nt, Salmonella enterica enterica serovar Typhi
gcgcgaauaaugcguccg

SEQ ID NO: 1668002 - RNA, 21 nt, Salmonella enterica enterica serovar Typhi
gcgcgaauaaugcguccgcca

SEQ ID NO: 1668003 - RNA, 22 nt, Salmonella enterica enterica serovar Typhi
gcgcgaaucgccucuucgaccg

SEQ ID NO: 1668004 - RNA, 20 nt, Salmonella enterica enterica serovar Typhi
gcgcgaaucgacaauccgcc

SEQ ID NO: 1668005 - RNA, 22 nt, Salmonella enterica enterica serovar Typhi
gcgcgacaauauucacgcgaau

SEQ ID NO: 1668006 - RNA, 21 nt, Salmonella enterica enterica serovar Typhi
gcgcgacgacgccagccagcc

SEQ ID NO: 1668007 - RNA, 15 nt, Salmonella enterica enterica serovar Typhi
gcgcgacgccgcaua

SEQ ID NO: 1668008 - RNA, 23 nt, Salmonella enterica enterica serovar Typhi
gcgcgccaaaguuaaucagcgcc

SEQ ID NO: 1668009 - RNA, 20 nt, Salmonella enterica enterica serovar Typhi
gcgcgaucgccccgaccagg

SEQ ID NO: 1668010 - RNA, 15 nt, Salmonella enterica enterica serovar Typhi
gcgccauuuccagcc

SEQ ID NO: 1668011 - RNA, 12 nt, Salmonella enterica enterica serovar Typhi
gcgcccaggcca

SEQ ID NO: 1668012 - RNA, 14 nt, Salmonella enterica enterica serovar Typhi
gcgcccaucaucau

SEQ ID NO: 1668013 - RNA, 13 nt, Salmonella enterica enterica serovar Typhi
gcgccauccggca

SEQ ID NO: 1668014 - RNA, 16 nt, Salmonella enterica enterica serovar Typhi
gcgccauccggcacau

SEQ ID NO: 1668015 - RNA, 14 nt, Salmonella enterica enterica serovar Typhi
gcgccaucaggcau

SEQ ID NO: 1668016 - RNA, 13 nt, Salmonella enterica enterica serovar Typhi
gcgccaucauccg

SEQ ID NO: 1668017 - RNA, 19 nt, Salmonella enterica enterica serovar Typhi
gcgccaucaugcagccggc

SEQ ID NO: 1668018 - RNA, 13 nt, Salmonella enterica enterica serovar Typhi
gcgccaucaggcu

SEQ ID NO: 1668019 - RNA, 22 nt, Salmonella enterica enterica serovar Typhi
gcgccagaaagguauuaaguga

SEQ ID NO: 1668020 - RNA, 16 nt, Salmonella enterica enterica serovar Typhi
gcgccgaucaucccgc

SEQ ID NO: 1668021 - RNA, 14 nt, Salmonella enterica enterica serovar Typhi
gcgcccuuccguca

SEQ ID NO: 1668022 - RNA, 14 nt, Salmonella enterica enterica serovar Typhi
gcgcccgccgccaa

SEQ ID NO: 1668023 - RNA, 14 nt, Salmonella enterica enterica serovar Typhi
gcgccgucauccgc

SEQ ID NO: 1668024 - RNA, 15 nt, Salmonella enterica enterica serovar Typhi
gcgccgucagcgguu

SEQ ID NO: 1668025 - RNA, 17 nt, Salmonella enterica enterica serovar Typhi
gcgccggaugacggcag

SEQ ID NO: 1668026 - RNA, 14 nt, Salmonella enterica enterica serovar Typhi
gcgccgccauccgg

SEQ ID NO: 1668027 - RNA, 17 nt, Salmonella enterica enterica serovar Typhi
gcgccgcaggccggaua

SEQ ID NO: 1668028 - RNA, 20 nt, Salmonella enterica enterica serovar Typhi
gcgccgcaggccggauaaga

SEQ ID NO: 1668029 - RNA, 20 nt, Salmonella enterica enterica serovar Typhi
gcgcaggccgucaaaccggc

SEQ ID NO: 1668030 - RNA, 20 nt, Salmonella enterica enterica serovar Typhi
gcgcagcugggccugcuccg

SEQ ID NO: 1668031 - RNA, 21 nt, Salmonella enterica enterica serovar Typhi
gcgccaccgggcaacacacgc

SEQ ID NO: 1668032 - RNA, 15 nt, Salmonella enterica enterica serovar Typhi
gcgccaccaucgucg

SEQ ID NO: 1668033 - RNA, 15 nt, Salmonella enterica enterica serovar Typhi
gcgcauguuagcaaa

SEQ ID NO: 1668034 - RNA, 14 nt, Salmonella enterica enterica serovar Typhi
gcgcauucaggcga

SEQ ID NO: 1668035 - RNA, 21 nt, Salmonella enterica enterica serovar Typhi
gcgcaguuuacgcagcgccuu

SEQ ID NO: 1668036 - RNA, 21 nt, Salmonella enterica enterica serovar Typhi
gcgcaguugccaguacagcag

SEQ ID NO: 1668037 - RNA, 16 nt, Salmonella enterica enterica serovar Typhi
gcgcauaccggccacg

SEQ ID NO: 1668038 - RNA, 13 nt, Salmonella enterica enterica serovar Typhi
gcgcagcgccacc

SEQ ID NO: 1668039 - RNA, 19 nt, Salmonella enterica enterica serovar Typhi
gcgcagcgccaucaggcau

SEQ ID NO: 1668040 - RNA, 20 nt, Salmonella enterica enterica serovar Typhi
gcgcagcgccaucaggcaug

SEQ ID NO: 1668041 - RNA, 12 nt, Salmonella enterica enterica serovar Typhi
gcgcagcgccca

SEQ ID NO: 1668042 - RNA, 11 nt, Salmonella enterica enterica serovar Typhi
gcgcagcgacu

SEQ ID NO: 1668043 - RNA, 19 nt, Salmonella enterica enterica serovar Typhi
gcgcagcgacuucaggcgu

SEQ ID NO: 1668044 - RNA, 18 nt, Salmonella enterica enterica serovar Typhi
gcgcagcgccaucaggca

SEQ ID NO: 1668045 - RNA, 15 nt, Salmonella enterica enterica serovar Typhi
gcgcagacacugcca

SEQ ID NO: 1668046 - RNA, 20 nt, Salmonella enterica enterica serovar Typhi
gcgcaccauaauauaaggau

SEQ ID NO: 1668047 - RNA, 16 nt, Salmonella enterica enterica serovar Typhi
gcgauagcccggcaug

SEQ ID NO: 1668048 - RNA, 22 nt, Salmonella enterica enterica serovar Typhi
gcgauaguguggucgucagccg

SEQ ID NO: 1668049 - RNA, 20 nt, Salmonella enterica enterica serovar Typhi
gcgauaucaacgucuugccg

SEQ ID NO: 1668050 - RNA, 17 nt, Salmonella enterica enterica serovar Typhi
gcgauagaccacgccau

SEQ ID NO: 1668051 - RNA, 14 nt, Salmonella enterica enterica serovar Typhi
gcgauacugccgcc

SEQ ID NO: 1668052 - RNA, 23 nt, Salmonella enterica enterica serovar Typhi
gcgauaaaaacccaccagcgcca

SEQ ID NO: 1668053 - RNA, 18 nt, Salmonella enterica enterica serovar Typhi
gccguugucauggcgcca

SEQ ID NO: 1668054 - RNA, 18 nt, Salmonella enterica enterica serovar Typhi
gccuacugcccuacgcuu

SEQ ID NO: 1668055 - RNA, 19 nt, Salmonella enterica enterica serovar Typhi
gccuacggcuaccgccugu

SEQ ID NO: 1668056 - RNA, 16 nt, Salmonella enterica enterica serovar Typhi
gccguuuucaauaauc

SEQ ID NO: 1668057 - RNA, 16 nt, Salmonella enterica enterica serovar Typhi
gccguuccguucgcgu

SEQ ID NO: 1668058 - RNA, 20 nt, Salmonella enterica enterica serovar Typhi
gccguuaaucuggccuacgg

SEQ ID NO: 1668059 - RNA, 18 nt, Salmonella enterica enterica serovar Typhi
gccguuauugucaugcua

SEQ ID NO: 1668060 - RNA, 18 nt, Salmonella enterica enterica serovar Typhi
gccgugcacuucugcggu

SEQ ID NO: 1668061 - RNA, 16 nt, Salmonella enterica enterica serovar Typhi
gccugaagauacgcca

SEQ ID NO: 1668062 - RNA, 21 nt, Salmonella enterica enterica serovar Typhi
gccugaagccagcaaucagcc

SEQ ID NO: 1668063 - RNA, 23 nt, Salmonella enterica enterica serovar Typhi
gccucuuucagaucgccgccggu

SEQ ID NO: 1668064 - RNA, 10 nt, Salmonella enterica enterica serovar Typhi
gccugagcgc

SEQ ID NO: 1668065 - RNA, 18 nt, Salmonella enterica enterica serovar Typhi
gccugagcgcgcagcugg

SEQ ID NO: 1668066 - RNA, 19 nt, Salmonella enterica enterica serovar Typhi
gccugauaagcacaggcca

SEQ ID NO: 1668067 - RNA, 14 nt, Salmonella enterica enterica serovar Typhi
gccugauaagcgca

SEQ ID NO: 1668068 - RNA, 20 nt, Salmonella enterica enterica serovar Typhi
gccugauaagcgcagcgcca

SEQ ID NO: 1668069 - RNA, 12 nt, Salmonella enterica enterica serovar Typhi
gccugauaaggu

SEQ ID NO: 1668070 - RNA, 15 nt, Salmonella enterica enterica serovar Typhi
gccugaugccgccgu

SEQ ID NO: 1668071 - RNA, 14 nt, Salmonella enterica enterica serovar Typhi
gccugcacauugca

SEQ ID NO: 1668072 - RNA, 23 nt, Salmonella enterica enterica serovar Typhi
gccuccggguuucacugcgugau

SEQ ID NO: 1668073 - RNA, 19 nt, Salmonella enterica enterica serovar Typhi
gccuauuuucucuuccaca

SEQ ID NO: 1668074 - RNA, 23 nt, Salmonella enterica enterica serovar Typhi
gccuauagacaccuuauauuccg

SEQ ID NO: 1668075 - RNA, 12 nt, Salmonella enterica enterica serovar Typhi
gccuaucgccau

SEQ ID NO: 1668076 - RNA, 15 nt, Salmonella enterica enterica serovar Typhi
gccgggcuauccggc

SEQ ID NO: 1668077 - RNA, 18 nt, Salmonella enterica enterica serovar Typhi
gccgggcuauccggcugu

SEQ ID NO: 1668078 - RNA, 14 nt, Salmonella enterica enterica serovar Typhi
gccgggccugcgcc

SEQ ID NO: 1668079 - RNA, 23 nt, Salmonella enterica enterica serovar Typhi
gccggcgucgaucagcgcguaga

SEQ ID NO: 1668080 - RNA, 16 nt, Salmonella enterica enterica serovar Typhi
gccgguuuauccccgc

SEQ ID NO: 1668081 - RNA, 16 nt, Salmonella enterica enterica serovar Typhi
gccgguuucauaacac

SEQ ID NO: 1668082 - RNA, 17 nt, Salmonella enterica enterica serovar Typhi
gccguaaggcguaccgc

SEQ ID NO: 1668083 - RNA, 14 nt, Salmonella enterica enterica serovar Typhi
gccguagcgcgcuu

SEQ ID NO: 1668084 - RNA, 20 nt, Salmonella enterica enterica serovar Typhi
gccggugccugccgccucca

SEQ ID NO: 1668085 - RNA, 16 nt, Salmonella enterica enterica serovar Typhi
gccgguuauaccgcca

SEQ ID NO: 1668086 - RNA, 14 nt, Salmonella enterica enterica serovar Typhi
gccggugcgagaaa

SEQ ID NO: 1668087 - RNA, 20 nt, Salmonella enterica enterica serovar Typhi
gccgguacgcagcaggcaga

SEQ ID NO: 1668088 - RNA, 20 nt, Salmonella enterica enterica serovar Typhi
gccggguaaacgcagcguca

SEQ ID NO: 1668089 - RNA, 16 nt, Salmonella enterica enterica serovar Typhi
gcgaccuuaccggcga

SEQ ID NO: 1668090 - RNA, 17 nt, Salmonella enterica enterica serovar Typhi
gcgaccuuaccggcgac

SEQ ID NO: 1668091 - RNA, 24 nt, Salmonella enterica enterica serovar Typhi
gcgaccuguagaugaaacucgcug

SEQ ID NO: 1668092 - RNA, 19 nt, Salmonella enterica enterica serovar Typhi
gcgaccuucacgccgccaa

SEQ ID NO: 1668093 - RNA, 17 nt, Salmonella enterica enterica serovar Typhi
gcgacgacgccagccag

SEQ ID NO: 1668094 - RNA, 19 nt, Salmonella enterica enterica serovar Typhi
gcgacgacgccagccagcc

SEQ ID NO: 1668095 - RNA, 18 nt, Salmonella enterica enterica serovar Typhi
gcgaauggagaagcgcgc

SEQ ID NO: 1668096 - RNA, 12 nt, Salmonella enterica enterica serovar Typhi
gcgaaugcgcgc

SEQ ID NO: 1668097 - RNA, 16 nt, Salmonella enterica enterica serovar Typhi
gcgaaugcgcgccaua

SEQ ID NO: 1668098 - RNA, 20 nt, Salmonella enterica enterica serovar Typhi
gcgaaucgccaaucgccgcc

SEQ ID NO: 1668099 - RNA, 16 nt, Salmonella enterica enterica serovar Typhi
gcgaaucuaccagauc

SEQ ID NO: 1668100 - RNA, 17 nt, Salmonella enterica enterica serovar Typhi
gcgacaaccuguaggcc

SEQ ID NO: 1668101 - RNA, 16 nt, Salmonella enterica enterica serovar Typhi
gcgaauuucacgcagc

SEQ ID NO: 1668102 - RNA, 17 nt, Salmonella enterica enterica serovar Typhi
gcgaauuucaaucgcca

SEQ ID NO: 1668103 - RNA, 18 nt, Salmonella enterica enterica serovar Typhi
gcgaauuucaaucgccag

SEQ ID NO: 1668104 - RNA, 19 nt, Salmonella enterica enterica serovar Typhi
aagcccggccacagcgcca

SEQ ID NO: 1668105 - RNA, 21 nt, Salmonella enterica enterica serovar Typhi
gcgacauggcgguaaucgcgc

SEQ ID NO: 1668106 - RNA, 21 nt, Salmonella enterica enterica serovar Typhi
gcgaccaauauccgcaggcga

SEQ ID NO: 1668107 - RNA, 16 nt, Salmonella enterica enterica serovar Typhi
gcgacacuccgcgcau

SEQ ID NO: 1668108 - RNA, 20 nt, Salmonella enterica enterica serovar Typhi
gcgacaucguuuccagcgaa

SEQ ID NO: 1668109 - RNA, 16 nt, Salmonella enterica enterica serovar Typhi
gcgacaucagccagcc

SEQ ID NO: 1668110 - RNA, 23 nt, Salmonella enterica enterica serovar Typhi
gcgacugaucaggcuaaagugcg

SEQ ID NO: 1668111 - RNA, 13 nt, Salmonella enterica enterica serovar Typhi
gcgagaacugcug

SEQ ID NO: 1668112 - RNA, 21 nt, Salmonella enterica enterica serovar Typhi
gcgacuuucacgaaaccggcg

SEQ ID NO: 1668113 - RNA, 22 nt, Salmonella enterica enterica serovar Typhi
gcgagaacggguaaaugcgcgc

SEQ ID NO: 1668114 - RNA, 14 nt, Salmonella enterica enterica serovar Typhi
gcgacgguccuggc

SEQ ID NO: 1668115 - RNA, 20 nt, Salmonella enterica enterica serovar Typhi
gcgacgcgccagccagcgcc

SEQ ID NO: 1668116 - RNA, 14 nt, Salmonella enterica enterica serovar Typhi
gcgagugccugcug

SEQ ID NO: 1668117 - RNA, 16 nt, Salmonella enterica enterica serovar Typhi
gcgaguacgcacaaca

SEQ ID NO: 1668118 - RNA, 16 nt, Salmonella enterica enterica serovar Typhi
gcgaguauucgcgccc

SEQ ID NO: 1668119 - RNA, 16 nt, Salmonella enterica enterica serovar Typhi
gcgaagcgcuccggca

SEQ ID NO: 1668120 - RNA, 20 nt, Salmonella enterica enterica serovar Typhi
gcgaacguuacccggccagc

SEQ ID NO: 1668121 - RNA, 21 nt, Salmonella enterica enterica serovar Typhi
gcgaacugguuauacaguuca

SEQ ID NO: 1668122 - RNA, 20 nt, Salmonella enterica enterica serovar Typhi
gcgaaggggcgggcagcagc

SEQ ID NO: 1668123 - RNA, 15 nt, Salmonella enterica enterica serovar Typhi
gcgaauccgccauag

SEQ ID NO: 1668124 - RNA, 21 nt, Salmonella enterica enterica serovar Typhi
gcgaauccauaccugacgcac

SEQ ID NO: 1668125 - RNA, 19 nt, Salmonella enterica enterica serovar Typhi
gcgaaucacauccgccagc

SEQ ID NO: 1668126 - RNA, 22 nt, Salmonella enterica enterica serovar Typhi
gcgaaucacauccgccagcgcc

SEQ ID NO: 1668127 - RNA, 18 nt, Salmonella enterica enterica serovar Typhi
gcgaauagccagacagcc

SEQ ID NO: 1668128 - RNA, 16 nt, Salmonella enterica enterica serovar Typhi
gcgaauaaaacugccg

SEQ ID NO: 1668129 - RNA, 14 nt, Salmonella enterica enterica serovar Typhi
gcgaauaagcuccg

SEQ ID NO: 1668130 - RNA, 14 nt, Salmonella enterica enterica serovar Typhi
gcgaaaguaccggc

SEQ ID NO: 1668131 - RNA, 19 nt, Salmonella enterica enterica serovar Typhi
gcgaaauaggccgcgauac

SEQ ID NO: 1668132 - RNA, 21 nt, Salmonella enterica enterica serovar Typhi
gcgaaagcacuucucgcgcau

SEQ ID NO: 1668133 - RNA, 12 nt, Salmonella enterica enterica serovar Typhi
gcgaacagcgcu

SEQ ID NO: 1668134 - RNA, 12 nt, Salmonella enterica enterica serovar Typhi
gcgaacagcgca

SEQ ID NO: 1668135 - RNA, 22 nt, Salmonella enterica enterica serovar Typhi
gcgaacaguacggucaggcuca

SEQ ID NO: 1668136 - RNA, 21 nt, Salmonella enterica enterica serovar Typhi
gcgaacggcuuuccagcagcc

SEQ ID NO: 1668137 - RNA, 17 nt, Salmonella enterica enterica serovar Typhi
gcgaaccggaccagcac

SEQ ID NO: 1668138 - RNA, 13 nt, Salmonella enterica enterica serovar Typhi
gcgaaccggcauc

SEQ ID NO: 1668139 - RNA, 18 nt, Salmonella enterica enterica serovar Typhi
gcgaacauuucagcgcca

SEQ ID NO: 1668140 - RNA, 17 nt, Salmonella enterica enterica serovar Typhi
gcgaacauuucagcgcc

SEQ ID NO: 1668141 - RNA, 14 nt, Salmonella enterica enterica serovar Typhi
gcgaaccaccagcc

SEQ ID NO: 1668142 - RNA, 20 nt, Salmonella enterica enterica serovar Typhi
gccuguuccggcgaggacug

SEQ ID NO: 1668143 - RNA, 18 nt, Salmonella enterica enterica serovar Typhi
gccuuauccggccuacuc

SEQ ID NO: 1668144 - RNA, 22 nt, Salmonella enterica enterica serovar Typhi
gccuucauauuaaauuccggcu

SEQ ID NO: 1668145 - RNA, 13 nt, Salmonella enterica enterica serovar Typhi
gccuuccaggcgg

SEQ ID NO: 1668146 - RNA, 18 nt, Salmonella enterica enterica serovar Typhi
gccuucguuauaaggccu

SEQ ID NO: 1668147 - RNA, 21 nt, Salmonella enterica enterica serovar Typhi
gccuugagcaaaacaccgcuc

SEQ ID NO: 1668148 - RNA, 15 nt, Salmonella enterica enterica serovar Typhi
gccugcauacguuuc

SEQ ID NO: 1668149 - RNA, 18 nt, Salmonella enterica enterica serovar Typhi
gccugucuccucagcagg

SEQ ID NO: 1668150 - RNA, 17 nt, Salmonella enterica enterica serovar Typhi
gccugucgggccuacag

SEQ ID NO: 1668151 - RNA, 13 nt, Salmonella enterica enterica serovar Typhi
gccuguuauucaa

SEQ ID NO: 1668152 - RNA, 16 nt, Salmonella enterica enterica serovar Typhi
gccuguugacgcgcau

SEQ ID NO: 1668153 - RNA, 14 nt, Salmonella enterica enterica serovar Typhi
gccuuguccggcgu

SEQ ID NO: 1668154 - RNA, 13 nt, Salmonella enterica enterica serovar Typhi
gccuugccgccag

SEQ ID NO: 1668155 - RNA, 22 nt, Salmonella enterica enterica serovar Typhi
gccuugcccguauugaagcgau

SEQ ID NO: 1668156 - RNA, 16 nt, Salmonella enterica enterica serovar Typhi
gccuugauaccgccgc

SEQ ID NO: 1668157 - RNA, 16 nt, Salmonella enterica enterica serovar Typhi
gccuuugcguaccgca

SEQ ID NO: 1668158 - RNA, 17 nt, Salmonella enterica enterica serovar Typhi
gccuuugcguaccgcaa

SEQ ID NO: 1668159 - RNA, 22 nt, Salmonella enterica enterica serovar Typhi
gccuuuggcaaucauaccguca

SEQ ID NO: 1668160 - RNA, 20 nt, Salmonella enterica enterica serovar Typhi
gccuuugucgaaauugccgc

SEQ ID NO: 1668161 - RNA, 15 nt, Salmonella enterica enterica serovar Typhi
gccuuucgcgcgaua

SEQ ID NO: 1668162 - RNA, 20 nt, Salmonella enterica enterica serovar Typhi
gcgaaagcacucggcgccuu

SEQ ID NO: 1668163 - RNA, 22 nt, Salmonella enterica enterica serovar Typhi
gcgaaaaccagcgccgccagau

SEQ ID NO: 1668164 - RNA, 18 nt, Salmonella enterica enterica serovar Typhi
gcgaaaaaguucacgcuu

SEQ ID NO: 1668165 - RNA, 13 nt, Salmonella enterica enterica serovar Typhi
gccuuuuggcagc

SEQ ID NO: 1668166 - RNA, 15 nt, Salmonella enterica enterica serovar Typhi
aagcgcuggcuggcg

SEQ ID NO: 1668167 - RNA, 14 nt, Salmonella enterica enterica serovar Typhi
aagcgcuagcgcca

SEQ ID NO: 1668168 - RNA, 22 nt, Salmonella enterica enterica serovar Typhi
aagcggauaagauagcaggcga

SEQ ID NO: 1668169 - RNA, 21 nt, Salmonella enterica enterica serovar Typhi
gcggccaugaucgccgccauc

SEQ ID NO: 1668170 - RNA, 16 nt, Salmonella enterica enterica serovar Typhi
gcggccaugaucgccg

SEQ ID NO: 1668171 - RNA, 21 nt, Salmonella enterica enterica serovar Typhi
aagcggcagcgccauccggca

SEQ ID NO: 1668172 - RNA, 15 nt, Salmonella enterica enterica serovar Typhi
gcggcccgcgcugaa

SEQ ID NO: 1668173 - RNA, 19 nt, Salmonella enterica enterica serovar Typhi
gcggccuugccgccagcgc

SEQ ID NO: 1668174 - RNA, 21 nt, Salmonella enterica enterica serovar Typhi
gcggcgaaauaggccgcgaua

SEQ ID NO: 1668175 - RNA, 21 nt, Salmonella enterica enterica serovar Typhi
gcggccuaugacuauaucagc

SEQ ID NO: 1668176 - RNA, 13 nt, Salmonella enterica enterica serovar Typhi
aagcgcagcgcca

SEQ ID NO: 1668177 - RNA, 23 nt, Salmonella enterica enterica serovar Typhi
gcggcagccaugcuauucagcag

SEQ ID NO: 1668178 - RNA, 16 nt, Salmonella enterica enterica serovar Typhi
gcggcaggauccccau

SEQ ID NO: 1668179 - RNA, 21 nt, Salmonella enterica enterica serovar Typhi
gcggcacuucgauaaacgccu

SEQ ID NO: 1668180 - RNA, 22 nt, Salmonella enterica enterica serovar Typhi
gcggcacguauucggcuuaccc

SEQ ID NO: 1668181 - RNA, 18 nt, Salmonella enterica enterica serovar Typhi
gcggcacguuuuccaggu

SEQ ID NO: 1668182 - RNA, 20 nt, Salmonella enterica enterica serovar Typhi
aagcgacgcgcgguugcggc

SEQ ID NO: 1668183 - RNA, 17 nt, Salmonella enterica enterica serovar Typhi
aagcgaccagcgcgcca

SEQ ID NO: 1668184 - RNA, 13 nt, Salmonella enterica enterica serovar Typhi
aagcgaagcgcca

SEQ ID NO: 1668185 - RNA, 20 nt, Salmonella enterica enterica serovar Typhi
aagcgcagcgccauccggca

SEQ ID NO: 1668186 - RNA, 19 nt, Salmonella enterica enterica serovar Typhi
aagcgccugcugcgcaaca

SEQ ID NO: 1668187 - RNA, 13 nt, Salmonella enterica enterica serovar Typhi
gcggccagcgccu

SEQ ID NO: 1668188 - RNA, 13 nt, Salmonella enterica enterica serovar Typhi
gcggccagccaua

SEQ ID NO: 1668189 - RNA, 11 nt, Salmonella enterica enterica serovar Typhi
gcggcggcaag

SEQ ID NO: 1668190 - RNA, 15 nt, Salmonella enterica enterica serovar Typhi
gcggcgccaucgccu

SEQ ID NO: 1668191 - RNA, 22 nt, Salmonella enterica enterica serovar Typhi
gcggcgaaaugccuuauccggc

SEQ ID NO: 1668192 - RNA, 13 nt, Salmonella enterica enterica serovar Typhi
aagcgucaguaaa

SEQ ID NO: 1668193 - RNA, 20 nt, Salmonella enterica enterica serovar Typhi
aagcguagcgccauccggca

SEQ ID NO: 1668194 - RNA, 15 nt, Salmonella enterica enterica serovar Typhi
aagcgucagcauggu

SEQ ID NO: 1668195 - RNA, 16 nt, Salmonella enterica enterica serovar Typhi
aagcguagcgccauca

SEQ ID NO: 1668196 - RNA, 17 nt, Salmonella enterica enterica serovar Typhi
gcgggcaauuccgguca

SEQ ID NO: 1668197 - RNA, 12 nt, Salmonella enterica enterica serovar Typhi
gcggcuuauccg

SEQ ID NO: 1668198 - RNA, 15 nt, Salmonella enterica enterica serovar Typhi
gcggcuucagcgaca

SEQ ID NO: 1668199 - RNA, 17 nt, Salmonella enterica enterica serovar Typhi
gcggcuuuuucaucauc

SEQ ID NO: 1668200 - RNA, 22 nt, Salmonella enterica enterica serovar Typhi
gcggcugcgccuuauccggcgu

SEQ ID NO: 1668201 - RNA, 12 nt, Salmonella enterica enterica serovar Typhi
gcggcugaugca

SEQ ID NO: 1668202 - RNA, 16 nt, Salmonella enterica enterica serovar Typhi
gcggcguucugcgcca

SEQ ID NO: 1668203 - RNA, 17 nt, Salmonella enterica enterica serovar Typhi
gcguauagccaggcaga

SEQ ID NO: 1668204 - RNA, 15 nt, Salmonella enterica enterica serovar Typhi
gcgucacauggcgaa

SEQ ID NO: 1668205 - RNA, 13 nt, Salmonella enterica enterica serovar Typhi
gcguagagagcgg

SEQ ID NO: 1668206 - RNA, 17 nt, Salmonella enterica enterica serovar Typhi
gcguagaagcuuaccac

SEQ ID NO: 1668207 - RNA, 20 nt, Salmonella enterica enterica serovar Typhi
gcguagcccagcgccgcauc

SEQ ID NO: 1668208 - RNA, 16 nt, Salmonella enterica enterica serovar Typhi
gcguagcccagcgccg

SEQ ID NO: 1668209 - RNA, 15 nt, Salmonella enterica enterica serovar Typhi
gcguagucagcgacg

SEQ ID NO: 1668210 - RNA, 22 nt, Salmonella enterica enterica serovar Typhi
gcgucaggccaucgcuucggca

SEQ ID NO: 1668211 - RNA, 17 nt, Salmonella enterica enterica serovar Typhi
gcgucagcgugcgguaa

SEQ ID NO: 1668212 - RNA, 11 nt, Salmonella enterica enterica serovar Typhi
gcgucgccaua

SEQ ID NO: 1668213 - RNA, 19 nt, Salmonella enterica enterica serovar Typhi
gcgucgcguaccagcgccc

SEQ ID NO: 1668214 - RNA, 15 nt, Salmonella enterica enterica serovar Typhi
gcgucggcuucauca

SEQ ID NO: 1668215 - RNA, 18 nt, Salmonella enterica enterica serovar Typhi
gcguccguucugauacuc

SEQ ID NO: 1668216 - RNA, 14 nt, Salmonella enterica enterica serovar Typhi
gcgucgcauccggc

SEQ ID NO: 1668217 - RNA, 18 nt, Salmonella enterica enterica serovar Typhi
gcgucgcauucgauacgc

SEQ ID NO: 1668218 - RNA, 13 nt, Salmonella enterica enterica serovar Typhi
gcgugcuggcggc

SEQ ID NO: 1668219 - RNA, 22 nt, Salmonella enterica enterica serovar Typhi
gcgugauuuuggccucauccgc

SEQ ID NO: 1668220 - RNA, 22 nt, Salmonella enterica enterica serovar Typhi
gcguuaccggcaggcuggcggu

SEQ ID NO: 1668221 - RNA, 22 nt, Salmonella enterica enterica serovar Typhi
gcguuacugcaacugcgcggca

SEQ ID NO: 1668222 - RNA, 13 nt, Salmonella enterica enterica serovar Typhi
gcguuacuggcga

SEQ ID NO: 1668223 - RNA, 18 nt, Salmonella enterica enterica serovar Typhi
gcguuagaauaacguucg

SEQ ID NO: 1668224 - RNA, 14 nt, Salmonella enterica enterica serovar Typhi
gcguuagccgccau

SEQ ID NO: 1668225 - RNA, 13 nt, Salmonella enterica enterica serovar Typhi
gcguuagcgucau

SEQ ID NO: 1668226 - RNA, 18 nt, Salmonella enterica enterica serovar Typhi
gcguuaacguuuucccgc

SEQ ID NO: 1668227 - RNA, 23 nt, Salmonella enterica enterica serovar Typhi
gcguuaauauccuucagcguuug

SEQ ID NO: 1668228 - RNA, 19 nt, Salmonella enterica enterica serovar Typhi
gcguguuguaaaacgcgcc

SEQ ID NO: 1668229 - RNA, 20 nt, Salmonella enterica enterica serovar Typhi
gcguuaacggcuucguuuca

SEQ ID NO: 1668230 - RNA, 17 nt, Salmonella enterica enterica serovar Typhi
gcguuauccgccugcug

SEQ ID NO: 1668231 - RNA, 22 nt, Salmonella enterica enterica serovar Typhi
gcguuaucguccgucagauccg

SEQ ID NO: 1668232 - RNA, 23 nt, Salmonella enterica enterica serovar Typhi
gcgucuuuuagucacuccaggcg

SEQ ID NO: 1668233 - RNA, 17 nt, Salmonella enterica enterica serovar Typhi
gcgugacgaccggcacg

SEQ ID NO: 1668234 - RNA, 21 nt, Salmonella enterica enterica serovar Typhi
gcgugauccacagcguaggcc

SEQ ID NO: 1668235 - RNA, 21 nt, Salmonella enterica enterica serovar Typhi
gcgucugcuggccaaacugcg

SEQ ID NO: 1668236 - RNA, 14 nt, Salmonella enterica enterica serovar Typhi
gcgucuucaucagc

SEQ ID NO: 1668237 - RNA, 15 nt, Salmonella enterica enterica serovar Typhi
gcgucuucaucagcc

SEQ ID NO: 1668238 - RNA, 20 nt, Salmonella enterica enterica serovar Typhi
gcgucuucauuuucggcagg

SEQ ID NO: 1668239 - RNA, 17 nt, Salmonella enterica enterica serovar Typhi
gcguaacagcgguauac

SEQ ID NO: 1668240 - RNA, 19 nt, Salmonella enterica enterica serovar Typhi
gcguaaacgcaacaccauc

SEQ ID NO: 1668241 - RNA, 15 nt, Salmonella enterica enterica serovar Typhi
gcguaaaaccgcgcu

SEQ ID NO: 1668242 - RNA, 17 nt, Salmonella enterica enterica serovar Typhi
gcguaaaauauacagcc

SEQ ID NO: 1668243 - RNA, 23 nt, Salmonella enterica enterica serovar Typhi
gcguacaaucgcguuuuccagca

SEQ ID NO: 1668244 - RNA, 15 nt, Salmonella enterica enterica serovar Typhi
gcguaauauacgcca

SEQ ID NO: 1668245 - RNA, 20 nt, Salmonella enterica enterica serovar Typhi
gcguaaucuucgcggcugcc

SEQ ID NO: 1668246 - RNA, 23 nt, Salmonella enterica enterica serovar Typhi
gcguaaugacuggcuuugcgcca

SEQ ID NO: 1668247 - RNA, 12 nt, Salmonella enterica enterica serovar Typhi
gcguaccgcaau

SEQ ID NO: 1668248 - RNA, 15 nt, Salmonella enterica enterica serovar Typhi
gcguacucagcagac

SEQ ID NO: 1668249 - RNA, 13 nt, Salmonella enterica enterica serovar Typhi
gcguaccagcgcc

SEQ ID NO: 1668250 - RNA, 23 nt, Salmonella enterica enterica serovar Typhi
gcguacaggauguccaggcgaca

SEQ ID NO: 1668251 - RNA, 14 nt, Salmonella enterica enterica serovar Typhi
gcguaacugccaga

SEQ ID NO: 1668252 - RNA, 15 nt, Salmonella enterica enterica serovar Typhi
gcgguucucccggca

SEQ ID NO: 1668253 - RNA, 16 nt, Salmonella enterica enterica serovar Typhi
gcgguucucccggcau

SEQ ID NO: 1668254 - RNA, 23 nt, Salmonella enterica enterica serovar Typhi
gcgguuuaaugcuaucccaggcg

SEQ ID NO: 1668255 - RNA, 17 nt, Salmonella enterica enterica serovar Typhi
gcgguugucggcgcgau

SEQ ID NO: 1668256 - RNA, 18 nt, Salmonella enterica enterica serovar Typhi
gcgguuuuccugaugaua

SEQ ID NO: 1668257 - RNA, 21 nt, Salmonella enterica enterica serovar Typhi
gcgguuucaucgagcguguca

SEQ ID NO: 1668258 - RNA, 15 nt, Salmonella enterica enterica serovar Typhi
gcgguuucaucgagc

SEQ ID NO: 1668259 - RNA, 15 nt, Salmonella enterica enterica serovar Typhi
gcgguuacguccggc

SEQ ID NO: 1668260 - RNA, 13 nt, Salmonella enterica enterica serovar Typhi
gcgguuauccgcc

SEQ ID NO: 1668261 - RNA, 19 nt, Salmonella enterica enterica serovar Typhi
gcgguuauccgccagcgca

SEQ ID NO: 1668262 - RNA, 18 nt, Salmonella enterica enterica serovar Typhi
gcgguggguagcggcaau

SEQ ID NO: 1668263 - RNA, 23 nt, Salmonella enterica enterica serovar Typhi
gcgguaucaaugcgacagcgaca

SEQ ID NO: 1668264 - RNA, 13 nt, Salmonella enterica enterica serovar Typhi
gcggucagccaca

SEQ ID NO: 1668265 - RNA, 15 nt, Salmonella enterica enterica serovar Typhi
gcggucagggcuuac

SEQ ID NO: 1668266 - RNA, 14 nt, Salmonella enterica enterica serovar Typhi
gcgguauaucacgc

SEQ ID NO: 1668267 - RNA, 17 nt, Salmonella enterica enterica serovar Typhi
gcgguauagcaucccgc

SEQ ID NO: 1668268 - RNA, 23 nt, Salmonella enterica enterica serovar Typhi
gcgguauacaccagcucccgcgu

SEQ ID NO: 1668269 - RNA, 16 nt, Salmonella enterica enterica serovar Typhi
gcggucacaggcauac

SEQ ID NO: 1668270 - RNA, 15 nt, Salmonella enterica enterica serovar Typhi
gcgguagcugcgcca

SEQ ID NO: 1668271 - RNA, 14 nt, Salmonella enterica enterica serovar Typhi
gcgguaauaacuga

SEQ ID NO: 1668272 - RNA, 22 nt, Salmonella enterica enterica serovar Typhi
gcggugcagguugccugauggc

SEQ ID NO: 1668273 - RNA, 18 nt, Salmonella enterica enterica serovar Typhi
gcggugagaaacgcgcca

SEQ ID NO: 1668274 - RNA, 22 nt, Salmonella enterica enterica serovar Typhi
gcggugaaaugcccgauggcgc

SEQ ID NO: 1668275 - RNA, 19 nt, Salmonella enterica enterica serovar Typhi
gcggucggcagcaccggaa

SEQ ID NO: 1668276 - RNA, 17 nt, Salmonella enterica enterica serovar Typhi
gcguucacgccgccauc

SEQ ID NO: 1668277 - RNA, 15 nt, Salmonella enterica enterica serovar Typhi
gcucagccagaaacg

SEQ ID NO: 1668278 - RNA, 19 nt, Salmonella enterica enterica serovar Typhi
gcucagcggcggcgggaac

SEQ ID NO: 1668279 - RNA, 15 nt, Salmonella enterica enterica serovar Typhi
gcucagcgcggcagc

SEQ ID NO: 1668280 - RNA, 14 nt, Salmonella enterica enterica serovar Typhi
gcucaggcgcgaau

SEQ ID NO: 1668281 - RNA, 22 nt, Salmonella enterica enterica serovar Typhi
gcucaggguuuucuaccgcagc

SEQ ID NO: 1668282 - RNA, 14 nt, Salmonella enterica enterica serovar Typhi
gcucaucagcgcca

SEQ ID NO: 1668283 - RNA, 18 nt, Salmonella enterica enterica serovar Typhi
gcucauccaacugcgccu

SEQ ID NO: 1668284 - RNA, 20 nt, Salmonella enterica enterica serovar Typhi
gcuccaugucuugcuaucaa

SEQ ID NO: 1668285 - RNA, 14 nt, Salmonella enterica enterica serovar Typhi
gcucaugcgcgucc

SEQ ID NO: 1668286 - RNA, 22 nt, Salmonella enterica enterica serovar Typhi
gcuccagaagcacuucuccacg

SEQ ID NO: 1668287 - RNA, 21 nt, Salmonella enterica enterica serovar Typhi
gcuccagaccaccagcgacau

SEQ ID NO: 1668288 - RNA, 17 nt, Salmonella enterica enterica serovar Typhi
gcuccacgggcgccacg

SEQ ID NO: 1668289 - RNA, 16 nt, Salmonella enterica enterica serovar Typhi
gcucgcccagaauuuc

SEQ ID NO: 1668290 - RNA, 15 nt, Salmonella enterica enterica serovar Typhi
gcucccgcugcggcg

SEQ ID NO: 1668291 - RNA, 20 nt, Salmonella enterica enterica serovar Typhi
gcuccggacgcaccagccag

SEQ ID NO: 1668292 - RNA, 20 nt, Salmonella enterica enterica serovar Typhi
gcuccgaauaauccuucccg

SEQ ID NO: 1668293 - RNA, 16 nt, Salmonella enterica enterica serovar Typhi
gcuccugguccguaac

SEQ ID NO: 1668294 - RNA, 20 nt, Salmonella enterica enterica serovar Typhi
gcuccuucuucgccgucaua

SEQ ID NO: 1668295 - RNA, 19 nt, Salmonella enterica enterica serovar Typhi
gcuccuuucggacuuccug

SEQ ID NO: 1668296 - RNA, 22 nt, Salmonella enterica enterica serovar Typhi
gcucgaguucuucacgcugaug

SEQ ID NO: 1668297 - RNA, 22 nt, Salmonella enterica enterica serovar Typhi
gcugaaagaagacgaaaucguc

SEQ ID NO: 1668298 - RNA, 16 nt, Salmonella enterica enterica serovar Typhi
gcucuuuucaggcgcu

SEQ ID NO: 1668299 - RNA, 20 nt, Salmonella enterica enterica serovar Typhi
gcugacaaagguugcgccaa

SEQ ID NO: 1668300 - RNA, 18 nt, Salmonella enterica enterica serovar Typhi
gcucguuguuuaauacgc

SEQ ID NO: 1668301 - RNA, 18 nt, Salmonella enterica enterica serovar Typhi
gcucuaccaacugagcua

SEQ ID NO: 1668302 - RNA, 15 nt, Salmonella enterica enterica serovar Typhi
gcucuauucggcgcu

SEQ ID NO: 1668303 - RNA, 18 nt, Salmonella enterica enterica serovar Typhi
gcucucccagcugagcua

SEQ ID NO: 1668304 - RNA, 21 nt, Salmonella enterica enterica serovar Typhi
gcucuccuggaugcgcugaau

SEQ ID NO: 1668305 - RNA, 20 nt, Salmonella enterica enterica serovar Typhi
gcugagugguucgccaucca

SEQ ID NO: 1668306 - RNA, 16 nt, Salmonella enterica enterica serovar Typhi
gcugaguucaggcacg

SEQ ID NO: 1668307 - RNA, 19 nt, Salmonella enterica enterica serovar Typhi
gcugacacccucugcgccu

SEQ ID NO: 1668308 - RNA, 15 nt, Salmonella enterica enterica serovar Typhi
gcugacaaucagcac

SEQ ID NO: 1668309 - RNA, 23 nt, Salmonella enterica enterica serovar Typhi
gcugagcucugguugcagcgcca

SEQ ID NO: 1668310 - RNA, 21 nt, Salmonella enterica enterica serovar Typhi
gcugagcacgcccggucuguc

SEQ ID NO: 1668311 - RNA, 23 nt, Salmonella enterica enterica serovar Typhi
gcugaugcccagguuagcagcca

SEQ ID NO: 1668312 - RNA, 15 nt, Salmonella enterica enterica serovar Typhi
gcugaugacgcgccg

SEQ ID NO: 1668313 - RNA, 18 nt, Salmonella enterica enterica serovar Typhi
gcugcgccugcgggucca

SEQ ID NO: 1668314 - RNA, 13 nt, Salmonella enterica enterica serovar Typhi
gcugcgccagcgu

SEQ ID NO: 1668315 - RNA, 12 nt, Salmonella enterica enterica serovar Typhi
gcugcgcgcgau

SEQ ID NO: 1668316 - RNA, 22 nt, Salmonella enterica enterica serovar Typhi
ggaaaucaugccagaauugcac

SEQ ID NO: 1668317 - RNA, 19 nt, Salmonella enterica enterica serovar Typhi
ggaaagacggcagcgccau

SEQ ID NO: 1668318 - RNA, 15 nt, Salmonella enterica enterica serovar Typhi
ggaaagacggcagcg

SEQ ID NO: 1668319 - RNA, 15 nt, Salmonella enterica enterica serovar Typhi
ggaaaaagccgccgu

SEQ ID NO: 1668320 - RNA, 14 nt, Salmonella enterica enterica serovar Typhi
ggaaaccaaccacg

SEQ ID NO: 1668321 - RNA, 23 nt, Salmonella enterica enterica serovar Typhi
ggaaaaccuuaccgucagccacu

SEQ ID NO: 1668322 - RNA, 13 nt, Salmonella enterica enterica serovar Typhi
ggaaaaugcgcca

SEQ ID NO: 1668323 - RNA, 19 nt, Salmonella enterica enterica serovar Typhi
gcuuugcuuauccggccua

SEQ ID NO: 1668324 - RNA, 23 nt, Salmonella enterica enterica serovar Typhi
gcuuuuaucggcgucgcggcaau

SEQ ID NO: 1668325 - RNA, 17 nt, Salmonella enterica enterica serovar Typhi
gcuuuugauucaaaugu

SEQ ID NO: 1668326 - RNA, 17 nt, Salmonella enterica enterica serovar Typhi
gcuuugccgccaucaug

SEQ ID NO: 1668327 - RNA, 16 nt, Salmonella enterica enterica serovar Typhi
gcuuugcgccggcagu

SEQ ID NO: 1668328 - RNA, 20 nt, Salmonella enterica enterica serovar Typhi
gcuuucgauaaucugacgcg

SEQ ID NO: 1668329 - RNA, 20 nt, Salmonella enterica enterica serovar Typhi
gcuuucuguaggccggauaa

SEQ ID NO: 1668330 - RNA, 23 nt, Salmonella enterica enterica serovar Typhi
gcuuucuucccuccccugcgccu

SEQ ID NO: 1668331 - RNA, 17 nt, Salmonella enterica enterica serovar Typhi
gcuuguaaauugcgcca

SEQ ID NO: 1668332 - RNA, 21 nt, Salmonella enterica enterica serovar Typhi
gcuuguuacugcauuccgcgu

SEQ ID NO: 1668333 - RNA, 22 nt, Salmonella enterica enterica serovar Typhi
gcuuguuuacgcccucaucggc

SEQ ID NO: 1668334 - RNA, 17 nt, Salmonella enterica enterica serovar Typhi
gcuuuaugcgcuuccag

SEQ ID NO: 1668335 - RNA, 22 nt, Salmonella enterica enterica serovar Typhi
gcuuuaugcagucgguagcuuu

SEQ ID NO: 1668336 - RNA, 14 nt, Salmonella enterica enterica serovar Typhi
gcuuuacagcgacg

SEQ ID NO: 1668337 - RNA, 16 nt, Salmonella enterica enterica serovar Typhi
gcuuuagugccgccau

SEQ ID NO: 1668338 - RNA, 15 nt, Salmonella enterica enterica serovar Typhi
gcuuuaccgggccua

SEQ ID NO: 1668339 - RNA, 19 nt, Salmonella enterica enterica serovar Typhi
gcuuuaaugcuuuccagcc

SEQ ID NO: 1668340 - RNA, 12 nt, Salmonella enterica enterica serovar Typhi
gcuuucacgcca

SEQ ID NO: 1668341 - RNA, 14 nt, Salmonella enterica enterica serovar Typhi
gcuugcgcuauccg

SEQ ID NO: 1668342 - RNA, 19 nt, Salmonella enterica enterica serovar Typhi
gcuugcccgauggcgcugc

SEQ ID NO: 1668343 - RNA, 17 nt, Salmonella enterica enterica serovar Typhi
gcuugcacuaucgggca

SEQ ID NO: 1668344 - RNA, 13 nt, Salmonella enterica enterica serovar Typhi
gcuugauacgcca

SEQ ID NO: 1668345 - RNA, 15 nt, Salmonella enterica enterica serovar Typhi
gcuugaucgcgcagc

SEQ ID NO: 1668346 - RNA, 14 nt, Salmonella enterica enterica serovar Typhi
gcuugcgccgccau

SEQ ID NO: 1668347 - RNA, 22 nt, Salmonella enterica enterica serovar Typhi
gcuugcgccgccauccggccug

SEQ ID NO: 1668348 - RNA, 12 nt, Salmonella enterica enterica serovar Typhi
gcuucugcgccg

SEQ ID NO: 1668349 - RNA, 21 nt, Salmonella enterica enterica serovar Typhi
gcuucuuaaaauagccaucgu

SEQ ID NO: 1668350 - RNA, 22 nt, Salmonella enterica enterica serovar Typhi
gcuucucuauacggcgcgcagu

SEQ ID NO: 1668351 - RNA, 18 nt, Salmonella enterica enterica serovar Typhi
gcuucucgccuucggccu

SEQ ID NO: 1668352 - RNA, 20 nt, Salmonella enterica enterica serovar Typhi
gcuuccagaugaagcgcauc

SEQ ID NO: 1668353 - RNA, 13 nt, Salmonella enterica enterica serovar Typhi
gcuucccacaguc

SEQ ID NO: 1668354 - RNA, 15 nt, Salmonella enterica enterica serovar Typhi
gcuuccaguugaaaa

SEQ ID NO: 1668355 - RNA, 19 nt, Salmonella enterica enterica serovar Typhi
gcuuccgcgacgaugcgca

SEQ ID NO: 1668356 - RNA, 22 nt, Salmonella enterica enterica serovar Typhi
gcuucaggugugguacggcuuu

SEQ ID NO: 1668357 - RNA, 21 nt, Salmonella enterica enterica serovar Typhi
gcuucaggauuuacugagcgc

SEQ ID NO: 1668358 - RNA, 22 nt, Salmonella enterica enterica serovar Typhi
gcuucagcaaacggcuggauaa

SEQ ID NO: 1668359 - RNA, 14 nt, Salmonella enterica enterica serovar Typhi
gcuucagcgacauc

SEQ ID NO: 1668360 - RNA, 15 nt, Salmonella enterica enterica serovar Typhi
gcuuccacucguaac

SEQ ID NO: 1668361 - RNA, 17 nt, Salmonella enterica enterica serovar Typhi
gcuucgguccggcgcua

SEQ ID NO: 1668362 - RNA, 15 nt, Salmonella enterica enterica serovar Typhi
gcuucgcgcgccagu

SEQ ID NO: 1668363 - RNA, 19 nt, Salmonella enterica enterica serovar Typhi
gcuucgacauagccuuugu

SEQ ID NO: 1668364 - RNA, 18 nt, Salmonella enterica enterica serovar Typhi
gcuucgccaucuccauca

SEQ ID NO: 1668365 - RNA, 17 nt, Salmonella enterica enterica serovar Typhi
gcugggauauuacagau

SEQ ID NO: 1668366 - RNA, 16 nt, Salmonella enterica enterica serovar Typhi
gcuggcggcgauggcc

SEQ ID NO: 1668367 - RNA, 20 nt, Salmonella enterica enterica serovar Typhi
gcuggcggucgggaacgcug

SEQ ID NO: 1668368 - RNA, 17 nt, Salmonella enterica enterica serovar Typhi
gcugcuccaucuccggc

SEQ ID NO: 1668369 - RNA, 18 nt, Salmonella enterica enterica serovar Typhi
gcugguaaauccggcgcu

SEQ ID NO: 1668370 - RNA, 22 nt, Salmonella enterica enterica serovar Typhi
gcugguaagagagccuuacagg

SEQ ID NO: 1668371 - RNA, 16 nt, Salmonella enterica enterica serovar Typhi
gcuggguucauccagc

SEQ ID NO: 1668372 - RNA, 18 nt, Salmonella enterica enterica serovar Typhi
gcuggucgagauacugca

SEQ ID NO: 1668373 - RNA, 21 nt, Salmonella enterica enterica serovar Typhi
gcuggucgccgcccaucgggc

SEQ ID NO: 1668374 - RNA, 17 nt, Salmonella enterica enterica serovar Typhi
gcuggugaagacgcugc

SEQ ID NO: 1668375 - RNA, 14 nt, Salmonella enterica enterica serovar Typhi
gcuggugaaacguu

SEQ ID NO: 1668376 - RNA, 19 nt, Salmonella enterica enterica serovar Typhi
gcugguuuuagcuuauccc

SEQ ID NO: 1668377 - RNA, 20 nt, Salmonella enterica enterica serovar Typhi
gcugucaucgaaggcgauac

SEQ ID NO: 1668378 - RNA, 18 nt, Salmonella enterica enterica serovar Typhi
gcugucccagugucaacu

SEQ ID NO: 1668379 - RNA, 21 nt, Salmonella enterica enterica serovar Typhi
gcuguacgcuacugagcguca

SEQ ID NO: 1668380 - RNA, 22 nt, Salmonella enterica enterica serovar Typhi
gcuguaccaucaccugaugucc

SEQ ID NO: 1668381 - RNA, 19 nt, Salmonella enterica enterica serovar Typhi
gcuguaacuucacgccauc

SEQ ID NO: 1668382 - RNA, 17 nt, Salmonella enterica enterica serovar Typhi
gcuguaacagacgcagg

SEQ ID NO: 1668383 - RNA, 21 nt, Salmonella enterica enterica serovar Typhi
gcugucggucaggcugcggac

SEQ ID NO: 1668384 - RNA, 22 nt, Salmonella enterica enterica serovar Typhi
gcugugcagacugcacuuccug

SEQ ID NO: 1668385 - RNA, 21 nt, Salmonella enterica enterica serovar Typhi
gcugucuuacacugauacccc

SEQ ID NO: 1668386 - RNA, 19 nt, Salmonella enterica enterica serovar Typhi
gcuguuaaaaccggcugcc

SEQ ID NO: 1668387 - RNA, 16 nt, Salmonella enterica enterica serovar Typhi
gcuguguccgccugcu

SEQ ID NO: 1668388 - RNA, 20 nt, Salmonella enterica enterica serovar Typhi
gcuguuuaaagguuauccgc

SEQ ID NO: 1668389 - RNA, 21 nt, Salmonella enterica enterica serovar Typhi
gcuuaaucaccagcgcauuga

SEQ ID NO: 1668390 - RNA, 16 nt, Salmonella enterica enterica serovar Typhi
gcuuaaauggcgcugu

SEQ ID NO: 1668391 - RNA, 22 nt, Salmonella enterica enterica serovar Typhi
gcuuaacagcguacaggcggaa

SEQ ID NO: 1668392 - RNA, 17 nt, Salmonella enterica enterica serovar Typhi
gcuuaaaaaauccugca

SEQ ID NO: 1668393 - RNA, 18 nt, Salmonella enterica enterica serovar Typhi
gcuuaccaucuggccuac

SEQ ID NO: 1668394 - RNA, 20 nt, Salmonella enterica enterica serovar Typhi
gcuuacaucgccauccggca

SEQ ID NO: 1668395 - RNA, 20 nt, Salmonella enterica enterica serovar Typhi
gcuuaccagcgggccgcuga

SEQ ID NO: 1668396 - RNA, 17 nt, Salmonella enterica enterica serovar Typhi
gcuuaccgggccugcgu

SEQ ID NO: 1668397 - RNA, 22 nt, Salmonella enterica enterica serovar Typhi
gcuuaaugcccggcccgucauc

SEQ ID NO: 1668398 - RNA, 18 nt, Salmonella enterica enterica serovar Typhi
gcuuacacacccggccua

SEQ ID NO: 1668399 - RNA, 19 nt, Salmonella enterica enterica serovar Typhi
gcuuacacacccggccuau

SEQ ID NO: 1668400 - RNA, 17 nt, Salmonella enterica enterica serovar Typhi
gcuuacaggcacgccug

SEQ ID NO: 1668401 - RNA, 14 nt, Salmonella enterica enterica serovar Typhi
gcuucagagcaggu

SEQ ID NO: 1668402 - RNA, 20 nt, Salmonella enterica enterica serovar Typhi
gcuucaccuuucgccgccag

SEQ ID NO: 1668403 - RNA, 23 nt, Salmonella enterica enterica serovar Typhi
gcuucacgcggauugccgcccgu

SEQ ID NO: 1668404 - RNA, 19 nt, Salmonella enterica enterica serovar Typhi
gcuuauuccagucauuaac

SEQ ID NO: 1668405 - RNA, 16 nt, Salmonella enterica enterica serovar Typhi
gcuuauuuucgucguu

SEQ ID NO: 1668406 - RNA, 14 nt, Salmonella enterica enterica serovar Typhi
gcuucaaccuccug

SEQ ID NO: 1668407 - RNA, 17 nt, Salmonella enterica enterica serovar Typhi
gcuuacuuucagauaau

SEQ ID NO: 1668408 - RNA, 20 nt, Salmonella enterica enterica serovar Typhi
gcuuacgcuuacccggccua

SEQ ID NO: 1668409 - RNA, 17 nt, Salmonella enterica enterica serovar Typhi
gcuuacggcaaacugaa

SEQ ID NO: 1668410 - RNA, 20 nt, Salmonella enterica enterica serovar Typhi
gcuuauagcuacguagcgca

SEQ ID NO: 1668411 - RNA, 17 nt, Salmonella enterica enterica serovar Typhi
gcuuaucaggccuacaa

SEQ ID NO: 1668412 - RNA, 16 nt, Salmonella enterica enterica serovar Typhi
gcuuaucaaguaacgu

SEQ ID NO: 1668413 - RNA, 18 nt, Salmonella enterica enterica serovar Typhi
gcuuaucaggccuacaau

SEQ ID NO: 1668414 - RNA, 14 nt, Salmonella enterica enterica serovar Typhi
gcuuauccggccua

SEQ ID NO: 1668415 - RNA, 18 nt, Salmonella enterica enterica serovar Typhi
gcuuauccggccuacaga

SEQ ID NO: 1668416 - RNA, 22 nt, Salmonella enterica enterica serovar Typhi
gcuuauccccauucugcugaug

SEQ ID NO: 1668417 - RNA, 17 nt, Salmonella enterica enterica serovar Typhi
gcuuaucgggccuacga

SEQ ID NO: 1668418 - RNA, 20 nt, Salmonella enterica enterica serovar Typhi
gcuuaucugaguaucgcuuu

SEQ ID NO: 1668419 - RNA, 16 nt, Salmonella enterica enterica serovar Typhi
gcuuaucuuuacgcuu

SEQ ID NO: 1668420 - RNA, 14 nt, Salmonella enterica enterica serovar Typhi
gcuuaucgggccua

SEQ ID NO: 1668421 - RNA, 20 nt, Salmonella enterica enterica serovar Typhi
gcuuauccggccuacgauuu

SEQ ID NO: 1668422 - RNA, 19 nt, Salmonella enterica enterica serovar Typhi
gcuuauccggccuacgcuu

SEQ ID NO: 1668423 - RNA, 22 nt, Salmonella enterica enterica serovar Typhi
ggccggauuagcgacagcgcua

SEQ ID NO: 1668424 - RNA, 16 nt, Salmonella enterica enterica serovar Typhi
ggccggauaaggcguu

SEQ ID NO: 1668425 - RNA, 21 nt, Salmonella enterica enterica serovar Typhi
ggccggauaagcgcagcguca

SEQ ID NO: 1668426 - RNA, 22 nt, Salmonella enterica enterica serovar Typhi
ggccggauaagcggcagcgcca

SEQ ID NO: 1668427 - RNA, 14 nt, Salmonella enterica enterica serovar Typhi
ggccggauaaggcc

SEQ ID NO: 1668428 - RNA, 23 nt, Salmonella enterica enterica serovar Typhi
ggccggauaaggcgcagccgcca

SEQ ID NO: 1668429 - RNA, 23 nt, Salmonella enterica enterica serovar Typhi
ggccggaugaggcgcagccgcca

SEQ ID NO: 1668430 - RNA, 18 nt, Salmonella enterica enterica serovar Typhi
ggccggaauacguaauac

SEQ ID NO: 1668431 - RNA, 21 nt, Salmonella enterica enterica serovar Typhi
ggccggauaagcaacgcgcca

SEQ ID NO: 1668432 - RNA, 20 nt, Salmonella enterica enterica serovar Typhi
ggccggauaagcauagcguu

SEQ ID NO: 1668433 - RNA, 22 nt, Salmonella enterica enterica serovar Typhi
ggccggauaagcauuagcgcca

SEQ ID NO: 1668434 - RNA, 21 nt, Salmonella enterica enterica serovar Typhi
ggccggauaagcgcagcgcca

SEQ ID NO: 1668435 - RNA, 21 nt, Salmonella enterica enterica serovar Typhi
ggccugauaagcauagcgcca

SEQ ID NO: 1668436 - RNA, 23 nt, Salmonella enterica enterica serovar Typhi
ggccugauaagcgcagcgccauc

SEQ ID NO: 1668437 - RNA, 21 nt, Salmonella enterica enterica serovar Typhi
ggccugauaagcguagcgcca

SEQ ID NO: 1668438 - RNA, 19 nt, Salmonella enterica enterica serovar Typhi
ggccuccggaucgacagca

SEQ ID NO: 1668439 - RNA, 20 nt, Salmonella enterica enterica serovar Typhi
ggccugauaagcacaggcca

SEQ ID NO: 1668440 - RNA, 19 nt, Salmonella enterica enterica serovar Typhi
ggccugauaagcacaggcc

SEQ ID NO: 1668441 - RNA, 16 nt, Salmonella enterica enterica serovar Typhi
ggccuacaaagccaaa

SEQ ID NO: 1668442 - RNA, 14 nt, Salmonella enterica enterica serovar Typhi
ggccgucggcgcca

SEQ ID NO: 1668443 - RNA, 22 nt, Salmonella enterica enterica serovar Typhi
ggccgguuguuuacacggcaaa

SEQ ID NO: 1668444 - RNA, 16 nt, Salmonella enterica enterica serovar Typhi
ggccaggcauccggcc

SEQ ID NO: 1668445 - RNA, 16 nt, Salmonella enterica enterica serovar Typhi
ggccgacgauaaacag

SEQ ID NO: 1668446 - RNA, 21 nt, Salmonella enterica enterica serovar Typhi
ggccgauuuuuuaucucgccg

SEQ ID NO: 1668447 - RNA, 17 nt, Salmonella enterica enterica serovar Typhi
ggccgauggucgcgcca

SEQ ID NO: 1668448 - RNA, 23 nt, Salmonella enterica enterica serovar Typhi
ggccacgccgccauccggcauca

SEQ ID NO: 1668449 - RNA, 15 nt, Salmonella enterica enterica serovar Typhi
ggccacgccgccauc

SEQ ID NO: 1668450 - RNA, 22 nt, Salmonella enterica enterica serovar Typhi
ggccacaauuguagcugcgcca

SEQ ID NO: 1668451 - RNA, 22 nt, Salmonella enterica enterica serovar Typhi
ggccaauggcucaacuccgccg

SEQ ID NO: 1668452 - RNA, 16 nt, Salmonella enterica enterica serovar Typhi
ggccaauuccgccaua

SEQ ID NO: 1668453 - RNA, 23 nt, Salmonella enterica enterica serovar Typhi
ggccagauagcgcagcacgguaa

SEQ ID NO: 1668454 - RNA, 16 nt, Salmonella enterica enterica serovar Typhi
ggcagcucucccgcca

SEQ ID NO: 1668455 - RNA, 17 nt, Salmonella enterica enterica serovar Typhi
ggcagaguccagcggca

SEQ ID NO: 1668456 - RNA, 12 nt, Salmonella enterica enterica serovar Typhi
ggcagacgauag

SEQ ID NO: 1668457 - RNA, 19 nt, Salmonella enterica enterica serovar Typhi
ggcaggccuuucggcagcg

SEQ ID NO: 1668458 - RNA, 14 nt, Salmonella enterica enterica serovar Typhi
ggcaggcagcgcca

SEQ ID NO: 1668459 - RNA, 14 nt, Salmonella enterica enterica serovar Typhi
ggcaguuuauccgg

SEQ ID NO: 1668460 - RNA, 15 nt, Salmonella enterica enterica serovar Typhi
ggcaucugcgcaacu

SEQ ID NO: 1668461 - RNA, 12 nt, Salmonella enterica enterica serovar Typhi
ggcaucucgcca

SEQ ID NO: 1668462 - RNA, 17 nt, Salmonella enterica enterica serovar Typhi
ggcauuucgccgccauc

SEQ ID NO: 1668463 - RNA, 23 nt, Salmonella enterica enterica serovar Typhi
ggcauuucacuuaauacucgccc

SEQ ID NO: 1668464 - RNA, 18 nt, Salmonella enterica enterica serovar Typhi
ggcauuuuuauuuaacgc

SEQ ID NO: 1668465 - RNA, 20 nt, Salmonella enterica enterica serovar Typhi
ggcauuuuuauuuaacgcca

SEQ ID NO: 1668466 - RNA, 13 nt, Salmonella enterica enterica serovar Typhi
ggccaaauaaccc

SEQ ID NO: 1668467 - RNA, 13 nt, Salmonella enterica enterica serovar Typhi
ggcauucgcacac

SEQ ID NO: 1668468 - RNA, 16 nt, Salmonella enterica enterica serovar Typhi
ggcauuuaugccgcca

SEQ ID NO: 1668469 - RNA, 13 nt, Salmonella enterica enterica serovar Typhi
ggcauuaaaugcg

SEQ ID NO: 1668470 - RNA, 18 nt, Salmonella enterica enterica serovar Typhi
ggcauuccccaucgcgac

SEQ ID NO: 1668471 - RNA, 22 nt, Salmonella enterica enterica serovar Typhi
ggcauuaguaauaaagcguagc

SEQ ID NO: 1668472 - RNA, 15 nt, Salmonella enterica enterica serovar Typhi
ggcaaucuuuaacgc

SEQ ID NO: 1668473 - RNA, 20 nt, Salmonella enterica enterica serovar Typhi
ggcaaugaugguagacaggc

SEQ ID NO: 1668474 - RNA, 15 nt, Salmonella enterica enterica serovar Typhi
ggcaaugaucagcga

SEQ ID NO: 1668475 - RNA, 19 nt, Salmonella enterica enterica serovar Typhi
ggcaaugcccccucggcag

SEQ ID NO: 1668476 - RNA, 11 nt, Salmonella enterica enterica serovar Typhi
ggcacagccag

SEQ ID NO: 1668477 - RNA, 13 nt, Salmonella enterica enterica serovar Typhi
ggcacaucaggca

SEQ ID NO: 1668478 - RNA, 22 nt, Salmonella enterica enterica serovar Typhi
ggcaagagauucaggccgccag

SEQ ID NO: 1668479 - RNA, 20 nt, Salmonella enterica enterica serovar Typhi
ggcaaacggcgccagcucau

SEQ ID NO: 1668480 - RNA, 12 nt, Salmonella enterica enterica serovar Typhi
ggcaaaaaucag

SEQ ID NO: 1668481 - RNA, 14 nt, Salmonella enterica enterica serovar Typhi
ggcaaaaaacggaa

SEQ ID NO: 1668482 - RNA, 23 nt, Salmonella enterica enterica serovar Typhi
ggauuucgucgcuaagcgucaga

SEQ ID NO: 1668483 - RNA, 13 nt, Salmonella enterica enterica serovar Typhi
ggcaacgccagag

SEQ ID NO: 1668484 - RNA, 19 nt, Salmonella enterica enterica serovar Typhi
ggcaaagccccagucauuc

SEQ ID NO: 1668485 - RNA, 15 nt, Salmonella enterica enterica serovar Typhi
ggcaaagucgaacga

SEQ ID NO: 1668486 - RNA, 18 nt, Salmonella enterica enterica serovar Typhi
ggcacugcgcuuauccgg

SEQ ID NO: 1668487 - RNA, 19 nt, Salmonella enterica enterica serovar Typhi
ggcacucugcgccagguuu

SEQ ID NO: 1668488 - RNA, 15 nt, Salmonella enterica enterica serovar Typhi
ggcaccucguccaga

SEQ ID NO: 1668489 - RNA, 21 nt, Salmonella enterica enterica serovar Typhi
ggcaccggaaccggcaucggg

SEQ ID NO: 1668490 - RNA, 22 nt, Salmonella enterica enterica serovar Typhi
ggcaccauaauuuccguagcga

SEQ ID NO: 1668491 - RNA, 15 nt, Salmonella enterica enterica serovar Typhi
ggaacaagcaaaccu

SEQ ID NO: 1668492 - RNA, 13 nt, Salmonella enterica enterica serovar Typhi
ggaucgccggauu

SEQ ID NO: 1668493 - RNA, 14 nt, Salmonella enterica enterica serovar Typhi
ggaucggccauauc

SEQ ID NO: 1668494 - RNA, 20 nt, Salmonella enterica enterica serovar Typhi
ggaucgggcagacuuucuga

SEQ ID NO: 1668495 - RNA, 20 nt, Salmonella enterica enterica serovar Typhi
ggaugaagcagacaucgcgc

SEQ ID NO: 1668496 - RNA, 20 nt, Salmonella enterica enterica serovar Typhi
ggaucugcuuaugaucgccc

SEQ ID NO: 1668497 - RNA, 15 nt, Salmonella enterica enterica serovar Typhi
ggaucgggcuuccag

SEQ ID NO: 1668498 - RNA, 19 nt, Salmonella enterica enterica serovar Typhi
ggauggaauuuugcaccau

SEQ ID NO: 1668499 - RNA, 20 nt, Salmonella enterica enterica serovar Typhi
ggaugcgagaaugucgccau

SEQ ID NO: 1668500 - RNA, 10 nt, Salmonella enterica enterica serovar Typhi
ggaugguggu

SEQ ID NO: 1668501 - RNA, 11 nt, Salmonella enterica enterica serovar Typhi
ggauguaggcc

SEQ ID NO: 1668502 - RNA, 22 nt, Salmonella enterica enterica serovar Typhi
ggauggcggcguaaacgccuua

SEQ ID NO: 1668503 - RNA, 16 nt, Salmonella enterica enterica serovar Typhi
ggauugauauccagcu

SEQ ID NO: 1668504 - RNA, 22 nt, Salmonella enterica enterica serovar Typhi
ggauucucuaacgucagcgcca

SEQ ID NO: 1668505 - RNA, 23 nt, Salmonella enterica enterica serovar Typhi
ggauuaaaugacgcccugcgcca

SEQ ID NO: 1668506 - RNA, 12 nt, Salmonella enterica enterica serovar Typhi
ggcgccaucaug

SEQ ID NO: 1668507 - RNA, 21 nt, Salmonella enterica enterica serovar Typhi
ggcgcauuuucggcagcgcga

SEQ ID NO: 1668508 - RNA, 22 nt, Salmonella enterica enterica serovar Typhi
ggcgcagccgccauccggcaca

SEQ ID NO: 1668509 - RNA, 23 nt, Salmonella enterica enterica serovar Typhi
ggcgcaaaucgccaucagcgcga

SEQ ID NO: 1668510 - RNA, 21 nt, Salmonella enterica enterica serovar Typhi
ggcgccgauaacacggcuggc

SEQ ID NO: 1668511 - RNA, 15 nt, Salmonella enterica enterica serovar Typhi
ggcgccggggcagca

SEQ ID NO: 1668512 - RNA, 15 nt, Salmonella enterica enterica serovar Typhi
ggcgauuugacgaac

SEQ ID NO: 1668513 - RNA, 13 nt, Salmonella enterica enterica serovar Typhi
ggcgauuuucagc

SEQ ID NO: 1668514 - RNA, 19 nt, Salmonella enterica enterica serovar Typhi
ggcgauguucuugccgcca

SEQ ID NO: 1668515 - RNA, 17 nt, Salmonella enterica enterica serovar Typhi
ggcgauucccgaucuuc

SEQ ID NO: 1668516 - RNA, 19 nt, Salmonella enterica enterica serovar Typhi
ggcgaucgcuaaucaggac

SEQ ID NO: 1668517 - RNA, 19 nt, Salmonella enterica enterica serovar Typhi
ggcgaugccuuauccggcc

SEQ ID NO: 1668518 - RNA, 14 nt, Salmonella enterica enterica serovar Typhi
ggcgaucagcgcca

SEQ ID NO: 1668519 - RNA, 15 nt, Salmonella enterica enterica serovar Typhi
ggcgaucagcgccac

SEQ ID NO: 1668520 - RNA, 14 nt, Salmonella enterica enterica serovar Typhi
ggcgaucaccacgc

SEQ ID NO: 1668521 - RNA, 22 nt, Salmonella enterica enterica serovar Typhi
ggcgauaccgguacggaacguc

SEQ ID NO: 1668522 - RNA, 20 nt, Salmonella enterica enterica serovar Typhi
ggcgauaaaaauauccgcca

SEQ ID NO: 1668523 - RNA, 15 nt, Salmonella enterica enterica serovar Typhi
ggcgaggcguaaaac

SEQ ID NO: 1668524 - RNA, 17 nt, Salmonella enterica enterica serovar Typhi
ggcgcuuugcuuauccg

SEQ ID NO: 1668525 - RNA, 15 nt, Salmonella enterica enterica serovar Typhi
ggcgcuuugccguuc

SEQ ID NO: 1668526 - RNA, 18 nt, Salmonella enterica enterica serovar Typhi
ggcgcugucgcuuaccgg

SEQ ID NO: 1668527 - RNA, 20 nt, Salmonella enterica enterica serovar Typhi
ggcgcuucgcuuaucaggcc

SEQ ID NO: 1668528 - RNA, 21 nt, Salmonella enterica enterica serovar Typhi
ggcgcuugcgccaucauccgg

SEQ ID NO: 1668529 - RNA, 12 nt, Salmonella enterica enterica serovar Typhi
ggcgcuuaucca

SEQ ID NO: 1668530 - RNA, 23 nt, Salmonella enterica enterica serovar Typhi
ggcggcauaaaugccuuauccgg

SEQ ID NO: 1668531 - RNA, 15 nt, Salmonella enterica enterica serovar Typhi
ggcggcuuuacccgg

SEQ ID NO: 1668532 - RNA, 20 nt, Salmonella enterica enterica serovar Typhi
ggcggcuucgccuuauccgg

SEQ ID NO: 1668533 - RNA, 19 nt, Salmonella enterica enterica serovar Typhi
ggcggcuucgccuuauccg

SEQ ID NO: 1668534 - RNA, 19 nt, Salmonella enterica enterica serovar Typhi
ggcggcugcgccuuauccg

SEQ ID NO: 1668535 - RNA, 23 nt, Salmonella enterica enterica serovar Typhi
ggcggcgugaacgccuuauccgg

SEQ ID NO: 1668536 - RNA, 23 nt, Salmonella enterica enterica serovar Typhi
ggcggcguaaacaccuuauccgg

SEQ ID NO: 1668537 - RNA, 21 nt, Salmonella enterica enterica serovar Typhi
ggcggcgaaaugccuuauccg

SEQ ID NO: 1668538 - RNA, 23 nt, Salmonella enterica enterica serovar Typhi
ggcggcgcaaaggccuuauccgg

SEQ ID NO: 1668539 - RNA, 20 nt, Salmonella enterica enterica serovar Typhi
ggcggcgaugccuuauccgg

SEQ ID NO: 1668540 - RNA, 21 nt, Salmonella enterica enterica serovar Typhi
ggcgcugaacgcauacaggcu

SEQ ID NO: 1668541 - RNA, 18 nt, Salmonella enterica enterica serovar Typhi
ggcgcuacgcuuaucagg

SEQ ID NO: 1668542 - RNA, 23 nt, Salmonella enterica enterica serovar Typhi
ggcgcuaaaccggcggaauagcu

SEQ ID NO: 1668543 - RNA, 18 nt, Salmonella enterica enterica serovar Typhi
ggcgcuaagccagccaaa

SEQ ID NO: 1668544 - RNA, 19 nt, Salmonella enterica enterica serovar Typhi
ggcgcuaaugcuuauccgg

SEQ ID NO: 1668545 - RNA, 20 nt, Salmonella enterica enterica serovar Typhi
ggcgcugcguuuauuaggcc

SEQ ID NO: 1668546 - RNA, 17 nt, Salmonella enterica enterica serovar Typhi
ggcgcugcgcuuauccg

SEQ ID NO: 1668547 - RNA, 20 nt, Salmonella enterica enterica serovar Typhi
ggcgcugcgcuuaucagacc

SEQ ID NO: 1668548 - RNA, 20 nt, Salmonella enterica enterica serovar Typhi
ggcgcugcgcgcaucgggcc

SEQ ID NO: 1668549 - RNA, 17 nt, Salmonella enterica enterica serovar Typhi
ggcgcugcgcuuaccgg

SEQ ID NO: 1668550 - RNA, 21 nt, Salmonella enterica enterica serovar Typhi
ggcgcugccgcuuauccggcc

SEQ ID NO: 1668551 - RNA, 20 nt, Salmonella enterica enterica serovar Typhi
ggcgcgcgcgccuaccgcca

SEQ ID NO: 1668552 - RNA, 22 nt, Salmonella enterica enterica serovar Typhi
ggcgcgaacgccuuauccggcc

SEQ ID NO: 1668553 - RNA, 14 nt, Salmonella enterica enterica serovar Typhi
ggcgccuuguccgg

SEQ ID NO: 1668554 - RNA, 13 nt, Salmonella enterica enterica serovar Typhi
ggcuaaucgccac

SEQ ID NO: 1668555 - RNA, 21 nt, Salmonella enterica enterica serovar Typhi
ggcuaauacgccagccgucau

SEQ ID NO: 1668556 - RNA, 21 nt, Salmonella enterica enterica serovar Typhi
ggcguuuacgcugcuauccgg

SEQ ID NO: 1668557 - RNA, 14 nt, Salmonella enterica enterica serovar Typhi
ggcguuacgcgcca

SEQ ID NO: 1668558 - RNA, 13 nt, Salmonella enterica enterica serovar Typhi
ggcguguuucagc

SEQ ID NO: 1668559 - RNA, 12 nt, Salmonella enterica enterica serovar Typhi
ggcguuccgcac

SEQ ID NO: 1668560 - RNA, 17 nt, Salmonella enterica enterica serovar Typhi
ggcguggugucucgucg

SEQ ID NO: 1668561 - RNA, 19 nt, Salmonella enterica enterica serovar Typhi
ggcucccacucuuccagca

SEQ ID NO: 1668562 - RNA, 21 nt, Salmonella enterica enterica serovar Typhi
ggcucaggaaaacaaauugca

SEQ ID NO: 1668563 - RNA, 21 nt, Salmonella enterica enterica serovar Typhi
ggcuccgaccaucgccgcgaa

SEQ ID NO: 1668564 - RNA, 18 nt, Salmonella enterica enterica serovar Typhi
ggcuccgaccaucgccgc

SEQ ID NO: 1668565 - RNA, 16 nt, Salmonella enterica enterica serovar Typhi
ggcgugccgggcuggc

SEQ ID NO: 1668566 - RNA, 21 nt, Salmonella enterica enterica serovar Typhi
ggcgugccguccugugcuuug

SEQ ID NO: 1668567 - RNA, 14 nt, Salmonella enterica enterica serovar Typhi
ggcgugacgcgcca

SEQ ID NO: 1668568 - RNA, 22 nt, Salmonella enterica enterica serovar Typhi
ggcgugaccgccuuauccggcc

SEQ ID NO: 1668569 - RNA, 15 nt, Salmonella enterica enterica serovar Typhi
ggcgugaaccgguaa

SEQ ID NO: 1668570 - RNA, 13 nt, Salmonella enterica enterica serovar Typhi
ggcucuacucgcg

SEQ ID NO: 1668571 - RNA, 20 nt, Salmonella enterica enterica serovar Typhi
ggcugccguuaaucuggccu

SEQ ID NO: 1668572 - RNA, 12 nt, Salmonella enterica enterica serovar Typhi
ggcugccgccau

SEQ ID NO: 1668573 - RNA, 19 nt, Salmonella enterica enterica serovar Typhi
ggcugauugacuaucagcc

SEQ ID NO: 1668574 - RNA, 13 nt, Salmonella enterica enterica serovar Typhi
ggcugauggcgaa

SEQ ID NO: 1668575 - RNA, 15 nt, Salmonella enterica enterica serovar Typhi
ggcugaguucaggca

SEQ ID NO: 1668576 - RNA, 13 nt, Salmonella enterica enterica serovar Typhi
ggcugccacacgu

SEQ ID NO: 1668577 - RNA, 18 nt, Salmonella enterica enterica serovar Typhi
ggcuucuucaacauuguc

SEQ ID NO: 1668578 - RNA, 14 nt, Salmonella enterica enterica serovar Typhi
ggcuuccucgccac

SEQ ID NO: 1668579 - RNA, 16 nt, Salmonella enterica enterica serovar Typhi
ggcuuaccuucggccu

SEQ ID NO: 1668580 - RNA, 11 nt, Salmonella enterica enterica serovar Typhi
ggcuuccggca

SEQ ID NO: 1668581 - RNA, 20 nt, Salmonella enterica enterica serovar Typhi
ggcuuugccagcggcgcgau

SEQ ID NO: 1668582 - RNA, 21 nt, Salmonella enterica enterica serovar Typhi
ggcuuucacaccguuauccgg

SEQ ID NO: 1668583 - RNA, 11 nt, Salmonella enterica enterica serovar Typhi
ggcuuucacgc

SEQ ID NO: 1668584 - RNA, 19 nt, Salmonella enterica enterica serovar Typhi
gggaaaagcgguaucacgc

SEQ ID NO: 1668585 - RNA, 21 nt, Salmonella enterica enterica serovar Typhi
ggcuguccuugcgccaucggc

SEQ ID NO: 1668586 - RNA, 21 nt, Salmonella enterica enterica serovar Typhi
ggcugucgauaacagcauaaa

SEQ ID NO: 1668587 - RNA, 18 nt, Salmonella enterica enterica serovar Typhi
ggcuguagccagccugaa

SEQ ID NO: 1668588 - RNA, 18 nt, Salmonella enterica enterica serovar Typhi
ggcuuaacacccggauau

SEQ ID NO: 1668589 - RNA, 14 nt, Salmonella enterica enterica serovar Typhi
ggcuuauaccgaca

SEQ ID NO: 1668590 - RNA, 14 nt, Salmonella enterica enterica serovar Typhi
gguuccauuccaga

SEQ ID NO: 1668591 - RNA, 14 nt, Salmonella enterica enterica serovar Typhi
gguucccaccgcau

SEQ ID NO: 1668592 - RNA, 20 nt, Salmonella enterica enterica serovar Typhi
gguuauacaguucaggaucg

SEQ ID NO: 1668593 - RNA, 12 nt, Salmonella enterica enterica serovar Typhi
gguuauccagca

SEQ ID NO: 1668594 - RNA, 17 nt, Salmonella enterica enterica serovar Typhi
gguuaaaaacagccagc

SEQ ID NO: 1668595 - RNA, 13 nt, Salmonella enterica enterica serovar Typhi
ggugugccgccau

SEQ ID NO: 1668596 - RNA, 22 nt, Salmonella enterica enterica serovar Typhi
gguuucagcaccuccagcgccu

SEQ ID NO: 1668597 - RNA, 22 nt, Salmonella enterica enterica serovar Typhi
gguugucuuaccuaacggauaa

SEQ ID NO: 1668598 - RNA, 18 nt, Salmonella enterica enterica serovar Typhi
gguuggcuauacgcggcg

SEQ ID NO: 1668599 - RNA, 19 nt, Salmonella enterica enterica serovar Typhi
gguuggcgacauacgcgcu

SEQ ID NO: 1668600 - RNA, 13 nt, Salmonella enterica enterica serovar Typhi
gguugccgcauaa

SEQ ID NO: 1668601 - RNA, 17 nt, Salmonella enterica enterica serovar Typhi
gguugcgcgcuggauca

SEQ ID NO: 1668602 - RNA, 17 nt, Salmonella enterica enterica serovar Typhi
gguggguuccagcgcca

SEQ ID NO: 1668603 - RNA, 14 nt, Salmonella enterica enterica serovar Typhi
ggugucaaagcgcc

SEQ ID NO: 1668604 - RNA, 13 nt, Salmonella enterica enterica serovar Typhi
ggugcuuaucuga

SEQ ID NO: 1668605 - RNA, 18 nt, Salmonella enterica enterica serovar Typhi
guagcccagcgccgcauc

SEQ ID NO: 1668606 - RNA, 14 nt, Salmonella enterica enterica serovar Typhi
guagcccucgcaaa

SEQ ID NO: 1668607 - RNA, 16 nt, Salmonella enterica enterica serovar Typhi
guagcccgcuuuaccg

SEQ ID NO: 1668608 - RNA, 18 nt, Salmonella enterica enterica serovar Typhi
guagccgcgcgccgccuc

SEQ ID NO: 1668609 - RNA, 21 nt, Salmonella enterica enterica serovar Typhi
guagaacaccacgcgaccaug

SEQ ID NO: 1668610 - RNA, 15 nt, Salmonella enterica enterica serovar Typhi
guacuuucuacaaau

SEQ ID NO: 1668611 - RNA, 22 nt, Salmonella enterica enterica serovar Typhi
guacuuuucauccacagcgcca

SEQ ID NO: 1668612 - RNA, 17 nt, Salmonella enterica enterica serovar Typhi
guacuccgcgcgcguaa

SEQ ID NO: 1668613 - RNA, 17 nt, Salmonella enterica enterica serovar Typhi
guagaagugaagcgccg

SEQ ID NO: 1668614 - RNA, 16 nt, Salmonella enterica enterica serovar Typhi
guagacauagccggug

SEQ ID NO: 1668615 - RNA, 18 nt, Salmonella enterica enterica serovar Typhi
guagagcggauaagcgca

SEQ ID NO: 1668616 - RNA, 14 nt, Salmonella enterica enterica serovar Typhi
guagauaagcgcca

SEQ ID NO: 1668617 - RNA, 21 nt, Salmonella enterica enterica serovar Typhi
guagauacugaccaagcguca

SEQ ID NO: 1668618 - RNA, 12 nt, Salmonella enterica enterica serovar Typhi
guagaucgccag

SEQ ID NO: 1668619 - RNA, 14 nt, Salmonella enterica enterica serovar Typhi
guaggguugccaga

SEQ ID NO: 1668620 - RNA, 18 nt, Salmonella enterica enterica serovar Typhi
guaggguagaucacgcca

SEQ ID NO: 1668621 - RNA, 14 nt, Salmonella enterica enterica serovar Typhi
guauagccaggcag

SEQ ID NO: 1668622 - RNA, 16 nt, Salmonella enterica enterica serovar Typhi
guauccugaaccagcg

SEQ ID NO: 1668623 - RNA, 17 nt, Salmonella enterica enterica serovar Typhi
aaguccguauuauccac

SEQ ID NO: 1668624 - RNA, 19 nt, Salmonella enterica enterica serovar Typhi
guaggccggauaaggcauu

SEQ ID NO: 1668625 - RNA, 13 nt, Salmonella enterica enterica serovar Typhi
guaggccggauaa

SEQ ID NO: 1668626 - RNA, 21 nt, Salmonella enterica enterica serovar Typhi
guaggccggauuaaggcguuu

SEQ ID NO: 1668627 - RNA, 19 nt, Salmonella enterica enterica serovar Typhi
guaggccugauaagcguag

SEQ ID NO: 1668628 - RNA, 19 nt, Salmonella enterica enterica serovar Typhi
guaggccugauaagcgcag

SEQ ID NO: 1668629 - RNA, 22 nt, Salmonella enterica enterica serovar Typhi
guaacgcauacggguaaaggca

SEQ ID NO: 1668630 - RNA, 17 nt, Salmonella enterica enterica serovar Typhi
guaacggaaaagcauug

SEQ ID NO: 1668631 - RNA, 18 nt, Salmonella enterica enterica serovar Typhi
guaacggacucaggccuu

SEQ ID NO: 1668632 - RNA, 21 nt, Salmonella enterica enterica serovar Typhi
guaacgguguuucaucuucau

SEQ ID NO: 1668633 - RNA, 13 nt, Salmonella enterica enterica serovar Typhi
guaaucuuccacc

SEQ ID NO: 1668634 - RNA, 20 nt, Salmonella enterica enterica serovar Typhi
guaaucuucgcggcugccgu

SEQ ID NO: 1668635 - RNA, 18 nt, Salmonella enterica enterica serovar Typhi
guaauuaaggauugccgc

SEQ ID NO: 1668636 - RNA, 24 nt, Salmonella enterica enterica serovar Typhi
guaaugacuggcuuugcgccacuu

SEQ ID NO: 1668637 - RNA, 16 nt, Salmonella enterica enterica serovar Typhi
guacagaagguuauuc

SEQ ID NO: 1668638 - RNA, 16 nt, Salmonella enterica enterica serovar Typhi
guacagacaucaucga

SEQ ID NO: 1668639 - RNA, 21 nt, Salmonella enterica enterica serovar Typhi
guacagacaucaucgaacgcc

SEQ ID NO: 1668640 - RNA, 16 nt, Salmonella enterica enterica serovar Typhi
guacagcagcgacgca

SEQ ID NO: 1668641 - RNA, 22 nt, Salmonella enterica enterica serovar Typhi
guaauucucacagaaucaucag

SEQ ID NO: 1668642 - RNA, 12 nt, Salmonella enterica enterica serovar Typhi
guaaacgcgcca

SEQ ID NO: 1668643 - RNA, 15 nt, Salmonella enterica enterica serovar Typhi
guaaacgcgccaucg

SEQ ID NO: 1668644 - RNA, 12 nt, Salmonella enterica enterica serovar Typhi
guaaacgugcca

SEQ ID NO: 1668645 - RNA, 20 nt, Salmonella enterica enterica serovar Typhi
guaaauuuaucgaucuccau

SEQ ID NO: 1668646 - RNA, 23 nt, Salmonella enterica enterica serovar Typhi
guaaauuucaacccgaucgccau

SEQ ID NO: 1668647 - RNA, 13 nt, Salmonella enterica enterica serovar Typhi
guaacaucgaaug

SEQ ID NO: 1668648 - RNA, 18 nt, Salmonella enterica enterica serovar Typhi
guaacaguauccgacgca

SEQ ID NO: 1668649 - RNA, 15 nt, Salmonella enterica enterica serovar Typhi
guaacccgccgccau

SEQ ID NO: 1668650 - RNA, 20 nt, Salmonella enterica enterica serovar Typhi
guaaauuucaacccgaucgc

SEQ ID NO: 1668651 - RNA, 14 nt, Salmonella enterica enterica serovar Typhi
guaacacaaucagg

SEQ ID NO: 1668652 - RNA, 17 nt, Salmonella enterica enterica serovar Typhi
guaacagaauuaacgca

SEQ ID NO: 1668653 - RNA, 13 nt, Salmonella enterica enterica serovar Typhi
guaacagcaacau

SEQ ID NO: 1668654 - RNA, 18 nt, Salmonella enterica enterica serovar Typhi
guaaacacgacgcugcca

SEQ ID NO: 1668655 - RNA, 14 nt, Salmonella enterica enterica serovar Typhi
gguuucuccagccu

SEQ ID NO: 1668656 - RNA, 14 nt, Salmonella enterica enterica serovar Typhi
guaccggcaaccgg

SEQ ID NO: 1668657 - RNA, 14 nt, Salmonella enterica enterica serovar Typhi
guaccagcgcgaac

SEQ ID NO: 1668658 - RNA, 20 nt, Salmonella enterica enterica serovar Typhi
guaccaccagaaucgccagc

SEQ ID NO: 1668659 - RNA, 16 nt, Salmonella enterica enterica serovar Typhi
guacgcagcaggcaga

SEQ ID NO: 1668660 - RNA, 17 nt, Salmonella enterica enterica serovar Typhi
guacgcgacugaucagg

SEQ ID NO: 1668661 - RNA, 15 nt, Salmonella enterica enterica serovar Typhi
guacgcggucgccug

SEQ ID NO: 1668662 - RNA, 20 nt, Salmonella enterica enterica serovar Typhi
guacgcgucugaaugacgcc

SEQ ID NO: 1668663 - RNA, 21 nt, Salmonella enterica enterica serovar Typhi
guacggaaaugaucagacgca

SEQ ID NO: 1668664 - RNA, 22 nt, Salmonella enterica enterica serovar Typhi
guacggaauaucccgcaagaaa

SEQ ID NO: 1668665 - RNA, 18 nt, Salmonella enterica enterica serovar Typhi
guacggccaccaggccug

SEQ ID NO: 1668666 - RNA, 15 nt, Salmonella enterica enterica serovar Typhi
guacggcauggcguc

SEQ ID NO: 1668667 - RNA, 14 nt, Salmonella enterica enterica serovar Typhi
guacggauggcguc

SEQ ID NO: 1668668 - RNA, 13 nt, Salmonella enterica enterica serovar Typhi
ggugaaaucacgc

SEQ ID NO: 1668669 - RNA, 17 nt, Salmonella enterica enterica serovar Typhi
ggucugacaacuauugc

SEQ ID NO: 1668670 - RNA, 12 nt, Salmonella enterica enterica serovar Typhi
ggugaagacgcu

SEQ ID NO: 1668671 - RNA, 16 nt, Salmonella enterica enterica serovar Typhi
ggucgucugaaagcga

SEQ ID NO: 1668672 - RNA, 19 nt, Salmonella enterica enterica serovar Typhi
ggucgucugaaagcgacuc

SEQ ID NO: 1668673 - RNA, 23 nt, Salmonella enterica enterica serovar Typhi
ggugagcuccagcccgccgcccu

SEQ ID NO: 1668674 - RNA, 20 nt, Salmonella enterica enterica serovar Typhi
ggugacggcaacggcgacaa

SEQ ID NO: 1668675 - RNA, 23 nt, Salmonella enterica enterica serovar Typhi
ggucgcuuuuugcgccagcgcca

SEQ ID NO: 1668676 - RNA, 18 nt, Salmonella enterica enterica serovar Typhi
ggucggcgcaguucgccg

SEQ ID NO: 1668677 - RNA, 20 nt, Salmonella enterica enterica serovar Typhi
ggucagcucacgcgccagca

SEQ ID NO: 1668678 - RNA, 22 nt, Salmonella enterica enterica serovar Typhi
ggucaggaacugcggccagaca

SEQ ID NO: 1668679 - RNA, 14 nt, Salmonella enterica enterica serovar Typhi
ggucaggaagacuu

SEQ ID NO: 1668680 - RNA, 21 nt, Salmonella enterica enterica serovar Typhi
gguagucacggagagucgcac

SEQ ID NO: 1668681 - RNA, 18 nt, Salmonella enterica enterica serovar Typhi
gguagcgguuucgccuua

SEQ ID NO: 1668682 - RNA, 15 nt, Salmonella enterica enterica serovar Typhi
gguagcguuauccag

SEQ ID NO: 1668683 - RNA, 16 nt, Salmonella enterica enterica serovar Typhi
gguaguguuaucgccg

SEQ ID NO: 1668684 - RNA, 21 nt, Salmonella enterica enterica serovar Typhi
ggucagggugaaucccgccau

SEQ ID NO: 1668685 - RNA, 17 nt, Salmonella enterica enterica serovar Typhi
ggucaucgcggccagca

SEQ ID NO: 1668686 - RNA, 18 nt, Salmonella enterica enterica serovar Typhi
ggucauucaggacggugg

SEQ ID NO: 1668687 - RNA, 14 nt, Salmonella enterica enterica serovar Typhi
ggguaaauccgcga

SEQ ID NO: 1668688 - RNA, 18 nt, Salmonella enterica enterica serovar Typhi
ggguaauagaugcgucgc

SEQ ID NO: 1668689 - RNA, 17 nt, Salmonella enterica enterica serovar Typhi
ggguaaacgcagcguca

SEQ ID NO: 1668690 - RNA, 16 nt, Salmonella enterica enterica serovar Typhi
ggguaucccgacgcac

SEQ ID NO: 1668691 - RNA, 19 nt, Salmonella enterica enterica serovar Typhi
ggguauuuuuuagcgccaa

SEQ ID NO: 1668692 - RNA, 20 nt, Salmonella enterica enterica serovar Typhi
gggucgacguuguccggcga

SEQ ID NO: 1668693 - RNA, 14 nt, Salmonella enterica enterica serovar Typhi
gggaauaagcgccc

SEQ ID NO: 1668694 - RNA, 22 nt, Salmonella enterica enterica serovar Typhi
gggaaguccuucuccuucgcca

SEQ ID NO: 1668695 - RNA, 14 nt, Salmonella enterica enterica serovar Typhi
gggaagcgcgcgca

SEQ ID NO: 1668696 - RNA, 22 nt, Salmonella enterica enterica serovar Typhi
gggaagaugugccacuccgcca

SEQ ID NO: 1668697 - RNA, 15 nt, Salmonella enterica enterica serovar Typhi
gggguguuacgccau

SEQ ID NO: 1668698 - RNA, 17 nt, Salmonella enterica enterica serovar Typhi
gguacauccaugccauc

SEQ ID NO: 1668699 - RNA, 18 nt, Salmonella enterica enterica serovar Typhi
ggguuuucuaccgcagcc

SEQ ID NO: 1668700 - RNA, 22 nt, Salmonella enterica enterica serovar Typhi
gguacacaaucaaggcagcgaa

SEQ ID NO: 1668701 - RNA, 15 nt, Salmonella enterica enterica serovar Typhi
gguaauuugcgccau

SEQ ID NO: 1668702 - RNA, 21 nt, Salmonella enterica enterica serovar Typhi
gggucgugcaggauucgaacc

SEQ ID NO: 1668703 - RNA, 15 nt, Salmonella enterica enterica serovar Typhi
gggugagacgcagcc

SEQ ID NO: 1668704 - RNA, 22 nt, Salmonella enterica enterica serovar Typhi
gggucuuauuucuccugcgcca

SEQ ID NO: 1668705 - RNA, 21 nt, Salmonella enterica enterica serovar Typhi
gggugaugacgggaucgaacc

SEQ ID NO: 1668706 - RNA, 12 nt, Salmonella enterica enterica serovar Typhi
ggguggcgagca

SEQ ID NO: 1668707 - RNA, 21 nt, Salmonella enterica enterica serovar Typhi
gucauuuaccagugcuaaaau

SEQ ID NO: 1668708 - RNA, 19 nt, Salmonella enterica enterica serovar Typhi
guccaccgauuucaucgcu

SEQ ID NO: 1668709 - RNA, 22 nt, Salmonella enterica enterica serovar Typhi
gucauggcgccaccagcgauuu

SEQ ID NO: 1668710 - RNA, 17 nt, Salmonella enterica enterica serovar Typhi
gucauggcuuagcgcca

SEQ ID NO: 1668711 - RNA, 13 nt, Salmonella enterica enterica serovar Typhi
gucaugcgccacg

SEQ ID NO: 1668712 - RNA, 14 nt, Salmonella enterica enterica serovar Typhi
gucauaaucgccgu

SEQ ID NO: 1668713 - RNA, 20 nt, Salmonella enterica enterica serovar Typhi
gucaguguuuccauacauuu

SEQ ID NO: 1668714 - RNA, 23 nt, Salmonella enterica enterica serovar Typhi
gucaguacgcgcguauccgccgg

SEQ ID NO: 1668715 - RNA, 23 nt, Salmonella enterica enterica serovar Typhi
gucaggagccaccggcagggcca

SEQ ID NO: 1668716 - RNA, 16 nt, Salmonella enterica enterica serovar Typhi
guaucgcgacagcgcu

SEQ ID NO: 1668717 - RNA, 14 nt, Salmonella enterica enterica serovar Typhi
guccagcggcagcu

SEQ ID NO: 1668718 - RNA, 21 nt, Salmonella enterica enterica serovar Typhi
guccagcauccaugccagcgc

SEQ ID NO: 1668719 - RNA, 20 nt, Salmonella enterica enterica serovar Typhi
gucgaccaguccuuccgccg

SEQ ID NO: 1668720 - RNA, 17 nt, Salmonella enterica enterica serovar Typhi
guccuucacaaacuucu

SEQ ID NO: 1668721 - RNA, 17 nt, Salmonella enterica enterica serovar Typhi
guccggguucagcgaca

SEQ ID NO: 1668722 - RNA, 14 nt, Salmonella enterica enterica serovar Typhi
gucgaucucggcca

SEQ ID NO: 1668723 - RNA, 18 nt, Salmonella enterica enterica serovar Typhi
gucgcaaucuggcgcaau

SEQ ID NO: 1668724 - RNA, 14 nt, Salmonella enterica enterica serovar Typhi
gucgcccaugcgau

SEQ ID NO: 1668725 - RNA, 23 nt, Salmonella enterica enterica serovar Typhi
gucgccagacccagcgcuaacgg

SEQ ID NO: 1668726 - RNA, 13 nt, Salmonella enterica enterica serovar Typhi
gucgcgccagcga

SEQ ID NO: 1668727 - RNA, 23 nt, Salmonella enterica enterica serovar Typhi
gucgccuuccagcgacuccggau

SEQ ID NO: 1668728 - RNA, 16 nt, Salmonella enterica enterica serovar Typhi
gucgccggggcgcugg

SEQ ID NO: 1668729 - RNA, 15 nt, Salmonella enterica enterica serovar Typhi
gucugauggcgcugc

SEQ ID NO: 1668730 - RNA, 21 nt, Salmonella enterica enterica serovar Typhi
gucugaauauuaaaguucagc

SEQ ID NO: 1668731 - RNA, 13 nt, Salmonella enterica enterica serovar Typhi
gucucauccggca

SEQ ID NO: 1668732 - RNA, 16 nt, Salmonella enterica enterica serovar Typhi
gucucaaucgcaaauu

SEQ ID NO: 1668733 - RNA, 19 nt, Salmonella enterica enterica serovar Typhi
gucguuuguaggccggaug

SEQ ID NO: 1668734 - RNA, 22 nt, Salmonella enterica enterica serovar Typhi
gucuccggcgcgccgcuggcga

SEQ ID NO: 1668735 - RNA, 19 nt, Salmonella enterica enterica serovar Typhi
gucuccucgccagcuaccg

SEQ ID NO: 1668736 - RNA, 23 nt, Salmonella enterica enterica serovar Typhi
gucuguaccaccagaaucgccag

SEQ ID NO: 1668737 - RNA, 14 nt, Salmonella enterica enterica serovar Typhi
gucuguuucaacgc

SEQ ID NO: 1668738 - RNA, 22 nt, Salmonella enterica enterica serovar Typhi
gucugcugaucguuuuugucca

SEQ ID NO: 1668739 - RNA, 17 nt, Salmonella enterica enterica serovar Typhi
gucuugcgcguccgccu

SEQ ID NO: 1668740 - RNA, 19 nt, Salmonella enterica enterica serovar Typhi
gucuuuauucaucaucuug

SEQ ID NO: 1668741 - RNA, 20 nt, Salmonella enterica enterica serovar Typhi
gugaaaagcgggggcgacag

SEQ ID NO: 1668742 - RNA, 13 nt, Salmonella enterica enterica serovar Typhi
gucuucugccagc

SEQ ID NO: 1668743 - RNA, 19 nt, Salmonella enterica enterica serovar Typhi
gugaagacacaacgugcca

SEQ ID NO: 1668744 - RNA, 13 nt, Salmonella enterica enterica serovar Typhi
gugaacugcgccu

SEQ ID NO: 1668745 - RNA, 17 nt, Salmonella enterica enterica serovar Typhi
gugaacgcacgcagcca

SEQ ID NO: 1668746 - RNA, 19 nt, Salmonella enterica enterica serovar Typhi
gugaacgccuuauccggcc

SEQ ID NO: 1668747 - RNA, 20 nt, Salmonella enterica enterica serovar Typhi
gugaacaaaggcagccaaca

SEQ ID NO: 1668748 - RNA, 13 nt, Salmonella enterica enterica serovar Typhi
gugaccagcaguu

SEQ ID NO: 1668749 - RNA, 20 nt, Salmonella enterica enterica serovar Typhi
gugacauuuaucuuccggca

SEQ ID NO: 1668750 - RNA, 21 nt, Salmonella enterica enterica serovar Typhi
gugaauaugaucugcacaaca

SEQ ID NO: 1668751 - RNA, 21 nt, Salmonella enterica enterica serovar Typhi
gugaaucaucaucauccgcgc

SEQ ID NO: 1668752 - RNA, 21 nt, Salmonella enterica enterica serovar Typhi
gugaauaugaucugcgcaaca

SEQ ID NO: 1668753 - RNA, 20 nt, Salmonella enterica enterica serovar Typhi
gugagcgaacaggucgcuaa

SEQ ID NO: 1668754 - RNA, 14 nt, Salmonella enterica enterica serovar Typhi
gugagcaucggcga

SEQ ID NO: 1668755 - RNA, 14 nt, Salmonella enterica enterica serovar Typhi
gugacgguaucgug

SEQ ID NO: 1668756 - RNA, 18 nt, Salmonella enterica enterica serovar Typhi
gugacgucaagaucgcgc

SEQ ID NO: 1668757 - RNA, 17 nt, Salmonella enterica enterica serovar Typhi
gugacggaaaccagcau

SEQ ID NO: 1668758 - RNA, 17 nt, Salmonella enterica enterica serovar Typhi
gugaccuuucaacggau

SEQ ID NO: 1668759 - RNA, 20 nt, Salmonella enterica enterica serovar Typhi
gucggguauuuuagcgguaa

SEQ ID NO: 1668760 - RNA, 22 nt, Salmonella enterica enterica serovar Typhi
gucgggcagaaagugggucaca

SEQ ID NO: 1668761 - RNA, 23 nt, Salmonella enterica enterica serovar Typhi
gucgggggcgacaaacagcgccc

SEQ ID NO: 1668762 - RNA, 22 nt, Salmonella enterica enterica serovar Typhi
gucgcggcucaccagcugacgc

SEQ ID NO: 1668763 - RNA, 23 nt, Salmonella enterica enterica serovar Typhi
gucgggaagagagaaaaucggcg

SEQ ID NO: 1668764 - RNA, 21 nt, Salmonella enterica enterica serovar Typhi
gucggcuuacgccuuauccgg

SEQ ID NO: 1668765 - RNA, 22 nt, Salmonella enterica enterica serovar Typhi
gucguaccggcgcucagccaga

SEQ ID NO: 1668766 - RNA, 18 nt, Salmonella enterica enterica serovar Typhi
gucgguuucauaacgcac

SEQ ID NO: 1668767 - RNA, 14 nt, Salmonella enterica enterica serovar Typhi
gucgugccugcggu

SEQ ID NO: 1668768 - RNA, 21 nt, Salmonella enterica enterica serovar Typhi
gucguugccuuugcguaccgc

SEQ ID NO: 1668769 - RNA, 17 nt, Salmonella enterica enterica serovar Typhi
cgccgcaucgauacccu

SEQ ID NO: 1668770 - RNA, 23 nt, Salmonella enterica enterica serovar Typhi
cgccgcaggccaucauaccgcca

SEQ ID NO: 1668771 - RNA, 21 nt, Salmonella enterica enterica serovar Typhi
cgccgaucagcaccacgcccg

SEQ ID NO: 1668772 - RNA, 20 nt, Salmonella enterica enterica serovar Typhi
cgccgcaaauuccaccacgu

SEQ ID NO: 1668773 - RNA, 14 nt, Salmonella enterica enterica serovar Typhi
cgcccagaacggca

SEQ ID NO: 1668774 - RNA, 22 nt, Salmonella enterica enterica serovar Typhi
cgccgacugccaccgucgcggc

SEQ ID NO: 1668775 - RNA, 14 nt, Salmonella enterica enterica serovar Typhi
cgccgacucacgca

SEQ ID NO: 1668776 - RNA, 15 nt, Salmonella enterica enterica serovar Typhi
cgccgacucacgcag

SEQ ID NO: 1668777 - RNA, 21 nt, Salmonella enterica enterica serovar Typhi
cgccgauaccgcuaaucggga

SEQ ID NO: 1668778 - RNA, 22 nt, Salmonella enterica enterica serovar Typhi
cgccgccauuuuauccaggcca

SEQ ID NO: 1668779 - RNA, 19 nt, Salmonella enterica enterica serovar Typhi
cgccgccaucaacgaccau

SEQ ID NO: 1668780 - RNA, 12 nt, Salmonella enterica enterica serovar Typhi
cgccgccauccg

SEQ ID NO: 1668781 - RNA, 14 nt, Salmonella enterica enterica serovar Typhi
cgccgccauccggc

SEQ ID NO: 1668782 - RNA, 17 nt, Salmonella enterica enterica serovar Typhi
cgccgccauccggcaca

SEQ ID NO: 1668783 - RNA, 18 nt, Salmonella enterica enterica serovar Typhi
cgccgccauccggcauca

SEQ ID NO: 1668784 - RNA, 14 nt, Salmonella enterica enterica serovar Typhi
cgccgcccacgcug

SEQ ID NO: 1668785 - RNA, 14 nt, Salmonella enterica enterica serovar Typhi
cgccgcccgcaugg

SEQ ID NO: 1668786 - RNA, 14 nt, Salmonella enterica enterica serovar Typhi
cgccgccagccgau

SEQ ID NO: 1668787 - RNA, 13 nt, Salmonella enterica enterica serovar Typhi
cgccgccagccau

SEQ ID NO: 1668788 - RNA, 18 nt, Salmonella enterica enterica serovar Typhi
cgccgccagauuauccag

SEQ ID NO: 1668789 - RNA, 21 nt, Salmonella enterica enterica serovar Typhi
cgccgccaccauguugcgcag

SEQ ID NO: 1668790 - RNA, 22 nt, Salmonella enterica enterica serovar Typhi
cgccgccaaagcgcccgauaau

SEQ ID NO: 1668791 - RNA, 13 nt, Salmonella enterica enterica serovar Typhi
cgccgccgccaga

SEQ ID NO: 1668792 - RNA, 13 nt, Salmonella enterica enterica serovar Typhi
cgccgccggcgag

SEQ ID NO: 1668793 - RNA, 14 nt, Salmonella enterica enterica serovar Typhi
cgccgccgcccaga

SEQ ID NO: 1668794 - RNA, 14 nt, Salmonella enterica enterica serovar Typhi
cgccgccgccaucg

SEQ ID NO: 1668795 - RNA, 15 nt, Salmonella enterica enterica serovar Typhi
cgccgccugcgccaa

SEQ ID NO: 1668796 - RNA, 17 nt, Salmonella enterica enterica serovar Typhi
cgccgccugcgccaacg

SEQ ID NO: 1668797 - RNA, 14 nt, Salmonella enterica enterica serovar Typhi
cgccgccugcgcca

SEQ ID NO: 1668798 - RNA, 22 nt, Salmonella enterica enterica serovar Typhi
cgccgcgauaaagaauagccug

SEQ ID NO: 1668799 - RNA, 17 nt, Salmonella enterica enterica serovar Typhi
cgccgcuacugccgcca

SEQ ID NO: 1668800 - RNA, 18 nt, Salmonella enterica enterica serovar Typhi
cgccgcucuucagcgucc

SEQ ID NO: 1668801 - RNA, 22 nt, Salmonella enterica enterica serovar Typhi
cgccggaaagaaacgccgcgca

SEQ ID NO: 1668802 - RNA, 22 nt, Salmonella enterica enterica serovar Typhi
cgccgcuggcuggccagggcau

SEQ ID NO: 1668803 - RNA, 21 nt, Salmonella enterica enterica serovar Typhi
cgccggcagacgauagcgggu

SEQ ID NO: 1668804 - RNA, 13 nt, Salmonella enterica enterica serovar Typhi
cgccggccuguua

SEQ ID NO: 1668805 - RNA, 23 nt, Salmonella enterica enterica serovar Typhi
aacaccucagccacccacugacg

SEQ ID NO: 1668806 - RNA, 13 nt, Salmonella enterica enterica serovar Typhi
aacacgccgcgcu

SEQ ID NO: 1668807 - RNA, 16 nt, Salmonella enterica enterica serovar Typhi
cgccgggccugccagg

SEQ ID NO: 1668808 - RNA, 16 nt, Salmonella enterica enterica serovar Typhi
cgccgggcuauccggc

SEQ ID NO: 1668809 - RNA, 20 nt, Salmonella enterica enterica serovar Typhi
cgccggggauaucaaugcgc

SEQ ID NO: 1668810 - RNA, 22 nt, Salmonella enterica enterica serovar Typhi
cgccggucacugaccggcguuu

SEQ ID NO: 1668811 - RNA, 20 nt, Salmonella enterica enterica serovar Typhi
cgccggucaugccaucccgc

SEQ ID NO: 1668812 - RNA, 15 nt, Salmonella enterica enterica serovar Typhi
cgccggucgccagca

SEQ ID NO: 1668813 - RNA, 20 nt, Salmonella enterica enterica serovar Typhi
cgccguacuccagcccauca

SEQ ID NO: 1668814 - RNA, 21 nt, Salmonella enterica enterica serovar Typhi
cgccguacuugacacaggcgu

SEQ ID NO: 1668815 - RNA, 12 nt, Salmonella enterica enterica serovar Typhi
cgccgucauccg

SEQ ID NO: 1668816 - RNA, 19 nt, Salmonella enterica enterica serovar Typhi
cgccguccauuucaaugca

SEQ ID NO: 1668817 - RNA, 17 nt, Salmonella enterica enterica serovar Typhi
cgccuguuucugcgccg

SEQ ID NO: 1668818 - RNA, 21 nt, Salmonella enterica enterica serovar Typhi
cgccuguuugacgaaaucgca

SEQ ID NO: 1668819 - RNA, 16 nt, Salmonella enterica enterica serovar Typhi
cgccuuacccaaccgu

SEQ ID NO: 1668820 - RNA, 19 nt, Salmonella enterica enterica serovar Typhi
cgccuuauccgaccuacag

SEQ ID NO: 1668821 - RNA, 20 nt, Salmonella enterica enterica serovar Typhi
cgccuuaccgggccuacgga

SEQ ID NO: 1668822 - RNA, 20 nt, Salmonella enterica enterica serovar Typhi
cgccuuauccggccuacaaa

SEQ ID NO: 1668823 - RNA, 20 nt, Salmonella enterica enterica serovar Typhi
cgccuuauccggccuacaac

SEQ ID NO: 1668824 - RNA, 18 nt, Salmonella enterica enterica serovar Typhi
cgccuuauccggccuacg

SEQ ID NO: 1668825 - RNA, 18 nt, Salmonella enterica enterica serovar Typhi
cgccuucacacugcgccg

SEQ ID NO: 1668826 - RNA, 12 nt, Salmonella enterica enterica serovar Typhi
cgccuuccagcg

SEQ ID NO: 1668827 - RNA, 15 nt, Salmonella enterica enterica serovar Typhi
cgccuguuuacugac

SEQ ID NO: 1668828 - RNA, 14 nt, Salmonella enterica enterica serovar Typhi
cgccuguagcguaa

SEQ ID NO: 1668829 - RNA, 17 nt, Salmonella enterica enterica serovar Typhi
cgccuguaaacguuccu

SEQ ID NO: 1668830 - RNA, 14 nt, Salmonella enterica enterica serovar Typhi
cgccugcugugccg

SEQ ID NO: 1668831 - RNA, 14 nt, Salmonella enterica enterica serovar Typhi
cgccuggcaguuca

SEQ ID NO: 1668832 - RNA, 19 nt, Salmonella enterica enterica serovar Typhi
cgccuggcaguucagucgg

SEQ ID NO: 1668833 - RNA, 16 nt, Salmonella enterica enterica serovar Typhi
cgccuggaucgugcgg

SEQ ID NO: 1668834 - RNA, 19 nt, Salmonella enterica enterica serovar Typhi
cgccugggugggcggaaaa

SEQ ID NO: 1668835 - RNA, 22 nt, Salmonella enterica enterica serovar Typhi
cgccuccaccguuugcagccag

SEQ ID NO: 1668836 - RNA, 16 nt, Salmonella enterica enterica serovar Typhi
cgccuccccugccggc

SEQ ID NO: 1668837 - RNA, 22 nt, Salmonella enterica enterica serovar Typhi
cgccuccccugccggcggcaga

SEQ ID NO: 1668838 - RNA, 22 nt, Salmonella enterica enterica serovar Typhi
cgccugauggcgcuacgcuuau

SEQ ID NO: 1668839 - RNA, 14 nt, Salmonella enterica enterica serovar Typhi
cgccugaugcgccg

SEQ ID NO: 1668840 - RNA, 15 nt, Salmonella enterica enterica serovar Typhi
cgccugaucgcgcag

SEQ ID NO: 1668841 - RNA, 19 nt, Salmonella enterica enterica serovar Typhi
cgccuuuucccccagcauu

SEQ ID NO: 1668842 - RNA, 22 nt, Salmonella enterica enterica serovar Typhi
cgccuuuaauuccgccgggcaa

SEQ ID NO: 1668843 - RNA, 19 nt, Salmonella enterica enterica serovar Typhi
cgcgaacguucaaaaucaa

SEQ ID NO: 1668844 - RNA, 15 nt, Salmonella enterica enterica serovar Typhi
cgccuucggccugaa

SEQ ID NO: 1668845 - RNA, 22 nt, Salmonella enterica enterica serovar Typhi
cgccuucgaaccggguauugaa

SEQ ID NO: 1668846 - RNA, 17 nt, Salmonella enterica enterica serovar Typhi
cgccuuguugcggauga

SEQ ID NO: 1668847 - RNA, 22 nt, Salmonella enterica enterica serovar Typhi
cgccuugcuuaacagaauugcg

SEQ ID NO: 1668848 - RNA, 21 nt, Salmonella enterica enterica serovar Typhi
cgccuugcccgcgccagaggc

SEQ ID NO: 1668849 - RNA, 15 nt, Salmonella enterica enterica serovar Typhi
cgcgaacugcacucg

SEQ ID NO: 1668850 - RNA, 22 nt, Salmonella enterica enterica serovar Typhi
cgcgaauaaaugagaucccggg

SEQ ID NO: 1668851 - RNA, 21 nt, Salmonella enterica enterica serovar Typhi
cgcgaauuccuuuuuccgcca

SEQ ID NO: 1668852 - RNA, 18 nt, Salmonella enterica enterica serovar Typhi
cgcgaauuucacgcagca

SEQ ID NO: 1668853 - RNA, 15 nt, Salmonella enterica enterica serovar Typhi
cgcgaauccgccaua

SEQ ID NO: 1668854 - RNA, 21 nt, Salmonella enterica enterica serovar Typhi
cgcgaaucgacaauccgccac

SEQ ID NO: 1668855 - RNA, 23 nt, Salmonella enterica enterica serovar Typhi
cgcgaauuugccccagauacgca

SEQ ID NO: 1668856 - RNA, 14 nt, Salmonella enterica enterica serovar Typhi
cgcgacaacgccgg

SEQ ID NO: 1668857 - RNA, 15 nt, Salmonella enterica enterica serovar Typhi
cgcgacccagcgcau

SEQ ID NO: 1668858 - RNA, 17 nt, Salmonella enterica enterica serovar Typhi
cgcgacccagcgcauga

SEQ ID NO: 1668859 - RNA, 18 nt, Salmonella enterica enterica serovar Typhi
cgcgaccgcaucaaugcc

SEQ ID NO: 1668860 - RNA, 13 nt, Salmonella enterica enterica serovar Typhi
cgcgaccgcauca

SEQ ID NO: 1668861 - RNA, 15 nt, Salmonella enterica enterica serovar Typhi
cgcgacauggcggua

SEQ ID NO: 1668862 - RNA, 14 nt, Salmonella enterica enterica serovar Typhi
cgcgacauggcgaa

SEQ ID NO: 1668863 - RNA, 16 nt, Salmonella enterica enterica serovar Typhi
cgcgacauggcgguaa

SEQ ID NO: 1668864 - RNA, 13 nt, Salmonella enterica enterica serovar Typhi
cgcgaccacgcau

SEQ ID NO: 1668865 - RNA, 22 nt, Salmonella enterica enterica serovar Typhi
cgcgccgacauagcugaacaau

SEQ ID NO: 1668866 - RNA, 13 nt, Salmonella enterica enterica serovar Typhi
cgcgccgccaacg

SEQ ID NO: 1668867 - RNA, 16 nt, Salmonella enterica enterica serovar Typhi
cgcgccgcaggccgga

SEQ ID NO: 1668868 - RNA, 16 nt, Salmonella enterica enterica serovar Typhi
cgcgccgcaucuucca

SEQ ID NO: 1668869 - RNA, 13 nt, Salmonella enterica enterica serovar Typhi
cgcgccagcgaca

SEQ ID NO: 1668870 - RNA, 17 nt, Salmonella enterica enterica serovar Typhi
cgcgcaggcgccgauaa

SEQ ID NO: 1668871 - RNA, 20 nt, Salmonella enterica enterica serovar Typhi
cgcgcauccugcauaaucca

SEQ ID NO: 1668872 - RNA, 14 nt, Salmonella enterica enterica serovar Typhi
cgcgcagcaggcca

SEQ ID NO: 1668873 - RNA, 18 nt, Salmonella enterica enterica serovar Typhi
cgcgcaaagccuuuccgc

SEQ ID NO: 1668874 - RNA, 15 nt, Salmonella enterica enterica serovar Typhi
cgcgauuuagcguug

SEQ ID NO: 1668875 - RNA, 17 nt, Salmonella enterica enterica serovar Typhi
cgcgauuuucaucaagc

SEQ ID NO: 1668876 - RNA, 18 nt, Salmonella enterica enterica serovar Typhi
cgcgaucacuaccgccau

SEQ ID NO: 1668877 - RNA, 21 nt, Salmonella enterica enterica serovar Typhi
cgcgaucaaucacgccgauaa

SEQ ID NO: 1668878 - RNA, 14 nt, Salmonella enterica enterica serovar Typhi
cgcgaucgcggcaa

SEQ ID NO: 1668879 - RNA, 20 nt, Salmonella enterica enterica serovar Typhi
cgcgaggcauaccgcccaga

SEQ ID NO: 1668880 - RNA, 21 nt, Salmonella enterica enterica serovar Typhi
cgcgagccguaaacggaacca

SEQ ID NO: 1668881 - RNA, 18 nt, Salmonella enterica enterica serovar Typhi
cgcgacguccgccaacag

SEQ ID NO: 1668882 - RNA, 18 nt, Salmonella enterica enterica serovar Typhi
cgcgacgccagccgauca

SEQ ID NO: 1668883 - RNA, 14 nt, Salmonella enterica enterica serovar Typhi
cgcgacgacgccag

SEQ ID NO: 1668884 - RNA, 19 nt, Salmonella enterica enterica serovar Typhi
cgcgacguacuggaacagu

SEQ ID NO: 1668885 - RNA, 22 nt, Salmonella enterica enterica serovar Typhi
cgcgacgcgccagccagcgcca

SEQ ID NO: 1668886 - RNA, 15 nt, Salmonella enterica enterica serovar Typhi
cgcggcaaauaccgg

SEQ ID NO: 1668887 - RNA, 16 nt, Salmonella enterica enterica serovar Typhi
cgcggcaaaccccgga

SEQ ID NO: 1668888 - RNA, 15 nt, Salmonella enterica enterica serovar Typhi
cgcggauugccgccc

SEQ ID NO: 1668889 - RNA, 19 nt, Salmonella enterica enterica serovar Typhi
cgcggcacacuuucaucag

SEQ ID NO: 1668890 - RNA, 20 nt, Salmonella enterica enterica serovar Typhi
cgcggaucggcacacagcca

SEQ ID NO: 1668891 - RNA, 21 nt, Salmonella enterica enterica serovar Typhi
cgcggaucgugauaacgcgau

SEQ ID NO: 1668892 - RNA, 18 nt, Salmonella enterica enterica serovar Typhi
cgcggaugcuaucgcgga

SEQ ID NO: 1668893 - RNA, 13 nt, Salmonella enterica enterica serovar Typhi
cgcggcagccgga

SEQ ID NO: 1668894 - RNA, 14 nt, Salmonella enterica enterica serovar Typhi
cgcggcagccggaa

SEQ ID NO: 1668895 - RNA, 15 nt, Salmonella enterica enterica serovar Typhi
cgcggcauuaaaugc

SEQ ID NO: 1668896 - RNA, 17 nt, Salmonella enterica enterica serovar Typhi
cgcggcauuaaaugcgc

SEQ ID NO: 1668897 - RNA, 14 nt, Salmonella enterica enterica serovar Typhi
cgcgcuuucaaucg

SEQ ID NO: 1668898 - RNA, 22 nt, Salmonella enterica enterica serovar Typhi
cgcgcuuacgcuccugcgguac

SEQ ID NO: 1668899 - RNA, 19 nt, Salmonella enterica enterica serovar Typhi
cgcggauaugcagcagcca

SEQ ID NO: 1668900 - RNA, 17 nt, Salmonella enterica enterica serovar Typhi
cgcggacgaccaauucc

SEQ ID NO: 1668901 - RNA, 19 nt, Salmonella enterica enterica serovar Typhi
cgcggaccuuuugccgccc

SEQ ID NO: 1668902 - RNA, 14 nt, Salmonella enterica enterica serovar Typhi
cgcggcguaccgcg

SEQ ID NO: 1668903 - RNA, 15 nt, Salmonella enterica enterica serovar Typhi
aacagccagcagcgc

SEQ ID NO: 1668904 - RNA, 22 nt, Salmonella enterica enterica serovar Typhi
cgcggcguacacuucauccggc

SEQ ID NO: 1668905 - RNA, 19 nt, Salmonella enterica enterica serovar Typhi
cgcggccccaucagcacau

SEQ ID NO: 1668906 - RNA, 16 nt, Salmonella enterica enterica serovar Typhi
cgcggcgaaauaggcc

SEQ ID NO: 1668907 - RNA, 18 nt, Salmonella enterica enterica serovar Typhi
cgcggcgcaaaucgccau

SEQ ID NO: 1668908 - RNA, 14 nt, Salmonella enterica enterica serovar Typhi
cgcgugacgcagua

SEQ ID NO: 1668909 - RNA, 21 nt, Salmonella enterica enterica serovar Typhi
cgcgugacgacuaccgccgau

SEQ ID NO: 1668910 - RNA, 16 nt, Salmonella enterica enterica serovar Typhi
cgcgugagaucguuau

SEQ ID NO: 1668911 - RNA, 15 nt, Salmonella enterica enterica serovar Typhi
cgcguuuagcgccag

SEQ ID NO: 1668912 - RNA, 14 nt, Salmonella enterica enterica serovar Typhi
cgcguuuaucgcau

SEQ ID NO: 1668913 - RNA, 16 nt, Salmonella enterica enterica serovar Typhi
cgcuaaacagcgccgc

SEQ ID NO: 1668914 - RNA, 14 nt, Salmonella enterica enterica serovar Typhi
cgcguuuuccagca

SEQ ID NO: 1668915 - RNA, 15 nt, Salmonella enterica enterica serovar Typhi
cgcguuguaaucgcc

SEQ ID NO: 1668916 - RNA, 21 nt, Salmonella enterica enterica serovar Typhi
cgcguucgcaccauagcagcc

SEQ ID NO: 1668917 - RNA, 22 nt, Salmonella enterica enterica serovar Typhi
cgcguugcuuaucaggccuaca

SEQ ID NO: 1668918 - RNA, 20 nt, Salmonella enterica enterica serovar Typhi
cgcguucgcuucgaggauaa

SEQ ID NO: 1668919 - RNA, 12 nt, Salmonella enterica enterica serovar Typhi
cgcuccggcagg

SEQ ID NO: 1668920 - RNA, 15 nt, Salmonella enterica enterica serovar Typhi
cgcucccccggcgau

SEQ ID NO: 1668921 - RNA, 13 nt, Salmonella enterica enterica serovar Typhi
cgcuccaucacgg

SEQ ID NO: 1668922 - RNA, 18 nt, Salmonella enterica enterica serovar Typhi
cgcucaggagcgccugac

SEQ ID NO: 1668923 - RNA, 15 nt, Salmonella enterica enterica serovar Typhi
cgcucaccuccgcca

SEQ ID NO: 1668924 - RNA, 16 nt, Salmonella enterica enterica serovar Typhi
cgcucaccuccgccac

SEQ ID NO: 1668925 - RNA, 18 nt, Salmonella enterica enterica serovar Typhi
cgcuacauccgccagccg

SEQ ID NO: 1668926 - RNA, 22 nt, Salmonella enterica enterica serovar Typhi
cgcuacaaccagcgcggccaga

SEQ ID NO: 1668927 - RNA, 18 nt, Salmonella enterica enterica serovar Typhi
cgcuacaauccaggacgu

SEQ ID NO: 1668928 - RNA, 15 nt, Salmonella enterica enterica serovar Typhi
cgcuaaccauugcgg

SEQ ID NO: 1668929 - RNA, 23 nt, Salmonella enterica enterica serovar Typhi
cgcuaaaugacaaauagaagcca

SEQ ID NO: 1668930 - RNA, 14 nt, Salmonella enterica enterica serovar Typhi
cgcuaauauccacc

SEQ ID NO: 1668931 - RNA, 23 nt, Salmonella enterica enterica serovar Typhi
cgcggugccgauggcuaaagcgc

SEQ ID NO: 1668932 - RNA, 14 nt, Salmonella enterica enterica serovar Typhi
cgcgguaaauuccg

SEQ ID NO: 1668933 - RNA, 23 nt, Salmonella enterica enterica serovar Typhi
cgcggucagggugaaucccgcca

SEQ ID NO: 1668934 - RNA, 20 nt, Salmonella enterica enterica serovar Typhi
cgcguacuuucgccaguuca

SEQ ID NO: 1668935 - RNA, 15 nt, Salmonella enterica enterica serovar Typhi
cgcgucagggcgaua

SEQ ID NO: 1668936 - RNA, 16 nt, Salmonella enterica enterica serovar Typhi
cgcgucagggcgauaa

SEQ ID NO: 1668937 - RNA, 19 nt, Salmonella enterica enterica serovar Typhi
cgcgucagcaaaauggcaa

SEQ ID NO: 1668938 - RNA, 13 nt, Salmonella enterica enterica serovar Typhi
cgcguagcgccaa

SEQ ID NO: 1668939 - RNA, 18 nt, Salmonella enterica enterica serovar Typhi
cgcguagcccagcgccgc

SEQ ID NO: 1668940 - RNA, 19 nt, Salmonella enterica enterica serovar Typhi
cgcuucacgcgcggcuacu

SEQ ID NO: 1668941 - RNA, 12 nt, Salmonella enterica enterica serovar Typhi
cgcuuagcggcg

SEQ ID NO: 1668942 - RNA, 18 nt, Salmonella enterica enterica serovar Typhi
cgcuuaucaggccuacaa

SEQ ID NO: 1668943 - RNA, 13 nt, Salmonella enterica enterica serovar Typhi
cgcuuaucaggcc

SEQ ID NO: 1668944 - RNA, 19 nt, Salmonella enterica enterica serovar Typhi
cgcuuaucaggccuacaag

SEQ ID NO: 1668945 - RNA, 23 nt, Salmonella enterica enterica serovar Typhi
cgcuuaucaggccuacauccggc

SEQ ID NO: 1668946 - RNA, 17 nt, Salmonella enterica enterica serovar Typhi
cgcuuaucaggccuacc

SEQ ID NO: 1668947 - RNA, 13 nt, Salmonella enterica enterica serovar Typhi
cgcuuauccugcc

SEQ ID NO: 1668948 - RNA, 14 nt, Salmonella enterica enterica serovar Typhi
cgcuuauccggccu

SEQ ID NO: 1668949 - RNA, 18 nt, Salmonella enterica enterica serovar Typhi
cgcuuauccggccuacag

SEQ ID NO: 1668950 - RNA, 13 nt, Salmonella enterica enterica serovar Typhi
cgcuuauccggcc

SEQ ID NO: 1668951 - RNA, 20 nt, Salmonella enterica enterica serovar Typhi
cgcuucgcuuaucaggccua

SEQ ID NO: 1668952 - RNA, 18 nt, Salmonella enterica enterica serovar Typhi
cgcuuccugccaggccgg

SEQ ID NO: 1668953 - RNA, 18 nt, Salmonella enterica enterica serovar Typhi
cgcuucugauuauugaca

SEQ ID NO: 1668954 - RNA, 18 nt, Salmonella enterica enterica serovar Typhi
cgcuucuggcguaaugcg

SEQ ID NO: 1668955 - RNA, 13 nt, Salmonella enterica enterica serovar Typhi
cgcuucuucggca

SEQ ID NO: 1668956 - RNA, 20 nt, Salmonella enterica enterica serovar Typhi
cgcuucuuugaaauugauca

SEQ ID NO: 1668957 - RNA, 12 nt, Salmonella enterica enterica serovar Typhi
cgcuucuggaau

SEQ ID NO: 1668958 - RNA, 16 nt, Salmonella enterica enterica serovar Typhi
cgcuucuauuaccgca

SEQ ID NO: 1668959 - RNA, 15 nt, Salmonella enterica enterica serovar Typhi
cgcugucgccgcgca

SEQ ID NO: 1668960 - RNA, 17 nt, Salmonella enterica enterica serovar Typhi
cgcugucaccagcagca

SEQ ID NO: 1668961 - RNA, 19 nt, Salmonella enterica enterica serovar Typhi
cgcugucacuccggcugca

SEQ ID NO: 1668962 - RNA, 13 nt, Salmonella enterica enterica serovar Typhi
cgcuguagcgcca

SEQ ID NO: 1668963 - RNA, 18 nt, Salmonella enterica enterica serovar Typhi
cgcuguaacccgccgcca

SEQ ID NO: 1668964 - RNA, 19 nt, Salmonella enterica enterica serovar Typhi
cgcuuaccaggccuacacg

SEQ ID NO: 1668965 - RNA, 12 nt, Salmonella enterica enterica serovar Typhi
cgcuuaccgggc

SEQ ID NO: 1668966 - RNA, 18 nt, Salmonella enterica enterica serovar Typhi
cgcuuaccgggcaggaua

SEQ ID NO: 1668967 - RNA, 15 nt, Salmonella enterica enterica serovar Typhi
cgcuuacaucgccau

SEQ ID NO: 1668968 - RNA, 14 nt, Salmonella enterica enterica serovar Typhi
cgcuuaccaggccu

SEQ ID NO: 1668969 - RNA, 16 nt, Salmonella enterica enterica serovar Typhi
cgcuuacacacccggc

SEQ ID NO: 1668970 - RNA, 22 nt, Salmonella enterica enterica serovar Typhi
cgcuuacacacccggccuauca

SEQ ID NO: 1668971 - RNA, 21 nt, Salmonella enterica enterica serovar Typhi
cgcuuaauaauaagcggccua

SEQ ID NO: 1668972 - RNA, 15 nt, Salmonella enterica enterica serovar Typhi
cgcuuaacgaugcgg

SEQ ID NO: 1668973 - RNA, 12 nt, Salmonella enterica enterica serovar Typhi
cgcuguuguucc

SEQ ID NO: 1668974 - RNA, 21 nt, Salmonella enterica enterica serovar Typhi
cgcugugcuaucaggccuaca

SEQ ID NO: 1668975 - RNA, 15 nt, Salmonella enterica enterica serovar Typhi
cgcuguucgccggau

SEQ ID NO: 1668976 - RNA, 17 nt, Salmonella enterica enterica serovar Typhi
cgcugugguuuauccgc

SEQ ID NO: 1668977 - RNA, 13 nt, Salmonella enterica enterica serovar Typhi
cgcugucggucag

SEQ ID NO: 1668978 - RNA, 17 nt, Salmonella enterica enterica serovar Typhi
cgcugucgccgcgcaca

SEQ ID NO: 1668979 - RNA, 21 nt, Salmonella enterica enterica serovar Typhi
cggaagccacguucuuccaga

SEQ ID NO: 1668980 - RNA, 21 nt, Salmonella enterica enterica serovar Typhi
cggaagcuuuuaguuacgcac

SEQ ID NO: 1668981 - RNA, 17 nt, Salmonella enterica enterica serovar Typhi
cggaacaccagcgccgc

SEQ ID NO: 1668982 - RNA, 23 nt, Salmonella enterica enterica serovar Typhi
cggaacgcgacucccaggcgcgc

SEQ ID NO: 1668983 - RNA, 20 nt, Salmonella enterica enterica serovar Typhi
cggaaugugaaauacagcca

SEQ ID NO: 1668984 - RNA, 18 nt, Salmonella enterica enterica serovar Typhi
cggaaugacaaacgccac

SEQ ID NO: 1668985 - RNA, 23 nt, Salmonella enterica enterica serovar Typhi
cggaauucuguucaguggcguag

SEQ ID NO: 1668986 - RNA, 20 nt, Salmonella enterica enterica serovar Typhi
cggaauccccgccgccagua

SEQ ID NO: 1668987 - RNA, 14 nt, Salmonella enterica enterica serovar Typhi
cggaaacgcuguuc

SEQ ID NO: 1668988 - RNA, 21 nt, Salmonella enterica enterica serovar Typhi
cggaaagacggcagcgccauc

SEQ ID NO: 1668989 - RNA, 19 nt, Salmonella enterica enterica serovar Typhi
cggaaaggauauaagcgcc

SEQ ID NO: 1668990 - RNA, 21 nt, Salmonella enterica enterica serovar Typhi
cggaaaggauauaagcgccau

SEQ ID NO: 1668991 - RNA, 16 nt, Salmonella enterica enterica serovar Typhi
cggaaauagcgccauc

SEQ ID NO: 1668992 - RNA, 14 nt, Salmonella enterica enterica serovar Typhi
cggaaaucacgcau

SEQ ID NO: 1668993 - RNA, 14 nt, Salmonella enterica enterica serovar Typhi
cggaacaccagcgc

SEQ ID NO: 1668994 - RNA, 21 nt, Salmonella enterica enterica serovar Typhi
cggaaauucacuuccgucaug

SEQ ID NO: 1668995 - RNA, 20 nt, Salmonella enterica enterica serovar Typhi
cgcuuuucgguuacguucgg

SEQ ID NO: 1668996 - RNA, 19 nt, Salmonella enterica enterica serovar Typhi
cgcuuuuaauugcgcauca

SEQ ID NO: 1668997 - RNA, 15 nt, Salmonella enterica enterica serovar Typhi
cgcuuugccgccauc

SEQ ID NO: 1668998 - RNA, 16 nt, Salmonella enterica enterica serovar Typhi
cgcuuuuaauugcgca

SEQ ID NO: 1668999 - RNA, 22 nt, Salmonella enterica enterica serovar Typhi
cgcuuugucgaacuuacgacgc

SEQ ID NO: 1669000 - RNA, 20 nt, Salmonella enterica enterica serovar Typhi
cgcuuuugguuuuucaacca

SEQ ID NO: 1669001 - RNA, 23 nt, Salmonella enterica enterica serovar Typhi
cgcuuuuuccagcauuagcgcca

SEQ ID NO: 1669002 - RNA, 15 nt, Salmonella enterica enterica serovar Typhi
cgcuugcgcguucgg

SEQ ID NO: 1669003 - RNA, 20 nt, Salmonella enterica enterica serovar Typhi
cgcuuuaagcgcugccgcaa

SEQ ID NO: 1669004 - RNA, 14 nt, Salmonella enterica enterica serovar Typhi
cgcuuuaauaccgg

SEQ ID NO: 1669005 - RNA, 20 nt, Salmonella enterica enterica serovar Typhi
cgcuuuaaucaguucauagc

SEQ ID NO: 1669006 - RNA, 16 nt, Salmonella enterica enterica serovar Typhi
cgcuuugccagcaucg

SEQ ID NO: 1669007 - RNA, 16 nt, Salmonella enterica enterica serovar Typhi
cgcuuuccaguugcgg

SEQ ID NO: 1669008 - RNA, 22 nt, Salmonella enterica enterica serovar Typhi
cgcuuuaugcgcuuccagcaug

SEQ ID NO: 1669009 - RNA, 14 nt, Salmonella enterica enterica serovar Typhi
cgcuuuagcgauaa

SEQ ID NO: 1669010 - RNA, 19 nt, Salmonella enterica enterica serovar Typhi
cgcuuuagcguaggccaca

SEQ ID NO: 1669011 - RNA, 14 nt, Salmonella enterica enterica serovar Typhi
cgcugcauccugua

SEQ ID NO: 1669012 - RNA, 11 nt, Salmonella enterica enterica serovar Typhi
cgcugauggcg

SEQ ID NO: 1669013 - RNA, 18 nt, Salmonella enterica enterica serovar Typhi
cgcugauuuucuccagca

SEQ ID NO: 1669014 - RNA, 22 nt, Salmonella enterica enterica serovar Typhi
cgcugaguuucucccgccagau

SEQ ID NO: 1669015 - RNA, 17 nt, Salmonella enterica enterica serovar Typhi
cgcugauaaucguauca

SEQ ID NO: 1669016 - RNA, 22 nt, Salmonella enterica enterica serovar Typhi
cgcugagucuaacccguugccg

SEQ ID NO: 1669017 - RNA, 19 nt, Salmonella enterica enterica serovar Typhi
cgcugaguuucucccgcca

SEQ ID NO: 1669018 - RNA, 12 nt, Salmonella enterica enterica serovar Typhi
cgcugaucgcca

SEQ ID NO: 1669019 - RNA, 17 nt, Salmonella enterica enterica serovar Typhi
cgcugauaauuaaugcg

SEQ ID NO: 1669020 - RNA, 14 nt, Salmonella enterica enterica serovar Typhi
cgcugcauuguucc

SEQ ID NO: 1669021 - RNA, 22 nt, Salmonella enterica enterica serovar Typhi
cgcugccagcugcgucagcgcu

SEQ ID NO: 1669022 - RNA, 17 nt, Salmonella enterica enterica serovar Typhi
cgcugccgcuuauccgg

SEQ ID NO: 1669023 - RNA, 18 nt, Salmonella enterica enterica serovar Typhi
cgcugccgcuuauccggc

SEQ ID NO: 1669024 - RNA, 13 nt, Salmonella enterica enterica serovar Typhi
cgcugcgccagau

SEQ ID NO: 1669025 - RNA, 14 nt, Salmonella enterica enterica serovar Typhi
cgcugcgcaggcgu

SEQ ID NO: 1669026 - RNA, 17 nt, Salmonella enterica enterica serovar Typhi
cgcugcgucaggcgaua

SEQ ID NO: 1669027 - RNA, 17 nt, Salmonella enterica enterica serovar Typhi
cgcugcguggcgggcgu

SEQ ID NO: 1669028 - RNA, 22 nt, Salmonella enterica enterica serovar Typhi
cgcugcggguagucaucgccuu

SEQ ID NO: 1669029 - RNA, 20 nt, Salmonella enterica enterica serovar Typhi
cgcugcguuuauuaggccua

SEQ ID NO: 1669030 - RNA, 14 nt, Salmonella enterica enterica serovar Typhi
cgcugcgcucacgc

SEQ ID NO: 1669031 - RNA, 19 nt, Salmonella enterica enterica serovar Typhi
cgcugcgcuuacccagucu

SEQ ID NO: 1669032 - RNA, 20 nt, Salmonella enterica enterica serovar Typhi
cgcugcgcuuaccgggccua

SEQ ID NO: 1669033 - RNA, 17 nt, Salmonella enterica enterica serovar Typhi
cgcugcgcuuauccggc

SEQ ID NO: 1669034 - RNA, 20 nt, Salmonella enterica enterica serovar Typhi
cgcugcgcuuaucaggccua

SEQ ID NO: 1669035 - RNA, 16 nt, Salmonella enterica enterica serovar Typhi
cgcugcgcuuauccgc

SEQ ID NO: 1669036 - RNA, 18 nt, Salmonella enterica enterica serovar Typhi
cgcugcuguaacagacgc

SEQ ID NO: 1669037 - RNA, 13 nt, Salmonella enterica enterica serovar Typhi
cgcuggcgcuguc

SEQ ID NO: 1669038 - RNA, 13 nt, Salmonella enterica enterica serovar Typhi
cgcuggcgccacc

SEQ ID NO: 1669039 - RNA, 13 nt, Salmonella enterica enterica serovar Typhi
cgcuggcgccgca

SEQ ID NO: 1669040 - RNA, 17 nt, Salmonella enterica enterica serovar Typhi
cgcuggcggcguccggc

SEQ ID NO: 1669041 - RNA, 22 nt, Salmonella enterica enterica serovar Typhi
cgcuggcggcgacgauaggcau

SEQ ID NO: 1669042 - RNA, 23 nt, Salmonella enterica enterica serovar Typhi
cgcuggcggguagcgcauaacgc

SEQ ID NO: 1669043 - RNA, 11 nt, Salmonella enterica enterica serovar Typhi
cgcuggcguac

SEQ ID NO: 1669044 - RNA, 17 nt, Salmonella enterica enterica serovar Typhi
cgcuggcguccagcccg

SEQ ID NO: 1669045 - RNA, 23 nt, Salmonella enterica enterica serovar Typhi
cgcuggcuaacgccuugaauacg

SEQ ID NO: 1669046 - RNA, 21 nt, Salmonella enterica enterica serovar Typhi
cgcuggcgucuguccggcgcu

SEQ ID NO: 1669047 - RNA, 15 nt, Salmonella enterica enterica serovar Typhi
cgcuggcugccgcca

SEQ ID NO: 1669048 - RNA, 22 nt, Salmonella enterica enterica serovar Typhi
cgcugggaaucgcgauuccgga

SEQ ID NO: 1669049 - RNA, 14 nt, Salmonella enterica enterica serovar Typhi
cgcugggcacgcua

SEQ ID NO: 1669050 - RNA, 15 nt, Salmonella enterica enterica serovar Typhi
cgcugggcgauaaaa

SEQ ID NO: 1669051 - RNA, 16 nt, Salmonella enterica enterica serovar Typhi
cgcugguaaauccggc

SEQ ID NO: 1669052 - RNA, 22 nt, Salmonella enterica enterica serovar Typhi
cgcugggugagcgggcuggugc

SEQ ID NO: 1669053 - RNA, 15 nt, Salmonella enterica enterica serovar Typhi
cgcuggucaacacgc

SEQ ID NO: 1669054 - RNA, 14 nt, Salmonella enterica enterica serovar Typhi
cgcuggucagcgcg

SEQ ID NO: 1669055 - RNA, 18 nt, Salmonella enterica enterica serovar Typhi
cgggauuuuaagcaucca

SEQ ID NO: 1669056 - RNA, 16 nt, Salmonella enterica enterica serovar Typhi
cgggcaaaagggccau

SEQ ID NO: 1669057 - RNA, 16 nt, Salmonella enterica enterica serovar Typhi
cgggcaaaaugcgucg

SEQ ID NO: 1669058 - RNA, 14 nt, Salmonella enterica enterica serovar Typhi
aacauugcaggucu

SEQ ID NO: 1669059 - RNA, 13 nt, Salmonella enterica enterica serovar Typhi
cgggaucgccaga

SEQ ID NO: 1669060 - RNA, 18 nt, Salmonella enterica enterica serovar Typhi
cgggagcguuaaucaccu

SEQ ID NO: 1669061 - RNA, 13 nt, Salmonella enterica enterica serovar Typhi
cgggcacgauggc

SEQ ID NO: 1669062 - RNA, 19 nt, Salmonella enterica enterica serovar Typhi
cgggcagggaauacccgcc

SEQ ID NO: 1669063 - RNA, 22 nt, Salmonella enterica enterica serovar Typhi
cgggcgauuauaaggucgauau

SEQ ID NO: 1669064 - RNA, 18 nt, Salmonella enterica enterica serovar Typhi
cgggccuacaaaaucgcc

SEQ ID NO: 1669065 - RNA, 21 nt, Salmonella enterica enterica serovar Typhi
cgggccguuaucuacggagua

SEQ ID NO: 1669066 - RNA, 17 nt, Salmonella enterica enterica serovar Typhi
cgggcgguauuauccgc

SEQ ID NO: 1669067 - RNA, 18 nt, Salmonella enterica enterica serovar Typhi
cggcugccauuaucacca

SEQ ID NO: 1669068 - RNA, 17 nt, Salmonella enterica enterica serovar Typhi
cggcuguagccagccug

SEQ ID NO: 1669069 - RNA, 17 nt, Salmonella enterica enterica serovar Typhi
cggcuggguuuccggau

SEQ ID NO: 1669070 - RNA, 16 nt, Salmonella enterica enterica serovar Typhi
cggcugguaagagagc

SEQ ID NO: 1669071 - RNA, 23 nt, Salmonella enterica enterica serovar Typhi
cggcuuccguuuuguugccgccc

SEQ ID NO: 1669072 - RNA, 19 nt, Salmonella enterica enterica serovar Typhi
cggcguugcgcccaggcca

SEQ ID NO: 1669073 - RNA, 23 nt, Salmonella enterica enterica serovar Typhi
cggcguuucaagcaguuccagca

SEQ ID NO: 1669074 - RNA, 21 nt, Salmonella enterica enterica serovar Typhi
cggcuacgaaccgagcggucg

SEQ ID NO: 1669075 - RNA, 13 nt, Salmonella enterica enterica serovar Typhi
cggcuaaacugcg

SEQ ID NO: 1669076 - RNA, 18 nt, Salmonella enterica enterica serovar Typhi
cggcguuacuccgcggua

SEQ ID NO: 1669077 - RNA, 13 nt, Salmonella enterica enterica serovar Typhi
cggcguuacuccg

SEQ ID NO: 1669078 - RNA, 16 nt, Salmonella enterica enterica serovar Typhi
cggcguggaaccgccg

SEQ ID NO: 1669079 - RNA, 16 nt, Salmonella enterica enterica serovar Typhi
cggcguaccagaaugc

SEQ ID NO: 1669080 - RNA, 23 nt, Salmonella enterica enterica serovar Typhi
cggcgucuucauccucgccauaa

SEQ ID NO: 1669081 - RNA, 12 nt, Salmonella enterica enterica serovar Typhi
cggcgugaacgu

SEQ ID NO: 1669082 - RNA, 14 nt, Salmonella enterica enterica serovar Typhi
cggcgugaacgccu

SEQ ID NO: 1669083 - RNA, 22 nt, Salmonella enterica enterica serovar Typhi
cggguucagcgacaggcugucg

SEQ ID NO: 1669084 - RNA, 17 nt, Salmonella enterica enterica serovar Typhi
cggguugauuacucccg

SEQ ID NO: 1669085 - RNA, 22 nt, Salmonella enterica enterica serovar Typhi
cggguuaaaccagcucacgcca

SEQ ID NO: 1669086 - RNA, 17 nt, Salmonella enterica enterica serovar Typhi
cggguggccuaacgcca

SEQ ID NO: 1669087 - RNA, 18 nt, Salmonella enterica enterica serovar Typhi
cggguggccuaacgccag

SEQ ID NO: 1669088 - RNA, 21 nt, Salmonella enterica enterica serovar Typhi
cgggugcgcagccccagcgcc

SEQ ID NO: 1669089 - RNA, 15 nt, Salmonella enterica enterica serovar Typhi
aaccaguucacgcgu

SEQ ID NO: 1669090 - RNA, 20 nt, Salmonella enterica enterica serovar Typhi
aaccaggcgaaccccaugcc

SEQ ID NO: 1669091 - RNA, 22 nt, Salmonella enterica enterica serovar Typhi
aaccagggucaauacgccguca

SEQ ID NO: 1669092 - RNA, 16 nt, Salmonella enterica enterica serovar Typhi
aaccagcggcgacaca

SEQ ID NO: 1669093 - RNA, 20 nt, Salmonella enterica enterica serovar Typhi
aaccagcgcgccgccaacgc

SEQ ID NO: 1669094 - RNA, 15 nt, Salmonella enterica enterica serovar Typhi
aaccagccaugccau

SEQ ID NO: 1669095 - RNA, 23 nt, Salmonella enterica enterica serovar Typhi
cgggugcauauacguugcggcgc

SEQ ID NO: 1669096 - RNA, 14 nt, Salmonella enterica enterica serovar Typhi
cgggugacuggucu

SEQ ID NO: 1669097 - RNA, 16 nt, Salmonella enterica enterica serovar Typhi
cgggugaucugcgccg

SEQ ID NO: 1669098 - RNA, 20 nt, Salmonella enterica enterica serovar Typhi
cgggugaauaacuucacgcu

SEQ ID NO: 1669099 - RNA, 15 nt, Salmonella enterica enterica serovar Typhi
aaccaauaguaucca

SEQ ID NO: 1669100 - RNA, 17 nt, Salmonella enterica enterica serovar Typhi
cgggguaucuguuuauu

SEQ ID NO: 1669101 - RNA, 22 nt, Salmonella enterica enterica serovar Typhi
cggguaggccggauaaggccac

SEQ ID NO: 1669102 - RNA, 23 nt, Salmonella enterica enterica serovar Typhi
cggguagucaucgccuucauccg

SEQ ID NO: 1669103 - RNA, 15 nt, Salmonella enterica enterica serovar Typhi
cggguagucaucgcc

SEQ ID NO: 1669104 - RNA, 20 nt, Salmonella enterica enterica serovar Typhi
cggguauguuuuagcagagu

SEQ ID NO: 1669105 - RNA, 14 nt, Salmonella enterica enterica serovar Typhi
cgggucagcgucug

SEQ ID NO: 1669106 - RNA, 19 nt, Salmonella enterica enterica serovar Typhi
cgggucagcgucugcccca

SEQ ID NO: 1669107 - RNA, 13 nt, Salmonella enterica enterica serovar Typhi
cgggucagcgucu

SEQ ID NO: 1669108 - RNA, 20 nt, Salmonella enterica enterica serovar Typhi
cgguauuuuucaccucacuc

SEQ ID NO: 1669109 - RNA, 18 nt, Salmonella enterica enterica serovar Typhi
cggucaacgcgccgccaa

SEQ ID NO: 1669110 - RNA, 16 nt, Salmonella enterica enterica serovar Typhi
cgguaucgccggcaga

SEQ ID NO: 1669111 - RNA, 15 nt, Salmonella enterica enterica serovar Typhi
cgguauaaaaccccu

SEQ ID NO: 1669112 - RNA, 13 nt, Salmonella enterica enterica serovar Typhi
cgguagcugcgcc

SEQ ID NO: 1669113 - RNA, 18 nt, Salmonella enterica enterica serovar Typhi
cgguacgcgucugaauga

SEQ ID NO: 1669114 - RNA, 22 nt, Salmonella enterica enterica serovar Typhi
cgguagcaaaggcuaccgggca

SEQ ID NO: 1669115 - RNA, 15 nt, Salmonella enterica enterica serovar Typhi
cgguaaaccaggcca

SEQ ID NO: 1669116 - RNA, 17 nt, Salmonella enterica enterica serovar Typhi
aacccagauaucagucu

SEQ ID NO: 1669117 - RNA, 15 nt, Salmonella enterica enterica serovar Typhi
aacccaccugccagu

SEQ ID NO: 1669118 - RNA, 15 nt, Salmonella enterica enterica serovar Typhi
aacccaccagcgcca

SEQ ID NO: 1669119 - RNA, 13 nt, Salmonella enterica enterica serovar Typhi
aaccaucggcaaa

SEQ ID NO: 1669120 - RNA, 22 nt, Salmonella enterica enterica serovar Typhi
cgguaauaauuagcauccagca

SEQ ID NO: 1669121 - RNA, 18 nt, Salmonella enterica enterica serovar Typhi
cgguaaucacugccgcca

SEQ ID NO: 1669122 - RNA, 22 nt, Salmonella enterica enterica serovar Typhi
cgguaagaagaaccagcgcgac

SEQ ID NO: 1669123 - RNA, 17 nt, Salmonella enterica enterica serovar Typhi
cgguaagcgcagcgcca

SEQ ID NO: 1669124 - RNA, 19 nt, Salmonella enterica enterica serovar Typhi
cgguaagcgccugcugcgc

SEQ ID NO: 1669125 - RNA, 19 nt, Salmonella enterica enterica serovar Typhi
cgguaagcgcuagcgccac

SEQ ID NO: 1669126 - RNA, 18 nt, Salmonella enterica enterica serovar Typhi
cgguaagcgcagcgccac

SEQ ID NO: 1669127 - RNA, 17 nt, Salmonella enterica enterica serovar Typhi
cgguaagcgucgccaga

SEQ ID NO: 1669128 - RNA, 23 nt, Salmonella enterica enterica serovar Typhi
cgguaaagguaauaucauccggu

SEQ ID NO: 1669129 - RNA, 24 nt, Salmonella enterica enterica serovar Typhi
cgguaaauccacaaccggcuggcu

SEQ ID NO: 1669130 - RNA, 22 nt, Salmonella enterica enterica serovar Typhi
cgguaaauuucuugaucaaucu

SEQ ID NO: 1669131 - RNA, 18 nt, Salmonella enterica enterica serovar Typhi
cgguaacguaaauaccca

SEQ ID NO: 1669132 - RNA, 18 nt, Salmonella enterica enterica serovar Typhi
cgguacacuucagccaga

SEQ ID NO: 1669133 - RNA, 21 nt, Salmonella enterica enterica serovar Typhi
cgguaaucaccagaucggcau

SEQ ID NO: 1669134 - RNA, 18 nt, Salmonella enterica enterica serovar Typhi
cgguaauugcgccguuca

SEQ ID NO: 1669135 - RNA, 22 nt, Salmonella enterica enterica serovar Typhi
cgguaauugcuugcccgauggc

SEQ ID NO: 1669136 - RNA, 20 nt, Salmonella enterica enterica serovar Typhi
cgguaccgcguuuugcugau

SEQ ID NO: 1669137 - RNA, 16 nt, Salmonella enterica enterica serovar Typhi
cggucagccacaugcc

SEQ ID NO: 1669138 - RNA, 13 nt, Salmonella enterica enterica serovar Typhi
cggucacaggcau

SEQ ID NO: 1669139 - RNA, 17 nt, Salmonella enterica enterica serovar Typhi
cggucauggauaacaug

SEQ ID NO: 1669140 - RNA, 23 nt, Salmonella enterica enterica serovar Typhi
cggucagggugaaucccgccauc

SEQ ID NO: 1669141 - RNA, 21 nt, Salmonella enterica enterica serovar Typhi
cgguccggcgcuaaccagcgc

SEQ ID NO: 1669142 - RNA, 20 nt, Salmonella enterica enterica serovar Typhi
aacauccccgcuugcagcgu

SEQ ID NO: 1669143 - RNA, 15 nt, Salmonella enterica enterica serovar Typhi
aacaucgcuccggca

SEQ ID NO: 1669144 - RNA, 20 nt, Salmonella enterica enterica serovar Typhi
aacaucguguccuggguaac

SEQ ID NO: 1669145 - RNA, 17 nt, Salmonella enterica enterica serovar Typhi
cggccauucgcggcgua

SEQ ID NO: 1669146 - RNA, 23 nt, Salmonella enterica enterica serovar Typhi
cggcccauaucaaucaacgguuc

SEQ ID NO: 1669147 - RNA, 16 nt, Salmonella enterica enterica serovar Typhi
cggcccaggcaucgac

SEQ ID NO: 1669148 - RNA, 13 nt, Salmonella enterica enterica serovar Typhi
cggccaggauggc

SEQ ID NO: 1669149 - RNA, 18 nt, Salmonella enterica enterica serovar Typhi
cggccagcaaaaucacca

SEQ ID NO: 1669150 - RNA, 14 nt, Salmonella enterica enterica serovar Typhi
cggcccgccgcugg

SEQ ID NO: 1669151 - RNA, 14 nt, Salmonella enterica enterica serovar Typhi
cggcaggcuggcgg

SEQ ID NO: 1669152 - RNA, 15 nt, Salmonella enterica enterica serovar Typhi
cggcagccacgccga

SEQ ID NO: 1669153 - RNA, 18 nt, Salmonella enterica enterica serovar Typhi
aacaucagccagcagcuc

SEQ ID NO: 1669154 - RNA, 22 nt, Salmonella enterica enterica serovar Typhi
aacaucagcccuaucgcugcgc

SEQ ID NO: 1669155 - RNA, 14 nt, Salmonella enterica enterica serovar Typhi
cggcagccagcgua

SEQ ID NO: 1669156 - RNA, 13 nt, Salmonella enterica enterica serovar Typhi
cggcagccacgcc

SEQ ID NO: 1669157 - RNA, 17 nt, Salmonella enterica enterica serovar Typhi
cggcagccgacagcgua

SEQ ID NO: 1669158 - RNA, 21 nt, Salmonella enterica enterica serovar Typhi
cggcagcgcgcacguucaggu

SEQ ID NO: 1669159 - RNA, 15 nt, Salmonella enterica enterica serovar Typhi
cggcagcgccauccg

SEQ ID NO: 1669160 - RNA, 16 nt, Salmonella enterica enterica serovar Typhi
cggccaaccccggcaa

SEQ ID NO: 1669161 - RNA, 17 nt, Salmonella enterica enterica serovar Typhi
cggcauggaugcaugag

SEQ ID NO: 1669162 - RNA, 22 nt, Salmonella enterica enterica serovar Typhi
cggcaguucuaacaggaagcga

SEQ ID NO: 1669163 - RNA, 12 nt, Salmonella enterica enterica serovar Typhi
cggcauacaccg

SEQ ID NO: 1669164 - RNA, 15 nt, Salmonella enterica enterica serovar Typhi
cggcauaauccggca

SEQ ID NO: 1669165 - RNA, 14 nt, Salmonella enterica enterica serovar Typhi
cggcauacacgccg

SEQ ID NO: 1669166 - RNA, 21 nt, Salmonella enterica enterica serovar Typhi
cggcauacaccgccagcgucu

SEQ ID NO: 1669167 - RNA, 16 nt, Salmonella enterica enterica serovar Typhi
cggcaucucgccauaa

SEQ ID NO: 1669168 - RNA, 20 nt, Salmonella enterica enterica serovar Typhi
cggcaucgggaacggcauac

SEQ ID NO: 1669169 - RNA, 18 nt, Salmonella enterica enterica serovar Typhi
cggcaucguagucaggca

SEQ ID NO: 1669170 - RNA, 15 nt, Salmonella enterica enterica serovar Typhi
aacaggcuucccaau

SEQ ID NO: 1669171 - RNA, 16 nt, Salmonella enterica enterica serovar Typhi
aacagggguuccggca

SEQ ID NO: 1669172 - RNA, 23 nt, Salmonella enterica enterica serovar Typhi
aacagggugauggugucaaucgc

SEQ ID NO: 1669173 - RNA, 12 nt, Salmonella enterica enterica serovar Typhi
cggcacgccgaa

SEQ ID NO: 1669174 - RNA, 17 nt, Salmonella enterica enterica serovar Typhi
cggcacgguaaaccucu

SEQ ID NO: 1669175 - RNA, 23 nt, Salmonella enterica enterica serovar Typhi
cggacagcagcauauaaauuccg

SEQ ID NO: 1669176 - RNA, 14 nt, Salmonella enterica enterica serovar Typhi
cggcagcagcuuca

SEQ ID NO: 1669177 - RNA, 20 nt, Salmonella enterica enterica serovar Typhi
cggcagcagcuucagcauca

SEQ ID NO: 1669178 - RNA, 20 nt, Salmonella enterica enterica serovar Typhi
cggcacguuuuccagguugu

SEQ ID NO: 1669179 - RNA, 14 nt, Salmonella enterica enterica serovar Typhi
cggcacuaaagcgu

SEQ ID NO: 1669180 - RNA, 11 nt, Salmonella enterica enterica serovar Typhi
cggcagaccgg

SEQ ID NO: 1669181 - RNA, 21 nt, Salmonella enterica enterica serovar Typhi
cggcagaauuaacucaucaca

SEQ ID NO: 1669182 - RNA, 14 nt, Salmonella enterica enterica serovar Typhi
cggcagacggcugg

SEQ ID NO: 1669183 - RNA, 16 nt, Salmonella enterica enterica serovar Typhi
cggcgcgaaugcguag

SEQ ID NO: 1669184 - RNA, 15 nt, Salmonella enterica enterica serovar Typhi
cggcgcgccagcgca

SEQ ID NO: 1669185 - RNA, 14 nt, Salmonella enterica enterica serovar Typhi
cggcgcucacgcug

SEQ ID NO: 1669186 - RNA, 16 nt, Salmonella enterica enterica serovar Typhi
cggcgcuacggcguuu

SEQ ID NO: 1669187 - RNA, 16 nt, Salmonella enterica enterica serovar Typhi
cggcgcgcuggcgugg

SEQ ID NO: 1669188 - RNA, 13 nt, Salmonella enterica enterica serovar Typhi
cggcggccaaccc

SEQ ID NO: 1669189 - RNA, 17 nt, Salmonella enterica enterica serovar Typhi
cggcggaugaucgccuc

SEQ ID NO: 1669190 - RNA, 18 nt, Salmonella enterica enterica serovar Typhi
cggcgcucaggaucgccg

SEQ ID NO: 1669191 - RNA, 16 nt, Salmonella enterica enterica serovar Typhi
cggcggaggccagacu

SEQ ID NO: 1669192 - RNA, 16 nt, Salmonella enterica enterica serovar Typhi
cggcgccaggacaacg

SEQ ID NO: 1669193 - RNA, 17 nt, Salmonella enterica enterica serovar Typhi
cggcgccggggugcugu

SEQ ID NO: 1669194 - RNA, 21 nt, Salmonella enterica enterica serovar Typhi
cggcgcaguucgccgccagga

SEQ ID NO: 1669195 - RNA, 20 nt, Salmonella enterica enterica serovar Typhi
cggcgcacugccugauggcg

SEQ ID NO: 1669196 - RNA, 15 nt, Salmonella enterica enterica serovar Typhi
cggcgcacugccuga

SEQ ID NO: 1669197 - RNA, 15 nt, Salmonella enterica enterica serovar Typhi
cggcgcaaacaguac

SEQ ID NO: 1669198 - RNA, 16 nt, Salmonella enterica enterica serovar Typhi
cggcgacggacucgcg

SEQ ID NO: 1669199 - RNA, 16 nt, Salmonella enterica enterica serovar Typhi
cggcgacugccgcaga

SEQ ID NO: 1669200 - RNA, 14 nt, Salmonella enterica enterica serovar Typhi
cggcgacuccagaa

SEQ ID NO: 1669201 - RNA, 16 nt, Salmonella enterica enterica serovar Typhi
cggccugcgguguaga

SEQ ID NO: 1669202 - RNA, 14 nt, Salmonella enterica enterica serovar Typhi
cggccuugccgcca

SEQ ID NO: 1669203 - RNA, 18 nt, Salmonella enterica enterica serovar Typhi
cggcgaaucgcagagcgu

SEQ ID NO: 1669204 - RNA, 16 nt, Salmonella enterica enterica serovar Typhi
cggcgaacaggcguaa

SEQ ID NO: 1669205 - RNA, 22 nt, Salmonella enterica enterica serovar Typhi
ccggagaguucauaacgcacaa

SEQ ID NO: 1669206 - RNA, 18 nt, Salmonella enterica enterica serovar Typhi
ccggacgccagugcgcau

SEQ ID NO: 1669207 - RNA, 22 nt, Salmonella enterica enterica serovar Typhi
ccggacgcaccagccaggcgau

SEQ ID NO: 1669208 - RNA, 20 nt, Salmonella enterica enterica serovar Typhi
ccggauaagcaacgcgccau

SEQ ID NO: 1669209 - RNA, 19 nt, Salmonella enterica enterica serovar Typhi
ccggauaacgcgcuggaug

SEQ ID NO: 1669210 - RNA, 22 nt, Salmonella enterica enterica serovar Typhi
ccggauaagccgcguccggcaa

SEQ ID NO: 1669211 - RNA, 21 nt, Salmonella enterica enterica serovar Typhi
ccggauaagcggcagcgccau

SEQ ID NO: 1669212 - RNA, 22 nt, Salmonella enterica enterica serovar Typhi
ccggauaagcgugcgccauccg

SEQ ID NO: 1669213 - RNA, 18 nt, Salmonella enterica enterica serovar Typhi
ccggaucgaucccggcaa

SEQ ID NO: 1669214 - RNA, 17 nt, Salmonella enterica enterica serovar Typhi
ccggaaaucgcggcgau

SEQ ID NO: 1669215 - RNA, 13 nt, Salmonella enterica enterica serovar Typhi
ccggaaccggcau

SEQ ID NO: 1669216 - RNA, 18 nt, Salmonella enterica enterica serovar Typhi
ccggaacgcgagaagccc

SEQ ID NO: 1669217 - RNA, 18 nt, Salmonella enterica enterica serovar Typhi
ccggaacggacgugcgcu

SEQ ID NO: 1669218 - RNA, 19 nt, Salmonella enterica enterica serovar Typhi
ccggaaucgccugcgucgc

SEQ ID NO: 1669219 - RNA, 21 nt, Salmonella enterica enterica serovar Typhi
ccgcguagcguuaucuguaau

SEQ ID NO: 1669220 - RNA, 23 nt, Salmonella enterica enterica serovar Typhi
ccgcggggaucgguuuauccccg

SEQ ID NO: 1669221 - RNA, 20 nt, Salmonella enterica enterica serovar Typhi
ccgcgucguuacgcucguca

SEQ ID NO: 1669222 - RNA, 16 nt, Salmonella enterica enterica serovar Typhi
ccgcuaaaaaacaggc

SEQ ID NO: 1669223 - RNA, 17 nt, Salmonella enterica enterica serovar Typhi
ccgcuaacggcaccagc

SEQ ID NO: 1669224 - RNA, 14 nt, Salmonella enterica enterica serovar Typhi
ccgcuccgcgcauc

SEQ ID NO: 1669225 - RNA, 15 nt, Salmonella enterica enterica serovar Typhi
ccgcuacccggcaca

SEQ ID NO: 1669226 - RNA, 23 nt, Salmonella enterica enterica serovar Typhi
ccggcaucauucugcaggcgggu

SEQ ID NO: 1669227 - RNA, 14 nt, Salmonella enterica enterica serovar Typhi
ccggcgacguauuc

SEQ ID NO: 1669228 - RNA, 22 nt, Salmonella enterica enterica serovar Typhi
ccggcacgauggucucaaucgc

SEQ ID NO: 1669229 - RNA, 19 nt, Salmonella enterica enterica serovar Typhi
ccggcagacgauagcgggu

SEQ ID NO: 1669230 - RNA, 23 nt, Salmonella enterica enterica serovar Typhi
ccggcagggucguacuaaagagc

SEQ ID NO: 1669231 - RNA, 23 nt, Salmonella enterica enterica serovar Typhi
ccggcagcgucggcuucaucaca

SEQ ID NO: 1669232 - RNA, 20 nt, Salmonella enterica enterica serovar Typhi
ccggcaggagcggagagagc

SEQ ID NO: 1669233 - RNA, 12 nt, Salmonella enterica enterica serovar Typhi
ccggcaacugcc

SEQ ID NO: 1669234 - RNA, 18 nt, Salmonella enterica enterica serovar Typhi
ccggcaaccugagcgcga

SEQ ID NO: 1669235 - RNA, 19 nt, Salmonella enterica enterica serovar Typhi
ccggcaacacccgccgaac

SEQ ID NO: 1669236 - RNA, 23 nt, Salmonella enterica enterica serovar Typhi
ccggcacauauuccggcgcuggc

SEQ ID NO: 1669237 - RNA, 22 nt, Salmonella enterica enterica serovar Typhi
ccggcaauauuacggaaacggu

SEQ ID NO: 1669238 - RNA, 15 nt, Salmonella enterica enterica serovar Typhi
ccggaugcgccucau

SEQ ID NO: 1669239 - RNA, 19 nt, Salmonella enterica enterica serovar Typhi
ccggaucggucuggcgcau

SEQ ID NO: 1669240 - RNA, 19 nt, Salmonella enterica enterica serovar Typhi
ccggcaaaccuaccggcau

SEQ ID NO: 1669241 - RNA, 21 nt, Salmonella enterica enterica serovar Typhi
ccggauggcgguauaacugcc

SEQ ID NO: 1669242 - RNA, 15 nt, Salmonella enterica enterica serovar Typhi
ccggcaaaaaucagc

SEQ ID NO: 1669243 - RNA, 21 nt, Salmonella enterica enterica serovar Typhi
ccggauuagcgacagcgcuau

SEQ ID NO: 1669244 - RNA, 23 nt, Salmonella enterica enterica serovar Typhi
ccggauggggcauuagccgccau

SEQ ID NO: 1669245 - RNA, 21 nt, Salmonella enterica enterica serovar Typhi
ccggauggcggcgucgccugu

SEQ ID NO: 1669246 - RNA, 21 nt, Salmonella enterica enterica serovar Typhi
ccggauggcggcuuugaacag

SEQ ID NO: 1669247 - RNA, 16 nt, Salmonella enterica enterica serovar Typhi
ccggaugugagcgcau

SEQ ID NO: 1669248 - RNA, 12 nt, Salmonella enterica enterica serovar Typhi
ccgccuagcguc

SEQ ID NO: 1669249 - RNA, 20 nt, Salmonella enterica enterica serovar Typhi
ccgccuguacuuccgguauc

SEQ ID NO: 1669250 - RNA, 17 nt, Salmonella enterica enterica serovar Typhi
ccgccuuaucaggccug

SEQ ID NO: 1669251 - RNA, 13 nt, Salmonella enterica enterica serovar Typhi
ccgccuuaccgcg

SEQ ID NO: 1669252 - RNA, 21 nt, Salmonella enterica enterica serovar Typhi
ccgcgaaaaacgauauucgcg

SEQ ID NO: 1669253 - RNA, 19 nt, Salmonella enterica enterica serovar Typhi
ccgccuugcccguauugaa

SEQ ID NO: 1669254 - RNA, 16 nt, Salmonella enterica enterica serovar Typhi
ccgccgucaucugcgc

SEQ ID NO: 1669255 - RNA, 23 nt, Salmonella enterica enterica serovar Typhi
aaaugcaccggcguuacuccgcg

SEQ ID NO: 1669256 - RNA, 17 nt, Salmonella enterica enterica serovar Typhi
aaaugauguguuucagc

SEQ ID NO: 1669257 - RNA, 18 nt, Salmonella enterica enterica serovar Typhi
ccgcgcacaaaaggcugg

SEQ ID NO: 1669258 - RNA, 16 nt, Salmonella enterica enterica serovar Typhi
ccgcgccagacgccau

SEQ ID NO: 1669259 - RNA, 11 nt, Salmonella enterica enterica serovar Typhi
ccgcgccugaa

SEQ ID NO: 1669260 - RNA, 15 nt, Salmonella enterica enterica serovar Typhi
ccgccauccggcaca

SEQ ID NO: 1669261 - RNA, 14 nt, Salmonella enterica enterica serovar Typhi
ccgccauccggcga

SEQ ID NO: 1669262 - RNA, 15 nt, Salmonella enterica enterica serovar Typhi
ccgcagccgacgcau

SEQ ID NO: 1669263 - RNA, 16 nt, Salmonella enterica enterica serovar Typhi
ccgcagccgacgcauu

SEQ ID NO: 1669264 - RNA, 13 nt, Salmonella enterica enterica serovar Typhi
ccgcagccgcuca

SEQ ID NO: 1669265 - RNA, 14 nt, Salmonella enterica enterica serovar Typhi
ccgcagcuuauucc

SEQ ID NO: 1669266 - RNA, 16 nt, Salmonella enterica enterica serovar Typhi
ccgcaucaaacuugcc

SEQ ID NO: 1669267 - RNA, 12 nt, Salmonella enterica enterica serovar Typhi
ccgcauacaucg

SEQ ID NO: 1669268 - RNA, 18 nt, Salmonella enterica enterica serovar Typhi
ccgccaguucgccggcaa

SEQ ID NO: 1669269 - RNA, 12 nt, Salmonella enterica enterica serovar Typhi
ccgccagcgcaa

SEQ ID NO: 1669270 - RNA, 10 nt, Salmonella enterica enterica serovar Typhi
ccgccagcgc

SEQ ID NO: 1669271 - RNA, 14 nt, Salmonella enterica enterica serovar Typhi
ccgcaucgcgccca

SEQ ID NO: 1669272 - RNA, 13 nt, Salmonella enterica enterica serovar Typhi
ccgcaucggcauc

SEQ ID NO: 1669273 - RNA, 13 nt, Salmonella enterica enterica serovar Typhi
ccgccagacgccc

SEQ ID NO: 1669274 - RNA, 14 nt, Salmonella enterica enterica serovar Typhi
ccgccagagcacga

SEQ ID NO: 1669275 - RNA, 15 nt, Salmonella enterica enterica serovar Typhi
ccgccagauaaagcg

SEQ ID NO: 1669276 - RNA, 15 nt, Salmonella enterica enterica serovar Typhi
ccgccagauuaucca

SEQ ID NO: 1669277 - RNA, 15 nt, Salmonella enterica enterica serovar Typhi
ccgccacccggcaaa

SEQ ID NO: 1669278 - RNA, 14 nt, Salmonella enterica enterica serovar Typhi
ccugcgcgccugac

SEQ ID NO: 1669279 - RNA, 17 nt, Salmonella enterica enterica serovar Typhi
ccugcgcguaaauuuca

SEQ ID NO: 1669280 - RNA, 15 nt, Salmonella enterica enterica serovar Typhi
ccugcgcugacggcg

SEQ ID NO: 1669281 - RNA, 20 nt, Salmonella enterica enterica serovar Typhi
ccugccguccugaucaaggc

SEQ ID NO: 1669282 - RNA, 17 nt, Salmonella enterica enterica serovar Typhi
ccugccgacaggcaggu

SEQ ID NO: 1669283 - RNA, 18 nt, Salmonella enterica enterica serovar Typhi
ccugccaggauccguuca

SEQ ID NO: 1669284 - RNA, 13 nt, Salmonella enterica enterica serovar Typhi
ccugccaguccgc

SEQ ID NO: 1669285 - RNA, 23 nt, Salmonella enterica enterica serovar Typhi
ccugcggacgcagcucauacccu

SEQ ID NO: 1669286 - RNA, 20 nt, Salmonella enterica enterica serovar Typhi
ccugcguuucuacggccaca

SEQ ID NO: 1669287 - RNA, 17 nt, Salmonella enterica enterica serovar Typhi
ccugcuaucuuauccgc

SEQ ID NO: 1669288 - RNA, 16 nt, Salmonella enterica enterica serovar Typhi
ccugcucccgcugcgg

SEQ ID NO: 1669289 - RNA, 18 nt, Salmonella enterica enterica serovar Typhi
ccugcgucgcuucgccaa

SEQ ID NO: 1669290 - RNA, 20 nt, Salmonella enterica enterica serovar Typhi
ccugcggguucaucgccaca

SEQ ID NO: 1669291 - RNA, 13 nt, Salmonella enterica enterica serovar Typhi
ccugcucuugcgg

SEQ ID NO: 1669292 - RNA, 18 nt, Salmonella enterica enterica serovar Typhi
ccugcugcggauaacguu

SEQ ID NO: 1669293 - RNA, 13 nt, Salmonella enterica enterica serovar Typhi
ccugggcgaaaac

SEQ ID NO: 1669294 - RNA, 14 nt, Salmonella enterica enterica serovar Typhi
ccuggcuuaccugc

SEQ ID NO: 1669295 - RNA, 20 nt, Salmonella enterica enterica serovar Typhi
ccuggcugagaaaaauacgc

SEQ ID NO: 1669296 - RNA, 13 nt, Salmonella enterica enterica serovar Typhi
ccuggcguuauca

SEQ ID NO: 1669297 - RNA, 14 nt, Salmonella enterica enterica serovar Typhi
ccuggcuaucccga

SEQ ID NO: 1669298 - RNA, 17 nt, Salmonella enterica enterica serovar Typhi
ccugguccucugauaag

SEQ ID NO: 1669299 - RNA, 20 nt, Salmonella enterica enterica serovar Typhi
ccugggugagcgucaucggc

SEQ ID NO: 1669300 - RNA, 18 nt, Salmonella enterica enterica serovar Typhi
ccugguggcgaauacugu

SEQ ID NO: 1669301 - RNA, 19 nt, Salmonella enterica enterica serovar Typhi
ccuggugcgacaccacgca

SEQ ID NO: 1669302 - RNA, 13 nt, Salmonella enterica enterica serovar Typhi
ccuggccuccggc

SEQ ID NO: 1669303 - RNA, 21 nt, Salmonella enterica enterica serovar Typhi
ccuggaugcgcugaauagcgc

SEQ ID NO: 1669304 - RNA, 20 nt, Salmonella enterica enterica serovar Typhi
ccuggaucugcgcauuaacg

SEQ ID NO: 1669305 - RNA, 23 nt, Salmonella enterica enterica serovar Typhi
ccuggaucugcgcauuaacgcca

SEQ ID NO: 1669306 - RNA, 22 nt, Salmonella enterica enterica serovar Typhi
ccuggauacguuccagcagcgc

SEQ ID NO: 1669307 - RNA, 20 nt, Salmonella enterica enterica serovar Typhi
ccuggauaauaagacgccag

SEQ ID NO: 1669308 - RNA, 17 nt, Salmonella enterica enterica serovar Typhi
ccuggacgcgagccaca

SEQ ID NO: 1669309 - RNA, 19 nt, Salmonella enterica enterica serovar Typhi
ccugauggcguagcgccau

SEQ ID NO: 1669310 - RNA, 13 nt, Salmonella enterica enterica serovar Typhi
ccugauagcgcug

SEQ ID NO: 1669311 - RNA, 19 nt, Salmonella enterica enterica serovar Typhi
ccugaucggccagcgucgc

SEQ ID NO: 1669312 - RNA, 12 nt, Salmonella enterica enterica serovar Typhi
ccugauccagcu

SEQ ID NO: 1669313 - RNA, 21 nt, Salmonella enterica enterica serovar Typhi
ccugaucgccaacgaccggcg

SEQ ID NO: 1669314 - RNA, 18 nt, Salmonella enterica enterica serovar Typhi
ccugcaaauuaugauuca

SEQ ID NO: 1669315 - RNA, 16 nt, Salmonella enterica enterica serovar Typhi
ccugcacguuacccgc

SEQ ID NO: 1669316 - RNA, 18 nt, Salmonella enterica enterica serovar Typhi
ccugcagggaauaagcgc

SEQ ID NO: 1669317 - RNA, 22 nt, Salmonella enterica enterica serovar Typhi
ccugcagggaauaagcgcccau

SEQ ID NO: 1669318 - RNA, 12 nt, Salmonella enterica enterica serovar Typhi
ccugcaucacgc

SEQ ID NO: 1669319 - RNA, 20 nt, Salmonella enterica enterica serovar Typhi
ccugcaucacgcccggcggu

SEQ ID NO: 1669320 - RNA, 15 nt, Salmonella enterica enterica serovar Typhi
ccugcauugccugau

SEQ ID NO: 1669321 - RNA, 20 nt, Salmonella enterica enterica serovar Typhi
ccugcauuaacggcaacagu

SEQ ID NO: 1669322 - RNA, 11 nt, Salmonella enterica enterica serovar Typhi
ccugccagauu

SEQ ID NO: 1669323 - RNA, 24 nt, Salmonella enterica enterica serovar Typhi
ccugaccaguuguuccgcgcugau

SEQ ID NO: 1669324 - RNA, 20 nt, Salmonella enterica enterica serovar Typhi
ccugacagcgcgcgaauauc

SEQ ID NO: 1669325 - RNA, 15 nt, Salmonella enterica enterica serovar Typhi
ccugacggcgcuguc

SEQ ID NO: 1669326 - RNA, 23 nt, Salmonella enterica enterica serovar Typhi
ccugacgcgcagcgauauagcgc

SEQ ID NO: 1669327 - RNA, 20 nt, Salmonella enterica enterica serovar Typhi
ccugauaagcgcagcgccau

SEQ ID NO: 1669328 - RNA, 19 nt, Salmonella enterica enterica serovar Typhi
ccugauaagcacaggccau

SEQ ID NO: 1669329 - RNA, 19 nt, Salmonella enterica enterica serovar Typhi
ccugauaagcgcagcgcau

SEQ ID NO: 1669330 - RNA, 20 nt, Salmonella enterica enterica serovar Typhi
ccugauaaacguagcgucau

SEQ ID NO: 1669331 - RNA, 22 nt, Salmonella enterica enterica serovar Typhi
ccugacuguucacgcagcgcau

SEQ ID NO: 1669332 - RNA, 21 nt, Salmonella enterica enterica serovar Typhi
ccugacugcgcgccugcgcug

SEQ ID NO: 1669333 - RNA, 15 nt, Salmonella enterica enterica serovar Typhi
ccugaaccagcgccg

SEQ ID NO: 1669334 - RNA, 20 nt, Salmonella enterica enterica serovar Typhi
ccugaacgcccggcgcgaca

SEQ ID NO: 1669335 - RNA, 22 nt, Salmonella enterica enterica serovar Typhi
ccugaaaagagcgacguugucu

SEQ ID NO: 1669336 - RNA, 13 nt, Salmonella enterica enterica serovar Typhi
ccugaagcgcagu

SEQ ID NO: 1669337 - RNA, 19 nt, Salmonella enterica enterica serovar Typhi
ccucuuccgguagcgccug

SEQ ID NO: 1669338 - RNA, 14 nt, Salmonella enterica enterica serovar Typhi
ccucuuccgccagg

SEQ ID NO: 1669339 - RNA, 20 nt, Salmonella enterica enterica serovar Typhi
ccucuuucagccgacuaucu

SEQ ID NO: 1669340 - RNA, 17 nt, Salmonella enterica enterica serovar Typhi
ccucguucccagcggga

SEQ ID NO: 1669341 - RNA, 22 nt, Salmonella enterica enterica serovar Typhi
ccucucuugccugauggcgcgc

SEQ ID NO: 1669342 - RNA, 14 nt, Salmonella enterica enterica serovar Typhi
ccuccagacuggcg

SEQ ID NO: 1669343 - RNA, 16 nt, Salmonella enterica enterica serovar Typhi
ccucgcaguuaugcgc

SEQ ID NO: 1669344 - RNA, 14 nt, Salmonella enterica enterica serovar Typhi
ccguauugccagau

SEQ ID NO: 1669345 - RNA, 19 nt, Salmonella enterica enterica serovar Typhi
ccguaggccugauaagacg

SEQ ID NO: 1669346 - RNA, 12 nt, Salmonella enterica enterica serovar Typhi
ccgguugcugau

SEQ ID NO: 1669347 - RNA, 19 nt, Salmonella enterica enterica serovar Typhi
ccguccacauccagcgcca

SEQ ID NO: 1669348 - RNA, 20 nt, Salmonella enterica enterica serovar Typhi
ccgucacaccaucccggcgu

SEQ ID NO: 1669349 - RNA, 18 nt, Salmonella enterica enterica serovar Typhi
ccgucaaagaaaacuuuc

SEQ ID NO: 1669350 - RNA, 17 nt, Salmonella enterica enterica serovar Typhi
ccgucaaacaucgcgcu

SEQ ID NO: 1669351 - RNA, 18 nt, Salmonella enterica enterica serovar Typhi
ccggucaucgcggaaagc

SEQ ID NO: 1669352 - RNA, 18 nt, Salmonella enterica enterica serovar Typhi
ccggugcgauucagcgca

SEQ ID NO: 1669353 - RNA, 16 nt, Salmonella enterica enterica serovar Typhi
ccggugcggagcaggc

SEQ ID NO: 1669354 - RNA, 17 nt, Salmonella enterica enterica serovar Typhi
ccgucguuaaucagcgc

SEQ ID NO: 1669355 - RNA, 17 nt, Salmonella enterica enterica serovar Typhi
ccgucucuuuuugcagc

SEQ ID NO: 1669356 - RNA, 17 nt, Salmonella enterica enterica serovar Typhi
ccgucgcggcuuucagc

SEQ ID NO: 1669357 - RNA, 13 nt, Salmonella enterica enterica serovar Typhi
ccgucgcggcauc

SEQ ID NO: 1669358 - RNA, 18 nt, Salmonella enterica enterica serovar Typhi
ccgucgugauagccauac

SEQ ID NO: 1669359 - RNA, 23 nt, Salmonella enterica enterica serovar Typhi
ccgucgcgcccacgcgcggcauc

SEQ ID NO: 1669360 - RNA, 12 nt, Salmonella enterica enterica serovar Typhi
ccgucgccggaa

SEQ ID NO: 1669361 - RNA, 19 nt, Salmonella enterica enterica serovar Typhi
ccgugcaaaaucacgcggc

SEQ ID NO: 1669362 - RNA, 21 nt, Salmonella enterica enterica serovar Typhi
ccgugauaauaguggugcgca

SEQ ID NO: 1669363 - RNA, 20 nt, Salmonella enterica enterica serovar Typhi
ccguggaaaagagcgucguu

SEQ ID NO: 1669364 - RNA, 16 nt, Salmonella enterica enterica serovar Typhi
ccgugcucuucgugga

SEQ ID NO: 1669365 - RNA, 21 nt, Salmonella enterica enterica serovar Typhi
ccggucaauacaucacgcaac

SEQ ID NO: 1669366 - RNA, 20 nt, Salmonella enterica enterica serovar Typhi
ccgguaacguaaauacccag

SEQ ID NO: 1669367 - RNA, 20 nt, Salmonella enterica enterica serovar Typhi
ccgguaaauccacaaccggc

SEQ ID NO: 1669368 - RNA, 15 nt, Salmonella enterica enterica serovar Typhi
ccggguucagcgaca

SEQ ID NO: 1669369 - RNA, 15 nt, Salmonella enterica enterica serovar Typhi
ccggguggcgcugug

SEQ ID NO: 1669370 - RNA, 22 nt, Salmonella enterica enterica serovar Typhi
ccgggucagcgggguucagacc

SEQ ID NO: 1669371 - RNA, 15 nt, Salmonella enterica enterica serovar Typhi
ccggcugacauaauc

SEQ ID NO: 1669372 - RNA, 23 nt, Salmonella enterica enterica serovar Typhi
ccggcugaacguuguauaaacag

SEQ ID NO: 1669373 - RNA, 21 nt, Salmonella enterica enterica serovar Typhi
ccggcuaugccggaggauauu

SEQ ID NO: 1669374 - RNA, 19 nt, Salmonella enterica enterica serovar Typhi
cgagccaacguauaaaaug

SEQ ID NO: 1669375 - RNA, 17 nt, Salmonella enterica enterica serovar Typhi
cgagcaucuccagcgca

SEQ ID NO: 1669376 - RNA, 14 nt, Salmonella enterica enterica serovar Typhi
cgagcaguacgccu

SEQ ID NO: 1669377 - RNA, 17 nt, Salmonella enterica enterica serovar Typhi
cgagccacgcggcauca

SEQ ID NO: 1669378 - RNA, 20 nt, Salmonella enterica enterica serovar Typhi
aacacccgcaaacuaauggc

SEQ ID NO: 1669379 - RNA, 21 nt, Salmonella enterica enterica serovar Typhi
aacacccaauauagaguccug

SEQ ID NO: 1669380 - RNA, 21 nt, Salmonella enterica enterica serovar Typhi
cgagcaaaacccggugcggca

SEQ ID NO: 1669381 - RNA, 16 nt, Salmonella enterica enterica serovar Typhi
cgagauuuuucugcgc

SEQ ID NO: 1669382 - RNA, 18 nt, Salmonella enterica enterica serovar Typhi
cgagauuuuucugcgcca

SEQ ID NO: 1669383 - RNA, 19 nt, Salmonella enterica enterica serovar Typhi
cgagcacuuuuuccuccug

SEQ ID NO: 1669384 - RNA, 17 nt, Salmonella enterica enterica serovar Typhi
cgagaguccagcgccag

SEQ ID NO: 1669385 - RNA, 16 nt, Salmonella enterica enterica serovar Typhi
cgagauaaaaacgggu

SEQ ID NO: 1669386 - RNA, 12 nt, Salmonella enterica enterica serovar Typhi
cgagauacgcug

SEQ ID NO: 1669387 - RNA, 19 nt, Salmonella enterica enterica serovar Typhi
cgagauacugcaacgccag

SEQ ID NO: 1669388 - RNA, 16 nt, Salmonella enterica enterica serovar Typhi
cgagaaccaacugcca

SEQ ID NO: 1669389 - RNA, 23 nt, Salmonella enterica enterica serovar Typhi
cgacuuuaaacuuauccgccauc

SEQ ID NO: 1669390 - RNA, 17 nt, Salmonella enterica enterica serovar Typhi
cgacucauccagcaucg

SEQ ID NO: 1669391 - RNA, 22 nt, Salmonella enterica enterica serovar Typhi
cgacguucagcauauccagcgc

SEQ ID NO: 1669392 - RNA, 14 nt, Salmonella enterica enterica serovar Typhi
cgagccuugccgca

SEQ ID NO: 1669393 - RNA, 21 nt, Salmonella enterica enterica serovar Typhi
cgagcgaguacguaaugugaa

SEQ ID NO: 1669394 - RNA, 21 nt, Salmonella enterica enterica serovar Typhi
cgagcgaaggggcgggcagca

SEQ ID NO: 1669395 - RNA, 15 nt, Salmonella enterica enterica serovar Typhi
cgagcgccguuaaac

SEQ ID NO: 1669396 - RNA, 13 nt, Salmonella enterica enterica serovar Typhi
cgaguuacguugc

SEQ ID NO: 1669397 - RNA, 23 nt, Salmonella enterica enterica serovar Typhi
cgauaaaaacccaccagcgccag

SEQ ID NO: 1669398 - RNA, 14 nt, Salmonella enterica enterica serovar Typhi
cgauaaaaacagcg

SEQ ID NO: 1669399 - RNA, 17 nt, Salmonella enterica enterica serovar Typhi
cgauacccgcccagauc

SEQ ID NO: 1669400 - RNA, 22 nt, Salmonella enterica enterica serovar Typhi
cgauacccgcccagaucaggcc

SEQ ID NO: 1669401 - RNA, 22 nt, Salmonella enterica enterica serovar Typhi
cgauaccgaaacgcauacgcag

SEQ ID NO: 1669402 - RNA, 15 nt, Salmonella enterica enterica serovar Typhi
cgauaaauuucacgu

SEQ ID NO: 1669403 - RNA, 14 nt, Salmonella enterica enterica serovar Typhi
cgauaaauacccga

SEQ ID NO: 1669404 - RNA, 17 nt, Salmonella enterica enterica serovar Typhi
cgauaaacucaaucagg

SEQ ID NO: 1669405 - RNA, 19 nt, Salmonella enterica enterica serovar Typhi
cgauaaagcgguuaucggc

SEQ ID NO: 1669406 - RNA, 23 nt, Salmonella enterica enterica serovar Typhi
cgauaucagggcuuuuuucucgc

SEQ ID NO: 1669407 - RNA, 14 nt, Salmonella enterica enterica serovar Typhi
cgauauagcgcuga

SEQ ID NO: 1669408 - RNA, 20 nt, Salmonella enterica enterica serovar Typhi
cgauauaucgcgucaucaaa

SEQ ID NO: 1669409 - RNA, 13 nt, Salmonella enterica enterica serovar Typhi
cgauauagcgcau

SEQ ID NO: 1669410 - RNA, 15 nt, Salmonella enterica enterica serovar Typhi
cgauauagcgcauag

SEQ ID NO: 1669411 - RNA, 14 nt, Salmonella enterica enterica serovar Typhi
cgauaucgauaaag

SEQ ID NO: 1669412 - RNA, 17 nt, Salmonella enterica enterica serovar Typhi
cgagggaggcaaucgca

SEQ ID NO: 1669413 - RNA, 22 nt, Salmonella enterica enterica serovar Typhi
cgaggucagcauuucauccauu

SEQ ID NO: 1669414 - RNA, 18 nt, Salmonella enterica enterica serovar Typhi
cgaguccgaggcgaaacg

SEQ ID NO: 1669415 - RNA, 18 nt, Salmonella enterica enterica serovar Typhi
cgacacccgauacacgcc

SEQ ID NO: 1669416 - RNA, 19 nt, Salmonella enterica enterica serovar Typhi
cgacacccgauacacgccg

SEQ ID NO: 1669417 - RNA, 14 nt, Salmonella enterica enterica serovar Typhi
aacaagccgccaac

SEQ ID NO: 1669418 - RNA, 16 nt, Salmonella enterica enterica serovar Typhi
cgacaccgcaaaccgu

SEQ ID NO: 1669419 - RNA, 21 nt, Salmonella enterica enterica serovar Typhi
cgacaagguauaucaacccgc

SEQ ID NO: 1669420 - RNA, 22 nt, Salmonella enterica enterica serovar Typhi
cgacaagcuaauccccagcgcu

SEQ ID NO: 1669421 - RNA, 18 nt, Salmonella enterica enterica serovar Typhi
cgaauuaucguucgggag

SEQ ID NO: 1669422 - RNA, 16 nt, Salmonella enterica enterica serovar Typhi
cgaauuccgccugcug

SEQ ID NO: 1669423 - RNA, 21 nt, Salmonella enterica enterica serovar Typhi
cgacaaccuguaggccggaua

SEQ ID NO: 1669424 - RNA, 17 nt, Salmonella enterica enterica serovar Typhi
cgacaacgcuuccggcg

SEQ ID NO: 1669425 - RNA, 16 nt, Salmonella enterica enterica serovar Typhi
cgacaaugaaccagcc

SEQ ID NO: 1669426 - RNA, 21 nt, Salmonella enterica enterica serovar Typhi
cgacaauggcgacgaucagcg

SEQ ID NO: 1669427 - RNA, 23 nt, Salmonella enterica enterica serovar Typhi
cgacacauuuucaaugcacgcca

SEQ ID NO: 1669428 - RNA, 15 nt, Salmonella enterica enterica serovar Typhi
cgacacccaauccgg

SEQ ID NO: 1669429 - RNA, 16 nt, Salmonella enterica enterica serovar Typhi
cgacaccagcgucgca

SEQ ID NO: 1669430 - RNA, 14 nt, Salmonella enterica enterica serovar Typhi
cgacagcggcgauu

SEQ ID NO: 1669431 - RNA, 20 nt, Salmonella enterica enterica serovar Typhi
cgacaguaguaucauccaua

SEQ ID NO: 1669432 - RNA, 15 nt, Salmonella enterica enterica serovar Typhi
cgacagucgcagagc

SEQ ID NO: 1669433 - RNA, 16 nt, Salmonella enterica enterica serovar Typhi
cgacagcccggcgugu

SEQ ID NO: 1669434 - RNA, 18 nt, Salmonella enterica enterica serovar Typhi
cgacagagaaugcgccgc

SEQ ID NO: 1669435 - RNA, 23 nt, Salmonella enterica enterica serovar Typhi
cgacagagucguuagcagaaugg

SEQ ID NO: 1669436 - RNA, 21 nt, Salmonella enterica enterica serovar Typhi
cgacagauuggucagcagccc

SEQ ID NO: 1669437 - RNA, 22 nt, Salmonella enterica enterica serovar Typhi
cgacacgcugcauauaacuuuc

SEQ ID NO: 1669438 - RNA, 19 nt, Salmonella enterica enterica serovar Typhi
cgaauccccaucuccagac

SEQ ID NO: 1669439 - RNA, 20 nt, Salmonella enterica enterica serovar Typhi
cgaaugugcaccuuaaccgu

SEQ ID NO: 1669440 - RNA, 13 nt, Salmonella enterica enterica serovar Typhi
cgaaucgccucaa

SEQ ID NO: 1669441 - RNA, 19 nt, Salmonella enterica enterica serovar Typhi
cgaaggggcgggcagcagc

SEQ ID NO: 1669442 - RNA, 23 nt, Salmonella enterica enterica serovar Typhi
cgaaggauaauccgguguuuguc

SEQ ID NO: 1669443 - RNA, 23 nt, Salmonella enterica enterica serovar Typhi
cgaagaucguuauccagcagcca

SEQ ID NO: 1669444 - RNA, 21 nt, Salmonella enterica enterica serovar Typhi
cgaagaucgcguacagcgcca

SEQ ID NO: 1669445 - RNA, 15 nt, Salmonella enterica enterica serovar Typhi
cgaagcaggcggaga

SEQ ID NO: 1669446 - RNA, 22 nt, Salmonella enterica enterica serovar Typhi
ccuguaguacaugccauccggc

SEQ ID NO: 1669447 - RNA, 19 nt, Salmonella enterica enterica serovar Typhi
ccugucaguacgucgcaua

SEQ ID NO: 1669448 - RNA, 20 nt, Salmonella enterica enterica serovar Typhi
ccuguaacgcauaagcgcga

SEQ ID NO: 1669449 - RNA, 21 nt, Salmonella enterica enterica serovar Typhi
ccuguagggcacugggcgaua

SEQ ID NO: 1669450 - RNA, 16 nt, Salmonella enterica enterica serovar Typhi
ccuguacuugcgccgc

SEQ ID NO: 1669451 - RNA, 23 nt, Salmonella enterica enterica serovar Typhi
cgaacuacugauuccugccagac

SEQ ID NO: 1669452 - RNA, 16 nt, Salmonella enterica enterica serovar Typhi
cgaacuugaccagcac

SEQ ID NO: 1669453 - RNA, 18 nt, Salmonella enterica enterica serovar Typhi
cgaacugucugaaucagu

SEQ ID NO: 1669454 - RNA, 23 nt, Salmonella enterica enterica serovar Typhi
cgacgccggagaccggcgaaauc

SEQ ID NO: 1669455 - RNA, 12 nt, Salmonella enterica enterica serovar Typhi
cgacgcgccacc

SEQ ID NO: 1669456 - RNA, 14 nt, Salmonella enterica enterica serovar Typhi
cgacgcgccagcca

SEQ ID NO: 1669457 - RNA, 19 nt, Salmonella enterica enterica serovar Typhi
cgacgcgcgguugcggcgg

SEQ ID NO: 1669458 - RNA, 15 nt, Salmonella enterica enterica serovar Typhi
cgacgacgccagcca

SEQ ID NO: 1669459 - RNA, 22 nt, Salmonella enterica enterica serovar Typhi
cgacgaccggcagcgucagccc

SEQ ID NO: 1669460 - RNA, 13 nt, Salmonella enterica enterica serovar Typhi
cgaccucaucaaa

SEQ ID NO: 1669461 - RNA, 20 nt, Salmonella enterica enterica serovar Typhi
cgaccgugauuuuuaccgcc

SEQ ID NO: 1669462 - RNA, 18 nt, Salmonella enterica enterica serovar Typhi
cgaccccaauagcgaucg

SEQ ID NO: 1669463 - RNA, 18 nt, Salmonella enterica enterica serovar Typhi
cgaccaguuuuugcgcca

SEQ ID NO: 1669464 - RNA, 18 nt, Salmonella enterica enterica serovar Typhi
cgaccaguccuuccgccg

SEQ ID NO: 1669465 - RNA, 15 nt, Salmonella enterica enterica serovar Typhi
cgaccaggaucagac

SEQ ID NO: 1669466 - RNA, 13 nt, Salmonella enterica enterica serovar Typhi
cgacauaaacauu

SEQ ID NO: 1669467 - RNA, 14 nt, Salmonella enterica enterica serovar Typhi
cgccauuuccagcc

SEQ ID NO: 1669468 - RNA, 18 nt, Salmonella enterica enterica serovar Typhi
cgcccaaauaguccagca

SEQ ID NO: 1669469 - RNA, 13 nt, Salmonella enterica enterica serovar Typhi
cgccauuacgccg

SEQ ID NO: 1669470 - RNA, 22 nt, Salmonella enterica enterica serovar Typhi
cgccauucgcuuccgccgggaa

SEQ ID NO: 1669471 - RNA, 13 nt, Salmonella enterica enterica serovar Typhi
cgccaugcggcgc

SEQ ID NO: 1669472 - RNA, 22 nt, Salmonella enterica enterica serovar Typhi
cgccaugcugugugaccagcag

SEQ ID NO: 1669473 - RNA, 15 nt, Salmonella enterica enterica serovar Typhi
cgccaugcggcgcca

SEQ ID NO: 1669474 - RNA, 19 nt, Salmonella enterica enterica serovar Typhi
cgccaugcggaaucacgca

SEQ ID NO: 1669475 - RNA, 16 nt, Salmonella enterica enterica serovar Typhi
cgccaucaugcagccg

SEQ ID NO: 1669476 - RNA, 16 nt, Salmonella enterica enterica serovar Typhi
cgccaucauccggcaa

SEQ ID NO: 1669477 - RNA, 17 nt, Salmonella enterica enterica serovar Typhi
cgccaucagccgcgcua

SEQ ID NO: 1669478 - RNA, 22 nt, Salmonella enterica enterica serovar Typhi
cgccauauacgccacggccagc

SEQ ID NO: 1669479 - RNA, 20 nt, Salmonella enterica enterica serovar Typhi
cgccauaguccauuacgcag

SEQ ID NO: 1669480 - RNA, 16 nt, Salmonella enterica enterica serovar Typhi
cgccauauacgccacg

SEQ ID NO: 1669481 - RNA, 17 nt, Salmonella enterica enterica serovar Typhi
cgccaucaauuuugcgc

SEQ ID NO: 1669482 - RNA, 14 nt, Salmonella enterica enterica serovar Typhi
cgccaguuuacgcg

SEQ ID NO: 1669483 - RNA, 20 nt, Salmonella enterica enterica serovar Typhi
cgccauacaacguaccguug

SEQ ID NO: 1669484 - RNA, 20 nt, Salmonella enterica enterica serovar Typhi
cgccauaaaucccggcgauu

SEQ ID NO: 1669485 - RNA, 13 nt, Salmonella enterica enterica serovar Typhi
cgccauacguccg

SEQ ID NO: 1669486 - RNA, 11 nt, Salmonella enterica enterica serovar Typhi
cgccauccggc

SEQ ID NO: 1669487 - RNA, 14 nt, Salmonella enterica enterica serovar Typhi
cgccauccggcaau

SEQ ID NO: 1669488 - RNA, 18 nt, Salmonella enterica enterica serovar Typhi
cgccauccggcaucacgu

SEQ ID NO: 1669489 - RNA, 13 nt, Salmonella enterica enterica serovar Typhi
cgccauccggccu

SEQ ID NO: 1669490 - RNA, 18 nt, Salmonella enterica enterica serovar Typhi
cgccauccugccgcacca

SEQ ID NO: 1669491 - RNA, 13 nt, Salmonella enterica enterica serovar Typhi
cgccauccggcaa

SEQ ID NO: 1669492 - RNA, 14 nt, Salmonella enterica enterica serovar Typhi
cgccauccggcaca

SEQ ID NO: 1669493 - RNA, 16 nt, Salmonella enterica enterica serovar Typhi
cgccaucgccuccaga

SEQ ID NO: 1669494 - RNA, 21 nt, Salmonella enterica enterica serovar Typhi
cgccaucgcgaauuucaaucg

SEQ ID NO: 1669495 - RNA, 17 nt, Salmonella enterica enterica serovar Typhi
cgccaucgacagcgcca

SEQ ID NO: 1669496 - RNA, 18 nt, Salmonella enterica enterica serovar Typhi
cgccaucgacagcgccau

SEQ ID NO: 1669497 - RNA, 21 nt, Salmonella enterica enterica serovar Typhi
cgccaucggcuuuggcaaacg

SEQ ID NO: 1669498 - RNA, 15 nt, Salmonella enterica enterica serovar Typhi
cgccaucgucacgca

SEQ ID NO: 1669499 - RNA, 17 nt, Salmonella enterica enterica serovar Typhi
cgccaucguccagccau

SEQ ID NO: 1669500 - RNA, 17 nt, Salmonella enterica enterica serovar Typhi
cgccaucucacgcaugg

SEQ ID NO: 1669501 - RNA, 19 nt, Salmonella enterica enterica serovar Typhi
cgccaucucauucgccagc

SEQ ID NO: 1669502 - RNA, 23 nt, Salmonella enterica enterica serovar Typhi
cgccaucucauucgccagcggau

SEQ ID NO: 1669503 - RNA, 22 nt, Salmonella enterica enterica serovar Typhi
cgccaugaccugggcgccagag

SEQ ID NO: 1669504 - RNA, 11 nt, Salmonella enterica enterica serovar Typhi
cgccaggccgc

SEQ ID NO: 1669505 - RNA, 23 nt, Salmonella enterica enterica serovar Typhi
cgccagcuccauagaaaucagca

SEQ ID NO: 1669506 - RNA, 14 nt, Salmonella enterica enterica serovar Typhi
cgccagcugcgcgc

SEQ ID NO: 1669507 - RNA, 20 nt, Salmonella enterica enterica serovar Typhi
cgccagcgcuacccgcugac

SEQ ID NO: 1669508 - RNA, 17 nt, Salmonella enterica enterica serovar Typhi
cgccagcggcgccauca

SEQ ID NO: 1669509 - RNA, 20 nt, Salmonella enterica enterica serovar Typhi
cgccagcgugcgcagcgcgu

SEQ ID NO: 1669510 - RNA, 22 nt, Salmonella enterica enterica serovar Typhi
cgccagguagccgacggccaua

SEQ ID NO: 1669511 - RNA, 18 nt, Salmonella enterica enterica serovar Typhi
cgccaggccgcggcugua

SEQ ID NO: 1669512 - RNA, 14 nt, Salmonella enterica enterica serovar Typhi
cgccaggcgccacg

SEQ ID NO: 1669513 - RNA, 22 nt, Salmonella enterica enterica serovar Typhi
cgccagguuuuacgugccgccg

SEQ ID NO: 1669514 - RNA, 14 nt, Salmonella enterica enterica serovar Typhi
cgccaguggaugcg

SEQ ID NO: 1669515 - RNA, 16 nt, Salmonella enterica enterica serovar Typhi
cgccaguucagcgucu

SEQ ID NO: 1669516 - RNA, 14 nt, Salmonella enterica enterica serovar Typhi
cgccagugacgcca

SEQ ID NO: 1669517 - RNA, 22 nt, Salmonella enterica enterica serovar Typhi
cgccacggccagcagccauucg

SEQ ID NO: 1669518 - RNA, 17 nt, Salmonella enterica enterica serovar Typhi
cgccagaagccgucgau

SEQ ID NO: 1669519 - RNA, 21 nt, Salmonella enterica enterica serovar Typhi
cgccacuuccgcuacguucgg

SEQ ID NO: 1669520 - RNA, 13 nt, Salmonella enterica enterica serovar Typhi
cgccacuuccagc

SEQ ID NO: 1669521 - RNA, 19 nt, Salmonella enterica enterica serovar Typhi
cgccacuuuuccggcaccu

SEQ ID NO: 1669522 - RNA, 20 nt, Salmonella enterica enterica serovar Typhi
cgccacuucacuggcggcaa

SEQ ID NO: 1669523 - RNA, 17 nt, Salmonella enterica enterica serovar Typhi
cgccacucuggcgacgc

SEQ ID NO: 1669524 - RNA, 21 nt, Salmonella enterica enterica serovar Typhi
cgccacucuggcgacgccaau

SEQ ID NO: 1669525 - RNA, 23 nt, Salmonella enterica enterica serovar Typhi
cgccagcacauuaagcauggcgu

SEQ ID NO: 1669526 - RNA, 14 nt, Salmonella enterica enterica serovar Typhi
cgccagcaccagca

SEQ ID NO: 1669527 - RNA, 19 nt, Salmonella enterica enterica serovar Typhi
cgccagcaacguuaaggcc

SEQ ID NO: 1669528 - RNA, 13 nt, Salmonella enterica enterica serovar Typhi
cgccagcaacgag

SEQ ID NO: 1669529 - RNA, 23 nt, Salmonella enterica enterica serovar Typhi
cgccagcaaaauuuugcgcagac

SEQ ID NO: 1669530 - RNA, 21 nt, Salmonella enterica enterica serovar Typhi
cgccagcaaaauuuugcgcag

SEQ ID NO: 1669531 - RNA, 19 nt, Salmonella enterica enterica serovar Typhi
cgccagauuaucggccagc

SEQ ID NO: 1669532 - RNA, 20 nt, Salmonella enterica enterica serovar Typhi
cgccagaucgaacagcggca

SEQ ID NO: 1669533 - RNA, 22 nt, Salmonella enterica enterica serovar Typhi
cgccagacacuggaaacagcca

SEQ ID NO: 1669534 - RNA, 16 nt, Salmonella enterica enterica serovar Typhi
cgccagacccagcgcu

SEQ ID NO: 1669535 - RNA, 23 nt, Salmonella enterica enterica serovar Typhi
cgccagacccgcaauaacgccga

SEQ ID NO: 1669536 - RNA, 16 nt, Salmonella enterica enterica serovar Typhi
cgccagaccgacgcca

SEQ ID NO: 1669537 - RNA, 17 nt, Salmonella enterica enterica serovar Typhi
cgccagaccgacgccaa

SEQ ID NO: 1669538 - RNA, 21 nt, Salmonella enterica enterica serovar Typhi
cgccagacucagccaggucug

SEQ ID NO: 1669539 - RNA, 17 nt, Salmonella enterica enterica serovar Typhi
cgccagaucaggcguca

SEQ ID NO: 1669540 - RNA, 23 nt, Salmonella enterica enterica serovar Typhi
cgccagaucaggcgucagcaugg

SEQ ID NO: 1669541 - RNA, 23 nt, Salmonella enterica enterica serovar Typhi
cgccagcaggucgcacuccucug

SEQ ID NO: 1669542 - RNA, 13 nt, Salmonella enterica enterica serovar Typhi
cgccagcagcucg

SEQ ID NO: 1669543 - RNA, 14 nt, Salmonella enterica enterica serovar Typhi
cgccagcagcagcg

SEQ ID NO: 1669544 - RNA, 13 nt, Salmonella enterica enterica serovar Typhi
cgccagcagcagc

SEQ ID NO: 1669545 - RNA, 21 nt, Salmonella enterica enterica serovar Typhi
cgccagccauuaaagaaggcg

SEQ ID NO: 1669546 - RNA, 16 nt, Salmonella enterica enterica serovar Typhi
cgccagccagcgccac

SEQ ID NO: 1669547 - RNA, 17 nt, Salmonella enterica enterica serovar Typhi
cgccagccagcgccacc

SEQ ID NO: 1669548 - RNA, 14 nt, Salmonella enterica enterica serovar Typhi
cgccagccgccauu

SEQ ID NO: 1669549 - RNA, 13 nt, Salmonella enterica enterica serovar Typhi
cgccagccgucaa

SEQ ID NO: 1669550 - RNA, 13 nt, Salmonella enterica enterica serovar Typhi
cgccagcgccacc

SEQ ID NO: 1669551 - RNA, 18 nt, Salmonella enterica enterica serovar Typhi
cgccagccuaucgccaua

SEQ ID NO: 1669552 - RNA, 17 nt, Salmonella enterica enterica serovar Typhi
cgccagccugaacaucu

SEQ ID NO: 1669553 - RNA, 13 nt, Salmonella enterica enterica serovar Typhi
cgccaauaaagcu

SEQ ID NO: 1669554 - RNA, 20 nt, Salmonella enterica enterica serovar Typhi
cgccaauccaugccggcuuu

SEQ ID NO: 1669555 - RNA, 20 nt, Salmonella enterica enterica serovar Typhi
cgccaaucaacgccgccagg

SEQ ID NO: 1669556 - RNA, 17 nt, Salmonella enterica enterica serovar Typhi
cgccaaucaccgccagc

SEQ ID NO: 1669557 - RNA, 16 nt, Salmonella enterica enterica serovar Typhi
cgccaccaccagcgua

SEQ ID NO: 1669558 - RNA, 22 nt, Salmonella enterica enterica serovar Typhi
cgccaaagucauugcugccagu

SEQ ID NO: 1669559 - RNA, 22 nt, Salmonella enterica enterica serovar Typhi
cgccaaagcgauccggcaucca

SEQ ID NO: 1669560 - RNA, 17 nt, Salmonella enterica enterica serovar Typhi
cgcauuccagacccgau

SEQ ID NO: 1669561 - RNA, 16 nt, Salmonella enterica enterica serovar Typhi
cgccaaaaucaggcau

SEQ ID NO: 1669562 - RNA, 14 nt, Salmonella enterica enterica serovar Typhi
cgccaaaccggcga

SEQ ID NO: 1669563 - RNA, 16 nt, Salmonella enterica enterica serovar Typhi
cgcauuuuaccucacg

SEQ ID NO: 1669564 - RNA, 15 nt, Salmonella enterica enterica serovar Typhi
cgcauuuuuaucagg

SEQ ID NO: 1669565 - RNA, 14 nt, Salmonella enterica enterica serovar Typhi
cgcauugccggcga

SEQ ID NO: 1669566 - RNA, 22 nt, Salmonella enterica enterica serovar Typhi
cgcauugagacaugccgccaga

SEQ ID NO: 1669567 - RNA, 18 nt, Salmonella enterica enterica serovar Typhi
cgcauugguaaagccggu

SEQ ID NO: 1669568 - RNA, 17 nt, Salmonella enterica enterica serovar Typhi
cgccaccgggcaacccg

SEQ ID NO: 1669569 - RNA, 20 nt, Salmonella enterica enterica serovar Typhi
cgccaccaggcucaaauugg

SEQ ID NO: 1669570 - RNA, 13 nt, Salmonella enterica enterica serovar Typhi
cgccaccagcgau

SEQ ID NO: 1669571 - RNA, 17 nt, Salmonella enterica enterica serovar Typhi
cgccaccagcacagccc

SEQ ID NO: 1669572 - RNA, 23 nt, Salmonella enterica enterica serovar Typhi
cgccacggauggccucugccagu

SEQ ID NO: 1669573 - RNA, 21 nt, Salmonella enterica enterica serovar Typhi
cgccacgacgcugguuccccg

SEQ ID NO: 1669574 - RNA, 22 nt, Salmonella enterica enterica serovar Typhi
cgccacgcagauaucuuccagc

SEQ ID NO: 1669575 - RNA, 15 nt, Salmonella enterica enterica serovar Typhi
cgccacgcagcgacg

SEQ ID NO: 1669576 - RNA, 13 nt, Salmonella enterica enterica serovar Typhi
cgccacgccaccg

SEQ ID NO: 1669577 - RNA, 23 nt, Salmonella enterica enterica serovar Typhi
cgccaccugcccuuucagagcgu

SEQ ID NO: 1669578 - RNA, 19 nt, Salmonella enterica enterica serovar Typhi
cgcacuggcgagcggcacc

SEQ ID NO: 1669579 - RNA, 19 nt, Salmonella enterica enterica serovar Typhi
cgcacgccaucacguccug

SEQ ID NO: 1669580 - RNA, 21 nt, Salmonella enterica enterica serovar Typhi
cgcacgcgacgcgccagccag

SEQ ID NO: 1669581 - RNA, 18 nt, Salmonella enterica enterica serovar Typhi
cgcaccacgcaaaccgcu

SEQ ID NO: 1669582 - RNA, 13 nt, Salmonella enterica enterica serovar Typhi
cgcaccagucggc

SEQ ID NO: 1669583 - RNA, 23 nt, Salmonella enterica enterica serovar Typhi
cgcaacgccggugccugccgccu

SEQ ID NO: 1669584 - RNA, 18 nt, Salmonella enterica enterica serovar Typhi
cgcacccguuucagacgc

SEQ ID NO: 1669585 - RNA, 15 nt, Salmonella enterica enterica serovar Typhi
cgcacuuuuccagcc

SEQ ID NO: 1669586 - RNA, 18 nt, Salmonella enterica enterica serovar Typhi
cgcagaaggucacgccgg

SEQ ID NO: 1669587 - RNA, 13 nt, Salmonella enterica enterica serovar Typhi
cgcagaaucagcg

SEQ ID NO: 1669588 - RNA, 15 nt, Salmonella enterica enterica serovar Typhi
cgcagaccaaaguca

SEQ ID NO: 1669589 - RNA, 14 nt, Salmonella enterica enterica serovar Typhi
cgcagcaucgccau

SEQ ID NO: 1669590 - RNA, 20 nt, Salmonella enterica enterica serovar Typhi
cgcagccgccauccggcaca

SEQ ID NO: 1669591 - RNA, 17 nt, Salmonella enterica enterica serovar Typhi
cgcagcgccugcgccgc

SEQ ID NO: 1669592 - RNA, 22 nt, Salmonella enterica enterica serovar Typhi
cgcagcgcuuuugccgcgccca

SEQ ID NO: 1669593 - RNA, 19 nt, Salmonella enterica enterica serovar Typhi
cgcagcggcauuggcguua

SEQ ID NO: 1669594 - RNA, 22 nt, Salmonella enterica enterica serovar Typhi
cgcaggggcauuuuccggcgac

SEQ ID NO: 1669595 - RNA, 14 nt, Salmonella enterica enterica serovar Typhi
cgcaggaagcauau

SEQ ID NO: 1669596 - RNA, 16 nt, Salmonella enterica enterica serovar Typhi
cgcagcgucaucaggc

SEQ ID NO: 1669597 - RNA, 17 nt, Salmonella enterica enterica serovar Typhi
cgauggcgcugcgcgca

SEQ ID NO: 1669598 - RNA, 23 nt, Salmonella enterica enterica serovar Typhi
cgaugcgcuuuuccaggcgacca

SEQ ID NO: 1669599 - RNA, 22 nt, Salmonella enterica enterica serovar Typhi
cgaugcccugugcaaucagcga

SEQ ID NO: 1669600 - RNA, 16 nt, Salmonella enterica enterica serovar Typhi
cgauauuuugcugcac

SEQ ID NO: 1669601 - RNA, 17 nt, Salmonella enterica enterica serovar Typhi
cgauauguggacgccau

SEQ ID NO: 1669602 - RNA, 19 nt, Salmonella enterica enterica serovar Typhi
cgaucugguuauccaccag

SEQ ID NO: 1669603 - RNA, 18 nt, Salmonella enterica enterica serovar Typhi
cgaucuguuggugcgcgu

SEQ ID NO: 1669604 - RNA, 16 nt, Salmonella enterica enterica serovar Typhi
cgaugaacgacgcuga

SEQ ID NO: 1669605 - RNA, 23 nt, Salmonella enterica enterica serovar Typhi
cgaugcaaccccugacgggcgau

SEQ ID NO: 1669606 - RNA, 12 nt, Salmonella enterica enterica serovar Typhi
cgaugcagcacc

SEQ ID NO: 1669607 - RNA, 23 nt, Salmonella enterica enterica serovar Typhi
cgaugagcuugcacuaucgggca

SEQ ID NO: 1669608 - RNA, 14 nt, Salmonella enterica enterica serovar Typhi
cgauguucgauaau

SEQ ID NO: 1669609 - RNA, 21 nt, Salmonella enterica enterica serovar Typhi
cgauguucuugccgccaucuc

SEQ ID NO: 1669610 - RNA, 23 nt, Salmonella enterica enterica serovar Typhi
cgaugugcguauugagcgcagug

SEQ ID NO: 1669611 - RNA, 17 nt, Salmonella enterica enterica serovar Typhi
cgauggugccgacaacc

SEQ ID NO: 1669612 - RNA, 14 nt, Salmonella enterica enterica serovar Typhi
cgauggugcggcgc

SEQ ID NO: 1669613 - RNA, 15 nt, Salmonella enterica enterica serovar Typhi
cgauggugcggcgca

SEQ ID NO: 1669614 - RNA, 17 nt, Salmonella enterica enterica serovar Typhi
cgauguaaaaccuggca

SEQ ID NO: 1669615 - RNA, 17 nt, Salmonella enterica enterica serovar Typhi
cgauuuugguagcgcug

SEQ ID NO: 1669616 - RNA, 13 nt, Salmonella enterica enterica serovar Typhi
cgcaaacgccgaa

SEQ ID NO: 1669617 - RNA, 16 nt, Salmonella enterica enterica serovar Typhi
cgcaaacgccgugaac

SEQ ID NO: 1669618 - RNA, 14 nt, Salmonella enterica enterica serovar Typhi
cgcaaacugccagg

SEQ ID NO: 1669619 - RNA, 19 nt, Salmonella enterica enterica serovar Typhi
cgcaaagacaggugaccag

SEQ ID NO: 1669620 - RNA, 21 nt, Salmonella enterica enterica serovar Typhi
cgcaaagcccaucagcgccag

SEQ ID NO: 1669621 - RNA, 20 nt, Salmonella enterica enterica serovar Typhi
cgcaaagcccaucagcgcca

SEQ ID NO: 1669622 - RNA, 18 nt, Salmonella enterica enterica serovar Typhi
cgcaaagcccaucagcgc

SEQ ID NO: 1669623 - RNA, 14 nt, Salmonella enterica enterica serovar Typhi
cgcaaccacggcgc

SEQ ID NO: 1669624 - RNA, 18 nt, Salmonella enterica enterica serovar Typhi
cgcaacaggccgcaucgg

SEQ ID NO: 1669625 - RNA, 17 nt, Salmonella enterica enterica serovar Typhi
cgauucauaugcgccaa

SEQ ID NO: 1669626 - RNA, 16 nt, Salmonella enterica enterica serovar Typhi
cgauucccgaucuuca

SEQ ID NO: 1669627 - RNA, 18 nt, Salmonella enterica enterica serovar Typhi
cgauguuugccacgccaa

SEQ ID NO: 1669628 - RNA, 19 nt, Salmonella enterica enterica serovar Typhi
ccaaugaacccucgaaugu

SEQ ID NO: 1669629 - RNA, 16 nt, Salmonella enterica enterica serovar Typhi
ccaaugaugcgcugua

SEQ ID NO: 1669630 - RNA, 12 nt, Salmonella enterica enterica serovar Typhi
aaagcgaauacu

SEQ ID NO: 1669631 - RNA, 22 nt, Salmonella enterica enterica serovar Typhi
aaagccucugauuucgacgaua

SEQ ID NO: 1669632 - RNA, 23 nt, Salmonella enterica enterica serovar Typhi
aaagccgugaauaaaaccggcau

SEQ ID NO: 1669633 - RNA, 23 nt, Salmonella enterica enterica serovar Typhi
ccacaacgccugaugcugcgcau

SEQ ID NO: 1669634 - RNA, 17 nt, Salmonella enterica enterica serovar Typhi
ccacaaaaccguugucg

SEQ ID NO: 1669635 - RNA, 15 nt, Salmonella enterica enterica serovar Typhi
ccacaaaggcgcgua

SEQ ID NO: 1669636 - RNA, 16 nt, Salmonella enterica enterica serovar Typhi
ccacaaauucugaaga

SEQ ID NO: 1669637 - RNA, 14 nt, Salmonella enterica enterica serovar Typhi
ccacaaucccgcca

SEQ ID NO: 1669638 - RNA, 18 nt, Salmonella enterica enterica serovar Typhi
ccacaaucacagcgcaga

SEQ ID NO: 1669639 - RNA, 14 nt, Salmonella enterica enterica serovar Typhi
ccaagcagcgccac

SEQ ID NO: 1669640 - RNA, 20 nt, Salmonella enterica enterica serovar Typhi
ccaauauugacguuaaaaug

SEQ ID NO: 1669641 - RNA, 23 nt, Salmonella enterica enterica serovar Typhi
aaagccggaugugagcgcauccg

SEQ ID NO: 1669642 - RNA, 19 nt, Salmonella enterica enterica serovar Typhi
aaagccggaugugagcgca

SEQ ID NO: 1669643 - RNA, 16 nt, Salmonella enterica enterica serovar Typhi
ccaauccagaauacca

SEQ ID NO: 1669644 - RNA, 17 nt, Salmonella enterica enterica serovar Typhi
ccaacagguuaaucagc

SEQ ID NO: 1669645 - RNA, 21 nt, Salmonella enterica enterica serovar Typhi
ccaacauguaauuacggcaca

SEQ ID NO: 1669646 - RNA, 15 nt, Salmonella enterica enterica serovar Typhi
ccaaaguuaaucagc

SEQ ID NO: 1669647 - RNA, 13 nt, Salmonella enterica enterica serovar Typhi
ccaaagucauugc

SEQ ID NO: 1669648 - RNA, 14 nt, Salmonella enterica enterica serovar Typhi
ccaaagauaagacc

SEQ ID NO: 1669649 - RNA, 15 nt, Salmonella enterica enterica serovar Typhi
ccaacggcgacgccc

SEQ ID NO: 1669650 - RNA, 18 nt, Salmonella enterica enterica serovar Typhi
ccaagauuuuucagacgc

SEQ ID NO: 1669651 - RNA, 12 nt, Salmonella enterica enterica serovar Typhi
ccaccgccaguu

SEQ ID NO: 1669652 - RNA, 20 nt, Salmonella enterica enterica serovar Typhi
aaagcuugaaagcagucccg

SEQ ID NO: 1669653 - RNA, 15 nt, Salmonella enterica enterica serovar Typhi
ccaccgccucgccaa

SEQ ID NO: 1669654 - RNA, 12 nt, Salmonella enterica enterica serovar Typhi
ccaccgcugaug

SEQ ID NO: 1669655 - RNA, 19 nt, Salmonella enterica enterica serovar Typhi
ccaccauaggccagcguca

SEQ ID NO: 1669656 - RNA, 14 nt, Salmonella enterica enterica serovar Typhi
ccaccauccggcaa

SEQ ID NO: 1669657 - RNA, 13 nt, Salmonella enterica enterica serovar Typhi
ccaccauccgcgc

SEQ ID NO: 1669658 - RNA, 22 nt, Salmonella enterica enterica serovar Typhi
ccacccgggccggaagagcgca

SEQ ID NO: 1669659 - RNA, 15 nt, Salmonella enterica enterica serovar Typhi
ccacccgggaagccc

SEQ ID NO: 1669660 - RNA, 13 nt, Salmonella enterica enterica serovar Typhi
ccaccagcgccau

SEQ ID NO: 1669661 - RNA, 13 nt, Salmonella enterica enterica serovar Typhi
ccaccagcgccag

SEQ ID NO: 1669662 - RNA, 14 nt, Salmonella enterica enterica serovar Typhi
ccaccaacgaccau

SEQ ID NO: 1669663 - RNA, 19 nt, Salmonella enterica enterica serovar Typhi
ccacagaucuaucugaaca

SEQ ID NO: 1669664 - RNA, 12 nt, Salmonella enterica enterica serovar Typhi
ccaccaaagcca

SEQ ID NO: 1669665 - RNA, 21 nt, Salmonella enterica enterica serovar Typhi
ccagacgccgaucgcgguuca

SEQ ID NO: 1669666 - RNA, 19 nt, Salmonella enterica enterica serovar Typhi
ccagacggcgcccagccug

SEQ ID NO: 1669667 - RNA, 12 nt, Salmonella enterica enterica serovar Typhi
ccagaucauuac

SEQ ID NO: 1669668 - RNA, 22 nt, Salmonella enterica enterica serovar Typhi
ccagauuuuccaggccgccagc

SEQ ID NO: 1669669 - RNA, 20 nt, Salmonella enterica enterica serovar Typhi
ccagcaaaccuuccgccagg

SEQ ID NO: 1669670 - RNA, 14 nt, Salmonella enterica enterica serovar Typhi
ccagcaaacuggcg

SEQ ID NO: 1669671 - RNA, 16 nt, Salmonella enterica enterica serovar Typhi
ccagaugcgggcgauc

SEQ ID NO: 1669672 - RNA, 18 nt, Salmonella enterica enterica serovar Typhi
ccagaugcugggcguguc

SEQ ID NO: 1669673 - RNA, 15 nt, Salmonella enterica enterica serovar Typhi
ccagaugaagcgcau

SEQ ID NO: 1669674 - RNA, 20 nt, Salmonella enterica enterica serovar Typhi
ccagcaacacuuugcgcugc

SEQ ID NO: 1669675 - RNA, 19 nt, Salmonella enterica enterica serovar Typhi
ccacuuauuuguauugacg

SEQ ID NO: 1669676 - RNA, 12 nt, Salmonella enterica enterica serovar Typhi
ccacuucagcag

SEQ ID NO: 1669677 - RNA, 22 nt, Salmonella enterica enterica serovar Typhi
ccagaaaucgcucaugcgcguc

SEQ ID NO: 1669678 - RNA, 21 nt, Salmonella enterica enterica serovar Typhi
ccagaaccucaccguccgcca

SEQ ID NO: 1669679 - RNA, 21 nt, Salmonella enterica enterica serovar Typhi
aaagguauuaagugaauagca

SEQ ID NO: 1669680 - RNA, 22 nt, Salmonella enterica enterica serovar Typhi
aaaggcuugcaggaugucgaua

SEQ ID NO: 1669681 - RNA, 23 nt, Salmonella enterica enterica serovar Typhi
aaaggcguagaucucuaucggca

SEQ ID NO: 1669682 - RNA, 14 nt, Salmonella enterica enterica serovar Typhi
ccacgacauccgga

SEQ ID NO: 1669683 - RNA, 15 nt, Salmonella enterica enterica serovar Typhi
aaaguccugcgucgc

SEQ ID NO: 1669684 - RNA, 19 nt, Salmonella enterica enterica serovar Typhi
aaagugaaggccagacuua

SEQ ID NO: 1669685 - RNA, 17 nt, Salmonella enterica enterica serovar Typhi
aaaguacgcaaacaguu

SEQ ID NO: 1669686 - RNA, 22 nt, Salmonella enterica enterica serovar Typhi
ccacgcagcgcagaccgagcgc

SEQ ID NO: 1669687 - RNA, 15 nt, Salmonella enterica enterica serovar Typhi
ccacgccaucgcggc

SEQ ID NO: 1669688 - RNA, 16 nt, Salmonella enterica enterica serovar Typhi
ccacgcggcaucaggc

SEQ ID NO: 1669689 - RNA, 16 nt, Salmonella enterica enterica serovar Typhi
aaaguucagccgauaa

SEQ ID NO: 1669690 - RNA, 13 nt, Salmonella enterica enterica serovar Typhi
ccacgcugacgcg

SEQ ID NO: 1669691 - RNA, 21 nt, Salmonella enterica enterica serovar Typhi
aaaucaugaaggagagcauuu

SEQ ID NO: 1669692 - RNA, 22 nt, Salmonella enterica enterica serovar Typhi
ccagcgggccgacgauaaacag

SEQ ID NO: 1669693 - RNA, 13 nt, Salmonella enterica enterica serovar Typhi
ccagcgucaucag

SEQ ID NO: 1669694 - RNA, 16 nt, Salmonella enterica enterica serovar Typhi
ccagcgguugcgcuuc

SEQ ID NO: 1669695 - RNA, 17 nt, Salmonella enterica enterica serovar Typhi
ccagcgcccacaccaua

SEQ ID NO: 1669696 - RNA, 13 nt, Salmonella enterica enterica serovar Typhi
ccagcggccauga

SEQ ID NO: 1669697 - RNA, 14 nt, Salmonella enterica enterica serovar Typhi
ccagcggcgacaca

SEQ ID NO: 1669698 - RNA, 16 nt, Salmonella enterica enterica serovar Typhi
ccagccauuaaagaag

SEQ ID NO: 1669699 - RNA, 14 nt, Salmonella enterica enterica serovar Typhi
ccagccaugccaua

SEQ ID NO: 1669700 - RNA, 15 nt, Salmonella enterica enterica serovar Typhi
ccagccauccccaua

SEQ ID NO: 1669701 - RNA, 22 nt, Salmonella enterica enterica serovar Typhi
ccagccaguuagcgaucgcgcc

SEQ ID NO: 1669702 - RNA, 15 nt, Salmonella enterica enterica serovar Typhi
ccagccacugcgcca

SEQ ID NO: 1669703 - RNA, 18 nt, Salmonella enterica enterica serovar Typhi
ccagcauuucaaucgcgc

SEQ ID NO: 1669704 - RNA, 19 nt, Salmonella enterica enterica serovar Typhi
ccagcauuucaaucgcgcc

SEQ ID NO: 1669705 - RNA, 18 nt, Salmonella enterica enterica serovar Typhi
ccagcauugggccgauaa

SEQ ID NO: 1669706 - RNA, 18 nt, Salmonella enterica enterica serovar Typhi
ccagcauuuccagcuggu

SEQ ID NO: 1669707 - RNA, 14 nt, Salmonella enterica enterica serovar Typhi
ccagcaucccgcug

SEQ ID NO: 1669708 - RNA, 17 nt, Salmonella enterica enterica serovar Typhi
ccagcaucaauagcagc

SEQ ID NO: 1669709 - RNA, 19 nt, Salmonella enterica enterica serovar Typhi
ccagcauauuuuccggcgu

SEQ ID NO: 1669710 - RNA, 18 nt, Salmonella enterica enterica serovar Typhi
ccagccccgaugucgcca

SEQ ID NO: 1669711 - RNA, 17 nt, Salmonella enterica enterica serovar Typhi
ccagcccccagccgauc

SEQ ID NO: 1669712 - RNA, 18 nt, Salmonella enterica enterica serovar Typhi
ccagcgaacugauaaaag

SEQ ID NO: 1669713 - RNA, 16 nt, Salmonella enterica enterica serovar Typhi
ccagcgacaucgcaua

SEQ ID NO: 1669714 - RNA, 23 nt, Salmonella enterica enterica serovar Typhi
ccagcgacauggcggucgccaua

SEQ ID NO: 1669715 - RNA, 16 nt, Salmonella enterica enterica serovar Typhi
ccagccgggcuucagg

SEQ ID NO: 1669716 - RNA, 19 nt, Salmonella enterica enterica serovar Typhi
ccagccgggcaggaaaagc

SEQ ID NO: 1669717 - RNA, 17 nt, Salmonella enterica enterica serovar Typhi
ccaggaauuuucccaua

SEQ ID NO: 1669718 - RNA, 17 nt, Salmonella enterica enterica serovar Typhi
ccaggacaacgccggua

SEQ ID NO: 1669719 - RNA, 20 nt, Salmonella enterica enterica serovar Typhi
ccaggauaaccuuccggcac

SEQ ID NO: 1669720 - RNA, 16 nt, Salmonella enterica enterica serovar Typhi
ccagcugcgcgcuauu

SEQ ID NO: 1669721 - RNA, 15 nt, Salmonella enterica enterica serovar Typhi
ccagcugacgcagca

SEQ ID NO: 1669722 - RNA, 15 nt, Salmonella enterica enterica serovar Typhi
ccagcucccgcguca

SEQ ID NO: 1669723 - RNA, 22 nt, Salmonella enterica enterica serovar Typhi
ccagcucauuuuuacagacacg

SEQ ID NO: 1669724 - RNA, 21 nt, Salmonella enterica enterica serovar Typhi
ccagcucaugauagggcagca

SEQ ID NO: 1669725 - RNA, 16 nt, Salmonella enterica enterica serovar Typhi
ccaggccguggcgcau

SEQ ID NO: 1669726 - RNA, 14 nt, Salmonella enterica enterica serovar Typhi
ccaggcauugauaa

SEQ ID NO: 1669727 - RNA, 13 nt, Salmonella enterica enterica serovar Typhi
ccaggcagaacgc

SEQ ID NO: 1669728 - RNA, 21 nt, Salmonella enterica enterica serovar Typhi
ccaggcagcgcgccagcgcua

SEQ ID NO: 1669729 - RNA, 15 nt, Salmonella enterica enterica serovar Typhi
ccagguuagcagcca

SEQ ID NO: 1669730 - RNA, 15 nt, Salmonella enterica enterica serovar Typhi
ccaguaccauaccgg

SEQ ID NO: 1669731 - RNA, 16 nt, Salmonella enterica enterica serovar Typhi
ccaguaccgacgccau

SEQ ID NO: 1669732 - RNA, 20 nt, Salmonella enterica enterica serovar Typhi
ccagguaaguucaaacaggu

SEQ ID NO: 1669733 - RNA, 14 nt, Salmonella enterica enterica serovar Typhi
ccagggcaucaaua

SEQ ID NO: 1669734 - RNA, 18 nt, Salmonella enterica enterica serovar Typhi
cccggaugauuaucaucu

SEQ ID NO: 1669735 - RNA, 19 nt, Salmonella enterica enterica serovar Typhi
cccgccgcugaggauggcg

SEQ ID NO: 1669736 - RNA, 14 nt, Salmonella enterica enterica serovar Typhi
cccgauaagcaagc

SEQ ID NO: 1669737 - RNA, 15 nt, Salmonella enterica enterica serovar Typhi
cccgaugagcuugca

SEQ ID NO: 1669738 - RNA, 16 nt, Salmonella enterica enterica serovar Typhi
cccgcacgcgacgcgc

SEQ ID NO: 1669739 - RNA, 15 nt, Salmonella enterica enterica serovar Typhi
cccgacaccagccgu

SEQ ID NO: 1669740 - RNA, 19 nt, Salmonella enterica enterica serovar Typhi
ccccuuuucacccaacauu

SEQ ID NO: 1669741 - RNA, 18 nt, Salmonella enterica enterica serovar Typhi
ccccuggccgacggcaua

SEQ ID NO: 1669742 - RNA, 23 nt, Salmonella enterica enterica serovar Typhi
ccccugcgguuucuaccacccag

SEQ ID NO: 1669743 - RNA, 20 nt, Salmonella enterica enterica serovar Typhi
ccccugaugcguauccagcg

SEQ ID NO: 1669744 - RNA, 21 nt, Salmonella enterica enterica serovar Typhi
ccccagcgcuccaccaaccag

SEQ ID NO: 1669745 - RNA, 14 nt, Salmonella enterica enterica serovar Typhi
ccccaucccggcaa

SEQ ID NO: 1669746 - RNA, 19 nt, Salmonella enterica enterica serovar Typhi
cccauuuucggcaucagca

SEQ ID NO: 1669747 - RNA, 18 nt, Salmonella enterica enterica serovar Typhi
ccccggaucaccggcauu

SEQ ID NO: 1669748 - RNA, 13 nt, Salmonella enterica enterica serovar Typhi
ccaguccggcaga

SEQ ID NO: 1669749 - RNA, 14 nt, Salmonella enterica enterica serovar Typhi
ccaugcucauccaa

SEQ ID NO: 1669750 - RNA, 12 nt, Salmonella enterica enterica serovar Typhi
ccauuagcgccu

SEQ ID NO: 1669751 - RNA, 15 nt, Salmonella enterica enterica serovar Typhi
ccauuccgccaacgg

SEQ ID NO: 1669752 - RNA, 22 nt, Salmonella enterica enterica serovar Typhi
ccauuaacgccgcauagcggca

SEQ ID NO: 1669753 - RNA, 14 nt, Salmonella enterica enterica serovar Typhi
ccauuaagacaggu

SEQ ID NO: 1669754 - RNA, 18 nt, Salmonella enterica enterica serovar Typhi
aaaucgacagcgacggcg

SEQ ID NO: 1669755 - RNA, 16 nt, Salmonella enterica enterica serovar Typhi
aaaucgcaaacgccag

SEQ ID NO: 1669756 - RNA, 16 nt, Salmonella enterica enterica serovar Typhi
aaaucgcuaagcagaa

SEQ ID NO: 1669757 - RNA, 23 nt, Salmonella enterica enterica serovar Typhi
aaaucgccaaagaaacgcugauc

SEQ ID NO: 1669758 - RNA, 22 nt, Salmonella enterica enterica serovar Typhi
ccauuggcaccaccaggaacgc

SEQ ID NO: 1669759 - RNA, 14 nt, Salmonella enterica enterica serovar Typhi
ccauuggccagaua

SEQ ID NO: 1669760 - RNA, 23 nt, Salmonella enterica enterica serovar Typhi
cccagaaugccgcccauccagag

SEQ ID NO: 1669761 - RNA, 23 nt, Salmonella enterica enterica serovar Typhi
cccagaacggcagcguccgccau

SEQ ID NO: 1669762 - RNA, 15 nt, Salmonella enterica enterica serovar Typhi
cccaccgggccaccg

SEQ ID NO: 1669763 - RNA, 23 nt, Salmonella enterica enterica serovar Typhi
ccauuuuggggaaaauaccggua

SEQ ID NO: 1669764 - RNA, 19 nt, Salmonella enterica enterica serovar Typhi
ccauuugaaucguagcgug

SEQ ID NO: 1669765 - RNA, 15 nt, Salmonella enterica enterica serovar Typhi
cccaccaccgccacu

SEQ ID NO: 1669766 - RNA, 13 nt, Salmonella enterica enterica serovar Typhi
cccaaccgccagc

SEQ ID NO: 1669767 - RNA, 17 nt, Salmonella enterica enterica serovar Typhi
cccauuaugugcgacgu

SEQ ID NO: 1669768 - RNA, 14 nt, Salmonella enterica enterica serovar Typhi
cccauguugcgccg

SEQ ID NO: 1669769 - RNA, 15 nt, Salmonella enterica enterica serovar Typhi
cccauuaauaucagc

SEQ ID NO: 1669770 - RNA, 16 nt, Salmonella enterica enterica serovar Typhi
cccauuucaugaccga

SEQ ID NO: 1669771 - RNA, 15 nt, Salmonella enterica enterica serovar Typhi
cccaugcaaccagug

SEQ ID NO: 1669772 - RNA, 15 nt, Salmonella enterica enterica serovar Typhi
cccaucuccagcccg

SEQ ID NO: 1669773 - RNA, 11 nt, Salmonella enterica enterica serovar Typhi
cccauccgcgc

SEQ ID NO: 1669774 - RNA, 16 nt, Salmonella enterica enterica serovar Typhi
cccaucgccacagcgg

SEQ ID NO: 1669775 - RNA, 15 nt, Salmonella enterica enterica serovar Typhi
cccaucaccgccagu

SEQ ID NO: 1669776 - RNA, 20 nt, Salmonella enterica enterica serovar Typhi
cccauauuuuuucugccagu

SEQ ID NO: 1669777 - RNA, 12 nt, Salmonella enterica enterica serovar Typhi
cccagucauccg

SEQ ID NO: 1669778 - RNA, 20 nt, Salmonella enterica enterica serovar Typhi
cccagcgggaacaucacgga

SEQ ID NO: 1669779 - RNA, 22 nt, Salmonella enterica enterica serovar Typhi
cccagcgcuaacggcgguacca

SEQ ID NO: 1669780 - RNA, 22 nt, Salmonella enterica enterica serovar Typhi
cccagguuuuggucagcucacg

SEQ ID NO: 1669781 - RNA, 16 nt, Salmonella enterica enterica serovar Typhi
ccgacuaccggcacca

SEQ ID NO: 1669782 - RNA, 17 nt, Salmonella enterica enterica serovar Typhi
ccgagaucaggccgauu

SEQ ID NO: 1669783 - RNA, 16 nt, Salmonella enterica enterica serovar Typhi
ccgagacgcgugacca

SEQ ID NO: 1669784 - RNA, 18 nt, Salmonella enterica enterica serovar Typhi
ccgagaguccagcgccag

SEQ ID NO: 1669785 - RNA, 18 nt, Salmonella enterica enterica serovar Typhi
ccgagaauuucagcacgc

SEQ ID NO: 1669786 - RNA, 14 nt, Salmonella enterica enterica serovar Typhi
ccgacgccagccau

SEQ ID NO: 1669787 - RNA, 19 nt, Salmonella enterica enterica serovar Typhi
ccgacggggcguuaaucac

SEQ ID NO: 1669788 - RNA, 19 nt, Salmonella enterica enterica serovar Typhi
ccgacggcaaaaagcauau

SEQ ID NO: 1669789 - RNA, 23 nt, Salmonella enterica enterica serovar Typhi
ccgacgcgaauugcgaguaaccu

SEQ ID NO: 1669790 - RNA, 16 nt, Salmonella enterica enterica serovar Typhi
ccgaccccaugacggc

SEQ ID NO: 1669791 - RNA, 16 nt, Salmonella enterica enterica serovar Typhi
ccgaccaccauccggc

SEQ ID NO: 1669792 - RNA, 13 nt, Salmonella enterica enterica serovar Typhi
ccgaccgccagca

SEQ ID NO: 1669793 - RNA, 23 nt, Salmonella enterica enterica serovar Typhi
ccgacaagaaucacguaaucggc

SEQ ID NO: 1669794 - RNA, 20 nt, Salmonella enterica enterica serovar Typhi
ccgacaagguauaucaaccc

SEQ ID NO: 1669795 - RNA, 23 nt, Salmonella enterica enterica serovar Typhi
ccgacaauggcgacgaucagcgc

SEQ ID NO: 1669796 - RNA, 21 nt, Salmonella enterica enterica serovar Typhi
ccgacacugaaacuccgcagc

SEQ ID NO: 1669797 - RNA, 18 nt, Salmonella enterica enterica serovar Typhi
ccgacaucgccaccgcau

SEQ ID NO: 1669798 - RNA, 18 nt, Salmonella enterica enterica serovar Typhi
ccgacaucgccaguugca

SEQ ID NO: 1669799 - RNA, 18 nt, Salmonella enterica enterica serovar Typhi
ccgacauucccugcgcau

SEQ ID NO: 1669800 - RNA, 20 nt, Salmonella enterica enterica serovar Typhi
ccgacauucccugcgcauac

SEQ ID NO: 1669801 - RNA, 16 nt, Salmonella enterica enterica serovar Typhi
cccguuuucgccggau

SEQ ID NO: 1669802 - RNA, 21 nt, Salmonella enterica enterica serovar Typhi
cccguuccaggcgaucucguu

SEQ ID NO: 1669803 - RNA, 19 nt, Salmonella enterica enterica serovar Typhi
cccgugucggauaucagac

SEQ ID NO: 1669804 - RNA, 16 nt, Salmonella enterica enterica serovar Typhi
cccgucagucgccaga

SEQ ID NO: 1669805 - RNA, 13 nt, Salmonella enterica enterica serovar Typhi
cccgucacagcgg

SEQ ID NO: 1669806 - RNA, 20 nt, Salmonella enterica enterica serovar Typhi
cccggcuuuuugccgggcgu

SEQ ID NO: 1669807 - RNA, 19 nt, Salmonella enterica enterica serovar Typhi
cccggcgucauacugccaa

SEQ ID NO: 1669808 - RNA, 23 nt, Salmonella enterica enterica serovar Typhi
cccggucaagcgcaaucacguua

SEQ ID NO: 1669809 - RNA, 23 nt, Salmonella enterica enterica serovar Typhi
cccuuccgccaccagguucagca

SEQ ID NO: 1669810 - RNA, 22 nt, Salmonella enterica enterica serovar Typhi
cccuugcugacaucgcgauugu

SEQ ID NO: 1669811 - RNA, 21 nt, Salmonella enterica enterica serovar Typhi
cccuuuuuugguuauccagca

SEQ ID NO: 1669812 - RNA, 20 nt, Salmonella enterica enterica serovar Typhi
cccuuuuuuggucagaaagc

SEQ ID NO: 1669813 - RNA, 17 nt, Salmonella enterica enterica serovar Typhi
cccugcuggcgcaugau

SEQ ID NO: 1669814 - RNA, 24 nt, Salmonella enterica enterica serovar Typhi
cccugccggaaaaugcgccaggaa

SEQ ID NO: 1669815 - RNA, 16 nt, Salmonella enterica enterica serovar Typhi
cccugcgccagacgcg

SEQ ID NO: 1669816 - RNA, 19 nt, Salmonella enterica enterica serovar Typhi
cccugcgccagcauggcgu

SEQ ID NO: 1669817 - RNA, 15 nt, Salmonella enterica enterica serovar Typhi
cccugcgcauacguc

SEQ ID NO: 1669818 - RNA, 15 nt, Salmonella enterica enterica serovar Typhi
ccgaaggaagauagc

SEQ ID NO: 1669819 - RNA, 15 nt, Salmonella enterica enterica serovar Typhi
ccgaauaacgccagg

SEQ ID NO: 1669820 - RNA, 17 nt, Salmonella enterica enterica serovar Typhi
caggguucacugccagu

SEQ ID NO: 1669821 - RNA, 18 nt, Salmonella enterica enterica serovar Typhi
caggguucgcguacgcau

SEQ ID NO: 1669822 - RNA, 16 nt, Salmonella enterica enterica serovar Typhi
caggguccccauaucc

SEQ ID NO: 1669823 - RNA, 17 nt, Salmonella enterica enterica serovar Typhi
caggguaucuaacccgc

SEQ ID NO: 1669824 - RNA, 16 nt, Salmonella enterica enterica serovar Typhi
cagggguuccggcaau

SEQ ID NO: 1669825 - RNA, 14 nt, Salmonella enterica enterica serovar Typhi
cagggcgauaauag

SEQ ID NO: 1669826 - RNA, 23 nt, Salmonella enterica enterica serovar Typhi
cagucauuaauucccgcagccag

SEQ ID NO: 1669827 - RNA, 23 nt, Salmonella enterica enterica serovar Typhi
cagucgauguggccuuccucguc

SEQ ID NO: 1669828 - RNA, 18 nt, Salmonella enterica enterica serovar Typhi
cagucucaaaggccugca

SEQ ID NO: 1669829 - RNA, 21 nt, Salmonella enterica enterica serovar Typhi
cagucucaaaggccugcauca

SEQ ID NO: 1669830 - RNA, 16 nt, Salmonella enterica enterica serovar Typhi
cagucguuuacgcgcu

SEQ ID NO: 1669831 - RNA, 12 nt, Salmonella enterica enterica serovar Typhi
cagugcgcgacc

SEQ ID NO: 1669832 - RNA, 23 nt, Salmonella enterica enterica serovar Typhi
caguacggaaaugaucagacgca

SEQ ID NO: 1669833 - RNA, 23 nt, Salmonella enterica enterica serovar Typhi
cagguuguaucauguuccggcag

SEQ ID NO: 1669834 - RNA, 13 nt, Salmonella enterica enterica serovar Typhi
caguacugcgccc

SEQ ID NO: 1669835 - RNA, 16 nt, Salmonella enterica enterica serovar Typhi
cagguuccccaaugau

SEQ ID NO: 1669836 - RNA, 18 nt, Salmonella enterica enterica serovar Typhi
cagguggaucggaaauca

SEQ ID NO: 1669837 - RNA, 16 nt, Salmonella enterica enterica serovar Typhi
caggcggcauggguaa

SEQ ID NO: 1669838 - RNA, 17 nt, Salmonella enterica enterica serovar Typhi
caggcggaugaaacagu

SEQ ID NO: 1669839 - RNA, 17 nt, Salmonella enterica enterica serovar Typhi
caggcgcagagugagca

SEQ ID NO: 1669840 - RNA, 16 nt, Salmonella enterica enterica serovar Typhi
caggccucuaucuucu

SEQ ID NO: 1669841 - RNA, 17 nt, Salmonella enterica enterica serovar Typhi
caggccugcaaaccucu

SEQ ID NO: 1669842 - RNA, 14 nt, Salmonella enterica enterica serovar Typhi
caggcuuccacgca

SEQ ID NO: 1669843 - RNA, 16 nt, Salmonella enterica enterica serovar Typhi
cagggauauuccauac

SEQ ID NO: 1669844 - RNA, 19 nt, Salmonella enterica enterica serovar Typhi
caggcuugcccauucgccg

SEQ ID NO: 1669845 - RNA, 13 nt, Salmonella enterica enterica serovar Typhi
cagggcagcgagc

SEQ ID NO: 1669846 - RNA, 16 nt, Salmonella enterica enterica serovar Typhi
caggcggggaggguca

SEQ ID NO: 1669847 - RNA, 16 nt, Salmonella enterica enterica serovar Typhi
caggcggguggugagc

SEQ ID NO: 1669848 - RNA, 20 nt, Salmonella enterica enterica serovar Typhi
caggauuuucgcgaucuccg

SEQ ID NO: 1669849 - RNA, 16 nt, Salmonella enterica enterica serovar Typhi
caggcaaaaaucggcc

SEQ ID NO: 1669850 - RNA, 20 nt, Salmonella enterica enterica serovar Typhi
caggcaaaugauuaucucca

SEQ ID NO: 1669851 - RNA, 16 nt, Salmonella enterica enterica serovar Typhi
caggcagauuaaucag

SEQ ID NO: 1669852 - RNA, 17 nt, Salmonella enterica enterica serovar Typhi
caggauucgaaccugcg

SEQ ID NO: 1669853 - RNA, 16 nt, Salmonella enterica enterica serovar Typhi
caggauggccagcacc

SEQ ID NO: 1669854 - RNA, 15 nt, Salmonella enterica enterica serovar Typhi
caggaucagauauuc

SEQ ID NO: 1669855 - RNA, 22 nt, Salmonella enterica enterica serovar Typhi
caggaucagauauuccagcgac

SEQ ID NO: 1669856 - RNA, 18 nt, Salmonella enterica enterica serovar Typhi
caggauaaaauccugcac

SEQ ID NO: 1669857 - RNA, 18 nt, Salmonella enterica enterica serovar Typhi
cagcguguaaucgccgua

SEQ ID NO: 1669858 - RNA, 16 nt, Salmonella enterica enterica serovar Typhi
cagcguguaaucgccg

SEQ ID NO: 1669859 - RNA, 17 nt, Salmonella enterica enterica serovar Typhi
cagcguuaaaauaccgc

SEQ ID NO: 1669860 - RNA, 14 nt, Salmonella enterica enterica serovar Typhi
caggcagcgcgcca

SEQ ID NO: 1669861 - RNA, 20 nt, Salmonella enterica enterica serovar Typhi
aaagauuuguuucaucgccu

SEQ ID NO: 1669862 - RNA, 21 nt, Salmonella enterica enterica serovar Typhi
caucgcggccagcaugguuaa

SEQ ID NO: 1669863 - RNA, 16 nt, Salmonella enterica enterica serovar Typhi
caucgcggccagcaug

SEQ ID NO: 1669864 - RNA, 13 nt, Salmonella enterica enterica serovar Typhi
caucgcucgcgcc

SEQ ID NO: 1669865 - RNA, 18 nt, Salmonella enterica enterica serovar Typhi
caucgcgucgccaucagg

SEQ ID NO: 1669866 - RNA, 22 nt, Salmonella enterica enterica serovar Typhi
caucgcgccuccccugccggcg

SEQ ID NO: 1669867 - RNA, 13 nt, Salmonella enterica enterica serovar Typhi
caucgccagccau

SEQ ID NO: 1669868 - RNA, 19 nt, Salmonella enterica enterica serovar Typhi
caucgagccugaaguaucg

SEQ ID NO: 1669869 - RNA, 21 nt, Salmonella enterica enterica serovar Typhi
caucgacguucagcauaucca

SEQ ID NO: 1669870 - RNA, 21 nt, Salmonella enterica enterica serovar Typhi
caucaguaugagcgaacggcu

SEQ ID NO: 1669871 - RNA, 13 nt, Salmonella enterica enterica serovar Typhi
caucagucucaaa

SEQ ID NO: 1669872 - RNA, 15 nt, Salmonella enterica enterica serovar Typhi
cauccagucagcaau

SEQ ID NO: 1669873 - RNA, 14 nt, Salmonella enterica enterica serovar Typhi
cauccauugcgcca

SEQ ID NO: 1669874 - RNA, 16 nt, Salmonella enterica enterica serovar Typhi
cauccauugcgccacg

SEQ ID NO: 1669875 - RNA, 16 nt, Salmonella enterica enterica serovar Typhi
caucaggcacggcgua

SEQ ID NO: 1669876 - RNA, 13 nt, Salmonella enterica enterica serovar Typhi
caucaggcaucug

SEQ ID NO: 1669877 - RNA, 19 nt, Salmonella enterica enterica serovar Typhi
caucaggcaucugaaaugc

SEQ ID NO: 1669878 - RNA, 15 nt, Salmonella enterica enterica serovar Typhi
cauccgugaccugcu

SEQ ID NO: 1669879 - RNA, 20 nt, Salmonella enterica enterica serovar Typhi
cauccgucaaaaugaucaga

SEQ ID NO: 1669880 - RNA, 16 nt, Salmonella enterica enterica serovar Typhi
cauccggcacggucaa

SEQ ID NO: 1669881 - RNA, 14 nt, Salmonella enterica enterica serovar Typhi
cauccggcaaugau

SEQ ID NO: 1669882 - RNA, 17 nt, Salmonella enterica enterica serovar Typhi
cauagauaacgauguga

SEQ ID NO: 1669883 - RNA, 17 nt, Salmonella enterica enterica serovar Typhi
cauagacuuuggcgcag

SEQ ID NO: 1669884 - RNA, 22 nt, Salmonella enterica enterica serovar Typhi
caucacaaucuccagaccgcug

SEQ ID NO: 1669885 - RNA, 19 nt, Salmonella enterica enterica serovar Typhi
caucaaugcccagcgcaau

SEQ ID NO: 1669886 - RNA, 18 nt, Salmonella enterica enterica serovar Typhi
caucaauuuugcgccuac

SEQ ID NO: 1669887 - RNA, 13 nt, Salmonella enterica enterica serovar Typhi
caucaauagcgcu

SEQ ID NO: 1669888 - RNA, 15 nt, Salmonella enterica enterica serovar Typhi
cauauucacgcagcu

SEQ ID NO: 1669889 - RNA, 22 nt, Salmonella enterica enterica serovar Typhi
cauauucaguuuuacgccauag

SEQ ID NO: 1669890 - RNA, 21 nt, Salmonella enterica enterica serovar Typhi
caucaaaaucaucgccacgau

SEQ ID NO: 1669891 - RNA, 12 nt, Salmonella enterica enterica serovar Typhi
caucaccguuac

SEQ ID NO: 1669892 - RNA, 16 nt, Salmonella enterica enterica serovar Typhi
caucaccguuuuccag

SEQ ID NO: 1669893 - RNA, 19 nt, Salmonella enterica enterica serovar Typhi
caucaccugaugucccauc

SEQ ID NO: 1669894 - RNA, 20 nt, Salmonella enterica enterica serovar Typhi
caucagaaaaaccuccggcu

SEQ ID NO: 1669895 - RNA, 20 nt, Salmonella enterica enterica serovar Typhi
caucagaaaauagugaaugg

SEQ ID NO: 1669896 - RNA, 18 nt, Salmonella enterica enterica serovar Typhi
caucagacuguuacgcug

SEQ ID NO: 1669897 - RNA, 16 nt, Salmonella enterica enterica serovar Typhi
caucacguucaggcag

SEQ ID NO: 1669898 - RNA, 17 nt, Salmonella enterica enterica serovar Typhi
caucagccagcagcuca

SEQ ID NO: 1669899 - RNA, 17 nt, Salmonella enterica enterica serovar Typhi
caucagcccuaucgcug

SEQ ID NO: 1669900 - RNA, 14 nt, Salmonella enterica enterica serovar Typhi
caucagcacaugau

SEQ ID NO: 1669901 - RNA, 12 nt, Salmonella enterica enterica serovar Typhi
cauaccgcagau

SEQ ID NO: 1669902 - RNA, 16 nt, Salmonella enterica enterica serovar Typhi
cauacaccuuugcccg

SEQ ID NO: 1669903 - RNA, 15 nt, Salmonella enterica enterica serovar Typhi
cauacaccggcgcca

SEQ ID NO: 1669904 - RNA, 14 nt, Salmonella enterica enterica serovar Typhi
cauaccgucaccac

SEQ ID NO: 1669905 - RNA, 22 nt, Salmonella enterica enterica serovar Typhi
cauaccggacuccaggcaacgu

SEQ ID NO: 1669906 - RNA, 16 nt, Salmonella enterica enterica serovar Typhi
cauaccugacgcacag

SEQ ID NO: 1669907 - RNA, 18 nt, Salmonella enterica enterica serovar Typhi
cauacucauuaccggcug

SEQ ID NO: 1669908 - RNA, 22 nt, Salmonella enterica enterica serovar Typhi
cauacugaaauuucuuuuccag

SEQ ID NO: 1669909 - RNA, 19 nt, Salmonella enterica enterica serovar Typhi
cauacugaacaagcgaucg

SEQ ID NO: 1669910 - RNA, 16 nt, Salmonella enterica enterica serovar Typhi
cauacgcuuuacgcuu

SEQ ID NO: 1669911 - RNA, 18 nt, Salmonella enterica enterica serovar Typhi
cauacgccgccagccacu

SEQ ID NO: 1669912 - RNA, 17 nt, Salmonella enterica enterica serovar Typhi
cauaacgcuguaccggc

SEQ ID NO: 1669913 - RNA, 16 nt, Salmonella enterica enterica serovar Typhi
cauaaccgugcggcgg

SEQ ID NO: 1669914 - RNA, 15 nt, Salmonella enterica enterica serovar Typhi
cauaaccaaacgcgc

SEQ ID NO: 1669915 - RNA, 14 nt, Salmonella enterica enterica serovar Typhi
cauaaugaauacgc

SEQ ID NO: 1669916 - RNA, 16 nt, Salmonella enterica enterica serovar Typhi
cauaaugaauacgcuc

SEQ ID NO: 1669917 - RNA, 17 nt, Salmonella enterica enterica serovar Typhi
cauaaugcacaauacgc

SEQ ID NO: 1669918 - RNA, 20 nt, Salmonella enterica enterica serovar Typhi
cauaacgcuuuguacagaca

SEQ ID NO: 1669919 - RNA, 15 nt, Salmonella enterica enterica serovar Typhi
caugacccagagcga

SEQ ID NO: 1669920 - RNA, 14 nt, Salmonella enterica enterica serovar Typhi
caugaccagcgccg

SEQ ID NO: 1669921 - RNA, 21 nt, Salmonella enterica enterica serovar Typhi
caugacugguuuuucgccgac

SEQ ID NO: 1669922 - RNA, 16 nt, Salmonella enterica enterica serovar Typhi
caugacgggggcgauc

SEQ ID NO: 1669923 - RNA, 14 nt, Salmonella enterica enterica serovar Typhi
caucuuuugccgcg

SEQ ID NO: 1669924 - RNA, 15 nt, Salmonella enterica enterica serovar Typhi
caucuucgccuggau

SEQ ID NO: 1669925 - RNA, 14 nt, Salmonella enterica enterica serovar Typhi
caucuuccagcauc

SEQ ID NO: 1669926 - RNA, 15 nt, Salmonella enterica enterica serovar Typhi
caucuucccgcagau

SEQ ID NO: 1669927 - RNA, 16 nt, Salmonella enterica enterica serovar Typhi
caucuuccagcaucag

SEQ ID NO: 1669928 - RNA, 16 nt, Salmonella enterica enterica serovar Typhi
caucuucacuucacaa

SEQ ID NO: 1669929 - RNA, 21 nt, Salmonella enterica enterica serovar Typhi
caucuucacuucacaaacaau

SEQ ID NO: 1669930 - RNA, 17 nt, Salmonella enterica enterica serovar Typhi
caucuucaccuuuccag

SEQ ID NO: 1669931 - RNA, 14 nt, Salmonella enterica enterica serovar Typhi
caucuuaucaggcc

SEQ ID NO: 1669932 - RNA, 13 nt, Salmonella enterica enterica serovar Typhi
caucuggcacagg

SEQ ID NO: 1669933 - RNA, 17 nt, Salmonella enterica enterica serovar Typhi
caugcccggugauauug

SEQ ID NO: 1669934 - RNA, 18 nt, Salmonella enterica enterica serovar Typhi
caugcauaaugcagccau

SEQ ID NO: 1669935 - RNA, 21 nt, Salmonella enterica enterica serovar Typhi
caugcauuaaugggcgaaaac

SEQ ID NO: 1669936 - RNA, 17 nt, Salmonella enterica enterica serovar Typhi
caugccagauuuuccag

SEQ ID NO: 1669937 - RNA, 16 nt, Salmonella enterica enterica serovar Typhi
caugcaccacgacggc

SEQ ID NO: 1669938 - RNA, 20 nt, Salmonella enterica enterica serovar Typhi
caugauuucuugagcggcau

SEQ ID NO: 1669939 - RNA, 21 nt, Salmonella enterica enterica serovar Typhi
caugaucggcuggguuuccgg

SEQ ID NO: 1669940 - RNA, 14 nt, Salmonella enterica enterica serovar Typhi
caugauauucuguc

SEQ ID NO: 1669941 - RNA, 15 nt, Salmonella enterica enterica serovar Typhi
caugaugagcgccau

SEQ ID NO: 1669942 - RNA, 14 nt, Salmonella enterica enterica serovar Typhi
caugauggcguaau

SEQ ID NO: 1669943 - RNA, 15 nt, Salmonella enterica enterica serovar Typhi
caugauggugaacag

SEQ ID NO: 1669944 - RNA, 16 nt, Salmonella enterica enterica serovar Typhi
caucggcggcaaugcc

SEQ ID NO: 1669945 - RNA, 19 nt, Salmonella enterica enterica serovar Typhi
caucggccagcaggcgcac

SEQ ID NO: 1669946 - RNA, 14 nt, Salmonella enterica enterica serovar Typhi
caucgcuggcgcgc

SEQ ID NO: 1669947 - RNA, 21 nt, Salmonella enterica enterica serovar Typhi
caucgcuuuuaggcugaaagc

SEQ ID NO: 1669948 - RNA, 13 nt, Salmonella enterica enterica serovar Typhi
caucgcuugccca

SEQ ID NO: 1669949 - RNA, 21 nt, Salmonella enterica enterica serovar Typhi
caucggauucauuugauacgu

SEQ ID NO: 1669950 - RNA, 19 nt, Salmonella enterica enterica serovar Typhi
caucggcagcgccagugac

SEQ ID NO: 1669951 - RNA, 17 nt, Salmonella enterica enterica serovar Typhi
caucgguucucugccau

SEQ ID NO: 1669952 - RNA, 14 nt, Salmonella enterica enterica serovar Typhi
caucgguuucgcgg

SEQ ID NO: 1669953 - RNA, 20 nt, Salmonella enterica enterica serovar Typhi
caucguagucaggcaacagg

SEQ ID NO: 1669954 - RNA, 23 nt, Salmonella enterica enterica serovar Typhi
caucguaccaauacccagcgcca

SEQ ID NO: 1669955 - RNA, 21 nt, Salmonella enterica enterica serovar Typhi
caucgggccguuaucuacgga

SEQ ID NO: 1669956 - RNA, 21 nt, Salmonella enterica enterica serovar Typhi
caucggcucagcaaucacuuc

SEQ ID NO: 1669957 - RNA, 14 nt, Salmonella enterica enterica serovar Typhi
caucuccucgcgcg

SEQ ID NO: 1669958 - RNA, 13 nt, Salmonella enterica enterica serovar Typhi
caucuaucgccag

SEQ ID NO: 1669959 - RNA, 22 nt, Salmonella enterica enterica serovar Typhi
caucucgguuaugaccaauggc

SEQ ID NO: 1669960 - RNA, 22 nt, Salmonella enterica enterica serovar Typhi
caucucgucaaacucuuccggg

SEQ ID NO: 1669961 - RNA, 23 nt, Salmonella enterica enterica serovar Typhi
caucugaccgugaguaucgaucg

SEQ ID NO: 1669962 - RNA, 21 nt, Salmonella enterica enterica serovar Typhi
caucucuuugcccgucgccga

SEQ ID NO: 1669963 - RNA, 19 nt, Salmonella enterica enterica serovar Typhi
caucugcauaauggcgacg

SEQ ID NO: 1669964 - RNA, 17 nt, Salmonella enterica enterica serovar Typhi
caucugcgcaacuggaa

SEQ ID NO: 1669965 - RNA, 14 nt, Salmonella enterica enterica serovar Typhi
caucugcguugcgc

SEQ ID NO: 1669966 - RNA, 16 nt, Salmonella enterica enterica serovar Typhi
caucuaccgcauacug

SEQ ID NO: 1669967 - RNA, 20 nt, Salmonella enterica enterica serovar Typhi
caucguuugcgcuacgcugc

SEQ ID NO: 1669968 - RNA, 18 nt, Salmonella enterica enterica serovar Typhi
caucguuaccgcuucaca

SEQ ID NO: 1669969 - RNA, 15 nt, Salmonella enterica enterica serovar Typhi
cagcaagcggcuguc

SEQ ID NO: 1669970 - RNA, 18 nt, Salmonella enterica enterica serovar Typhi
cagcaaugauuuuuagcc

SEQ ID NO: 1669971 - RNA, 18 nt, Salmonella enterica enterica serovar Typhi
cagcaauaucagccauua

SEQ ID NO: 1669972 - RNA, 23 nt, Salmonella enterica enterica serovar Typhi
cagcaauaacauuugccgggcca

SEQ ID NO: 1669973 - RNA, 19 nt, Salmonella enterica enterica serovar Typhi
cagcaaaauaccggcagcg

SEQ ID NO: 1669974 - RNA, 20 nt, Salmonella enterica enterica serovar Typhi
cagcaaauagccguuaccgc

SEQ ID NO: 1669975 - RNA, 21 nt, Salmonella enterica enterica serovar Typhi
cagcaaaacggcuaccgucau

SEQ ID NO: 1669976 - RNA, 21 nt, Salmonella enterica enterica serovar Typhi
cagcaaacggcuggauaaccg

SEQ ID NO: 1669977 - RNA, 22 nt, Salmonella enterica enterica serovar Typhi
cagcaacacuuugcgcugcgca

SEQ ID NO: 1669978 - RNA, 15 nt, Salmonella enterica enterica serovar Typhi
cagcaaaucgcccau

SEQ ID NO: 1669979 - RNA, 14 nt, Salmonella enterica enterica serovar Typhi
cagcaacugacgcg

SEQ ID NO: 1669980 - RNA, 19 nt, Salmonella enterica enterica serovar Typhi
cagauguccaccgauuuca

SEQ ID NO: 1669981 - RNA, 23 nt, Salmonella enterica enterica serovar Typhi
cagauuauccagucccaccgggc

SEQ ID NO: 1669982 - RNA, 14 nt, Salmonella enterica enterica serovar Typhi
cagaugcugcguuu

SEQ ID NO: 1669983 - RNA, 22 nt, Salmonella enterica enterica serovar Typhi
cagaugagcgguaagucgacca

SEQ ID NO: 1669984 - RNA, 17 nt, Salmonella enterica enterica serovar Typhi
cagaugacagugcgcca

SEQ ID NO: 1669985 - RNA, 13 nt, Salmonella enterica enterica serovar Typhi
cagaugcagcggc

SEQ ID NO: 1669986 - RNA, 15 nt, Salmonella enterica enterica serovar Typhi
cagcacgagcgccag

SEQ ID NO: 1669987 - RNA, 23 nt, Salmonella enterica enterica serovar Typhi
cagcaauuucucgcccgccagau

SEQ ID NO: 1669988 - RNA, 14 nt, Salmonella enterica enterica serovar Typhi
cagcaauuccgcca

SEQ ID NO: 1669989 - RNA, 21 nt, Salmonella enterica enterica serovar Typhi
cagcaucaugggcucaucaaa

SEQ ID NO: 1669990 - RNA, 14 nt, Salmonella enterica enterica serovar Typhi
cagcaucccggcaa

SEQ ID NO: 1669991 - RNA, 16 nt, Salmonella enterica enterica serovar Typhi
cagcauccuccggcga

SEQ ID NO: 1669992 - RNA, 16 nt, Salmonella enterica enterica serovar Typhi
cagcaucgaccaggau

SEQ ID NO: 1669993 - RNA, 19 nt, Salmonella enterica enterica serovar Typhi
cagcaugcccgccagcggg

SEQ ID NO: 1669994 - RNA, 15 nt, Salmonella enterica enterica serovar Typhi
cagccaaauagcgcc

SEQ ID NO: 1669995 - RNA, 14 nt, Salmonella enterica enterica serovar Typhi
cagcauuucgucga

SEQ ID NO: 1669996 - RNA, 19 nt, Salmonella enterica enterica serovar Typhi
cagcauugggauggauaaa

SEQ ID NO: 1669997 - RNA, 20 nt, Salmonella enterica enterica serovar Typhi
cagcauguccgccuaccagc

SEQ ID NO: 1669998 - RNA, 12 nt, Salmonella enterica enterica serovar Typhi
cagcaugugccg

SEQ ID NO: 1669999 - RNA, 13 nt, Salmonella enterica enterica serovar Typhi
cagcauaaacauc

SEQ ID NO: 1670000 - RNA, 13 nt, Salmonella enterica enterica serovar Typhi
cagcaucccggca

SEQ ID NO: 1670001 - RNA, 14 nt, Salmonella enterica enterica serovar Typhi
cagcauccagcuca

SEQ ID NO: 1670002 - RNA, 16 nt, Salmonella enterica enterica serovar Typhi
cagcaguugccauagc

SEQ ID NO: 1670003 - RNA, 16 nt, Salmonella enterica enterica serovar Typhi
cagcaguuccggcgua

SEQ ID NO: 1670004 - RNA, 24 nt, Salmonella enterica enterica serovar Typhi
cagcagauaauuuuucagacguca

SEQ ID NO: 1670005 - RNA, 17 nt, Salmonella enterica enterica serovar Typhi
cagcacuucagaacggc

SEQ ID NO: 1670006 - RNA, 20 nt, Salmonella enterica enterica serovar Typhi
cagcagacaaccgacgcauu

SEQ ID NO: 1670007 - RNA, 16 nt, Salmonella enterica enterica serovar Typhi
cagcagaaagcaacag

SEQ ID NO: 1670008 - RNA, 22 nt, Salmonella enterica enterica serovar Typhi
cagcagaaauucggcagcgucu

SEQ ID NO: 1670009 - RNA, 17 nt, Salmonella enterica enterica serovar Typhi
cagcagcggaaucgcuu

SEQ ID NO: 1670010 - RNA, 14 nt, Salmonella enterica enterica serovar Typhi
cagcagcagccggu

SEQ ID NO: 1670011 - RNA, 17 nt, Salmonella enterica enterica serovar Typhi
cagcagcgcgaucgccc

SEQ ID NO: 1670012 - RNA, 15 nt, Salmonella enterica enterica serovar Typhi
cagcaggcagacgcg

SEQ ID NO: 1670013 - RNA, 23 nt, Salmonella enterica enterica serovar Typhi
cagcaggauagcgaccagcguca

SEQ ID NO: 1670014 - RNA, 17 nt, Salmonella enterica enterica serovar Typhi
cagaacgcuuuugcgca

SEQ ID NO: 1670015 - RNA, 13 nt, Salmonella enterica enterica serovar Typhi
cacuuucaucagc

SEQ ID NO: 1670016 - RNA, 18 nt, Salmonella enterica enterica serovar Typhi
cacuuuccgaaucaggcg

SEQ ID NO: 1670017 - RNA, 23 nt, Salmonella enterica enterica serovar Typhi
cagaaauaacucccuauaaugcg

SEQ ID NO: 1670018 - RNA, 15 nt, Salmonella enterica enterica serovar Typhi
cagaaaucggcagca

SEQ ID NO: 1670019 - RNA, 13 nt, Salmonella enterica enterica serovar Typhi
cacuucgauaaac

SEQ ID NO: 1670020 - RNA, 19 nt, Salmonella enterica enterica serovar Typhi
cacuucucgcgcaucagga

SEQ ID NO: 1670021 - RNA, 16 nt, Salmonella enterica enterica serovar Typhi
cacuucauccggauaa

SEQ ID NO: 1670022 - RNA, 13 nt, Salmonella enterica enterica serovar Typhi
cacuucauccggc

SEQ ID NO: 1670023 - RNA, 21 nt, Salmonella enterica enterica serovar Typhi
cacuucauccggcguugcgcc

SEQ ID NO: 1670024 - RNA, 15 nt, Salmonella enterica enterica serovar Typhi
cacucauccagacca

SEQ ID NO: 1670025 - RNA, 19 nt, Salmonella enterica enterica serovar Typhi
cacguugagaaagggauaa

SEQ ID NO: 1670026 - RNA, 16 nt, Salmonella enterica enterica serovar Typhi
cacgcgacggcccaac

SEQ ID NO: 1670027 - RNA, 17 nt, Salmonella enterica enterica serovar Typhi
cacgcgaauagccagac

SEQ ID NO: 1670028 - RNA, 18 nt, Salmonella enterica enterica serovar Typhi
cacugauaguccaucacc

SEQ ID NO: 1670029 - RNA, 20 nt, Salmonella enterica enterica serovar Typhi
cacugauaguccaucaccuc

SEQ ID NO: 1670030 - RNA, 15 nt, Salmonella enterica enterica serovar Typhi
cacugcuguagcguc

SEQ ID NO: 1670031 - RNA, 21 nt, Salmonella enterica enterica serovar Typhi
cacugauggcuggcgucgcca

SEQ ID NO: 1670032 - RNA, 21 nt, Salmonella enterica enterica serovar Typhi
cagagagcguuucuacgccau

SEQ ID NO: 1670033 - RNA, 15 nt, Salmonella enterica enterica serovar Typhi
aaagagcgucguuau

SEQ ID NO: 1670034 - RNA, 19 nt, Salmonella enterica enterica serovar Typhi
aaagacggcagcgccaucc

SEQ ID NO: 1670035 - RNA, 14 nt, Salmonella enterica enterica serovar Typhi
cagacucugcgcgu

SEQ ID NO: 1670036 - RNA, 22 nt, Salmonella enterica enterica serovar Typhi
aaagaaugucccaguaauaucg

SEQ ID NO: 1670037 - RNA, 13 nt, Salmonella enterica enterica serovar Typhi
cagacguagcgcc

SEQ ID NO: 1670038 - RNA, 15 nt, Salmonella enterica enterica serovar Typhi
cagaaugccagcgcc

SEQ ID NO: 1670039 - RNA, 21 nt, Salmonella enterica enterica serovar Typhi
cagacaaaaucuuuccagcuc

SEQ ID NO: 1670040 - RNA, 20 nt, Salmonella enterica enterica serovar Typhi
cagacaagcacauaacugag

SEQ ID NO: 1670041 - RNA, 14 nt, Salmonella enterica enterica serovar Typhi
cagacaauccgcgg

SEQ ID NO: 1670042 - RNA, 20 nt, Salmonella enterica enterica serovar Typhi
cagacaauaccagggcgauu

SEQ ID NO: 1670043 - RNA, 20 nt, Salmonella enterica enterica serovar Typhi
cagacaaguagccugccagc

SEQ ID NO: 1670044 - RNA, 13 nt, Salmonella enterica enterica serovar Typhi
cagacaugaccgc

SEQ ID NO: 1670045 - RNA, 15 nt, Salmonella enterica enterica serovar Typhi
cagacauucgcgcac

SEQ ID NO: 1670046 - RNA, 19 nt, Salmonella enterica enterica serovar Typhi
cagaggaucuggacgccaa

SEQ ID NO: 1670047 - RNA, 18 nt, Salmonella enterica enterica serovar Typhi
cagaguaaaaaaaccggc

SEQ ID NO: 1670048 - RNA, 21 nt, Salmonella enterica enterica serovar Typhi
cagagguaauuagaucggcaa

SEQ ID NO: 1670049 - RNA, 20 nt, Salmonella enterica enterica serovar Typhi
cagauaaaucagcccgauac

SEQ ID NO: 1670050 - RNA, 16 nt, Salmonella enterica enterica serovar Typhi
cagauauuccagcgac

SEQ ID NO: 1670051 - RNA, 16 nt, Salmonella enterica enterica serovar Typhi
cagaucgcgcugcgca

SEQ ID NO: 1670052 - RNA, 18 nt, Salmonella enterica enterica serovar Typhi
cagaucguagccauguuc

SEQ ID NO: 1670053 - RNA, 22 nt, Salmonella enterica enterica serovar Typhi
cagaugaaacugcauaucgccg

SEQ ID NO: 1670054 - RNA, 17 nt, Salmonella enterica enterica serovar Typhi
cagaugaagcgcaucgg

SEQ ID NO: 1670055 - RNA, 19 nt, Salmonella enterica enterica serovar Typhi
cagcgcgcgacccagcgca

SEQ ID NO: 1670056 - RNA, 14 nt, Salmonella enterica enterica serovar Typhi
cagcgcgcguaacc

SEQ ID NO: 1670057 - RNA, 17 nt, Salmonella enterica enterica serovar Typhi
cagcgcgaccagcguga

SEQ ID NO: 1670058 - RNA, 14 nt, Salmonella enterica enterica serovar Typhi
cagcgcgauacgcg

SEQ ID NO: 1670059 - RNA, 14 nt, Salmonella enterica enterica serovar Typhi
cagcgcgucgacca

SEQ ID NO: 1670060 - RNA, 13 nt, Salmonella enterica enterica serovar Typhi
cagcgcggcguga

SEQ ID NO: 1670061 - RNA, 12 nt, Salmonella enterica enterica serovar Typhi
cagcgcugcugu

SEQ ID NO: 1670062 - RNA, 14 nt, Salmonella enterica enterica serovar Typhi
cagcgcuuagcggc

SEQ ID NO: 1670063 - RNA, 20 nt, Salmonella enterica enterica serovar Typhi
cagcgcuugugccugcugcg

SEQ ID NO: 1670064 - RNA, 23 nt, Salmonella enterica enterica serovar Typhi
cagcggaaagugaaggccagacu

SEQ ID NO: 1670065 - RNA, 22 nt, Salmonella enterica enterica serovar Typhi
cagcgcuuugccgcugcugccu

SEQ ID NO: 1670066 - RNA, 21 nt, Salmonella enterica enterica serovar Typhi
cagcgcugcauuugcugccgu

SEQ ID NO: 1670067 - RNA, 16 nt, Salmonella enterica enterica serovar Typhi
cagcgcucugcaaugu

SEQ ID NO: 1670068 - RNA, 17 nt, Salmonella enterica enterica serovar Typhi
cagcgcguugggcguga

SEQ ID NO: 1670069 - RNA, 15 nt, Salmonella enterica enterica serovar Typhi
cagcgcgugaaccgu

SEQ ID NO: 1670070 - RNA, 17 nt, Salmonella enterica enterica serovar Typhi
cagcggcaacucgugca

SEQ ID NO: 1670071 - RNA, 20 nt, Salmonella enterica enterica serovar Typhi
cagcguacaggcggaaauca

SEQ ID NO: 1670072 - RNA, 22 nt, Salmonella enterica enterica serovar Typhi
cagcgguugcauaaaauccugg

SEQ ID NO: 1670073 - RNA, 16 nt, Salmonella enterica enterica serovar Typhi
cagcgguuagcggcau

SEQ ID NO: 1670074 - RNA, 20 nt, Salmonella enterica enterica serovar Typhi
cagcgguuacuuuugaacau

SEQ ID NO: 1670075 - RNA, 14 nt, Salmonella enterica enterica serovar Typhi
cagcggucaucaau

SEQ ID NO: 1670076 - RNA, 19 nt, Salmonella enterica enterica serovar Typhi
cagcguaaugcgccaggca

SEQ ID NO: 1670077 - RNA, 20 nt, Salmonella enterica enterica serovar Typhi
cagcgucgucauagcguuga

SEQ ID NO: 1670078 - RNA, 13 nt, Salmonella enterica enterica serovar Typhi
cagcggcugcgcc

SEQ ID NO: 1670079 - RNA, 24 nt, Salmonella enterica enterica serovar Typhi
cagcgccucuucuaaaucauacca

SEQ ID NO: 1670080 - RNA, 14 nt, Salmonella enterica enterica serovar Typhi
cagcgccugacggc

SEQ ID NO: 1670081 - RNA, 21 nt, Salmonella enterica enterica serovar Typhi
cagcgccuguaggaucaacca

SEQ ID NO: 1670082 - RNA, 13 nt, Salmonella enterica enterica serovar Typhi
cagcgccagcggc

SEQ ID NO: 1670083 - RNA, 14 nt, Salmonella enterica enterica serovar Typhi
cagcgccagcgcca

SEQ ID NO: 1670084 - RNA, 13 nt, Salmonella enterica enterica serovar Typhi
cagcgccaggcca

SEQ ID NO: 1670085 - RNA, 21 nt, Salmonella enterica enterica serovar Typhi
cagcgcagucaaaacgacaua

SEQ ID NO: 1670086 - RNA, 20 nt, Salmonella enterica enterica serovar Typhi
cagcgccagaaagguauuaa

SEQ ID NO: 1670087 - RNA, 13 nt, Salmonella enterica enterica serovar Typhi
cagcgcaccugcc

SEQ ID NO: 1670088 - RNA, 18 nt, Salmonella enterica enterica serovar Typhi
cagcgcaacgcgcaucaa

SEQ ID NO: 1670089 - RNA, 19 nt, Salmonella enterica enterica serovar Typhi
cagcgacugguguuauuaa

SEQ ID NO: 1670090 - RNA, 21 nt, Salmonella enterica enterica serovar Typhi
cagccgucgugauagccauac

SEQ ID NO: 1670091 - RNA, 16 nt, Salmonella enterica enterica serovar Typhi
cagcgaauuccggcca

SEQ ID NO: 1670092 - RNA, 13 nt, Salmonella enterica enterica serovar Typhi
cagcccugugccg

SEQ ID NO: 1670093 - RNA, 18 nt, Salmonella enterica enterica serovar Typhi
cagccaaacugcuguagc

SEQ ID NO: 1670094 - RNA, 21 nt, Salmonella enterica enterica serovar Typhi
cagccguaucuuccgguguga

SEQ ID NO: 1670095 - RNA, 13 nt, Salmonella enterica enterica serovar Typhi
cagccgccauggc

SEQ ID NO: 1670096 - RNA, 14 nt, Salmonella enterica enterica serovar Typhi
caccgccauccggc

SEQ ID NO: 1670097 - RNA, 15 nt, Salmonella enterica enterica serovar Typhi
caccgacacgcauau

SEQ ID NO: 1670098 - RNA, 15 nt, Salmonella enterica enterica serovar Typhi
caccgacagcaccgc

SEQ ID NO: 1670099 - RNA, 14 nt, Salmonella enterica enterica serovar Typhi
caccccaaaucucc

SEQ ID NO: 1670100 - RNA, 21 nt, Salmonella enterica enterica serovar Typhi
cacccauuuuauccucuucaa

SEQ ID NO: 1670101 - RNA, 16 nt, Salmonella enterica enterica serovar Typhi
caccucuuccgccagg

SEQ ID NO: 1670102 - RNA, 19 nt, Salmonella enterica enterica serovar Typhi
caccucuuccgccaggucg

SEQ ID NO: 1670103 - RNA, 16 nt, Salmonella enterica enterica serovar Typhi
caccugcaacuccugg

SEQ ID NO: 1670104 - RNA, 21 nt, Salmonella enterica enterica serovar Typhi
caccugaucgugccaugacca

SEQ ID NO: 1670105 - RNA, 22 nt, Salmonella enterica enterica serovar Typhi
caccguggcaucaucaaacgau

SEQ ID NO: 1670106 - RNA, 16 nt, Salmonella enterica enterica serovar Typhi
caccgucuaucgugga

SEQ ID NO: 1670107 - RNA, 16 nt, Salmonella enterica enterica serovar Typhi
caccggacucggcuga

SEQ ID NO: 1670108 - RNA, 22 nt, Salmonella enterica enterica serovar Typhi
caccggacaucccaaacgcaau

SEQ ID NO: 1670109 - RNA, 19 nt, Salmonella enterica enterica serovar Typhi
cacgccgccauccggcaac

SEQ ID NO: 1670110 - RNA, 22 nt, Salmonella enterica enterica serovar Typhi
cacgccucuggcguacgcagau

SEQ ID NO: 1670111 - RNA, 14 nt, Salmonella enterica enterica serovar Typhi
cacgccguagcugc

SEQ ID NO: 1670112 - RNA, 17 nt, Salmonella enterica enterica serovar Typhi
cacgccauugccaggac

SEQ ID NO: 1670113 - RNA, 20 nt, Salmonella enterica enterica serovar Typhi
cacgccauggccgcagcccg

SEQ ID NO: 1670114 - RNA, 12 nt, Salmonella enterica enterica serovar Typhi
cacgccagcggu

SEQ ID NO: 1670115 - RNA, 14 nt, Salmonella enterica enterica serovar Typhi
cacgcaguccaaca

SEQ ID NO: 1670116 - RNA, 15 nt, Salmonella enterica enterica serovar Typhi
cacgccaaaaucgcc

SEQ ID NO: 1670117 - RNA, 21 nt, Salmonella enterica enterica serovar Typhi
cacgcagcgccuuaucgagug

SEQ ID NO: 1670118 - RNA, 15 nt, Salmonella enterica enterica serovar Typhi
cacgcaaugccugac

SEQ ID NO: 1670119 - RNA, 16 nt, Salmonella enterica enterica serovar Typhi
caccuggaugcugccu

SEQ ID NO: 1670120 - RNA, 17 nt, Salmonella enterica enterica serovar Typhi
caccugccauucacgcu

SEQ ID NO: 1670121 - RNA, 20 nt, Salmonella enterica enterica serovar Typhi
caccugccauucacgcuggg

SEQ ID NO: 1670122 - RNA, 13 nt, Salmonella enterica enterica serovar Typhi
caccugcccuuuc

SEQ ID NO: 1670123 - RNA, 20 nt, Salmonella enterica enterica serovar Typhi
caccugguuauuagaugcga

SEQ ID NO: 1670124 - RNA, 13 nt, Salmonella enterica enterica serovar Typhi
caccuuauccugg

SEQ ID NO: 1670125 - RNA, 21 nt, Salmonella enterica enterica serovar Typhi
caccuuuuuauuuacugccgu

SEQ ID NO: 1670126 - RNA, 15 nt, Salmonella enterica enterica serovar Typhi
caccuuucugccagg

SEQ ID NO: 1670127 - RNA, 20 nt, Salmonella enterica enterica serovar Typhi
cacgauaaaccucacgcaau

SEQ ID NO: 1670128 - RNA, 12 nt, Salmonella enterica enterica serovar Typhi
cacgaucgccua

SEQ ID NO: 1670129 - RNA, 21 nt, Salmonella enterica enterica serovar Typhi
cacgauaugcauaaucgccga

SEQ ID NO: 1670130 - RNA, 16 nt, Salmonella enterica enterica serovar Typhi
cacgaucgagccgucg

SEQ ID NO: 1670131 - RNA, 13 nt, Salmonella enterica enterica serovar Typhi
cacgaaugucgcg

SEQ ID NO: 1670132 - RNA, 14 nt, Salmonella enterica enterica serovar Typhi
cacgaccagcgaca

SEQ ID NO: 1670133 - RNA, 19 nt, Salmonella enterica enterica serovar Typhi
cacgacgcucauuaacgac

SEQ ID NO: 1670134 - RNA, 23 nt, Salmonella enterica enterica serovar Typhi
cacaucguuacccauuaccuggc

SEQ ID NO: 1670135 - RNA, 21 nt, Salmonella enterica enterica serovar Typhi
cacaucuacucauaugcggau

SEQ ID NO: 1670136 - RNA, 20 nt, Salmonella enterica enterica serovar Typhi
caccaacgccgcuuuaccgc

SEQ ID NO: 1670137 - RNA, 17 nt, Salmonella enterica enterica serovar Typhi
cacagggggaacauuua

SEQ ID NO: 1670138 - RNA, 20 nt, Salmonella enterica enterica serovar Typhi
cacaguacgcccggcgggua

SEQ ID NO: 1670139 - RNA, 16 nt, Salmonella enterica enterica serovar Typhi
caccaacugcugaccg

SEQ ID NO: 1670140 - RNA, 22 nt, Salmonella enterica enterica serovar Typhi
cacacucauuuugccguugcug

SEQ ID NO: 1670141 - RNA, 18 nt, Salmonella enterica enterica serovar Typhi
cacagcgcuaucaggcac

SEQ ID NO: 1670142 - RNA, 15 nt, Salmonella enterica enterica serovar Typhi
cacagcgcuaucagg

SEQ ID NO: 1670143 - RNA, 17 nt, Salmonella enterica enterica serovar Typhi
cacaccaucccggcgua

SEQ ID NO: 1670144 - RNA, 18 nt, Salmonella enterica enterica serovar Typhi
cacacgccaaaaucgccc

SEQ ID NO: 1670145 - RNA, 15 nt, Salmonella enterica enterica serovar Typhi
cacaccgccgccagc

SEQ ID NO: 1670146 - RNA, 20 nt, Salmonella enterica enterica serovar Typhi
caccagcuuaucgggaugau

SEQ ID NO: 1670147 - RNA, 18 nt, Salmonella enterica enterica serovar Typhi
caccaggaguuaaaccug

SEQ ID NO: 1670148 - RNA, 18 nt, Salmonella enterica enterica serovar Typhi
caccagcacgaugcauau

SEQ ID NO: 1670149 - RNA, 17 nt, Salmonella enterica enterica serovar Typhi
caccagcacgaugcaua

SEQ ID NO: 1670150 - RNA, 14 nt, Salmonella enterica enterica serovar Typhi
caccagcacagccc

SEQ ID NO: 1670151 - RNA, 19 nt, Salmonella enterica enterica serovar Typhi
caccaucuuuuccggcagg

SEQ ID NO: 1670152 - RNA, 19 nt, Salmonella enterica enterica serovar Typhi
cacccaucgcgacaucgcc

SEQ ID NO: 1670153 - RNA, 16 nt, Salmonella enterica enterica serovar Typhi
cacccagugccaccag

SEQ ID NO: 1670154 - RNA, 22 nt, Salmonella enterica enterica serovar Typhi
caaugagcugcuugucacgaag

SEQ ID NO: 1670155 - RNA, 16 nt, Salmonella enterica enterica serovar Typhi
caaugccgcagcgcgg

SEQ ID NO: 1670156 - RNA, 18 nt, Salmonella enterica enterica serovar Typhi
caaugcggcaucucgcca

SEQ ID NO: 1670157 - RNA, 19 nt, Salmonella enterica enterica serovar Typhi
caaugaacucgccucgcug

SEQ ID NO: 1670158 - RNA, 22 nt, Salmonella enterica enterica serovar Typhi
caaugaccauaauuuccggcgc

SEQ ID NO: 1670159 - RNA, 14 nt, Salmonella enterica enterica serovar Typhi
caaugagccgucgc

SEQ ID NO: 1670160 - RNA, 13 nt, Salmonella enterica enterica serovar Typhi
caaugagcaggcc

SEQ ID NO: 1670161 - RNA, 17 nt, Salmonella enterica enterica serovar Typhi
caauacgaaaaccgagc

SEQ ID NO: 1670162 - RNA, 15 nt, Salmonella enterica enterica serovar Typhi
caaucaguacgcgcg

SEQ ID NO: 1670163 - RNA, 17 nt, Salmonella enterica enterica serovar Typhi
caaucaguucucgcgcc

SEQ ID NO: 1670164 - RNA, 16 nt, Salmonella enterica enterica serovar Typhi
caaucgcguucgcggg

SEQ ID NO: 1670165 - RNA, 18 nt, Salmonella enterica enterica serovar Typhi
caaucgcguuuuccagca

SEQ ID NO: 1670166 - RNA, 20 nt, Salmonella enterica enterica serovar Typhi
caaucgcuaucugacagcca

SEQ ID NO: 1670167 - RNA, 16 nt, Salmonella enterica enterica serovar Typhi
caaucgcgguaugcga

SEQ ID NO: 1670168 - RNA, 16 nt, Salmonella enterica enterica serovar Typhi
caaucgccugcaacgc

SEQ ID NO: 1670169 - RNA, 17 nt, Salmonella enterica enterica serovar Typhi
caauuugcccagcgcug

SEQ ID NO: 1670170 - RNA, 13 nt, Salmonella enterica enterica serovar Typhi
cacaacccaaagg

SEQ ID NO: 1670171 - RNA, 16 nt, Salmonella enterica enterica serovar Typhi
caauuucuuuguuaga

SEQ ID NO: 1670172 - RNA, 14 nt, Salmonella enterica enterica serovar Typhi
caauguaaaacggu

SEQ ID NO: 1670173 - RNA, 17 nt, Salmonella enterica enterica serovar Typhi
caauguuaaauucagca

SEQ ID NO: 1670174 - RNA, 22 nt, Salmonella enterica enterica serovar Typhi
caauguuaaauucagcauuagg

SEQ ID NO: 1670175 - RNA, 15 nt, Salmonella enterica enterica serovar Typhi
cacaaguuuauccgg

SEQ ID NO: 1670176 - RNA, 18 nt, Salmonella enterica enterica serovar Typhi
cacaaguuuauccggcac

SEQ ID NO: 1670177 - RNA, 12 nt, Salmonella enterica enterica serovar Typhi
cacaaucagcca

SEQ ID NO: 1670178 - RNA, 20 nt, Salmonella enterica enterica serovar Typhi
cacaauuccggcccaggcca

SEQ ID NO: 1670179 - RNA, 19 nt, Salmonella enterica enterica serovar Typhi
cacacauaucgccagccau

SEQ ID NO: 1670180 - RNA, 18 nt, Salmonella enterica enterica serovar Typhi
caagaaguuccaccgucu

SEQ ID NO: 1670181 - RNA, 18 nt, Salmonella enterica enterica serovar Typhi
caagcaguucugaagcua

SEQ ID NO: 1670182 - RNA, 16 nt, Salmonella enterica enterica serovar Typhi
caacagaaucgcgaua

SEQ ID NO: 1670183 - RNA, 21 nt, Salmonella enterica enterica serovar Typhi
caacagcaaaacgcgcuauca

SEQ ID NO: 1670184 - RNA, 11 nt, Salmonella enterica enterica serovar Typhi
caacuggcuca

SEQ ID NO: 1670185 - RNA, 12 nt, Salmonella enterica enterica serovar Typhi
caacuggaagcg

SEQ ID NO: 1670186 - RNA, 22 nt, Salmonella enterica enterica serovar Typhi
caacuuccagagcaucuaccgc

SEQ ID NO: 1670187 - RNA, 18 nt, Salmonella enterica enterica serovar Typhi
caagcgucagcaugguaa

SEQ ID NO: 1670188 - RNA, 18 nt, Salmonella enterica enterica serovar Typhi
caagucgcgggcgcuaaa

SEQ ID NO: 1670189 - RNA, 16 nt, Salmonella enterica enterica serovar Typhi
caauaaccaccuguuc

SEQ ID NO: 1670190 - RNA, 19 nt, Salmonella enterica enterica serovar Typhi
caauaacagccagcgggcg

SEQ ID NO: 1670191 - RNA, 13 nt, Salmonella enterica enterica serovar Typhi
caauaaacuggag

SEQ ID NO: 1670192 - RNA, 21 nt, Salmonella enterica enterica serovar Typhi
caauaacgaccccaauagcga

SEQ ID NO: 1670193 - RNA, 17 nt, Salmonella enterica enterica serovar Typhi
caauaacucaauagcgg

SEQ ID NO: 1670194 - RNA, 21 nt, Salmonella enterica enterica serovar Typhi
caauaauccgcuaacgauguc

SEQ ID NO: 1670195 - RNA, 23 nt, Salmonella enterica enterica serovar Typhi
augccuguguaucgcccugccag

SEQ ID NO: 1670196 - RNA, 20 nt, Salmonella enterica enterica serovar Typhi
augccggccugauauccacg

SEQ ID NO: 1670197 - RNA, 22 nt, Salmonella enterica enterica serovar Typhi
augcgccccgcuucccgaaagg

SEQ ID NO: 1670198 - RNA, 18 nt, Salmonella enterica enterica serovar Typhi
augcgccccggcggcgua

SEQ ID NO: 1670199 - RNA, 18 nt, Salmonella enterica enterica serovar Typhi
augcgccaguucagcguc

SEQ ID NO: 1670200 - RNA, 13 nt, Salmonella enterica enterica serovar Typhi
augcgccagcggc

SEQ ID NO: 1670201 - RNA, 21 nt, Salmonella enterica enterica serovar Typhi
augcgauacguaggccugaua

SEQ ID NO: 1670202 - RNA, 14 nt, Salmonella enterica enterica serovar Typhi
augcgcgucaggcc

SEQ ID NO: 1670203 - RNA, 19 nt, Salmonella enterica enterica serovar Typhi
augcgcggaauagcggcua

SEQ ID NO: 1670204 - RNA, 15 nt, Salmonella enterica enterica serovar Typhi
augcgcgucaggcca

SEQ ID NO: 1670205 - RNA, 22 nt, Salmonella enterica enterica serovar Typhi
augcgcgugcgguuuuccugau

SEQ ID NO: 1670206 - RNA, 18 nt, Salmonella enterica enterica serovar Typhi
augcgccgacugaacaua

SEQ ID NO: 1670207 - RNA, 18 nt, Salmonella enterica enterica serovar Typhi
augcgccccugcaggcga

SEQ ID NO: 1670208 - RNA, 13 nt, Salmonella enterica enterica serovar Typhi
augcggcuagcgc

SEQ ID NO: 1670209 - RNA, 19 nt, Salmonella enterica enterica serovar Typhi
augcucauccaacugcgcc

SEQ ID NO: 1670210 - RNA, 20 nt, Salmonella enterica enterica serovar Typhi
augcuacccgucgcgcccac

SEQ ID NO: 1670211 - RNA, 22 nt, Salmonella enterica enterica serovar Typhi
augccgcccaggccaugcgccg

SEQ ID NO: 1670212 - RNA, 19 nt, Salmonella enterica enterica serovar Typhi
augcccucuuccagcgcca

SEQ ID NO: 1670213 - RNA, 22 nt, Salmonella enterica enterica serovar Typhi
augcccgcgagagauuaagcga

SEQ ID NO: 1670214 - RNA, 22 nt, Salmonella enterica enterica serovar Typhi
augccagauuuuccaggccgcc

SEQ ID NO: 1670215 - RNA, 13 nt, Salmonella enterica enterica serovar Typhi
augccagauauuu

SEQ ID NO: 1670216 - RNA, 20 nt, Salmonella enterica enterica serovar Typhi
augccacgccccuaaggcag

SEQ ID NO: 1670217 - RNA, 18 nt, Salmonella enterica enterica serovar Typhi
augcaugacgggggcgau

SEQ ID NO: 1670218 - RNA, 18 nt, Salmonella enterica enterica serovar Typhi
augcccaauagcgcugag

SEQ ID NO: 1670219 - RNA, 23 nt, Salmonella enterica enterica serovar Typhi
augcccaccggaccuaauagcca

SEQ ID NO: 1670220 - RNA, 23 nt, Salmonella enterica enterica serovar Typhi
augcccaccguggagcguucgcg

SEQ ID NO: 1670221 - RNA, 20 nt, Salmonella enterica enterica serovar Typhi
augccccaucacgggaucgc

SEQ ID NO: 1670222 - RNA, 17 nt, Salmonella enterica enterica serovar Typhi
augcccagcgccgucau

SEQ ID NO: 1670223 - RNA, 19 nt, Salmonella enterica enterica serovar Typhi
auggggauuaagcgagcgc

SEQ ID NO: 1670224 - RNA, 19 nt, Salmonella enterica enterica serovar Typhi
auggggcaagcucagcggc

SEQ ID NO: 1670225 - RNA, 17 nt, Salmonella enterica enterica serovar Typhi
auggcggcguuuuccgg

SEQ ID NO: 1670226 - RNA, 22 nt, Salmonella enterica enterica serovar Typhi
auggcgcuacgcuuaucaggcc

SEQ ID NO: 1670227 - RNA, 13 nt, Salmonella enterica enterica serovar Typhi
augguuaacgccg

SEQ ID NO: 1670228 - RNA, 13 nt, Salmonella enterica enterica serovar Typhi
auguccagggcau

SEQ ID NO: 1670229 - RNA, 22 nt, Salmonella enterica enterica serovar Typhi
augucagugacgguaucgugac

SEQ ID NO: 1670230 - RNA, 23 nt, Salmonella enterica enterica serovar Typhi
augcugccagcgaaccgcggcau

SEQ ID NO: 1670231 - RNA, 16 nt, Salmonella enterica enterica serovar Typhi
auggauaacauguggc

SEQ ID NO: 1670232 - RNA, 13 nt, Salmonella enterica enterica serovar Typhi
auggcgaucagcg

SEQ ID NO: 1670233 - RNA, 15 nt, Salmonella enterica enterica serovar Typhi
auggcgaucagcgcc

SEQ ID NO: 1670234 - RNA, 16 nt, Salmonella enterica enterica serovar Typhi
auggcgaucagcgcca

SEQ ID NO: 1670235 - RNA, 22 nt, Salmonella enterica enterica serovar Typhi
auggccggucuuaugcugccag

SEQ ID NO: 1670236 - RNA, 14 nt, Salmonella enterica enterica serovar Typhi
auggcaauugcgcc

SEQ ID NO: 1670237 - RNA, 18 nt, Salmonella enterica enterica serovar Typhi
auggcagggcgauaucca

SEQ ID NO: 1670238 - RNA, 14 nt, Salmonella enterica enterica serovar Typhi
auggcauaacgcug

SEQ ID NO: 1670239 - RNA, 21 nt, Salmonella enterica enterica serovar Typhi
aucugacagccaaacugcugu

SEQ ID NO: 1670240 - RNA, 12 nt, Salmonella enterica enterica serovar Typhi
aucugauagccc

SEQ ID NO: 1670241 - RNA, 22 nt, Salmonella enterica enterica serovar Typhi
aucugaugauggaacagacgcc

SEQ ID NO: 1670242 - RNA, 15 nt, Salmonella enterica enterica serovar Typhi
aucucuuuugcggcg

SEQ ID NO: 1670243 - RNA, 15 nt, Salmonella enterica enterica serovar Typhi
aucucuggcggcgua

SEQ ID NO: 1670244 - RNA, 14 nt, Salmonella enterica enterica serovar Typhi
aucucuuaauguaa

SEQ ID NO: 1670245 - RNA, 18 nt, Salmonella enterica enterica serovar Typhi
aucguuaauucauggcca

SEQ ID NO: 1670246 - RNA, 13 nt, Salmonella enterica enterica serovar Typhi
aucucccugccag

SEQ ID NO: 1670247 - RNA, 21 nt, Salmonella enterica enterica serovar Typhi
aucucgcgguugacgcugcuu

SEQ ID NO: 1670248 - RNA, 19 nt, Salmonella enterica enterica serovar Typhi
aucucgcuaaccaucagcg

SEQ ID NO: 1670249 - RNA, 15 nt, Salmonella enterica enterica serovar Typhi
aucgucgccgaucgg

SEQ ID NO: 1670250 - RNA, 12 nt, Salmonella enterica enterica serovar Typhi
aucgucgcgcca

SEQ ID NO: 1670251 - RNA, 16 nt, Salmonella enterica enterica serovar Typhi
aucguauccagcggca

SEQ ID NO: 1670252 - RNA, 19 nt, Salmonella enterica enterica serovar Typhi
aucguaugcagccaggcca

SEQ ID NO: 1670253 - RNA, 23 nt, Salmonella enterica enterica serovar Typhi
aucgucgaggaagcugcgcagca

SEQ ID NO: 1670254 - RNA, 16 nt, Salmonella enterica enterica serovar Typhi
aucgucgcgaucgcgc

SEQ ID NO: 1670255 - RNA, 22 nt, Salmonella enterica enterica serovar Typhi
aucguaccaauacccagcgcca

SEQ ID NO: 1670256 - RNA, 18 nt, Salmonella enterica enterica serovar Typhi
aucgguguacaucgcgcu

SEQ ID NO: 1670257 - RNA, 20 nt, Salmonella enterica enterica serovar Typhi
aucgguucaucuucgccugg

SEQ ID NO: 1670258 - RNA, 16 nt, Salmonella enterica enterica serovar Typhi
aucgguguacaucgcg

SEQ ID NO: 1670259 - RNA, 12 nt, Salmonella enterica enterica serovar Typhi
aucgaaggucag

SEQ ID NO: 1670260 - RNA, 20 nt, Salmonella enterica enterica serovar Typhi
aucgaacgccgccugcgcca

SEQ ID NO: 1670261 - RNA, 23 nt, Salmonella enterica enterica serovar Typhi
aucgacagacuucacccacugca

SEQ ID NO: 1670262 - RNA, 18 nt, Salmonella enterica enterica serovar Typhi
aucgacaaaacacggcua

SEQ ID NO: 1670263 - RNA, 21 nt, Salmonella enterica enterica serovar Typhi
aucgggcuguuauucagcagg

SEQ ID NO: 1670264 - RNA, 15 nt, Salmonella enterica enterica serovar Typhi
augagcguuagcgcc

SEQ ID NO: 1670265 - RNA, 15 nt, Salmonella enterica enterica serovar Typhi
augagcgcaggcgag

SEQ ID NO: 1670266 - RNA, 16 nt, Salmonella enterica enterica serovar Typhi
augacggccaccagcg

SEQ ID NO: 1670267 - RNA, 11 nt, Salmonella enterica enterica serovar Typhi
augacgcuucg

SEQ ID NO: 1670268 - RNA, 20 nt, Salmonella enterica enterica serovar Typhi
augacgcugcgcuuauccgg

SEQ ID NO: 1670269 - RNA, 18 nt, Salmonella enterica enterica serovar Typhi
augaggcaaaucccugau

SEQ ID NO: 1670270 - RNA, 18 nt, Salmonella enterica enterica serovar Typhi
augcacgcgcggcgccag

SEQ ID NO: 1670271 - RNA, 20 nt, Salmonella enterica enterica serovar Typhi
augcaggccaagcagcgcca

SEQ ID NO: 1670272 - RNA, 22 nt, Salmonella enterica enterica serovar Typhi
augcagguucccgcccugcccg

SEQ ID NO: 1670273 - RNA, 19 nt, Salmonella enterica enterica serovar Typhi
augcauaugcacagcgcua

SEQ ID NO: 1670274 - RNA, 19 nt, Salmonella enterica enterica serovar Typhi
aucuggcuguggcguuuua

SEQ ID NO: 1670275 - RNA, 23 nt, Salmonella enterica enterica serovar Typhi
aucuggcgagagcauugccugau

SEQ ID NO: 1670276 - RNA, 17 nt, Salmonella enterica enterica serovar Typhi
aucuggcgcaaccggcg

SEQ ID NO: 1670277 - RNA, 17 nt, Salmonella enterica enterica serovar Typhi
augaaaaauccccgcaa

SEQ ID NO: 1670278 - RNA, 20 nt, Salmonella enterica enterica serovar Typhi
augaaacauauauauccgcu

SEQ ID NO: 1670279 - RNA, 18 nt, Salmonella enterica enterica serovar Typhi
augaagcuggagccacau

SEQ ID NO: 1670280 - RNA, 17 nt, Salmonella enterica enterica serovar Typhi
augaauaaucucugcga

SEQ ID NO: 1670281 - RNA, 22 nt, Salmonella enterica enterica serovar Typhi
augaacgacgcugauuugccaa

SEQ ID NO: 1670282 - RNA, 14 nt, Salmonella enterica enterica serovar Typhi
augaagcgucauca

SEQ ID NO: 1670283 - RNA, 14 nt, Salmonella enterica enterica serovar Typhi
augacgcagggcaa

SEQ ID NO: 1670284 - RNA, 15 nt, Salmonella enterica enterica serovar Typhi
augaccagcgcccac

SEQ ID NO: 1670285 - RNA, 13 nt, Salmonella enterica enterica serovar Typhi
augaccagcgccg

SEQ ID NO: 1670286 - RNA, 23 nt, Salmonella enterica enterica serovar Typhi
caaacagcgcgcccgccaccagc

SEQ ID NO: 1670287 - RNA, 14 nt, Salmonella enterica enterica serovar Typhi
caaacaguacgccc

SEQ ID NO: 1670288 - RNA, 18 nt, Salmonella enterica enterica serovar Typhi
caaacaguucagacacca

SEQ ID NO: 1670289 - RNA, 14 nt, Salmonella enterica enterica serovar Typhi
caaacaacccggcu

SEQ ID NO: 1670290 - RNA, 17 nt, Salmonella enterica enterica serovar Typhi
caaaaugcgcaaagcau

SEQ ID NO: 1670291 - RNA, 20 nt, Salmonella enterica enterica serovar Typhi
caaaauuaaucgccagcagc

SEQ ID NO: 1670292 - RNA, 13 nt, Salmonella enterica enterica serovar Typhi
caaaauuaaucgc

SEQ ID NO: 1670293 - RNA, 21 nt, Salmonella enterica enterica serovar Typhi
caaaaucacgcacacgucuga

SEQ ID NO: 1670294 - RNA, 21 nt, Salmonella enterica enterica serovar Typhi
caaaaucgcccaggccugaug

SEQ ID NO: 1670295 - RNA, 18 nt, Salmonella enterica enterica serovar Typhi
caaaaucgcaaacgccag

SEQ ID NO: 1670296 - RNA, 17 nt, Salmonella enterica enterica serovar Typhi
caaaccggcgaauagcg

SEQ ID NO: 1670297 - RNA, 19 nt, Salmonella enterica enterica serovar Typhi
caaaccacgcugaggcgcc

SEQ ID NO: 1670298 - RNA, 14 nt, Salmonella enterica enterica serovar Typhi
caaaccaucgucgg

SEQ ID NO: 1670299 - RNA, 18 nt, Salmonella enterica enterica serovar Typhi
caaacggaauagcgccuu

SEQ ID NO: 1670300 - RNA, 16 nt, Salmonella enterica enterica serovar Typhi
caaacgcuggugcugu

SEQ ID NO: 1670301 - RNA, 16 nt, Salmonella enterica enterica serovar Typhi
caaacgccaccgccac

SEQ ID NO: 1670302 - RNA, 22 nt, Salmonella enterica enterica serovar Typhi
caaacucacguuccccagcacc

SEQ ID NO: 1670303 - RNA, 22 nt, Salmonella enterica enterica serovar Typhi
caaacucgcugccgaccuggcu

SEQ ID NO: 1670304 - RNA, 22 nt, Salmonella enterica enterica serovar Typhi
caaagucuuuuguauugcgcgu

SEQ ID NO: 1670305 - RNA, 16 nt, Salmonella enterica enterica serovar Typhi
caaauaguccagcauc

SEQ ID NO: 1670306 - RNA, 18 nt, Salmonella enterica enterica serovar Typhi
caaaggccuuauccggcc

SEQ ID NO: 1670307 - RNA, 15 nt, Salmonella enterica enterica serovar Typhi
caaaggccagcagca

SEQ ID NO: 1670308 - RNA, 20 nt, Salmonella enterica enterica serovar Typhi
caaaggaauuacgggcgaua

SEQ ID NO: 1670309 - RNA, 21 nt, Salmonella enterica enterica serovar Typhi
caacacaucgacaugcagauc

SEQ ID NO: 1670310 - RNA, 19 nt, Salmonella enterica enterica serovar Typhi
caacacuuagaacgcggaa

SEQ ID NO: 1670311 - RNA, 21 nt, Salmonella enterica enterica serovar Typhi
caacagaccgacgaugaccgg

SEQ ID NO: 1670312 - RNA, 13 nt, Salmonella enterica enterica serovar Typhi
caaauuccggcac

SEQ ID NO: 1670313 - RNA, 23 nt, Salmonella enterica enterica serovar Typhi
caaauuaaugugcguaaacaggc

SEQ ID NO: 1670314 - RNA, 14 nt, Salmonella enterica enterica serovar Typhi
auuuuucugcgcca

SEQ ID NO: 1670315 - RNA, 22 nt, Salmonella enterica enterica serovar Typhi
auuuuucauugcaagccgaccu

SEQ ID NO: 1670316 - RNA, 18 nt, Salmonella enterica enterica serovar Typhi
auuuuucucccagcagac

SEQ ID NO: 1670317 - RNA, 16 nt, Salmonella enterica enterica serovar Typhi
caaaaaaaaaccggca

SEQ ID NO: 1670318 - RNA, 16 nt, Salmonella enterica enterica serovar Typhi
auuuuuugcuggcggc

SEQ ID NO: 1670319 - RNA, 22 nt, Salmonella enterica enterica serovar Typhi
auuuuguggcggauacgcuucc

SEQ ID NO: 1670320 - RNA, 18 nt, Salmonella enterica enterica serovar Typhi
auuuugcaccaucaacgc

SEQ ID NO: 1670321 - RNA, 23 nt, Salmonella enterica enterica serovar Typhi
auuuugauaagagaaaauaccgc

SEQ ID NO: 1670322 - RNA, 16 nt, Salmonella enterica enterica serovar Typhi
caaaagugaucauggu

SEQ ID NO: 1670323 - RNA, 21 nt, Salmonella enterica enterica serovar Typhi
caaaagccggucguaaugagc

SEQ ID NO: 1670324 - RNA, 14 nt, Salmonella enterica enterica serovar Typhi
caaaacggaauguu

SEQ ID NO: 1670325 - RNA, 14 nt, Salmonella enterica enterica serovar Typhi
caaaaaugaucacu

SEQ ID NO: 1670326 - RNA, 21 nt, Salmonella enterica enterica serovar Typhi
caaaaacguuaggcgcaaagg

SEQ ID NO: 1670327 - RNA, 20 nt, Salmonella enterica enterica serovar Typhi
auuugaauaauucuguacca

SEQ ID NO: 1670328 - RNA, 15 nt, Salmonella enterica enterica serovar Typhi
auuucuuugucgcca

SEQ ID NO: 1670329 - RNA, 20 nt, Salmonella enterica enterica serovar Typhi
auuucuuacauuuuuaccga

SEQ ID NO: 1670330 - RNA, 18 nt, Salmonella enterica enterica serovar Typhi
auuugcccuuccagcagc

SEQ ID NO: 1670331 - RNA, 20 nt, Salmonella enterica enterica serovar Typhi
auuugucucuuacguugcau

SEQ ID NO: 1670332 - RNA, 17 nt, Salmonella enterica enterica serovar Typhi
auuuucaaugcacgcca

SEQ ID NO: 1670333 - RNA, 17 nt, Salmonella enterica enterica serovar Typhi
auuuucgauaaucgcgc

SEQ ID NO: 1670334 - RNA, 20 nt, Salmonella enterica enterica serovar Typhi
auuuucgcaaacugaucgag

SEQ ID NO: 1670335 - RNA, 16 nt, Salmonella enterica enterica serovar Typhi
auuuuccggcgacgcu

SEQ ID NO: 1670336 - RNA, 15 nt, Salmonella enterica enterica serovar Typhi
auuuuagcgcaucgc

SEQ ID NO: 1670337 - RNA, 20 nt, Salmonella enterica enterica serovar Typhi
auuguccacggggcggcaau

SEQ ID NO: 1670338 - RNA, 18 nt, Salmonella enterica enterica serovar Typhi
auugucaucauucgcgaa

SEQ ID NO: 1670339 - RNA, 14 nt, Salmonella enterica enterica serovar Typhi
auucgugauccacc

SEQ ID NO: 1670340 - RNA, 13 nt, Salmonella enterica enterica serovar Typhi
auucuaaggccgc

SEQ ID NO: 1670341 - RNA, 11 nt, Salmonella enterica enterica serovar Typhi
auucgcggcaa

SEQ ID NO: 1670342 - RNA, 20 nt, Salmonella enterica enterica serovar Typhi
auucgccuuucacgcguuca

SEQ ID NO: 1670343 - RNA, 15 nt, Salmonella enterica enterica serovar Typhi
auugcgccccagcac

SEQ ID NO: 1670344 - RNA, 17 nt, Salmonella enterica enterica serovar Typhi
auugcccgcggcgaucu

SEQ ID NO: 1670345 - RNA, 21 nt, Salmonella enterica enterica serovar Typhi
auugccgaccgccagcagagc

SEQ ID NO: 1670346 - RNA, 15 nt, Salmonella enterica enterica serovar Typhi
auugccacaauauca

SEQ ID NO: 1670347 - RNA, 13 nt, Salmonella enterica enterica serovar Typhi
auugcaucaucgg

SEQ ID NO: 1670348 - RNA, 23 nt, Salmonella enterica enterica serovar Typhi
auugccaugcgacuaaccugauc

SEQ ID NO: 1670349 - RNA, 19 nt, Salmonella enterica enterica serovar Typhi
auuucaaugcauacugccg

SEQ ID NO: 1670350 - RNA, 13 nt, Salmonella enterica enterica serovar Typhi
auuucaaucgcgc

SEQ ID NO: 1670351 - RNA, 14 nt, Salmonella enterica enterica serovar Typhi
auuucaaucgcgcc

SEQ ID NO: 1670352 - RNA, 14 nt, Salmonella enterica enterica serovar Typhi
auuucaaaacccgc

SEQ ID NO: 1670353 - RNA, 14 nt, Salmonella enterica enterica serovar Typhi
auuuaugccgccau

SEQ ID NO: 1670354 - RNA, 18 nt, Salmonella enterica enterica serovar Typhi
auuuaucuuccggcauca

SEQ ID NO: 1670355 - RNA, 23 nt, Salmonella enterica enterica serovar Typhi
auuuauccaccgccagacgcccc

SEQ ID NO: 1670356 - RNA, 14 nt, Salmonella enterica enterica serovar Typhi
auuuauccuccgaa

SEQ ID NO: 1670357 - RNA, 21 nt, Salmonella enterica enterica serovar Typhi
auuuacaaaugaccucaagaa

SEQ ID NO: 1670358 - RNA, 16 nt, Salmonella enterica enterica serovar Typhi
auuucggaaugagaga

SEQ ID NO: 1670359 - RNA, 19 nt, Salmonella enterica enterica serovar Typhi
auuucgcgaauaaucuguu

SEQ ID NO: 1670360 - RNA, 12 nt, Salmonella enterica enterica serovar Typhi
auuucgaucugu

SEQ ID NO: 1670361 - RNA, 13 nt, Salmonella enterica enterica serovar Typhi
auuucgccgccau

SEQ ID NO: 1670362 - RNA, 21 nt, Salmonella enterica enterica serovar Typhi
auuccgucaggaacggauaac

SEQ ID NO: 1670363 - RNA, 21 nt, Salmonella enterica enterica serovar Typhi
auuccgcuuucuucccggcag

SEQ ID NO: 1670364 - RNA, 20 nt, Salmonella enterica enterica serovar Typhi
auucgagauuuuucugcgcc

SEQ ID NO: 1670365 - RNA, 15 nt, Salmonella enterica enterica serovar Typhi
auucgccccagcaua

SEQ ID NO: 1670366 - RNA, 13 nt, Salmonella enterica enterica serovar Typhi
aaacucaacuggg

SEQ ID NO: 1670367 - RNA, 17 nt, Salmonella enterica enterica serovar Typhi
auuccgccaacgguaag

SEQ ID NO: 1670368 - RNA, 15 nt, Salmonella enterica enterica serovar Typhi
aaacugacugaugcu

SEQ ID NO: 1670369 - RNA, 14 nt, Salmonella enterica enterica serovar Typhi
auucagcagcgccc

SEQ ID NO: 1670370 - RNA, 20 nt, Salmonella enterica enterica serovar Typhi
auucagcugcggcugaacca

SEQ ID NO: 1670371 - RNA, 22 nt, Salmonella enterica enterica serovar Typhi
auuccagauagcgcugcgccag

SEQ ID NO: 1670372 - RNA, 12 nt, Salmonella enterica enterica serovar Typhi
auuccaccacgu

SEQ ID NO: 1670373 - RNA, 22 nt, Salmonella enterica enterica serovar Typhi
auucccacgcauaguccugccg

SEQ ID NO: 1670374 - RNA, 21 nt, Salmonella enterica enterica serovar Typhi
auuacucguccuucacguuau

SEQ ID NO: 1670375 - RNA, 12 nt, Salmonella enterica enterica serovar Typhi
auuaccgcaucg

SEQ ID NO: 1670376 - RNA, 17 nt, Salmonella enterica enterica serovar Typhi
auucaccaaauccucac

SEQ ID NO: 1670377 - RNA, 16 nt, Salmonella enterica enterica serovar Typhi
auuaugcggaccgaua

SEQ ID NO: 1670378 - RNA, 16 nt, Salmonella enterica enterica serovar Typhi
auuaucguccggcauc

SEQ ID NO: 1670379 - RNA, 17 nt, Salmonella enterica enterica serovar Typhi
auuaucguuuacguuau

SEQ ID NO: 1670380 - RNA, 16 nt, Salmonella enterica enterica serovar Typhi
auuacagauauccacc

SEQ ID NO: 1670381 - RNA, 21 nt, Salmonella enterica enterica serovar Typhi
auuacaacgccugaugacgcu

SEQ ID NO: 1670382 - RNA, 10 nt, Salmonella enterica enterica serovar Typhi
auuaccagua

SEQ ID NO: 1670383 - RNA, 12 nt, Salmonella enterica enterica serovar Typhi
auuaaucgccag

SEQ ID NO: 1670384 - RNA, 16 nt, Salmonella enterica enterica serovar Typhi
auuaaucccgccaucg

SEQ ID NO: 1670385 - RNA, 18 nt, Salmonella enterica enterica serovar Typhi
aggguuuucuaccgcagc

SEQ ID NO: 1670386 - RNA, 17 nt, Salmonella enterica enterica serovar Typhi
agggcauucauuguccg

SEQ ID NO: 1670387 - RNA, 22 nt, Salmonella enterica enterica serovar Typhi
agggcggaagcagauaccagcc

SEQ ID NO: 1670388 - RNA, 22 nt, Salmonella enterica enterica serovar Typhi
agggaggugcucucccagcuga

SEQ ID NO: 1670389 - RNA, 21 nt, Salmonella enterica enterica serovar Typhi
aggcuggagagcaacgccauc

SEQ ID NO: 1670390 - RNA, 21 nt, Salmonella enterica enterica serovar Typhi
agggaaaaauguguugcggcc

SEQ ID NO: 1670391 - RNA, 20 nt, Salmonella enterica enterica serovar Typhi
aggcguuagcggcgauucug

SEQ ID NO: 1670392 - RNA, 22 nt, Salmonella enterica enterica serovar Typhi
aggcguuaaggcaucucuggcg

SEQ ID NO: 1670393 - RNA, 16 nt, Salmonella enterica enterica serovar Typhi
aggccgccaccgccuc

SEQ ID NO: 1670394 - RNA, 17 nt, Salmonella enterica enterica serovar Typhi
aggcgucgaccggucca

SEQ ID NO: 1670395 - RNA, 14 nt, Salmonella enterica enterica serovar Typhi
aggccgccaaugac

SEQ ID NO: 1670396 - RNA, 15 nt, Salmonella enterica enterica serovar Typhi
aggucugcaccacgg

SEQ ID NO: 1670397 - RNA, 14 nt, Salmonella enterica enterica serovar Typhi
agguacauugccag

SEQ ID NO: 1670398 - RNA, 16 nt, Salmonella enterica enterica serovar Typhi
aggucgcuauccagca

SEQ ID NO: 1670399 - RNA, 18 nt, Salmonella enterica enterica serovar Typhi
agguauccgccauauccc

SEQ ID NO: 1670400 - RNA, 23 nt, Salmonella enterica enterica serovar Typhi
agguaucccgccagcggcgccau

SEQ ID NO: 1670401 - RNA, 17 nt, Salmonella enterica enterica serovar Typhi
aggucgcgauccgcgag

SEQ ID NO: 1670402 - RNA, 15 nt, Salmonella enterica enterica serovar Typhi
aguaauuccauuagc

SEQ ID NO: 1670403 - RNA, 18 nt, Salmonella enterica enterica serovar Typhi
aguacgagcauccagauc

SEQ ID NO: 1670404 - RNA, 23 nt, Salmonella enterica enterica serovar Typhi
aguaccugcccggcaacgggcaa

SEQ ID NO: 1670405 - RNA, 20 nt, Salmonella enterica enterica serovar Typhi
aggugucgaugagcucguua

SEQ ID NO: 1670406 - RNA, 22 nt, Salmonella enterica enterica serovar Typhi
agguuauaaacccccuggccgg

SEQ ID NO: 1670407 - RNA, 15 nt, Salmonella enterica enterica serovar Typhi
agguuauauuccgcc

SEQ ID NO: 1670408 - RNA, 16 nt, Salmonella enterica enterica serovar Typhi
agguuauccgccggag

SEQ ID NO: 1670409 - RNA, 17 nt, Salmonella enterica enterica serovar Typhi
agguugaaaggccuaaa

SEQ ID NO: 1670410 - RNA, 17 nt, Salmonella enterica enterica serovar Typhi
agguucccgccgccauu

SEQ ID NO: 1670411 - RNA, 17 nt, Salmonella enterica enterica serovar Typhi
agucccgggcuaaucgc

SEQ ID NO: 1670412 - RNA, 18 nt, Salmonella enterica enterica serovar Typhi
agucccuggcgcgccagc

SEQ ID NO: 1670413 - RNA, 17 nt, Salmonella enterica enterica serovar Typhi
aguagcugagcgucagg

SEQ ID NO: 1670414 - RNA, 18 nt, Salmonella enterica enterica serovar Typhi
aguagcguucuuuccagu

SEQ ID NO: 1670415 - RNA, 16 nt, Salmonella enterica enterica serovar Typhi
aguagccugccagcaa

SEQ ID NO: 1670416 - RNA, 19 nt, Salmonella enterica enterica serovar Typhi
agucauuaauucccgcagc

SEQ ID NO: 1670417 - RNA, 17 nt, Salmonella enterica enterica serovar Typhi
agucauauuaucgcgcu

SEQ ID NO: 1670418 - RNA, 17 nt, Salmonella enterica enterica serovar Typhi
agucagcgcgagcguga

SEQ ID NO: 1670419 - RNA, 16 nt, Salmonella enterica enterica serovar Typhi
aguccugcgucgcuuc

SEQ ID NO: 1670420 - RNA, 17 nt, Salmonella enterica enterica serovar Typhi
aguccugucccugccag

SEQ ID NO: 1670421 - RNA, 19 nt, Salmonella enterica enterica serovar Typhi
agucgagggugauuuccgc

SEQ ID NO: 1670422 - RNA, 19 nt, Salmonella enterica enterica serovar Typhi
aguccgccgucgucaccgc

SEQ ID NO: 1670423 - RNA, 19 nt, Salmonella enterica enterica serovar Typhi
aguccgucguuaaucagcg

SEQ ID NO: 1670424 - RNA, 21 nt, Salmonella enterica enterica serovar Typhi
aguccgucguuaaucagcgcg

SEQ ID NO: 1670425 - RNA, 13 nt, Salmonella enterica enterica serovar Typhi
agucgccaggauc

SEQ ID NO: 1670426 - RNA, 16 nt, Salmonella enterica enterica serovar Typhi
agucgcaucauggcga

SEQ ID NO: 1670427 - RNA, 14 nt, Salmonella enterica enterica serovar Typhi
agucgauacgcuga

SEQ ID NO: 1670428 - RNA, 21 nt, Salmonella enterica enterica serovar Typhi
agugcccguuugcgagacggc

SEQ ID NO: 1670429 - RNA, 15 nt, Salmonella enterica enterica serovar Typhi
agugccgccaggcaa

SEQ ID NO: 1670430 - RNA, 14 nt, Salmonella enterica enterica serovar Typhi
aguguuagcgucag

SEQ ID NO: 1670431 - RNA, 12 nt, Salmonella enterica enterica serovar Typhi
aguguuuccggc

SEQ ID NO: 1670432 - RNA, 16 nt, Salmonella enterica enterica serovar Typhi
aguguuuaagcgucag

SEQ ID NO: 1670433 - RNA, 17 nt, Salmonella enterica enterica serovar Typhi
aguuaacuucuccgcca

SEQ ID NO: 1670434 - RNA, 24 nt, Salmonella enterica enterica serovar Typhi
aguuaccguaaucaucgcgaucgc

SEQ ID NO: 1670435 - RNA, 19 nt, Salmonella enterica enterica serovar Typhi
agugaucccccagaaucgg

SEQ ID NO: 1670436 - RNA, 21 nt, Salmonella enterica enterica serovar Typhi
agucgguuaugcauugcugau

SEQ ID NO: 1670437 - RNA, 24 nt, Salmonella enterica enterica serovar Typhi
auaaacaucagcgcggacacgaua

SEQ ID NO: 1670438 - RNA, 17 nt, Salmonella enterica enterica serovar Typhi
auaaaccuucguaauag

SEQ ID NO: 1670439 - RNA, 16 nt, Salmonella enterica enterica serovar Typhi
auaaaccaaagcagag

SEQ ID NO: 1670440 - RNA, 16 nt, Salmonella enterica enterica serovar Typhi
auaaacgcugcgcaac

SEQ ID NO: 1670441 - RNA, 18 nt, Salmonella enterica enterica serovar Typhi
auaaauaggcgccgccga

SEQ ID NO: 1670442 - RNA, 14 nt, Salmonella enterica enterica serovar Typhi
auaaauaaugccgu

SEQ ID NO: 1670443 - RNA, 16 nt, Salmonella enterica enterica serovar Typhi
auaaagcuucugcgcc

SEQ ID NO: 1670444 - RNA, 20 nt, Salmonella enterica enterica serovar Typhi
auaaagcgcucaugccacgc

SEQ ID NO: 1670445 - RNA, 19 nt, Salmonella enterica enterica serovar Typhi
auaaaggccggcagccgcu

SEQ ID NO: 1670446 - RNA, 22 nt, Salmonella enterica enterica serovar Typhi
aguuggaaccaaacaccagauc

SEQ ID NO: 1670447 - RNA, 16 nt, Salmonella enterica enterica serovar Typhi
aguugguucccagcac

SEQ ID NO: 1670448 - RNA, 16 nt, Salmonella enterica enterica serovar Typhi
aguuagcgaucgcgcc

SEQ ID NO: 1670449 - RNA, 18 nt, Salmonella enterica enterica serovar Typhi
auaagcgcagcgccauca

SEQ ID NO: 1670450 - RNA, 22 nt, Salmonella enterica enterica serovar Typhi
auaagcgaauugccgucgccgg

SEQ ID NO: 1670451 - RNA, 15 nt, Salmonella enterica enterica serovar Typhi
auaagcucaacgaua

SEQ ID NO: 1670452 - RNA, 19 nt, Salmonella enterica enterica serovar Typhi
auaagcggcagcgccaucc

SEQ ID NO: 1670453 - RNA, 17 nt, Salmonella enterica enterica serovar Typhi
auaagcgugcgccaucc

SEQ ID NO: 1670454 - RNA, 20 nt, Salmonella enterica enterica serovar Typhi
auaaauucugucucaauaaa

SEQ ID NO: 1670455 - RNA, 20 nt, Salmonella enterica enterica serovar Typhi
auaaggccugccguccugau

SEQ ID NO: 1670456 - RNA, 21 nt, Salmonella enterica enterica serovar Typhi
auaaucgcgauacugccgccc

SEQ ID NO: 1670457 - RNA, 23 nt, Salmonella enterica enterica serovar Typhi
auaaugcgccccgcaacgccgau

SEQ ID NO: 1670458 - RNA, 23 nt, Salmonella enterica enterica serovar Typhi
auaaucuaccauugauaccaaua

SEQ ID NO: 1670459 - RNA, 14 nt, Salmonella enterica enterica serovar Typhi
auaaucggcgucau

SEQ ID NO: 1670460 - RNA, 17 nt, Salmonella enterica enterica serovar Typhi
auaaugaauacgcucca

SEQ ID NO: 1670461 - RNA, 13 nt, Salmonella enterica enterica serovar Typhi
auacaccgcaucc

SEQ ID NO: 1670462 - RNA, 18 nt, Salmonella enterica enterica serovar Typhi
auacaagguauccgccau

SEQ ID NO: 1670463 - RNA, 23 nt, Salmonella enterica enterica serovar Typhi
auaauguuuacuccauucccagc

SEQ ID NO: 1670464 - RNA, 17 nt, Salmonella enterica enterica serovar Typhi
auagcguagcgccaucc

SEQ ID NO: 1670465 - RNA, 17 nt, Salmonella enterica enterica serovar Typhi
auagcuucaaugaucca

SEQ ID NO: 1670466 - RNA, 18 nt, Salmonella enterica enterica serovar Typhi
auaccagcgaaaugcgaa

SEQ ID NO: 1670467 - RNA, 23 nt, Salmonella enterica enterica serovar Typhi
auaccacgcccgccgccagcauu

SEQ ID NO: 1670468 - RNA, 17 nt, Salmonella enterica enterica serovar Typhi
auaccacgcagcggcau

SEQ ID NO: 1670469 - RNA, 20 nt, Salmonella enterica enterica serovar Typhi
auaccacccgcuaugaagac

SEQ ID NO: 1670470 - RNA, 11 nt, Salmonella enterica enterica serovar Typhi
auacagcacgg

SEQ ID NO: 1670471 - RNA, 18 nt, Salmonella enterica enterica serovar Typhi
auacagcggcgcgccaau

SEQ ID NO: 1670472 - RNA, 14 nt, Salmonella enterica enterica serovar Typhi
auacagagucgcuu

SEQ ID NO: 1670473 - RNA, 20 nt, Salmonella enterica enterica serovar Typhi
auagucgucuauuuccgcuu

SEQ ID NO: 1670474 - RNA, 23 nt, Salmonella enterica enterica serovar Typhi
auaggugccgccgcacagaaucg

SEQ ID NO: 1670475 - RNA, 19 nt, Salmonella enterica enterica serovar Typhi
auaguggaacgucaggccg

SEQ ID NO: 1670476 - RNA, 17 nt, Salmonella enterica enterica serovar Typhi
auagucguugcgccgua

SEQ ID NO: 1670477 - RNA, 18 nt, Salmonella enterica enterica serovar Typhi
auagugacgccgccaucc

SEQ ID NO: 1670478 - RNA, 22 nt, Salmonella enterica enterica serovar Typhi
auauaguugagccauuccagcg

SEQ ID NO: 1670479 - RNA, 13 nt, Salmonella enterica enterica serovar Typhi
auauccaggagca

SEQ ID NO: 1670480 - RNA, 13 nt, Salmonella enterica enterica serovar Typhi
auauccagcacgc

SEQ ID NO: 1670481 - RNA, 13 nt, Salmonella enterica enterica serovar Typhi
auaucaucgucau

SEQ ID NO: 1670482 - RNA, 22 nt, Salmonella enterica enterica serovar Typhi
auaucagggcuuuuuucucgcg

SEQ ID NO: 1670483 - RNA, 21 nt, Salmonella enterica enterica serovar Typhi
auaucagccccacggcaaauu

SEQ ID NO: 1670484 - RNA, 18 nt, Salmonella enterica enterica serovar Typhi
auauauuucacuucauca

SEQ ID NO: 1670485 - RNA, 16 nt, Salmonella enterica enterica serovar Typhi
auauccaguugcgcca

SEQ ID NO: 1670486 - RNA, 23 nt, Salmonella enterica enterica serovar Typhi
auauucaguacugacgcaaucug

SEQ ID NO: 1670487 - RNA, 16 nt, Salmonella enterica enterica serovar Typhi
auauuccgcgcuaucg

SEQ ID NO: 1670488 - RNA, 19 nt, Salmonella enterica enterica serovar Typhi
auauugcgcuuaccaggua

SEQ ID NO: 1670489 - RNA, 17 nt, Salmonella enterica enterica serovar Typhi
auauugauggccacauc

SEQ ID NO: 1670490 - RNA, 23 nt, Salmonella enterica enterica serovar Typhi
auauucgcgaugcucaaccagua

SEQ ID NO: 1670491 - RNA, 14 nt, Salmonella enterica enterica serovar Typhi
auauucgggcgcau

SEQ ID NO: 1670492 - RNA, 14 nt, Salmonella enterica enterica serovar Typhi
aucaacgccgccag

SEQ ID NO: 1670493 - RNA, 16 nt, Salmonella enterica enterica serovar Typhi
aucaaacauagagauc

SEQ ID NO: 1670494 - RNA, 20 nt, Salmonella enterica enterica serovar Typhi
auauugcugugcuaugauaa

SEQ ID NO: 1670495 - RNA, 14 nt, Salmonella enterica enterica serovar Typhi
auauuggcguuaga

SEQ ID NO: 1670496 - RNA, 15 nt, Salmonella enterica enterica serovar Typhi
aucaaaagugaucau

SEQ ID NO: 1670497 - RNA, 20 nt, Salmonella enterica enterica serovar Typhi
auauuuuuacgucccgguaa

SEQ ID NO: 1670498 - RNA, 22 nt, Salmonella enterica enterica serovar Typhi
aucaauaaaaucaccgcggcaa

SEQ ID NO: 1670499 - RNA, 20 nt, Salmonella enterica enterica serovar Typhi
aucaccgcccaaugccccca

SEQ ID NO: 1670500 - RNA, 22 nt, Salmonella enterica enterica serovar Typhi
aucacgccacaguauuccggca

SEQ ID NO: 1670501 - RNA, 14 nt, Salmonella enterica enterica serovar Typhi
aucacuuccgccac

SEQ ID NO: 1670502 - RNA, 16 nt, Salmonella enterica enterica serovar Typhi
aucacuuccgccacca

SEQ ID NO: 1670503 - RNA, 13 nt, Salmonella enterica enterica serovar Typhi
aucacuuuuggcg

SEQ ID NO: 1670504 - RNA, 23 nt, Salmonella enterica enterica serovar Typhi
aucagaacaaacuuaucccacaa

SEQ ID NO: 1670505 - RNA, 23 nt, Salmonella enterica enterica serovar Typhi
aucacggccuucgcagaucgccu

SEQ ID NO: 1670506 - RNA, 18 nt, Salmonella enterica enterica serovar Typhi
aucacgcucaucggcggc

SEQ ID NO: 1670507 - RNA, 23 nt, Salmonella enterica enterica serovar Typhi
aucacgcugaaaacggcaucaag

SEQ ID NO: 1670508 - RNA, 16 nt, Salmonella enterica enterica serovar Typhi
aucagaccgugaauaa

SEQ ID NO: 1670509 - RNA, 22 nt, Salmonella enterica enterica serovar Typhi
aucagaccaucggccgcuaucu

SEQ ID NO: 1670510 - RNA, 14 nt, Salmonella enterica enterica serovar Typhi
aucagacgcaucag

SEQ ID NO: 1670511 - RNA, 18 nt, Salmonella enterica enterica serovar Typhi
aucagccagcaucgcuaa

SEQ ID NO: 1670512 - RNA, 17 nt, Salmonella enterica enterica serovar Typhi
aucagccauuaaccaga

SEQ ID NO: 1670513 - RNA, 17 nt, Salmonella enterica enterica serovar Typhi
aucauccccggcaggcu

SEQ ID NO: 1670514 - RNA, 17 nt, Salmonella enterica enterica serovar Typhi
aucaucaggguuauccu

SEQ ID NO: 1670515 - RNA, 15 nt, Salmonella enterica enterica serovar Typhi
aucaucacgaucgag

SEQ ID NO: 1670516 - RNA, 23 nt, Salmonella enterica enterica serovar Typhi
aucaugcccacaggcagggcgau

SEQ ID NO: 1670517 - RNA, 22 nt, Salmonella enterica enterica serovar Typhi
aucaugauuucuugagcggcau

SEQ ID NO: 1670518 - RNA, 20 nt, Salmonella enterica enterica serovar Typhi
aucaucucugucgaccaucg

SEQ ID NO: 1670519 - RNA, 20 nt, Salmonella enterica enterica serovar Typhi
aucauaaacgccugacgaua

SEQ ID NO: 1670520 - RNA, 20 nt, Salmonella enterica enterica serovar Typhi
aucaguuuaaccguuccaac

SEQ ID NO: 1670521 - RNA, 21 nt, Salmonella enterica enterica serovar Typhi
aucagugaccugaacauacuu

SEQ ID NO: 1670522 - RNA, 18 nt, Salmonella enterica enterica serovar Typhi
aucagucucaaaggccug

SEQ ID NO: 1670523 - RNA, 13 nt, Salmonella enterica enterica serovar Typhi
aucaggucgcuaa

SEQ ID NO: 1670524 - RNA, 17 nt, Salmonella enterica enterica serovar Typhi
aucaggucaugcgcgag

SEQ ID NO: 1670525 - RNA, 13 nt, Salmonella enterica enterica serovar Typhi
auccgcacggcgg

SEQ ID NO: 1670526 - RNA, 16 nt, Salmonella enterica enterica serovar Typhi
auccgcagauccagca

SEQ ID NO: 1670527 - RNA, 19 nt, Salmonella enterica enterica serovar Typhi
auccgccagugaauccacc

SEQ ID NO: 1670528 - RNA, 16 nt, Salmonella enterica enterica serovar Typhi
auccgccagccgccau

SEQ ID NO: 1670529 - RNA, 20 nt, Salmonella enterica enterica serovar Typhi
auccgccaguuuguaaccaa

SEQ ID NO: 1670530 - RNA, 19 nt, Salmonella enterica enterica serovar Typhi
auccgccgagggcauugau

SEQ ID NO: 1670531 - RNA, 19 nt, Salmonella enterica enterica serovar Typhi
auccgccgcccagcgggua

SEQ ID NO: 1670532 - RNA, 20 nt, Salmonella enterica enterica serovar Typhi
auccgcgccgccgccgaagg

SEQ ID NO: 1670533 - RNA, 15 nt, Salmonella enterica enterica serovar Typhi
auccggcauuaccgc

SEQ ID NO: 1670534 - RNA, 21 nt, Salmonella enterica enterica serovar Typhi
auccggcgcgguauuucgccg

SEQ ID NO: 1670535 - RNA, 13 nt, Salmonella enterica enterica serovar Typhi
auccggcggcguc

SEQ ID NO: 1670536 - RNA, 17 nt, Salmonella enterica enterica serovar Typhi
auccgcguaaucgcgaa

SEQ ID NO: 1670537 - RNA, 16 nt, Salmonella enterica enterica serovar Typhi
auccggauauucugca

SEQ ID NO: 1670538 - RNA, 20 nt, Salmonella enterica enterica serovar Typhi
auccggcaacaaaacuaccg

SEQ ID NO: 1670539 - RNA, 15 nt, Salmonella enterica enterica serovar Typhi
auccggcaacugccg

SEQ ID NO: 1670540 - RNA, 23 nt, Salmonella enterica enterica serovar Typhi
auccggacgauaaccaugcucag

SEQ ID NO: 1670541 - RNA, 19 nt, Salmonella enterica enterica serovar Typhi
auccgucaaaaugaucaga

SEQ ID NO: 1670542 - RNA, 18 nt, Salmonella enterica enterica serovar Typhi
auccgugaauguccugcg

SEQ ID NO: 1670543 - RNA, 21 nt, Salmonella enterica enterica serovar Typhi
auccgguaaacgcuccggcag

SEQ ID NO: 1670544 - RNA, 14 nt, Salmonella enterica enterica serovar Typhi
auccgggcuggcaa

SEQ ID NO: 1670545 - RNA, 17 nt, Salmonella enterica enterica serovar Typhi
auccugcaggguaauua

SEQ ID NO: 1670546 - RNA, 12 nt, Salmonella enterica enterica serovar Typhi
auccugaagaug

SEQ ID NO: 1670547 - RNA, 15 nt, Salmonella enterica enterica serovar Typhi
auccugacaggccgg

SEQ ID NO: 1670548 - RNA, 18 nt, Salmonella enterica enterica serovar Typhi
auccuuuaauuaauccau

SEQ ID NO: 1670549 - RNA, 18 nt, Salmonella enterica enterica serovar Typhi
auccuguuaaucaucgcu

SEQ ID NO: 1670550 - RNA, 11 nt, Salmonella enterica enterica serovar Typhi
auccagccagg

SEQ ID NO: 1670551 - RNA, 18 nt, Salmonella enterica enterica serovar Typhi
auccagaucggcaugaug

SEQ ID NO: 1670552 - RNA, 16 nt, Salmonella enterica enterica serovar Typhi
auccagacaugcacau

SEQ ID NO: 1670553 - RNA, 17 nt, Salmonella enterica enterica serovar Typhi
auccagcuacuggccac

SEQ ID NO: 1670554 - RNA, 16 nt, Salmonella enterica enterica serovar Typhi
auccaggucuuccgcc

SEQ ID NO: 1670555 - RNA, 19 nt, Salmonella enterica enterica serovar Typhi
auccagguggaucggaaau

SEQ ID NO: 1670556 - RNA, 20 nt, Salmonella enterica enterica serovar Typhi
auccagcgaaccuuccaucg

SEQ ID NO: 1670557 - RNA, 19 nt, Salmonella enterica enterica serovar Typhi
aucaugcugcaccgcauca

SEQ ID NO: 1670558 - RNA, 14 nt, Salmonella enterica enterica serovar Typhi
aucauggcgaaucc

SEQ ID NO: 1670559 - RNA, 20 nt, Salmonella enterica enterica serovar Typhi
aucauguuccggcagacggc

SEQ ID NO: 1670560 - RNA, 19 nt, Salmonella enterica enterica serovar Typhi
aucauuaauuuacugauaa

SEQ ID NO: 1670561 - RNA, 23 nt, Salmonella enterica enterica serovar Typhi
aucauugccuguaucgcuauccg

SEQ ID NO: 1670562 - RNA, 19 nt, Salmonella enterica enterica serovar Typhi
aucauuuuuuuggcuucug

SEQ ID NO: 1670563 - RNA, 19 nt, Salmonella enterica enterica serovar Typhi
aucauuggauuaacggcaa

SEQ ID NO: 1670564 - RNA, 23 nt, Salmonella enterica enterica serovar Typhi
aucccgcugugauccauguugcc

SEQ ID NO: 1670565 - RNA, 19 nt, Salmonella enterica enterica serovar Typhi
aucccgccagcggcgccau

SEQ ID NO: 1670566 - RNA, 14 nt, Salmonella enterica enterica serovar Typhi
aucccgcaggcggc

SEQ ID NO: 1670567 - RNA, 23 nt, Salmonella enterica enterica serovar Typhi
aucccgaccaguuuuugcgccag

SEQ ID NO: 1670568 - RNA, 20 nt, Salmonella enterica enterica serovar Typhi
aucccgguauuccguuccuu

SEQ ID NO: 1670569 - RNA, 15 nt, Salmonella enterica enterica serovar Typhi
aucccggcguagcgc

SEQ ID NO: 1670570 - RNA, 19 nt, Salmonella enterica enterica serovar Typhi
auccauugcgccacggaug

SEQ ID NO: 1670571 - RNA, 19 nt, Salmonella enterica enterica serovar Typhi
auccaugauggcguaaucc

SEQ ID NO: 1670572 - RNA, 20 nt, Salmonella enterica enterica serovar Typhi
aucccacuccaucgccugau

SEQ ID NO: 1670573 - RNA, 17 nt, Salmonella enterica enterica serovar Typhi
auccccagcgcuccacc

SEQ ID NO: 1670574 - RNA, 16 nt, Salmonella enterica enterica serovar Typhi
aucccccaacgucacc

SEQ ID NO: 1670575 - RNA, 12 nt, Salmonella enterica enterica serovar Typhi
agcgacugauaa

SEQ ID NO: 1670576 - RNA, 20 nt, Salmonella enterica enterica serovar Typhi
agcgaccuguagaugaaacu

SEQ ID NO: 1670577 - RNA, 16 nt, Salmonella enterica enterica serovar Typhi
agcgcaacgcgcauca

SEQ ID NO: 1670578 - RNA, 20 nt, Salmonella enterica enterica serovar Typhi
agcgcagagugaccagcggu

SEQ ID NO: 1670579 - RNA, 17 nt, Salmonella enterica enterica serovar Typhi
agcgaugagcgccagca

SEQ ID NO: 1670580 - RNA, 21 nt, Salmonella enterica enterica serovar Typhi
agcgauuucgacaucuuggcg

SEQ ID NO: 1670581 - RNA, 17 nt, Salmonella enterica enterica serovar Typhi
agcgauuacgccagaca

SEQ ID NO: 1670582 - RNA, 22 nt, Salmonella enterica enterica serovar Typhi
agcgauauagcgcauagcggcc

SEQ ID NO: 1670583 - RNA, 16 nt, Salmonella enterica enterica serovar Typhi
agcgauauagcgcaua

SEQ ID NO: 1670584 - RNA, 16 nt, Salmonella enterica enterica serovar Typhi
agcgaucacgccgucc

SEQ ID NO: 1670585 - RNA, 19 nt, Salmonella enterica enterica serovar Typhi
agcgccagcccugcgauca

SEQ ID NO: 1670586 - RNA, 23 nt, Salmonella enterica enterica serovar Typhi
agcgccauggagaaacaggccgc

SEQ ID NO: 1670587 - RNA, 19 nt, Salmonella enterica enterica serovar Typhi
agcgccggcagcaguucuu

SEQ ID NO: 1670588 - RNA, 18 nt, Salmonella enterica enterica serovar Typhi
agcgcauguucuucgucg

SEQ ID NO: 1670589 - RNA, 18 nt, Salmonella enterica enterica serovar Typhi
agcgcauuuuacugccgu

SEQ ID NO: 1670590 - RNA, 22 nt, Salmonella enterica enterica serovar Typhi
agcgccaccaaagccaggccgc

SEQ ID NO: 1670591 - RNA, 14 nt, Salmonella enterica enterica serovar Typhi
agcgcauccggcca

SEQ ID NO: 1670592 - RNA, 15 nt, Salmonella enterica enterica serovar Typhi
agcgcauccgguaaa

SEQ ID NO: 1670593 - RNA, 22 nt, Salmonella enterica enterica serovar Typhi
agcgcauacgcuguccagucaa

SEQ ID NO: 1670594 - RNA, 21 nt, Salmonella enterica enterica serovar Typhi
agccugauggcgcuacgcuua

SEQ ID NO: 1670595 - RNA, 22 nt, Salmonella enterica enterica serovar Typhi
agccuucuccccuucaucagua

SEQ ID NO: 1670596 - RNA, 12 nt, Salmonella enterica enterica serovar Typhi
agccuugcaucu

SEQ ID NO: 1670597 - RNA, 18 nt, Salmonella enterica enterica serovar Typhi
agccuaccugccgccaua

SEQ ID NO: 1670598 - RNA, 14 nt, Salmonella enterica enterica serovar Typhi
agccucgcgcaucc

SEQ ID NO: 1670599 - RNA, 22 nt, Salmonella enterica enterica serovar Typhi
agccgugaauggucacauucug

SEQ ID NO: 1670600 - RNA, 21 nt, Salmonella enterica enterica serovar Typhi
agccggaaaucaauuccgguu

SEQ ID NO: 1670601 - RNA, 19 nt, Salmonella enterica enterica serovar Typhi
agccggauguaggccugau

SEQ ID NO: 1670602 - RNA, 20 nt, Salmonella enterica enterica serovar Typhi
agccggauaagcguagcgcc

SEQ ID NO: 1670603 - RNA, 16 nt, Salmonella enterica enterica serovar Typhi
agccggauaagccgcg

SEQ ID NO: 1670604 - RNA, 23 nt, Salmonella enterica enterica serovar Typhi
agccgcuuuccgccgccgccauc

SEQ ID NO: 1670605 - RNA, 14 nt, Salmonella enterica enterica serovar Typhi
agcccuuccaccag

SEQ ID NO: 1670606 - RNA, 15 nt, Salmonella enterica enterica serovar Typhi
agccgccauccggca

SEQ ID NO: 1670607 - RNA, 21 nt, Salmonella enterica enterica serovar Typhi
agccgcccugcggacaggcga

SEQ ID NO: 1670608 - RNA, 15 nt, Salmonella enterica enterica serovar Typhi
agccgcgcagcgcaa

SEQ ID NO: 1670609 - RNA, 20 nt, Salmonella enterica enterica serovar Typhi
agccauuccccacgccaucg

SEQ ID NO: 1670610 - RNA, 13 nt, Salmonella enterica enterica serovar Typhi
agccauugccgcg

SEQ ID NO: 1670611 - RNA, 17 nt, Salmonella enterica enterica serovar Typhi
agccaucuucugcguca

SEQ ID NO: 1670612 - RNA, 17 nt, Salmonella enterica enterica serovar Typhi
agccaugccauauggcc

SEQ ID NO: 1670613 - RNA, 23 nt, Salmonella enterica enterica serovar Typhi
agccccccuuugcauuacggcga

SEQ ID NO: 1670614 - RNA, 13 nt, Salmonella enterica enterica serovar Typhi
agccccaggccgg

SEQ ID NO: 1670615 - RNA, 15 nt, Salmonella enterica enterica serovar Typhi
agccccagcgccagc

SEQ ID NO: 1670616 - RNA, 14 nt, Salmonella enterica enterica serovar Typhi
agccccgaugucgc

SEQ ID NO: 1670617 - RNA, 17 nt, Salmonella enterica enterica serovar Typhi
agccaaaauuuucaaua

SEQ ID NO: 1670618 - RNA, 13 nt, Salmonella enterica enterica serovar Typhi
agccaaucagccc

SEQ ID NO: 1670619 - RNA, 15 nt, Salmonella enterica enterica serovar Typhi
agccaauccagaaua

SEQ ID NO: 1670620 - RNA, 21 nt, Salmonella enterica enterica serovar Typhi
agcauauucaccagagcauca

SEQ ID NO: 1670621 - RNA, 16 nt, Salmonella enterica enterica serovar Typhi
agcauaucaaacugaa

SEQ ID NO: 1670622 - RNA, 15 nt, Salmonella enterica enterica serovar Typhi
agccacguugcgcgc

SEQ ID NO: 1670623 - RNA, 14 nt, Salmonella enterica enterica serovar Typhi
agccacucacggca

SEQ ID NO: 1670624 - RNA, 20 nt, Salmonella enterica enterica serovar Typhi
agccagcccuaaggucacgc

SEQ ID NO: 1670625 - RNA, 15 nt, Salmonella enterica enterica serovar Typhi
agccagcgcagucaa

SEQ ID NO: 1670626 - RNA, 10 nt, Salmonella enterica enterica serovar Typhi
agcaggcggg

SEQ ID NO: 1670627 - RNA, 16 nt, Salmonella enterica enterica serovar Typhi
agcauaauauccugca

SEQ ID NO: 1670628 - RNA, 16 nt, Salmonella enterica enterica serovar Typhi
agcauacgacaucgcc

SEQ ID NO: 1670629 - RNA, 21 nt, Salmonella enterica enterica serovar Typhi
agauuugaacgucgcgugcga

SEQ ID NO: 1670630 - RNA, 20 nt, Salmonella enterica enterica serovar Typhi
agauuuucaucauaucugau

SEQ ID NO: 1670631 - RNA, 19 nt, Salmonella enterica enterica serovar Typhi
agauuggcccgcccagcau

SEQ ID NO: 1670632 - RNA, 19 nt, Salmonella enterica enterica serovar Typhi
agauuaugcaguucuucgc

SEQ ID NO: 1670633 - RNA, 18 nt, Salmonella enterica enterica serovar Typhi
agauuagguacguacauc

SEQ ID NO: 1670634 - RNA, 19 nt, Salmonella enterica enterica serovar Typhi
aggcaauauccuccggcgu

SEQ ID NO: 1670635 - RNA, 17 nt, Salmonella enterica enterica serovar Typhi
aggcaacugauccugcg

SEQ ID NO: 1670636 - RNA, 19 nt, Salmonella enterica enterica serovar Typhi
aggcaagcugguaaaugcg

SEQ ID NO: 1670637 - RNA, 17 nt, Salmonella enterica enterica serovar Typhi
aggcaacggcccgaagg

SEQ ID NO: 1670638 - RNA, 17 nt, Salmonella enterica enterica serovar Typhi
aggcaacgacccgaagg

SEQ ID NO: 1670639 - RNA, 19 nt, Salmonella enterica enterica serovar Typhi
aggcaagguuaacgucaga

SEQ ID NO: 1670640 - RNA, 16 nt, Salmonella enterica enterica serovar Typhi
aggcauuuaugccgcc

SEQ ID NO: 1670641 - RNA, 16 nt, Salmonella enterica enterica serovar Typhi
aggccaucauaccgcc

SEQ ID NO: 1670642 - RNA, 15 nt, Salmonella enterica enterica serovar Typhi
aggauauuuauuugc

SEQ ID NO: 1670643 - RNA, 14 nt, Salmonella enterica enterica serovar Typhi
aggauauaagcgcc

SEQ ID NO: 1670644 - RNA, 21 nt, Salmonella enterica enterica serovar Typhi
aggauauuuugcggcuucagc

SEQ ID NO: 1670645 - RNA, 17 nt, Salmonella enterica enterica serovar Typhi
aggauaguacugaccag

SEQ ID NO: 1670646 - RNA, 15 nt, Salmonella enterica enterica serovar Typhi
aggauaaccuuccgg

SEQ ID NO: 1670647 - RNA, 16 nt, Salmonella enterica enterica serovar Typhi
aggaggcgcguuuacu

SEQ ID NO: 1670648 - RNA, 21 nt, Salmonella enterica enterica serovar Typhi
aaacguagcgucaucaggcgu

SEQ ID NO: 1670649 - RNA, 14 nt, Salmonella enterica enterica serovar Typhi
aggaaccacaucca

SEQ ID NO: 1670650 - RNA, 19 nt, Salmonella enterica enterica serovar Typhi
agcuuuuuacucagggcaa

SEQ ID NO: 1670651 - RNA, 19 nt, Salmonella enterica enterica serovar Typhi
agcuuuugccugcgucguu

SEQ ID NO: 1670652 - RNA, 16 nt, Salmonella enterica enterica serovar Typhi
aggaacgccauaugcg

SEQ ID NO: 1670653 - RNA, 20 nt, Salmonella enterica enterica serovar Typhi
aggaaggucuugauggcgau

SEQ ID NO: 1670654 - RNA, 13 nt, Salmonella enterica enterica serovar Typhi
aggaagcugcgca

SEQ ID NO: 1670655 - RNA, 15 nt, Salmonella enterica enterica serovar Typhi
aggacaaaaauggau

SEQ ID NO: 1670656 - RNA, 20 nt, Salmonella enterica enterica serovar Typhi
aggacagacagacguugcgc

SEQ ID NO: 1670657 - RNA, 23 nt, Salmonella enterica enterica serovar Typhi
aggaauaaccacugauggcuggc

SEQ ID NO: 1670658 - RNA, 15 nt, Salmonella enterica enterica serovar Typhi
aggaauauaccauca

SEQ ID NO: 1670659 - RNA, 13 nt, Salmonella enterica enterica serovar Typhi
agcuucaugcgcc

SEQ ID NO: 1670660 - RNA, 17 nt, Salmonella enterica enterica serovar Typhi
agcuucgcccaggcggg

SEQ ID NO: 1670661 - RNA, 19 nt, Salmonella enterica enterica serovar Typhi
agcuucgguccggcgcuaa

SEQ ID NO: 1670662 - RNA, 18 nt, Salmonella enterica enterica serovar Typhi
agcuugaaagcagucccg

SEQ ID NO: 1670663 - RNA, 21 nt, Salmonella enterica enterica serovar Typhi
agcuuguuguuuauccugcaa

SEQ ID NO: 1670664 - RNA, 22 nt, Salmonella enterica enterica serovar Typhi
agcuuuaaugauccgaugcgcu

SEQ ID NO: 1670665 - RNA, 15 nt, Salmonella enterica enterica serovar Typhi
agcuugccguagcgc

SEQ ID NO: 1670666 - RNA, 12 nt, Salmonella enterica enterica serovar Typhi
agcuugccgcca

SEQ ID NO: 1670667 - RNA, 22 nt, Salmonella enterica enterica serovar Typhi
agcugguugagauccauaagau

SEQ ID NO: 1670668 - RNA, 15 nt, Salmonella enterica enterica serovar Typhi
agcuuaggauucgcc

SEQ ID NO: 1670669 - RNA, 22 nt, Salmonella enterica enterica serovar Typhi
agcugugauugcgacaggcugc

SEQ ID NO: 1670670 - RNA, 16 nt, Salmonella enterica enterica serovar Typhi
agcuguuaauuugcau

SEQ ID NO: 1670671 - RNA, 18 nt, Salmonella enterica enterica serovar Typhi
agcugguauaggccaggc

SEQ ID NO: 1670672 - RNA, 18 nt, Salmonella enterica enterica serovar Typhi
agcggauugccgcgcuca

SEQ ID NO: 1670673 - RNA, 19 nt, Salmonella enterica enterica serovar Typhi
agcgcuuguuaucuggcau

SEQ ID NO: 1670674 - RNA, 18 nt, Salmonella enterica enterica serovar Typhi
agcgcgucguucacgcca

SEQ ID NO: 1670675 - RNA, 13 nt, Salmonella enterica enterica serovar Typhi
agcgcugccgcaa

SEQ ID NO: 1670676 - RNA, 17 nt, Salmonella enterica enterica serovar Typhi
agcgcuggcuggcgaca

SEQ ID NO: 1670677 - RNA, 21 nt, Salmonella enterica enterica serovar Typhi
agcgcuuggcguauagccgcc

SEQ ID NO: 1670678 - RNA, 17 nt, Salmonella enterica enterica serovar Typhi
agcgcguccccgguaag

SEQ ID NO: 1670679 - RNA, 16 nt, Salmonella enterica enterica serovar Typhi
agcgccgucauaccgc

SEQ ID NO: 1670680 - RNA, 20 nt, Salmonella enterica enterica serovar Typhi
agcgcggcgcccauuccgcc

SEQ ID NO: 1670681 - RNA, 20 nt, Salmonella enterica enterica serovar Typhi
agcgggcgucgaaaucgucc

SEQ ID NO: 1670682 - RNA, 21 nt, Salmonella enterica enterica serovar Typhi
agcggcgaucccgggcgauaa

SEQ ID NO: 1670683 - RNA, 22 nt, Salmonella enterica enterica serovar Typhi
agcggcaagccgaucagcgugu

SEQ ID NO: 1670684 - RNA, 17 nt, Salmonella enterica enterica serovar Typhi
agcgucgccagcgucuc

SEQ ID NO: 1670685 - RNA, 18 nt, Salmonella enterica enterica serovar Typhi
agcgucagccagaacgaa

SEQ ID NO: 1670686 - RNA, 12 nt, Salmonella enterica enterica serovar Typhi
agcgucaggcca

SEQ ID NO: 1670687 - RNA, 17 nt, Salmonella enterica enterica serovar Typhi
agcgucaggcuuaucgu

SEQ ID NO: 1670688 - RNA, 22 nt, Salmonella enterica enterica serovar Typhi
agcgugucgcagauacgcugua

SEQ ID NO: 1670689 - RNA, 12 nt, Salmonella enterica enterica serovar Typhi
agcguuuccaga

SEQ ID NO: 1670690 - RNA, 20 nt, Salmonella enterica enterica serovar Typhi
agcguuagcgccauccggca

SEQ ID NO: 1670691 - RNA, 15 nt, Salmonella enterica enterica serovar Typhi
agcguuagcgcaaaa

SEQ ID NO: 1670692 - RNA, 13 nt, Salmonella enterica enterica serovar Typhi
agcguuagcgcca

SEQ ID NO: 1670693 - RNA, 22 nt, Salmonella enterica enterica serovar Typhi
agcguaaccgguugucgcgcca

SEQ ID NO: 1670694 - RNA, 18 nt, Salmonella enterica enterica serovar Typhi
agcguaccgaagaacaua

SEQ ID NO: 1670695 - RNA, 19 nt, Salmonella enterica enterica serovar Typhi
agcguaauuucugguacca

SEQ ID NO: 1670696 - RNA, 18 nt, Salmonella enterica enterica serovar Typhi
agcgucaauacaccucgg

SEQ ID NO: 1670697 - RNA, 12 nt, Salmonella enterica enterica serovar Typhi
agcgucagcaga

SEQ ID NO: 1670698 - RNA, 19 nt, Salmonella enterica enterica serovar Typhi
agcgucaccucuuucgccg

SEQ ID NO: 1670699 - RNA, 23 nt, Salmonella enterica enterica serovar Typhi
agcgucaauaaucgcgcgcguau

SEQ ID NO: 1670700 - RNA, 21 nt, Salmonella enterica enterica serovar Typhi
agcguaggguagaucacgcca

SEQ ID NO: 1670701 - RNA, 17 nt, Salmonella enterica enterica serovar Typhi
agcuacgaccggucagc

SEQ ID NO: 1670702 - RNA, 21 nt, Salmonella enterica enterica serovar Typhi
agcuacgaccggucagccggu

SEQ ID NO: 1670703 - RNA, 18 nt, Salmonella enterica enterica serovar Typhi
agcuacucaggagaucgg

SEQ ID NO: 1670704 - RNA, 14 nt, Salmonella enterica enterica serovar Typhi
agcucgcccagcac

SEQ ID NO: 1670705 - RNA, 10 nt, Salmonella enterica enterica serovar Typhi
uuuuuuugca

SEQ ID NO: 1670706 - RNA, 11 nt, Salmonella enterica enterica serovar Typhi
uuuuuuugccc

SEQ ID NO: 1670707 - RNA, 12 nt, Salmonella enterica enterica serovar Typhi
uuuuuucagccu

SEQ ID NO: 1670708 - RNA, 13 nt, Salmonella enterica enterica serovar Typhi
uuuuucaucauac

SEQ ID NO: 1670709 - RNA, 13 nt, Salmonella enterica enterica serovar Typhi
uuuuucauaucca

SEQ ID NO: 1670710 - RNA, 17 nt, Salmonella enterica enterica serovar Typhi
uuuugucggaauuuccg

SEQ ID NO: 1670711 - RNA, 11 nt, Salmonella enterica enterica serovar Typhi
uuuugucaugg

SEQ ID NO: 1670712 - RNA, 23 nt, Salmonella enterica enterica serovar Typhi
uuuuguauugcgcgucacaagcu

SEQ ID NO: 1670713 - RNA, 19 nt, Salmonella enterica enterica serovar Typhi
uuuuguuguuaauuugauu

SEQ ID NO: 1670714 - RNA, 13 nt, Salmonella enterica enterica serovar Typhi
uuuuuaaaaaacc

SEQ ID NO: 1670715 - RNA, 11 nt, Salmonella enterica enterica serovar Typhi
uuuuggcagcc

SEQ ID NO: 1670716 - RNA, 17 nt, Salmonella enterica enterica serovar Typhi
uuuuggccggaccugcg

SEQ ID NO: 1670717 - RNA, 14 nt, Salmonella enterica enterica serovar Typhi
uuuugguaucuucu

SEQ ID NO: 1670718 - RNA, 15 nt, Salmonella enterica enterica serovar Typhi
uuuuggucagcucac

SEQ ID NO: 1670719 - RNA, 19 nt, Salmonella enterica enterica serovar Typhi
uuuugccugcggauuugcu

SEQ ID NO: 1670720 - RNA, 17 nt, Salmonella enterica enterica serovar Typhi
uuuugcccgcucgcuua

SEQ ID NO: 1670721 - RNA, 21 nt, Salmonella enterica enterica serovar Typhi
uuuugccgcccagucacggcu

SEQ ID NO: 1670722 - RNA, 11 nt, Salmonella enterica enterica serovar Typhi
uuuugcucagu

SEQ ID NO: 1670723 - RNA, 19 nt, Salmonella enterica enterica serovar Typhi
uuuuuaaauaacuuuuaau

SEQ ID NO: 1670724 - RNA, 13 nt, Salmonella enterica enterica serovar Typhi
uuuuuaauauaag

SEQ ID NO: 1670725 - RNA, 16 nt, Salmonella enterica enterica serovar Typhi
uuuuuaauauaagccu

SEQ ID NO: 1670726 - RNA, 15 nt, Salmonella enterica enterica serovar Typhi
uuuuuacaaauuuaa

SEQ ID NO: 1670727 - RNA, 20 nt, Salmonella enterica enterica serovar Typhi
uuuuuagccuguuauucaau

SEQ ID NO: 1670728 - RNA, 16 nt, Salmonella enterica enterica serovar Typhi
uuuuuacgccugaacg

SEQ ID NO: 1670729 - RNA, 22 nt, Salmonella enterica enterica serovar Typhi
uuuuuaccgcauuauaaauauc

SEQ ID NO: 1670730 - RNA, 23 nt, Salmonella enterica enterica serovar Typhi
uuuuuaccgcauuauaaauauca

SEQ ID NO: 1670731 - RNA, 19 nt, Salmonella enterica enterica serovar Typhi
uuuuuaugugacaaucacu

SEQ ID NO: 1670732 - RNA, 13 nt, Salmonella enterica enterica serovar Typhi
uuuuucagcaaau

SEQ ID NO: 1670733 - RNA, 12 nt, Salmonella enterica enterica serovar Typhi
uuuuucagaucu

SEQ ID NO: 1670734 - RNA, 15 nt, Salmonella enterica enterica serovar Typhi
uuuuucaauuuccag

SEQ ID NO: 1670735 - RNA, 12 nt, Salmonella enterica enterica serovar Typhi
uuuuuauaacau

SEQ ID NO: 1670736 - RNA, 23 nt, Salmonella enterica enterica serovar Typhi
uuuuuaggcuauaaaaaucaucc

SEQ ID NO: 1670737 - RNA, 21 nt, Salmonella enterica enterica serovar Typhi
uuuuuauauuccgcaggcaag

SEQ ID NO: 1670738 - RNA, 16 nt, Salmonella enterica enterica serovar Typhi
uuuuuauauucgcuca

SEQ ID NO: 1670739 - RNA, 18 nt, Salmonella enterica enterica serovar Typhi
uuuucugcgccaccagcg

SEQ ID NO: 1670740 - RNA, 13 nt, Salmonella enterica enterica serovar Typhi
uuuucugcuuucu

SEQ ID NO: 1670741 - RNA, 17 nt, Salmonella enterica enterica serovar Typhi
uuuucgccaguuuugca

SEQ ID NO: 1670742 - RNA, 23 nt, Salmonella enterica enterica serovar Typhi
uuuugacugcgggggcaaaugcg

SEQ ID NO: 1670743 - RNA, 22 nt, Salmonella enterica enterica serovar Typhi
uuuugcacggcaucuuuguucu

SEQ ID NO: 1670744 - RNA, 21 nt, Salmonella enterica enterica serovar Typhi
uuuugcccgaucccaugcuca

SEQ ID NO: 1670745 - RNA, 19 nt, Salmonella enterica enterica serovar Typhi
uuuucacgaccaaccaaca

SEQ ID NO: 1670746 - RNA, 13 nt, Salmonella enterica enterica serovar Typhi
uuuucaccauuaa

SEQ ID NO: 1670747 - RNA, 23 nt, Salmonella enterica enterica serovar Typhi
uuuucacuaauccccauuuuuuu

SEQ ID NO: 1670748 - RNA, 21 nt, Salmonella enterica enterica serovar Typhi
uuuucaaaugaucguuuuuug

SEQ ID NO: 1670749 - RNA, 22 nt, Salmonella enterica enterica serovar Typhi
uuuaccggugcagaccucugca

SEQ ID NO: 1670750 - RNA, 18 nt, Salmonella enterica enterica serovar Typhi
uuuaccgccgcuuuucag

SEQ ID NO: 1670751 - RNA, 19 nt, Salmonella enterica enterica serovar Typhi
uuuaccggaugggcagaua

SEQ ID NO: 1670752 - RNA, 14 nt, Salmonella enterica enterica serovar Typhi
uuuaccuuuuccuc

SEQ ID NO: 1670753 - RNA, 12 nt, Salmonella enterica enterica serovar Typhi
uuuucaugaauc

SEQ ID NO: 1670754 - RNA, 15 nt, Salmonella enterica enterica serovar Typhi
uuuucaugcaauaau

SEQ ID NO: 1670755 - RNA, 16 nt, Salmonella enterica enterica serovar Typhi
uuuucagcagugcaaa

SEQ ID NO: 1670756 - RNA, 17 nt, Salmonella enterica enterica serovar Typhi
uuuucagcgucuuucuu

SEQ ID NO: 1670757 - RNA, 17 nt, Salmonella enterica enterica serovar Typhi
uuuucaggaaguuuaac

SEQ ID NO: 1670758 - RNA, 15 nt, Salmonella enterica enterica serovar Typhi
uuuucaggcacagaa

SEQ ID NO: 1670759 - RNA, 13 nt, Salmonella enterica enterica serovar Typhi
uuuucgaaaauuu

SEQ ID NO: 1670760 - RNA, 19 nt, Salmonella enterica enterica serovar Typhi
uuuuccugaaaaaauuccc

SEQ ID NO: 1670761 - RNA, 20 nt, Salmonella enterica enterica serovar Typhi
uuuuccugcugguagagcau

SEQ ID NO: 1670762 - RNA, 14 nt, Salmonella enterica enterica serovar Typhi
ucugagaucaaaca

SEQ ID NO: 1670763 - RNA, 20 nt, Salmonella enterica enterica serovar Typhi
ucugauagcccuauucguga

SEQ ID NO: 1670764 - RNA, 23 nt, Salmonella enterica enterica serovar Typhi
ucugagaauuuggguuuauguag

SEQ ID NO: 1670765 - RNA, 14 nt, Salmonella enterica enterica serovar Typhi
ucugaaaagaguag

SEQ ID NO: 1670766 - RNA, 14 nt, Salmonella enterica enterica serovar Typhi
ucucuuuugcuuca

SEQ ID NO: 1670767 - RNA, 13 nt, Salmonella enterica enterica serovar Typhi
ucucuuucagaau

SEQ ID NO: 1670768 - RNA, 15 nt, Salmonella enterica enterica serovar Typhi
ucugaaucagugcau

SEQ ID NO: 1670769 - RNA, 22 nt, Salmonella enterica enterica serovar Typhi
ucugaaucagugcaucuucacu

SEQ ID NO: 1670770 - RNA, 15 nt, Salmonella enterica enterica serovar Typhi
ucucugccaucaucc

SEQ ID NO: 1670771 - RNA, 15 nt, Salmonella enterica enterica serovar Typhi
ucucugucgccgccc

SEQ ID NO: 1670772 - RNA, 20 nt, Salmonella enterica enterica serovar Typhi
ucucuggcgcgggcuucacg

SEQ ID NO: 1670773 - RNA, 12 nt, Salmonella enterica enterica serovar Typhi
ucucuauugauu

SEQ ID NO: 1670774 - RNA, 13 nt, Salmonella enterica enterica serovar Typhi
ucucuauuaaccg

SEQ ID NO: 1670775 - RNA, 15 nt, Salmonella enterica enterica serovar Typhi
ucucucauuuucuuu

SEQ ID NO: 1670776 - RNA, 20 nt, Salmonella enterica enterica serovar Typhi
ucucugaaaagaguagucuu

SEQ ID NO: 1670777 - RNA, 17 nt, Salmonella enterica enterica serovar Typhi
ucucucccaggcauccu

SEQ ID NO: 1670778 - RNA, 17 nt, Salmonella enterica enterica serovar Typhi
ucucuucgacaucuuca

SEQ ID NO: 1670779 - RNA, 16 nt, Salmonella enterica enterica serovar Typhi
ucucuucaauaacgaa

SEQ ID NO: 1670780 - RNA, 19 nt, Salmonella enterica enterica serovar Typhi
ucucuuacguugcauuuau

SEQ ID NO: 1670781 - RNA, 19 nt, Salmonella enterica enterica serovar Typhi
ucucuuaugccgcuuuugc

SEQ ID NO: 1670782 - RNA, 17 nt, Salmonella enterica enterica serovar Typhi
ucucuuaaugccagcgg

SEQ ID NO: 1670783 - RNA, 18 nt, Salmonella enterica enterica serovar Typhi
ucucuuaauguaaaacaa

SEQ ID NO: 1670784 - RNA, 15 nt, Salmonella enterica enterica serovar Typhi
ucucuugugcuucca

SEQ ID NO: 1670785 - RNA, 20 nt, Salmonella enterica enterica serovar Typhi
ucucuugugcuuccagcucc

SEQ ID NO: 1670786 - RNA, 12 nt, Salmonella enterica enterica serovar Typhi
ucucuuuauuga

SEQ ID NO: 1670787 - RNA, 12 nt, Salmonella enterica enterica serovar Typhi
ucucuugccugc

SEQ ID NO: 1670788 - RNA, 20 nt, Salmonella enterica enterica serovar Typhi
ucucuugcagacagcgccug

SEQ ID NO: 1670789 - RNA, 14 nt, Salmonella enterica enterica serovar Typhi
ucucuugccagcgc

SEQ ID NO: 1670790 - RNA, 21 nt, Salmonella enterica enterica serovar Typhi
ucucuugccagcgcauccacc

SEQ ID NO: 1670791 - RNA, 13 nt, Salmonella enterica enterica serovar Typhi
ucucuucuaucug

SEQ ID NO: 1670792 - RNA, 22 nt, Salmonella enterica enterica serovar Typhi
ucucuucguuauuuuccugaaa

SEQ ID NO: 1670793 - RNA, 14 nt, Salmonella enterica enterica serovar Typhi
ucucuacgccggcg

SEQ ID NO: 1670794 - RNA, 14 nt, Salmonella enterica enterica serovar Typhi
ucucgucgccaggg

SEQ ID NO: 1670795 - RNA, 12 nt, Salmonella enterica enterica serovar Typhi
ucucgucaaggu

SEQ ID NO: 1670796 - RNA, 13 nt, Salmonella enterica enterica serovar Typhi
ucucgcacaucau

SEQ ID NO: 1670797 - RNA, 19 nt, Salmonella enterica enterica serovar Typhi
ucucgcaagauuccagaua

SEQ ID NO: 1670798 - RNA, 18 nt, Salmonella enterica enterica serovar Typhi
ucuccugaagccagugcc

SEQ ID NO: 1670799 - RNA, 17 nt, Salmonella enterica enterica serovar Typhi
ucuccugaacgcccggc

SEQ ID NO: 1670800 - RNA, 14 nt, Salmonella enterica enterica serovar Typhi
ucuccugccagcga

SEQ ID NO: 1670801 - RNA, 19 nt, Salmonella enterica enterica serovar Typhi
ucuccgacauuguucuaaa

SEQ ID NO: 1670802 - RNA, 15 nt, Salmonella enterica enterica serovar Typhi
ucuccgccgccuggc

SEQ ID NO: 1670803 - RNA, 19 nt, Salmonella enterica enterica serovar Typhi
ucucccguuuguauaaauu

SEQ ID NO: 1670804 - RNA, 15 nt, Salmonella enterica enterica serovar Typhi
ucucccuccccauuc

SEQ ID NO: 1670805 - RNA, 20 nt, Salmonella enterica enterica serovar Typhi
ucucccguuuguauaaauua

SEQ ID NO: 1670806 - RNA, 21 nt, Salmonella enterica enterica serovar Typhi
ucuccggcacauucaccacgc

SEQ ID NO: 1670807 - RNA, 20 nt, Salmonella enterica enterica serovar Typhi
ucuccgggauagcaaucucg

SEQ ID NO: 1670808 - RNA, 19 nt, Salmonella enterica enterica serovar Typhi
ucuccggcagcgaauguau

SEQ ID NO: 1670809 - RNA, 23 nt, Salmonella enterica enterica serovar Typhi
ucuccggcagcguauugagcugg

SEQ ID NO: 1670810 - RNA, 14 nt, Salmonella enterica enterica serovar Typhi
ucuccggcaucuca

SEQ ID NO: 1670811 - RNA, 17 nt, Salmonella enterica enterica serovar Typhi
ucuccucuucaguaagc

SEQ ID NO: 1670812 - RNA, 19 nt, Salmonella enterica enterica serovar Typhi
ucuccagaucgcauaaaau

SEQ ID NO: 1670813 - RNA, 15 nt, Salmonella enterica enterica serovar Typhi
ucucauugaucaguu

SEQ ID NO: 1670814 - RNA, 20 nt, Salmonella enterica enterica serovar Typhi
ucuacaugcccuucuuuaau

SEQ ID NO: 1670815 - RNA, 20 nt, Salmonella enterica enterica serovar Typhi
ucuaccaacugagcuaacga

SEQ ID NO: 1670816 - RNA, 21 nt, Salmonella enterica enterica serovar Typhi
ucuacauuuucguaaaauaua

SEQ ID NO: 1670817 - RNA, 21 nt, Salmonella enterica enterica serovar Typhi
ucuguaauucucccaaauuuu

SEQ ID NO: 1670818 - RNA, 15 nt, Salmonella enterica enterica serovar Typhi
ucuguaccaccagaa

SEQ ID NO: 1670819 - RNA, 21 nt, Salmonella enterica enterica serovar Typhi
ucuguaagagacugacaauga

SEQ ID NO: 1670820 - RNA, 14 nt, Salmonella enterica enterica serovar Typhi
ucuggcugcugaug

SEQ ID NO: 1670821 - RNA, 14 nt, Salmonella enterica enterica serovar Typhi
ucuggcucagacca

SEQ ID NO: 1670822 - RNA, 16 nt, Salmonella enterica enterica serovar Typhi
ucuggaaucaauuucc

SEQ ID NO: 1670823 - RNA, 15 nt, Salmonella enterica enterica serovar Typhi
ucuggaguacgggca

SEQ ID NO: 1670824 - RNA, 16 nt, Salmonella enterica enterica serovar Typhi
ucugcaccagaacucc

SEQ ID NO: 1670825 - RNA, 20 nt, Salmonella enterica enterica serovar Typhi
ucugcacaacauuccgcuuc

SEQ ID NO: 1670826 - RNA, 17 nt, Salmonella enterica enterica serovar Typhi
ucugcgccuuuuaccuu

SEQ ID NO: 1670827 - RNA, 19 nt, Salmonella enterica enterica serovar Typhi
ucuggaaagcgccucgcaa

SEQ ID NO: 1670828 - RNA, 23 nt, Salmonella enterica enterica serovar Typhi
ucugcugacacccucugcgccuu

SEQ ID NO: 1670829 - RNA, 19 nt, Salmonella enterica enterica serovar Typhi
ucugcugccucaucaauuc

SEQ ID NO: 1670830 - RNA, 14 nt, Salmonella enterica enterica serovar Typhi
ucugcugccagcgc

SEQ ID NO: 1670831 - RNA, 22 nt, Salmonella enterica enterica serovar Typhi
ucugcugaugcugguuuuagcu

SEQ ID NO: 1670832 - RNA, 16 nt, Salmonella enterica enterica serovar Typhi
ucugcugauaauacug

SEQ ID NO: 1670833 - RNA, 21 nt, Salmonella enterica enterica serovar Typhi
ucugcgugacgccaagcagcg

SEQ ID NO: 1670834 - RNA, 17 nt, Salmonella enterica enterica serovar Typhi
ucugcuccgccagcaau

SEQ ID NO: 1670835 - RNA, 17 nt, Salmonella enterica enterica serovar Typhi
ucugcucagaaauauuc

SEQ ID NO: 1670836 - RNA, 15 nt, Salmonella enterica enterica serovar Typhi
ucugcuccgccagca

SEQ ID NO: 1670837 - RNA, 14 nt, Salmonella enterica enterica serovar Typhi
ucuguuauauauuu

SEQ ID NO: 1670838 - RNA, 13 nt, Salmonella enterica enterica serovar Typhi
ucuuaccacgccg

SEQ ID NO: 1670839 - RNA, 16 nt, Salmonella enterica enterica serovar Typhi
ucuuacgagaggcuuu

SEQ ID NO: 1670840 - RNA, 18 nt, Salmonella enterica enterica serovar Typhi
ucuuaccgcuaaaauacc

SEQ ID NO: 1670841 - RNA, 15 nt, Salmonella enterica enterica serovar Typhi
ucuguucaacuuuuc

SEQ ID NO: 1670842 - RNA, 22 nt, Salmonella enterica enterica serovar Typhi
ucuguuaaaaaauuuauaacgu

SEQ ID NO: 1670843 - RNA, 21 nt, Salmonella enterica enterica serovar Typhi
ucuuacuaauaaauauucauc

SEQ ID NO: 1670844 - RNA, 23 nt, Salmonella enterica enterica serovar Typhi
ucuuacuaauaaauauucaucaa

SEQ ID NO: 1670845 - RNA, 21 nt, Salmonella enterica enterica serovar Typhi
ucuuaccaggucuuaccuauu

SEQ ID NO: 1670846 - RNA, 19 nt, Salmonella enterica enterica serovar Typhi
ucuuacuaauaaauauuca

SEQ ID NO: 1670847 - RNA, 20 nt, Salmonella enterica enterica serovar Typhi
ucuuacuaauaaauauucau

SEQ ID NO: 1670848 - RNA, 16 nt, Salmonella enterica enterica serovar Typhi
ucuuacugaccggccc

SEQ ID NO: 1670849 - RNA, 14 nt, Salmonella enterica enterica serovar Typhi
ucuuauuacaagaa

SEQ ID NO: 1670850 - RNA, 18 nt, Salmonella enterica enterica serovar Typhi
ucuuauuagcgauuuaau

SEQ ID NO: 1670851 - RNA, 12 nt, Salmonella enterica enterica serovar Typhi
ucuuauccgacu

SEQ ID NO: 1670852 - RNA, 22 nt, Salmonella enterica enterica serovar Typhi
ucuuaucaggccuacacucugc

SEQ ID NO: 1670853 - RNA, 17 nt, Salmonella enterica enterica serovar Typhi
ucuuauccggccuaccu

SEQ ID NO: 1670854 - RNA, 18 nt, Salmonella enterica enterica serovar Typhi
ucuuauccggccugcaug

SEQ ID NO: 1670855 - RNA, 17 nt, Salmonella enterica enterica serovar Typhi
ucuucaaugaacaauaa

SEQ ID NO: 1670856 - RNA, 13 nt, Salmonella enterica enterica serovar Typhi
ucuucaacgugca

SEQ ID NO: 1670857 - RNA, 14 nt, Salmonella enterica enterica serovar Typhi
ucuucaauaacgaa

SEQ ID NO: 1670858 - RNA, 12 nt, Salmonella enterica enterica serovar Typhi
ucuuauuuuccg

SEQ ID NO: 1670859 - RNA, 22 nt, Salmonella enterica enterica serovar Typhi
ucuucacgcagucguuccagac

SEQ ID NO: 1670860 - RNA, 22 nt, Salmonella enterica enterica serovar Typhi
ucuucaccuuuccagucaacga

SEQ ID NO: 1670861 - RNA, 15 nt, Salmonella enterica enterica serovar Typhi
ucuucacuaaaaaca

SEQ ID NO: 1670862 - RNA, 16 nt, Salmonella enterica enterica serovar Typhi
ucuucacuaaaaacag

SEQ ID NO: 1670863 - RNA, 23 nt, Salmonella enterica enterica serovar Typhi
ucuucacgccgugaauuucugcu

SEQ ID NO: 1670864 - RNA, 15 nt, Salmonella enterica enterica serovar Typhi
ucuucaucguuucug

SEQ ID NO: 1670865 - RNA, 19 nt, Salmonella enterica enterica serovar Typhi
ugaaacguucggugaagaa

SEQ ID NO: 1670866 - RNA, 17 nt, Salmonella enterica enterica serovar Typhi
ugaaacucgccaugcca

SEQ ID NO: 1670867 - RNA, 18 nt, Salmonella enterica enterica serovar Typhi
ugaaacugaaccaacagc

SEQ ID NO: 1670868 - RNA, 17 nt, Salmonella enterica enterica serovar Typhi
ugaaacgcccuucccag

SEQ ID NO: 1670869 - RNA, 20 nt, Salmonella enterica enterica serovar Typhi
ugaaacccauaauaaugacu

SEQ ID NO: 1670870 - RNA, 14 nt, Salmonella enterica enterica serovar Typhi
ugaaaccccaaauc

SEQ ID NO: 1670871 - RNA, 18 nt, Salmonella enterica enterica serovar Typhi
ugaaacccauaauaauga

SEQ ID NO: 1670872 - RNA, 22 nt, Salmonella enterica enterica serovar Typhi
ugaaaccggcgcgccuuccagc

SEQ ID NO: 1670873 - RNA, 23 nt, Salmonella enterica enterica serovar Typhi
ugaaaccggcgcgccuuccagca

SEQ ID NO: 1670874 - RNA, 21 nt, Salmonella enterica enterica serovar Typhi
ugaaagucuucccgcaaacug

SEQ ID NO: 1670875 - RNA, 16 nt, Salmonella enterica enterica serovar Typhi
ugaaauaacagacucc

SEQ ID NO: 1670876 - RNA, 14 nt, Salmonella enterica enterica serovar Typhi
ugaaagauuauuuu

SEQ ID NO: 1670877 - RNA, 20 nt, Salmonella enterica enterica serovar Typhi
ugaaagauuauuuuaucauc

SEQ ID NO: 1670878 - RNA, 14 nt, Salmonella enterica enterica serovar Typhi
ugaaaggccuaaac

SEQ ID NO: 1670879 - RNA, 20 nt, Salmonella enterica enterica serovar Typhi
ugaaacauauauauccgcua

SEQ ID NO: 1670880 - RNA, 15 nt, Salmonella enterica enterica serovar Typhi
ugaaaauuuguacuu

SEQ ID NO: 1670881 - RNA, 15 nt, Salmonella enterica enterica serovar Typhi
ugaaaaucaaaaaca

SEQ ID NO: 1670882 - RNA, 13 nt, Salmonella enterica enterica serovar Typhi
ugaaaauaauuga

SEQ ID NO: 1670883 - RNA, 14 nt, Salmonella enterica enterica serovar Typhi
ugaaaauaauuuuu

SEQ ID NO: 1670884 - RNA, 18 nt, Salmonella enterica enterica serovar Typhi
ugaaaauaauuuuuauca

SEQ ID NO: 1670885 - RNA, 13 nt, Salmonella enterica enterica serovar Typhi
ugaaaacaccagg

SEQ ID NO: 1670886 - RNA, 12 nt, Salmonella enterica enterica serovar Typhi
ugaaaaaucauu

SEQ ID NO: 1670887 - RNA, 11 nt, Salmonella enterica enterica serovar Typhi
ugaaaaagaau

SEQ ID NO: 1670888 - RNA, 14 nt, Salmonella enterica enterica serovar Typhi
ugaaaaacuggaaa

SEQ ID NO: 1670889 - RNA, 13 nt, Salmonella enterica enterica serovar Typhi
ugaaaagauaaag

SEQ ID NO: 1670890 - RNA, 12 nt, Salmonella enterica enterica serovar Typhi
ugaaaagcuuag

SEQ ID NO: 1670891 - RNA, 19 nt, Salmonella enterica enterica serovar Typhi
ugaaaagcuuagaacucac

SEQ ID NO: 1670892 - RNA, 23 nt, Salmonella enterica enterica serovar Typhi
ugaaaaggggaucguguaacaau

SEQ ID NO: 1670893 - RNA, 12 nt, Salmonella enterica enterica serovar Typhi
ugaaaagggacu

SEQ ID NO: 1670894 - RNA, 21 nt, Salmonella enterica enterica serovar Typhi
ugaaaacgcagccccaguugg

SEQ ID NO: 1670895 - RNA, 15 nt, Salmonella enterica enterica serovar Typhi
ugaaaacggcaucaa

SEQ ID NO: 1670896 - RNA, 19 nt, Salmonella enterica enterica serovar Typhi
ugaaaacucggcgggguuu

SEQ ID NO: 1670897 - RNA, 22 nt, Salmonella enterica enterica serovar Typhi
ugaaaacucggcgggguuuuuu

SEQ ID NO: 1670898 - RNA, 16 nt, Salmonella enterica enterica serovar Typhi
ugaaccauaucaaaca

SEQ ID NO: 1670899 - RNA, 20 nt, Salmonella enterica enterica serovar Typhi
ugaacccgaccgucuuuguc

SEQ ID NO: 1670900 - RNA, 22 nt, Salmonella enterica enterica serovar Typhi
ugaacccguaagcccuauuagg

SEQ ID NO: 1670901 - RNA, 22 nt, Salmonella enterica enterica serovar Typhi
ugaaccacggagagacaguuca

SEQ ID NO: 1670902 - RNA, 14 nt, Salmonella enterica enterica serovar Typhi
ugaacgccaaauac

SEQ ID NO: 1670903 - RNA, 13 nt, Salmonella enterica enterica serovar Typhi
ugaacgccaggcc

SEQ ID NO: 1670904 - RNA, 14 nt, Salmonella enterica enterica serovar Typhi
ugaacgaagcauuu

SEQ ID NO: 1670905 - RNA, 21 nt, Salmonella enterica enterica serovar Typhi
ugaacaccacugaaaaauaau

SEQ ID NO: 1670906 - RNA, 12 nt, Salmonella enterica enterica serovar Typhi
ugaacaccagca

SEQ ID NO: 1670907 - RNA, 20 nt, Salmonella enterica enterica serovar Typhi
ugaacauacguuuaaagcgc

SEQ ID NO: 1670908 - RNA, 18 nt, Salmonella enterica enterica serovar Typhi
ugaacauacguuuaaagc

SEQ ID NO: 1670909 - RNA, 23 nt, Salmonella enterica enterica serovar Typhi
ugaacauaugaaggauacggaau

SEQ ID NO: 1670910 - RNA, 15 nt, Salmonella enterica enterica serovar Typhi
ugaacaugcgcagaa

SEQ ID NO: 1670911 - RNA, 21 nt, Salmonella enterica enterica serovar Typhi
ugaacaugacgccgaaauaaa

SEQ ID NO: 1670912 - RNA, 22 nt, Salmonella enterica enterica serovar Typhi
ugaacaugacgccgaaauaaau

SEQ ID NO: 1670913 - RNA, 17 nt, Salmonella enterica enterica serovar Typhi
ugaacagcgucauccag

SEQ ID NO: 1670914 - RNA, 22 nt, Salmonella enterica enterica serovar Typhi
ugaacagcgucauccaguguua

SEQ ID NO: 1670915 - RNA, 20 nt, Salmonella enterica enterica serovar Typhi
ugaacaggcugugcaacauc

SEQ ID NO: 1670916 - RNA, 17 nt, Salmonella enterica enterica serovar Typhi
ugaaauuucuuuuccag

SEQ ID NO: 1670917 - RNA, 18 nt, Salmonella enterica enterica serovar Typhi
ugaaauucuaugccaggc

SEQ ID NO: 1670918 - RNA, 19 nt, Salmonella enterica enterica serovar Typhi
ugaaauucuaugccaggcg

SEQ ID NO: 1670919 - RNA, 20 nt, Salmonella enterica enterica serovar Typhi
ugaaaucgccuguuaauggu

SEQ ID NO: 1670920 - RNA, 14 nt, Salmonella enterica enterica serovar Typhi
ugaaauacagccag

SEQ ID NO: 1670921 - RNA, 22 nt, Salmonella enterica enterica serovar Typhi
ucuuuaacuaauggcaauaaua

SEQ ID NO: 1670922 - RNA, 19 nt, Salmonella enterica enterica serovar Typhi
ucuuguuucaucgucagcu

SEQ ID NO: 1670923 - RNA, 19 nt, Salmonella enterica enterica serovar Typhi
ucuuggagagcaucaucug

SEQ ID NO: 1670924 - RNA, 21 nt, Salmonella enterica enterica serovar Typhi
ucuugugcuuccagcuccauc

SEQ ID NO: 1670925 - RNA, 13 nt, Salmonella enterica enterica serovar Typhi
ucuuguggaacac

SEQ ID NO: 1670926 - RNA, 21 nt, Salmonella enterica enterica serovar Typhi
ucuucccgaauagcccucggu

SEQ ID NO: 1670927 - RNA, 18 nt, Salmonella enterica enterica serovar Typhi
ucuuccccgaucagaaaa

SEQ ID NO: 1670928 - RNA, 12 nt, Salmonella enterica enterica serovar Typhi
ucuucccggcag

SEQ ID NO: 1670929 - RNA, 14 nt, Salmonella enterica enterica serovar Typhi
ucuuccagcugcuc

SEQ ID NO: 1670930 - RNA, 19 nt, Salmonella enterica enterica serovar Typhi
ucuuccagcgucuccagac

SEQ ID NO: 1670931 - RNA, 17 nt, Salmonella enterica enterica serovar Typhi
ucuuccagcgccaaaaa

SEQ ID NO: 1670932 - RNA, 23 nt, Salmonella enterica enterica serovar Typhi
ucuuccagcacgauauccagcac

SEQ ID NO: 1670933 - RNA, 23 nt, Salmonella enterica enterica serovar Typhi
ucuuccaguuguaacgccuggcg

SEQ ID NO: 1670934 - RNA, 14 nt, Salmonella enterica enterica serovar Typhi
ucuuccaucagcca

SEQ ID NO: 1670935 - RNA, 21 nt, Salmonella enterica enterica serovar Typhi
ucuucccagguuucaaugccg

SEQ ID NO: 1670936 - RNA, 21 nt, Salmonella enterica enterica serovar Typhi
ucuuucugaaacggaucaaaa

SEQ ID NO: 1670937 - RNA, 13 nt, Salmonella enterica enterica serovar Typhi
ucuuucccuuuuu

SEQ ID NO: 1670938 - RNA, 15 nt, Salmonella enterica enterica serovar Typhi
ucuuuccuuuuucag

SEQ ID NO: 1670939 - RNA, 14 nt, Salmonella enterica enterica serovar Typhi
ucuuucauuuuacc

SEQ ID NO: 1670940 - RNA, 13 nt, Salmonella enterica enterica serovar Typhi
ucuuucauuucug

SEQ ID NO: 1670941 - RNA, 17 nt, Salmonella enterica enterica serovar Typhi
ucuuucauuucugccug

SEQ ID NO: 1670942 - RNA, 13 nt, Salmonella enterica enterica serovar Typhi
ucuuucaucaaac

SEQ ID NO: 1670943 - RNA, 22 nt, Salmonella enterica enterica serovar Typhi
ucuuucagcaaacguucaauga

SEQ ID NO: 1670944 - RNA, 23 nt, Salmonella enterica enterica serovar Typhi
ucuuuaugcgagaguuuuucagc

SEQ ID NO: 1670945 - RNA, 23 nt, Salmonella enterica enterica serovar Typhi
ucuuuaugcggcgcuuccagacu

SEQ ID NO: 1670946 - RNA, 16 nt, Salmonella enterica enterica serovar Typhi
ucuuuauccugaagau

SEQ ID NO: 1670947 - RNA, 12 nt, Salmonella enterica enterica serovar Typhi
ucuuuaucuucu

SEQ ID NO: 1670948 - RNA, 12 nt, Salmonella enterica enterica serovar Typhi
ucuuuaucaaac

SEQ ID NO: 1670949 - RNA, 20 nt, Salmonella enterica enterica serovar Typhi
ucuuuaauuugugccagcgu

SEQ ID NO: 1670950 - RNA, 20 nt, Salmonella enterica enterica serovar Typhi
ucuuugacccacgccagcag

SEQ ID NO: 1670951 - RNA, 14 nt, Salmonella enterica enterica serovar Typhi
ucuuucuuuuuaua

SEQ ID NO: 1670952 - RNA, 14 nt, Salmonella enterica enterica serovar Typhi
ucuuugcugccguc

SEQ ID NO: 1670953 - RNA, 15 nt, Salmonella enterica enterica serovar Typhi
ucuuuggacggcauc

SEQ ID NO: 1670954 - RNA, 22 nt, Salmonella enterica enterica serovar Typhi
ucuuuuaaggcggcaaagauaa

SEQ ID NO: 1670955 - RNA, 15 nt, Salmonella enterica enterica serovar Typhi
ucuuuuaauuuucug

SEQ ID NO: 1670956 - RNA, 13 nt, Salmonella enterica enterica serovar Typhi
ucuuuuaaaaauc

SEQ ID NO: 1670957 - RNA, 18 nt, Salmonella enterica enterica serovar Typhi
ucuuuuacgaucgccacc

SEQ ID NO: 1670958 - RNA, 12 nt, Salmonella enterica enterica serovar Typhi
ugaaaaaauuuc

SEQ ID NO: 1670959 - RNA, 11 nt, Salmonella enterica enterica serovar Typhi
ugaaaaaaacg

SEQ ID NO: 1670960 - RNA, 17 nt, Salmonella enterica enterica serovar Typhi
ucuuuuguuuuucucuu

SEQ ID NO: 1670961 - RNA, 16 nt, Salmonella enterica enterica serovar Typhi
ucuuuugcgccuucca

SEQ ID NO: 1670962 - RNA, 23 nt, Salmonella enterica enterica serovar Typhi
ucuuuuucgaucagcauaucgau

SEQ ID NO: 1670963 - RNA, 20 nt, Salmonella enterica enterica serovar Typhi
ucggcaaacgccgccuggau

SEQ ID NO: 1670964 - RNA, 14 nt, Salmonella enterica enterica serovar Typhi
ucggccauuuuuuu

SEQ ID NO: 1670965 - RNA, 17 nt, Salmonella enterica enterica serovar Typhi
ucggcgacgucccggca

SEQ ID NO: 1670966 - RNA, 15 nt, Salmonella enterica enterica serovar Typhi
ucgcuguggccaggc

SEQ ID NO: 1670967 - RNA, 12 nt, Salmonella enterica enterica serovar Typhi
ucgcuguuaacc

SEQ ID NO: 1670968 - RNA, 14 nt, Salmonella enterica enterica serovar Typhi
ucgcuguccgggua

SEQ ID NO: 1670969 - RNA, 17 nt, Salmonella enterica enterica serovar Typhi
ucgcuggugugcagcca

SEQ ID NO: 1670970 - RNA, 17 nt, Salmonella enterica enterica serovar Typhi
ucgcuggccguuaugca

SEQ ID NO: 1670971 - RNA, 23 nt, Salmonella enterica enterica serovar Typhi
ucgcuggccauauuuuuucagga

SEQ ID NO: 1670972 - RNA, 15 nt, Salmonella enterica enterica serovar Typhi
ucgcuggacauuaag

SEQ ID NO: 1670973 - RNA, 20 nt, Salmonella enterica enterica serovar Typhi
ucgcugcugaugauaugggu

SEQ ID NO: 1670974 - RNA, 20 nt, Salmonella enterica enterica serovar Typhi
ucgcgcagauagagcgccug

SEQ ID NO: 1670975 - RNA, 19 nt, Salmonella enterica enterica serovar Typhi
ucgcgcagauagagcgccu

SEQ ID NO: 1670976 - RNA, 16 nt, Salmonella enterica enterica serovar Typhi
ucggagguucgaaucc

SEQ ID NO: 1670977 - RNA, 18 nt, Salmonella enterica enterica serovar Typhi
ucggagauuucauccucu

SEQ ID NO: 1670978 - RNA, 20 nt, Salmonella enterica enterica serovar Typhi
ucggagauuucauccucuug

SEQ ID NO: 1670979 - RNA, 20 nt, Salmonella enterica enterica serovar Typhi
ucgcuuaaacauauacugcu

SEQ ID NO: 1670980 - RNA, 17 nt, Salmonella enterica enterica serovar Typhi
ucgcuuuacccgggcca

SEQ ID NO: 1670981 - RNA, 22 nt, Salmonella enterica enterica serovar Typhi
ucgcuuuacccgggccaucuuu

SEQ ID NO: 1670982 - RNA, 23 nt, Salmonella enterica enterica serovar Typhi
ucgcuuguugacgacuuuugcaa

SEQ ID NO: 1670983 - RNA, 20 nt, Salmonella enterica enterica serovar Typhi
ucggcuugcuucaucugguu

SEQ ID NO: 1670984 - RNA, 16 nt, Salmonella enterica enterica serovar Typhi
ucggcuucucccaaca

SEQ ID NO: 1670985 - RNA, 13 nt, Salmonella enterica enterica serovar Typhi
ucggcuuacccaa

SEQ ID NO: 1670986 - RNA, 14 nt, Salmonella enterica enterica serovar Typhi
ucggcuccugguga

SEQ ID NO: 1670987 - RNA, 18 nt, Salmonella enterica enterica serovar Typhi
ucggcgucgcgaauaauu

SEQ ID NO: 1670988 - RNA, 22 nt, Salmonella enterica enterica serovar Typhi
ucggcgucgcgaauaauuauuu

SEQ ID NO: 1670989 - RNA, 23 nt, Salmonella enterica enterica serovar Typhi
ucggcgcagggaucguuuuucuu

SEQ ID NO: 1670990 - RNA, 15 nt, Salmonella enterica enterica serovar Typhi
ucggcgacuuucacg

SEQ ID NO: 1670991 - RNA, 20 nt, Salmonella enterica enterica serovar Typhi
ucgggaugcauaaaaaaacg

SEQ ID NO: 1670992 - RNA, 21 nt, Salmonella enterica enterica serovar Typhi
ucggcuuuuuuuuaugccucu

SEQ ID NO: 1670993 - RNA, 14 nt, Salmonella enterica enterica serovar Typhi
ucgggaacgcuguc

SEQ ID NO: 1670994 - RNA, 19 nt, Salmonella enterica enterica serovar Typhi
ucgggagcagugauuaugc

SEQ ID NO: 1670995 - RNA, 23 nt, Salmonella enterica enterica serovar Typhi
ucgggugagacgcagccucucuu

SEQ ID NO: 1670996 - RNA, 16 nt, Salmonella enterica enterica serovar Typhi
ucggggucuuccagca

SEQ ID NO: 1670997 - RNA, 18 nt, Salmonella enterica enterica serovar Typhi
ucggggauucgccagcgu

SEQ ID NO: 1670998 - RNA, 18 nt, Salmonella enterica enterica serovar Typhi
ucgguggaaaccgcagaa

SEQ ID NO: 1670999 - RNA, 22 nt, Salmonella enterica enterica serovar Typhi
ucguaagccgcauuacaaacag

SEQ ID NO: 1671000 - RNA, 17 nt, Salmonella enterica enterica serovar Typhi
ucguaaaucaaaugaga

SEQ ID NO: 1671001 - RNA, 15 nt, Salmonella enterica enterica serovar Typhi
ucgguggauaaauuu

SEQ ID NO: 1671002 - RNA, 22 nt, Salmonella enterica enterica serovar Typhi
ucggugguuuuaacccccagca

SEQ ID NO: 1671003 - RNA, 23 nt, Salmonella enterica enterica serovar Typhi
ucggugcgguuacguccggcauu

SEQ ID NO: 1671004 - RNA, 13 nt, Salmonella enterica enterica serovar Typhi
ucggugcccggcu

SEQ ID NO: 1671005 - RNA, 16 nt, Salmonella enterica enterica serovar Typhi
ucggguuuuccugaau

SEQ ID NO: 1671006 - RNA, 22 nt, Salmonella enterica enterica serovar Typhi
ucgguauaugaaucaucagaau

SEQ ID NO: 1671007 - RNA, 16 nt, Salmonella enterica enterica serovar Typhi
ucgguaugccuuccag

SEQ ID NO: 1671008 - RNA, 23 nt, Salmonella enterica enterica serovar Typhi
ucgguacuucacaauaagaaauu

SEQ ID NO: 1671009 - RNA, 15 nt, Salmonella enterica enterica serovar Typhi
ucggucaguuugccc

SEQ ID NO: 1671010 - RNA, 15 nt, Salmonella enterica enterica serovar Typhi
ucggucuuuuucgca

SEQ ID NO: 1671011 - RNA, 18 nt, Salmonella enterica enterica serovar Typhi
ucguacgccuaaaugaac

SEQ ID NO: 1671012 - RNA, 21 nt, Salmonella enterica enterica serovar Typhi
ucguacacgcgcccgccgcca

SEQ ID NO: 1671013 - RNA, 18 nt, Salmonella enterica enterica serovar Typhi
ucguaaugagcacuuucc

SEQ ID NO: 1671014 - RNA, 12 nt, Salmonella enterica enterica serovar Typhi
ucgucccaggcc

SEQ ID NO: 1671015 - RNA, 14 nt, Salmonella enterica enterica serovar Typhi
ucguauuauuggug

SEQ ID NO: 1671016 - RNA, 12 nt, Salmonella enterica enterica serovar Typhi
ucguauuauugg

SEQ ID NO: 1671017 - RNA, 20 nt, Salmonella enterica enterica serovar Typhi
ucguauccccagucuuccug

SEQ ID NO: 1671018 - RNA, 21 nt, Salmonella enterica enterica serovar Typhi
ucguauccccagucuuccugc

SEQ ID NO: 1671019 - RNA, 13 nt, Salmonella enterica enterica serovar Typhi
ucguauccccagu

SEQ ID NO: 1671020 - RNA, 15 nt, Salmonella enterica enterica serovar Typhi
ucguauccccagucu

SEQ ID NO: 1671021 - RNA, 19 nt, Salmonella enterica enterica serovar Typhi
ucgucccaggccagaugcg

SEQ ID NO: 1671022 - RNA, 18 nt, Salmonella enterica enterica serovar Typhi
ucgucgccaaucagcagc

SEQ ID NO: 1671023 - RNA, 12 nt, Salmonella enterica enterica serovar Typhi
ucguccggugau

SEQ ID NO: 1671024 - RNA, 15 nt, Salmonella enterica enterica serovar Typhi
ucgucggcaagaauu

SEQ ID NO: 1671025 - RNA, 22 nt, Salmonella enterica enterica serovar Typhi
ucgucggcaagaauuucaauca

SEQ ID NO: 1671026 - RNA, 23 nt, Salmonella enterica enterica serovar Typhi
ucuaaaucuacccaauugaauuu

SEQ ID NO: 1671027 - RNA, 23 nt, Salmonella enterica enterica serovar Typhi
ucuaaaaaggaaagggacgauga

SEQ ID NO: 1671028 - RNA, 17 nt, Salmonella enterica enterica serovar Typhi
ucuaaaucauaccagcg

SEQ ID NO: 1671029 - RNA, 20 nt, Salmonella enterica enterica serovar Typhi
ucuacaguuugucaucaguc

SEQ ID NO: 1671030 - RNA, 11 nt, Salmonella enterica enterica serovar Typhi
ucguuaucauu

SEQ ID NO: 1671031 - RNA, 20 nt, Salmonella enterica enterica serovar Typhi
ucguuauuuccgagaucgcc

SEQ ID NO: 1671032 - RNA, 14 nt, Salmonella enterica enterica serovar Typhi
ucguuaccagcauc

SEQ ID NO: 1671033 - RNA, 14 nt, Salmonella enterica enterica serovar Typhi
ucguuacccgugcg

SEQ ID NO: 1671034 - RNA, 23 nt, Salmonella enterica enterica serovar Typhi
ucguuaccggcuccggcaaauuc

SEQ ID NO: 1671035 - RNA, 21 nt, Salmonella enterica enterica serovar Typhi
ucguuaccggugauauugccg

SEQ ID NO: 1671036 - RNA, 13 nt, Salmonella enterica enterica serovar Typhi
ucgugaggaaaaa

SEQ ID NO: 1671037 - RNA, 17 nt, Salmonella enterica enterica serovar Typhi
ucgugaggauaauccau

SEQ ID NO: 1671038 - RNA, 23 nt, Salmonella enterica enterica serovar Typhi
ucgugacaucaagcccacacauc

SEQ ID NO: 1671039 - RNA, 15 nt, Salmonella enterica enterica serovar Typhi
ucgugacccacacau

SEQ ID NO: 1671040 - RNA, 23 nt, Salmonella enterica enterica serovar Typhi
ucgugaaucaucaucauccgcgc

SEQ ID NO: 1671041 - RNA, 20 nt, Salmonella enterica enterica serovar Typhi
ucguuuaaguaagguaaagc

SEQ ID NO: 1671042 - RNA, 18 nt, Salmonella enterica enterica serovar Typhi
ucguuucccucauauuug

SEQ ID NO: 1671043 - RNA, 14 nt, Salmonella enterica enterica serovar Typhi
ucguucgcccuuca

SEQ ID NO: 1671044 - RNA, 22 nt, Salmonella enterica enterica serovar Typhi
ucguucgauagcguuuuccagc

SEQ ID NO: 1671045 - RNA, 15 nt, Salmonella enterica enterica serovar Typhi
ucguucccgccugcu

SEQ ID NO: 1671046 - RNA, 17 nt, Salmonella enterica enterica serovar Typhi
ucguuccgguucuuccc

SEQ ID NO: 1671047 - RNA, 16 nt, Salmonella enterica enterica serovar Typhi
ucguucauugcuuucu

SEQ ID NO: 1671048 - RNA, 21 nt, Salmonella enterica enterica serovar Typhi
uccuuccgccggggagggaug

SEQ ID NO: 1671049 - RNA, 16 nt, Salmonella enterica enterica serovar Typhi
uccuuccgcuuuaagc

SEQ ID NO: 1671050 - RNA, 17 nt, Salmonella enterica enterica serovar Typhi
uccuuccagcccguucu

SEQ ID NO: 1671051 - RNA, 13 nt, Salmonella enterica enterica serovar Typhi
uccuucauucaga

SEQ ID NO: 1671052 - RNA, 18 nt, Salmonella enterica enterica serovar Typhi
uccuucagcguuugcgcc

SEQ ID NO: 1671053 - RNA, 14 nt, Salmonella enterica enterica serovar Typhi
uccuucaauuuuac

SEQ ID NO: 1671054 - RNA, 18 nt, Salmonella enterica enterica serovar Typhi
uccuuauuaaagccccuu

SEQ ID NO: 1671055 - RNA, 21 nt, Salmonella enterica enterica serovar Typhi
uccuuauuuaauacaucagaa

SEQ ID NO: 1671056 - RNA, 17 nt, Salmonella enterica enterica serovar Typhi
uccuuauaaugcuuacg

SEQ ID NO: 1671057 - RNA, 10 nt, Salmonella enterica enterica serovar Typhi
uccuucuucc

SEQ ID NO: 1671058 - RNA, 13 nt, Salmonella enterica enterica serovar Typhi
uccuucuuccauu

SEQ ID NO: 1671059 - RNA, 16 nt, Salmonella enterica enterica serovar Typhi
uccuucuucgccguca

SEQ ID NO: 1671060 - RNA, 11 nt, Salmonella enterica enterica serovar Typhi
uccuucuuccg

SEQ ID NO: 1671061 - RNA, 20 nt, Salmonella enterica enterica serovar Typhi
uccuucguuacuuucauaau

SEQ ID NO: 1671062 - RNA, 15 nt, Salmonella enterica enterica serovar Typhi
uccuucgcuuccugg

SEQ ID NO: 1671063 - RNA, 15 nt, Salmonella enterica enterica serovar Typhi
uccuugauuucauug

SEQ ID NO: 1671064 - RNA, 14 nt, Salmonella enterica enterica serovar Typhi
uccuugagugguuu

SEQ ID NO: 1671065 - RNA, 21 nt, Salmonella enterica enterica serovar Typhi
uccuugcuucgauggccucau

SEQ ID NO: 1671066 - RNA, 20 nt, Salmonella enterica enterica serovar Typhi
uccugcaucgacauccgauu

SEQ ID NO: 1671067 - RNA, 22 nt, Salmonella enterica enterica serovar Typhi
uccugcgcuuuuugcuucgcca

SEQ ID NO: 1671068 - RNA, 15 nt, Salmonella enterica enterica serovar Typhi
uccugcggcaguucu

SEQ ID NO: 1671069 - RNA, 22 nt, Salmonella enterica enterica serovar Typhi
uccugcgugccguugaccagcu

SEQ ID NO: 1671070 - RNA, 20 nt, Salmonella enterica enterica serovar Typhi
uccugcucaugcgagguaua

SEQ ID NO: 1671071 - RNA, 17 nt, Salmonella enterica enterica serovar Typhi
uccugcuccaugcuguc

SEQ ID NO: 1671072 - RNA, 13 nt, Salmonella enterica enterica serovar Typhi
uccugcagcgcca

SEQ ID NO: 1671073 - RNA, 14 nt, Salmonella enterica enterica serovar Typhi
uccugcuccugcgg

SEQ ID NO: 1671074 - RNA, 21 nt, Salmonella enterica enterica serovar Typhi
uccugcuccugcggcguggaa

SEQ ID NO: 1671075 - RNA, 17 nt, Salmonella enterica enterica serovar Typhi
uccugcugcgccagcgc

SEQ ID NO: 1671076 - RNA, 21 nt, Salmonella enterica enterica serovar Typhi
uccugcuggcaaaacgcaucc

SEQ ID NO: 1671077 - RNA, 13 nt, Salmonella enterica enterica serovar Typhi
uccuggauuuuac

SEQ ID NO: 1671078 - RNA, 14 nt, Salmonella enterica enterica serovar Typhi
uccuggauuugcug

SEQ ID NO: 1671079 - RNA, 13 nt, Salmonella enterica enterica serovar Typhi
uccuggaacugac

SEQ ID NO: 1671080 - RNA, 22 nt, Salmonella enterica enterica serovar Typhi
uccuguagcgucuuuugaguga

SEQ ID NO: 1671081 - RNA, 15 nt, Salmonella enterica enterica serovar Typhi
uccuggccaggcuuc

SEQ ID NO: 1671082 - RNA, 22 nt, Salmonella enterica enterica serovar Typhi
uccuguaacaacuguuuuucac

SEQ ID NO: 1671083 - RNA, 15 nt, Salmonella enterica enterica serovar Typhi
uccugugcuuugauu

SEQ ID NO: 1671084 - RNA, 12 nt, Salmonella enterica enterica serovar Typhi
uccugucccugc

SEQ ID NO: 1671085 - RNA, 18 nt, Salmonella enterica enterica serovar Typhi
uccugucgucaccagcag

SEQ ID NO: 1671086 - RNA, 23 nt, Salmonella enterica enterica serovar Typhi
ucgaacgccgccugcgccagcgc

SEQ ID NO: 1671087 - RNA, 16 nt, Salmonella enterica enterica serovar Typhi
ucgaacgguaacagga

SEQ ID NO: 1671088 - RNA, 19 nt, Salmonella enterica enterica serovar Typhi
ucgaacagcggcaggcgga

SEQ ID NO: 1671089 - RNA, 11 nt, Salmonella enterica enterica serovar Typhi
ucgacaagcua

SEQ ID NO: 1671090 - RNA, 19 nt, Salmonella enterica enterica serovar Typhi
ucgacaauaaauugcgacc

SEQ ID NO: 1671091 - RNA, 23 nt, Salmonella enterica enterica serovar Typhi
ucgacaacgcguuuauuauaaac

SEQ ID NO: 1671092 - RNA, 16 nt, Salmonella enterica enterica serovar Typhi
ucgaaucgccucaacc

SEQ ID NO: 1671093 - RNA, 21 nt, Salmonella enterica enterica serovar Typhi
ucgaauaaagacacugcugcu

SEQ ID NO: 1671094 - RNA, 22 nt, Salmonella enterica enterica serovar Typhi
ucgacccgcaaugugcagcagg

SEQ ID NO: 1671095 - RNA, 18 nt, Salmonella enterica enterica serovar Typhi
ucgacagauuggucagca

SEQ ID NO: 1671096 - RNA, 17 nt, Salmonella enterica enterica serovar Typhi
ucgaccgucagcagcac

SEQ ID NO: 1671097 - RNA, 20 nt, Salmonella enterica enterica serovar Typhi
ucgaaacuggcauugugagc

SEQ ID NO: 1671098 - RNA, 16 nt, Salmonella enterica enterica serovar Typhi
ucgaaagagcaaauac

SEQ ID NO: 1671099 - RNA, 22 nt, Salmonella enterica enterica serovar Typhi
ucgaaagagcaaauacuggaaa

SEQ ID NO: 1671100 - RNA, 15 nt, Salmonella enterica enterica serovar Typhi
uccuuguaggccgga

SEQ ID NO: 1671101 - RNA, 19 nt, Salmonella enterica enterica serovar Typhi
uccuuuaucugcccuuucu

SEQ ID NO: 1671102 - RNA, 20 nt, Salmonella enterica enterica serovar Typhi
uccuuuaggguugacugcca

SEQ ID NO: 1671103 - RNA, 18 nt, Salmonella enterica enterica serovar Typhi
uccuuucgagaagcccag

SEQ ID NO: 1671104 - RNA, 14 nt, Salmonella enterica enterica serovar Typhi
uccuuugccuuucu

SEQ ID NO: 1671105 - RNA, 15 nt, Salmonella enterica enterica serovar Typhi
uccuuugccuuucuu

SEQ ID NO: 1671106 - RNA, 19 nt, Salmonella enterica enterica serovar Typhi
ucgacgcuauuuuucaggg

SEQ ID NO: 1671107 - RNA, 20 nt, Salmonella enterica enterica serovar Typhi
ucgacgccgguuaguaguag

SEQ ID NO: 1671108 - RNA, 13 nt, Salmonella enterica enterica serovar Typhi
ucgacgccagcgg

SEQ ID NO: 1671109 - RNA, 22 nt, Salmonella enterica enterica serovar Typhi
ucgauaucugccugcagaccca

SEQ ID NO: 1671110 - RNA, 20 nt, Salmonella enterica enterica serovar Typhi
ucgauaaccuguaaauaaua

SEQ ID NO: 1671111 - RNA, 20 nt, Salmonella enterica enterica serovar Typhi
ucgaguucuucacgcugaug

SEQ ID NO: 1671112 - RNA, 15 nt, Salmonella enterica enterica serovar Typhi
ucgcaccaccggacu

SEQ ID NO: 1671113 - RNA, 13 nt, Salmonella enterica enterica serovar Typhi
ucgcaccauagca

SEQ ID NO: 1671114 - RNA, 14 nt, Salmonella enterica enterica serovar Typhi
ucgcaaugccacca

SEQ ID NO: 1671115 - RNA, 13 nt, Salmonella enterica enterica serovar Typhi
ucgcaaugccacc

SEQ ID NO: 1671116 - RNA, 15 nt, Salmonella enterica enterica serovar Typhi
ucgcaauauucaugc

SEQ ID NO: 1671117 - RNA, 21 nt, Salmonella enterica enterica serovar Typhi
ucgcaauauaaauaucauucg

SEQ ID NO: 1671118 - RNA, 20 nt, Salmonella enterica enterica serovar Typhi
ucgcaauauacugauauugc

SEQ ID NO: 1671119 - RNA, 18 nt, Salmonella enterica enterica serovar Typhi
ucgcacgccucuggcgua

SEQ ID NO: 1671120 - RNA, 20 nt, Salmonella enterica enterica serovar Typhi
ucgcagggcugcuggugcgc

SEQ ID NO: 1671121 - RNA, 22 nt, Salmonella enterica enterica serovar Typhi
ucgcaacgcuuaucagucccca

SEQ ID NO: 1671122 - RNA, 18 nt, Salmonella enterica enterica serovar Typhi
ucgccgccaucggcgcgu

SEQ ID NO: 1671123 - RNA, 18 nt, Salmonella enterica enterica serovar Typhi
ucgccgcgcgaagaggau

SEQ ID NO: 1671124 - RNA, 18 nt, Salmonella enterica enterica serovar Typhi
ucgccgcguuuaaguccc

SEQ ID NO: 1671125 - RNA, 18 nt, Salmonella enterica enterica serovar Typhi
ucgccgcugccgcuauug

SEQ ID NO: 1671126 - RNA, 18 nt, Salmonella enterica enterica serovar Typhi
ucgcccuucaucuuccag

SEQ ID NO: 1671127 - RNA, 19 nt, Salmonella enterica enterica serovar Typhi
ucgcccuucaucuuccagu

SEQ ID NO: 1671128 - RNA, 17 nt, Salmonella enterica enterica serovar Typhi
ucgccuguaccgggcag

SEQ ID NO: 1671129 - RNA, 18 nt, Salmonella enterica enterica serovar Typhi
ucgccugcgucgccccaa

SEQ ID NO: 1671130 - RNA, 16 nt, Salmonella enterica enterica serovar Typhi
ucgccuuauccggccu

SEQ ID NO: 1671131 - RNA, 17 nt, Salmonella enterica enterica serovar Typhi
ucgccuucuucaucuuc

SEQ ID NO: 1671132 - RNA, 23 nt, Salmonella enterica enterica serovar Typhi
ucgccguaaaacaacagcggcgu

SEQ ID NO: 1671133 - RNA, 21 nt, Salmonella enterica enterica serovar Typhi
ucgccguaggcgugggugaag

SEQ ID NO: 1671134 - RNA, 16 nt, Salmonella enterica enterica serovar Typhi
ucgccgguuuugguau

SEQ ID NO: 1671135 - RNA, 21 nt, Salmonella enterica enterica serovar Typhi
ucgccggagccgccuggccug

SEQ ID NO: 1671136 - RNA, 14 nt, Salmonella enterica enterica serovar Typhi
ucgccguccauuuc

SEQ ID NO: 1671137 - RNA, 17 nt, Salmonella enterica enterica serovar Typhi
ucgccguguaagagcug

SEQ ID NO: 1671138 - RNA, 14 nt, Salmonella enterica enterica serovar Typhi
ucgccuaaaugacc

SEQ ID NO: 1671139 - RNA, 18 nt, Salmonella enterica enterica serovar Typhi
ucgcccgccgcaaaaaau

SEQ ID NO: 1671140 - RNA, 14 nt, Salmonella enterica enterica serovar Typhi
ucgcccggaaaugg

SEQ ID NO: 1671141 - RNA, 22 nt, Salmonella enterica enterica serovar Typhi
ucgcccgggcgauaucacggaa

SEQ ID NO: 1671142 - RNA, 14 nt, Salmonella enterica enterica serovar Typhi
ucgcccugcaauuc

SEQ ID NO: 1671143 - RNA, 20 nt, Salmonella enterica enterica serovar Typhi
ucgcccucgccagcaacagg

SEQ ID NO: 1671144 - RNA, 14 nt, Salmonella enterica enterica serovar Typhi
ucgcccucgccagc

SEQ ID NO: 1671145 - RNA, 11 nt, Salmonella enterica enterica serovar Typhi
ucgccccacac

SEQ ID NO: 1671146 - RNA, 19 nt, Salmonella enterica enterica serovar Typhi
ucgccccggcgagugccug

SEQ ID NO: 1671147 - RNA, 17 nt, Salmonella enterica enterica serovar Typhi
ucgcauaaaauuauaaa

SEQ ID NO: 1671148 - RNA, 13 nt, Salmonella enterica enterica serovar Typhi
ucgcauagacgcc

SEQ ID NO: 1671149 - RNA, 15 nt, Salmonella enterica enterica serovar Typhi
ucgccaaagauauag

SEQ ID NO: 1671150 - RNA, 17 nt, Salmonella enterica enterica serovar Typhi
ucgccaagaucgccaag

SEQ ID NO: 1671151 - RNA, 21 nt, Salmonella enterica enterica serovar Typhi
ucgccaauaauuaguuuuacc

SEQ ID NO: 1671152 - RNA, 22 nt, Salmonella enterica enterica serovar Typhi
ucgccauccggcaaugauuaga

SEQ ID NO: 1671153 - RNA, 20 nt, Salmonella enterica enterica serovar Typhi
ucgccaucgauagcagcgcu

SEQ ID NO: 1671154 - RNA, 14 nt, Salmonella enterica enterica serovar Typhi
ugauaagagaaaau

SEQ ID NO: 1671155 - RNA, 13 nt, Salmonella enterica enterica serovar Typhi
ugauaagagaaaa

SEQ ID NO: 1671156 - RNA, 16 nt, Salmonella enterica enterica serovar Typhi
ugauaaauguuuacuu

SEQ ID NO: 1671157 - RNA, 18 nt, Salmonella enterica enterica serovar Typhi
ugauaagcauagcgccau

SEQ ID NO: 1671158 - RNA, 13 nt, Salmonella enterica enterica serovar Typhi
ugauaagcgcagc

SEQ ID NO: 1671159 - RNA, 21 nt, Salmonella enterica enterica serovar Typhi
ugauaauaauuguaggcagga

SEQ ID NO: 1671160 - RNA, 12 nt, Salmonella enterica enterica serovar Typhi
ugauaaucagcg

SEQ ID NO: 1671161 - RNA, 22 nt, Salmonella enterica enterica serovar Typhi
ugauacagaaaaccggcaaaua

SEQ ID NO: 1671162 - RNA, 16 nt, Salmonella enterica enterica serovar Typhi
ugauacaggaauaacc

SEQ ID NO: 1671163 - RNA, 14 nt, Salmonella enterica enterica serovar Typhi
ugauacagcagcac

SEQ ID NO: 1671164 - RNA, 23 nt, Salmonella enterica enterica serovar Typhi
ugauacagccaaaucagcaggac

SEQ ID NO: 1671165 - RNA, 22 nt, Salmonella enterica enterica serovar Typhi
ugauaauguuggauuauacauu

SEQ ID NO: 1671166 - RNA, 14 nt, Salmonella enterica enterica serovar Typhi
ugauaccggaggag

SEQ ID NO: 1671167 - RNA, 17 nt, Salmonella enterica enterica serovar Typhi
ugauaccuauuuaauaa

SEQ ID NO: 1671168 - RNA, 21 nt, Salmonella enterica enterica serovar Typhi
ugauacggcgugaucacuccc

SEQ ID NO: 1671169 - RNA, 19 nt, Salmonella enterica enterica serovar Typhi
ugauacgggaagucauuag

SEQ ID NO: 1671170 - RNA, 15 nt, Salmonella enterica enterica serovar Typhi
ugauaccuauuuaau

SEQ ID NO: 1671171 - RNA, 19 nt, Salmonella enterica enterica serovar Typhi
ugauacgcgucaaauagag

SEQ ID NO: 1671172 - RNA, 14 nt, Salmonella enterica enterica serovar Typhi
ugagcauugcgcuc

SEQ ID NO: 1671173 - RNA, 15 nt, Salmonella enterica enterica serovar Typhi
ugaguuaacgacugc

SEQ ID NO: 1671174 - RNA, 17 nt, Salmonella enterica enterica serovar Typhi
ugaguuugacugccaga

SEQ ID NO: 1671175 - RNA, 16 nt, Salmonella enterica enterica serovar Typhi
ugaguuugucauccag

SEQ ID NO: 1671176 - RNA, 13 nt, Salmonella enterica enterica serovar Typhi
ugauaaagcgcuc

SEQ ID NO: 1671177 - RNA, 11 nt, Salmonella enterica enterica serovar Typhi
ugauaaauauc

SEQ ID NO: 1671178 - RNA, 15 nt, Salmonella enterica enterica serovar Typhi
ugauaaauacgcugc

SEQ ID NO: 1671179 - RNA, 14 nt, Salmonella enterica enterica serovar Typhi
ugauaaaacgcagg

SEQ ID NO: 1671180 - RNA, 17 nt, Salmonella enterica enterica serovar Typhi
ugauaaaauaaacacua

SEQ ID NO: 1671181 - RNA, 18 nt, Salmonella enterica enterica serovar Typhi
ugauaaaauaaacacuaa

SEQ ID NO: 1671182 - RNA, 23 nt, Salmonella enterica enterica serovar Typhi
ugaucaauuugccuuuauucauu

SEQ ID NO: 1671183 - RNA, 13 nt, Salmonella enterica enterica serovar Typhi
ugaucaggcaaaa

SEQ ID NO: 1671184 - RNA, 21 nt, Salmonella enterica enterica serovar Typhi
ugauaucggccggaugccagu

SEQ ID NO: 1671185 - RNA, 18 nt, Salmonella enterica enterica serovar Typhi
ugauagggcgccuguuua

SEQ ID NO: 1671186 - RNA, 13 nt, Salmonella enterica enterica serovar Typhi
ugauagggcagca

SEQ ID NO: 1671187 - RNA, 14 nt, Salmonella enterica enterica serovar Typhi
ugauagggcagcag

SEQ ID NO: 1671188 - RNA, 23 nt, Salmonella enterica enterica serovar Typhi
ugauagguucaauaugccaggca

SEQ ID NO: 1671189 - RNA, 18 nt, Salmonella enterica enterica serovar Typhi
ugauaguuuaaauccagc

SEQ ID NO: 1671190 - RNA, 21 nt, Salmonella enterica enterica serovar Typhi
ugauagcccguuaugccaucu

SEQ ID NO: 1671191 - RNA, 18 nt, Salmonella enterica enterica serovar Typhi
ugauagcgaggcagcagg

SEQ ID NO: 1671192 - RNA, 16 nt, Salmonella enterica enterica serovar Typhi
ugauagacguaaugau

SEQ ID NO: 1671193 - RNA, 23 nt, Salmonella enterica enterica serovar Typhi
ugauagagguuaccgggcuaaac

SEQ ID NO: 1671194 - RNA, 18 nt, Salmonella enterica enterica serovar Typhi
ugaugagaugcaggccaa

SEQ ID NO: 1671195 - RNA, 12 nt, Salmonella enterica enterica serovar Typhi
ugaucuuucugg

SEQ ID NO: 1671196 - RNA, 22 nt, Salmonella enterica enterica serovar Typhi
ugaucuucaaccucuauaacuu

SEQ ID NO: 1671197 - RNA, 18 nt, Salmonella enterica enterica serovar Typhi
ugaucuucaaccucuaua

SEQ ID NO: 1671198 - RNA, 15 nt, Salmonella enterica enterica serovar Typhi
ugaugauagcgccau

SEQ ID NO: 1671199 - RNA, 17 nt, Salmonella enterica enterica serovar Typhi
ugaugaugaagcugcag

SEQ ID NO: 1671200 - RNA, 17 nt, Salmonella enterica enterica serovar Typhi
ugaugagcaggccaggg

SEQ ID NO: 1671201 - RNA, 22 nt, Salmonella enterica enterica serovar Typhi
ugaugccccagaacaacgggaa

SEQ ID NO: 1671202 - RNA, 13 nt, Salmonella enterica enterica serovar Typhi
ugaugaugccagg

SEQ ID NO: 1671203 - RNA, 14 nt, Salmonella enterica enterica serovar Typhi
ugaucauacugccg

SEQ ID NO: 1671204 - RNA, 15 nt, Salmonella enterica enterica serovar Typhi
ugaucauacugccgc

SEQ ID NO: 1671205 - RNA, 20 nt, Salmonella enterica enterica serovar Typhi
ugaucaucggcgcgucgcug

SEQ ID NO: 1671206 - RNA, 18 nt, Salmonella enterica enterica serovar Typhi
ugaucggguuuuccugaa

SEQ ID NO: 1671207 - RNA, 15 nt, Salmonella enterica enterica serovar Typhi
ugaucguuucauuuu

SEQ ID NO: 1671208 - RNA, 13 nt, Salmonella enterica enterica serovar Typhi
ugaucuggccaau

SEQ ID NO: 1671209 - RNA, 19 nt, Salmonella enterica enterica serovar Typhi
ugaucuggccaauuuuuca

SEQ ID NO: 1671210 - RNA, 18 nt, Salmonella enterica enterica serovar Typhi
ugcaaaaugcuucuucaa

SEQ ID NO: 1671211 - RNA, 14 nt, Salmonella enterica enterica serovar Typhi
ugcaaaagaaaaaa

SEQ ID NO: 1671212 - RNA, 23 nt, Salmonella enterica enterica serovar Typhi
ugauuuuuaccgccgguuuaucc

SEQ ID NO: 1671213 - RNA, 17 nt, Salmonella enterica enterica serovar Typhi
ugcaaauaccacaucag

SEQ ID NO: 1671214 - RNA, 20 nt, Salmonella enterica enterica serovar Typhi
ugcaaauacugcuuuuccgg

SEQ ID NO: 1671215 - RNA, 14 nt, Salmonella enterica enterica serovar Typhi
ugcaaauauucgcc

SEQ ID NO: 1671216 - RNA, 14 nt, Salmonella enterica enterica serovar Typhi
ugcaaaugucagau

SEQ ID NO: 1671217 - RNA, 14 nt, Salmonella enterica enterica serovar Typhi
ugcaaauccaucuc

SEQ ID NO: 1671218 - RNA, 17 nt, Salmonella enterica enterica serovar Typhi
ugauuuacuccaaaaau

SEQ ID NO: 1671219 - RNA, 16 nt, Salmonella enterica enterica serovar Typhi
ugauugcgacaggcug

SEQ ID NO: 1671220 - RNA, 21 nt, Salmonella enterica enterica serovar Typhi
ugauugccggagauuuaucuu

SEQ ID NO: 1671221 - RNA, 17 nt, Salmonella enterica enterica serovar Typhi
ugauugccggaugacgc

SEQ ID NO: 1671222 - RNA, 15 nt, Salmonella enterica enterica serovar Typhi
ugauuuauuuugaau

SEQ ID NO: 1671223 - RNA, 20 nt, Salmonella enterica enterica serovar Typhi
ugauugacuaucagccgcga

SEQ ID NO: 1671224 - RNA, 13 nt, Salmonella enterica enterica serovar Typhi
ugauugauuuugu

SEQ ID NO: 1671225 - RNA, 22 nt, Salmonella enterica enterica serovar Typhi
ugauuacguuuucccugagcgc

SEQ ID NO: 1671226 - RNA, 20 nt, Salmonella enterica enterica serovar Typhi
ugauuagaaacccauauucc

SEQ ID NO: 1671227 - RNA, 18 nt, Salmonella enterica enterica serovar Typhi
ugaugcgccccgcuuccc

SEQ ID NO: 1671228 - RNA, 18 nt, Salmonella enterica enterica serovar Typhi
ugaugcgccugucuccag

SEQ ID NO: 1671229 - RNA, 19 nt, Salmonella enterica enterica serovar Typhi
ugaugcgccugucuccagc

SEQ ID NO: 1671230 - RNA, 16 nt, Salmonella enterica enterica serovar Typhi
ugauuaaaauaaauga

SEQ ID NO: 1671231 - RNA, 13 nt, Salmonella enterica enterica serovar Typhi
ugauuaaagccac

SEQ ID NO: 1671232 - RNA, 20 nt, Salmonella enterica enterica serovar Typhi
ugcacgcacgacagugcuau

SEQ ID NO: 1671233 - RNA, 21 nt, Salmonella enterica enterica serovar Typhi
ugcacgccaggguaauacugg

SEQ ID NO: 1671234 - RNA, 15 nt, Salmonella enterica enterica serovar Typhi
ugcacgccaggguaa

SEQ ID NO: 1671235 - RNA, 16 nt, Salmonella enterica enterica serovar Typhi
ugcacgcgcggcgcca

SEQ ID NO: 1671236 - RNA, 16 nt, Salmonella enterica enterica serovar Typhi
ugcaauuguuccugcg

SEQ ID NO: 1671237 - RNA, 16 nt, Salmonella enterica enterica serovar Typhi
ugcaauguucaauauc

SEQ ID NO: 1671238 - RNA, 20 nt, Salmonella enterica enterica serovar Typhi
ugcaauuccggcgaaaaacc

SEQ ID NO: 1671239 - RNA, 24 nt, Salmonella enterica enterica serovar Typhi
ugcaauuucugcuggacaugauaa

SEQ ID NO: 1671240 - RNA, 16 nt, Salmonella enterica enterica serovar Typhi
ugcaccagaacucccu

SEQ ID NO: 1671241 - RNA, 17 nt, Salmonella enterica enterica serovar Typhi
ugcaccacuuuguuuuu

SEQ ID NO: 1671242 - RNA, 16 nt, Salmonella enterica enterica serovar Typhi
ugcacccgccuuaccc

SEQ ID NO: 1671243 - RNA, 17 nt, Salmonella enterica enterica serovar Typhi
ugcacccggagagaaac

SEQ ID NO: 1671244 - RNA, 16 nt, Salmonella enterica enterica serovar Typhi
ugcaacuucaccucag

SEQ ID NO: 1671245 - RNA, 16 nt, Salmonella enterica enterica serovar Typhi
ugcaacuauuaauucu

SEQ ID NO: 1671246 - RNA, 21 nt, Salmonella enterica enterica serovar Typhi
ugcaacgcuuuagugccgcca

SEQ ID NO: 1671247 - RNA, 20 nt, Salmonella enterica enterica serovar Typhi
ugcaagaaauguccauaaau

SEQ ID NO: 1671248 - RNA, 13 nt, Salmonella enterica enterica serovar Typhi
ugcaagagaaaua

SEQ ID NO: 1671249 - RNA, 17 nt, Salmonella enterica enterica serovar Typhi
ugcaagaacgggcugcg

SEQ ID NO: 1671250 - RNA, 22 nt, Salmonella enterica enterica serovar Typhi
ugcaaucaguuccaaucucuuu

SEQ ID NO: 1671251 - RNA, 20 nt, Salmonella enterica enterica serovar Typhi
ugcaaucagcgaaggcaacu

SEQ ID NO: 1671252 - RNA, 19 nt, Salmonella enterica enterica serovar Typhi
ugcaacauugcaggucugg

SEQ ID NO: 1671253 - RNA, 21 nt, Salmonella enterica enterica serovar Typhi
ugcaacgaucccuaauaaaau

SEQ ID NO: 1671254 - RNA, 23 nt, Salmonella enterica enterica serovar Typhi
ugcaacgaucccuaauaaaauaa

SEQ ID NO: 1671255 - RNA, 14 nt, Salmonella enterica enterica serovar Typhi
ugcaacagcaccag

SEQ ID NO: 1671256 - RNA, 24 nt, Salmonella enterica enterica serovar Typhi
ugcaacaucuuaccggugcgauuc

SEQ ID NO: 1671257 - RNA, 15 nt, Salmonella enterica enterica serovar Typhi
ugacgguuuauaugc

SEQ ID NO: 1671258 - RNA, 22 nt, Salmonella enterica enterica serovar Typhi
ugacgguaaaguaauuuccaua

SEQ ID NO: 1671259 - RNA, 22 nt, Salmonella enterica enterica serovar Typhi
ugacgguauucccggucaagcg

SEQ ID NO: 1671260 - RNA, 20 nt, Salmonella enterica enterica serovar Typhi
ugacggggggaauguuuggc

SEQ ID NO: 1671261 - RNA, 16 nt, Salmonella enterica enterica serovar Typhi
ugacguagauucugau

SEQ ID NO: 1671262 - RNA, 13 nt, Salmonella enterica enterica serovar Typhi
ugacguacaaaca

SEQ ID NO: 1671263 - RNA, 22 nt, Salmonella enterica enterica serovar Typhi
ugacguacaaacaguuuuuccu

SEQ ID NO: 1671264 - RNA, 21 nt, Salmonella enterica enterica serovar Typhi
ugacgucgcaagacgaaaaau

SEQ ID NO: 1671265 - RNA, 20 nt, Salmonella enterica enterica serovar Typhi
ugacgucgcagccugauggc

SEQ ID NO: 1671266 - RNA, 14 nt, Salmonella enterica enterica serovar Typhi
ugacgugagagaaa

SEQ ID NO: 1671267 - RNA, 16 nt, Salmonella enterica enterica serovar Typhi
ugacguuauccaguau

SEQ ID NO: 1671268 - RNA, 17 nt, Salmonella enterica enterica serovar Typhi
ugacguuaucugucagc

SEQ ID NO: 1671269 - RNA, 16 nt, Salmonella enterica enterica serovar Typhi
ugacucuguggccgcg

SEQ ID NO: 1671270 - RNA, 23 nt, Salmonella enterica enterica serovar Typhi
ugacugaaauuacgccauaaaaa

SEQ ID NO: 1671271 - RNA, 22 nt, Salmonella enterica enterica serovar Typhi
ugacucuuguuucucguauuau

SEQ ID NO: 1671272 - RNA, 15 nt, Salmonella enterica enterica serovar Typhi
ugacugaacucauca

SEQ ID NO: 1671273 - RNA, 16 nt, Salmonella enterica enterica serovar Typhi
ugacugaauuaucagg

SEQ ID NO: 1671274 - RNA, 22 nt, Salmonella enterica enterica serovar Typhi
ugacugagccacugcugaaagc

SEQ ID NO: 1671275 - RNA, 17 nt, Salmonella enterica enterica serovar Typhi
ugacugaucgauccacu

SEQ ID NO: 1671276 - RNA, 21 nt, Salmonella enterica enterica serovar Typhi
ugacuauacccaaaauaauuc

SEQ ID NO: 1671277 - RNA, 15 nt, Salmonella enterica enterica serovar Typhi
ugacuauccacagcg

SEQ ID NO: 1671278 - RNA, 19 nt, Salmonella enterica enterica serovar Typhi
ugacuaucuggauacgaua

SEQ ID NO: 1671279 - RNA, 16 nt, Salmonella enterica enterica serovar Typhi
ugacuucacacugugg

SEQ ID NO: 1671280 - RNA, 20 nt, Salmonella enterica enterica serovar Typhi
ugacuucugcucgguaaaaa

SEQ ID NO: 1671281 - RNA, 22 nt, Salmonella enterica enterica serovar Typhi
ugacuucugcucgguaaaaagu

SEQ ID NO: 1671282 - RNA, 13 nt, Salmonella enterica enterica serovar Typhi
ugagaccauccug

SEQ ID NO: 1671283 - RNA, 18 nt, Salmonella enterica enterica serovar Typhi
ugagaauuuccaguucaa

SEQ ID NO: 1671284 - RNA, 19 nt, Salmonella enterica enterica serovar Typhi
ugagaauuuccaguucaau

SEQ ID NO: 1671285 - RNA, 22 nt, Salmonella enterica enterica serovar Typhi
ugagagaacguugccgcaggca

SEQ ID NO: 1671286 - RNA, 19 nt, Salmonella enterica enterica serovar Typhi
ugagagcacguaggccuga

SEQ ID NO: 1671287 - RNA, 12 nt, Salmonella enterica enterica serovar Typhi
ugagacucagca

SEQ ID NO: 1671288 - RNA, 17 nt, Salmonella enterica enterica serovar Typhi
ugagacuguuugucuca

SEQ ID NO: 1671289 - RNA, 22 nt, Salmonella enterica enterica serovar Typhi
ugagagucgauacucacgacuu

SEQ ID NO: 1671290 - RNA, 17 nt, Salmonella enterica enterica serovar Typhi
ugagagacggagaaaaa

SEQ ID NO: 1671291 - RNA, 16 nt, Salmonella enterica enterica serovar Typhi
ugaccgaucacggcuu

SEQ ID NO: 1671292 - RNA, 16 nt, Salmonella enterica enterica serovar Typhi
ugaccgcacagcagac

SEQ ID NO: 1671293 - RNA, 14 nt, Salmonella enterica enterica serovar Typhi
ugacccucccugcg

SEQ ID NO: 1671294 - RNA, 22 nt, Salmonella enterica enterica serovar Typhi
ugaccaguaagggcagccgaga

SEQ ID NO: 1671295 - RNA, 18 nt, Salmonella enterica enterica serovar Typhi
ugaccaacgucagcaucu

SEQ ID NO: 1671296 - RNA, 21 nt, Salmonella enterica enterica serovar Typhi
ugaccaacaucauuauucccc

SEQ ID NO: 1671297 - RNA, 20 nt, Salmonella enterica enterica serovar Typhi
ugaccaacaucauuauuccc

SEQ ID NO: 1671298 - RNA, 13 nt, Salmonella enterica enterica serovar Typhi
ugaccaacaacag

SEQ ID NO: 1671299 - RNA, 17 nt, Salmonella enterica enterica serovar Typhi
ugaccaacaacagauau

SEQ ID NO: 1671300 - RNA, 18 nt, Salmonella enterica enterica serovar Typhi
ugacaucucaucggcuuu

SEQ ID NO: 1671301 - RNA, 20 nt, Salmonella enterica enterica serovar Typhi
ugacaucucuuuuaauuuuc

SEQ ID NO: 1671302 - RNA, 21 nt, Salmonella enterica enterica serovar Typhi
ugacaaucuccuccggcuuca

SEQ ID NO: 1671303 - RNA, 12 nt, Salmonella enterica enterica serovar Typhi
ugacaaucugcu

SEQ ID NO: 1671304 - RNA, 18 nt, Salmonella enterica enterica serovar Typhi
ugacaucgcaaugccacc

SEQ ID NO: 1671305 - RNA, 18 nt, Salmonella enterica enterica serovar Typhi
ugacaucccccucuugcc

SEQ ID NO: 1671306 - RNA, 20 nt, Salmonella enterica enterica serovar Typhi
ugacgaaaaccguccacauc

SEQ ID NO: 1671307 - RNA, 20 nt, Salmonella enterica enterica serovar Typhi
ugacgaauaccgugcacgcu

SEQ ID NO: 1671308 - RNA, 15 nt, Salmonella enterica enterica serovar Typhi
ugacgacccgcuucc

SEQ ID NO: 1671309 - RNA, 17 nt, Salmonella enterica enterica serovar Typhi
ugaccgccgucauagca

SEQ ID NO: 1671310 - RNA, 23 nt, Salmonella enterica enterica serovar Typhi
ugaccgccgucauagcaggagau

SEQ ID NO: 1671311 - RNA, 14 nt, Salmonella enterica enterica serovar Typhi
ugaccgccgcgcgu

SEQ ID NO: 1671312 - RNA, 17 nt, Salmonella enterica enterica serovar Typhi
ugaccuuaauccagcag

SEQ ID NO: 1671313 - RNA, 18 nt, Salmonella enterica enterica serovar Typhi
ugaccugcagcuccgcaa

SEQ ID NO: 1671314 - RNA, 17 nt, Salmonella enterica enterica serovar Typhi
ugaccugggcgccagag

SEQ ID NO: 1671315 - RNA, 18 nt, Salmonella enterica enterica serovar Typhi
ugacgauguucgucccug

SEQ ID NO: 1671316 - RNA, 12 nt, Salmonella enterica enterica serovar Typhi
ugacgccaggca

SEQ ID NO: 1671317 - RNA, 20 nt, Salmonella enterica enterica serovar Typhi
ugacgccaguucccacagcu

SEQ ID NO: 1671318 - RNA, 18 nt, Salmonella enterica enterica serovar Typhi
ugacgcgcauacucauua

SEQ ID NO: 1671319 - RNA, 18 nt, Salmonella enterica enterica serovar Typhi
ugacgccgcuguuuucac

SEQ ID NO: 1671320 - RNA, 18 nt, Salmonella enterica enterica serovar Typhi
ugacgcgaauuauagaac

SEQ ID NO: 1671321 - RNA, 15 nt, Salmonella enterica enterica serovar Typhi
ugacgcgucauaaug

SEQ ID NO: 1671322 - RNA, 18 nt, Salmonella enterica enterica serovar Typhi
ugacgggaaaucucccug

SEQ ID NO: 1671323 - RNA, 22 nt, Salmonella enterica enterica serovar Typhi
ugacgcguuaauauccuucagc

SEQ ID NO: 1671324 - RNA, 20 nt, Salmonella enterica enterica serovar Typhi
ugacgcgucauaaugcccag

SEQ ID NO: 1671325 - RNA, 20 nt, Salmonella enterica enterica serovar Typhi
ugaacucuaugcaaaagaaa

SEQ ID NO: 1671326 - RNA, 23 nt, Salmonella enterica enterica serovar Typhi
ugaacucuaugcaaaagaaaaaa

SEQ ID NO: 1671327 - RNA, 22 nt, Salmonella enterica enterica serovar Typhi
ugaacuacgccccggcgcgcca

SEQ ID NO: 1671328 - RNA, 20 nt, Salmonella enterica enterica serovar Typhi
ugaacuacggcccuggcuca

SEQ ID NO: 1671329 - RNA, 22 nt, Salmonella enterica enterica serovar Typhi
ugaacuacggcccuggcucaau

SEQ ID NO: 1671330 - RNA, 18 nt, Salmonella enterica enterica serovar Typhi
ugaacggcucaaaauaau

SEQ ID NO: 1671331 - RNA, 19 nt, Salmonella enterica enterica serovar Typhi
ugaagacgacgggaaaaag

SEQ ID NO: 1671332 - RNA, 18 nt, Salmonella enterica enterica serovar Typhi
ugaacuuccguaaaaaga

SEQ ID NO: 1671333 - RNA, 13 nt, Salmonella enterica enterica serovar Typhi
ugaagcugcaggg

SEQ ID NO: 1671334 - RNA, 18 nt, Salmonella enterica enterica serovar Typhi
ugaagcugccgucccagc

SEQ ID NO: 1671335 - RNA, 17 nt, Salmonella enterica enterica serovar Typhi
ugaaggcaaaacaccau

SEQ ID NO: 1671336 - RNA, 18 nt, Salmonella enterica enterica serovar Typhi
ugaaggcgcuccccugcu

SEQ ID NO: 1671337 - RNA, 21 nt, Salmonella enterica enterica serovar Typhi
ugaagggcggcuggauaaaag

SEQ ID NO: 1671338 - RNA, 22 nt, Salmonella enterica enterica serovar Typhi
ugaagggcauauuaugcugcuc

SEQ ID NO: 1671339 - RNA, 15 nt, Salmonella enterica enterica serovar Typhi
ugaagguuuuucccg

SEQ ID NO: 1671340 - RNA, 19 nt, Salmonella enterica enterica serovar Typhi
ugaaguaauucuucgaaug

SEQ ID NO: 1671341 - RNA, 22 nt, Salmonella enterica enterica serovar Typhi
ugaagcgauuuauccaccgcca

SEQ ID NO: 1671342 - RNA, 17 nt, Salmonella enterica enterica serovar Typhi
ugaagcgcguucguccc

SEQ ID NO: 1671343 - RNA, 22 nt, Salmonella enterica enterica serovar Typhi
ugaagccuggucaccugucuuu

SEQ ID NO: 1671344 - RNA, 19 nt, Salmonella enterica enterica serovar Typhi
ugaagccaucaaauuugau

SEQ ID NO: 1671345 - RNA, 22 nt, Salmonella enterica enterica serovar Typhi
ugaagccaucaaauuugauagu

SEQ ID NO: 1671346 - RNA, 20 nt, Salmonella enterica enterica serovar Typhi
ugaagccauccucacgcaac

SEQ ID NO: 1671347 - RNA, 21 nt, Salmonella enterica enterica serovar Typhi
ugaagauggucuguaccacca

SEQ ID NO: 1671348 - RNA, 13 nt, Salmonella enterica enterica serovar Typhi
ugaagcagaagug

SEQ ID NO: 1671349 - RNA, 17 nt, Salmonella enterica enterica serovar Typhi
ugaagauuuuuauuccc

SEQ ID NO: 1671350 - RNA, 15 nt, Salmonella enterica enterica serovar Typhi
ugaaucccuguucaa

SEQ ID NO: 1671351 - RNA, 17 nt, Salmonella enterica enterica serovar Typhi
ugaaugcccuuuuccag

SEQ ID NO: 1671352 - RNA, 18 nt, Salmonella enterica enterica serovar Typhi
ugaaugcccuuuuccaga

SEQ ID NO: 1671353 - RNA, 21 nt, Salmonella enterica enterica serovar Typhi
ugaaugcucucauauuccagc

SEQ ID NO: 1671354 - RNA, 18 nt, Salmonella enterica enterica serovar Typhi
ugaauggcggagaucucc

SEQ ID NO: 1671355 - RNA, 20 nt, Salmonella enterica enterica serovar Typhi
ugaauggcggagaucuccag

SEQ ID NO: 1671356 - RNA, 16 nt, Salmonella enterica enterica serovar Typhi
ugaaucaagcuuugcg

SEQ ID NO: 1671357 - RNA, 17 nt, Salmonella enterica enterica serovar Typhi
ugaaucccccugccaca

SEQ ID NO: 1671358 - RNA, 21 nt, Salmonella enterica enterica serovar Typhi
ugaauccccagaauuucuuug

SEQ ID NO: 1671359 - RNA, 22 nt, Salmonella enterica enterica serovar Typhi
ugaauccauacgguuguugauu

SEQ ID NO: 1671360 - RNA, 16 nt, Salmonella enterica enterica serovar Typhi
ugaauccaggccagau

SEQ ID NO: 1671361 - RNA, 16 nt, Salmonella enterica enterica serovar Typhi
ugacaauauugccaua

SEQ ID NO: 1671362 - RNA, 23 nt, Salmonella enterica enterica serovar Typhi
ugacaauauugccauaaauacaa

SEQ ID NO: 1671363 - RNA, 16 nt, Salmonella enterica enterica serovar Typhi
ugacaaucucaauacc

SEQ ID NO: 1671364 - RNA, 17 nt, Salmonella enterica enterica serovar Typhi
ugacaaucagcacacua

SEQ ID NO: 1671365 - RNA, 13 nt, Salmonella enterica enterica serovar Typhi
ugacaauacugca

SEQ ID NO: 1671366 - RNA, 15 nt, Salmonella enterica enterica serovar Typhi
ugaauuuuauuagua

SEQ ID NO: 1671367 - RNA, 20 nt, Salmonella enterica enterica serovar Typhi
ugaauuugcugcauuucuug

SEQ ID NO: 1671368 - RNA, 14 nt, Salmonella enterica enterica serovar Typhi
ugaauuucucgcca

SEQ ID NO: 1671369 - RNA, 14 nt, Salmonella enterica enterica serovar Typhi
ugaauuucugcugc

SEQ ID NO: 1671370 - RNA, 22 nt, Salmonella enterica enterica serovar Typhi
ugaauuuuagauccccaaacug

SEQ ID NO: 1671371 - RNA, 15 nt, Salmonella enterica enterica serovar Typhi
ugaauaauaauacac

SEQ ID NO: 1671372 - RNA, 14 nt, Salmonella enterica enterica serovar Typhi
ugaauaaaggguuu

SEQ ID NO: 1671373 - RNA, 13 nt, Salmonella enterica enterica serovar Typhi
ugaauaaaccaga

SEQ ID NO: 1671374 - RNA, 15 nt, Salmonella enterica enterica serovar Typhi
ugaauagccagcccc

SEQ ID NO: 1671375 - RNA, 17 nt, Salmonella enterica enterica serovar Typhi
ugaauauucggcuccag

SEQ ID NO: 1671376 - RNA, 15 nt, Salmonella enterica enterica serovar Typhi
ugaagucgaaauuuu

SEQ ID NO: 1671377 - RNA, 14 nt, Salmonella enterica enterica serovar Typhi
ugaaguguuccuga

SEQ ID NO: 1671378 - RNA, 18 nt, Salmonella enterica enterica serovar Typhi
ugaaguguuccugagcca

SEQ ID NO: 1671379 - RNA, 15 nt, Salmonella enterica enterica serovar Typhi
ugaaguuauccagcg

SEQ ID NO: 1671380 - RNA, 18 nt, Salmonella enterica enterica serovar Typhi
ugaaguuaucgaagguca

SEQ ID NO: 1671381 - RNA, 11 nt, Salmonella enterica enterica serovar Typhi
ugaauaaaaua

SEQ ID NO: 1671382 - RNA, 20 nt, Salmonella enterica enterica serovar Typhi
ugcugaagcagauacugcgc

SEQ ID NO: 1671383 - RNA, 21 nt, Salmonella enterica enterica serovar Typhi
ugcugaaaaucgucucucauc

SEQ ID NO: 1671384 - RNA, 20 nt, Salmonella enterica enterica serovar Typhi
ugcugaaaugauaagugaua

SEQ ID NO: 1671385 - RNA, 15 nt, Salmonella enterica enterica serovar Typhi
ugcugauuuuggcuu

SEQ ID NO: 1671386 - RNA, 14 nt, Salmonella enterica enterica serovar Typhi
ugcugcaccgcauc

SEQ ID NO: 1671387 - RNA, 23 nt, Salmonella enterica enterica serovar Typhi
ugcugaucgugauaggccagacg

SEQ ID NO: 1671388 - RNA, 14 nt, Salmonella enterica enterica serovar Typhi
ugcugaugcugguu

SEQ ID NO: 1671389 - RNA, 13 nt, Salmonella enterica enterica serovar Typhi
ugcugaugcugua

SEQ ID NO: 1671390 - RNA, 22 nt, Salmonella enterica enterica serovar Typhi
ugcugaugacuaauggcauuuc

SEQ ID NO: 1671391 - RNA, 21 nt, Salmonella enterica enterica serovar Typhi
ugcugauguccgcagccgcau

SEQ ID NO: 1671392 - RNA, 15 nt, Salmonella enterica enterica serovar Typhi
ugcugccagcgccgc

SEQ ID NO: 1671393 - RNA, 13 nt, Salmonella enterica enterica serovar Typhi
ugcucaauauuau

SEQ ID NO: 1671394 - RNA, 12 nt, Salmonella enterica enterica serovar Typhi
ugcucaauaagc

SEQ ID NO: 1671395 - RNA, 16 nt, Salmonella enterica enterica serovar Typhi
ugcucaacuuccagag

SEQ ID NO: 1671396 - RNA, 17 nt, Salmonella enterica enterica serovar Typhi
ugcucaacuuccagagc

SEQ ID NO: 1671397 - RNA, 23 nt, Salmonella enterica enterica serovar Typhi
ugcguuggaagugcguuaacccg

SEQ ID NO: 1671398 - RNA, 18 nt, Salmonella enterica enterica serovar Typhi
ugcucaucgacagaacgg

SEQ ID NO: 1671399 - RNA, 23 nt, Salmonella enterica enterica serovar Typhi
ugcucaucgucuuucuccaugcu

SEQ ID NO: 1671400 - RNA, 13 nt, Salmonella enterica enterica serovar Typhi
ugcucauauugug

SEQ ID NO: 1671401 - RNA, 23 nt, Salmonella enterica enterica serovar Typhi
ugcucaugcgagguauacgccac

SEQ ID NO: 1671402 - RNA, 21 nt, Salmonella enterica enterica serovar Typhi
ugcucaugacaucgcccuggg

SEQ ID NO: 1671403 - RNA, 10 nt, Salmonella enterica enterica serovar Typhi
ugcucaccca

SEQ ID NO: 1671404 - RNA, 21 nt, Salmonella enterica enterica serovar Typhi
ugcucaauacuuuccgggccg

SEQ ID NO: 1671405 - RNA, 16 nt, Salmonella enterica enterica serovar Typhi
ugcucaaucgcaugac

SEQ ID NO: 1671406 - RNA, 11 nt, Salmonella enterica enterica serovar Typhi
ugcucaaugau

SEQ ID NO: 1671407 - RNA, 23 nt, Salmonella enterica enterica serovar Typhi
ugcucaauuauacgcuggugcag

SEQ ID NO: 1671408 - RNA, 22 nt, Salmonella enterica enterica serovar Typhi
ugcuccggcuuaaugcccggcc

SEQ ID NO: 1671409 - RNA, 14 nt, Salmonella enterica enterica serovar Typhi
ugcuccgccagcaa

SEQ ID NO: 1671410 - RNA, 23 nt, Salmonella enterica enterica serovar Typhi
ugcuccggcuuaaugcccggccc

SEQ ID NO: 1671411 - RNA, 12 nt, Salmonella enterica enterica serovar Typhi
ugcuccgggcca

SEQ ID NO: 1671412 - RNA, 18 nt, Salmonella enterica enterica serovar Typhi
ugcucgauauauuuuccg

SEQ ID NO: 1671413 - RNA, 18 nt, Salmonella enterica enterica serovar Typhi
ugcucgccauaaaucccg

SEQ ID NO: 1671414 - RNA, 20 nt, Salmonella enterica enterica serovar Typhi
ugcucguaaagcaucagacu

SEQ ID NO: 1671415 - RNA, 16 nt, Salmonella enterica enterica serovar Typhi
ugcuggcuuaacucac

SEQ ID NO: 1671416 - RNA, 14 nt, Salmonella enterica enterica serovar Typhi
ugcuggcgaugagu

SEQ ID NO: 1671417 - RNA, 22 nt, Salmonella enterica enterica serovar Typhi
ugcugcuuuaaccuggcgcaca

SEQ ID NO: 1671418 - RNA, 19 nt, Salmonella enterica enterica serovar Typhi
ugcugcugaaagaagacga

SEQ ID NO: 1671419 - RNA, 14 nt, Salmonella enterica enterica serovar Typhi
ugcugccucaucaa

SEQ ID NO: 1671420 - RNA, 19 nt, Salmonella enterica enterica serovar Typhi
ugcuguagcgucucaucaa

SEQ ID NO: 1671421 - RNA, 18 nt, Salmonella enterica enterica serovar Typhi
ugcuguagcugcccggau

SEQ ID NO: 1671422 - RNA, 22 nt, Salmonella enterica enterica serovar Typhi
ugcuguagcugcccggauaacc

SEQ ID NO: 1671423 - RNA, 17 nt, Salmonella enterica enterica serovar Typhi
ugcuguaaguuuccguc

SEQ ID NO: 1671424 - RNA, 17 nt, Salmonella enterica enterica serovar Typhi
ugcuguacauauccagu

SEQ ID NO: 1671425 - RNA, 14 nt, Salmonella enterica enterica serovar Typhi
ugcugguugucuca

SEQ ID NO: 1671426 - RNA, 14 nt, Salmonella enterica enterica serovar Typhi
ugcuguaaaauauc

SEQ ID NO: 1671427 - RNA, 14 nt, Salmonella enterica enterica serovar Typhi
ugcugugugaccag

SEQ ID NO: 1671428 - RNA, 16 nt, Salmonella enterica enterica serovar Typhi
ugcugugugaccagca

SEQ ID NO: 1671429 - RNA, 14 nt, Salmonella enterica enterica serovar Typhi
ugcuguucuucccu

SEQ ID NO: 1671430 - RNA, 15 nt, Salmonella enterica enterica serovar Typhi
ugcuugagcaggcag

SEQ ID NO: 1671431 - RNA, 20 nt, Salmonella enterica enterica serovar Typhi
ugcuucaccucagcaaaauc

SEQ ID NO: 1671432 - RNA, 18 nt, Salmonella enterica enterica serovar Typhi
ugcuucaacggugcugag

SEQ ID NO: 1671433 - RNA, 18 nt, Salmonella enterica enterica serovar Typhi
ugcuuauguaggccugau

SEQ ID NO: 1671434 - RNA, 18 nt, Salmonella enterica enterica serovar Typhi
ugcuuaucgauaucugcc

SEQ ID NO: 1671435 - RNA, 21 nt, Salmonella enterica enterica serovar Typhi
ugcuuuggccgguucggccag

SEQ ID NO: 1671436 - RNA, 19 nt, Salmonella enterica enterica serovar Typhi
ugcuuuaaaugccuguuua

SEQ ID NO: 1671437 - RNA, 19 nt, Salmonella enterica enterica serovar Typhi
ugcgccaggcccagccgcu

SEQ ID NO: 1671438 - RNA, 15 nt, Salmonella enterica enterica serovar Typhi
ugcgccaggcagcac

SEQ ID NO: 1671439 - RNA, 18 nt, Salmonella enterica enterica serovar Typhi
ugcgccagccugcugguc

SEQ ID NO: 1671440 - RNA, 22 nt, Salmonella enterica enterica serovar Typhi
ugcgccagccggauacugcgcu

SEQ ID NO: 1671441 - RNA, 15 nt, Salmonella enterica enterica serovar Typhi
ugcgccagccugcug

SEQ ID NO: 1671442 - RNA, 12 nt, Salmonella enterica enterica serovar Typhi
ugcgccagauca

SEQ ID NO: 1671443 - RNA, 13 nt, Salmonella enterica enterica serovar Typhi
ugcgccagauuca

SEQ ID NO: 1671444 - RNA, 11 nt, Salmonella enterica enterica serovar Typhi
ugcgccacgac

SEQ ID NO: 1671445 - RNA, 22 nt, Salmonella enterica enterica serovar Typhi
ugccuucuuuggugcgacgcca

SEQ ID NO: 1671446 - RNA, 17 nt, Salmonella enterica enterica serovar Typhi
ugcgccaccagcgcagu

SEQ ID NO: 1671447 - RNA, 20 nt, Salmonella enterica enterica serovar Typhi
ugcgccaccagcgcaguaaa

SEQ ID NO: 1671448 - RNA, 18 nt, Salmonella enterica enterica serovar Typhi
ugccuucucugucgagca

SEQ ID NO: 1671449 - RNA, 21 nt, Salmonella enterica enterica serovar Typhi
ugccuucuguuuuuugccaca

SEQ ID NO: 1671450 - RNA, 17 nt, Salmonella enterica enterica serovar Typhi
ugccuucggcgcuggga

SEQ ID NO: 1671451 - RNA, 16 nt, Salmonella enterica enterica serovar Typhi
ugccuucauccgcacg

SEQ ID NO: 1671452 - RNA, 21 nt, Salmonella enterica enterica serovar Typhi
ugccuuccacggcgaucacuu

SEQ ID NO: 1671453 - RNA, 17 nt, Salmonella enterica enterica serovar Typhi
ugcgcccuuccgucagc

SEQ ID NO: 1671454 - RNA, 16 nt, Salmonella enterica enterica serovar Typhi
ugcgccgccagcgaca

SEQ ID NO: 1671455 - RNA, 14 nt, Salmonella enterica enterica serovar Typhi
ugcgccgccaggca

SEQ ID NO: 1671456 - RNA, 21 nt, Salmonella enterica enterica serovar Typhi
ugcgccccggcggcguacagc

SEQ ID NO: 1671457 - RNA, 21 nt, Salmonella enterica enterica serovar Typhi
ugcgcccagcccggaaauaaa

SEQ ID NO: 1671458 - RNA, 19 nt, Salmonella enterica enterica serovar Typhi
ugcgccauuucaauaauau

SEQ ID NO: 1671459 - RNA, 14 nt, Salmonella enterica enterica serovar Typhi
ugcgccauuuccag

SEQ ID NO: 1671460 - RNA, 15 nt, Salmonella enterica enterica serovar Typhi
ugcgccaucgggccg

SEQ ID NO: 1671461 - RNA, 22 nt, Salmonella enterica enterica serovar Typhi
ugcgccauauaggcauguuccu

SEQ ID NO: 1671462 - RNA, 15 nt, Salmonella enterica enterica serovar Typhi
ugcgccuuaucaagc

SEQ ID NO: 1671463 - RNA, 12 nt, Salmonella enterica enterica serovar Typhi
ugcgccuuccag

SEQ ID NO: 1671464 - RNA, 13 nt, Salmonella enterica enterica serovar Typhi
ugcgccuuccagu

SEQ ID NO: 1671465 - RNA, 23 nt, Salmonella enterica enterica serovar Typhi
ugcgccugggugggcggaaaacu

SEQ ID NO: 1671466 - RNA, 14 nt, Salmonella enterica enterica serovar Typhi
ugcgccugucucca

SEQ ID NO: 1671467 - RNA, 20 nt, Salmonella enterica enterica serovar Typhi
ugcgccugucuccagcgccg

SEQ ID NO: 1671468 - RNA, 18 nt, Salmonella enterica enterica serovar Typhi
ugcgccugugguuuaaaa

SEQ ID NO: 1671469 - RNA, 22 nt, Salmonella enterica enterica serovar Typhi
ugcgccuguuagggcgcggcug

SEQ ID NO: 1671470 - RNA, 17 nt, Salmonella enterica enterica serovar Typhi
ugcgcgacgacgccagc

SEQ ID NO: 1671471 - RNA, 18 nt, Salmonella enterica enterica serovar Typhi
ugcgcgacgacgccagcc

SEQ ID NO: 1671472 - RNA, 19 nt, Salmonella enterica enterica serovar Typhi
ugcgccguccugcaaggca

SEQ ID NO: 1671473 - RNA, 21 nt, Salmonella enterica enterica serovar Typhi
ugcgccgugaaauauccuccg

SEQ ID NO: 1671474 - RNA, 14 nt, Salmonella enterica enterica serovar Typhi
ugcgccgugccugg

SEQ ID NO: 1671475 - RNA, 19 nt, Salmonella enterica enterica serovar Typhi
ugcgccgucaggcuugccg

SEQ ID NO: 1671476 - RNA, 21 nt, Salmonella enterica enterica serovar Typhi
ugcgccgucaggcuugccgcg

SEQ ID NO: 1671477 - RNA, 21 nt, Salmonella enterica enterica serovar Typhi
ugcgccggcugcgcugccagc

SEQ ID NO: 1671478 - RNA, 16 nt, Salmonella enterica enterica serovar Typhi
ugcgccuaccgacaaa

SEQ ID NO: 1671479 - RNA, 12 nt, Salmonella enterica enterica serovar Typhi
ugcgccugcuca

SEQ ID NO: 1671480 - RNA, 17 nt, Salmonella enterica enterica serovar Typhi
ugcgcggcgaaaaagcc

SEQ ID NO: 1671481 - RNA, 22 nt, Salmonella enterica enterica serovar Typhi
ugcgcggcgacgcgaggcuuuu

SEQ ID NO: 1671482 - RNA, 23 nt, Salmonella enterica enterica serovar Typhi
ugcgcggcacacuuucaucagcc

SEQ ID NO: 1671483 - RNA, 17 nt, Salmonella enterica enterica serovar Typhi
ugcgcgguccacaggcc

SEQ ID NO: 1671484 - RNA, 20 nt, Salmonella enterica enterica serovar Typhi
ugcgcguaaauuucacuuau

SEQ ID NO: 1671485 - RNA, 14 nt, Salmonella enterica enterica serovar Typhi
ugcgcgucccucuc

SEQ ID NO: 1671486 - RNA, 15 nt, Salmonella enterica enterica serovar Typhi
ugcgcgucccucucc

SEQ ID NO: 1671487 - RNA, 22 nt, Salmonella enterica enterica serovar Typhi
ugcgcguaaacgcaacaccauc

SEQ ID NO: 1671488 - RNA, 16 nt, Salmonella enterica enterica serovar Typhi
ugcgcguaaauuucac

SEQ ID NO: 1671489 - RNA, 22 nt, Salmonella enterica enterica serovar Typhi
ugcgcgcgugaccccaggcaua

SEQ ID NO: 1671490 - RNA, 18 nt, Salmonella enterica enterica serovar Typhi
ugcgcgcgaugcugcucc

SEQ ID NO: 1671491 - RNA, 23 nt, Salmonella enterica enterica serovar Typhi
ugcgcgcuggugucgccguggaa

SEQ ID NO: 1671492 - RNA, 12 nt, Salmonella enterica enterica serovar Typhi
ugcgcgcuauuc

SEQ ID NO: 1671493 - RNA, 23 nt, Salmonella enterica enterica serovar Typhi
ugcgcgccauacuuacugcuguc

SEQ ID NO: 1671494 - RNA, 16 nt, Salmonella enterica enterica serovar Typhi
ugcgcgccgacaggcu

SEQ ID NO: 1671495 - RNA, 19 nt, Salmonella enterica enterica serovar Typhi
ugcggggagcgaaaaggcc

SEQ ID NO: 1671496 - RNA, 15 nt, Salmonella enterica enterica serovar Typhi
ugcggcgcuuccaga

SEQ ID NO: 1671497 - RNA, 17 nt, Salmonella enterica enterica serovar Typhi
ugcggcgcgcccggcaa

SEQ ID NO: 1671498 - RNA, 22 nt, Salmonella enterica enterica serovar Typhi
ugcggcgaggaguaguuaaaaa

SEQ ID NO: 1671499 - RNA, 19 nt, Salmonella enterica enterica serovar Typhi
ugcgguuauaauaauaauu

SEQ ID NO: 1671500 - RNA, 15 nt, Salmonella enterica enterica serovar Typhi
ugcgguucucccggc

SEQ ID NO: 1671501 - RNA, 15 nt, Salmonella enterica enterica serovar Typhi
ugcguaaucuuuuca

SEQ ID NO: 1671502 - RNA, 22 nt, Salmonella enterica enterica serovar Typhi
ugcgguuuuccugaugauauuu

SEQ ID NO: 1671503 - RNA, 17 nt, Salmonella enterica enterica serovar Typhi
ugcgguucucccggcau

SEQ ID NO: 1671504 - RNA, 21 nt, Salmonella enterica enterica serovar Typhi
ugcgugcgccgugaaauaucc

SEQ ID NO: 1671505 - RNA, 16 nt, Salmonella enterica enterica serovar Typhi
ugcgugcuggcggccg

SEQ ID NO: 1671506 - RNA, 15 nt, Salmonella enterica enterica serovar Typhi
ugcgucuuaauggug

SEQ ID NO: 1671507 - RNA, 14 nt, Salmonella enterica enterica serovar Typhi
ugcgugaugcugca

SEQ ID NO: 1671508 - RNA, 17 nt, Salmonella enterica enterica serovar Typhi
ugcgugacaaucuccuc

SEQ ID NO: 1671509 - RNA, 21 nt, Salmonella enterica enterica serovar Typhi
ugcggccagacaauacuuaaa

SEQ ID NO: 1671510 - RNA, 11 nt, Salmonella enterica enterica serovar Typhi
ugcggcgacuu

SEQ ID NO: 1671511 - RNA, 18 nt, Salmonella enterica enterica serovar Typhi
ugcggcagggcggucugg

SEQ ID NO: 1671512 - RNA, 15 nt, Salmonella enterica enterica serovar Typhi
ugcggaugcgccauc

SEQ ID NO: 1671513 - RNA, 20 nt, Salmonella enterica enterica serovar Typhi
ugcggacgcagcucauaccc

SEQ ID NO: 1671514 - RNA, 18 nt, Salmonella enterica enterica serovar Typhi
ugcggacaggcgaaauaa

SEQ ID NO: 1671515 - RNA, 16 nt, Salmonella enterica enterica serovar Typhi
ugcggaaccgcccauc

SEQ ID NO: 1671516 - RNA, 21 nt, Salmonella enterica enterica serovar Typhi
ugcggaaccgcccaucaacac

SEQ ID NO: 1671517 - RNA, 15 nt, Salmonella enterica enterica serovar Typhi
ugcggaacaccagcg

SEQ ID NO: 1671518 - RNA, 17 nt, Salmonella enterica enterica serovar Typhi
ugcggaacaccagcgcc

SEQ ID NO: 1671519 - RNA, 14 nt, Salmonella enterica enterica serovar Typhi
ugcgcucaggguca

SEQ ID NO: 1671520 - RNA, 16 nt, Salmonella enterica enterica serovar Typhi
ugcgcuuuuccaggcg

SEQ ID NO: 1671521 - RNA, 21 nt, Salmonella enterica enterica serovar Typhi
ugcgcgugcgguuuuccugau

SEQ ID NO: 1671522 - RNA, 16 nt, Salmonella enterica enterica serovar Typhi
ugcgcguucugcucca

SEQ ID NO: 1671523 - RNA, 17 nt, Salmonella enterica enterica serovar Typhi
ugcgcguucugcuccag

SEQ ID NO: 1671524 - RNA, 20 nt, Salmonella enterica enterica serovar Typhi
ugcgcgucccucuccagggc

SEQ ID NO: 1671525 - RNA, 21 nt, Salmonella enterica enterica serovar Typhi
ugcgcgucccucuccagggca

SEQ ID NO: 1671526 - RNA, 17 nt, Salmonella enterica enterica serovar Typhi
ugcgcgucccucuccag

SEQ ID NO: 1671527 - RNA, 14 nt, Salmonella enterica enterica serovar Typhi
ugcgcguuuucauc

SEQ ID NO: 1671528 - RNA, 17 nt, Salmonella enterica enterica serovar Typhi
ugcgcguuuuccaccag

SEQ ID NO: 1671529 - RNA, 21 nt, Salmonella enterica enterica serovar Typhi
ugcgcguuuagcgccagcagc

SEQ ID NO: 1671530 - RNA, 17 nt, Salmonella enterica enterica serovar Typhi
ugcgcguuuagcgccag

SEQ ID NO: 1671531 - RNA, 16 nt, Salmonella enterica enterica serovar Typhi
ugcgcuaacuggccaa

SEQ ID NO: 1671532 - RNA, 12 nt, Salmonella enterica enterica serovar Typhi
ugcgcuaagcgu

SEQ ID NO: 1671533 - RNA, 15 nt, Salmonella enterica enterica serovar Typhi
ugcgcuauccgcgcu

SEQ ID NO: 1671534 - RNA, 20 nt, Salmonella enterica enterica serovar Typhi
ugcgcuauccgcgcucgcca

SEQ ID NO: 1671535 - RNA, 23 nt, Salmonella enterica enterica serovar Typhi
ugcgcuauguaagguucccugcg

SEQ ID NO: 1671536 - RNA, 18 nt, Salmonella enterica enterica serovar Typhi
ugcauccgcgcuuucugg

SEQ ID NO: 1671537 - RNA, 18 nt, Salmonella enterica enterica serovar Typhi
ugcaucuggucaggugau

SEQ ID NO: 1671538 - RNA, 22 nt, Salmonella enterica enterica serovar Typhi
ugcaucguuugcaguuccgcaa

SEQ ID NO: 1671539 - RNA, 17 nt, Salmonella enterica enterica serovar Typhi
ugcaucucuucaaacaa

SEQ ID NO: 1671540 - RNA, 23 nt, Salmonella enterica enterica serovar Typhi
ugcauggccggucuuaugcugcc

SEQ ID NO: 1671541 - RNA, 17 nt, Salmonella enterica enterica serovar Typhi
ugcauggcagauaaacc

SEQ ID NO: 1671542 - RNA, 22 nt, Salmonella enterica enterica serovar Typhi
ugcaugggauacgccagcagac

SEQ ID NO: 1671543 - RNA, 20 nt, Salmonella enterica enterica serovar Typhi
ugcaucuugaaugauuuugu

SEQ ID NO: 1671544 - RNA, 19 nt, Salmonella enterica enterica serovar Typhi
ugcauucaggccucugcuu

SEQ ID NO: 1671545 - RNA, 14 nt, Salmonella enterica enterica serovar Typhi
ugcauucaggccuc

SEQ ID NO: 1671546 - RNA, 12 nt, Salmonella enterica enterica serovar Typhi
ugcacugcaccu

SEQ ID NO: 1671547 - RNA, 16 nt, Salmonella enterica enterica serovar Typhi
ugcacuccaauauacu

SEQ ID NO: 1671548 - RNA, 14 nt, Salmonella enterica enterica serovar Typhi
ugcacugcaccugg

SEQ ID NO: 1671549 - RNA, 22 nt, Salmonella enterica enterica serovar Typhi
ugcaguucaucauccugcaggg

SEQ ID NO: 1671550 - RNA, 23 nt, Salmonella enterica enterica serovar Typhi
ugcaguuccgcaauccuggcuuc

SEQ ID NO: 1671551 - RNA, 19 nt, Salmonella enterica enterica serovar Typhi
ugcaguuccguugcaauau

SEQ ID NO: 1671552 - RNA, 17 nt, Salmonella enterica enterica serovar Typhi
ugcauaauauccaggag

SEQ ID NO: 1671553 - RNA, 12 nt, Salmonella enterica enterica serovar Typhi
ugcauaagaggu

SEQ ID NO: 1671554 - RNA, 20 nt, Salmonella enterica enterica serovar Typhi
ugcauaaagauuggcaucug

SEQ ID NO: 1671555 - RNA, 20 nt, Salmonella enterica enterica serovar Typhi
ugcauaaaacgguuuucaaa

SEQ ID NO: 1671556 - RNA, 23 nt, Salmonella enterica enterica serovar Typhi
ugcaguuuuaccguaaaaugcug

SEQ ID NO: 1671557 - RNA, 12 nt, Salmonella enterica enterica serovar Typhi
ugcauaauggug

SEQ ID NO: 1671558 - RNA, 23 nt, Salmonella enterica enterica serovar Typhi
ugcauacggaugaaauacucuuc

SEQ ID NO: 1671559 - RNA, 19 nt, Salmonella enterica enterica serovar Typhi
ugcauacguuucaccagca

SEQ ID NO: 1671560 - RNA, 22 nt, Salmonella enterica enterica serovar Typhi
ugcauauacguugcggcgcguu

SEQ ID NO: 1671561 - RNA, 19 nt, Salmonella enterica enterica serovar Typhi
ugcauaucgcuaaaccaaa

SEQ ID NO: 1671562 - RNA, 16 nt, Salmonella enterica enterica serovar Typhi
ugcauauuguauuggu

SEQ ID NO: 1671563 - RNA, 21 nt, Salmonella enterica enterica serovar Typhi
ugcaucaaacuucguuacuua

SEQ ID NO: 1671564 - RNA, 20 nt, Salmonella enterica enterica serovar Typhi
ugcauuugauuuguuuuuua

SEQ ID NO: 1671565 - RNA, 17 nt, Salmonella enterica enterica serovar Typhi
ugcauuucuuguugacg

SEQ ID NO: 1671566 - RNA, 15 nt, Salmonella enterica enterica serovar Typhi
ugcauuugcgcauau

SEQ ID NO: 1671567 - RNA, 22 nt, Salmonella enterica enterica serovar Typhi
ugccaaaaaaacuaauccucuu

SEQ ID NO: 1671568 - RNA, 13 nt, Salmonella enterica enterica serovar Typhi
ugccaaacugcug

SEQ ID NO: 1671569 - RNA, 14 nt, Salmonella enterica enterica serovar Typhi
ugcauuccaggugu

SEQ ID NO: 1671570 - RNA, 13 nt, Salmonella enterica enterica serovar Typhi
ugccaaugaaaua

SEQ ID NO: 1671571 - RNA, 15 nt, Salmonella enterica enterica serovar Typhi
ugccaaugaaauaau

SEQ ID NO: 1671572 - RNA, 18 nt, Salmonella enterica enterica serovar Typhi
ugccaaauguauacuccc

SEQ ID NO: 1671573 - RNA, 18 nt, Salmonella enterica enterica serovar Typhi
ugccacgaacgauauaaa

SEQ ID NO: 1671574 - RNA, 17 nt, Salmonella enterica enterica serovar Typhi
ugccacacucucuccag

SEQ ID NO: 1671575 - RNA, 20 nt, Salmonella enterica enterica serovar Typhi
ugccacgaacgauauaaaaa

SEQ ID NO: 1671576 - RNA, 19 nt, Salmonella enterica enterica serovar Typhi
ugccaguaacguucuucga

SEQ ID NO: 1671577 - RNA, 16 nt, Salmonella enterica enterica serovar Typhi
ugccaguacagcagcg

SEQ ID NO: 1671578 - RNA, 12 nt, Salmonella enterica enterica serovar Typhi
ugccaucaucag

SEQ ID NO: 1671579 - RNA, 16 nt, Salmonella enterica enterica serovar Typhi
ugccaucccauguuga

SEQ ID NO: 1671580 - RNA, 17 nt, Salmonella enterica enterica serovar Typhi
ugccaucggauauauuu

SEQ ID NO: 1671581 - RNA, 15 nt, Salmonella enterica enterica serovar Typhi
ugccagcgcucugca

SEQ ID NO: 1671582 - RNA, 19 nt, Salmonella enterica enterica serovar Typhi
ugccagcgcccuauccagc

SEQ ID NO: 1671583 - RNA, 15 nt, Salmonella enterica enterica serovar Typhi
ugccagccgccgccg

SEQ ID NO: 1671584 - RNA, 17 nt, Salmonella enterica enterica serovar Typhi
ugccagauuuuccaggc

SEQ ID NO: 1671585 - RNA, 14 nt, Salmonella enterica enterica serovar Typhi
ugccagcggccagg

SEQ ID NO: 1671586 - RNA, 15 nt, Salmonella enterica enterica serovar Typhi
ugccagcccaauauc

SEQ ID NO: 1671587 - RNA, 18 nt, Salmonella enterica enterica serovar Typhi
ugccagagauaauuuucc

SEQ ID NO: 1671588 - RNA, 21 nt, Salmonella enterica enterica serovar Typhi
ugccgccgacaaccagcgaaa

SEQ ID NO: 1671589 - RNA, 14 nt, Salmonella enterica enterica serovar Typhi
ugccgccgcaccac

SEQ ID NO: 1671590 - RNA, 21 nt, Salmonella enterica enterica serovar Typhi
ugccgcccguuuuuuccagcg

SEQ ID NO: 1671591 - RNA, 14 nt, Salmonella enterica enterica serovar Typhi
ugccgcagcgcagu

SEQ ID NO: 1671592 - RNA, 19 nt, Salmonella enterica enterica serovar Typhi
ugccgcaucuucgcccggc

SEQ ID NO: 1671593 - RNA, 12 nt, Salmonella enterica enterica serovar Typhi
ugccgcaggcaa

SEQ ID NO: 1671594 - RNA, 20 nt, Salmonella enterica enterica serovar Typhi
ugccgauaauaaacgcgcca

SEQ ID NO: 1671595 - RNA, 21 nt, Salmonella enterica enterica serovar Typhi
ugccgauaauaaacgcgccaa

SEQ ID NO: 1671596 - RNA, 15 nt, Salmonella enterica enterica serovar Typhi
ugcccucggaaaacu

SEQ ID NO: 1671597 - RNA, 17 nt, Salmonella enterica enterica serovar Typhi
ugcccuggaauuuuucc

SEQ ID NO: 1671598 - RNA, 15 nt, Salmonella enterica enterica serovar Typhi
ugcccgauggcgcua

SEQ ID NO: 1671599 - RNA, 21 nt, Salmonella enterica enterica serovar Typhi
ugcccggcaugucgccagcca

SEQ ID NO: 1671600 - RNA, 21 nt, Salmonella enterica enterica serovar Typhi
ugcccgcucgcuuacgcggcg

SEQ ID NO: 1671601 - RNA, 22 nt, Salmonella enterica enterica serovar Typhi
ugcccguuugcgagacggcgaa

SEQ ID NO: 1671602 - RNA, 17 nt, Salmonella enterica enterica serovar Typhi
ugccauuguucgcgcgu

SEQ ID NO: 1671603 - RNA, 21 nt, Salmonella enterica enterica serovar Typhi
ugccauuuuaucgacgcuauu

SEQ ID NO: 1671604 - RNA, 22 nt, Salmonella enterica enterica serovar Typhi
ugccccacgauacgccccugcu

SEQ ID NO: 1671605 - RNA, 18 nt, Salmonella enterica enterica serovar Typhi
ugccauucccagccgagc

SEQ ID NO: 1671606 - RNA, 23 nt, Salmonella enterica enterica serovar Typhi
ugccauuaucaccauucccagcg

SEQ ID NO: 1671607 - RNA, 13 nt, Salmonella enterica enterica serovar Typhi
ugccauguuucuu

SEQ ID NO: 1671608 - RNA, 19 nt, Salmonella enterica enterica serovar Typhi
ugcccccauacgcgcgcca

SEQ ID NO: 1671609 - RNA, 15 nt, Salmonella enterica enterica serovar Typhi
ugccccauuguucuu

SEQ ID NO: 1671610 - RNA, 18 nt, Salmonella enterica enterica serovar Typhi
ugccccaucucuuucaga

SEQ ID NO: 1671611 - RNA, 12 nt, Salmonella enterica enterica serovar Typhi
ugccguuuucaa

SEQ ID NO: 1671612 - RNA, 18 nt, Salmonella enterica enterica serovar Typhi
ugccgugcauguccagac

SEQ ID NO: 1671613 - RNA, 14 nt, Salmonella enterica enterica serovar Typhi
ugccguuaacugcu

SEQ ID NO: 1671614 - RNA, 14 nt, Salmonella enterica enterica serovar Typhi
ugccguuaauaaug

SEQ ID NO: 1671615 - RNA, 22 nt, Salmonella enterica enterica serovar Typhi
ugccguaaauugaguggacauc

SEQ ID NO: 1671616 - RNA, 14 nt, Salmonella enterica enterica serovar Typhi
ugccggugguggug

SEQ ID NO: 1671617 - RNA, 12 nt, Salmonella enterica enterica serovar Typhi
ugccuaaagaaa

SEQ ID NO: 1671618 - RNA, 14 nt, Salmonella enterica enterica serovar Typhi
ugccuaaagaaaaa

SEQ ID NO: 1671619 - RNA, 19 nt, Salmonella enterica enterica serovar Typhi
ugccuaacuggaaaaagac

SEQ ID NO: 1671620 - RNA, 19 nt, Salmonella enterica enterica serovar Typhi
ugccucguuucccucauau

SEQ ID NO: 1671621 - RNA, 15 nt, Salmonella enterica enterica serovar Typhi
ugccuggccuccggc

SEQ ID NO: 1671622 - RNA, 15 nt, Salmonella enterica enterica serovar Typhi
ugccuggcucauucu

SEQ ID NO: 1671623 - RNA, 13 nt, Salmonella enterica enterica serovar Typhi
ugccuguccggag

SEQ ID NO: 1671624 - RNA, 18 nt, Salmonella enterica enterica serovar Typhi
ugccucuggccaguuuca

SEQ ID NO: 1671625 - RNA, 19 nt, Salmonella enterica enterica serovar Typhi
ugccucuggccaguuucaa

SEQ ID NO: 1671626 - RNA, 23 nt, Salmonella enterica enterica serovar Typhi
ugccgcgcuggugggacuguuca

SEQ ID NO: 1671627 - RNA, 22 nt, Salmonella enterica enterica serovar Typhi
ugccgcuggugcuacgggcgcu

SEQ ID NO: 1671628 - RNA, 17 nt, Salmonella enterica enterica serovar Typhi
ugccgcgcccagcgccg

SEQ ID NO: 1671629 - RNA, 18 nt, Salmonella enterica enterica serovar Typhi
ugccgcgccugccauagc

SEQ ID NO: 1671630 - RNA, 15 nt, Salmonella enterica enterica serovar Typhi
ugccggcgaccaugc

SEQ ID NO: 1671631 - RNA, 14 nt, Salmonella enterica enterica serovar Typhi
ugccgggcaaaaaa

SEQ ID NO: 1671632 - RNA, 20 nt, Salmonella enterica enterica serovar Typhi
ugccgggcaaaaaacggaac

SEQ ID NO: 1671633 - RNA, 13 nt, Salmonella enterica enterica serovar Typhi
ugccgggccuggc

SEQ ID NO: 1671634 - RNA, 13 nt, Salmonella enterica enterica serovar Typhi
ugccggaagggau

SEQ ID NO: 1671635 - RNA, 19 nt, Salmonella enterica enterica serovar Typhi
ugccggaagcggacgggcg

SEQ ID NO: 1671636 - RNA, 23 nt, Salmonella enterica enterica serovar Typhi
ugccggaaagacggcagcgccau

SEQ ID NO: 1671637 - RNA, 23 nt, Salmonella enterica enterica serovar Typhi
ugccggaaaucgcggcgauggaa

SEQ ID NO: 1671638 - RNA, 17 nt, Salmonella enterica enterica serovar Typhi
uuacauagaaaauauau

SEQ ID NO: 1671639 - RNA, 15 nt, Salmonella enterica enterica serovar Typhi
uuacaucaauaaaca

SEQ ID NO: 1671640 - RNA, 12 nt, Salmonella enterica enterica serovar Typhi
uuacauuuucca

SEQ ID NO: 1671641 - RNA, 15 nt, Salmonella enterica enterica serovar Typhi
uuacauuuuccaugc

SEQ ID NO: 1671642 - RNA, 12 nt, Salmonella enterica enterica serovar Typhi
uuaccaaaucaa

SEQ ID NO: 1671643 - RNA, 22 nt, Salmonella enterica enterica serovar Typhi
uuacaccucgccacauucaauu

SEQ ID NO: 1671644 - RNA, 16 nt, Salmonella enterica enterica serovar Typhi
uuacacgaucauuuca

SEQ ID NO: 1671645 - RNA, 14 nt, Salmonella enterica enterica serovar Typhi
uuacacguuccaug

SEQ ID NO: 1671646 - RNA, 19 nt, Salmonella enterica enterica serovar Typhi
uuacacuuagcacaaagaa

SEQ ID NO: 1671647 - RNA, 12 nt, Salmonella enterica enterica serovar Typhi
uuacacugaagc

SEQ ID NO: 1671648 - RNA, 20 nt, Salmonella enterica enterica serovar Typhi
uuacaaauuuaaacauguca

SEQ ID NO: 1671649 - RNA, 19 nt, Salmonella enterica enterica serovar Typhi
uuacaaaugaccucaagaa

SEQ ID NO: 1671650 - RNA, 23 nt, Salmonella enterica enterica serovar Typhi
uuacaaccgcaccggaucaauau

SEQ ID NO: 1671651 - RNA, 19 nt, Salmonella enterica enterica serovar Typhi
uuacaagugucgugaaucg

SEQ ID NO: 1671652 - RNA, 20 nt, Salmonella enterica enterica serovar Typhi
uuaauuccuggcguaugcuu

SEQ ID NO: 1671653 - RNA, 22 nt, Salmonella enterica enterica serovar Typhi
uuacaaacaggcuuuauacagu

SEQ ID NO: 1671654 - RNA, 18 nt, Salmonella enterica enterica serovar Typhi
uuaaugcgcacgccagcg

SEQ ID NO: 1671655 - RNA, 19 nt, Salmonella enterica enterica serovar Typhi
uuaaugccuucgccgccgc

SEQ ID NO: 1671656 - RNA, 20 nt, Salmonella enterica enterica serovar Typhi
uuaaugccgacccaccugac

SEQ ID NO: 1671657 - RNA, 22 nt, Salmonella enterica enterica serovar Typhi
uuaaugcuguccugcaaaauac

SEQ ID NO: 1671658 - RNA, 18 nt, Salmonella enterica enterica serovar Typhi
uuaauggcagaauaaaac

SEQ ID NO: 1671659 - RNA, 15 nt, Salmonella enterica enterica serovar Typhi
uuaaugguaccaaua

SEQ ID NO: 1671660 - RNA, 19 nt, Salmonella enterica enterica serovar Typhi
uuaauggcgcaaugucccu

SEQ ID NO: 1671661 - RNA, 20 nt, Salmonella enterica enterica serovar Typhi
uuaauggugguugcaucauc

SEQ ID NO: 1671662 - RNA, 14 nt, Salmonella enterica enterica serovar Typhi
uuaaugucaucauc

SEQ ID NO: 1671663 - RNA, 14 nt, Salmonella enterica enterica serovar Typhi
uuaauuauacuguc

SEQ ID NO: 1671664 - RNA, 21 nt, Salmonella enterica enterica serovar Typhi
uuaaucugcgcuggguuuuuc

SEQ ID NO: 1671665 - RNA, 16 nt, Salmonella enterica enterica serovar Typhi
uuaaugacuuuuuaua

SEQ ID NO: 1671666 - RNA, 15 nt, Salmonella enterica enterica serovar Typhi
uuaaugaccugccgc

SEQ ID NO: 1671667 - RNA, 23 nt, Salmonella enterica enterica serovar Typhi
uuaaugaguagaacguauuauua

SEQ ID NO: 1671668 - RNA, 18 nt, Salmonella enterica enterica serovar Typhi
uuaaugacuuuuuauaua

SEQ ID NO: 1671669 - RNA, 19 nt, Salmonella enterica enterica serovar Typhi
uuaaugacuuuuuauauaa

SEQ ID NO: 1671670 - RNA, 17 nt, Salmonella enterica enterica serovar Typhi
uuaaugauguccagaau

SEQ ID NO: 1671671 - RNA, 21 nt, Salmonella enterica enterica serovar Typhi
uuaaugauuugcuuuauuugu

SEQ ID NO: 1671672 - RNA, 23 nt, Salmonella enterica enterica serovar Typhi
uuaaugcauggcagauaaaccac

SEQ ID NO: 1671673 - RNA, 14 nt, Salmonella enterica enterica serovar Typhi
uuaaucuauuuaau

SEQ ID NO: 1671674 - RNA, 15 nt, Salmonella enterica enterica serovar Typhi
uuaauacccauagua

SEQ ID NO: 1671675 - RNA, 24 nt, Salmonella enterica enterica serovar Typhi
uuaauaccgugcaggacagacaga

SEQ ID NO: 1671676 - RNA, 14 nt, Salmonella enterica enterica serovar Typhi
uuaauaccugguaa

SEQ ID NO: 1671677 - RNA, 12 nt, Salmonella enterica enterica serovar Typhi
uuacugaauaaa

SEQ ID NO: 1671678 - RNA, 15 nt, Salmonella enterica enterica serovar Typhi
uuacucuuccugcug

SEQ ID NO: 1671679 - RNA, 12 nt, Salmonella enterica enterica serovar Typhi
uuacucuuccac

SEQ ID NO: 1671680 - RNA, 23 nt, Salmonella enterica enterica serovar Typhi
uuacugcuuugaucacccacacc

SEQ ID NO: 1671681 - RNA, 20 nt, Salmonella enterica enterica serovar Typhi
uuacugacgccauucauucc

SEQ ID NO: 1671682 - RNA, 15 nt, Salmonella enterica enterica serovar Typhi
uuacuccaaaaauaa

SEQ ID NO: 1671683 - RNA, 13 nt, Salmonella enterica enterica serovar Typhi
uuacuauuuuuca

SEQ ID NO: 1671684 - RNA, 12 nt, Salmonella enterica enterica serovar Typhi
uuacucccgucg

SEQ ID NO: 1671685 - RNA, 15 nt, Salmonella enterica enterica serovar Typhi
uuacucacugccgcc

SEQ ID NO: 1671686 - RNA, 14 nt, Salmonella enterica enterica serovar Typhi
uuacuauuuuucac

SEQ ID NO: 1671687 - RNA, 18 nt, Salmonella enterica enterica serovar Typhi
uuacuuucaaaauacugg

SEQ ID NO: 1671688 - RNA, 14 nt, Salmonella enterica enterica serovar Typhi
uuacuuguaggccu

SEQ ID NO: 1671689 - RNA, 22 nt, Salmonella enterica enterica serovar Typhi
uuagaauagaaucaauuucucu

SEQ ID NO: 1671690 - RNA, 21 nt, Salmonella enterica enterica serovar Typhi
uuagaauauaguuagaaaaua

SEQ ID NO: 1671691 - RNA, 13 nt, Salmonella enterica enterica serovar Typhi
uuagaaucucuga

SEQ ID NO: 1671692 - RNA, 15 nt, Salmonella enterica enterica serovar Typhi
uuagaagugaagaau

SEQ ID NO: 1671693 - RNA, 20 nt, Salmonella enterica enterica serovar Typhi
uuagaaaauauauuggccuu

SEQ ID NO: 1671694 - RNA, 13 nt, Salmonella enterica enterica serovar Typhi
uuacccaauaaug

SEQ ID NO: 1671695 - RNA, 13 nt, Salmonella enterica enterica serovar Typhi
uuacccagccuga

SEQ ID NO: 1671696 - RNA, 15 nt, Salmonella enterica enterica serovar Typhi
uuaccauccauuaaa

SEQ ID NO: 1671697 - RNA, 20 nt, Salmonella enterica enterica serovar Typhi
uuacccauacaguacagacu

SEQ ID NO: 1671698 - RNA, 22 nt, Salmonella enterica enterica serovar Typhi
uuacgacgggucagauucagca

SEQ ID NO: 1671699 - RNA, 13 nt, Salmonella enterica enterica serovar Typhi
uuacgcaggcuug

SEQ ID NO: 1671700 - RNA, 19 nt, Salmonella enterica enterica serovar Typhi
uuacgaucguuugcccauu

SEQ ID NO: 1671701 - RNA, 20 nt, Salmonella enterica enterica serovar Typhi
uuacgcacgccagauaaauc

SEQ ID NO: 1671702 - RNA, 19 nt, Salmonella enterica enterica serovar Typhi
uuacguuaaguucaaggau

SEQ ID NO: 1671703 - RNA, 15 nt, Salmonella enterica enterica serovar Typhi
uuacguugauuauca

SEQ ID NO: 1671704 - RNA, 12 nt, Salmonella enterica enterica serovar Typhi
uuacguaacugc

SEQ ID NO: 1671705 - RNA, 23 nt, Salmonella enterica enterica serovar Typhi
uuacguguaguuauaaauuuauu

SEQ ID NO: 1671706 - RNA, 11 nt, Salmonella enterica enterica serovar Typhi
uuacgcugccg

SEQ ID NO: 1671707 - RNA, 17 nt, Salmonella enterica enterica serovar Typhi
uuacgcuauagcuauca

SEQ ID NO: 1671708 - RNA, 15 nt, Salmonella enterica enterica serovar Typhi
uuacggaaaaaauac

SEQ ID NO: 1671709 - RNA, 21 nt, Salmonella enterica enterica serovar Typhi
uuacggcacauaggcaaacac

SEQ ID NO: 1671710 - RNA, 16 nt, Salmonella enterica enterica serovar Typhi
uuacggauaaaaaccc

SEQ ID NO: 1671711 - RNA, 16 nt, Salmonella enterica enterica serovar Typhi
uguugcgcaagcacug

SEQ ID NO: 1671712 - RNA, 15 nt, Salmonella enterica enterica serovar Typhi
uguugauuaagcacg

SEQ ID NO: 1671713 - RNA, 23 nt, Salmonella enterica enterica serovar Typhi
uguugccgcccguuuuuuccagc

SEQ ID NO: 1671714 - RNA, 22 nt, Salmonella enterica enterica serovar Typhi
uguugcgggccagcagccaggc

SEQ ID NO: 1671715 - RNA, 13 nt, Salmonella enterica enterica serovar Typhi
uuaaacaacauau

SEQ ID NO: 1671716 - RNA, 18 nt, Salmonella enterica enterica serovar Typhi
uuaaacaacgccauaaua

SEQ ID NO: 1671717 - RNA, 18 nt, Salmonella enterica enterica serovar Typhi
uuaaauaacuuuuaauuu

SEQ ID NO: 1671718 - RNA, 19 nt, Salmonella enterica enterica serovar Typhi
uuaaaguacuucacaauca

SEQ ID NO: 1671719 - RNA, 22 nt, Salmonella enterica enterica serovar Typhi
uuaaagacgccguuaccaaucu

SEQ ID NO: 1671720 - RNA, 14 nt, Salmonella enterica enterica serovar Typhi
uuaaagaaaaagaa

SEQ ID NO: 1671721 - RNA, 19 nt, Salmonella enterica enterica serovar Typhi
uuaaauucauauuuaaaua

SEQ ID NO: 1671722 - RNA, 21 nt, Salmonella enterica enterica serovar Typhi
uuaaauuaaugauuaaaauaa

SEQ ID NO: 1671723 - RNA, 22 nt, Salmonella enterica enterica serovar Typhi
uuaaauucccagcguacaucuu

SEQ ID NO: 1671724 - RNA, 19 nt, Salmonella enterica enterica serovar Typhi
uuaaauuaaugauuaaaau

SEQ ID NO: 1671725 - RNA, 20 nt, Salmonella enterica enterica serovar Typhi
uuaaauuaaugauuaaaaua

SEQ ID NO: 1671726 - RNA, 14 nt, Salmonella enterica enterica serovar Typhi
uuaaaugucugaau

SEQ ID NO: 1671727 - RNA, 23 nt, Salmonella enterica enterica serovar Typhi
uuaaauguuuuuucaucuccgau

SEQ ID NO: 1671728 - RNA, 16 nt, Salmonella enterica enterica serovar Typhi
uuaaauagcaggcaau

SEQ ID NO: 1671729 - RNA, 23 nt, Salmonella enterica enterica serovar Typhi
uuaaauacugcaacggcgaggug

SEQ ID NO: 1671730 - RNA, 18 nt, Salmonella enterica enterica serovar Typhi
uuaagcgggucccagaag

SEQ ID NO: 1671731 - RNA, 18 nt, Salmonella enterica enterica serovar Typhi
uuaagcuuaaugauaauu

SEQ ID NO: 1671732 - RNA, 21 nt, Salmonella enterica enterica serovar Typhi
uuaagcuuugcaccacuuugu

SEQ ID NO: 1671733 - RNA, 13 nt, Salmonella enterica enterica serovar Typhi
uuaauaaaaucua

SEQ ID NO: 1671734 - RNA, 21 nt, Salmonella enterica enterica serovar Typhi
uuaaguuuuacugaugccagc

SEQ ID NO: 1671735 - RNA, 18 nt, Salmonella enterica enterica serovar Typhi
uuaacuucugcagggaaa

SEQ ID NO: 1671736 - RNA, 15 nt, Salmonella enterica enterica serovar Typhi
uuaacucaucacagc

SEQ ID NO: 1671737 - RNA, 19 nt, Salmonella enterica enterica serovar Typhi
uuaagccgggucagccccc

SEQ ID NO: 1671738 - RNA, 22 nt, Salmonella enterica enterica serovar Typhi
uuaagccccucgcuaaugcccg

SEQ ID NO: 1671739 - RNA, 16 nt, Salmonella enterica enterica serovar Typhi
uuaagcaccgcuuugg

SEQ ID NO: 1671740 - RNA, 21 nt, Salmonella enterica enterica serovar Typhi
uuaagcauuaccccguggugg

SEQ ID NO: 1671741 - RNA, 22 nt, Salmonella enterica enterica serovar Typhi
uuaacccgcuuacaauuuaucu

SEQ ID NO: 1671742 - RNA, 15 nt, Salmonella enterica enterica serovar Typhi
uuaacgacaaaaaua

SEQ ID NO: 1671743 - RNA, 16 nt, Salmonella enterica enterica serovar Typhi
uuaaccguucuuccug

SEQ ID NO: 1671744 - RNA, 15 nt, Salmonella enterica enterica serovar Typhi
uuaaccagcaguccu

SEQ ID NO: 1671745 - RNA, 19 nt, Salmonella enterica enterica serovar Typhi
uuaacuaauggcaauaaua

SEQ ID NO: 1671746 - RNA, 17 nt, Salmonella enterica enterica serovar Typhi
uuaacgcgccaucuuuc

SEQ ID NO: 1671747 - RNA, 16 nt, Salmonella enterica enterica serovar Typhi
uuaacggcaaaaacgu

SEQ ID NO: 1671748 - RNA, 13 nt, Salmonella enterica enterica serovar Typhi
uuaacgcagaaua

SEQ ID NO: 1671749 - RNA, 19 nt, Salmonella enterica enterica serovar Typhi
uuaacgccaugcucaucca

SEQ ID NO: 1671750 - RNA, 19 nt, Salmonella enterica enterica serovar Typhi
uuaacagagagggaaaaaa

SEQ ID NO: 1671751 - RNA, 12 nt, Salmonella enterica enterica serovar Typhi
uuaacagaauug

SEQ ID NO: 1671752 - RNA, 13 nt, Salmonella enterica enterica serovar Typhi
uuaacaucagaaa

SEQ ID NO: 1671753 - RNA, 15 nt, Salmonella enterica enterica serovar Typhi
uuaacacgauaaaac

SEQ ID NO: 1671754 - RNA, 15 nt, Salmonella enterica enterica serovar Typhi
uuaacacccggauau

SEQ ID NO: 1671755 - RNA, 11 nt, Salmonella enterica enterica serovar Typhi
uuauuuuaaau

SEQ ID NO: 1671756 - RNA, 21 nt, Salmonella enterica enterica serovar Typhi
uuauuuuagugaaaaaauauc

SEQ ID NO: 1671757 - RNA, 11 nt, Salmonella enterica enterica serovar Typhi
uuauuucuauc

SEQ ID NO: 1671758 - RNA, 16 nt, Salmonella enterica enterica serovar Typhi
uuauuucaagcaauac

SEQ ID NO: 1671759 - RNA, 11 nt, Salmonella enterica enterica serovar Typhi
uuauugugcac

SEQ ID NO: 1671760 - RNA, 22 nt, Salmonella enterica enterica serovar Typhi
uuauugcuguaggcacuuucca

SEQ ID NO: 1671761 - RNA, 15 nt, Salmonella enterica enterica serovar Typhi
uuauugcguugcuuu

SEQ ID NO: 1671762 - RNA, 13 nt, Salmonella enterica enterica serovar Typhi
uuauuuaauucuu

SEQ ID NO: 1671763 - RNA, 15 nt, Salmonella enterica enterica serovar Typhi
uuauuuaauugcuau

SEQ ID NO: 1671764 - RNA, 15 nt, Salmonella enterica enterica serovar Typhi
uuauuuaacgccagu

SEQ ID NO: 1671765 - RNA, 19 nt, Salmonella enterica enterica serovar Typhi
uuauuagaggucagaauaa

SEQ ID NO: 1671766 - RNA, 23 nt, Salmonella enterica enterica serovar Typhi
uuauuagaggucagaauaacuca

SEQ ID NO: 1671767 - RNA, 22 nt, Salmonella enterica enterica serovar Typhi
uuauuauagcuauggucacuuu

SEQ ID NO: 1671768 - RNA, 13 nt, Salmonella enterica enterica serovar Typhi
uuauuaacgugcu

SEQ ID NO: 1671769 - RNA, 14 nt, Salmonella enterica enterica serovar Typhi
uuauuacagacagu

SEQ ID NO: 1671770 - RNA, 12 nt, Salmonella enterica enterica serovar Typhi
uuauuaccaaug

SEQ ID NO: 1671771 - RNA, 20 nt, Salmonella enterica enterica serovar Typhi
uuauuacgcaagaucacaua

SEQ ID NO: 1671772 - RNA, 15 nt, Salmonella enterica enterica serovar Typhi
uuauuaaucuuuaca

SEQ ID NO: 1671773 - RNA, 23 nt, Salmonella enterica enterica serovar Typhi
uuauugaccaucgccagccauuc

SEQ ID NO: 1671774 - RNA, 15 nt, Salmonella enterica enterica serovar Typhi
uuauugagauaauuu

SEQ ID NO: 1671775 - RNA, 19 nt, Salmonella enterica enterica serovar Typhi
uuauuccuuaucacauuuu

SEQ ID NO: 1671776 - RNA, 22 nt, Salmonella enterica enterica serovar Typhi
uuauucgcauguugacugcgcu

SEQ ID NO: 1671777 - RNA, 15 nt, Salmonella enterica enterica serovar Typhi
uuauuccgaauacgg

SEQ ID NO: 1671778 - RNA, 19 nt, Salmonella enterica enterica serovar Typhi
uuauuccauucaucgauuu

SEQ ID NO: 1671779 - RNA, 20 nt, Salmonella enterica enterica serovar Typhi
uuauucacgcuauguuugcu

SEQ ID NO: 1671780 - RNA, 17 nt, Salmonella enterica enterica serovar Typhi
uucaaaaaugauguguu

SEQ ID NO: 1671781 - RNA, 20 nt, Salmonella enterica enterica serovar Typhi
uuauuuuccugaaaaaauuc

SEQ ID NO: 1671782 - RNA, 14 nt, Salmonella enterica enterica serovar Typhi
uuauuuugucaugu

SEQ ID NO: 1671783 - RNA, 13 nt, Salmonella enterica enterica serovar Typhi
uuauuuuuaauug

SEQ ID NO: 1671784 - RNA, 20 nt, Salmonella enterica enterica serovar Typhi
uuauuuuucgccagaucgau

SEQ ID NO: 1671785 - RNA, 17 nt, Salmonella enterica enterica serovar Typhi
uuauuuuucuggcuucu

SEQ ID NO: 1671786 - RNA, 13 nt, Salmonella enterica enterica serovar Typhi
uucaaaaucaaac

SEQ ID NO: 1671787 - RNA, 14 nt, Salmonella enterica enterica serovar Typhi
uucaaaaucaaaca

SEQ ID NO: 1671788 - RNA, 19 nt, Salmonella enterica enterica serovar Typhi
uucaaauguuguuugaaaa

SEQ ID NO: 1671789 - RNA, 19 nt, Salmonella enterica enterica serovar Typhi
uucaaauuucugaugugau

SEQ ID NO: 1671790 - RNA, 17 nt, Salmonella enterica enterica serovar Typhi
uucaaauauauugaaaa

SEQ ID NO: 1671791 - RNA, 16 nt, Salmonella enterica enterica serovar Typhi
uucaacagcucgccau

SEQ ID NO: 1671792 - RNA, 14 nt, Salmonella enterica enterica serovar Typhi
uucaacaaacucag

SEQ ID NO: 1671793 - RNA, 23 nt, Salmonella enterica enterica serovar Typhi
uucaaccagccgaucagcgccau

SEQ ID NO: 1671794 - RNA, 18 nt, Salmonella enterica enterica serovar Typhi
uucaacgugcaucuccuc

SEQ ID NO: 1671795 - RNA, 17 nt, Salmonella enterica enterica serovar Typhi
uucaaccggcaguuuuu

SEQ ID NO: 1671796 - RNA, 18 nt, Salmonella enterica enterica serovar Typhi
uucaaccucacuguugau

SEQ ID NO: 1671797 - RNA, 17 nt, Salmonella enterica enterica serovar Typhi
uucaacgcguugccuga

SEQ ID NO: 1671798 - RNA, 19 nt, Salmonella enterica enterica serovar Typhi
uucaacgcguugccugaaa

SEQ ID NO: 1671799 - RNA, 12 nt, Salmonella enterica enterica serovar Typhi
uucaagcaauaa

SEQ ID NO: 1671800 - RNA, 12 nt, Salmonella enterica enterica serovar Typhi
uucaagcaauac

SEQ ID NO: 1671801 - RNA, 18 nt, Salmonella enterica enterica serovar Typhi
uucaagcccgugcuuagc

SEQ ID NO: 1671802 - RNA, 13 nt, Salmonella enterica enterica serovar Typhi
uuaucgacgcuau

SEQ ID NO: 1671803 - RNA, 16 nt, Salmonella enterica enterica serovar Typhi
uuauccuccagccagc

SEQ ID NO: 1671804 - RNA, 17 nt, Salmonella enterica enterica serovar Typhi
uuauccugcaaauagcg

SEQ ID NO: 1671805 - RNA, 16 nt, Salmonella enterica enterica serovar Typhi
uuauccugcaaauagc

SEQ ID NO: 1671806 - RNA, 22 nt, Salmonella enterica enterica serovar Typhi
uuauccuccgaacaggcguuug

SEQ ID NO: 1671807 - RNA, 12 nt, Salmonella enterica enterica serovar Typhi
uuaucgcuauca

SEQ ID NO: 1671808 - RNA, 17 nt, Salmonella enterica enterica serovar Typhi
uuaucgccgaucacaaa

SEQ ID NO: 1671809 - RNA, 13 nt, Salmonella enterica enterica serovar Typhi
uuaucgccugggg

SEQ ID NO: 1671810 - RNA, 18 nt, Salmonella enterica enterica serovar Typhi
uuaucugacauauacaaa

SEQ ID NO: 1671811 - RNA, 22 nt, Salmonella enterica enterica serovar Typhi
uuaucuccccaauugcugcuau

SEQ ID NO: 1671812 - RNA, 12 nt, Salmonella enterica enterica serovar Typhi
uuaucuguugau

SEQ ID NO: 1671813 - RNA, 18 nt, Salmonella enterica enterica serovar Typhi
uuaucuucggucgagcuu

SEQ ID NO: 1671814 - RNA, 20 nt, Salmonella enterica enterica serovar Typhi
uuaucuugagucaaaagauu

SEQ ID NO: 1671815 - RNA, 13 nt, Salmonella enterica enterica serovar Typhi
uuaucuuccggca

SEQ ID NO: 1671816 - RNA, 21 nt, Salmonella enterica enterica serovar Typhi
uuauggaggauauaaaaaaca

SEQ ID NO: 1671817 - RNA, 19 nt, Salmonella enterica enterica serovar Typhi
uuaugcguuuaauugaauu

SEQ ID NO: 1671818 - RNA, 22 nt, Salmonella enterica enterica serovar Typhi
uuaugcgucaaaguugcaucaa

SEQ ID NO: 1671819 - RNA, 22 nt, Salmonella enterica enterica serovar Typhi
uuaugcguuuuuaucuuucuuu

SEQ ID NO: 1671820 - RNA, 15 nt, Salmonella enterica enterica serovar Typhi
uuaugucauuuauuu

SEQ ID NO: 1671821 - RNA, 14 nt, Salmonella enterica enterica serovar Typhi
uuaugucauucagg

SEQ ID NO: 1671822 - RNA, 23 nt, Salmonella enterica enterica serovar Typhi
uuauguagccagccauggcccuu

SEQ ID NO: 1671823 - RNA, 14 nt, Salmonella enterica enterica serovar Typhi
uuauguugauaacg

SEQ ID NO: 1671824 - RNA, 15 nt, Salmonella enterica enterica serovar Typhi
uuauuaaagccccuu

SEQ ID NO: 1671825 - RNA, 16 nt, Salmonella enterica enterica serovar Typhi
uuaucuuuaaauuuca

SEQ ID NO: 1671826 - RNA, 14 nt, Salmonella enterica enterica serovar Typhi
uuaugaaugacagu

SEQ ID NO: 1671827 - RNA, 20 nt, Salmonella enterica enterica serovar Typhi
uuaugaccguauuacaagua

SEQ ID NO: 1671828 - RNA, 19 nt, Salmonella enterica enterica serovar Typhi
uuaugaccauacugcucaa

SEQ ID NO: 1671829 - RNA, 14 nt, Salmonella enterica enterica serovar Typhi
uuaugauuucaggc

SEQ ID NO: 1671830 - RNA, 17 nt, Salmonella enterica enterica serovar Typhi
uuaugccccauauaagg

SEQ ID NO: 1671831 - RNA, 20 nt, Salmonella enterica enterica serovar Typhi
uuaugcccggaugauuauca

SEQ ID NO: 1671832 - RNA, 22 nt, Salmonella enterica enterica serovar Typhi
uuaugccgaccaaugacgcuau

SEQ ID NO: 1671833 - RNA, 13 nt, Salmonella enterica enterica serovar Typhi
uuaugcaguuccg

SEQ ID NO: 1671834 - RNA, 13 nt, Salmonella enterica enterica serovar Typhi
uuaugcacgcuau

SEQ ID NO: 1671835 - RNA, 11 nt, Salmonella enterica enterica serovar Typhi
uuauccagcaa

SEQ ID NO: 1671836 - RNA, 17 nt, Salmonella enterica enterica serovar Typhi
uuauccagucagaggaa

SEQ ID NO: 1671837 - RNA, 14 nt, Salmonella enterica enterica serovar Typhi
uuaucaugcugacu

SEQ ID NO: 1671838 - RNA, 16 nt, Salmonella enterica enterica serovar Typhi
uuaucauucacuuuca

SEQ ID NO: 1671839 - RNA, 14 nt, Salmonella enterica enterica serovar Typhi
uuauccggccuaca

SEQ ID NO: 1671840 - RNA, 16 nt, Salmonella enterica enterica serovar Typhi
uuauccggcguguaaa

SEQ ID NO: 1671841 - RNA, 18 nt, Salmonella enterica enterica serovar Typhi
uuauccggccuacgcguc

SEQ ID NO: 1671842 - RNA, 11 nt, Salmonella enterica enterica serovar Typhi
uuauccccuuc

SEQ ID NO: 1671843 - RNA, 14 nt, Salmonella enterica enterica serovar Typhi
uuaucccguggugg

SEQ ID NO: 1671844 - RNA, 16 nt, Salmonella enterica enterica serovar Typhi
uuaucaucguaaaauc

SEQ ID NO: 1671845 - RNA, 19 nt, Salmonella enterica enterica serovar Typhi
uuaucaauuucauauuauu

SEQ ID NO: 1671846 - RNA, 14 nt, Salmonella enterica enterica serovar Typhi
uuaucaagccuaca

SEQ ID NO: 1671847 - RNA, 19 nt, Salmonella enterica enterica serovar Typhi
uuaucaacaaauuccggca

SEQ ID NO: 1671848 - RNA, 23 nt, Salmonella enterica enterica serovar Typhi
uuauacauccugugaaguaaaaa

SEQ ID NO: 1671849 - RNA, 17 nt, Salmonella enterica enterica serovar Typhi
uuauagcuggcuuuaua

SEQ ID NO: 1671850 - RNA, 20 nt, Salmonella enterica enterica serovar Typhi
uuauagcuggcuuuauauaa

SEQ ID NO: 1671851 - RNA, 18 nt, Salmonella enterica enterica serovar Typhi
uuauacaccgggaaaagc

SEQ ID NO: 1671852 - RNA, 17 nt, Salmonella enterica enterica serovar Typhi
uuagacuucuuccauac

SEQ ID NO: 1671853 - RNA, 13 nt, Salmonella enterica enterica serovar Typhi
uuagagccuaucc

SEQ ID NO: 1671854 - RNA, 16 nt, Salmonella enterica enterica serovar Typhi
uuagagaguaaaaccg

SEQ ID NO: 1671855 - RNA, 13 nt, Salmonella enterica enterica serovar Typhi
uuauaaaauaacg

SEQ ID NO: 1671856 - RNA, 15 nt, Salmonella enterica enterica serovar Typhi
uuauaagaaccaucu

SEQ ID NO: 1671857 - RNA, 16 nt, Salmonella enterica enterica serovar Typhi
uuauaagccugagcgc

SEQ ID NO: 1671858 - RNA, 22 nt, Salmonella enterica enterica serovar Typhi
uuauaaggccugccguccugau

SEQ ID NO: 1671859 - RNA, 21 nt, Salmonella enterica enterica serovar Typhi
ugucaguaucgguacgcgcgu

SEQ ID NO: 1671860 - RNA, 18 nt, Salmonella enterica enterica serovar Typhi
uguauuuaauaccuggua

SEQ ID NO: 1671861 - RNA, 17 nt, Salmonella enterica enterica serovar Typhi
ugucaacuuaaacguuc

SEQ ID NO: 1671862 - RNA, 15 nt, Salmonella enterica enterica serovar Typhi
uguacaucacauugc

SEQ ID NO: 1671863 - RNA, 21 nt, Salmonella enterica enterica serovar Typhi
uguaucuucgccguauucuua

SEQ ID NO: 1671864 - RNA, 23 nt, Salmonella enterica enterica serovar Typhi
uguaucugguggaaaagaaaaca

SEQ ID NO: 1671865 - RNA, 21 nt, Salmonella enterica enterica serovar Typhi
uguaucuucgccguguucuua

SEQ ID NO: 1671866 - RNA, 13 nt, Salmonella enterica enterica serovar Typhi
uguaucuugcuuu

SEQ ID NO: 1671867 - RNA, 17 nt, Salmonella enterica enterica serovar Typhi
ugucaucgccauccugc

SEQ ID NO: 1671868 - RNA, 21 nt, Salmonella enterica enterica serovar Typhi
ugucauccugcgcacagcaua

SEQ ID NO: 1671869 - RNA, 14 nt, Salmonella enterica enterica serovar Typhi
ugucaucagaucau

SEQ ID NO: 1671870 - RNA, 19 nt, Salmonella enterica enterica serovar Typhi
ugucaucaguaugagcgaa

SEQ ID NO: 1671871 - RNA, 16 nt, Salmonella enterica enterica serovar Typhi
ugucauauuugugagc

SEQ ID NO: 1671872 - RNA, 21 nt, Salmonella enterica enterica serovar Typhi
ugucauagucggcgccaaagu

SEQ ID NO: 1671873 - RNA, 22 nt, Salmonella enterica enterica serovar Typhi
ugucauagucggcgccaaaguu

SEQ ID NO: 1671874 - RNA, 13 nt, Salmonella enterica enterica serovar Typhi
ugucaucggcuuu

SEQ ID NO: 1671875 - RNA, 17 nt, Salmonella enterica enterica serovar Typhi
ugucaugcuaaaacaga

SEQ ID NO: 1671876 - RNA, 20 nt, Salmonella enterica enterica serovar Typhi
ugucaugcuaaaacagauaa

SEQ ID NO: 1671877 - RNA, 14 nt, Salmonella enterica enterica serovar Typhi
uguccaaacuggcu

SEQ ID NO: 1671878 - RNA, 17 nt, Salmonella enterica enterica serovar Typhi
ugucaugguaaaugccg

SEQ ID NO: 1671879 - RNA, 20 nt, Salmonella enterica enterica serovar Typhi
uguccaucagauucaacagg

SEQ ID NO: 1671880 - RNA, 17 nt, Salmonella enterica enterica serovar Typhi
uguccaguuuuuuacuu

SEQ ID NO: 1671881 - RNA, 17 nt, Salmonella enterica enterica serovar Typhi
uguccauguaaacucca

SEQ ID NO: 1671882 - RNA, 19 nt, Salmonella enterica enterica serovar Typhi
uguccauugcgagaaaaaa

SEQ ID NO: 1671883 - RNA, 20 nt, Salmonella enterica enterica serovar Typhi
ugucccaucguaacgccguc

SEQ ID NO: 1671884 - RNA, 13 nt, Salmonella enterica enterica serovar Typhi
ugucccagccuuc

SEQ ID NO: 1671885 - RNA, 20 nt, Salmonella enterica enterica serovar Typhi
ugucccagugucaacugcgc

SEQ ID NO: 1671886 - RNA, 22 nt, Salmonella enterica enterica serovar Typhi
uguccgcauucuugccgcaucu

SEQ ID NO: 1671887 - RNA, 15 nt, Salmonella enterica enterica serovar Typhi
uguccggaauaacuc

SEQ ID NO: 1671888 - RNA, 16 nt, Salmonella enterica enterica serovar Typhi
uguccguuuucucaaa

SEQ ID NO: 1671889 - RNA, 15 nt, Salmonella enterica enterica serovar Typhi
uguccugcagcgcca

SEQ ID NO: 1671890 - RNA, 15 nt, Salmonella enterica enterica serovar Typhi
uguccuuucugcugc

SEQ ID NO: 1671891 - RNA, 23 nt, Salmonella enterica enterica serovar Typhi
uguccuuuacugcgccagccugc

SEQ ID NO: 1671892 - RNA, 21 nt, Salmonella enterica enterica serovar Typhi
uguccuuuaucugcccuuucu

SEQ ID NO: 1671893 - RNA, 15 nt, Salmonella enterica enterica serovar Typhi
ugucgauaacagcau

SEQ ID NO: 1671894 - RNA, 21 nt, Salmonella enterica enterica serovar Typhi
ugucgagcaucuccagcgcau

SEQ ID NO: 1671895 - RNA, 16 nt, Salmonella enterica enterica serovar Typhi
ugucgcaaaccaccgg

SEQ ID NO: 1671896 - RNA, 23 nt, Salmonella enterica enterica serovar Typhi
ugucgcaaccgacacauucaggc

SEQ ID NO: 1671897 - RNA, 18 nt, Salmonella enterica enterica serovar Typhi
ugucgcgcaauaccugua

SEQ ID NO: 1671898 - RNA, 22 nt, Salmonella enterica enterica serovar Typhi
ugucgcugaguacgcaccagcc

SEQ ID NO: 1671899 - RNA, 16 nt, Salmonella enterica enterica serovar Typhi
ugucgcggauaugcag

SEQ ID NO: 1671900 - RNA, 21 nt, Salmonella enterica enterica serovar Typhi
ugucgcggauaugcagcagcc

SEQ ID NO: 1671901 - RNA, 23 nt, Salmonella enterica enterica serovar Typhi
ugucggccaggugccgagguuaa

SEQ ID NO: 1671902 - RNA, 14 nt, Salmonella enterica enterica serovar Typhi
ugucuccucaugcc

SEQ ID NO: 1671903 - RNA, 19 nt, Salmonella enterica enterica serovar Typhi
ugucucacccguuuucucc

SEQ ID NO: 1671904 - RNA, 14 nt, Salmonella enterica enterica serovar Typhi
ugucugaaugaguc

SEQ ID NO: 1671905 - RNA, 23 nt, Salmonella enterica enterica serovar Typhi
ugucuauaggccugauaaacgua

SEQ ID NO: 1671906 - RNA, 13 nt, Salmonella enterica enterica serovar Typhi
ugucuucaucuau

SEQ ID NO: 1671907 - RNA, 19 nt, Salmonella enterica enterica serovar Typhi
ugucuuaccuaacggauaa

SEQ ID NO: 1671908 - RNA, 23 nt, Salmonella enterica enterica serovar Typhi
ugucugccucggguggcaucuga

SEQ ID NO: 1671909 - RNA, 23 nt, Salmonella enterica enterica serovar Typhi
ugucugcgcaacgcuuccaccuc

SEQ ID NO: 1671910 - RNA, 14 nt, Salmonella enterica enterica serovar Typhi
ugucuucugccagc

SEQ ID NO: 1671911 - RNA, 18 nt, Salmonella enterica enterica serovar Typhi
ugucuucgcacugcccuu

SEQ ID NO: 1671912 - RNA, 22 nt, Salmonella enterica enterica serovar Typhi
ugugaacaucacguccucccgu

SEQ ID NO: 1671913 - RNA, 14 nt, Salmonella enterica enterica serovar Typhi
ugugaauaaaggau

SEQ ID NO: 1671914 - RNA, 14 nt, Salmonella enterica enterica serovar Typhi
ugugaaguccguau

SEQ ID NO: 1671915 - RNA, 16 nt, Salmonella enterica enterica serovar Typhi
ugugaauccaggccag

SEQ ID NO: 1671916 - RNA, 19 nt, Salmonella enterica enterica serovar Typhi
ugugaauaugaucugcaca

SEQ ID NO: 1671917 - RNA, 14 nt, Salmonella enterica enterica serovar Typhi
ugugauuaauccaa

SEQ ID NO: 1671918 - RNA, 20 nt, Salmonella enterica enterica serovar Typhi
ugugaucugguuugguaaag

SEQ ID NO: 1671919 - RNA, 15 nt, Salmonella enterica enterica serovar Typhi
ugugccauacuguuu

SEQ ID NO: 1671920 - RNA, 11 nt, Salmonella enterica enterica serovar Typhi
ugugcuuuagc

SEQ ID NO: 1671921 - RNA, 15 nt, Salmonella enterica enterica serovar Typhi
ugugcuuaccgggcc

SEQ ID NO: 1671922 - RNA, 22 nt, Salmonella enterica enterica serovar Typhi
ugugcuuaucacguagccagag

SEQ ID NO: 1671923 - RNA, 12 nt, Salmonella enterica enterica serovar Typhi
ugugcuuccagc

SEQ ID NO: 1671924 - RNA, 15 nt, Salmonella enterica enterica serovar Typhi
uguggagguuucuuc

SEQ ID NO: 1671925 - RNA, 17 nt, Salmonella enterica enterica serovar Typhi
uguggaaacuccagcgg

SEQ ID NO: 1671926 - RNA, 22 nt, Salmonella enterica enterica serovar Typhi
uguguaccagcagcgccagcga

SEQ ID NO: 1671927 - RNA, 18 nt, Salmonella enterica enterica serovar Typhi
uguguaccagcagcgcca

SEQ ID NO: 1671928 - RNA, 15 nt, Salmonella enterica enterica serovar Typhi
uguguacaaccauca

SEQ ID NO: 1671929 - RNA, 22 nt, Salmonella enterica enterica serovar Typhi
uguguagagauucugcaggcca

SEQ ID NO: 1671930 - RNA, 19 nt, Salmonella enterica enterica serovar Typhi
ugugguguuccauugcugc

SEQ ID NO: 1671931 - RNA, 15 nt, Salmonella enterica enterica serovar Typhi
uguuacgccaauaau

SEQ ID NO: 1671932 - RNA, 23 nt, Salmonella enterica enterica serovar Typhi
uguuaauccagagcggauaaaua

SEQ ID NO: 1671933 - RNA, 14 nt, Salmonella enterica enterica serovar Typhi
uguguuucagcagc

SEQ ID NO: 1671934 - RNA, 24 nt, Salmonella enterica enterica serovar Typhi
uguguugcucaaaaaagaguaaag

SEQ ID NO: 1671935 - RNA, 16 nt, Salmonella enterica enterica serovar Typhi
uguuagcaaaaaugcc

SEQ ID NO: 1671936 - RNA, 15 nt, Salmonella enterica enterica serovar Typhi
uguuaguuucuauua

SEQ ID NO: 1671937 - RNA, 14 nt, Salmonella enterica enterica serovar Typhi
uguuaguuucuauu

SEQ ID NO: 1671938 - RNA, 14 nt, Salmonella enterica enterica serovar Typhi
uguuauuuucaaaa

SEQ ID NO: 1671939 - RNA, 13 nt, Salmonella enterica enterica serovar Typhi
uguucaacuuuuc

SEQ ID NO: 1671940 - RNA, 16 nt, Salmonella enterica enterica serovar Typhi
uguucaagcaauaaug

SEQ ID NO: 1671941 - RNA, 20 nt, Salmonella enterica enterica serovar Typhi
uguucagugccauccauauu

SEQ ID NO: 1671942 - RNA, 13 nt, Salmonella enterica enterica serovar Typhi
uguucacaauugu

SEQ ID NO: 1671943 - RNA, 17 nt, Salmonella enterica enterica serovar Typhi
uguugaaagccccggcu

SEQ ID NO: 1671944 - RNA, 22 nt, Salmonella enterica enterica serovar Typhi
uguugaugauggcuccuguugg

SEQ ID NO: 1671945 - RNA, 20 nt, Salmonella enterica enterica serovar Typhi
uguucgagggcgauuuugac

SEQ ID NO: 1671946 - RNA, 23 nt, Salmonella enterica enterica serovar Typhi
uguucgcaaccuaaccaaacaga

SEQ ID NO: 1671947 - RNA, 23 nt, Salmonella enterica enterica serovar Typhi
uguucauaucgaagaccuggccg

SEQ ID NO: 1671948 - RNA, 19 nt, Salmonella enterica enterica serovar Typhi
uguucauaccggauauggc

SEQ ID NO: 1671949 - RNA, 21 nt, Salmonella enterica enterica serovar Typhi
uguucgcuucuucuaccaccu

SEQ ID NO: 1671950 - RNA, 19 nt, Salmonella enterica enterica serovar Typhi
uguucuguccauguuuuau

SEQ ID NO: 1671951 - RNA, 19 nt, Salmonella enterica enterica serovar Typhi
uggucggacgggcccuggc

SEQ ID NO: 1671952 - RNA, 21 nt, Salmonella enterica enterica serovar Typhi
uggucggacgggcccuggccg

SEQ ID NO: 1671953 - RNA, 14 nt, Salmonella enterica enterica serovar Typhi
uggucgguauuauc

SEQ ID NO: 1671954 - RNA, 18 nt, Salmonella enterica enterica serovar Typhi
uggugaaacguguuuauc

SEQ ID NO: 1671955 - RNA, 21 nt, Salmonella enterica enterica serovar Typhi
uggugaugaacaugcccggau

SEQ ID NO: 1671956 - RNA, 21 nt, Salmonella enterica enterica serovar Typhi
uggucuguagauagcuaucca

SEQ ID NO: 1671957 - RNA, 17 nt, Salmonella enterica enterica serovar Typhi
uggugccguuacuguuu

SEQ ID NO: 1671958 - RNA, 16 nt, Salmonella enterica enterica serovar Typhi
uggugccaaucuccag

SEQ ID NO: 1671959 - RNA, 18 nt, Salmonella enterica enterica serovar Typhi
ugguguaauugcgccagg

SEQ ID NO: 1671960 - RNA, 19 nt, Salmonella enterica enterica serovar Typhi
ugguggucauccgcccggc

SEQ ID NO: 1671961 - RNA, 22 nt, Salmonella enterica enterica serovar Typhi
ugguggucggcaaucaccugca

SEQ ID NO: 1671962 - RNA, 18 nt, Salmonella enterica enterica serovar Typhi
uggucacaaaggccagca

SEQ ID NO: 1671963 - RNA, 19 nt, Salmonella enterica enterica serovar Typhi
uggucacaaaggccagcag

SEQ ID NO: 1671964 - RNA, 21 nt, Salmonella enterica enterica serovar Typhi
ugguagucguuauaauccuga

SEQ ID NO: 1671965 - RNA, 16 nt, Salmonella enterica enterica serovar Typhi
ugguaguaagucagcu

SEQ ID NO: 1671966 - RNA, 23 nt, Salmonella enterica enterica serovar Typhi
uggucaccaugacgcagggcaau

SEQ ID NO: 1671967 - RNA, 21 nt, Salmonella enterica enterica serovar Typhi
uggucauuaggcguaauuauu

SEQ ID NO: 1671968 - RNA, 16 nt, Salmonella enterica enterica serovar Typhi
uggucauucccgucuc

SEQ ID NO: 1671969 - RNA, 21 nt, Salmonella enterica enterica serovar Typhi
ugguaaggcaaauaugcuguc

SEQ ID NO: 1671970 - RNA, 14 nt, Salmonella enterica enterica serovar Typhi
ugguaaggcaaaua

SEQ ID NO: 1671971 - RNA, 18 nt, Salmonella enterica enterica serovar Typhi
ugguaauggcgaagcccg

SEQ ID NO: 1671972 - RNA, 18 nt, Salmonella enterica enterica serovar Typhi
ugguaauuaaaggcagcg

SEQ ID NO: 1671973 - RNA, 16 nt, Salmonella enterica enterica serovar Typhi
ugguagagcaucgcgg

SEQ ID NO: 1671974 - RNA, 22 nt, Salmonella enterica enterica serovar Typhi
ugguagagaucgacaaaccacu

SEQ ID NO: 1671975 - RNA, 15 nt, Salmonella enterica enterica serovar Typhi
ugguagacaggcugg

SEQ ID NO: 1671976 - RNA, 22 nt, Salmonella enterica enterica serovar Typhi
ugguaaccuguuccucacugag

SEQ ID NO: 1671977 - RNA, 16 nt, Salmonella enterica enterica serovar Typhi
uggguaaauaccaggc

SEQ ID NO: 1671978 - RNA, 17 nt, Salmonella enterica enterica serovar Typhi
uggguaaauaccaggca

SEQ ID NO: 1671979 - RNA, 17 nt, Salmonella enterica enterica serovar Typhi
uguaauugcgccaggcc

SEQ ID NO: 1671980 - RNA, 15 nt, Salmonella enterica enterica serovar Typhi
uguaauuauaaauau

SEQ ID NO: 1671981 - RNA, 18 nt, Salmonella enterica enterica serovar Typhi
uguaauucaccaaauccu

SEQ ID NO: 1671982 - RNA, 22 nt, Salmonella enterica enterica serovar Typhi
uguaauuaaggauugccgccuu

SEQ ID NO: 1671983 - RNA, 15 nt, Salmonella enterica enterica serovar Typhi
uguaauggugggaca

SEQ ID NO: 1671984 - RNA, 22 nt, Salmonella enterica enterica serovar Typhi
uguaauggugggacacugccgg

SEQ ID NO: 1671985 - RNA, 11 nt, Salmonella enterica enterica serovar Typhi
uguaaaaaaau

SEQ ID NO: 1671986 - RNA, 16 nt, Salmonella enterica enterica serovar Typhi
uguaaaaaaauaaaaa

SEQ ID NO: 1671987 - RNA, 16 nt, Salmonella enterica enterica serovar Typhi
uguaaaaaauccagcg

SEQ ID NO: 1671988 - RNA, 21 nt, Salmonella enterica enterica serovar Typhi
uguaaaaaaauaaaaaaggca

SEQ ID NO: 1671989 - RNA, 21 nt, Salmonella enterica enterica serovar Typhi
uguaagggaggugcucuccca

SEQ ID NO: 1671990 - RNA, 16 nt, Salmonella enterica enterica serovar Typhi
uguaacauauuuuuau

SEQ ID NO: 1671991 - RNA, 20 nt, Salmonella enterica enterica serovar Typhi
ugguuuuaucuguaauuaua

SEQ ID NO: 1671992 - RNA, 20 nt, Salmonella enterica enterica serovar Typhi
ugguuuauguaauuugcaaa

SEQ ID NO: 1671993 - RNA, 16 nt, Salmonella enterica enterica serovar Typhi
ugguuucgcggugaaa

SEQ ID NO: 1671994 - RNA, 19 nt, Salmonella enterica enterica serovar Typhi
ugguuucggcaugccacug

SEQ ID NO: 1671995 - RNA, 23 nt, Salmonella enterica enterica serovar Typhi
ugguuuaauaccgcguaaaaagu

SEQ ID NO: 1671996 - RNA, 22 nt, Salmonella enterica enterica serovar Typhi
ugguuuaucgccgauugagggg

SEQ ID NO: 1671997 - RNA, 16 nt, Salmonella enterica enterica serovar Typhi
ugguuguagcacagcc

SEQ ID NO: 1671998 - RNA, 16 nt, Salmonella enterica enterica serovar Typhi
ugguucgcauaauauc

SEQ ID NO: 1671999 - RNA, 13 nt, Salmonella enterica enterica serovar Typhi
ugguuccauucca

SEQ ID NO: 1672000 - RNA, 16 nt, Salmonella enterica enterica serovar Typhi
ugguuagccauuucgc

SEQ ID NO: 1672001 - RNA, 13 nt, Salmonella enterica enterica serovar Typhi
ugguuagcgcucu

SEQ ID NO: 1672002 - RNA, 15 nt, Salmonella enterica enterica serovar Typhi
ugguuaaugaccugc

SEQ ID NO: 1672003 - RNA, 16 nt, Salmonella enterica enterica serovar Typhi
ugguuacuauuuuuca

SEQ ID NO: 1672004 - RNA, 16 nt, Salmonella enterica enterica serovar Typhi
ugguuaaccaccagcg

SEQ ID NO: 1672005 - RNA, 18 nt, Salmonella enterica enterica serovar Typhi
ugguuaaccaccucauua

SEQ ID NO: 1672006 - RNA, 23 nt, Salmonella enterica enterica serovar Typhi
uggcggggagguuauugcucuuu

SEQ ID NO: 1672007 - RNA, 14 nt, Salmonella enterica enterica serovar Typhi
uggcggaaagaagc

SEQ ID NO: 1672008 - RNA, 15 nt, Salmonella enterica enterica serovar Typhi
uggcggugacgucaa

SEQ ID NO: 1672009 - RNA, 17 nt, Salmonella enterica enterica serovar Typhi
uggcguaaauauucguu

SEQ ID NO: 1672010 - RNA, 21 nt, Salmonella enterica enterica serovar Typhi
uggcguaaaugugcgccagcc

SEQ ID NO: 1672011 - RNA, 20 nt, Salmonella enterica enterica serovar Typhi
uggcguaauuaaccgcgccg

SEQ ID NO: 1672012 - RNA, 17 nt, Salmonella enterica enterica serovar Typhi
uggcguacgcauccgcg

SEQ ID NO: 1672013 - RNA, 15 nt, Salmonella enterica enterica serovar Typhi
uggcgucaaucaacu

SEQ ID NO: 1672014 - RNA, 23 nt, Salmonella enterica enterica serovar Typhi
uggcguacgcauccgcguuaccc

SEQ ID NO: 1672015 - RNA, 17 nt, Salmonella enterica enterica serovar Typhi
uggcguagaagcuuacc

SEQ ID NO: 1672016 - RNA, 22 nt, Salmonella enterica enterica serovar Typhi
uggaaaacagcauaauaaagca

SEQ ID NO: 1672017 - RNA, 15 nt, Salmonella enterica enterica serovar Typhi
uggaaaaucacgcug

SEQ ID NO: 1672018 - RNA, 21 nt, Salmonella enterica enterica serovar Typhi
uggcgcgaucaguucuugcag

SEQ ID NO: 1672019 - RNA, 16 nt, Salmonella enterica enterica serovar Typhi
uggaaaauaauaaucg

SEQ ID NO: 1672020 - RNA, 23 nt, Salmonella enterica enterica serovar Typhi
uggaaaacaagugcagaagcaau

SEQ ID NO: 1672021 - RNA, 13 nt, Salmonella enterica enterica serovar Typhi
uggaaaagaaaac

SEQ ID NO: 1672022 - RNA, 21 nt, Salmonella enterica enterica serovar Typhi
uggaaaacagcauaauaaagc

SEQ ID NO: 1672023 - RNA, 14 nt, Salmonella enterica enterica serovar Typhi
uggcgcuccugaau

SEQ ID NO: 1672024 - RNA, 14 nt, Salmonella enterica enterica serovar Typhi
uggcgcgugcccag

SEQ ID NO: 1672025 - RNA, 17 nt, Salmonella enterica enterica serovar Typhi
uggcgcugucgcuuacc

SEQ ID NO: 1672026 - RNA, 18 nt, Salmonella enterica enterica serovar Typhi
uggcgcuguucuugcugc

SEQ ID NO: 1672027 - RNA, 16 nt, Salmonella enterica enterica serovar Typhi
uggcgcugcgcuuacc

SEQ ID NO: 1672028 - RNA, 17 nt, Salmonella enterica enterica serovar Typhi
uggcucaauccaggugg

SEQ ID NO: 1672029 - RNA, 17 nt, Salmonella enterica enterica serovar Typhi
uggcucaaggauauugc

SEQ ID NO: 1672030 - RNA, 20 nt, Salmonella enterica enterica serovar Typhi
uggcuauagcucaguuggua

SEQ ID NO: 1672031 - RNA, 14 nt, Salmonella enterica enterica serovar Typhi
uggcuagggaaacg

SEQ ID NO: 1672032 - RNA, 13 nt, Salmonella enterica enterica serovar Typhi
uggcucugggcca

SEQ ID NO: 1672033 - RNA, 23 nt, Salmonella enterica enterica serovar Typhi
uggcucuuagcagcauaaacauc

SEQ ID NO: 1672034 - RNA, 16 nt, Salmonella enterica enterica serovar Typhi
uggcucggcgucaucc

SEQ ID NO: 1672035 - RNA, 18 nt, Salmonella enterica enterica serovar Typhi
uggcucggcgucaucccg

SEQ ID NO: 1672036 - RNA, 19 nt, Salmonella enterica enterica serovar Typhi
uggcucccgcagccacucc

SEQ ID NO: 1672037 - RNA, 21 nt, Salmonella enterica enterica serovar Typhi
uggcucccgaacgauaauucg

SEQ ID NO: 1672038 - RNA, 17 nt, Salmonella enterica enterica serovar Typhi
uggcuaaucgccacgac

SEQ ID NO: 1672039 - RNA, 15 nt, Salmonella enterica enterica serovar Typhi
uggcguccagcccgu

SEQ ID NO: 1672040 - RNA, 15 nt, Salmonella enterica enterica serovar Typhi
uggcgucccuuuccc

SEQ ID NO: 1672041 - RNA, 16 nt, Salmonella enterica enterica serovar Typhi
uggcguccggccacua

SEQ ID NO: 1672042 - RNA, 21 nt, Salmonella enterica enterica serovar Typhi
uggcgucgccaaagcagcugc

SEQ ID NO: 1672043 - RNA, 15 nt, Salmonella enterica enterica serovar Typhi
uggcguggccaagau

SEQ ID NO: 1672044 - RNA, 17 nt, Salmonella enterica enterica serovar Typhi
ugggcgugcugacggag

SEQ ID NO: 1672045 - RNA, 18 nt, Salmonella enterica enterica serovar Typhi
uggggaucgggcagacuu

SEQ ID NO: 1672046 - RNA, 16 nt, Salmonella enterica enterica serovar Typhi
uggggauuaagcgagc

SEQ ID NO: 1672047 - RNA, 18 nt, Salmonella enterica enterica serovar Typhi
uggggauuaucaggauga

SEQ ID NO: 1672048 - RNA, 14 nt, Salmonella enterica enterica serovar Typhi
uggggaaguuaugu

SEQ ID NO: 1672049 - RNA, 15 nt, Salmonella enterica enterica serovar Typhi
ugggcguaagaaaag

SEQ ID NO: 1672050 - RNA, 16 nt, Salmonella enterica enterica serovar Typhi
ugggcguaagaaaagu

SEQ ID NO: 1672051 - RNA, 22 nt, Salmonella enterica enterica serovar Typhi
ugggcgucuuaaugcucuccag

SEQ ID NO: 1672052 - RNA, 16 nt, Salmonella enterica enterica serovar Typhi
ugggaauuagcgaauc

SEQ ID NO: 1672053 - RNA, 18 nt, Salmonella enterica enterica serovar Typhi
uggcuuaaucauugcuca

SEQ ID NO: 1672054 - RNA, 23 nt, Salmonella enterica enterica serovar Typhi
uggcuuaccguaugcaaaaggca

SEQ ID NO: 1672055 - RNA, 16 nt, Salmonella enterica enterica serovar Typhi
uggcuuaccugcucug

SEQ ID NO: 1672056 - RNA, 16 nt, Salmonella enterica enterica serovar Typhi
uggcuuccguccccag

SEQ ID NO: 1672057 - RNA, 18 nt, Salmonella enterica enterica serovar Typhi
uggcuucuucaacauugu

SEQ ID NO: 1672058 - RNA, 23 nt, Salmonella enterica enterica serovar Typhi
ugggaaucgccugaugaagcgga

SEQ ID NO: 1672059 - RNA, 14 nt, Salmonella enterica enterica serovar Typhi
uggcuuucauccaa

SEQ ID NO: 1672060 - RNA, 17 nt, Salmonella enterica enterica serovar Typhi
uggcuuuauauaaaaaa

SEQ ID NO: 1672061 - RNA, 14 nt, Salmonella enterica enterica serovar Typhi
uggcuggcauauug

SEQ ID NO: 1672062 - RNA, 14 nt, Salmonella enterica enterica serovar Typhi
uggcuggcgucccg

SEQ ID NO: 1672063 - RNA, 16 nt, Salmonella enterica enterica serovar Typhi
uggcugugcgugaccc

SEQ ID NO: 1672064 - RNA, 14 nt, Salmonella enterica enterica serovar Typhi
uggcuuaacucacc

SEQ ID NO: 1672065 - RNA, 17 nt, Salmonella enterica enterica serovar Typhi
uggcugucggcagaacc

SEQ ID NO: 1672066 - RNA, 15 nt, Salmonella enterica enterica serovar Typhi
uggcugugccaauaa

SEQ ID NO: 1672067 - RNA, 15 nt, Salmonella enterica enterica serovar Typhi
uggcugucguuucau

SEQ ID NO: 1672068 - RNA, 16 nt, Salmonella enterica enterica serovar Typhi
uggcugcgauaaugaa

SEQ ID NO: 1672069 - RNA, 21 nt, Salmonella enterica enterica serovar Typhi
uggcugcgcgucccucuccag

SEQ ID NO: 1672070 - RNA, 17 nt, Salmonella enterica enterica serovar Typhi
uggcugagaaaaauacg

SEQ ID NO: 1672071 - RNA, 19 nt, Salmonella enterica enterica serovar Typhi
uucaguaagcguaccauuc

SEQ ID NO: 1672072 - RNA, 19 nt, Salmonella enterica enterica serovar Typhi
uucagucauaauccuuccu

SEQ ID NO: 1672073 - RNA, 22 nt, Salmonella enterica enterica serovar Typhi
uucaggucuggauuacaaaaau

SEQ ID NO: 1672074 - RNA, 17 nt, Salmonella enterica enterica serovar Typhi
uucaggccgccagcaaa

SEQ ID NO: 1672075 - RNA, 17 nt, Salmonella enterica enterica serovar Typhi
uucaggcggcaaaaaac

SEQ ID NO: 1672076 - RNA, 17 nt, Salmonella enterica enterica serovar Typhi
uucaggcaaaggaaugc

SEQ ID NO: 1672077 - RNA, 23 nt, Salmonella enterica enterica serovar Typhi
uucaggauaauaucgcuggccau

SEQ ID NO: 1672078 - RNA, 22 nt, Salmonella enterica enterica serovar Typhi
uucaggacgagagacugauaau

SEQ ID NO: 1672079 - RNA, 18 nt, Salmonella enterica enterica serovar Typhi
uucagcgcgauaaauacc

SEQ ID NO: 1672080 - RNA, 23 nt, Salmonella enterica enterica serovar Typhi
uucagcggcuugucauccugcuc

SEQ ID NO: 1672081 - RNA, 16 nt, Salmonella enterica enterica serovar Typhi
uucagcguacagaagg

SEQ ID NO: 1672082 - RNA, 17 nt, Salmonella enterica enterica serovar Typhi
uucagcgacaggcuguc

SEQ ID NO: 1672083 - RNA, 17 nt, Salmonella enterica enterica serovar Typhi
uucagccugugcaacca

SEQ ID NO: 1672084 - RNA, 15 nt, Salmonella enterica enterica serovar Typhi
uucagccugaagcca

SEQ ID NO: 1672085 - RNA, 22 nt, Salmonella enterica enterica serovar Typhi
uucagcucgcaggccauaaaac

SEQ ID NO: 1672086 - RNA, 14 nt, Salmonella enterica enterica serovar Typhi
uucagcucuucaau

SEQ ID NO: 1672087 - RNA, 12 nt, Salmonella enterica enterica serovar Typhi
uucauaccacug

SEQ ID NO: 1672088 - RNA, 21 nt, Salmonella enterica enterica serovar Typhi
uucauaccggauauggcaaaa

SEQ ID NO: 1672089 - RNA, 15 nt, Salmonella enterica enterica serovar Typhi
uucauagaaccacuu

SEQ ID NO: 1672090 - RNA, 17 nt, Salmonella enterica enterica serovar Typhi
uucauagagaagucuga

SEQ ID NO: 1672091 - RNA, 17 nt, Salmonella enterica enterica serovar Typhi
uucauaggugaacauga

SEQ ID NO: 1672092 - RNA, 15 nt, Salmonella enterica enterica serovar Typhi
uucauagccguggcu

SEQ ID NO: 1672093 - RNA, 16 nt, Salmonella enterica enterica serovar Typhi
uucaucaaagaaaacc

SEQ ID NO: 1672094 - RNA, 13 nt, Salmonella enterica enterica serovar Typhi
uucagugccaucc

SEQ ID NO: 1672095 - RNA, 20 nt, Salmonella enterica enterica serovar Typhi
uucaguggcuaauuucaauu

SEQ ID NO: 1672096 - RNA, 23 nt, Salmonella enterica enterica serovar Typhi
uucaguggucaggcgaccaauau

SEQ ID NO: 1672097 - RNA, 18 nt, Salmonella enterica enterica serovar Typhi
uucagugccauccauauu

SEQ ID NO: 1672098 - RNA, 22 nt, Salmonella enterica enterica serovar Typhi
uucagucuaauuuauuaacccu

SEQ ID NO: 1672099 - RNA, 21 nt, Salmonella enterica enterica serovar Typhi
uucagucuacuacacacuuac

SEQ ID NO: 1672100 - RNA, 20 nt, Salmonella enterica enterica serovar Typhi
uucaguugcccauuuuccuc

SEQ ID NO: 1672101 - RNA, 21 nt, Salmonella enterica enterica serovar Typhi
uucaguucgacuuaacgauaa

SEQ ID NO: 1672102 - RNA, 12 nt, Salmonella enterica enterica serovar Typhi
uucauaaauacg

SEQ ID NO: 1672103 - RNA, 14 nt, Salmonella enterica enterica serovar Typhi
uucauaaauguacu

SEQ ID NO: 1672104 - RNA, 20 nt, Salmonella enterica enterica serovar Typhi
uucaguuucggcccccccca

SEQ ID NO: 1672105 - RNA, 18 nt, Salmonella enterica enterica serovar Typhi
uucaucuuuuaaaaucag

SEQ ID NO: 1672106 - RNA, 14 nt, Salmonella enterica enterica serovar Typhi
uucaugaaucauca

SEQ ID NO: 1672107 - RNA, 16 nt, Salmonella enterica enterica serovar Typhi
uucaugauacccagcg

SEQ ID NO: 1672108 - RNA, 12 nt, Salmonella enterica enterica serovar Typhi
uucaucgcuuuu

SEQ ID NO: 1672109 - RNA, 19 nt, Salmonella enterica enterica serovar Typhi
uucaucgguaauauuaagg

SEQ ID NO: 1672110 - RNA, 15 nt, Salmonella enterica enterica serovar Typhi
uucaucucaucaaug

SEQ ID NO: 1672111 - RNA, 14 nt, Salmonella enterica enterica serovar Typhi
uucaucucaucaau

SEQ ID NO: 1672112 - RNA, 21 nt, Salmonella enterica enterica serovar Typhi
uucaucuccucuucaguaagc

SEQ ID NO: 1672113 - RNA, 17 nt, Salmonella enterica enterica serovar Typhi
uucaucuccgauaaaua

SEQ ID NO: 1672114 - RNA, 21 nt, Salmonella enterica enterica serovar Typhi
uucaucuccgauaaauaagaa

SEQ ID NO: 1672115 - RNA, 11 nt, Salmonella enterica enterica serovar Typhi
uucaucaccau

SEQ ID NO: 1672116 - RNA, 17 nt, Salmonella enterica enterica serovar Typhi
uucaucaggcugacgaa

SEQ ID NO: 1672117 - RNA, 17 nt, Salmonella enterica enterica serovar Typhi
uucaucaguaacugacg

SEQ ID NO: 1672118 - RNA, 16 nt, Salmonella enterica enterica serovar Typhi
uucaucauaucuuccc

SEQ ID NO: 1672119 - RNA, 13 nt, Salmonella enterica enterica serovar Typhi
uucauccaugcca

SEQ ID NO: 1672120 - RNA, 14 nt, Salmonella enterica enterica serovar Typhi
uucauccaccgccc

SEQ ID NO: 1672121 - RNA, 20 nt, Salmonella enterica enterica serovar Typhi
uucaucgccgauuccugcug

SEQ ID NO: 1672122 - RNA, 19 nt, Salmonella enterica enterica serovar Typhi
uucaucccacucaaucauu

SEQ ID NO: 1672123 - RNA, 18 nt, Salmonella enterica enterica serovar Typhi
uucauccggcguugcgcc

SEQ ID NO: 1672124 - RNA, 14 nt, Salmonella enterica enterica serovar Typhi
uucauccucaacca

SEQ ID NO: 1672125 - RNA, 19 nt, Salmonella enterica enterica serovar Typhi
uucauucgccaccaggcuc

SEQ ID NO: 1672126 - RNA, 12 nt, Salmonella enterica enterica serovar Typhi
uucauucagacc

SEQ ID NO: 1672127 - RNA, 13 nt, Salmonella enterica enterica serovar Typhi
uucauucugucag

SEQ ID NO: 1672128 - RNA, 15 nt, Salmonella enterica enterica serovar Typhi
uucauuucaauguaa

SEQ ID NO: 1672129 - RNA, 18 nt, Salmonella enterica enterica serovar Typhi
uucauugucucuguuuuu

SEQ ID NO: 1672130 - RNA, 19 nt, Salmonella enterica enterica serovar Typhi
uucauuacagguguuaauc

SEQ ID NO: 1672131 - RNA, 13 nt, Salmonella enterica enterica serovar Typhi
uucauuacgcuuc

SEQ ID NO: 1672132 - RNA, 19 nt, Salmonella enterica enterica serovar Typhi
uucaugguacucaacauca

SEQ ID NO: 1672133 - RNA, 15 nt, Salmonella enterica enterica serovar Typhi
uucauguaaaugacg

SEQ ID NO: 1672134 - RNA, 12 nt, Salmonella enterica enterica serovar Typhi
uucaugcauuaa

SEQ ID NO: 1672135 - RNA, 21 nt, Salmonella enterica enterica serovar Typhi
uucaugccagaagcaaauuca

SEQ ID NO: 1672136 - RNA, 23 nt, Salmonella enterica enterica serovar Typhi
uucaugcaucauugaagcgaugu

SEQ ID NO: 1672137 - RNA, 18 nt, Salmonella enterica enterica serovar Typhi
uucaugcacgaugguauc

SEQ ID NO: 1672138 - RNA, 16 nt, Salmonella enterica enterica serovar Typhi
uucaagcuggugcuuu

SEQ ID NO: 1672139 - RNA, 22 nt, Salmonella enterica enterica serovar Typhi
uucaaguuuagaaaaaauuaaa

SEQ ID NO: 1672140 - RNA, 21 nt, Salmonella enterica enterica serovar Typhi
uucaaguuuagaaaaaauuaa

SEQ ID NO: 1672141 - RNA, 17 nt, Salmonella enterica enterica serovar Typhi
uucaauacgaaaaccga

SEQ ID NO: 1672142 - RNA, 21 nt, Salmonella enterica enterica serovar Typhi
uucaauaauggcgcgaaaaca

SEQ ID NO: 1672143 - RNA, 17 nt, Salmonella enterica enterica serovar Typhi
uucaauaauauuaucau

SEQ ID NO: 1672144 - RNA, 18 nt, Salmonella enterica enterica serovar Typhi
uucaauaauauuaucaua

SEQ ID NO: 1672145 - RNA, 14 nt, Salmonella enterica enterica serovar Typhi
uucaauaauaaaac

SEQ ID NO: 1672146 - RNA, 20 nt, Salmonella enterica enterica serovar Typhi
uucaauaagcgguaauaauu

SEQ ID NO: 1672147 - RNA, 19 nt, Salmonella enterica enterica serovar Typhi
uucaaucuggugacgauga

SEQ ID NO: 1672148 - RNA, 16 nt, Salmonella enterica enterica serovar Typhi
uucaaugccaugcugg

SEQ ID NO: 1672149 - RNA, 14 nt, Salmonella enterica enterica serovar Typhi
uucaaugcccaggc

SEQ ID NO: 1672150 - RNA, 17 nt, Salmonella enterica enterica serovar Typhi
uucaauggguuaugggu

SEQ ID NO: 1672151 - RNA, 15 nt, Salmonella enterica enterica serovar Typhi
uucaauaugccaggc

SEQ ID NO: 1672152 - RNA, 17 nt, Salmonella enterica enterica serovar Typhi
uucaaucgccaguuuuu

SEQ ID NO: 1672153 - RNA, 18 nt, Salmonella enterica enterica serovar Typhi
uucaaucgcgcccgccau

SEQ ID NO: 1672154 - RNA, 22 nt, Salmonella enterica enterica serovar Typhi
uucaaucacugaugccacaccc

SEQ ID NO: 1672155 - RNA, 13 nt, Salmonella enterica enterica serovar Typhi
uucaaucaucaua

SEQ ID NO: 1672156 - RNA, 17 nt, Salmonella enterica enterica serovar Typhi
uucacacaauuuucuua

SEQ ID NO: 1672157 - RNA, 21 nt, Salmonella enterica enterica serovar Typhi
uucacaccuuuauauuuuucc

SEQ ID NO: 1672158 - RNA, 15 nt, Salmonella enterica enterica serovar Typhi
uucaauuuucgcuuu

SEQ ID NO: 1672159 - RNA, 19 nt, Salmonella enterica enterica serovar Typhi
uucaauuaaugaguagaac

SEQ ID NO: 1672160 - RNA, 19 nt, Salmonella enterica enterica serovar Typhi
uucaauuagcgccuccccu

SEQ ID NO: 1672161 - RNA, 14 nt, Salmonella enterica enterica serovar Typhi
uucacagaaggcua

SEQ ID NO: 1672162 - RNA, 13 nt, Salmonella enterica enterica serovar Typhi
uucacauauauuu

SEQ ID NO: 1672163 - RNA, 24 nt, Salmonella enterica enterica serovar Typhi
uucaccaaaaggcagacagagaaa

SEQ ID NO: 1672164 - RNA, 19 nt, Salmonella enterica enterica serovar Typhi
uucaccaccgguauaaaac

SEQ ID NO: 1672165 - RNA, 16 nt, Salmonella enterica enterica serovar Typhi
uucaccagacgcuggc

SEQ ID NO: 1672166 - RNA, 12 nt, Salmonella enterica enterica serovar Typhi
uucaccagcgcg

SEQ ID NO: 1672167 - RNA, 20 nt, Salmonella enterica enterica serovar Typhi
uucacccagacugugauggc

SEQ ID NO: 1672168 - RNA, 18 nt, Salmonella enterica enterica serovar Typhi
uucaccauuaagcaaucc

SEQ ID NO: 1672169 - RNA, 14 nt, Salmonella enterica enterica serovar Typhi
uucagauaucccau

SEQ ID NO: 1672170 - RNA, 22 nt, Salmonella enterica enterica serovar Typhi
uucagauaucccaugaaacucg

SEQ ID NO: 1672171 - RNA, 14 nt, Salmonella enterica enterica serovar Typhi
uucagaugcagcgg

SEQ ID NO: 1672172 - RNA, 14 nt, Salmonella enterica enterica serovar Typhi
uucagcauuggcau

SEQ ID NO: 1672173 - RNA, 19 nt, Salmonella enterica enterica serovar Typhi
uucagccagguggcaauau

SEQ ID NO: 1672174 - RNA, 12 nt, Salmonella enterica enterica serovar Typhi
uucagcaucauc

SEQ ID NO: 1672175 - RNA, 17 nt, Salmonella enterica enterica serovar Typhi
uucagcagcgcccagcc

SEQ ID NO: 1672176 - RNA, 17 nt, Salmonella enterica enterica serovar Typhi
uucagaccacuauaguu

SEQ ID NO: 1672177 - RNA, 16 nt, Salmonella enterica enterica serovar Typhi
uucagaccauagucca

SEQ ID NO: 1672178 - RNA, 17 nt, Salmonella enterica enterica serovar Typhi
uucacuuuaccaggcau

SEQ ID NO: 1672179 - RNA, 14 nt, Salmonella enterica enterica serovar Typhi
uucacuuuuucucu

SEQ ID NO: 1672180 - RNA, 19 nt, Salmonella enterica enterica serovar Typhi
uucagaaauguauucuccc

SEQ ID NO: 1672181 - RNA, 19 nt, Salmonella enterica enterica serovar Typhi
uucacgccauugccaggac

SEQ ID NO: 1672182 - RNA, 23 nt, Salmonella enterica enterica serovar Typhi
uucacgcagcgcauccaccagac

SEQ ID NO: 1672183 - RNA, 20 nt, Salmonella enterica enterica serovar Typhi
uucacgccuuuugacgcuuc

SEQ ID NO: 1672184 - RNA, 22 nt, Salmonella enterica enterica serovar Typhi
uucacgcuauguuugcugagaa

SEQ ID NO: 1672185 - RNA, 20 nt, Salmonella enterica enterica serovar Typhi
uucacgccgccauccggcaa

SEQ ID NO: 1672186 - RNA, 20 nt, Salmonella enterica enterica serovar Typhi
uucacgagcggucaggccag

SEQ ID NO: 1672187 - RNA, 14 nt, Salmonella enterica enterica serovar Typhi
uucaccuuuccagu

SEQ ID NO: 1672188 - RNA, 23 nt, Salmonella enterica enterica serovar Typhi
uucaccuucugugaaaguuucag

SEQ ID NO: 1672189 - RNA, 12 nt, Salmonella enterica enterica serovar Typhi
uucaccggcguu

SEQ ID NO: 1672190 - RNA, 20 nt, Salmonella enterica enterica serovar Typhi
uucaccguuuaaaaacauca

SEQ ID NO: 1672191 - RNA, 13 nt, Salmonella enterica enterica serovar Typhi
uucaccucccugc

SEQ ID NO: 1672192 - RNA, 10 nt, Salmonella enterica enterica serovar Typhi
uucaccgugu

SEQ ID NO: 1672193 - RNA, 17 nt, Salmonella enterica enterica serovar Typhi
uucacccuauaagcugc

SEQ ID NO: 1672194 - RNA, 15 nt, Salmonella enterica enterica serovar Typhi
uucacccauugaacc

SEQ ID NO: 1672195 - RNA, 13 nt, Salmonella enterica enterica serovar Typhi
uucacccccaucg

SEQ ID NO: 1672196 - RNA, 13 nt, Salmonella enterica enterica serovar Typhi
uucaccgaggguu

SEQ ID NO: 1672197 - RNA, 21 nt, Salmonella enterica enterica serovar Typhi
uucacuguagcugauaagcua

SEQ ID NO: 1672198 - RNA, 15 nt, Salmonella enterica enterica serovar Typhi
uucacuuauaaauaa

SEQ ID NO: 1672199 - RNA, 20 nt, Salmonella enterica enterica serovar Typhi
uucacgccgugaauuucugc

SEQ ID NO: 1672200 - RNA, 18 nt, Salmonella enterica enterica serovar Typhi
uucacguuuuccaggugc

SEQ ID NO: 1672201 - RNA, 23 nt, Salmonella enterica enterica serovar Typhi
uucacuaauuugaugccuggcag

SEQ ID NO: 1672202 - RNA, 20 nt, Salmonella enterica enterica serovar Typhi
uuccacaaucccggcaacug

SEQ ID NO: 1672203 - RNA, 13 nt, Salmonella enterica enterica serovar Typhi
uuccacagaccca

SEQ ID NO: 1672204 - RNA, 23 nt, Salmonella enterica enterica serovar Typhi
uuccaauauuuauuuaauguuuc

SEQ ID NO: 1672205 - RNA, 20 nt, Salmonella enterica enterica serovar Typhi
uuccaccagcuuaucugacc

SEQ ID NO: 1672206 - RNA, 12 nt, Salmonella enterica enterica serovar Typhi
uuccaccaccuc

SEQ ID NO: 1672207 - RNA, 18 nt, Salmonella enterica enterica serovar Typhi
uuccaccucuucugcagu

SEQ ID NO: 1672208 - RNA, 21 nt, Salmonella enterica enterica serovar Typhi
uuccacgccgucgaugauggc

SEQ ID NO: 1672209 - RNA, 23 nt, Salmonella enterica enterica serovar Typhi
uuccacgcgcgcgccgauaaauu

SEQ ID NO: 1672210 - RNA, 14 nt, Salmonella enterica enterica serovar Typhi
uuccacgguaaaac

SEQ ID NO: 1672211 - RNA, 21 nt, Salmonella enterica enterica serovar Typhi
uuccacugagcuucaccgcca

SEQ ID NO: 1672212 - RNA, 18 nt, Salmonella enterica enterica serovar Typhi
uuccagaaauaaaauacg

SEQ ID NO: 1672213 - RNA, 17 nt, Salmonella enterica enterica serovar Typhi
uuccaguuucucaaaca

SEQ ID NO: 1672214 - RNA, 20 nt, Salmonella enterica enterica serovar Typhi
uuccaguugcgcuacuuuau

SEQ ID NO: 1672215 - RNA, 15 nt, Salmonella enterica enterica serovar Typhi
uuccaguuucucaaa

SEQ ID NO: 1672216 - RNA, 13 nt, Salmonella enterica enterica serovar Typhi
uuccaguccacgu

SEQ ID NO: 1672217 - RNA, 17 nt, Salmonella enterica enterica serovar Typhi
uuccagguugugacgaa

SEQ ID NO: 1672218 - RNA, 14 nt, Salmonella enterica enterica serovar Typhi
uuccaguaauuuca

SEQ ID NO: 1672219 - RNA, 19 nt, Salmonella enterica enterica serovar Typhi
uuccaggucaugguaaaac

SEQ ID NO: 1672220 - RNA, 15 nt, Salmonella enterica enterica serovar Typhi
uuccagauucucaac

SEQ ID NO: 1672221 - RNA, 20 nt, Salmonella enterica enterica serovar Typhi
uuccagcagcucaucaauaa

SEQ ID NO: 1672222 - RNA, 13 nt, Salmonella enterica enterica serovar Typhi
uuccagcacgccc

SEQ ID NO: 1672223 - RNA, 22 nt, Salmonella enterica enterica serovar Typhi
uuccagcauccugacauuaccc

SEQ ID NO: 1672224 - RNA, 17 nt, Salmonella enterica enterica serovar Typhi
uuccagcauuucuucaa

SEQ ID NO: 1672225 - RNA, 23 nt, Salmonella enterica enterica serovar Typhi
uuccagccgcccgcgauaaaaau

SEQ ID NO: 1672226 - RNA, 24 nt, Salmonella enterica enterica serovar Typhi
uuccagcgcgccgucaucgcucau

SEQ ID NO: 1672227 - RNA, 21 nt, Salmonella enterica enterica serovar Typhi
uuccagcgugccgagcaacag

SEQ ID NO: 1672228 - RNA, 14 nt, Salmonella enterica enterica serovar Typhi
uucccacagucggc

SEQ ID NO: 1672229 - RNA, 14 nt, Salmonella enterica enterica serovar Typhi
uucccacugcgccg

SEQ ID NO: 1672230 - RNA, 14 nt, Salmonella enterica enterica serovar Typhi
uucccacuccgccc

SEQ ID NO: 1672231 - RNA, 13 nt, Salmonella enterica enterica serovar Typhi
uuccauuuuucag

SEQ ID NO: 1672232 - RNA, 19 nt, Salmonella enterica enterica serovar Typhi
uucccaacaaugccacgcc

SEQ ID NO: 1672233 - RNA, 19 nt, Salmonella enterica enterica serovar Typhi
uuccauucaucgauuuccu

SEQ ID NO: 1672234 - RNA, 16 nt, Salmonella enterica enterica serovar Typhi
uuccauuaugaugagu

SEQ ID NO: 1672235 - RNA, 17 nt, Salmonella enterica enterica serovar Typhi
uuccauuagcuguuguu

SEQ ID NO: 1672236 - RNA, 13 nt, Salmonella enterica enterica serovar Typhi
uuccccagcaccg

SEQ ID NO: 1672237 - RNA, 16 nt, Salmonella enterica enterica serovar Typhi
uuccccaccaggaaug

SEQ ID NO: 1672238 - RNA, 17 nt, Salmonella enterica enterica serovar Typhi
uucccagcgggaacauc

SEQ ID NO: 1672239 - RNA, 18 nt, Salmonella enterica enterica serovar Typhi
uucccagcgggaacauca

SEQ ID NO: 1672240 - RNA, 16 nt, Salmonella enterica enterica serovar Typhi
uucccaucgcuuugca

SEQ ID NO: 1672241 - RNA, 20 nt, Salmonella enterica enterica serovar Typhi
uucccaucgcuuugcagaaa

SEQ ID NO: 1672242 - RNA, 22 nt, Salmonella enterica enterica serovar Typhi
uucccagugcgcggucauaucu

SEQ ID NO: 1672243 - RNA, 24 nt, Salmonella enterica enterica serovar Typhi
uucccaguauugcaccugggaauc

SEQ ID NO: 1672244 - RNA, 20 nt, Salmonella enterica enterica serovar Typhi
uucccccacuucugacagaa

SEQ ID NO: 1672245 - RNA, 22 nt, Salmonella enterica enterica serovar Typhi
uuccccuguaacugcaccuuuu

SEQ ID NO: 1672246 - RNA, 20 nt, Salmonella enterica enterica serovar Typhi
uuccccuuuaggcggcgccg

SEQ ID NO: 1672247 - RNA, 23 nt, Salmonella enterica enterica serovar Typhi
uucccgagccggguuauagccuu

SEQ ID NO: 1672248 - RNA, 21 nt, Salmonella enterica enterica serovar Typhi
uucccgcaaacuggccacagc

SEQ ID NO: 1672249 - RNA, 17 nt, Salmonella enterica enterica serovar Typhi
uucccuuuuuaaaauga

SEQ ID NO: 1672250 - RNA, 16 nt, Salmonella enterica enterica serovar Typhi
uucccuuccagcgacg

SEQ ID NO: 1672251 - RNA, 16 nt, Salmonella enterica enterica serovar Typhi
uucccuucugaaauga

SEQ ID NO: 1672252 - RNA, 17 nt, Salmonella enterica enterica serovar Typhi
uucccgcuauccaucau

SEQ ID NO: 1672253 - RNA, 17 nt, Salmonella enterica enterica serovar Typhi
uucccgcgccagcgucg

SEQ ID NO: 1672254 - RNA, 17 nt, Salmonella enterica enterica serovar Typhi
uucccgcuauagaaugc

SEQ ID NO: 1672255 - RNA, 15 nt, Salmonella enterica enterica serovar Typhi
uucccggaaaaguau

SEQ ID NO: 1672256 - RNA, 15 nt, Salmonella enterica enterica serovar Typhi
uucccggaucgcuaa

SEQ ID NO: 1672257 - RNA, 17 nt, Salmonella enterica enterica serovar Typhi
uuccgcguuaucaagag

SEQ ID NO: 1672258 - RNA, 19 nt, Salmonella enterica enterica serovar Typhi
uuccgcgagagaaaaaaau

SEQ ID NO: 1672259 - RNA, 15 nt, Salmonella enterica enterica serovar Typhi
uuccgcuggaauaaa

SEQ ID NO: 1672260 - RNA, 18 nt, Salmonella enterica enterica serovar Typhi
uuccgcuuuuccugccag

SEQ ID NO: 1672261 - RNA, 19 nt, Salmonella enterica enterica serovar Typhi
uuccgcccgcgcucccgcc

SEQ ID NO: 1672262 - RNA, 19 nt, Salmonella enterica enterica serovar Typhi
uuccgccaugaaaaaaacg

SEQ ID NO: 1672263 - RNA, 14 nt, Salmonella enterica enterica serovar Typhi
uuccgccagacuca

SEQ ID NO: 1672264 - RNA, 23 nt, Salmonella enterica enterica serovar Typhi
uuccgacagugaacggcauaauc

SEQ ID NO: 1672265 - RNA, 20 nt, Salmonella enterica enterica serovar Typhi
uuccgcaggggauucugcca

SEQ ID NO: 1672266 - RNA, 22 nt, Salmonella enterica enterica serovar Typhi
uuccgcagccaacaacaggccg

SEQ ID NO: 1672267 - RNA, 22 nt, Salmonella enterica enterica serovar Typhi
uuccgcaauaugcgucagcgcg

SEQ ID NO: 1672268 - RNA, 17 nt, Salmonella enterica enterica serovar Typhi
uucgccacgcucacuuu

SEQ ID NO: 1672269 - RNA, 22 nt, Salmonella enterica enterica serovar Typhi
uucgccaaagcagugaaucccc

SEQ ID NO: 1672270 - RNA, 15 nt, Salmonella enterica enterica serovar Typhi
uucgccagugacaaa

SEQ ID NO: 1672271 - RNA, 22 nt, Salmonella enterica enterica serovar Typhi
uucgccauucccgcgacgucaa

SEQ ID NO: 1672272 - RNA, 14 nt, Salmonella enterica enterica serovar Typhi
uucgcccagucauc

SEQ ID NO: 1672273 - RNA, 18 nt, Salmonella enterica enterica serovar Typhi
uucgcccggcgccagcuc

SEQ ID NO: 1672274 - RNA, 19 nt, Salmonella enterica enterica serovar Typhi
uucgcccauugccacccau

SEQ ID NO: 1672275 - RNA, 16 nt, Salmonella enterica enterica serovar Typhi
uucgccgucaccugaa

SEQ ID NO: 1672276 - RNA, 17 nt, Salmonella enterica enterica serovar Typhi
uucgccucccucacccu

SEQ ID NO: 1672277 - RNA, 19 nt, Salmonella enterica enterica serovar Typhi
uucgccgcccaaccagccc

SEQ ID NO: 1672278 - RNA, 20 nt, Salmonella enterica enterica serovar Typhi
uucgcuucuucuaccaccuu

SEQ ID NO: 1672279 - RNA, 13 nt, Salmonella enterica enterica serovar Typhi
uucgcucgcuuug

SEQ ID NO: 1672280 - RNA, 22 nt, Salmonella enterica enterica serovar Typhi
uucgcgucaaaacuuauuuuau

SEQ ID NO: 1672281 - RNA, 21 nt, Salmonella enterica enterica serovar Typhi
uucgcuaauccccccuuuuuu

SEQ ID NO: 1672282 - RNA, 13 nt, Salmonella enterica enterica serovar Typhi
uucgcgcaguuca

SEQ ID NO: 1672283 - RNA, 14 nt, Salmonella enterica enterica serovar Typhi
uucgccugaacagg

SEQ ID NO: 1672284 - RNA, 18 nt, Salmonella enterica enterica serovar Typhi
uucgcgaaucgcuucacg

SEQ ID NO: 1672285 - RNA, 18 nt, Salmonella enterica enterica serovar Typhi
uucgauaaccaccagcgg

SEQ ID NO: 1672286 - RNA, 17 nt, Salmonella enterica enterica serovar Typhi
uucgauaugaccaguac

SEQ ID NO: 1672287 - RNA, 15 nt, Salmonella enterica enterica serovar Typhi
uucgaugaaaaagag

SEQ ID NO: 1672288 - RNA, 14 nt, Salmonella enterica enterica serovar Typhi
uucgaugcgcucau

SEQ ID NO: 1672289 - RNA, 19 nt, Salmonella enterica enterica serovar Typhi
uucgaugcggccauggaga

SEQ ID NO: 1672290 - RNA, 23 nt, Salmonella enterica enterica serovar Typhi
uucgacgggacgaauuuccagcg

SEQ ID NO: 1672291 - RNA, 20 nt, Salmonella enterica enterica serovar Typhi
uucgaguguaucuccugaaa

SEQ ID NO: 1672292 - RNA, 12 nt, Salmonella enterica enterica serovar Typhi
uucgacaucuuc

SEQ ID NO: 1672293 - RNA, 22 nt, Salmonella enterica enterica serovar Typhi
uucgacaagaagauuucuuaau

SEQ ID NO: 1672294 - RNA, 20 nt, Salmonella enterica enterica serovar Typhi
uucgacaaacagcuauccau

SEQ ID NO: 1672295 - RNA, 17 nt, Salmonella enterica enterica serovar Typhi
uucgaauuacauaacca

SEQ ID NO: 1672296 - RNA, 18 nt, Salmonella enterica enterica serovar Typhi
uucgaaacaggaaaaaca

SEQ ID NO: 1672297 - RNA, 20 nt, Salmonella enterica enterica serovar Typhi
uuccuuguccgaugcagaca

SEQ ID NO: 1672298 - RNA, 19 nt, Salmonella enterica enterica serovar Typhi
uuccuuguuuuaacggaau

SEQ ID NO: 1672299 - RNA, 14 nt, Salmonella enterica enterica serovar Typhi
uuccuggcuugcca

SEQ ID NO: 1672300 - RNA, 14 nt, Salmonella enterica enterica serovar Typhi
uuccuggugcgaca

SEQ ID NO: 1672301 - RNA, 23 nt, Salmonella enterica enterica serovar Typhi
uuccuguauaauuauuuguuuac

SEQ ID NO: 1672302 - RNA, 12 nt, Salmonella enterica enterica serovar Typhi
uuccuuaucagc

SEQ ID NO: 1672303 - RNA, 17 nt, Salmonella enterica enterica serovar Typhi
uuccugaucaaucaacu

SEQ ID NO: 1672304 - RNA, 16 nt, Salmonella enterica enterica serovar Typhi
uuccugauccgccuua

SEQ ID NO: 1672305 - RNA, 16 nt, Salmonella enterica enterica serovar Typhi
uuccugauuaauauga

SEQ ID NO: 1672306 - RNA, 22 nt, Salmonella enterica enterica serovar Typhi
uuccugagcagacauauuuuca

SEQ ID NO: 1672307 - RNA, 18 nt, Salmonella enterica enterica serovar Typhi
uuccugccaggccggacu

SEQ ID NO: 1672308 - RNA, 21 nt, Salmonella enterica enterica serovar Typhi
uuccugcgcugucaccagcag

SEQ ID NO: 1672309 - RNA, 14 nt, Salmonella enterica enterica serovar Typhi
uuccgucaugguga

SEQ ID NO: 1672310 - RNA, 18 nt, Salmonella enterica enterica serovar Typhi
uuccgucauggugaugau

SEQ ID NO: 1672311 - RNA, 13 nt, Salmonella enterica enterica serovar Typhi
uuccguuagcucu

SEQ ID NO: 1672312 - RNA, 15 nt, Salmonella enterica enterica serovar Typhi
uuccuaacccuucau

SEQ ID NO: 1672313 - RNA, 21 nt, Salmonella enterica enterica serovar Typhi
uuccgggauguuaauuucauc

SEQ ID NO: 1672314 - RNA, 12 nt, Salmonella enterica enterica serovar Typhi
uuccggcagacg

SEQ ID NO: 1672315 - RNA, 22 nt, Salmonella enterica enterica serovar Typhi
uuccggcuucguuaagcgguuu

SEQ ID NO: 1672316 - RNA, 17 nt, Salmonella enterica enterica serovar Typhi
uuccucgucgcgcgccg

SEQ ID NO: 1672317 - RNA, 20 nt, Salmonella enterica enterica serovar Typhi
uuccucuaaaugggcaggag

SEQ ID NO: 1672318 - RNA, 14 nt, Salmonella enterica enterica serovar Typhi
uuccugaaaaaauu

SEQ ID NO: 1672319 - RNA, 21 nt, Salmonella enterica enterica serovar Typhi
uuccugacuguaauuucgcug

SEQ ID NO: 1672320 - RNA, 15 nt, Salmonella enterica enterica serovar Typhi
uugcgcccagauaau

SEQ ID NO: 1672321 - RNA, 15 nt, Salmonella enterica enterica serovar Typhi
uugcgcccaggccaa

SEQ ID NO: 1672322 - RNA, 16 nt, Salmonella enterica enterica serovar Typhi
uugcgccagcccggcg

SEQ ID NO: 1672323 - RNA, 18 nt, Salmonella enterica enterica serovar Typhi
uugcgccacggauggccu

SEQ ID NO: 1672324 - RNA, 17 nt, Salmonella enterica enterica serovar Typhi
uugccuucgccgcccaa

SEQ ID NO: 1672325 - RNA, 20 nt, Salmonella enterica enterica serovar Typhi
uugcgauuuguccgcugcug

SEQ ID NO: 1672326 - RNA, 20 nt, Salmonella enterica enterica serovar Typhi
uugcuccccaaccgccagcc

SEQ ID NO: 1672327 - RNA, 20 nt, Salmonella enterica enterica serovar Typhi
uugcgggccucguuaaaauc

SEQ ID NO: 1672328 - RNA, 19 nt, Salmonella enterica enterica serovar Typhi
uugcuaccccggaaauaac

SEQ ID NO: 1672329 - RNA, 17 nt, Salmonella enterica enterica serovar Typhi
uugcuauagcccacgca

SEQ ID NO: 1672330 - RNA, 18 nt, Salmonella enterica enterica serovar Typhi
uugccguuaacugcugcu

SEQ ID NO: 1672331 - RNA, 15 nt, Salmonella enterica enterica serovar Typhi
uugccgugaaaacga

SEQ ID NO: 1672332 - RNA, 18 nt, Salmonella enterica enterica serovar Typhi
uugccgugaauauucaga

SEQ ID NO: 1672333 - RNA, 21 nt, Salmonella enterica enterica serovar Typhi
uugccgguuuuuuuuugccug

SEQ ID NO: 1672334 - RNA, 16 nt, Salmonella enterica enterica serovar Typhi
uugccgggcugaccgc

SEQ ID NO: 1672335 - RNA, 17 nt, Salmonella enterica enterica serovar Typhi
uugccgguuaacucuuu

SEQ ID NO: 1672336 - RNA, 20 nt, Salmonella enterica enterica serovar Typhi
uugccauucgccagcccgau

SEQ ID NO: 1672337 - RNA, 22 nt, Salmonella enterica enterica serovar Typhi
uugccauaaauacaauucaacu

SEQ ID NO: 1672338 - RNA, 19 nt, Salmonella enterica enterica serovar Typhi
uugccaugaugagcgccau

SEQ ID NO: 1672339 - RNA, 23 nt, Salmonella enterica enterica serovar Typhi
uugcaguuuuaccguaaaaugcu

SEQ ID NO: 1672340 - RNA, 14 nt, Salmonella enterica enterica serovar Typhi
uugcauaagagguc

SEQ ID NO: 1672341 - RNA, 20 nt, Salmonella enterica enterica serovar Typhi
uugcagggugcagcaaauaa

SEQ ID NO: 1672342 - RNA, 20 nt, Salmonella enterica enterica serovar Typhi
uugcagguuacucacugccg

SEQ ID NO: 1672343 - RNA, 19 nt, Salmonella enterica enterica serovar Typhi
uugccagagccccaaugcu

SEQ ID NO: 1672344 - RNA, 13 nt, Salmonella enterica enterica serovar Typhi
uuggcaccaccag

SEQ ID NO: 1672345 - RNA, 12 nt, Salmonella enterica enterica serovar Typhi
uuggcaauuaaa

SEQ ID NO: 1672346 - RNA, 23 nt, Salmonella enterica enterica serovar Typhi
uuggcaaacugucgguaaagaaa

SEQ ID NO: 1672347 - RNA, 16 nt, Salmonella enterica enterica serovar Typhi
uuggcaaaccccugcu

SEQ ID NO: 1672348 - RNA, 15 nt, Salmonella enterica enterica serovar Typhi
uuggcaaaaaaggcc

SEQ ID NO: 1672349 - RNA, 23 nt, Salmonella enterica enterica serovar Typhi
uugcuucgcucucgugccaguaa

SEQ ID NO: 1672350 - RNA, 22 nt, Salmonella enterica enterica serovar Typhi
uugcuugugacggcaaaguucc

SEQ ID NO: 1672351 - RNA, 21 nt, Salmonella enterica enterica serovar Typhi
uuggaaacuaugcaaaacgua

SEQ ID NO: 1672352 - RNA, 18 nt, Salmonella enterica enterica serovar Typhi
uugcuggcaagaaccgcu

SEQ ID NO: 1672353 - RNA, 17 nt, Salmonella enterica enterica serovar Typhi
uugcugguagacaaaca

SEQ ID NO: 1672354 - RNA, 20 nt, Salmonella enterica enterica serovar Typhi
uuggccggcuucuccaccau

SEQ ID NO: 1672355 - RNA, 12 nt, Salmonella enterica enterica serovar Typhi
uuggugaguggc

SEQ ID NO: 1672356 - RNA, 20 nt, Salmonella enterica enterica serovar Typhi
uuggugauuaacagcgccau

SEQ ID NO: 1672357 - RNA, 20 nt, Salmonella enterica enterica serovar Typhi
uugguuucgccuaagcccac

SEQ ID NO: 1672358 - RNA, 11 nt, Salmonella enterica enterica serovar Typhi
uugguuuugcc

SEQ ID NO: 1672359 - RNA, 19 nt, Salmonella enterica enterica serovar Typhi
uuggucaggcuaaauggca

SEQ ID NO: 1672360 - RNA, 23 nt, Salmonella enterica enterica serovar Typhi
uuggucagguaagcuauuacaaa

SEQ ID NO: 1672361 - RNA, 16 nt, Salmonella enterica enterica serovar Typhi
uuuaaaauuccaauau

SEQ ID NO: 1672362 - RNA, 22 nt, Salmonella enterica enterica serovar Typhi
uuuaaaauuccaauauuuauuu

SEQ ID NO: 1672363 - RNA, 12 nt, Salmonella enterica enterica serovar Typhi
uuuaaaaugacc

SEQ ID NO: 1672364 - RNA, 16 nt, Salmonella enterica enterica serovar Typhi
uuuaaauuguuauacc

SEQ ID NO: 1672365 - RNA, 20 nt, Salmonella enterica enterica serovar Typhi
uuuaagcuuaaugauaauug

SEQ ID NO: 1672366 - RNA, 15 nt, Salmonella enterica enterica serovar Typhi
uuuaaggacauucag

SEQ ID NO: 1672367 - RNA, 18 nt, Salmonella enterica enterica serovar Typhi
uuuaagcgcaggugcgau

SEQ ID NO: 1672368 - RNA, 16 nt, Salmonella enterica enterica serovar Typhi
uuuaagccgauugaau

SEQ ID NO: 1672369 - RNA, 16 nt, Salmonella enterica enterica serovar Typhi
uuuaauccaccacagu

SEQ ID NO: 1672370 - RNA, 18 nt, Salmonella enterica enterica serovar Typhi
uuuacccacuucuuccag

SEQ ID NO: 1672371 - RNA, 20 nt, Salmonella enterica enterica serovar Typhi
uuuacccacuucuuccagcg

SEQ ID NO: 1672372 - RNA, 17 nt, Salmonella enterica enterica serovar Typhi
uuuacaauuucgcaaac

SEQ ID NO: 1672373 - RNA, 14 nt, Salmonella enterica enterica serovar Typhi
uuuacaauaauucg

SEQ ID NO: 1672374 - RNA, 22 nt, Salmonella enterica enterica serovar Typhi
uuuacaaaauuggguaguaaua

SEQ ID NO: 1672375 - RNA, 14 nt, Salmonella enterica enterica serovar Typhi
uuuaauuuuuaugu

SEQ ID NO: 1672376 - RNA, 18 nt, Salmonella enterica enterica serovar Typhi
uuuaauguugccguggca

SEQ ID NO: 1672377 - RNA, 15 nt, Salmonella enterica enterica serovar Typhi
uuguaggcaggaauu

SEQ ID NO: 1672378 - RNA, 18 nt, Salmonella enterica enterica serovar Typhi
uuguagcugcgccugaaa

SEQ ID NO: 1672379 - RNA, 18 nt, Salmonella enterica enterica serovar Typhi
uuguaggccugauagcac

SEQ ID NO: 1672380 - RNA, 18 nt, Salmonella enterica enterica serovar Typhi
uuguagcggcaacagcac

SEQ ID NO: 1672381 - RNA, 22 nt, Salmonella enterica enterica serovar Typhi
uuguccucaucauucgguuagg

SEQ ID NO: 1672382 - RNA, 22 nt, Salmonella enterica enterica serovar Typhi
uuguccggcguuuuagcgccau

SEQ ID NO: 1672383 - RNA, 18 nt, Salmonella enterica enterica serovar Typhi
uuguccuuuaucugcccu

SEQ ID NO: 1672384 - RNA, 15 nt, Salmonella enterica enterica serovar Typhi
uugucgcccugcaau

SEQ ID NO: 1672385 - RNA, 14 nt, Salmonella enterica enterica serovar Typhi
uugucgccaauaau

SEQ ID NO: 1672386 - RNA, 15 nt, Salmonella enterica enterica serovar Typhi
uugucgccaauaauu

SEQ ID NO: 1672387 - RNA, 23 nt, Salmonella enterica enterica serovar Typhi
uugugauacgcgucaaauagaga

SEQ ID NO: 1672388 - RNA, 22 nt, Salmonella enterica enterica serovar Typhi
uugugaguaauaaucacauuau

SEQ ID NO: 1672389 - RNA, 22 nt, Salmonella enterica enterica serovar Typhi
uugugagcuauacgguaaauca

SEQ ID NO: 1672390 - RNA, 23 nt, Salmonella enterica enterica serovar Typhi
uuguugccgcccguuuuuuccag

SEQ ID NO: 1672391 - RNA, 17 nt, Salmonella enterica enterica serovar Typhi
uuguuuauccugcaaau

SEQ ID NO: 1672392 - RNA, 19 nt, Salmonella enterica enterica serovar Typhi
uuguuucggauaauucuga

SEQ ID NO: 1672393 - RNA, 15 nt, Salmonella enterica enterica serovar Typhi
uuguuucuuaacccc

SEQ ID NO: 1672394 - RNA, 17 nt, Salmonella enterica enterica serovar Typhi
uuguuuauuaugcguuu

SEQ ID NO: 1672395 - RNA, 17 nt, Salmonella enterica enterica serovar Typhi
uuguuuauuccauucau

SEQ ID NO: 1672396 - RNA, 23 nt, Salmonella enterica enterica serovar Typhi
uuguucaauagagcgcagcaaaa

SEQ ID NO: 1672397 - RNA, 19 nt, Salmonella enterica enterica serovar Typhi
uuguucuuucaccauuaag

SEQ ID NO: 1672398 - RNA, 23 nt, Salmonella enterica enterica serovar Typhi
uugaacggcggcucguuguuuaa

SEQ ID NO: 1672399 - RNA, 11 nt, Salmonella enterica enterica serovar Typhi
uugaagacagc

SEQ ID NO: 1672400 - RNA, 14 nt, Salmonella enterica enterica serovar Typhi
uugaauuauaauaa

SEQ ID NO: 1672401 - RNA, 13 nt, Salmonella enterica enterica serovar Typhi
uugacgcuuugca

SEQ ID NO: 1672402 - RNA, 22 nt, Salmonella enterica enterica serovar Typhi
uugacgcaaacugccaggcaau

SEQ ID NO: 1672403 - RNA, 14 nt, Salmonella enterica enterica serovar Typhi
uugacggccaccau

SEQ ID NO: 1672404 - RNA, 15 nt, Salmonella enterica enterica serovar Typhi
uugacgcuuugcauu

SEQ ID NO: 1672405 - RNA, 16 nt, Salmonella enterica enterica serovar Typhi
uugaccucaucaccua

SEQ ID NO: 1672406 - RNA, 20 nt, Salmonella enterica enterica serovar Typhi
uugaaaaaaacaucgcugau

SEQ ID NO: 1672407 - RNA, 23 nt, Salmonella enterica enterica serovar Typhi
uucuuugacccacgccagcagcu

SEQ ID NO: 1672408 - RNA, 13 nt, Salmonella enterica enterica serovar Typhi
uucuuugguauug

SEQ ID NO: 1672409 - RNA, 19 nt, Salmonella enterica enterica serovar Typhi
uucuugcccgcugaguggu

SEQ ID NO: 1672410 - RNA, 17 nt, Salmonella enterica enterica serovar Typhi
uugaucggguuuuccug

SEQ ID NO: 1672411 - RNA, 13 nt, Salmonella enterica enterica serovar Typhi
uugaucguccauc

SEQ ID NO: 1672412 - RNA, 14 nt, Salmonella enterica enterica serovar Typhi
uugaucgcgcagca

SEQ ID NO: 1672413 - RNA, 12 nt, Salmonella enterica enterica serovar Typhi
uugauaaagcgc

SEQ ID NO: 1672414 - RNA, 18 nt, Salmonella enterica enterica serovar Typhi
uugaguuugcaauccaga

SEQ ID NO: 1672415 - RNA, 15 nt, Salmonella enterica enterica serovar Typhi
uugaguuugcaaucc

SEQ ID NO: 1672416 - RNA, 17 nt, Salmonella enterica enterica serovar Typhi
uugaguuccgcuucgua

SEQ ID NO: 1672417 - RNA, 16 nt, Salmonella enterica enterica serovar Typhi
uugagucgcauccagu

SEQ ID NO: 1672418 - RNA, 18 nt, Salmonella enterica enterica serovar Typhi
uugaugaugccaggacca

SEQ ID NO: 1672419 - RNA, 11 nt, Salmonella enterica enterica serovar Typhi
uugaugcccaa

SEQ ID NO: 1672420 - RNA, 20 nt, Salmonella enterica enterica serovar Typhi
uugcagccacguugcgcgcg

SEQ ID NO: 1672421 - RNA, 14 nt, Salmonella enterica enterica serovar Typhi
uugcagccagaacu

SEQ ID NO: 1672422 - RNA, 15 nt, Salmonella enterica enterica serovar Typhi
uugcagcgguaaaca

SEQ ID NO: 1672423 - RNA, 18 nt, Salmonella enterica enterica serovar Typhi
uugcagcgguaaacacca

SEQ ID NO: 1672424 - RNA, 12 nt, Salmonella enterica enterica serovar Typhi
uugcagcgccau

SEQ ID NO: 1672425 - RNA, 20 nt, Salmonella enterica enterica serovar Typhi
uugcagcgguaaacaccacc

SEQ ID NO: 1672426 - RNA, 11 nt, Salmonella enterica enterica serovar Typhi
uugcaaggcga

SEQ ID NO: 1672427 - RNA, 19 nt, Salmonella enterica enterica serovar Typhi
uugauuuuucugguaaacc

SEQ ID NO: 1672428 - RNA, 20 nt, Salmonella enterica enterica serovar Typhi
uucuggcgcagauacgcguc

SEQ ID NO: 1672429 - RNA, 22 nt, Salmonella enterica enterica serovar Typhi
uucuggacgggcuaucaauaug

SEQ ID NO: 1672430 - RNA, 16 nt, Salmonella enterica enterica serovar Typhi
uucuggauagcgguuu

SEQ ID NO: 1672431 - RNA, 14 nt, Salmonella enterica enterica serovar Typhi
uucuggcaauaagg

SEQ ID NO: 1672432 - RNA, 16 nt, Salmonella enterica enterica serovar Typhi
uucuggccauuucauc

SEQ ID NO: 1672433 - RNA, 15 nt, Salmonella enterica enterica serovar Typhi
uucuggcgcagauac

SEQ ID NO: 1672434 - RNA, 14 nt, Salmonella enterica enterica serovar Typhi
uucuggaagugacu

SEQ ID NO: 1672435 - RNA, 21 nt, Salmonella enterica enterica serovar Typhi
uucugaccacauuuucucgug

SEQ ID NO: 1672436 - RNA, 18 nt, Salmonella enterica enterica serovar Typhi
uucugaccaguugcaggc

SEQ ID NO: 1672437 - RNA, 18 nt, Salmonella enterica enterica serovar Typhi
uucugaucgauaaaaguu

SEQ ID NO: 1672438 - RNA, 23 nt, Salmonella enterica enterica serovar Typhi
uucucgccgccauuuuauccagg

SEQ ID NO: 1672439 - RNA, 17 nt, Salmonella enterica enterica serovar Typhi
uucucgcguccccagcc

SEQ ID NO: 1672440 - RNA, 16 nt, Salmonella enterica enterica serovar Typhi
uucucgcuaauuggcu

SEQ ID NO: 1672441 - RNA, 17 nt, Salmonella enterica enterica serovar Typhi
uucucggcuuuccagcu

SEQ ID NO: 1672442 - RNA, 18 nt, Salmonella enterica enterica serovar Typhi
uucugaauuucacgcuuc

SEQ ID NO: 1672443 - RNA, 15 nt, Salmonella enterica enterica serovar Typhi
uucugaauuucacgc

SEQ ID NO: 1672444 - RNA, 19 nt, Salmonella enterica enterica serovar Typhi
uucugaagcguaacagcgc

SEQ ID NO: 1672445 - RNA, 21 nt, Salmonella enterica enterica serovar Typhi
uucugaagcguaacagcgcua

SEQ ID NO: 1672446 - RNA, 18 nt, Salmonella enterica enterica serovar Typhi
uucugaauaaauugaauu

SEQ ID NO: 1672447 - RNA, 13 nt, Salmonella enterica enterica serovar Typhi
uucugaacgcugc

SEQ ID NO: 1672448 - RNA, 12 nt, Salmonella enterica enterica serovar Typhi
uucuuccucucg

SEQ ID NO: 1672449 - RNA, 18 nt, Salmonella enterica enterica serovar Typhi
uucuuccagguuaaccca

SEQ ID NO: 1672450 - RNA, 20 nt, Salmonella enterica enterica serovar Typhi
uucuucaagcguuuccagag

SEQ ID NO: 1672451 - RNA, 12 nt, Salmonella enterica enterica serovar Typhi
uucuucaaugaa

SEQ ID NO: 1672452 - RNA, 17 nt, Salmonella enterica enterica serovar Typhi
uucuucaagccaggcuu

SEQ ID NO: 1672453 - RNA, 14 nt, Salmonella enterica enterica serovar Typhi
uucuuaauuccuca

SEQ ID NO: 1672454 - RNA, 21 nt, Salmonella enterica enterica serovar Typhi
uucuccugcggccuugccgcc

SEQ ID NO: 1672455 - RNA, 13 nt, Salmonella enterica enterica serovar Typhi
uucuacugguuaa

SEQ ID NO: 1672456 - RNA, 23 nt, Salmonella enterica enterica serovar Typhi
uucuacuucaauuuuccagauag

SEQ ID NO: 1672457 - RNA, 17 nt, Salmonella enterica enterica serovar Typhi
uucgguguaauuucucg

SEQ ID NO: 1672458 - RNA, 22 nt, Salmonella enterica enterica serovar Typhi
uucggcaaaacgccgcagaaaa

SEQ ID NO: 1672459 - RNA, 16 nt, Salmonella enterica enterica serovar Typhi
uucggcaauggccaga

SEQ ID NO: 1672460 - RNA, 11 nt, Salmonella enterica enterica serovar Typhi
uucggcagacu

SEQ ID NO: 1672461 - RNA, 18 nt, Salmonella enterica enterica serovar Typhi
uucggcagaaaaaguaga

SEQ ID NO: 1672462 - RNA, 21 nt, Salmonella enterica enterica serovar Typhi
uucggagcgcuuuuuuuaugc

SEQ ID NO: 1672463 - RNA, 15 nt, Salmonella enterica enterica serovar Typhi
uucgucuucaucuuc

SEQ ID NO: 1672464 - RNA, 17 nt, Salmonella enterica enterica serovar Typhi
uucguggcgcuguucuu

SEQ ID NO: 1672465 - RNA, 14 nt, Salmonella enterica enterica serovar Typhi
uucguucucugaau

SEQ ID NO: 1672466 - RNA, 15 nt, Salmonella enterica enterica serovar Typhi
uucguucagggugaa

SEQ ID NO: 1672467 - RNA, 18 nt, Salmonella enterica enterica serovar Typhi
uucguuccgcgauuuccu

SEQ ID NO: 1672468 - RNA, 14 nt, Salmonella enterica enterica serovar Typhi
gaguccagcggcag

SEQ ID NO: 1672469 - RNA, 16 nt, Salmonella enterica enterica serovar Typhi
gagucgcagcggcggu

SEQ ID NO: 1672470 - RNA, 19 nt, Salmonella enterica enterica serovar Typhi
gagucggaucaugaaaaau

SEQ ID NO: 1672471 - RNA, 19 nt, Salmonella enterica enterica serovar Typhi
gagucuacaucaagagaaa

SEQ ID NO: 1672472 - RNA, 15 nt, Salmonella enterica enterica serovar Typhi
gagugcguucuucca

SEQ ID NO: 1672473 - RNA, 19 nt, Salmonella enterica enterica serovar Typhi
gagugcguucuuccacuuc

SEQ ID NO: 1672474 - RNA, 13 nt, Salmonella enterica enterica serovar Typhi
gaguggaaucagc

SEQ ID NO: 1672475 - RNA, 21 nt, Salmonella enterica enterica serovar Typhi
gagugcgcggcgaaaaagccg

SEQ ID NO: 1672476 - RNA, 19 nt, Salmonella enterica enterica serovar Typhi
gagucugaaaacucacgcc

SEQ ID NO: 1672477 - RNA, 18 nt, Salmonella enterica enterica serovar Typhi
gaguaugaacaggcagcg

SEQ ID NO: 1672478 - RNA, 22 nt, Salmonella enterica enterica serovar Typhi
gaguauuuaccuacuguggugu

SEQ ID NO: 1672479 - RNA, 18 nt, Salmonella enterica enterica serovar Typhi
gagucagaaacggccugg

SEQ ID NO: 1672480 - RNA, 18 nt, Salmonella enterica enterica serovar Typhi
gagucagacaccagcccu

SEQ ID NO: 1672481 - RNA, 17 nt, Salmonella enterica enterica serovar Typhi
gagucaaggcauccagc

SEQ ID NO: 1672482 - RNA, 18 nt, Salmonella enterica enterica serovar Typhi
gagucaaggcauccagca

SEQ ID NO: 1672483 - RNA, 20 nt, Salmonella enterica enterica serovar Typhi
gaauuucugcugccagcgcc

SEQ ID NO: 1672484 - RNA, 18 nt, Salmonella enterica enterica serovar Typhi
gaauuugaacucuuucag

SEQ ID NO: 1672485 - RNA, 14 nt, Salmonella enterica enterica serovar Typhi
gaauuugccccaga

SEQ ID NO: 1672486 - RNA, 20 nt, Salmonella enterica enterica serovar Typhi
gaguauagcggcguuuauau

SEQ ID NO: 1672487 - RNA, 17 nt, Salmonella enterica enterica serovar Typhi
gaguuaaugccaucauc

SEQ ID NO: 1672488 - RNA, 18 nt, Salmonella enterica enterica serovar Typhi
gaguuaaugccaucauca

SEQ ID NO: 1672489 - RNA, 22 nt, Salmonella enterica enterica serovar Typhi
gauaaaaacccaccagcgccag

SEQ ID NO: 1672490 - RNA, 14 nt, Salmonella enterica enterica serovar Typhi
gauaaaaaaaguau

SEQ ID NO: 1672491 - RNA, 16 nt, Salmonella enterica enterica serovar Typhi
gauaaaaagacagaua

SEQ ID NO: 1672492 - RNA, 16 nt, Salmonella enterica enterica serovar Typhi
gauaaaaagcaaagag

SEQ ID NO: 1672493 - RNA, 15 nt, Salmonella enterica enterica serovar Typhi
gauaaaauaaacacu

SEQ ID NO: 1672494 - RNA, 17 nt, Salmonella enterica enterica serovar Typhi
gauaaagcgaauaacau

SEQ ID NO: 1672495 - RNA, 17 nt, Salmonella enterica enterica serovar Typhi
gauaaagcuuucaucuu

SEQ ID NO: 1672496 - RNA, 19 nt, Salmonella enterica enterica serovar Typhi
gauaaagcugaguaaggac

SEQ ID NO: 1672497 - RNA, 16 nt, Salmonella enterica enterica serovar Typhi
gauaaaggauaauagu

SEQ ID NO: 1672498 - RNA, 15 nt, Salmonella enterica enterica serovar Typhi
gauacggcugucagg

SEQ ID NO: 1672499 - RNA, 22 nt, Salmonella enterica enterica serovar Typhi
gauacgggaucgauaauugcuc

SEQ ID NO: 1672500 - RNA, 16 nt, Salmonella enterica enterica serovar Typhi
gauacgcuggcacagg

SEQ ID NO: 1672501 - RNA, 15 nt, Salmonella enterica enterica serovar Typhi
gauacgccagcagac

SEQ ID NO: 1672502 - RNA, 14 nt, Salmonella enterica enterica serovar Typhi
gauacgccagcaga

SEQ ID NO: 1672503 - RNA, 14 nt, Salmonella enterica enterica serovar Typhi
gauacuguuuuugc

SEQ ID NO: 1672504 - RNA, 22 nt, Salmonella enterica enterica serovar Typhi
gauagagguuaccgggcuaaac

SEQ ID NO: 1672505 - RNA, 23 nt, Salmonella enterica enterica serovar Typhi
gauagauuugauucguuuaagua

SEQ ID NO: 1672506 - RNA, 12 nt, Salmonella enterica enterica serovar Typhi
gauagaugaaga

SEQ ID NO: 1672507 - RNA, 18 nt, Salmonella enterica enterica serovar Typhi
gauacacgccuuccucca

SEQ ID NO: 1672508 - RNA, 15 nt, Salmonella enterica enterica serovar Typhi
gauacagccaaauca

SEQ ID NO: 1672509 - RNA, 15 nt, Salmonella enterica enterica serovar Typhi
gauacaccuucacau

SEQ ID NO: 1672510 - RNA, 18 nt, Salmonella enterica enterica serovar Typhi
gauacaagguauccgcca

SEQ ID NO: 1672511 - RNA, 17 nt, Salmonella enterica enterica serovar Typhi
gauacaggacugacugc

SEQ ID NO: 1672512 - RNA, 21 nt, Salmonella enterica enterica serovar Typhi
gauacaggacugacugcuguc

SEQ ID NO: 1672513 - RNA, 21 nt, Salmonella enterica enterica serovar Typhi
gauaccccagcgaucccaguu

SEQ ID NO: 1672514 - RNA, 18 nt, Salmonella enterica enterica serovar Typhi
gauacauggcuauuccac

SEQ ID NO: 1672515 - RNA, 22 nt, Salmonella enterica enterica serovar Typhi
gauaccagccuucggacugcug

SEQ ID NO: 1672516 - RNA, 14 nt, Salmonella enterica enterica serovar Typhi
gauaccagauuaau

SEQ ID NO: 1672517 - RNA, 20 nt, Salmonella enterica enterica serovar Typhi
gauaaugaagcauaaaaaga

SEQ ID NO: 1672518 - RNA, 17 nt, Salmonella enterica enterica serovar Typhi
gauaauuuuucagacgu

SEQ ID NO: 1672519 - RNA, 15 nt, Salmonella enterica enterica serovar Typhi
gauaauucccccagu

SEQ ID NO: 1672520 - RNA, 23 nt, Salmonella enterica enterica serovar Typhi
gauaauucccccaguaguugacc

SEQ ID NO: 1672521 - RNA, 16 nt, Salmonella enterica enterica serovar Typhi
gauaaccuucuucguu

SEQ ID NO: 1672522 - RNA, 11 nt, Salmonella enterica enterica serovar Typhi
gauaacgugcg

SEQ ID NO: 1672523 - RNA, 18 nt, Salmonella enterica enterica serovar Typhi
gauaacggcgcaaagaca

SEQ ID NO: 1672524 - RNA, 14 nt, Salmonella enterica enterica serovar Typhi
gauaacgcgcuggc

SEQ ID NO: 1672525 - RNA, 12 nt, Salmonella enterica enterica serovar Typhi
gauaaauaagag

SEQ ID NO: 1672526 - RNA, 22 nt, Salmonella enterica enterica serovar Typhi
gauaaaguuagcguuauggaag

SEQ ID NO: 1672527 - RNA, 17 nt, Salmonella enterica enterica serovar Typhi
gauaaccuauuuugcaa

SEQ ID NO: 1672528 - RNA, 23 nt, Salmonella enterica enterica serovar Typhi
gauaaccuauuuugcaaaacuga

SEQ ID NO: 1672529 - RNA, 15 nt, Salmonella enterica enterica serovar Typhi
gauaacgaaaagggu

SEQ ID NO: 1672530 - RNA, 14 nt, Salmonella enterica enterica serovar Typhi
gauaacgaaccauc

SEQ ID NO: 1672531 - RNA, 13 nt, Salmonella enterica enterica serovar Typhi
gauaaccugcugu

SEQ ID NO: 1672532 - RNA, 11 nt, Salmonella enterica enterica serovar Typhi
gauaauaauga

SEQ ID NO: 1672533 - RNA, 16 nt, Salmonella enterica enterica serovar Typhi
gauaauaagacgccag

SEQ ID NO: 1672534 - RNA, 17 nt, Salmonella enterica enterica serovar Typhi
gauaauaguggugcgca

SEQ ID NO: 1672535 - RNA, 17 nt, Salmonella enterica enterica serovar Typhi
gauaauagccucauccc

SEQ ID NO: 1672536 - RNA, 22 nt, Salmonella enterica enterica serovar Typhi
gauaaucaauggccuugccagc

SEQ ID NO: 1672537 - RNA, 13 nt, Salmonella enterica enterica serovar Typhi
gauaaucaccagc

SEQ ID NO: 1672538 - RNA, 21 nt, Salmonella enterica enterica serovar Typhi
gauaaucacggcggaggccga

SEQ ID NO: 1672539 - RNA, 22 nt, Salmonella enterica enterica serovar Typhi
gauauuguguuuaccucauaua

SEQ ID NO: 1672540 - RNA, 15 nt, Salmonella enterica enterica serovar Typhi
gauauuuaaaacugg

SEQ ID NO: 1672541 - RNA, 22 nt, Salmonella enterica enterica serovar Typhi
gauauuuauuauuuccagguua

SEQ ID NO: 1672542 - RNA, 18 nt, Salmonella enterica enterica serovar Typhi
gaucagcgcgcuccagac

SEQ ID NO: 1672543 - RNA, 14 nt, Salmonella enterica enterica serovar Typhi
gaucaagcgggggc

SEQ ID NO: 1672544 - RNA, 19 nt, Salmonella enterica enterica serovar Typhi
gaucauuggggaaccuggc

SEQ ID NO: 1672545 - RNA, 19 nt, Salmonella enterica enterica serovar Typhi
gaucauuaccugucgccca

SEQ ID NO: 1672546 - RNA, 17 nt, Salmonella enterica enterica serovar Typhi
gaucaggaaaucuucca

SEQ ID NO: 1672547 - RNA, 16 nt, Salmonella enterica enterica serovar Typhi
gaucaggcgucagcgg

SEQ ID NO: 1672548 - RNA, 13 nt, Salmonella enterica enterica serovar Typhi
gaucaggcuaaag

SEQ ID NO: 1672549 - RNA, 22 nt, Salmonella enterica enterica serovar Typhi
gauaucagggcuuuuuucucgc

SEQ ID NO: 1672550 - RNA, 14 nt, Salmonella enterica enterica serovar Typhi
gauagcaucuuccu

SEQ ID NO: 1672551 - RNA, 16 nt, Salmonella enterica enterica serovar Typhi
gauagcaauuaauaaa

SEQ ID NO: 1672552 - RNA, 18 nt, Salmonella enterica enterica serovar Typhi
gauauccgcgcucaacac

SEQ ID NO: 1672553 - RNA, 21 nt, Salmonella enterica enterica serovar Typhi
gauauccagcaccucaucacc

SEQ ID NO: 1672554 - RNA, 13 nt, Salmonella enterica enterica serovar Typhi
gauaucugccgcg

SEQ ID NO: 1672555 - RNA, 23 nt, Salmonella enterica enterica serovar Typhi
gauaucuuuauucgcuuguuuca

SEQ ID NO: 1672556 - RNA, 14 nt, Salmonella enterica enterica serovar Typhi
gauaucgccccaga

SEQ ID NO: 1672557 - RNA, 14 nt, Salmonella enterica enterica serovar Typhi
gauauggcggcggc

SEQ ID NO: 1672558 - RNA, 23 nt, Salmonella enterica enterica serovar Typhi
gauauggccguuuucaugcacga

SEQ ID NO: 1672559 - RNA, 13 nt, Salmonella enterica enterica serovar Typhi
gauauggcaaacg

SEQ ID NO: 1672560 - RNA, 20 nt, Salmonella enterica enterica serovar Typhi
gauaugcgggggcaguaaau

SEQ ID NO: 1672561 - RNA, 21 nt, Salmonella enterica enterica serovar Typhi
gauaugcggucguauuaccaa

SEQ ID NO: 1672562 - RNA, 19 nt, Salmonella enterica enterica serovar Typhi
gauaugcgacgaaagcggc

SEQ ID NO: 1672563 - RNA, 18 nt, Salmonella enterica enterica serovar Typhi
gauaugaccaguacaggc

SEQ ID NO: 1672564 - RNA, 23 nt, Salmonella enterica enterica serovar Typhi
gauaugaugcgccccgcuucccg

SEQ ID NO: 1672565 - RNA, 13 nt, Salmonella enterica enterica serovar Typhi
gauaugcagcagc

SEQ ID NO: 1672566 - RNA, 14 nt, Salmonella enterica enterica serovar Typhi
gauaugcagcagcc

SEQ ID NO: 1672567 - RNA, 17 nt, Salmonella enterica enterica serovar Typhi
gauauuacuuuccagca

SEQ ID NO: 1672568 - RNA, 16 nt, Salmonella enterica enterica serovar Typhi
gauauuacuaauaaaa

SEQ ID NO: 1672569 - RNA, 13 nt, Salmonella enterica enterica serovar Typhi
gauauuacagauc

SEQ ID NO: 1672570 - RNA, 20 nt, Salmonella enterica enterica serovar Typhi
gauauuguguuuaccucaua

SEQ ID NO: 1672571 - RNA, 14 nt, Salmonella enterica enterica serovar Typhi
gaucgcgcagcagg

SEQ ID NO: 1672572 - RNA, 21 nt, Salmonella enterica enterica serovar Typhi
gaucgcgcucccggccaauca

SEQ ID NO: 1672573 - RNA, 20 nt, Salmonella enterica enterica serovar Typhi
gaucgcaagauccugauauu

SEQ ID NO: 1672574 - RNA, 21 nt, Salmonella enterica enterica serovar Typhi
gaucgccagcguuagcacauu

SEQ ID NO: 1672575 - RNA, 20 nt, Salmonella enterica enterica serovar Typhi
gaucgacuaauuuuaggaag

SEQ ID NO: 1672576 - RNA, 16 nt, Salmonella enterica enterica serovar Typhi
gaucgaggucagcauu

SEQ ID NO: 1672577 - RNA, 20 nt, Salmonella enterica enterica serovar Typhi
gaucgauagcgacggcgcgc

SEQ ID NO: 1672578 - RNA, 18 nt, Salmonella enterica enterica serovar Typhi
gaucgauauaucgcguca

SEQ ID NO: 1672579 - RNA, 20 nt, Salmonella enterica enterica serovar Typhi
gaucggaaaucaaaccaucc

SEQ ID NO: 1672580 - RNA, 18 nt, Salmonella enterica enterica serovar Typhi
gaucggcaaacagcuuca

SEQ ID NO: 1672581 - RNA, 16 nt, Salmonella enterica enterica serovar Typhi
gaucgcguacagcgcc

SEQ ID NO: 1672582 - RNA, 13 nt, Salmonella enterica enterica serovar Typhi
gaucgcuccauuc

SEQ ID NO: 1672583 - RNA, 20 nt, Salmonella enterica enterica serovar Typhi
gaucggcgcagguccauuuu

SEQ ID NO: 1672584 - RNA, 17 nt, Salmonella enterica enterica serovar Typhi
gaucggcuuuaucuuua

SEQ ID NO: 1672585 - RNA, 16 nt, Salmonella enterica enterica serovar Typhi
gaucccggccuucgaa

SEQ ID NO: 1672586 - RNA, 19 nt, Salmonella enterica enterica serovar Typhi
gauccgacaugaugccaaa

SEQ ID NO: 1672587 - RNA, 12 nt, Salmonella enterica enterica serovar Typhi
gauccagaaccg

SEQ ID NO: 1672588 - RNA, 21 nt, Salmonella enterica enterica serovar Typhi
gauccagccccagcgccagcu

SEQ ID NO: 1672589 - RNA, 22 nt, Salmonella enterica enterica serovar Typhi
gauccaccaaguauuugaguuc

SEQ ID NO: 1672590 - RNA, 19 nt, Salmonella enterica enterica serovar Typhi
gauccuguucaaacaucag

SEQ ID NO: 1672591 - RNA, 20 nt, Salmonella enterica enterica serovar Typhi
gauccuguaaaaaauccagc

SEQ ID NO: 1672592 - RNA, 18 nt, Salmonella enterica enterica serovar Typhi
gaucgacaaaccacugcu

SEQ ID NO: 1672593 - RNA, 19 nt, Salmonella enterica enterica serovar Typhi
gaucgacaaaccacugcug

SEQ ID NO: 1672594 - RNA, 17 nt, Salmonella enterica enterica serovar Typhi
gaucgacaaugaucaga

SEQ ID NO: 1672595 - RNA, 13 nt, Salmonella enterica enterica serovar Typhi
gauccggcagcca

SEQ ID NO: 1672596 - RNA, 18 nt, Salmonella enterica enterica serovar Typhi
gauccggcuguuccagua

SEQ ID NO: 1672597 - RNA, 22 nt, Salmonella enterica enterica serovar Typhi
gaucgucgcgaucgcgccagcc

SEQ ID NO: 1672598 - RNA, 18 nt, Salmonella enterica enterica serovar Typhi
gaucguaaaaugaaaaac

SEQ ID NO: 1672599 - RNA, 16 nt, Salmonella enterica enterica serovar Typhi
gaucguagccauguuc

SEQ ID NO: 1672600 - RNA, 22 nt, Salmonella enterica enterica serovar Typhi
gaucguaaagcgcauccagcuc

SEQ ID NO: 1672601 - RNA, 14 nt, Salmonella enterica enterica serovar Typhi
gaucguaugcgccu

SEQ ID NO: 1672602 - RNA, 22 nt, Salmonella enterica enterica serovar Typhi
gaugacaucgcaaugccaccac

SEQ ID NO: 1672603 - RNA, 15 nt, Salmonella enterica enterica serovar Typhi
gaugaugaaaaagaa

SEQ ID NO: 1672604 - RNA, 15 nt, Salmonella enterica enterica serovar Typhi
gaugaucuucagccc

SEQ ID NO: 1672605 - RNA, 21 nt, Salmonella enterica enterica serovar Typhi
gaugagcgugacgaccggcac

SEQ ID NO: 1672606 - RNA, 19 nt, Salmonella enterica enterica serovar Typhi
gaugagauccgggcuggca

SEQ ID NO: 1672607 - RNA, 14 nt, Salmonella enterica enterica serovar Typhi
gaugagcaggccag

SEQ ID NO: 1672608 - RNA, 15 nt, Salmonella enterica enterica serovar Typhi
gaugagcaggccagg

SEQ ID NO: 1672609 - RNA, 20 nt, Salmonella enterica enterica serovar Typhi
gaugcaggccaagcagcgcc

SEQ ID NO: 1672610 - RNA, 16 nt, Salmonella enterica enterica serovar Typhi
gaugcaucagaacaaa

SEQ ID NO: 1672611 - RNA, 13 nt, Salmonella enterica enterica serovar Typhi
gaugcauuugauu

SEQ ID NO: 1672612 - RNA, 13 nt, Salmonella enterica enterica serovar Typhi
gaugcgccaguac

SEQ ID NO: 1672613 - RNA, 16 nt, Salmonella enterica enterica serovar Typhi
gaugcgccauccacca

SEQ ID NO: 1672614 - RNA, 14 nt, Salmonella enterica enterica serovar Typhi
gaugcgccauccca

SEQ ID NO: 1672615 - RNA, 15 nt, Salmonella enterica enterica serovar Typhi
gaugcgaaucuucau

SEQ ID NO: 1672616 - RNA, 15 nt, Salmonella enterica enterica serovar Typhi
gaugcgacucggugc

SEQ ID NO: 1672617 - RNA, 18 nt, Salmonella enterica enterica serovar Typhi
gaugccgccgacaaccag

SEQ ID NO: 1672618 - RNA, 18 nt, Salmonella enterica enterica serovar Typhi
gaugccgaucaccagcgc

SEQ ID NO: 1672619 - RNA, 22 nt, Salmonella enterica enterica serovar Typhi
gaugcguucuagcuuaucgcca

SEQ ID NO: 1672620 - RNA, 21 nt, Salmonella enterica enterica serovar Typhi
gaugcugucuuagugaaagac

SEQ ID NO: 1672621 - RNA, 22 nt, Salmonella enterica enterica serovar Typhi
gaugcuugccauauugccgcac

SEQ ID NO: 1672622 - RNA, 19 nt, Salmonella enterica enterica serovar Typhi
gauggacggauuggcgcuc

SEQ ID NO: 1672623 - RNA, 11 nt, Salmonella enterica enterica serovar Typhi
gauggcacugc

SEQ ID NO: 1672624 - RNA, 23 nt, Salmonella enterica enterica serovar Typhi
gauggcacugcgcuuauccggcc

SEQ ID NO: 1672625 - RNA, 13 nt, Salmonella enterica enterica serovar Typhi
gauggcgccagcc

SEQ ID NO: 1672626 - RNA, 21 nt, Salmonella enterica enterica serovar Typhi
gauggcgauucauaugcgcca

SEQ ID NO: 1672627 - RNA, 20 nt, Salmonella enterica enterica serovar Typhi
gauggcgcugcguuuccugu

SEQ ID NO: 1672628 - RNA, 17 nt, Salmonella enterica enterica serovar Typhi
gauggcgcugcgcuuau

SEQ ID NO: 1672629 - RNA, 18 nt, Salmonella enterica enterica serovar Typhi
gauggcgcuaagccagcc

SEQ ID NO: 1672630 - RNA, 14 nt, Salmonella enterica enterica serovar Typhi
gauggcgcuccuga

SEQ ID NO: 1672631 - RNA, 18 nt, Salmonella enterica enterica serovar Typhi
gauggcggcgucgccugu

SEQ ID NO: 1672632 - RNA, 16 nt, Salmonella enterica enterica serovar Typhi
gauggucaauaacagc

SEQ ID NO: 1672633 - RNA, 14 nt, Salmonella enterica enterica serovar Typhi
gaugggcuucagau

SEQ ID NO: 1672634 - RNA, 23 nt, Salmonella enterica enterica serovar Typhi
gaugggcagauagaaugcuucuu

SEQ ID NO: 1672635 - RNA, 14 nt, Salmonella enterica enterica serovar Typhi
gauguaaucugaca

SEQ ID NO: 1672636 - RNA, 15 nt, Salmonella enterica enterica serovar Typhi
gauguaaaaccuggc

SEQ ID NO: 1672637 - RNA, 17 nt, Salmonella enterica enterica serovar Typhi
gauguaaaaccuggcac

SEQ ID NO: 1672638 - RNA, 13 nt, Salmonella enterica enterica serovar Typhi
gaugguuaagcag

SEQ ID NO: 1672639 - RNA, 21 nt, Salmonella enterica enterica serovar Typhi
gaugguuucggcaugccacug

SEQ ID NO: 1672640 - RNA, 13 nt, Salmonella enterica enterica serovar Typhi
gaugguuucuucg

SEQ ID NO: 1672641 - RNA, 20 nt, Salmonella enterica enterica serovar Typhi
gauggugcggcgcacugccu

SEQ ID NO: 1672642 - RNA, 14 nt, Salmonella enterica enterica serovar Typhi
gaugucgccacgcc

SEQ ID NO: 1672643 - RNA, 20 nt, Salmonella enterica enterica serovar Typhi
gauguccgucuuuucugucg

SEQ ID NO: 1672644 - RNA, 15 nt, Salmonella enterica enterica serovar Typhi
gaugucauaaucgcc

SEQ ID NO: 1672645 - RNA, 17 nt, Salmonella enterica enterica serovar Typhi
gaugucagauccuucau

SEQ ID NO: 1672646 - RNA, 21 nt, Salmonella enterica enterica serovar Typhi
gauguccaccgauuucaucgc

SEQ ID NO: 1672647 - RNA, 13 nt, Salmonella enterica enterica serovar Typhi
gauuaaccagcag

SEQ ID NO: 1672648 - RNA, 20 nt, Salmonella enterica enterica serovar Typhi
gauguuuuuaucaugcugac

SEQ ID NO: 1672649 - RNA, 20 nt, Salmonella enterica enterica serovar Typhi
gauuaucaggaugaauauga

SEQ ID NO: 1672650 - RNA, 21 nt, Salmonella enterica enterica serovar Typhi
gauuaucaggaugaauaugaa

SEQ ID NO: 1672651 - RNA, 20 nt, Salmonella enterica enterica serovar Typhi
gauuacuucaggcugccaac

SEQ ID NO: 1672652 - RNA, 16 nt, Salmonella enterica enterica serovar Typhi
gauuaucggccagcgc

SEQ ID NO: 1672653 - RNA, 20 nt, Salmonella enterica enterica serovar Typhi
gauuaagcgaauccagcgcc

SEQ ID NO: 1672654 - RNA, 18 nt, Salmonella enterica enterica serovar Typhi
gauuaccgggauuuccau

SEQ ID NO: 1672655 - RNA, 19 nt, Salmonella enterica enterica serovar Typhi
gauuaauaaaauuuuugcc

SEQ ID NO: 1672656 - RNA, 17 nt, Salmonella enterica enterica serovar Typhi
gauuaauaaccaauaau

SEQ ID NO: 1672657 - RNA, 16 nt, Salmonella enterica enterica serovar Typhi
gauuaauacaucacuu

SEQ ID NO: 1672658 - RNA, 21 nt, Salmonella enterica enterica serovar Typhi
gauuacucucuugccagcgca

SEQ ID NO: 1672659 - RNA, 16 nt, Salmonella enterica enterica serovar Typhi
gauuacugcgugcugg

SEQ ID NO: 1672660 - RNA, 16 nt, Salmonella enterica enterica serovar Typhi
gauugagacaaauaac

SEQ ID NO: 1672661 - RNA, 20 nt, Salmonella enterica enterica serovar Typhi
gauucucuaacgucagcgcc

SEQ ID NO: 1672662 - RNA, 15 nt, Salmonella enterica enterica serovar Typhi
gauucugcaggccaa

SEQ ID NO: 1672663 - RNA, 18 nt, Salmonella enterica enterica serovar Typhi
gauucuggcgaguuucac

SEQ ID NO: 1672664 - RNA, 13 nt, Salmonella enterica enterica serovar Typhi
gauucuucugccu

SEQ ID NO: 1672665 - RNA, 20 nt, Salmonella enterica enterica serovar Typhi
gauuauuuuaucaucagcac

SEQ ID NO: 1672666 - RNA, 17 nt, Salmonella enterica enterica serovar Typhi
gauuauuucauuaaucu

SEQ ID NO: 1672667 - RNA, 20 nt, Salmonella enterica enterica serovar Typhi
gauugaggcggguaauuugc

SEQ ID NO: 1672668 - RNA, 16 nt, Salmonella enterica enterica serovar Typhi
gauugacgguuugucu

SEQ ID NO: 1672669 - RNA, 12 nt, Salmonella enterica enterica serovar Typhi
gauuggcaaaau

SEQ ID NO: 1672670 - RNA, 12 nt, Salmonella enterica enterica serovar Typhi
gauuuuaaauug

SEQ ID NO: 1672671 - RNA, 19 nt, Salmonella enterica enterica serovar Typhi
gauuuuagcgcaucgcucc

SEQ ID NO: 1672672 - RNA, 16 nt, Salmonella enterica enterica serovar Typhi
gauuuauucuuugucu

SEQ ID NO: 1672673 - RNA, 18 nt, Salmonella enterica enterica serovar Typhi
gauuuauuuugaauuuuu

SEQ ID NO: 1672674 - RNA, 14 nt, Salmonella enterica enterica serovar Typhi
gauuucuucuggcu

SEQ ID NO: 1672675 - RNA, 17 nt, Salmonella enterica enterica serovar Typhi
gauuuuaucaagucgcg

SEQ ID NO: 1672676 - RNA, 15 nt, Salmonella enterica enterica serovar Typhi
gauuuuucauugcaa

SEQ ID NO: 1672677 - RNA, 22 nt, Salmonella enterica enterica serovar Typhi
gauuuuucgcgucaaaacuuau

SEQ ID NO: 1672678 - RNA, 16 nt, Salmonella enterica enterica serovar Typhi
gauuuuuaaaauguuu

SEQ ID NO: 1672679 - RNA, 23 nt, Salmonella enterica enterica serovar Typhi
gauuuuuaccgccgguuuauccc

SEQ ID NO: 1672680 - RNA, 15 nt, Salmonella enterica enterica serovar Typhi
gcaaaaauaggcuuu

SEQ ID NO: 1672681 - RNA, 14 nt, Salmonella enterica enterica serovar Typhi
gcaaaaaaggccag

SEQ ID NO: 1672682 - RNA, 19 nt, Salmonella enterica enterica serovar Typhi
gcaaaaacaccuaacccac

SEQ ID NO: 1672683 - RNA, 21 nt, Salmonella enterica enterica serovar Typhi
gcaaaaucguuaaccagcggc

SEQ ID NO: 1672684 - RNA, 14 nt, Salmonella enterica enterica serovar Typhi
gcaaaaugcuucuu

SEQ ID NO: 1672685 - RNA, 23 nt, Salmonella enterica enterica serovar Typhi
gcaaaauaguucagcgcagagug

SEQ ID NO: 1672686 - RNA, 18 nt, Salmonella enterica enterica serovar Typhi
gcaaaagcgguaauaacu

SEQ ID NO: 1672687 - RNA, 18 nt, Salmonella enterica enterica serovar Typhi
gcaaaagggccauggcug

SEQ ID NO: 1672688 - RNA, 22 nt, Salmonella enterica enterica serovar Typhi
gcaaacagugggaagcacaucc

SEQ ID NO: 1672689 - RNA, 12 nt, Salmonella enterica enterica serovar Typhi
gcaaacaucccc

SEQ ID NO: 1672690 - RNA, 12 nt, Salmonella enterica enterica serovar Typhi
gcaaacccucau

SEQ ID NO: 1672691 - RNA, 14 nt, Salmonella enterica enterica serovar Typhi
gcaaacccucaucg

SEQ ID NO: 1672692 - RNA, 13 nt, Salmonella enterica enterica serovar Typhi
gcaaacagcacgc

SEQ ID NO: 1672693 - RNA, 13 nt, Salmonella enterica enterica serovar Typhi
gcaaaauuacuuc

SEQ ID NO: 1672694 - RNA, 22 nt, Salmonella enterica enterica serovar Typhi
gcaaacuuugcgccauuucaau

SEQ ID NO: 1672695 - RNA, 16 nt, Salmonella enterica enterica serovar Typhi
gcaaagauaaucugaa

SEQ ID NO: 1672696 - RNA, 22 nt, Salmonella enterica enterica serovar Typhi
gcaaacuguauccguaauauga

SEQ ID NO: 1672697 - RNA, 15 nt, Salmonella enterica enterica serovar Typhi
gcaaacugcgcgccc

SEQ ID NO: 1672698 - RNA, 19 nt, Salmonella enterica enterica serovar Typhi
gcaaacggaauagcgccuu

SEQ ID NO: 1672699 - RNA, 14 nt, Salmonella enterica enterica serovar Typhi
gcaaacgccauagc

SEQ ID NO: 1672700 - RNA, 18 nt, Salmonella enterica enterica serovar Typhi
gcaaacgauaaaagcucu

SEQ ID NO: 1672701 - RNA, 15 nt, Salmonella enterica enterica serovar Typhi
gcaaacgauaaaagc

SEQ ID NO: 1672702 - RNA, 18 nt, Salmonella enterica enterica serovar Typhi
gcaaaccggcaugaagac

SEQ ID NO: 1672703 - RNA, 13 nt, Salmonella enterica enterica serovar Typhi
gcaaaucaccaca

SEQ ID NO: 1672704 - RNA, 15 nt, Salmonella enterica enterica serovar Typhi
gcaaaucaacauuau

SEQ ID NO: 1672705 - RNA, 20 nt, Salmonella enterica enterica serovar Typhi
gcaaaucaacauuauuaaaa

SEQ ID NO: 1672706 - RNA, 19 nt, Salmonella enterica enterica serovar Typhi
gcaaauaccggacagacuu

SEQ ID NO: 1672707 - RNA, 19 nt, Salmonella enterica enterica serovar Typhi
gcaaauacugcuuuuccgg

SEQ ID NO: 1672708 - RNA, 17 nt, Salmonella enterica enterica serovar Typhi
gcaaauacuggaaaaaa

SEQ ID NO: 1672709 - RNA, 20 nt, Salmonella enterica enterica serovar Typhi
gcaaauacuggaaaaaacgg

SEQ ID NO: 1672710 - RNA, 17 nt, Salmonella enterica enterica serovar Typhi
gcaaaucgcgguaaaaa

SEQ ID NO: 1672711 - RNA, 19 nt, Salmonella enterica enterica serovar Typhi
gcaaaugaccagaucaaca

SEQ ID NO: 1672712 - RNA, 12 nt, Salmonella enterica enterica serovar Typhi
gcaaaugucaga

SEQ ID NO: 1672713 - RNA, 15 nt, Salmonella enterica enterica serovar Typhi
gcaaauuaugauuca

SEQ ID NO: 1672714 - RNA, 22 nt, Salmonella enterica enterica serovar Typhi
gcaaauuccaacauauuugccc

SEQ ID NO: 1672715 - RNA, 22 nt, Salmonella enterica enterica serovar Typhi
gcaaagcccaucagcgccagcc

SEQ ID NO: 1672716 - RNA, 13 nt, Salmonella enterica enterica serovar Typhi
gcaaagccccagu

SEQ ID NO: 1672717 - RNA, 22 nt, Salmonella enterica enterica serovar Typhi
gcaaagcccacgcccugcaaug

SEQ ID NO: 1672718 - RNA, 22 nt, Salmonella enterica enterica serovar Typhi
gcaaagcacugcugcugaaaga

SEQ ID NO: 1672719 - RNA, 23 nt, Salmonella enterica enterica serovar Typhi
gcaaagcacugcugcugaaagaa

SEQ ID NO: 1672720 - RNA, 21 nt, Salmonella enterica enterica serovar Typhi
gcagcccuuugagaaaacugc

SEQ ID NO: 1672721 - RNA, 22 nt, Salmonella enterica enterica serovar Typhi
gcagcauugggucaugcggaug

SEQ ID NO: 1672722 - RNA, 20 nt, Salmonella enterica enterica serovar Typhi
gcagcgcauccaccagaccc

SEQ ID NO: 1672723 - RNA, 21 nt, Salmonella enterica enterica serovar Typhi
gcagcgccaccgggcaacaca

SEQ ID NO: 1672724 - RNA, 13 nt, Salmonella enterica enterica serovar Typhi
gcagcgccaucca

SEQ ID NO: 1672725 - RNA, 21 nt, Salmonella enterica enterica serovar Typhi
gcagcgccauugagcauucua

SEQ ID NO: 1672726 - RNA, 15 nt, Salmonella enterica enterica serovar Typhi
gcagcgccagugacg

SEQ ID NO: 1672727 - RNA, 14 nt, Salmonella enterica enterica serovar Typhi
gcagcgcaccugcc

SEQ ID NO: 1672728 - RNA, 16 nt, Salmonella enterica enterica serovar Typhi
gcagcgcaccugcccc

SEQ ID NO: 1672729 - RNA, 14 nt, Salmonella enterica enterica serovar Typhi
gcagcgcaucaucc

SEQ ID NO: 1672730 - RNA, 13 nt, Salmonella enterica enterica serovar Typhi
gcagcagcaggcu

SEQ ID NO: 1672731 - RNA, 15 nt, Salmonella enterica enterica serovar Typhi
gcagcagagaucagg

SEQ ID NO: 1672732 - RNA, 16 nt, Salmonella enterica enterica serovar Typhi
gcagcagagaucagga

SEQ ID NO: 1672733 - RNA, 20 nt, Salmonella enterica enterica serovar Typhi
gcagcaccagauauuuuucc

SEQ ID NO: 1672734 - RNA, 18 nt, Salmonella enterica enterica serovar Typhi
gcagcauaucgccguuca

SEQ ID NO: 1672735 - RNA, 13 nt, Salmonella enterica enterica serovar Typhi
gcagauugaggcu

SEQ ID NO: 1672736 - RNA, 15 nt, Salmonella enterica enterica serovar Typhi
gcagcaacccugccg

SEQ ID NO: 1672737 - RNA, 12 nt, Salmonella enterica enterica serovar Typhi
gcagcaaauaau

SEQ ID NO: 1672738 - RNA, 17 nt, Salmonella enterica enterica serovar Typhi
gcagcacaugcaauuug

SEQ ID NO: 1672739 - RNA, 18 nt, Salmonella enterica enterica serovar Typhi
gcagcaaaucagcuacuu

SEQ ID NO: 1672740 - RNA, 22 nt, Salmonella enterica enterica serovar Typhi
gcagcaaaucagcuacuuuaaa

SEQ ID NO: 1672741 - RNA, 18 nt, Salmonella enterica enterica serovar Typhi
gcacuguaacgcacuggu

SEQ ID NO: 1672742 - RNA, 15 nt, Salmonella enterica enterica serovar Typhi
gcagcggcugcgccu

SEQ ID NO: 1672743 - RNA, 14 nt, Salmonella enterica enterica serovar Typhi
gcagcgcggccugc

SEQ ID NO: 1672744 - RNA, 15 nt, Salmonella enterica enterica serovar Typhi
gcagcgcggcacaca

SEQ ID NO: 1672745 - RNA, 18 nt, Salmonella enterica enterica serovar Typhi
gcagcgcgcgacccagcg

SEQ ID NO: 1672746 - RNA, 15 nt, Salmonella enterica enterica serovar Typhi
gcagcgcgauggcgu

SEQ ID NO: 1672747 - RNA, 16 nt, Salmonella enterica enterica serovar Typhi
gcagcugccacaccac

SEQ ID NO: 1672748 - RNA, 22 nt, Salmonella enterica enterica serovar Typhi
gcagcucugccuguagcagcgc

SEQ ID NO: 1672749 - RNA, 14 nt, Salmonella enterica enterica serovar Typhi
gcagcgucuuccca

SEQ ID NO: 1672750 - RNA, 18 nt, Salmonella enterica enterica serovar Typhi
gcagcguaauagucugcu

SEQ ID NO: 1672751 - RNA, 19 nt, Salmonella enterica enterica serovar Typhi
gcagcguaauacaggcgau

SEQ ID NO: 1672752 - RNA, 19 nt, Salmonella enterica enterica serovar Typhi
gcagcgucagcccaagcug

SEQ ID NO: 1672753 - RNA, 22 nt, Salmonella enterica enterica serovar Typhi
gcagcgucugcccuccugaaua

SEQ ID NO: 1672754 - RNA, 18 nt, Salmonella enterica enterica serovar Typhi
gcaggcgauagccccagu

SEQ ID NO: 1672755 - RNA, 21 nt, Salmonella enterica enterica serovar Typhi
gcaggcgauagccccaguaaa

SEQ ID NO: 1672756 - RNA, 20 nt, Salmonella enterica enterica serovar Typhi
gcaggcgggugcgcagcccc

SEQ ID NO: 1672757 - RNA, 18 nt, Salmonella enterica enterica serovar Typhi
gcaggcgucaaaacaggu

SEQ ID NO: 1672758 - RNA, 22 nt, Salmonella enterica enterica serovar Typhi
gcaggcgucaaaacaggucugu

SEQ ID NO: 1672759 - RNA, 19 nt, Salmonella enterica enterica serovar Typhi
gcaggcgucauagccgcgc

SEQ ID NO: 1672760 - RNA, 20 nt, Salmonella enterica enterica serovar Typhi
gcaggcgucauagccgcgcg

SEQ ID NO: 1672761 - RNA, 22 nt, Salmonella enterica enterica serovar Typhi
gcaggcgucauagccgcgcguc

SEQ ID NO: 1672762 - RNA, 13 nt, Salmonella enterica enterica serovar Typhi
gcaggcguuucaa

SEQ ID NO: 1672763 - RNA, 22 nt, Salmonella enterica enterica serovar Typhi
gcaggcgaaaccggccgccauc

SEQ ID NO: 1672764 - RNA, 18 nt, Salmonella enterica enterica serovar Typhi
gcaggccuggcuggauga

SEQ ID NO: 1672765 - RNA, 21 nt, Salmonella enterica enterica serovar Typhi
gcaggcacuguggugugccug

SEQ ID NO: 1672766 - RNA, 17 nt, Salmonella enterica enterica serovar Typhi
gcaggcaggucuccagc

SEQ ID NO: 1672767 - RNA, 17 nt, Salmonella enterica enterica serovar Typhi
gcaggccaaacagcggc

SEQ ID NO: 1672768 - RNA, 18 nt, Salmonella enterica enterica serovar Typhi
gcaggcauuaaaaaaacg

SEQ ID NO: 1672769 - RNA, 18 nt, Salmonella enterica enterica serovar Typhi
gcagcuuggcggcuuccu

SEQ ID NO: 1672770 - RNA, 22 nt, Salmonella enterica enterica serovar Typhi
gcagugcaguauugcaccagga

SEQ ID NO: 1672771 - RNA, 16 nt, Salmonella enterica enterica serovar Typhi
gcagugcgcuaacugg

SEQ ID NO: 1672772 - RNA, 17 nt, Salmonella enterica enterica serovar Typhi
gcaguuugguaauacua

SEQ ID NO: 1672773 - RNA, 23 nt, Salmonella enterica enterica serovar Typhi
gcaguuuuaccguaaaaugcugg

SEQ ID NO: 1672774 - RNA, 15 nt, Salmonella enterica enterica serovar Typhi
gcaguuuuuauccuc

SEQ ID NO: 1672775 - RNA, 17 nt, Salmonella enterica enterica serovar Typhi
gcagugcucgccaaaac

SEQ ID NO: 1672776 - RNA, 17 nt, Salmonella enterica enterica serovar Typhi
gcauaaaaaacaucaug

SEQ ID NO: 1672777 - RNA, 12 nt, Salmonella enterica enterica serovar Typhi
gcauaaaaaaac

SEQ ID NO: 1672778 - RNA, 14 nt, Salmonella enterica enterica serovar Typhi
gcauaaaaaagagg

SEQ ID NO: 1672779 - RNA, 14 nt, Salmonella enterica enterica serovar Typhi
gcauaaaaaaugag

SEQ ID NO: 1672780 - RNA, 15 nt, Salmonella enterica enterica serovar Typhi
gcauaaaaaaugaga

SEQ ID NO: 1672781 - RNA, 23 nt, Salmonella enterica enterica serovar Typhi
gcauaauacggggccauuauuua

SEQ ID NO: 1672782 - RNA, 16 nt, Salmonella enterica enterica serovar Typhi
gcauaauaugcaacac

SEQ ID NO: 1672783 - RNA, 17 nt, Salmonella enterica enterica serovar Typhi
gcauaauauccaggagc

SEQ ID NO: 1672784 - RNA, 19 nt, Salmonella enterica enterica serovar Typhi
gcauauccagcgccugcgc

SEQ ID NO: 1672785 - RNA, 17 nt, Salmonella enterica enterica serovar Typhi
gcauauagugcgugaca

SEQ ID NO: 1672786 - RNA, 14 nt, Salmonella enterica enterica serovar Typhi
gcauacgccccggu

SEQ ID NO: 1672787 - RNA, 17 nt, Salmonella enterica enterica serovar Typhi
gcauagaauuucagggu

SEQ ID NO: 1672788 - RNA, 16 nt, Salmonella enterica enterica serovar Typhi
gcauagacgugcggca

SEQ ID NO: 1672789 - RNA, 18 nt, Salmonella enterica enterica serovar Typhi
gcauacucuuggagagca

SEQ ID NO: 1672790 - RNA, 19 nt, Salmonella enterica enterica serovar Typhi
gcauacucacgaauaagaa

SEQ ID NO: 1672791 - RNA, 21 nt, Salmonella enterica enterica serovar Typhi
gcauacucauuaccggcugcc

SEQ ID NO: 1672792 - RNA, 21 nt, Salmonella enterica enterica serovar Typhi
gcagucagccuugaccgccug

SEQ ID NO: 1672793 - RNA, 13 nt, Salmonella enterica enterica serovar Typhi
gcaguccaacaag

SEQ ID NO: 1672794 - RNA, 16 nt, Salmonella enterica enterica serovar Typhi
gcaguccaacaaggau

SEQ ID NO: 1672795 - RNA, 15 nt, Salmonella enterica enterica serovar Typhi
gcagucccgccggga

SEQ ID NO: 1672796 - RNA, 17 nt, Salmonella enterica enterica serovar Typhi
gcagucgcuacaaccag

SEQ ID NO: 1672797 - RNA, 12 nt, Salmonella enterica enterica serovar Typhi
gcagugauuuua

SEQ ID NO: 1672798 - RNA, 18 nt, Salmonella enterica enterica serovar Typhi
gcagugauuaugcucccg

SEQ ID NO: 1672799 - RNA, 18 nt, Salmonella enterica enterica serovar Typhi
gcagugauucguaguaag

SEQ ID NO: 1672800 - RNA, 20 nt, Salmonella enterica enterica serovar Typhi
gcagguuuuacuucuucagg

SEQ ID NO: 1672801 - RNA, 21 nt, Salmonella enterica enterica serovar Typhi
gcaguagccacgguaacagcu

SEQ ID NO: 1672802 - RNA, 13 nt, Salmonella enterica enterica serovar Typhi
gcaguagccaugc

SEQ ID NO: 1672803 - RNA, 22 nt, Salmonella enterica enterica serovar Typhi
gcaguauccgugccgagguggu

SEQ ID NO: 1672804 - RNA, 18 nt, Salmonella enterica enterica serovar Typhi
gcaguaugaccccuccgg

SEQ ID NO: 1672805 - RNA, 20 nt, Salmonella enterica enterica serovar Typhi
gcaguauugcaccaggaaga

SEQ ID NO: 1672806 - RNA, 14 nt, Salmonella enterica enterica serovar Typhi
gcaggcucaccagc

SEQ ID NO: 1672807 - RNA, 18 nt, Salmonella enterica enterica serovar Typhi
gcagggacgcugcugacg

SEQ ID NO: 1672808 - RNA, 17 nt, Salmonella enterica enterica serovar Typhi
gcagggacuuauuaaaa

SEQ ID NO: 1672809 - RNA, 17 nt, Salmonella enterica enterica serovar Typhi
gcagggaugacagaaag

SEQ ID NO: 1672810 - RNA, 14 nt, Salmonella enterica enterica serovar Typhi
gcaggucggcccga

SEQ ID NO: 1672811 - RNA, 17 nt, Salmonella enterica enterica serovar Typhi
gcaggugauggcggcuu

SEQ ID NO: 1672812 - RNA, 16 nt, Salmonella enterica enterica serovar Typhi
gcagguugagucugcu

SEQ ID NO: 1672813 - RNA, 18 nt, Salmonella enterica enterica serovar Typhi
gcagguugagucugcucg

SEQ ID NO: 1672814 - RNA, 15 nt, Salmonella enterica enterica serovar Typhi
gcaucaacguaaaua

SEQ ID NO: 1672815 - RNA, 13 nt, Salmonella enterica enterica serovar Typhi
gcaucaaacuuuu

SEQ ID NO: 1672816 - RNA, 16 nt, Salmonella enterica enterica serovar Typhi
gcaucaaacuuuuaaa

SEQ ID NO: 1672817 - RNA, 21 nt, Salmonella enterica enterica serovar Typhi
gcaucaaacuuuuaaauugaa

SEQ ID NO: 1672818 - RNA, 18 nt, Salmonella enterica enterica serovar Typhi
gcaucacaucaaagcccc

SEQ ID NO: 1672819 - RNA, 23 nt, Salmonella enterica enterica serovar Typhi
gcaucaagcugcuggcgagcagg

SEQ ID NO: 1672820 - RNA, 17 nt, Salmonella enterica enterica serovar Typhi
gcaucaauaaaaucacc

SEQ ID NO: 1672821 - RNA, 16 nt, Salmonella enterica enterica serovar Typhi
gcauaugcacagcgcu

SEQ ID NO: 1672822 - RNA, 13 nt, Salmonella enterica enterica serovar Typhi
gcauaucgcccug

SEQ ID NO: 1672823 - RNA, 23 nt, Salmonella enterica enterica serovar Typhi
gcauaucuggcgaggcuuugucc

SEQ ID NO: 1672824 - RNA, 22 nt, Salmonella enterica enterica serovar Typhi
gcaucaugggcucaucaaacag

SEQ ID NO: 1672825 - RNA, 21 nt, Salmonella enterica enterica serovar Typhi
gcaucaucgguguucacaauu

SEQ ID NO: 1672826 - RNA, 13 nt, Salmonella enterica enterica serovar Typhi
gcaucauaaaagg

SEQ ID NO: 1672827 - RNA, 23 nt, Salmonella enterica enterica serovar Typhi
gcaucauauaaccacgaaaauua

SEQ ID NO: 1672828 - RNA, 22 nt, Salmonella enterica enterica serovar Typhi
gcaucaggaaauccuggauacg

SEQ ID NO: 1672829 - RNA, 13 nt, Salmonella enterica enterica serovar Typhi
gcaucagaaaaac

SEQ ID NO: 1672830 - RNA, 14 nt, Salmonella enterica enterica serovar Typhi
gcaucagaaaaacc

SEQ ID NO: 1672831 - RNA, 15 nt, Salmonella enterica enterica serovar Typhi
gcaucacggcagcac

SEQ ID NO: 1672832 - RNA, 15 nt, Salmonella enterica enterica serovar Typhi
gcaucagacgguggc

SEQ ID NO: 1672833 - RNA, 16 nt, Salmonella enterica enterica serovar Typhi
gcaucagacuacuuuu

SEQ ID NO: 1672834 - RNA, 22 nt, Salmonella enterica enterica serovar Typhi
gcaucagaaaaaccuccggcua

SEQ ID NO: 1672835 - RNA, 23 nt, Salmonella enterica enterica serovar Typhi
gcauccugacuauugcugagcug

SEQ ID NO: 1672836 - RNA, 18 nt, Salmonella enterica enterica serovar Typhi
gcauccuccauccaggua

SEQ ID NO: 1672837 - RNA, 15 nt, Salmonella enterica enterica serovar Typhi
gcauccgugaccugc

SEQ ID NO: 1672838 - RNA, 23 nt, Salmonella enterica enterica serovar Typhi
gcauccuuaugggucacauccag

SEQ ID NO: 1672839 - RNA, 20 nt, Salmonella enterica enterica serovar Typhi
gcaucgauuccccaccagga

SEQ ID NO: 1672840 - RNA, 21 nt, Salmonella enterica enterica serovar Typhi
gcaucgauuuuucaucuucag

SEQ ID NO: 1672841 - RNA, 19 nt, Salmonella enterica enterica serovar Typhi
gcaucgacguucagcauau

SEQ ID NO: 1672842 - RNA, 23 nt, Salmonella enterica enterica serovar Typhi
gcauccgcggcgcuuugcuucuc

SEQ ID NO: 1672843 - RNA, 14 nt, Salmonella enterica enterica serovar Typhi
gcauccgccgccgc

SEQ ID NO: 1672844 - RNA, 18 nt, Salmonella enterica enterica serovar Typhi
gcauccgcaagacacgcu

SEQ ID NO: 1672845 - RNA, 17 nt, Salmonella enterica enterica serovar Typhi
gcaucccgucccaccac

SEQ ID NO: 1672846 - RNA, 15 nt, Salmonella enterica enterica serovar Typhi
gcaucccgcaggcgg

SEQ ID NO: 1672847 - RNA, 21 nt, Salmonella enterica enterica serovar Typhi
gcaucccgcuggcgccaccgc

SEQ ID NO: 1672848 - RNA, 15 nt, Salmonella enterica enterica serovar Typhi
gcaucauucugcagg

SEQ ID NO: 1672849 - RNA, 15 nt, Salmonella enterica enterica serovar Typhi
gcauccagcacgagc

SEQ ID NO: 1672850 - RNA, 21 nt, Salmonella enterica enterica serovar Typhi
gcauccagcacgagcgccagc

SEQ ID NO: 1672851 - RNA, 13 nt, Salmonella enterica enterica serovar Typhi
gcauccagaccca

SEQ ID NO: 1672852 - RNA, 15 nt, Salmonella enterica enterica serovar Typhi
gcauccaguuucuuc

SEQ ID NO: 1672853 - RNA, 16 nt, Salmonella enterica enterica serovar Typhi
gcauccaugccagcgc

SEQ ID NO: 1672854 - RNA, 23 nt, Salmonella enterica enterica serovar Typhi
gcaauuccgcuuucuucccggca

SEQ ID NO: 1672855 - RNA, 17 nt, Salmonella enterica enterica serovar Typhi
gcaauugauacauuuuu

SEQ ID NO: 1672856 - RNA, 21 nt, Salmonella enterica enterica serovar Typhi
gcaauugguaauuaaaggcag

SEQ ID NO: 1672857 - RNA, 23 nt, Salmonella enterica enterica serovar Typhi
gcaauucgagauuuuucugcgcc

SEQ ID NO: 1672858 - RNA, 19 nt, Salmonella enterica enterica serovar Typhi
gcaauucaaacugacugau

SEQ ID NO: 1672859 - RNA, 15 nt, Salmonella enterica enterica serovar Typhi
gcaauuaaauuagaa

SEQ ID NO: 1672860 - RNA, 16 nt, Salmonella enterica enterica serovar Typhi
gcaauuaacaaauaaa

SEQ ID NO: 1672861 - RNA, 23 nt, Salmonella enterica enterica serovar Typhi
gcaauuaauaaacaaugcaggua

SEQ ID NO: 1672862 - RNA, 20 nt, Salmonella enterica enterica serovar Typhi
gcaauguggacaaucaggcu

SEQ ID NO: 1672863 - RNA, 18 nt, Salmonella enterica enterica serovar Typhi
gcaauguucaauaucaaa

SEQ ID NO: 1672864 - RNA, 20 nt, Salmonella enterica enterica serovar Typhi
gcaauguucaauaucaaauu

SEQ ID NO: 1672865 - RNA, 17 nt, Salmonella enterica enterica serovar Typhi
gcaaugucugccucggg

SEQ ID NO: 1672866 - RNA, 23 nt, Salmonella enterica enterica serovar Typhi
gcacaauagcgcuaaacagcgcc

SEQ ID NO: 1672867 - RNA, 13 nt, Salmonella enterica enterica serovar Typhi
gcacaauuccggc

SEQ ID NO: 1672868 - RNA, 12 nt, Salmonella enterica enterica serovar Typhi
gcacaauaccaa

SEQ ID NO: 1672869 - RNA, 14 nt, Salmonella enterica enterica serovar Typhi
gcacaauaccaaua

SEQ ID NO: 1672870 - RNA, 16 nt, Salmonella enterica enterica serovar Typhi
gcacaacggccagcaa

SEQ ID NO: 1672871 - RNA, 18 nt, Salmonella enterica enterica serovar Typhi
gcaauuuaccuauuucga

SEQ ID NO: 1672872 - RNA, 13 nt, Salmonella enterica enterica serovar Typhi
gcacagaagcgcc

SEQ ID NO: 1672873 - RNA, 15 nt, Salmonella enterica enterica serovar Typhi
gcacacuuucaucag

SEQ ID NO: 1672874 - RNA, 18 nt, Salmonella enterica enterica serovar Typhi
gcacacgccaaaaucgcc

SEQ ID NO: 1672875 - RNA, 19 nt, Salmonella enterica enterica serovar Typhi
gcaccaacgauaaauuuuc

SEQ ID NO: 1672876 - RNA, 15 nt, Salmonella enterica enterica serovar Typhi
gcaccaacgccgcuu

SEQ ID NO: 1672877 - RNA, 18 nt, Salmonella enterica enterica serovar Typhi
gcacauuuacgccagcca

SEQ ID NO: 1672878 - RNA, 18 nt, Salmonella enterica enterica serovar Typhi
gcacauuggcgagcagga

SEQ ID NO: 1672879 - RNA, 19 nt, Salmonella enterica enterica serovar Typhi
gcaccaccaggaacgccau

SEQ ID NO: 1672880 - RNA, 14 nt, Salmonella enterica enterica serovar Typhi
gcaccaccugguua

SEQ ID NO: 1672881 - RNA, 17 nt, Salmonella enterica enterica serovar Typhi
gcaccacgcaaaccgcu

SEQ ID NO: 1672882 - RNA, 14 nt, Salmonella enterica enterica serovar Typhi
gcaaauucuuuuca

SEQ ID NO: 1672883 - RNA, 17 nt, Salmonella enterica enterica serovar Typhi
gcaacuucaccucaguc

SEQ ID NO: 1672884 - RNA, 19 nt, Salmonella enterica enterica serovar Typhi
gcaacuucagaauccaggu

SEQ ID NO: 1672885 - RNA, 14 nt, Salmonella enterica enterica serovar Typhi
gcaacuuaauaaua

SEQ ID NO: 1672886 - RNA, 15 nt, Salmonella enterica enterica serovar Typhi
gcaacuuagugucca

SEQ ID NO: 1672887 - RNA, 14 nt, Salmonella enterica enterica serovar Typhi
gcaagaaacaucau

SEQ ID NO: 1672888 - RNA, 15 nt, Salmonella enterica enterica serovar Typhi
gcaagcagcauaaug

SEQ ID NO: 1672889 - RNA, 17 nt, Salmonella enterica enterica serovar Typhi
gcaagaaccgcuuuucc

SEQ ID NO: 1672890 - RNA, 19 nt, Salmonella enterica enterica serovar Typhi
gcaagaaccgcuuuuccug

SEQ ID NO: 1672891 - RNA, 20 nt, Salmonella enterica enterica serovar Typhi
gcaagcauaaaaaacaucau

SEQ ID NO: 1672892 - RNA, 17 nt, Salmonella enterica enterica serovar Typhi
gcaagcauaaaaaacau

SEQ ID NO: 1672893 - RNA, 19 nt, Salmonella enterica enterica serovar Typhi
gcaagccgaacucuuccac

SEQ ID NO: 1672894 - RNA, 17 nt, Salmonella enterica enterica serovar Typhi
gcaagcgcuaagcaaca

SEQ ID NO: 1672895 - RNA, 13 nt, Salmonella enterica enterica serovar Typhi
gcaaguaugaaaa

SEQ ID NO: 1672896 - RNA, 14 nt, Salmonella enterica enterica serovar Typhi
gcaauaugcggcgc

SEQ ID NO: 1672897 - RNA, 16 nt, Salmonella enterica enterica serovar Typhi
gcaauaucgaugccag

SEQ ID NO: 1672898 - RNA, 17 nt, Salmonella enterica enterica serovar Typhi
gcaaucacaagcuguuu

SEQ ID NO: 1672899 - RNA, 14 nt, Salmonella enterica enterica serovar Typhi
gcaaucacacuaca

SEQ ID NO: 1672900 - RNA, 16 nt, Salmonella enterica enterica serovar Typhi
gcaaucacauacagca

SEQ ID NO: 1672901 - RNA, 15 nt, Salmonella enterica enterica serovar Typhi
gcaaucucacugccc

SEQ ID NO: 1672902 - RNA, 18 nt, Salmonella enterica enterica serovar Typhi
gcaaucucuggccaggca

SEQ ID NO: 1672903 - RNA, 19 nt, Salmonella enterica enterica serovar Typhi
gcaauauguuuaaagaaga

SEQ ID NO: 1672904 - RNA, 14 nt, Salmonella enterica enterica serovar Typhi
gcaauauugccgca

SEQ ID NO: 1672905 - RNA, 17 nt, Salmonella enterica enterica serovar Typhi
gcaauauuguuaaccag

SEQ ID NO: 1672906 - RNA, 11 nt, Salmonella enterica enterica serovar Typhi
gcaaucuggcg

SEQ ID NO: 1672907 - RNA, 15 nt, Salmonella enterica enterica serovar Typhi
gcaaucuuugccgca

SEQ ID NO: 1672908 - RNA, 23 nt, Salmonella enterica enterica serovar Typhi
gcaaugcugacgacauucagcac

SEQ ID NO: 1672909 - RNA, 18 nt, Salmonella enterica enterica serovar Typhi
gcacgcccuucgucagga

SEQ ID NO: 1672910 - RNA, 21 nt, Salmonella enterica enterica serovar Typhi
gcacgcccgcauucauaagca

SEQ ID NO: 1672911 - RNA, 12 nt, Salmonella enterica enterica serovar Typhi
gcacgccagggu

SEQ ID NO: 1672912 - RNA, 15 nt, Salmonella enterica enterica serovar Typhi
gcacgccaucgccug

SEQ ID NO: 1672913 - RNA, 15 nt, Salmonella enterica enterica serovar Typhi
gcaccuucaacagcu

SEQ ID NO: 1672914 - RNA, 14 nt, Salmonella enterica enterica serovar Typhi
gcaccuucucuccu

SEQ ID NO: 1672915 - RNA, 14 nt, Salmonella enterica enterica serovar Typhi
gcacgaaaaauaaa

SEQ ID NO: 1672916 - RNA, 15 nt, Salmonella enterica enterica serovar Typhi
gcacgaaaaauaaaa

SEQ ID NO: 1672917 - RNA, 16 nt, Salmonella enterica enterica serovar Typhi
gcaccucgcaauauuc

SEQ ID NO: 1672918 - RNA, 16 nt, Salmonella enterica enterica serovar Typhi
gcaccagaaucauuaa

SEQ ID NO: 1672919 - RNA, 21 nt, Salmonella enterica enterica serovar Typhi
gcaccagaacucccuguuccu

SEQ ID NO: 1672920 - RNA, 20 nt, Salmonella enterica enterica serovar Typhi
gcaccgccaaacgcggucag

SEQ ID NO: 1672921 - RNA, 15 nt, Salmonella enterica enterica serovar Typhi
gcacgucgucccagg

SEQ ID NO: 1672922 - RNA, 22 nt, Salmonella enterica enterica serovar Typhi
gcacguagccccuaucuggugc

SEQ ID NO: 1672923 - RNA, 22 nt, Salmonella enterica enterica serovar Typhi
gcacgcuuuuuugcuggcuggc

SEQ ID NO: 1672924 - RNA, 18 nt, Salmonella enterica enterica serovar Typhi
gcacgcuggcaucaauau

SEQ ID NO: 1672925 - RNA, 22 nt, Salmonella enterica enterica serovar Typhi
gcacgcuauauuccagccagga

SEQ ID NO: 1672926 - RNA, 17 nt, Salmonella enterica enterica serovar Typhi
gcacggcaagcgcggcg

SEQ ID NO: 1672927 - RNA, 16 nt, Salmonella enterica enterica serovar Typhi
gcacuaacagcagcag

SEQ ID NO: 1672928 - RNA, 19 nt, Salmonella enterica enterica serovar Typhi
gcacuacggauggcccugc

SEQ ID NO: 1672929 - RNA, 19 nt, Salmonella enterica enterica serovar Typhi
gcacuaucgggcauuucag

SEQ ID NO: 1672930 - RNA, 13 nt, Salmonella enterica enterica serovar Typhi
gcacucaccucuu

SEQ ID NO: 1672931 - RNA, 23 nt, Salmonella enterica enterica serovar Typhi
gcacguuaaagccgaccaucgcg

SEQ ID NO: 1672932 - RNA, 15 nt, Salmonella enterica enterica serovar Typhi
gcacguuuuccaggu

SEQ ID NO: 1672933 - RNA, 22 nt, Salmonella enterica enterica serovar Typhi
gcacuaaagcguugcaggcgau

SEQ ID NO: 1672934 - RNA, 19 nt, Salmonella enterica enterica serovar Typhi
gcacucuauucaugcauua

SEQ ID NO: 1672935 - RNA, 16 nt, Salmonella enterica enterica serovar Typhi
gcacucgcgacauggc

SEQ ID NO: 1672936 - RNA, 14 nt, Salmonella enterica enterica serovar Typhi
gcacugcaccuggu

SEQ ID NO: 1672937 - RNA, 15 nt, Salmonella enterica enterica serovar Typhi
gcacugcaccugguc

SEQ ID NO: 1672938 - RNA, 17 nt, Salmonella enterica enterica serovar Typhi
gcacugcaccuggucga

SEQ ID NO: 1672939 - RNA, 15 nt, Salmonella enterica enterica serovar Typhi
gcacugcaggcggga

SEQ ID NO: 1672940 - RNA, 12 nt, Salmonella enterica enterica serovar Typhi
gcacugcugcug

SEQ ID NO: 1672941 - RNA, 18 nt, Salmonella enterica enterica serovar Typhi
gcacugcugcugaaagaa

SEQ ID NO: 1672942 - RNA, 22 nt, Salmonella enterica enterica serovar Typhi
gcccgcaaaggaccaacaccag

SEQ ID NO: 1672943 - RNA, 21 nt, Salmonella enterica enterica serovar Typhi
gcccgcaaacagagcgccggc

SEQ ID NO: 1672944 - RNA, 15 nt, Salmonella enterica enterica serovar Typhi
gcccgcccacaggcu

SEQ ID NO: 1672945 - RNA, 17 nt, Salmonella enterica enterica serovar Typhi
gcccgauggcgcugcgu

SEQ ID NO: 1672946 - RNA, 14 nt, Salmonella enterica enterica serovar Typhi
gcccgauggcgcug

SEQ ID NO: 1672947 - RNA, 16 nt, Salmonella enterica enterica serovar Typhi
gcccgccugagcgcgc

SEQ ID NO: 1672948 - RNA, 12 nt, Salmonella enterica enterica serovar Typhi
gcccgccgggcg

SEQ ID NO: 1672949 - RNA, 15 nt, Salmonella enterica enterica serovar Typhi
gcccgcgcuaagcac

SEQ ID NO: 1672950 - RNA, 22 nt, Salmonella enterica enterica serovar Typhi
gcccgccugcuguaaccccugc

SEQ ID NO: 1672951 - RNA, 17 nt, Salmonella enterica enterica serovar Typhi
gcccgccugagcgcgca

SEQ ID NO: 1672952 - RNA, 22 nt, Salmonella enterica enterica serovar Typhi
gcccgccugagcgcgcaguggg

SEQ ID NO: 1672953 - RNA, 21 nt, Salmonella enterica enterica serovar Typhi
gcccggagggguuuucgccag

SEQ ID NO: 1672954 - RNA, 14 nt, Salmonella enterica enterica serovar Typhi
gcccggcaaacggg

SEQ ID NO: 1672955 - RNA, 22 nt, Salmonella enterica enterica serovar Typhi
gcccggauaaccgcccgcggcg

SEQ ID NO: 1672956 - RNA, 15 nt, Salmonella enterica enterica serovar Typhi
gccccguaucauuag

SEQ ID NO: 1672957 - RNA, 23 nt, Salmonella enterica enterica serovar Typhi
gccccguaucauuaggcggcgga

SEQ ID NO: 1672958 - RNA, 23 nt, Salmonella enterica enterica serovar Typhi
gccccguggcgggaugccccacu

SEQ ID NO: 1672959 - RNA, 23 nt, Salmonella enterica enterica serovar Typhi
gcccaggccaaaaccacagugac

SEQ ID NO: 1672960 - RNA, 13 nt, Salmonella enterica enterica serovar Typhi
gcccagcgcggcc

SEQ ID NO: 1672961 - RNA, 15 nt, Salmonella enterica enterica serovar Typhi
gcccagcgcggccca

SEQ ID NO: 1672962 - RNA, 23 nt, Salmonella enterica enterica serovar Typhi
gcccagcgcgauacgcagcaccg

SEQ ID NO: 1672963 - RNA, 17 nt, Salmonella enterica enterica serovar Typhi
gcccagcuuaguaaccc

SEQ ID NO: 1672964 - RNA, 18 nt, Salmonella enterica enterica serovar Typhi
gccccucuugcagcaaga

SEQ ID NO: 1672965 - RNA, 19 nt, Salmonella enterica enterica serovar Typhi
gccccugagcaaucaguuc

SEQ ID NO: 1672966 - RNA, 14 nt, Salmonella enterica enterica serovar Typhi
gccccugcgccagc

SEQ ID NO: 1672967 - RNA, 22 nt, Salmonella enterica enterica serovar Typhi
gcccgguggcggcuggcgccuu

SEQ ID NO: 1672968 - RNA, 18 nt, Salmonella enterica enterica serovar Typhi
gcccguaaacaggcugcc

SEQ ID NO: 1672969 - RNA, 20 nt, Salmonella enterica enterica serovar Typhi
gcccgucugggagccgcugc

SEQ ID NO: 1672970 - RNA, 21 nt, Salmonella enterica enterica serovar Typhi
gcccgucugggagccgcugcu

SEQ ID NO: 1672971 - RNA, 16 nt, Salmonella enterica enterica serovar Typhi
gcccgugacgccaggc

SEQ ID NO: 1672972 - RNA, 14 nt, Salmonella enterica enterica serovar Typhi
gcccguaaacgggc

SEQ ID NO: 1672973 - RNA, 19 nt, Salmonella enterica enterica serovar Typhi
gcccguaaacgggcugccc

SEQ ID NO: 1672974 - RNA, 19 nt, Salmonella enterica enterica serovar Typhi
gcccggugauggugcagcc

SEQ ID NO: 1672975 - RNA, 23 nt, Salmonella enterica enterica serovar Typhi
gcccggugauggugcagccccgg

SEQ ID NO: 1672976 - RNA, 15 nt, Salmonella enterica enterica serovar Typhi
gcccggugauggugc

SEQ ID NO: 1672977 - RNA, 21 nt, Salmonella enterica enterica serovar Typhi
gcccgguaagaaugcgcguca

SEQ ID NO: 1672978 - RNA, 18 nt, Salmonella enterica enterica serovar Typhi
gcccgguaagcgcagcgc

SEQ ID NO: 1672979 - RNA, 17 nt, Salmonella enterica enterica serovar Typhi
gcccggcgcgacgccgc

SEQ ID NO: 1672980 - RNA, 20 nt, Salmonella enterica enterica serovar Typhi
gcccggcgcgacgccgcaua

SEQ ID NO: 1672981 - RNA, 21 nt, Salmonella enterica enterica serovar Typhi
gcccgggagaacgccgggccu

SEQ ID NO: 1672982 - RNA, 15 nt, Salmonella enterica enterica serovar Typhi
gcccggcuuucuguu

SEQ ID NO: 1672983 - RNA, 17 nt, Salmonella enterica enterica serovar Typhi
gcccggccacagcgcca

SEQ ID NO: 1672984 - RNA, 14 nt, Salmonella enterica enterica serovar Typhi
gcccucgccagcaa

SEQ ID NO: 1672985 - RNA, 15 nt, Salmonella enterica enterica serovar Typhi
gcccucgccagcaac

SEQ ID NO: 1672986 - RNA, 18 nt, Salmonella enterica enterica serovar Typhi
gcccgugguuuuacugca

SEQ ID NO: 1672987 - RNA, 17 nt, Salmonella enterica enterica serovar Typhi
gcccuacgcuucucucc

SEQ ID NO: 1672988 - RNA, 17 nt, Salmonella enterica enterica serovar Typhi
gcccuauaacagcgcug

SEQ ID NO: 1672989 - RNA, 14 nt, Salmonella enterica enterica serovar Typhi
gcccuaucgcugcg

SEQ ID NO: 1672990 - RNA, 21 nt, Salmonella enterica enterica serovar Typhi
gcccugcaucaugcgcagaaa

SEQ ID NO: 1672991 - RNA, 14 nt, Salmonella enterica enterica serovar Typhi
gcccugcccgccag

SEQ ID NO: 1672992 - RNA, 16 nt, Salmonella enterica enterica serovar Typhi
gcccugagcccacagc

SEQ ID NO: 1672993 - RNA, 15 nt, Salmonella enterica enterica serovar Typhi
gcccugacgccgcug

SEQ ID NO: 1672994 - RNA, 13 nt, Salmonella enterica enterica serovar Typhi
gcccugcaaagca

SEQ ID NO: 1672995 - RNA, 21 nt, Salmonella enterica enterica serovar Typhi
gcccuguaaaggauugccgcc

SEQ ID NO: 1672996 - RNA, 18 nt, Salmonella enterica enterica serovar Typhi
gcccuguaacagaauuaa

SEQ ID NO: 1672997 - RNA, 19 nt, Salmonella enterica enterica serovar Typhi
gccgacaccggccugccua

SEQ ID NO: 1672998 - RNA, 17 nt, Salmonella enterica enterica serovar Typhi
gccgacacaguaaaaaa

SEQ ID NO: 1672999 - RNA, 16 nt, Salmonella enterica enterica serovar Typhi
gccgaccaaugacgcu

SEQ ID NO: 1673000 - RNA, 19 nt, Salmonella enterica enterica serovar Typhi
gccgaccaauugcaggcag

SEQ ID NO: 1673001 - RNA, 15 nt, Salmonella enterica enterica serovar Typhi
gccgacauucccugc

SEQ ID NO: 1673002 - RNA, 19 nt, Salmonella enterica enterica serovar Typhi
gccgacaugguuaaccacc

SEQ ID NO: 1673003 - RNA, 18 nt, Salmonella enterica enterica serovar Typhi
gccgacaucgccaccgca

SEQ ID NO: 1673004 - RNA, 15 nt, Salmonella enterica enterica serovar Typhi
gccgaccaccagcuu

SEQ ID NO: 1673005 - RNA, 16 nt, Salmonella enterica enterica serovar Typhi
gccgaccgccagcaga

SEQ ID NO: 1673006 - RNA, 17 nt, Salmonella enterica enterica serovar Typhi
gccgaccgccagcagag

SEQ ID NO: 1673007 - RNA, 14 nt, Salmonella enterica enterica serovar Typhi
gccgaccggcgcgc

SEQ ID NO: 1673008 - RNA, 20 nt, Salmonella enterica enterica serovar Typhi
gccgacccgcaucgccgcgg

SEQ ID NO: 1673009 - RNA, 19 nt, Salmonella enterica enterica serovar Typhi
gccgacccccuccuuguaa

SEQ ID NO: 1673010 - RNA, 20 nt, Salmonella enterica enterica serovar Typhi
gccgaagugugccagcagau

SEQ ID NO: 1673011 - RNA, 20 nt, Salmonella enterica enterica serovar Typhi
gccgaaguucauaaauguac

SEQ ID NO: 1673012 - RNA, 19 nt, Salmonella enterica enterica serovar Typhi
gccgacaagguugaucagg

SEQ ID NO: 1673013 - RNA, 23 nt, Salmonella enterica enterica serovar Typhi
gccgaauuuacugugauccacca

SEQ ID NO: 1673014 - RNA, 14 nt, Salmonella enterica enterica serovar Typhi
gcccuuaucuggau

SEQ ID NO: 1673015 - RNA, 20 nt, Salmonella enterica enterica serovar Typhi
gcccuguuuuuucgccgcgc

SEQ ID NO: 1673016 - RNA, 14 nt, Salmonella enterica enterica serovar Typhi
gcccuucaucuucc

SEQ ID NO: 1673017 - RNA, 15 nt, Salmonella enterica enterica serovar Typhi
gcccuuccagcagcc

SEQ ID NO: 1673018 - RNA, 11 nt, Salmonella enterica enterica serovar Typhi
gcccuuuuguu

SEQ ID NO: 1673019 - RNA, 16 nt, Salmonella enterica enterica serovar Typhi
gcccuuuuguuuuugc

SEQ ID NO: 1673020 - RNA, 22 nt, Salmonella enterica enterica serovar Typhi
gcccuuuuugcauucgcuccuc

SEQ ID NO: 1673021 - RNA, 21 nt, Salmonella enterica enterica serovar Typhi
gccgaacaacacggcggccau

SEQ ID NO: 1673022 - RNA, 19 nt, Salmonella enterica enterica serovar Typhi
gccgaaauccaccagcgga

SEQ ID NO: 1673023 - RNA, 13 nt, Salmonella enterica enterica serovar Typhi
gccgcaaaagccg

SEQ ID NO: 1673024 - RNA, 14 nt, Salmonella enterica enterica serovar Typhi
gccgauuuuucggc

SEQ ID NO: 1673025 - RNA, 15 nt, Salmonella enterica enterica serovar Typhi
gccgcaaggacgcca

SEQ ID NO: 1673026 - RNA, 18 nt, Salmonella enterica enterica serovar Typhi
gccgcaaccgccaauaau

SEQ ID NO: 1673027 - RNA, 20 nt, Salmonella enterica enterica serovar Typhi
gccgaucaucccgcccagca

SEQ ID NO: 1673028 - RNA, 17 nt, Salmonella enterica enterica serovar Typhi
gccgaucaggccgcaga

SEQ ID NO: 1673029 - RNA, 16 nt, Salmonella enterica enterica serovar Typhi
gccgaggcauucagcc

SEQ ID NO: 1673030 - RNA, 22 nt, Salmonella enterica enterica serovar Typhi
gccgagacgcugcacacgcugg

SEQ ID NO: 1673031 - RNA, 22 nt, Salmonella enterica enterica serovar Typhi
gccgacuuuacggccuagcugc

SEQ ID NO: 1673032 - RNA, 12 nt, Salmonella enterica enterica serovar Typhi
gccgacuuuacg

SEQ ID NO: 1673033 - RNA, 20 nt, Salmonella enterica enterica serovar Typhi
gccgagcauuuccgcagcca

SEQ ID NO: 1673034 - RNA, 14 nt, Salmonella enterica enterica serovar Typhi
gccgacucgcgcaa

SEQ ID NO: 1673035 - RNA, 19 nt, Salmonella enterica enterica serovar Typhi
gccgacguuaucgccgaca

SEQ ID NO: 1673036 - RNA, 18 nt, Salmonella enterica enterica serovar Typhi
gccgacgcauuucuccug

SEQ ID NO: 1673037 - RNA, 16 nt, Salmonella enterica enterica serovar Typhi
gccgaccgugauuuuu

SEQ ID NO: 1673038 - RNA, 20 nt, Salmonella enterica enterica serovar Typhi
gccgcgauguuugcucgcca

SEQ ID NO: 1673039 - RNA, 24 nt, Salmonella enterica enterica serovar Typhi
gccgcgauacauugucgcagcgcu

SEQ ID NO: 1673040 - RNA, 15 nt, Salmonella enterica enterica serovar Typhi
gccgccugcgccaac

SEQ ID NO: 1673041 - RNA, 18 nt, Salmonella enterica enterica serovar Typhi
gccgcgccuaccagcgcu

SEQ ID NO: 1673042 - RNA, 18 nt, Salmonella enterica enterica serovar Typhi
gccgcgcgccgccucuuc

SEQ ID NO: 1673043 - RNA, 20 nt, Salmonella enterica enterica serovar Typhi
gccgcaauaguuaauguuga

SEQ ID NO: 1673044 - RNA, 21 nt, Salmonella enterica enterica serovar Typhi
gccgcaaucacuucauacgaa

SEQ ID NO: 1673045 - RNA, 16 nt, Salmonella enterica enterica serovar Typhi
gccgcacaaaauuuug

SEQ ID NO: 1673046 - RNA, 12 nt, Salmonella enterica enterica serovar Typhi
gccgccgagcgc

SEQ ID NO: 1673047 - RNA, 14 nt, Salmonella enterica enterica serovar Typhi
gccgccgagcgccg

SEQ ID NO: 1673048 - RNA, 14 nt, Salmonella enterica enterica serovar Typhi
gccgccgccugcca

SEQ ID NO: 1673049 - RNA, 16 nt, Salmonella enterica enterica serovar Typhi
gccgccgcgcggaccg

SEQ ID NO: 1673050 - RNA, 15 nt, Salmonella enterica enterica serovar Typhi
gccgcuuauccggcc

SEQ ID NO: 1673051 - RNA, 17 nt, Salmonella enterica enterica serovar Typhi
gccgcuuccggcaggua

SEQ ID NO: 1673052 - RNA, 22 nt, Salmonella enterica enterica serovar Typhi
gccggaaucgcgauccagcccc

SEQ ID NO: 1673053 - RNA, 13 nt, Salmonella enterica enterica serovar Typhi
gccggacuccagc

SEQ ID NO: 1673054 - RNA, 12 nt, Salmonella enterica enterica serovar Typhi
gccggcagcagc

SEQ ID NO: 1673055 - RNA, 13 nt, Salmonella enterica enterica serovar Typhi
gccggcagcagcu

SEQ ID NO: 1673056 - RNA, 13 nt, Salmonella enterica enterica serovar Typhi
gccggagaccggc

SEQ ID NO: 1673057 - RNA, 12 nt, Salmonella enterica enterica serovar Typhi
gccggagagggg

SEQ ID NO: 1673058 - RNA, 13 nt, Salmonella enterica enterica serovar Typhi
gccggaugguggu

SEQ ID NO: 1673059 - RNA, 13 nt, Salmonella enterica enterica serovar Typhi
gccggauggcggc

SEQ ID NO: 1673060 - RNA, 12 nt, Salmonella enterica enterica serovar Typhi
gccggauggcgc

SEQ ID NO: 1673061 - RNA, 14 nt, Salmonella enterica enterica serovar Typhi
gccggauggcggcg

SEQ ID NO: 1673062 - RNA, 18 nt, Salmonella enterica enterica serovar Typhi
gccgcgcuuucaguaaua

SEQ ID NO: 1673063 - RNA, 15 nt, Salmonella enterica enterica serovar Typhi
gccgcggcgcuggcc

SEQ ID NO: 1673064 - RNA, 16 nt, Salmonella enterica enterica serovar Typhi
gccgcucccgcaugga

SEQ ID NO: 1673065 - RNA, 20 nt, Salmonella enterica enterica serovar Typhi
gccgcugauguuuugcgccg

SEQ ID NO: 1673066 - RNA, 14 nt, Salmonella enterica enterica serovar Typhi
gccgcuccacagca

SEQ ID NO: 1673067 - RNA, 19 nt, Salmonella enterica enterica serovar Typhi
gccgcucaggguaaucacc

SEQ ID NO: 1673068 - RNA, 20 nt, Salmonella enterica enterica serovar Typhi
gccgcuaucugcuccgccag

SEQ ID NO: 1673069 - RNA, 16 nt, Salmonella enterica enterica serovar Typhi
gccgcgugcucgcggc

SEQ ID NO: 1673070 - RNA, 18 nt, Salmonella enterica enterica serovar Typhi
gccggugaucccaccagc

SEQ ID NO: 1673071 - RNA, 16 nt, Salmonella enterica enterica serovar Typhi
gccggucggcgcguca

SEQ ID NO: 1673072 - RNA, 17 nt, Salmonella enterica enterica serovar Typhi
gccggugccauuccagc

SEQ ID NO: 1673073 - RNA, 21 nt, Salmonella enterica enterica serovar Typhi
gccggugccgcaaucgguuuc

SEQ ID NO: 1673074 - RNA, 15 nt, Salmonella enterica enterica serovar Typhi
gccgggcugaccgcu

SEQ ID NO: 1673075 - RNA, 21 nt, Salmonella enterica enterica serovar Typhi
gccgggcuauccggcuguucg

SEQ ID NO: 1673076 - RNA, 20 nt, Salmonella enterica enterica serovar Typhi
gccgggcgucacccgccggc

SEQ ID NO: 1673077 - RNA, 19 nt, Salmonella enterica enterica serovar Typhi
gccgguacuggagaccggc

SEQ ID NO: 1673078 - RNA, 21 nt, Salmonella enterica enterica serovar Typhi
gccgguacgcagcaggcagac

SEQ ID NO: 1673079 - RNA, 13 nt, Salmonella enterica enterica serovar Typhi
gccgguauccagc

SEQ ID NO: 1673080 - RNA, 17 nt, Salmonella enterica enterica serovar Typhi
gccgguauccagcgcgu

SEQ ID NO: 1673081 - RNA, 15 nt, Salmonella enterica enterica serovar Typhi
gccgucggcgccagc

SEQ ID NO: 1673082 - RNA, 20 nt, Salmonella enterica enterica serovar Typhi
gccgucgaugauggcggcua

SEQ ID NO: 1673083 - RNA, 15 nt, Salmonella enterica enterica serovar Typhi
gccguuaauuuucac

SEQ ID NO: 1673084 - RNA, 15 nt, Salmonella enterica enterica serovar Typhi
gccguuaccguggcg

SEQ ID NO: 1673085 - RNA, 15 nt, Salmonella enterica enterica serovar Typhi
gccguggaacgugcc

SEQ ID NO: 1673086 - RNA, 13 nt, Salmonella enterica enterica serovar Typhi
gccguuacuguuu

SEQ ID NO: 1673087 - RNA, 15 nt, Salmonella enterica enterica serovar Typhi
gccguuagcgccuuu

SEQ ID NO: 1673088 - RNA, 20 nt, Salmonella enterica enterica serovar Typhi
gccguucauucgccccagca

SEQ ID NO: 1673089 - RNA, 22 nt, Salmonella enterica enterica serovar Typhi
gccguucauucgccccagcaua

SEQ ID NO: 1673090 - RNA, 21 nt, Salmonella enterica enterica serovar Typhi
gccgugcguuuugugcggccu

SEQ ID NO: 1673091 - RNA, 19 nt, Salmonella enterica enterica serovar Typhi
gccgugcgccgacaucgcc

SEQ ID NO: 1673092 - RNA, 22 nt, Salmonella enterica enterica serovar Typhi
gccgugacuguucacauccagc

SEQ ID NO: 1673093 - RNA, 18 nt, Salmonella enterica enterica serovar Typhi
gccgugccuggcgcuggg

SEQ ID NO: 1673094 - RNA, 21 nt, Salmonella enterica enterica serovar Typhi
gccgguuuauccccgcuggcg

SEQ ID NO: 1673095 - RNA, 23 nt, Salmonella enterica enterica serovar Typhi
gccgguuuauccccgcuggcgcg

SEQ ID NO: 1673096 - RNA, 17 nt, Salmonella enterica enterica serovar Typhi
gccguaaacaggcaggc

SEQ ID NO: 1673097 - RNA, 17 nt, Salmonella enterica enterica serovar Typhi
gccguaaauugagugga

SEQ ID NO: 1673098 - RNA, 22 nt, Salmonella enterica enterica serovar Typhi
gccguaaggcguaccgccgcga

SEQ ID NO: 1673099 - RNA, 16 nt, Salmonella enterica enterica serovar Typhi
gccgguugcgcugguu

SEQ ID NO: 1673100 - RNA, 18 nt, Salmonella enterica enterica serovar Typhi
gccgguuauaccgccauc

SEQ ID NO: 1673101 - RNA, 22 nt, Salmonella enterica enterica serovar Typhi
gccgguuagccacaaugacaug

SEQ ID NO: 1673102 - RNA, 19 nt, Salmonella enterica enterica serovar Typhi
gccguagaaaaugcgcugg

SEQ ID NO: 1673103 - RNA, 13 nt, Salmonella enterica enterica serovar Typhi
gccguaggagaua

SEQ ID NO: 1673104 - RNA, 18 nt, Salmonella enterica enterica serovar Typhi
gccguagcccgcuuuacc

SEQ ID NO: 1673105 - RNA, 22 nt, Salmonella enterica enterica serovar Typhi
gccgucaacacgcagacccagg

SEQ ID NO: 1673106 - RNA, 17 nt, Salmonella enterica enterica serovar Typhi
gccgucacagagagcgu

SEQ ID NO: 1673107 - RNA, 18 nt, Salmonella enterica enterica serovar Typhi
gccguauucuuacccacc

SEQ ID NO: 1673108 - RNA, 18 nt, Salmonella enterica enterica serovar Typhi
gccgucaggcuugccgcg

SEQ ID NO: 1673109 - RNA, 17 nt, Salmonella enterica enterica serovar Typhi
gccgucagugagcccuc

SEQ ID NO: 1673110 - RNA, 18 nt, Salmonella enterica enterica serovar Typhi
gccgucauaccgcccaug

SEQ ID NO: 1673111 - RNA, 21 nt, Salmonella enterica enterica serovar Typhi
gccgucagacaggccugguua

SEQ ID NO: 1673112 - RNA, 13 nt, Salmonella enterica enterica serovar Typhi
gcaucggcaucaa

SEQ ID NO: 1673113 - RNA, 17 nt, Salmonella enterica enterica serovar Typhi
gcaucguaagccgcauu

SEQ ID NO: 1673114 - RNA, 22 nt, Salmonella enterica enterica serovar Typhi
gcaucgguagaaugaauguagc

SEQ ID NO: 1673115 - RNA, 23 nt, Salmonella enterica enterica serovar Typhi
gcaucgauuuuucaucuucagua

SEQ ID NO: 1673116 - RNA, 12 nt, Salmonella enterica enterica serovar Typhi
gcaucgccgccc

SEQ ID NO: 1673117 - RNA, 19 nt, Salmonella enterica enterica serovar Typhi
gcaucgccgcggcgcuggc

SEQ ID NO: 1673118 - RNA, 21 nt, Salmonella enterica enterica serovar Typhi
gcaucgcugcgcuuacacacc

SEQ ID NO: 1673119 - RNA, 15 nt, Salmonella enterica enterica serovar Typhi
gcaucgcuccccaac

SEQ ID NO: 1673120 - RNA, 13 nt, Salmonella enterica enterica serovar Typhi
gcaucgcggucag

SEQ ID NO: 1673121 - RNA, 22 nt, Salmonella enterica enterica serovar Typhi
gcaucgccgguagcuucagcgg

SEQ ID NO: 1673122 - RNA, 14 nt, Salmonella enterica enterica serovar Typhi
gcaucgugagcgcg

SEQ ID NO: 1673123 - RNA, 15 nt, Salmonella enterica enterica serovar Typhi
gcaucgugagcgcgu

SEQ ID NO: 1673124 - RNA, 22 nt, Salmonella enterica enterica serovar Typhi
gcaucguacgggcaaaaucuuc

SEQ ID NO: 1673125 - RNA, 14 nt, Salmonella enterica enterica serovar Typhi
gcaucguagucagg

SEQ ID NO: 1673126 - RNA, 21 nt, Salmonella enterica enterica serovar Typhi
gcaucuccucgcacuggcgag

SEQ ID NO: 1673127 - RNA, 20 nt, Salmonella enterica enterica serovar Typhi
gcaucucgccauaauuguuc

SEQ ID NO: 1673128 - RNA, 16 nt, Salmonella enterica enterica serovar Typhi
gcaucugucaucgccg

SEQ ID NO: 1673129 - RNA, 12 nt, Salmonella enterica enterica serovar Typhi
gcaucugucauc

SEQ ID NO: 1673130 - RNA, 20 nt, Salmonella enterica enterica serovar Typhi
gcaugcccgccagcgggccg

SEQ ID NO: 1673131 - RNA, 12 nt, Salmonella enterica enterica serovar Typhi
gcaugcgcugga

SEQ ID NO: 1673132 - RNA, 13 nt, Salmonella enterica enterica serovar Typhi
gcaugauuacaga

SEQ ID NO: 1673133 - RNA, 16 nt, Salmonella enterica enterica serovar Typhi
gcaugauuaagcuggg

SEQ ID NO: 1673134 - RNA, 18 nt, Salmonella enterica enterica serovar Typhi
gcaugauguccagcgcgc

SEQ ID NO: 1673135 - RNA, 13 nt, Salmonella enterica enterica serovar Typhi
gcaugagccagcc

SEQ ID NO: 1673136 - RNA, 18 nt, Salmonella enterica enterica serovar Typhi
gcaugagguuaguaaugc

SEQ ID NO: 1673137 - RNA, 21 nt, Salmonella enterica enterica serovar Typhi
gcaugaucauacugccgccgu

SEQ ID NO: 1673138 - RNA, 15 nt, Salmonella enterica enterica serovar Typhi
gcaugaucggcuggg

SEQ ID NO: 1673139 - RNA, 14 nt, Salmonella enterica enterica serovar Typhi
gcaugaugccacga

SEQ ID NO: 1673140 - RNA, 18 nt, Salmonella enterica enterica serovar Typhi
gcaucuuccucugugccg

SEQ ID NO: 1673141 - RNA, 14 nt, Salmonella enterica enterica serovar Typhi
gcaucuuuguucug

SEQ ID NO: 1673142 - RNA, 15 nt, Salmonella enterica enterica serovar Typhi
gcaucuuuccggaac

SEQ ID NO: 1673143 - RNA, 17 nt, Salmonella enterica enterica serovar Typhi
gcaucuuuaaccgccug

SEQ ID NO: 1673144 - RNA, 13 nt, Salmonella enterica enterica serovar Typhi
gcaugaauaucaa

SEQ ID NO: 1673145 - RNA, 20 nt, Salmonella enterica enterica serovar Typhi
gcaugaauaaccucccgccg

SEQ ID NO: 1673146 - RNA, 14 nt, Salmonella enterica enterica serovar Typhi
gcaugacccaggca

SEQ ID NO: 1673147 - RNA, 17 nt, Salmonella enterica enterica serovar Typhi
gcauguuaugaauaguu

SEQ ID NO: 1673148 - RNA, 20 nt, Salmonella enterica enterica serovar Typhi
gcauguacaacuucaugagu

SEQ ID NO: 1673149 - RNA, 19 nt, Salmonella enterica enterica serovar Typhi
gcauggugcagccgccauc

SEQ ID NO: 1673150 - RNA, 15 nt, Salmonella enterica enterica serovar Typhi
gcauuaacguccaua

SEQ ID NO: 1673151 - RNA, 17 nt, Salmonella enterica enterica serovar Typhi
gcauuaacguccauacc

SEQ ID NO: 1673152 - RNA, 15 nt, Salmonella enterica enterica serovar Typhi
gcauuaauuucuugc

SEQ ID NO: 1673153 - RNA, 13 nt, Salmonella enterica enterica serovar Typhi
gcauuacauucau

SEQ ID NO: 1673154 - RNA, 19 nt, Salmonella enterica enterica serovar Typhi
gcauuacgcuggccccuuu

SEQ ID NO: 1673155 - RNA, 19 nt, Salmonella enterica enterica serovar Typhi
gcauuagcaugggcuaaag

SEQ ID NO: 1673156 - RNA, 17 nt, Salmonella enterica enterica serovar Typhi
gcauuagcgccaccgag

SEQ ID NO: 1673157 - RNA, 20 nt, Salmonella enterica enterica serovar Typhi
gcauuagcgcgauaaaacca

SEQ ID NO: 1673158 - RNA, 23 nt, Salmonella enterica enterica serovar Typhi
gcauggugacuccccacaauccc

SEQ ID NO: 1673159 - RNA, 18 nt, Salmonella enterica enterica serovar Typhi
gcaugguguucagauggc

SEQ ID NO: 1673160 - RNA, 14 nt, Salmonella enterica enterica serovar Typhi
gcaugguccggugc

SEQ ID NO: 1673161 - RNA, 17 nt, Salmonella enterica enterica serovar Typhi
gcauggguaaagcccau

SEQ ID NO: 1673162 - RNA, 22 nt, Salmonella enterica enterica serovar Typhi
gcauggggagaccccacacuac

SEQ ID NO: 1673163 - RNA, 14 nt, Salmonella enterica enterica serovar Typhi
gcaugggaaauaac

SEQ ID NO: 1673164 - RNA, 17 nt, Salmonella enterica enterica serovar Typhi
gcauggcggucagcuuu

SEQ ID NO: 1673165 - RNA, 21 nt, Salmonella enterica enterica serovar Typhi
gcaugggauacgccagcagac

SEQ ID NO: 1673166 - RNA, 19 nt, Salmonella enterica enterica serovar Typhi
gcaugggcagcuugccgcc

SEQ ID NO: 1673167 - RNA, 23 nt, Salmonella enterica enterica serovar Typhi
gcauggcagauaaaccacgccgu

SEQ ID NO: 1673168 - RNA, 20 nt, Salmonella enterica enterica serovar Typhi
gcauggaugcaugagcacgc

SEQ ID NO: 1673169 - RNA, 16 nt, Salmonella enterica enterica serovar Typhi
gcauuccccaucgcga

SEQ ID NO: 1673170 - RNA, 12 nt, Salmonella enterica enterica serovar Typhi
gcauucacgcca

SEQ ID NO: 1673171 - RNA, 14 nt, Salmonella enterica enterica serovar Typhi
gcauucacgccacc

SEQ ID NO: 1673172 - RNA, 11 nt, Salmonella enterica enterica serovar Typhi
gcauuauaaau

SEQ ID NO: 1673173 - RNA, 20 nt, Salmonella enterica enterica serovar Typhi
gcauugagacaugccgccag

SEQ ID NO: 1673174 - RNA, 18 nt, Salmonella enterica enterica serovar Typhi
gcauucgcagcagacguu

SEQ ID NO: 1673175 - RNA, 17 nt, Salmonella enterica enterica serovar Typhi
gcauucucgccgugacu

SEQ ID NO: 1673176 - RNA, 19 nt, Salmonella enterica enterica serovar Typhi
gcauuguuaauccagagcg

SEQ ID NO: 1673177 - RNA, 16 nt, Salmonella enterica enterica serovar Typhi
gcauuguuaauccaga

SEQ ID NO: 1673178 - RNA, 16 nt, Salmonella enterica enterica serovar Typhi
gcauuucaaucgccac

SEQ ID NO: 1673179 - RNA, 14 nt, Salmonella enterica enterica serovar Typhi
gcauuuaggucuug

SEQ ID NO: 1673180 - RNA, 19 nt, Salmonella enterica enterica serovar Typhi
gcauuuaacggcuuacugc

SEQ ID NO: 1673181 - RNA, 16 nt, Salmonella enterica enterica serovar Typhi
gcauugccggaaacca

SEQ ID NO: 1673182 - RNA, 21 nt, Salmonella enterica enterica serovar Typhi
gcauuggcguuaccggcaggc

SEQ ID NO: 1673183 - RNA, 21 nt, Salmonella enterica enterica serovar Typhi
gccaaauuuucaaccacggau

SEQ ID NO: 1673184 - RNA, 19 nt, Salmonella enterica enterica serovar Typhi
gccaacaacaggccgccga

SEQ ID NO: 1673185 - RNA, 19 nt, Salmonella enterica enterica serovar Typhi
gccaaauuuagugcucagc

SEQ ID NO: 1673186 - RNA, 18 nt, Salmonella enterica enterica serovar Typhi
gccaaccgccacaauauc

SEQ ID NO: 1673187 - RNA, 20 nt, Salmonella enterica enterica serovar Typhi
gccaaccaccgcggagaucg

SEQ ID NO: 1673188 - RNA, 19 nt, Salmonella enterica enterica serovar Typhi
gccaacauagccacaggcu

SEQ ID NO: 1673189 - RNA, 17 nt, Salmonella enterica enterica serovar Typhi
gccaagcgcggcagcag

SEQ ID NO: 1673190 - RNA, 12 nt, Salmonella enterica enterica serovar Typhi
gccaagcgcggc

SEQ ID NO: 1673191 - RNA, 17 nt, Salmonella enterica enterica serovar Typhi
gccaagcagcgccacgc

SEQ ID NO: 1673192 - RNA, 15 nt, Salmonella enterica enterica serovar Typhi
gccaagcaacacggc

SEQ ID NO: 1673193 - RNA, 19 nt, Salmonella enterica enterica serovar Typhi
gccaagaccgccuaacagc

SEQ ID NO: 1673194 - RNA, 14 nt, Salmonella enterica enterica serovar Typhi
gccaacuuuuucuu

SEQ ID NO: 1673195 - RNA, 21 nt, Salmonella enterica enterica serovar Typhi
gccaacgauacagcacggcag

SEQ ID NO: 1673196 - RNA, 13 nt, Salmonella enterica enterica serovar Typhi
gccaaaaccgcuc

SEQ ID NO: 1673197 - RNA, 22 nt, Salmonella enterica enterica serovar Typhi
gccaaaacccaccagcagggca

SEQ ID NO: 1673198 - RNA, 18 nt, Salmonella enterica enterica serovar Typhi
gccaaaacggucgguaau

SEQ ID NO: 1673199 - RNA, 16 nt, Salmonella enterica enterica serovar Typhi
gccaaaagaggcagca

SEQ ID NO: 1673200 - RNA, 17 nt, Salmonella enterica enterica serovar Typhi
gccaaaagaggcagcaa

SEQ ID NO: 1673201 - RNA, 14 nt, Salmonella enterica enterica serovar Typhi
gccaaaccacugau

SEQ ID NO: 1673202 - RNA, 14 nt, Salmonella enterica enterica serovar Typhi
gccaaaccagaccc

SEQ ID NO: 1673203 - RNA, 17 nt, Salmonella enterica enterica serovar Typhi
gccaaacuccaccugau

SEQ ID NO: 1673204 - RNA, 13 nt, Salmonella enterica enterica serovar Typhi
gccaaacuccuca

SEQ ID NO: 1673205 - RNA, 15 nt, Salmonella enterica enterica serovar Typhi
gccaaacguggcggc

SEQ ID NO: 1673206 - RNA, 18 nt, Salmonella enterica enterica serovar Typhi
gccaaagucauugcugcc

SEQ ID NO: 1673207 - RNA, 15 nt, Salmonella enterica enterica serovar Typhi
gccaaaucagcagga

SEQ ID NO: 1673208 - RNA, 22 nt, Salmonella enterica enterica serovar Typhi
gccaaacuggcaaauaaaauag

SEQ ID NO: 1673209 - RNA, 21 nt, Salmonella enterica enterica serovar Typhi
gccaaacucuuuuucaauaaa

SEQ ID NO: 1673210 - RNA, 12 nt, Salmonella enterica enterica serovar Typhi
gccaaagggagc

SEQ ID NO: 1673211 - RNA, 15 nt, Salmonella enterica enterica serovar Typhi
gccaaaaaaucgcug

SEQ ID NO: 1673212 - RNA, 16 nt, Salmonella enterica enterica serovar Typhi
gcauuuuggccgggau

SEQ ID NO: 1673213 - RNA, 14 nt, Salmonella enterica enterica serovar Typhi
gcauuucgccgcca

SEQ ID NO: 1673214 - RNA, 12 nt, Salmonella enterica enterica serovar Typhi
gcauuucuucaa

SEQ ID NO: 1673215 - RNA, 17 nt, Salmonella enterica enterica serovar Typhi
gcauuuuaucuuuuguu

SEQ ID NO: 1673216 - RNA, 20 nt, Salmonella enterica enterica serovar Typhi
gcauuugucgcuguuaaucu

SEQ ID NO: 1673217 - RNA, 16 nt, Salmonella enterica enterica serovar Typhi
gccacacucucuccag

SEQ ID NO: 1673218 - RNA, 12 nt, Salmonella enterica enterica serovar Typhi
gccacagcaaau

SEQ ID NO: 1673219 - RNA, 21 nt, Salmonella enterica enterica serovar Typhi
gccacagauuaugcaguucuu

SEQ ID NO: 1673220 - RNA, 19 nt, Salmonella enterica enterica serovar Typhi
gccaccacaaacgccguca

SEQ ID NO: 1673221 - RNA, 13 nt, Salmonella enterica enterica serovar Typhi
gccaccacaaagc

SEQ ID NO: 1673222 - RNA, 14 nt, Salmonella enterica enterica serovar Typhi
gccaccacaaagcg

SEQ ID NO: 1673223 - RNA, 23 nt, Salmonella enterica enterica serovar Typhi
gccaccaaaaacgcccccagaua

SEQ ID NO: 1673224 - RNA, 20 nt, Salmonella enterica enterica serovar Typhi
gccaccaaagccaggccgcc

SEQ ID NO: 1673225 - RNA, 19 nt, Salmonella enterica enterica serovar Typhi
gccacauuguaugcaagaa

SEQ ID NO: 1673226 - RNA, 23 nt, Salmonella enterica enterica serovar Typhi
gccaccaaagccaggccgccagc

SEQ ID NO: 1673227 - RNA, 22 nt, Salmonella enterica enterica serovar Typhi
gccacauuucccgagccggguu

SEQ ID NO: 1673228 - RNA, 20 nt, Salmonella enterica enterica serovar Typhi
gccacagcgguauaucugua

SEQ ID NO: 1673229 - RNA, 12 nt, Salmonella enterica enterica serovar Typhi
gccacagccgca

SEQ ID NO: 1673230 - RNA, 17 nt, Salmonella enterica enterica serovar Typhi
gccacccacuucgccgg

SEQ ID NO: 1673231 - RNA, 21 nt, Salmonella enterica enterica serovar Typhi
gccaccaugauuaccugaagc

SEQ ID NO: 1673232 - RNA, 17 nt, Salmonella enterica enterica serovar Typhi
gccaccaugcugguugg

SEQ ID NO: 1673233 - RNA, 18 nt, Salmonella enterica enterica serovar Typhi
gccaccaucuuuuuugcg

SEQ ID NO: 1673234 - RNA, 17 nt, Salmonella enterica enterica serovar Typhi
gccaccaucgucgccag

SEQ ID NO: 1673235 - RNA, 13 nt, Salmonella enterica enterica serovar Typhi
gccaccauaucuu

SEQ ID NO: 1673236 - RNA, 13 nt, Salmonella enterica enterica serovar Typhi
gccaaucacugcg

SEQ ID NO: 1673237 - RNA, 14 nt, Salmonella enterica enterica serovar Typhi
gccaauccugcacc

SEQ ID NO: 1673238 - RNA, 24 nt, Salmonella enterica enterica serovar Typhi
gccaauacgggagagcguauccag

SEQ ID NO: 1673239 - RNA, 17 nt, Salmonella enterica enterica serovar Typhi
gccaauaauuuuagaaa

SEQ ID NO: 1673240 - RNA, 15 nt, Salmonella enterica enterica serovar Typhi
gccaauaggggcgga

SEQ ID NO: 1673241 - RNA, 17 nt, Salmonella enterica enterica serovar Typhi
gccaaggcaucugcgca

SEQ ID NO: 1673242 - RNA, 16 nt, Salmonella enterica enterica serovar Typhi
gccaagcugcagaauc

SEQ ID NO: 1673243 - RNA, 18 nt, Salmonella enterica enterica serovar Typhi
gccaauaaucaaaugauu

SEQ ID NO: 1673244 - RNA, 14 nt, Salmonella enterica enterica serovar Typhi
gccacaacagaagc

SEQ ID NO: 1673245 - RNA, 18 nt, Salmonella enterica enterica serovar Typhi
gccacaacagaagcggcc

SEQ ID NO: 1673246 - RNA, 23 nt, Salmonella enterica enterica serovar Typhi
gccacaacggcaauuuuuacaaa

SEQ ID NO: 1673247 - RNA, 18 nt, Salmonella enterica enterica serovar Typhi
gccacaauugccagcagg

SEQ ID NO: 1673248 - RNA, 21 nt, Salmonella enterica enterica serovar Typhi
gccacaaugggggcauaauac

SEQ ID NO: 1673249 - RNA, 12 nt, Salmonella enterica enterica serovar Typhi
gccacaaugaca

SEQ ID NO: 1673250 - RNA, 19 nt, Salmonella enterica enterica serovar Typhi
gccaaugccggacgccacc

SEQ ID NO: 1673251 - RNA, 20 nt, Salmonella enterica enterica serovar Typhi
gccaaugcgaaaauacuccc

SEQ ID NO: 1673252 - RNA, 15 nt, Salmonella enterica enterica serovar Typhi
gccaaugaaauaauu

SEQ ID NO: 1673253 - RNA, 11 nt, Salmonella enterica enterica serovar Typhi
gccaaugaacu

SEQ ID NO: 1673254 - RNA, 19 nt, Salmonella enterica enterica serovar Typhi
gccaauguacguaaaacca

SEQ ID NO: 1673255 - RNA, 21 nt, Salmonella enterica enterica serovar Typhi
gccacuuccagcgcgccguca

SEQ ID NO: 1673256 - RNA, 14 nt, Salmonella enterica enterica serovar Typhi
gccacuucuuccag

SEQ ID NO: 1673257 - RNA, 18 nt, Salmonella enterica enterica serovar Typhi
gccacuucuuccagcggc

SEQ ID NO: 1673258 - RNA, 16 nt, Salmonella enterica enterica serovar Typhi
gccacuugaaguauga

SEQ ID NO: 1673259 - RNA, 13 nt, Salmonella enterica enterica serovar Typhi
gccacugcgccau

SEQ ID NO: 1673260 - RNA, 16 nt, Salmonella enterica enterica serovar Typhi
gccacuuccagcgcgc

SEQ ID NO: 1673261 - RNA, 16 nt, Salmonella enterica enterica serovar Typhi
gccagcaaugccgccg

SEQ ID NO: 1673262 - RNA, 15 nt, Salmonella enterica enterica serovar Typhi
gccagcaccagcagu

SEQ ID NO: 1673263 - RNA, 19 nt, Salmonella enterica enterica serovar Typhi
gccagcaccagcagcgcau

SEQ ID NO: 1673264 - RNA, 15 nt, Salmonella enterica enterica serovar Typhi
gccagcaccagcagc

SEQ ID NO: 1673265 - RNA, 14 nt, Salmonella enterica enterica serovar Typhi
gccagcaccacuac

SEQ ID NO: 1673266 - RNA, 18 nt, Salmonella enterica enterica serovar Typhi
gccagcaacgcccagaua

SEQ ID NO: 1673267 - RNA, 14 nt, Salmonella enterica enterica serovar Typhi
gccagaggcgugca

SEQ ID NO: 1673268 - RNA, 14 nt, Salmonella enterica enterica serovar Typhi
gccagcaacagcgu

SEQ ID NO: 1673269 - RNA, 13 nt, Salmonella enterica enterica serovar Typhi
gccagcaauaaca

SEQ ID NO: 1673270 - RNA, 20 nt, Salmonella enterica enterica serovar Typhi
gccagcaacguuaaggccgc

SEQ ID NO: 1673271 - RNA, 23 nt, Salmonella enterica enterica serovar Typhi
gccagacgaugaauuccugcggc

SEQ ID NO: 1673272 - RNA, 16 nt, Salmonella enterica enterica serovar Typhi
gccagcauuuuuccac

SEQ ID NO: 1673273 - RNA, 22 nt, Salmonella enterica enterica serovar Typhi
gccagcauuucaaucgcgcccg

SEQ ID NO: 1673274 - RNA, 17 nt, Salmonella enterica enterica serovar Typhi
gccagcauuuccagcug

SEQ ID NO: 1673275 - RNA, 23 nt, Salmonella enterica enterica serovar Typhi
gccagccauggcccaaaagguag

SEQ ID NO: 1673276 - RNA, 16 nt, Salmonella enterica enterica serovar Typhi
gccagccauggcccuu

SEQ ID NO: 1673277 - RNA, 16 nt, Salmonella enterica enterica serovar Typhi
gccagccauucaccac

SEQ ID NO: 1673278 - RNA, 17 nt, Salmonella enterica enterica serovar Typhi
gccagccauucaccacu

SEQ ID NO: 1673279 - RNA, 20 nt, Salmonella enterica enterica serovar Typhi
gccagccauugaugcaggcg

SEQ ID NO: 1673280 - RNA, 14 nt, Salmonella enterica enterica serovar Typhi
gccagccccagccc

SEQ ID NO: 1673281 - RNA, 20 nt, Salmonella enterica enterica serovar Typhi
gccagcccgaucaucuccug

SEQ ID NO: 1673282 - RNA, 22 nt, Salmonella enterica enterica serovar Typhi
gccagcccgaucaucuccugua

SEQ ID NO: 1673283 - RNA, 22 nt, Salmonella enterica enterica serovar Typhi
gccagccgacgcucuuccucaa

SEQ ID NO: 1673284 - RNA, 20 nt, Salmonella enterica enterica serovar Typhi
gccagcagcauaaaaccgcc

SEQ ID NO: 1673285 - RNA, 16 nt, Salmonella enterica enterica serovar Typhi
gccagcauaccgccca

SEQ ID NO: 1673286 - RNA, 15 nt, Salmonella enterica enterica serovar Typhi
gccagcagcucgccg

SEQ ID NO: 1673287 - RNA, 11 nt, Salmonella enterica enterica serovar Typhi
gccagcaguug

SEQ ID NO: 1673288 - RNA, 20 nt, Salmonella enterica enterica serovar Typhi
gccagcaguuuuucaaucuu

SEQ ID NO: 1673289 - RNA, 23 nt, Salmonella enterica enterica serovar Typhi
gccagcaguuuuucaaucuuagc

SEQ ID NO: 1673290 - RNA, 19 nt, Salmonella enterica enterica serovar Typhi
gccaggcggcaaagucuuc

SEQ ID NO: 1673291 - RNA, 14 nt, Salmonella enterica enterica serovar Typhi
gccaggcuuccugc

SEQ ID NO: 1673292 - RNA, 17 nt, Salmonella enterica enterica serovar Typhi
gccaggggaugauuuuc

SEQ ID NO: 1673293 - RNA, 21 nt, Salmonella enterica enterica serovar Typhi
gccaggggaugauuuucaggc

SEQ ID NO: 1673294 - RNA, 18 nt, Salmonella enterica enterica serovar Typhi
gccaggugacuuugcccu

SEQ ID NO: 1673295 - RNA, 16 nt, Salmonella enterica enterica serovar Typhi
gccaggugccgagguu

SEQ ID NO: 1673296 - RNA, 13 nt, Salmonella enterica enterica serovar Typhi
gccaggcgccacg

SEQ ID NO: 1673297 - RNA, 19 nt, Salmonella enterica enterica serovar Typhi
gccaggcgcuaucuucaau

SEQ ID NO: 1673298 - RNA, 15 nt, Salmonella enterica enterica serovar Typhi
gccaggcgauuguca

SEQ ID NO: 1673299 - RNA, 18 nt, Salmonella enterica enterica serovar Typhi
gccaggcacguuaaacac

SEQ ID NO: 1673300 - RNA, 15 nt, Salmonella enterica enterica serovar Typhi
gccaggauaauaaug

SEQ ID NO: 1673301 - RNA, 20 nt, Salmonella enterica enterica serovar Typhi
gccagcuuaaaucgcggcgc

SEQ ID NO: 1673302 - RNA, 16 nt, Salmonella enterica enterica serovar Typhi
gccaggaucgccgccg

SEQ ID NO: 1673303 - RNA, 19 nt, Salmonella enterica enterica serovar Typhi
gccaggcaaagccccaguc

SEQ ID NO: 1673304 - RNA, 17 nt, Salmonella enterica enterica serovar Typhi
gccagcgacaucccaga

SEQ ID NO: 1673305 - RNA, 19 nt, Salmonella enterica enterica serovar Typhi
gccagcgacaacgcuuccg

SEQ ID NO: 1673306 - RNA, 14 nt, Salmonella enterica enterica serovar Typhi
gccagcgagaaguc

SEQ ID NO: 1673307 - RNA, 14 nt, Salmonella enterica enterica serovar Typhi
gccagccgccgccg

SEQ ID NO: 1673308 - RNA, 18 nt, Salmonella enterica enterica serovar Typhi
gccagccgccaaaaauau

SEQ ID NO: 1673309 - RNA, 13 nt, Salmonella enterica enterica serovar Typhi
gccagccgccgcc

SEQ ID NO: 1673310 - RNA, 13 nt, Salmonella enterica enterica serovar Typhi
gccagcgccgccg

SEQ ID NO: 1673311 - RNA, 14 nt, Salmonella enterica enterica serovar Typhi
gccagcgacgcaug

SEQ ID NO: 1673312 - RNA, 12 nt, Salmonella enterica enterica serovar Typhi
gccagcgccgcc

SEQ ID NO: 1673313 - RNA, 18 nt, Salmonella enterica enterica serovar Typhi
gccagcuaccgcucaggc

SEQ ID NO: 1673314 - RNA, 21 nt, Salmonella enterica enterica serovar Typhi
gccagcuaccgcucaggcgcg

SEQ ID NO: 1673315 - RNA, 18 nt, Salmonella enterica enterica serovar Typhi
gccagcuacaccugggcu

SEQ ID NO: 1673316 - RNA, 20 nt, Salmonella enterica enterica serovar Typhi
gccagcuacaccugggcuug

SEQ ID NO: 1673317 - RNA, 17 nt, Salmonella enterica enterica serovar Typhi
gccagcgugcgcagcgc

SEQ ID NO: 1673318 - RNA, 14 nt, Salmonella enterica enterica serovar Typhi
gccagcucuuuucu

SEQ ID NO: 1673319 - RNA, 16 nt, Salmonella enterica enterica serovar Typhi
gccagcggccagccau

SEQ ID NO: 1673320 - RNA, 16 nt, Salmonella enterica enterica serovar Typhi
gccagcgugacccaga

SEQ ID NO: 1673321 - RNA, 17 nt, Salmonella enterica enterica serovar Typhi
gccagcgcuacccgcug

SEQ ID NO: 1673322 - RNA, 20 nt, Salmonella enterica enterica serovar Typhi
gccagcgcuaauugugcggg

SEQ ID NO: 1673323 - RNA, 23 nt, Salmonella enterica enterica serovar Typhi
gccagcgcuaauugugcgggggu

SEQ ID NO: 1673324 - RNA, 22 nt, Salmonella enterica enterica serovar Typhi
gccagcgcguuuuccauuuuac

SEQ ID NO: 1673325 - RNA, 19 nt, Salmonella enterica enterica serovar Typhi
gccagcgcguuuuccauuu

SEQ ID NO: 1673326 - RNA, 18 nt, Salmonella enterica enterica serovar Typhi
gccagcggaucgcgucca

SEQ ID NO: 1673327 - RNA, 16 nt, Salmonella enterica enterica serovar Typhi
gccaugucuucacucu

SEQ ID NO: 1673328 - RNA, 19 nt, Salmonella enterica enterica serovar Typhi
gccauguugcguaaauaaa

SEQ ID NO: 1673329 - RNA, 15 nt, Salmonella enterica enterica serovar Typhi
gccauguuccucaca

SEQ ID NO: 1673330 - RNA, 16 nt, Salmonella enterica enterica serovar Typhi
gccauguuaauaccag

SEQ ID NO: 1673331 - RNA, 20 nt, Salmonella enterica enterica serovar Typhi
gccauuaaugcaggcagcac

SEQ ID NO: 1673332 - RNA, 18 nt, Salmonella enterica enterica serovar Typhi
gccauuauuguguucuca

SEQ ID NO: 1673333 - RNA, 19 nt, Salmonella enterica enterica serovar Typhi
gccauuaaugcaggcagca

SEQ ID NO: 1673334 - RNA, 14 nt, Salmonella enterica enterica serovar Typhi
gccauucauuaaaa

SEQ ID NO: 1673335 - RNA, 23 nt, Salmonella enterica enterica serovar Typhi
gccauucauuaaaauugaacgga

SEQ ID NO: 1673336 - RNA, 13 nt, Salmonella enterica enterica serovar Typhi
gccauucaccacu

SEQ ID NO: 1673337 - RNA, 14 nt, Salmonella enterica enterica serovar Typhi
gccauuccagccgg

SEQ ID NO: 1673338 - RNA, 18 nt, Salmonella enterica enterica serovar Typhi
gccauuccgcuucuucca

SEQ ID NO: 1673339 - RNA, 17 nt, Salmonella enterica enterica serovar Typhi
gccauuccgcagaagcc

SEQ ID NO: 1673340 - RNA, 15 nt, Salmonella enterica enterica serovar Typhi
gccauucgcuuccgc

SEQ ID NO: 1673341 - RNA, 13 nt, Salmonella enterica enterica serovar Typhi
gccauugaagucc

SEQ ID NO: 1673342 - RNA, 23 nt, Salmonella enterica enterica serovar Typhi
gccauucucuucuaccacgcugc

SEQ ID NO: 1673343 - RNA, 15 nt, Salmonella enterica enterica serovar Typhi
gccauggccgcagcc

SEQ ID NO: 1673344 - RNA, 21 nt, Salmonella enterica enterica serovar Typhi
gccaugguucacaauacagaa

SEQ ID NO: 1673345 - RNA, 19 nt, Salmonella enterica enterica serovar Typhi
gccauggcccuuuugcccg

SEQ ID NO: 1673346 - RNA, 13 nt, Salmonella enterica enterica serovar Typhi
gccauggccgcag

SEQ ID NO: 1673347 - RNA, 14 nt, Salmonella enterica enterica serovar Typhi
gccaugauccuggu

SEQ ID NO: 1673348 - RNA, 18 nt, Salmonella enterica enterica serovar Typhi
gccaugagccuguauggg

SEQ ID NO: 1673349 - RNA, 21 nt, Salmonella enterica enterica serovar Typhi
gccaugaucgccgccaucggc

SEQ ID NO: 1673350 - RNA, 15 nt, Salmonella enterica enterica serovar Typhi
gccaugaucgccgcc

SEQ ID NO: 1673351 - RNA, 17 nt, Salmonella enterica enterica serovar Typhi
gccaugcugugugacca

SEQ ID NO: 1673352 - RNA, 12 nt, Salmonella enterica enterica serovar Typhi
gccauggagaaa

SEQ ID NO: 1673353 - RNA, 16 nt, Salmonella enterica enterica serovar Typhi
gccaucuucacgcagc

SEQ ID NO: 1673354 - RNA, 14 nt, Salmonella enterica enterica serovar Typhi
gccaucuuccagca

SEQ ID NO: 1673355 - RNA, 17 nt, Salmonella enterica enterica serovar Typhi
gccaucuuccagcauca

SEQ ID NO: 1673356 - RNA, 18 nt, Salmonella enterica enterica serovar Typhi
gccaucuuccagcaucag

SEQ ID NO: 1673357 - RNA, 12 nt, Salmonella enterica enterica serovar Typhi
gccaucuuccuc

SEQ ID NO: 1673358 - RNA, 13 nt, Salmonella enterica enterica serovar Typhi
gccaucuuccuca

SEQ ID NO: 1673359 - RNA, 18 nt, Salmonella enterica enterica serovar Typhi
gccaucuuuacccugagc

SEQ ID NO: 1673360 - RNA, 15 nt, Salmonella enterica enterica serovar Typhi
gccaucaggaaauuc

SEQ ID NO: 1673361 - RNA, 23 nt, Salmonella enterica enterica serovar Typhi
gccaucaggcaguuuauccggcg

SEQ ID NO: 1673362 - RNA, 17 nt, Salmonella enterica enterica serovar Typhi
gccaucaggcaucugaa

SEQ ID NO: 1673363 - RNA, 17 nt, Salmonella enterica enterica serovar Typhi
gccaucaggcaaugucu

SEQ ID NO: 1673364 - RNA, 23 nt, Salmonella enterica enterica serovar Typhi
gccaucaggccccccuuguuauc

SEQ ID NO: 1673365 - RNA, 19 nt, Salmonella enterica enterica serovar Typhi
gccaucaggccccccuugu

SEQ ID NO: 1673366 - RNA, 18 nt, Salmonella enterica enterica serovar Typhi
gccaucaggcaucugaaa

SEQ ID NO: 1673367 - RNA, 15 nt, Salmonella enterica enterica serovar Typhi
gccaucaucaguaac

SEQ ID NO: 1673368 - RNA, 22 nt, Salmonella enterica enterica serovar Typhi
gccaucgacgcgcaucacaaug

SEQ ID NO: 1673369 - RNA, 19 nt, Salmonella enterica enterica serovar Typhi
gccauccugccgcaccagu

SEQ ID NO: 1673370 - RNA, 14 nt, Salmonella enterica enterica serovar Typhi
gccauccugcaccg

SEQ ID NO: 1673371 - RNA, 14 nt, Salmonella enterica enterica serovar Typhi
gccauccucacgca

SEQ ID NO: 1673372 - RNA, 23 nt, Salmonella enterica enterica serovar Typhi
gccauccugcgugccguugacca

SEQ ID NO: 1673373 - RNA, 17 nt, Salmonella enterica enterica serovar Typhi
gccaucucauucgccag

SEQ ID NO: 1673374 - RNA, 20 nt, Salmonella enterica enterica serovar Typhi
gccaucguaggcgcaaaccg

SEQ ID NO: 1673375 - RNA, 14 nt, Salmonella enterica enterica serovar Typhi
gccaguagcugcuc

SEQ ID NO: 1673376 - RNA, 15 nt, Salmonella enterica enterica serovar Typhi
gccaguagcucgccg

SEQ ID NO: 1673377 - RNA, 18 nt, Salmonella enterica enterica serovar Typhi
gccagguugcgcccggcg

SEQ ID NO: 1673378 - RNA, 23 nt, Salmonella enterica enterica serovar Typhi
gccagguuauuucgcgcaguuag

SEQ ID NO: 1673379 - RNA, 23 nt, Salmonella enterica enterica serovar Typhi
gccagucaauaagcuugcuuucc

SEQ ID NO: 1673380 - RNA, 23 nt, Salmonella enterica enterica serovar Typhi
gccaucagacucucaaugcccau

SEQ ID NO: 1673381 - RNA, 15 nt, Salmonella enterica enterica serovar Typhi
gcccaauagcgcuga

SEQ ID NO: 1673382 - RNA, 19 nt, Salmonella enterica enterica serovar Typhi
gcccacaaugacagaaaug

SEQ ID NO: 1673383 - RNA, 19 nt, Salmonella enterica enterica serovar Typhi
gcccaauguuuuaccggca

SEQ ID NO: 1673384 - RNA, 14 nt, Salmonella enterica enterica serovar Typhi
gcccaaugccccca

SEQ ID NO: 1673385 - RNA, 15 nt, Salmonella enterica enterica serovar Typhi
gcccaagcugacgga

SEQ ID NO: 1673386 - RNA, 23 nt, Salmonella enterica enterica serovar Typhi
gcccaacgcggcuuuaaguuuuu

SEQ ID NO: 1673387 - RNA, 19 nt, Salmonella enterica enterica serovar Typhi
gccauuuuauccaggccag

SEQ ID NO: 1673388 - RNA, 22 nt, Salmonella enterica enterica serovar Typhi
gcccaaaauagcguccagccgc

SEQ ID NO: 1673389 - RNA, 13 nt, Salmonella enterica enterica serovar Typhi
gccauuuuugcca

SEQ ID NO: 1673390 - RNA, 14 nt, Salmonella enterica enterica serovar Typhi
gccauuucugcuca

SEQ ID NO: 1673391 - RNA, 22 nt, Salmonella enterica enterica serovar Typhi
gccauuugcauccguagcuuca

SEQ ID NO: 1673392 - RNA, 20 nt, Salmonella enterica enterica serovar Typhi
gccauuucgccuauuuucuc

SEQ ID NO: 1673393 - RNA, 13 nt, Salmonella enterica enterica serovar Typhi
gccauuuccagcc

SEQ ID NO: 1673394 - RNA, 22 nt, Salmonella enterica enterica serovar Typhi
gccauuggcuauuuuuugcugg

SEQ ID NO: 1673395 - RNA, 12 nt, Salmonella enterica enterica serovar Typhi
gccauugccgcg

SEQ ID NO: 1673396 - RNA, 15 nt, Salmonella enterica enterica serovar Typhi
gccauuggcaaucag

SEQ ID NO: 1673397 - RNA, 14 nt, Salmonella enterica enterica serovar Typhi
gcccagcgccgaga

SEQ ID NO: 1673398 - RNA, 21 nt, Salmonella enterica enterica serovar Typhi
gcccagcgcgauacgcagcac

SEQ ID NO: 1673399 - RNA, 16 nt, Salmonella enterica enterica serovar Typhi
gcccagccaaagcgcc

SEQ ID NO: 1673400 - RNA, 16 nt, Salmonella enterica enterica serovar Typhi
gcccagagcgacaaug

SEQ ID NO: 1673401 - RNA, 18 nt, Salmonella enterica enterica serovar Typhi
gcccagagcgacaaugaa

SEQ ID NO: 1673402 - RNA, 23 nt, Salmonella enterica enterica serovar Typhi
gcccagagcgacaaugaaccagc

SEQ ID NO: 1673403 - RNA, 22 nt, Salmonella enterica enterica serovar Typhi
gcccagauaacgcaucagacug

SEQ ID NO: 1673404 - RNA, 23 nt, Salmonella enterica enterica serovar Typhi
gcccagauaaugccgcuggcgua

SEQ ID NO: 1673405 - RNA, 22 nt, Salmonella enterica enterica serovar Typhi
gcguuucacgcgcgccugccgc

SEQ ID NO: 1673406 - RNA, 14 nt, Salmonella enterica enterica serovar Typhi
gcuauaaaguuccc

SEQ ID NO: 1673407 - RNA, 23 nt, Salmonella enterica enterica serovar Typhi
gcuauaaaguucccaugcuucca

SEQ ID NO: 1673408 - RNA, 12 nt, Salmonella enterica enterica serovar Typhi
gcuauagcucag

SEQ ID NO: 1673409 - RNA, 14 nt, Salmonella enterica enterica serovar Typhi
gcuauacgcggcgu

SEQ ID NO: 1673410 - RNA, 18 nt, Salmonella enterica enterica serovar Typhi
gcuauagaaugcaagcag

SEQ ID NO: 1673411 - RNA, 19 nt, Salmonella enterica enterica serovar Typhi
gcuauaaucacagggguca

SEQ ID NO: 1673412 - RNA, 16 nt, Salmonella enterica enterica serovar Typhi
gcuauaccgcccgcgc

SEQ ID NO: 1673413 - RNA, 22 nt, Salmonella enterica enterica serovar Typhi
gcuaucucuuccagcgucucca

SEQ ID NO: 1673414 - RNA, 22 nt, Salmonella enterica enterica serovar Typhi
gcuaucugacagccaaacugcu

SEQ ID NO: 1673415 - RNA, 11 nt, Salmonella enterica enterica serovar Typhi
gcuaugaagac

SEQ ID NO: 1673416 - RNA, 22 nt, Salmonella enterica enterica serovar Typhi
gcuaugaagaccugcuucaggu

SEQ ID NO: 1673417 - RNA, 17 nt, Salmonella enterica enterica serovar Typhi
gcuaugaagcuggagcc

SEQ ID NO: 1673418 - RNA, 18 nt, Salmonella enterica enterica serovar Typhi
gcuaucuuuaugucagua

SEQ ID NO: 1673419 - RNA, 19 nt, Salmonella enterica enterica serovar Typhi
gcuauccggcgcgcuggug

SEQ ID NO: 1673420 - RNA, 14 nt, Salmonella enterica enterica serovar Typhi
gcuauccgccgcca

SEQ ID NO: 1673421 - RNA, 16 nt, Salmonella enterica enterica serovar Typhi
gcuauccggcgcgcug

SEQ ID NO: 1673422 - RNA, 20 nt, Salmonella enterica enterica serovar Typhi
gcuaucccaggcggagaaau

SEQ ID NO: 1673423 - RNA, 23 nt, Salmonella enterica enterica serovar Typhi
gcuaucccgaugcucagggcauc

SEQ ID NO: 1673424 - RNA, 14 nt, Salmonella enterica enterica serovar Typhi
gcuaucccaggcgg

SEQ ID NO: 1673425 - RNA, 20 nt, Salmonella enterica enterica serovar Typhi
gcuaucaggaagaacacgcc

SEQ ID NO: 1673426 - RNA, 16 nt, Salmonella enterica enterica serovar Typhi
gcuaucaggcacugaa

SEQ ID NO: 1673427 - RNA, 23 nt, Salmonella enterica enterica serovar Typhi
gcuaucaacgccuccaggcuacc

SEQ ID NO: 1673428 - RNA, 22 nt, Salmonella enterica enterica serovar Typhi
gcuaucaacgccuccaggcuac

SEQ ID NO: 1673429 - RNA, 20 nt, Salmonella enterica enterica serovar Typhi
gcuaucaagauaaaaagaca

SEQ ID NO: 1673430 - RNA, 14 nt, Salmonella enterica enterica serovar Typhi
gcuauauugcugcg

SEQ ID NO: 1673431 - RNA, 22 nt, Salmonella enterica enterica serovar Typhi
gcuauaguggauggcccacugu

SEQ ID NO: 1673432 - RNA, 15 nt, Salmonella enterica enterica serovar Typhi
gcuauuucaguggcu

SEQ ID NO: 1673433 - RNA, 12 nt, Salmonella enterica enterica serovar Typhi
gcuauuuaaccc

SEQ ID NO: 1673434 - RNA, 19 nt, Salmonella enterica enterica serovar Typhi
gcuauuccucgaucgccug

SEQ ID NO: 1673435 - RNA, 22 nt, Salmonella enterica enterica serovar Typhi
gcuauucauuauuuuuaaauaa

SEQ ID NO: 1673436 - RNA, 14 nt, Salmonella enterica enterica serovar Typhi
gcuauggcaacaaa

SEQ ID NO: 1673437 - RNA, 20 nt, Salmonella enterica enterica serovar Typhi
gcuaugcuuaccaucuggcc

SEQ ID NO: 1673438 - RNA, 14 nt, Salmonella enterica enterica serovar Typhi
gcuaugcuuaccau

SEQ ID NO: 1673439 - RNA, 16 nt, Salmonella enterica enterica serovar Typhi
gcuaugcgcuccagga

SEQ ID NO: 1673440 - RNA, 13 nt, Salmonella enterica enterica serovar Typhi
gcuaugcgccagu

SEQ ID NO: 1673441 - RNA, 21 nt, Salmonella enterica enterica serovar Typhi
gcuaugauggccgacuggcac

SEQ ID NO: 1673442 - RNA, 17 nt, Salmonella enterica enterica serovar Typhi
gcuaugggaagggugac

SEQ ID NO: 1673443 - RNA, 22 nt, Salmonella enterica enterica serovar Typhi
gcuauuaaucugugagcacagg

SEQ ID NO: 1673444 - RNA, 12 nt, Salmonella enterica enterica serovar Typhi
gcuauuagccaa

SEQ ID NO: 1673445 - RNA, 14 nt, Salmonella enterica enterica serovar Typhi
gcuauuaccaguaa

SEQ ID NO: 1673446 - RNA, 23 nt, Salmonella enterica enterica serovar Typhi
gcuauuaccggcuggaagcccaa

SEQ ID NO: 1673447 - RNA, 16 nt, Salmonella enterica enterica serovar Typhi
gcucaagcgccgcgau

SEQ ID NO: 1673448 - RNA, 15 nt, Salmonella enterica enterica serovar Typhi
gcucaacuuccagag

SEQ ID NO: 1673449 - RNA, 19 nt, Salmonella enterica enterica serovar Typhi
gcucaauaccuuaguaaaa

SEQ ID NO: 1673450 - RNA, 20 nt, Salmonella enterica enterica serovar Typhi
gcucaauaccuuaguaaaac

SEQ ID NO: 1673451 - RNA, 15 nt, Salmonella enterica enterica serovar Typhi
gcucacggcacgccc

SEQ ID NO: 1673452 - RNA, 20 nt, Salmonella enterica enterica serovar Typhi
gcuauuuuuugcuggcggca

SEQ ID NO: 1673453 - RNA, 22 nt, Salmonella enterica enterica serovar Typhi
gcucaaaaaagaguaaaguuau

SEQ ID NO: 1673454 - RNA, 12 nt, Salmonella enterica enterica serovar Typhi
gcucaaauauga

SEQ ID NO: 1673455 - RNA, 15 nt, Salmonella enterica enterica serovar Typhi
gcucaaccgcgcggc

SEQ ID NO: 1673456 - RNA, 23 nt, Salmonella enterica enterica serovar Typhi
gcucaaccaugauaaccagcccc

SEQ ID NO: 1673457 - RNA, 23 nt, Salmonella enterica enterica serovar Typhi
gcuccggcgcuggcgcuggcugc

SEQ ID NO: 1673458 - RNA, 16 nt, Salmonella enterica enterica serovar Typhi
gcuccugcgccggacg

SEQ ID NO: 1673459 - RNA, 13 nt, Salmonella enterica enterica serovar Typhi
gcuccugccagau

SEQ ID NO: 1673460 - RNA, 18 nt, Salmonella enterica enterica serovar Typhi
gcucccgcagccacuccc

SEQ ID NO: 1673461 - RNA, 18 nt, Salmonella enterica enterica serovar Typhi
gcuccccguuccaccgcc

SEQ ID NO: 1673462 - RNA, 20 nt, Salmonella enterica enterica serovar Typhi
gcucccgcauggacaaggau

SEQ ID NO: 1673463 - RNA, 22 nt, Salmonella enterica enterica serovar Typhi
gcucccgccagcgagaugaaaa

SEQ ID NO: 1673464 - RNA, 20 nt, Salmonella enterica enterica serovar Typhi
gcucccgcagccacucccga

SEQ ID NO: 1673465 - RNA, 13 nt, Salmonella enterica enterica serovar Typhi
gcucgcccgccgc

SEQ ID NO: 1673466 - RNA, 23 nt, Salmonella enterica enterica serovar Typhi
gcucgcccgccgcaaaaaauacc

SEQ ID NO: 1673467 - RNA, 22 nt, Salmonella enterica enterica serovar Typhi
gcuccugcgguacggccagcgc

SEQ ID NO: 1673468 - RNA, 17 nt, Salmonella enterica enterica serovar Typhi
gcuccugucaggcgagc

SEQ ID NO: 1673469 - RNA, 14 nt, Salmonella enterica enterica serovar Typhi
gcucagcggcggcg

SEQ ID NO: 1673470 - RNA, 16 nt, Salmonella enterica enterica serovar Typhi
gcucagcgcggcagcc

SEQ ID NO: 1673471 - RNA, 13 nt, Salmonella enterica enterica serovar Typhi
gcucacgcuggug

SEQ ID NO: 1673472 - RNA, 23 nt, Salmonella enterica enterica serovar Typhi
gcucacgguuucaacuuccacca

SEQ ID NO: 1673473 - RNA, 23 nt, Salmonella enterica enterica serovar Typhi
gcucaugcgaucgggcaauccau

SEQ ID NO: 1673474 - RNA, 18 nt, Salmonella enterica enterica serovar Typhi
gcucauuaacgacaacuu

SEQ ID NO: 1673475 - RNA, 19 nt, Salmonella enterica enterica serovar Typhi
gcucaugugcagcauccag

SEQ ID NO: 1673476 - RNA, 20 nt, Salmonella enterica enterica serovar Typhi
gcucaugugcagcauccagc

SEQ ID NO: 1673477 - RNA, 15 nt, Salmonella enterica enterica serovar Typhi
gcucaugacaucgcc

SEQ ID NO: 1673478 - RNA, 13 nt, Salmonella enterica enterica serovar Typhi
gcucaucggcggc

SEQ ID NO: 1673479 - RNA, 20 nt, Salmonella enterica enterica serovar Typhi
gcuccagacaggacgccagc

SEQ ID NO: 1673480 - RNA, 19 nt, Salmonella enterica enterica serovar Typhi
gcuccagaccaccagcgac

SEQ ID NO: 1673481 - RNA, 19 nt, Salmonella enterica enterica serovar Typhi
gcuccagacaggacgccag

SEQ ID NO: 1673482 - RNA, 16 nt, Salmonella enterica enterica serovar Typhi
gcuccagcuggcuggc

SEQ ID NO: 1673483 - RNA, 16 nt, Salmonella enterica enterica serovar Typhi
gcucccacucuuccag

SEQ ID NO: 1673484 - RNA, 18 nt, Salmonella enterica enterica serovar Typhi
gcucccagaaucguggcu

SEQ ID NO: 1673485 - RNA, 21 nt, Salmonella enterica enterica serovar Typhi
gcucccagauuaaaucauccu

SEQ ID NO: 1673486 - RNA, 13 nt, Salmonella enterica enterica serovar Typhi
gcuccccaacagg

SEQ ID NO: 1673487 - RNA, 17 nt, Salmonella enterica enterica serovar Typhi
gcugacugguuuguugc

SEQ ID NO: 1673488 - RNA, 21 nt, Salmonella enterica enterica serovar Typhi
gcugacguucgacccgcaaug

SEQ ID NO: 1673489 - RNA, 12 nt, Salmonella enterica enterica serovar Typhi
gcugagaaaaau

SEQ ID NO: 1673490 - RNA, 14 nt, Salmonella enterica enterica serovar Typhi
gcugagaaaaauac

SEQ ID NO: 1673491 - RNA, 14 nt, Salmonella enterica enterica serovar Typhi
gcugaggaucaccc

SEQ ID NO: 1673492 - RNA, 13 nt, Salmonella enterica enterica serovar Typhi
gcugaggcgcugg

SEQ ID NO: 1673493 - RNA, 17 nt, Salmonella enterica enterica serovar Typhi
gcugaggcuuugagcgu

SEQ ID NO: 1673494 - RNA, 21 nt, Salmonella enterica enterica serovar Typhi
gcugagucagaaacggccugg

SEQ ID NO: 1673495 - RNA, 17 nt, Salmonella enterica enterica serovar Typhi
gcugagucauccuuccc

SEQ ID NO: 1673496 - RNA, 20 nt, Salmonella enterica enterica serovar Typhi
gcugagucauccuuccccca

SEQ ID NO: 1673497 - RNA, 16 nt, Salmonella enterica enterica serovar Typhi
gcugagcuaaucaccc

SEQ ID NO: 1673498 - RNA, 17 nt, Salmonella enterica enterica serovar Typhi
gcugaucccgcgcgccu

SEQ ID NO: 1673499 - RNA, 20 nt, Salmonella enterica enterica serovar Typhi
gcugauaagcuaguaaagaa

SEQ ID NO: 1673500 - RNA, 21 nt, Salmonella enterica enterica serovar Typhi
gcugauaagcuaguaaagaaa

SEQ ID NO: 1673501 - RNA, 15 nt, Salmonella enterica enterica serovar Typhi
gcugauaggccugga

SEQ ID NO: 1673502 - RNA, 22 nt, Salmonella enterica enterica serovar Typhi
gcugaguuucucccgccagaug

SEQ ID NO: 1673503 - RNA, 13 nt, Salmonella enterica enterica serovar Typhi
gcugauaauacug

SEQ ID NO: 1673504 - RNA, 20 nt, Salmonella enterica enterica serovar Typhi
gcugaccgcuuucccggcau

SEQ ID NO: 1673505 - RNA, 17 nt, Salmonella enterica enterica serovar Typhi
gcugaccuuaauccagc

SEQ ID NO: 1673506 - RNA, 16 nt, Salmonella enterica enterica serovar Typhi
gcugacgacauucagc

SEQ ID NO: 1673507 - RNA, 17 nt, Salmonella enterica enterica serovar Typhi
gcugacguagauucuga

SEQ ID NO: 1673508 - RNA, 17 nt, Salmonella enterica enterica serovar Typhi
gcugacggagcuggcac

SEQ ID NO: 1673509 - RNA, 15 nt, Salmonella enterica enterica serovar Typhi
gcugacgcccaucag

SEQ ID NO: 1673510 - RNA, 22 nt, Salmonella enterica enterica serovar Typhi
gcugacgauacucagccccagg

SEQ ID NO: 1673511 - RNA, 19 nt, Salmonella enterica enterica serovar Typhi
gcugacgacauucagcaca

SEQ ID NO: 1673512 - RNA, 21 nt, Salmonella enterica enterica serovar Typhi
gcugacgacauucagcacaug

SEQ ID NO: 1673513 - RNA, 14 nt, Salmonella enterica enterica serovar Typhi
gcugacgaccccag

SEQ ID NO: 1673514 - RNA, 17 nt, Salmonella enterica enterica serovar Typhi
gcugacgacgccagccc

SEQ ID NO: 1673515 - RNA, 23 nt, Salmonella enterica enterica serovar Typhi
gcugacaucguguauaccaaaaa

SEQ ID NO: 1673516 - RNA, 16 nt, Salmonella enterica enterica serovar Typhi
gcugacaaucagcaca

SEQ ID NO: 1673517 - RNA, 16 nt, Salmonella enterica enterica serovar Typhi
gcugacaaucugcugg

SEQ ID NO: 1673518 - RNA, 12 nt, Salmonella enterica enterica serovar Typhi
gcugaauguucu

SEQ ID NO: 1673519 - RNA, 17 nt, Salmonella enterica enterica serovar Typhi
gcugacaaacccuguau

SEQ ID NO: 1673520 - RNA, 17 nt, Salmonella enterica enterica serovar Typhi
gcugaauagccagcccc

SEQ ID NO: 1673521 - RNA, 13 nt, Salmonella enterica enterica serovar Typhi
gcugaauaacccc

SEQ ID NO: 1673522 - RNA, 15 nt, Salmonella enterica enterica serovar Typhi
gcucuuuuuuuugcu

SEQ ID NO: 1673523 - RNA, 18 nt, Salmonella enterica enterica serovar Typhi
gcugaagcuugaaccggg

SEQ ID NO: 1673524 - RNA, 22 nt, Salmonella enterica enterica serovar Typhi
gcucuaucgccuggagcugauc

SEQ ID NO: 1673525 - RNA, 22 nt, Salmonella enterica enterica serovar Typhi
gcucuacguugaccucaucacc

SEQ ID NO: 1673526 - RNA, 14 nt, Salmonella enterica enterica serovar Typhi
gcucuaucaccgcc

SEQ ID NO: 1673527 - RNA, 20 nt, Salmonella enterica enterica serovar Typhi
gcucuaucaccgcccgccgg

SEQ ID NO: 1673528 - RNA, 23 nt, Salmonella enterica enterica serovar Typhi
gcucucccgccacugaauuacug

SEQ ID NO: 1673529 - RNA, 14 nt, Salmonella enterica enterica serovar Typhi
gcucucccagcuga

SEQ ID NO: 1673530 - RNA, 19 nt, Salmonella enterica enterica serovar Typhi
gcucuccuggcauggcucg

SEQ ID NO: 1673531 - RNA, 20 nt, Salmonella enterica enterica serovar Typhi
gcucucucaaacuauuuuua

SEQ ID NO: 1673532 - RNA, 21 nt, Salmonella enterica enterica serovar Typhi
gcucucgccgcgcuccaucau

SEQ ID NO: 1673533 - RNA, 21 nt, Salmonella enterica enterica serovar Typhi
gcucguagcguuuaaagacca

SEQ ID NO: 1673534 - RNA, 19 nt, Salmonella enterica enterica serovar Typhi
gcucguaaagcaucagacu

SEQ ID NO: 1673535 - RNA, 23 nt, Salmonella enterica enterica serovar Typhi
gcucguuuuuguuuaaaaaccag

SEQ ID NO: 1673536 - RNA, 18 nt, Salmonella enterica enterica serovar Typhi
gcucguuaaauccuccca

SEQ ID NO: 1673537 - RNA, 11 nt, Salmonella enterica enterica serovar Typhi
gcucugcuguu

SEQ ID NO: 1673538 - RNA, 15 nt, Salmonella enterica enterica serovar Typhi
gcucugcuguuccuu

SEQ ID NO: 1673539 - RNA, 17 nt, Salmonella enterica enterica serovar Typhi
gcucugcuguuccuuca

SEQ ID NO: 1673540 - RNA, 13 nt, Salmonella enterica enterica serovar Typhi
gcugaaagaagac

SEQ ID NO: 1673541 - RNA, 13 nt, Salmonella enterica enterica serovar Typhi
gcucuuucaacug

SEQ ID NO: 1673542 - RNA, 16 nt, Salmonella enterica enterica serovar Typhi
gcucuuuacauaaugu

SEQ ID NO: 1673543 - RNA, 17 nt, Salmonella enterica enterica serovar Typhi
gcucuucuucgcucucg

SEQ ID NO: 1673544 - RNA, 20 nt, Salmonella enterica enterica serovar Typhi
gcucuucaauuuccaucugu

SEQ ID NO: 1673545 - RNA, 17 nt, Salmonella enterica enterica serovar Typhi
gcgucggacauuuuguu

SEQ ID NO: 1673546 - RNA, 16 nt, Salmonella enterica enterica serovar Typhi
gcgucgcuucguucug

SEQ ID NO: 1673547 - RNA, 18 nt, Salmonella enterica enterica serovar Typhi
gcgucgcggcaauagcga

SEQ ID NO: 1673548 - RNA, 17 nt, Salmonella enterica enterica serovar Typhi
gcgucgcguaccagcgc

SEQ ID NO: 1673549 - RNA, 22 nt, Salmonella enterica enterica serovar Typhi
gcgucgccuguccggccuguaa

SEQ ID NO: 1673550 - RNA, 22 nt, Salmonella enterica enterica serovar Typhi
gcgucgcgcuuucaaucgucag

SEQ ID NO: 1673551 - RNA, 14 nt, Salmonella enterica enterica serovar Typhi
gcgucgggccgcgc

SEQ ID NO: 1673552 - RNA, 20 nt, Salmonella enterica enterica serovar Typhi
gcgugacgccaagcagcggc

SEQ ID NO: 1673553 - RNA, 18 nt, Salmonella enterica enterica serovar Typhi
gcgugauaaaggccggca

SEQ ID NO: 1673554 - RNA, 17 nt, Salmonella enterica enterica serovar Typhi
gcgugauaauuccccca

SEQ ID NO: 1673555 - RNA, 15 nt, Salmonella enterica enterica serovar Typhi
gcgugccgggcuggc

SEQ ID NO: 1673556 - RNA, 20 nt, Salmonella enterica enterica serovar Typhi
gcgucguuggcauggucagc

SEQ ID NO: 1673557 - RNA, 19 nt, Salmonella enterica enterica serovar Typhi
gcgucuauagaugauaauc

SEQ ID NO: 1673558 - RNA, 15 nt, Salmonella enterica enterica serovar Typhi
gcgucucaagcuuuu

SEQ ID NO: 1673559 - RNA, 18 nt, Salmonella enterica enterica serovar Typhi
gcgucguucacgucgcga

SEQ ID NO: 1673560 - RNA, 17 nt, Salmonella enterica enterica serovar Typhi
gcgucguuccgucagug

SEQ ID NO: 1673561 - RNA, 18 nt, Salmonella enterica enterica serovar Typhi
gcgucucaucaaaaaggc

SEQ ID NO: 1673562 - RNA, 16 nt, Salmonella enterica enterica serovar Typhi
gcgucucauccggcag

SEQ ID NO: 1673563 - RNA, 22 nt, Salmonella enterica enterica serovar Typhi
gcgucucacuuuucgggugaga

SEQ ID NO: 1673564 - RNA, 17 nt, Salmonella enterica enterica serovar Typhi
gcgucucagcaggcggc

SEQ ID NO: 1673565 - RNA, 13 nt, Salmonella enterica enterica serovar Typhi
gcgugacccagac

SEQ ID NO: 1673566 - RNA, 16 nt, Salmonella enterica enterica serovar Typhi
gcgugcgccauccggc

SEQ ID NO: 1673567 - RNA, 18 nt, Salmonella enterica enterica serovar Typhi
gcgugcgaauuucggcaa

SEQ ID NO: 1673568 - RNA, 20 nt, Salmonella enterica enterica serovar Typhi
gcguggcugcaggacuuacc

SEQ ID NO: 1673569 - RNA, 23 nt, Salmonella enterica enterica serovar Typhi
gcguguuguacagcaauaaaagg

SEQ ID NO: 1673570 - RNA, 17 nt, Salmonella enterica enterica serovar Typhi
gcguguuuguaaaaaua

SEQ ID NO: 1673571 - RNA, 22 nt, Salmonella enterica enterica serovar Typhi
gcguuaacccgcuuacaauuua

SEQ ID NO: 1673572 - RNA, 16 nt, Salmonella enterica enterica serovar Typhi
gcguugggcgugacgg

SEQ ID NO: 1673573 - RNA, 19 nt, Salmonella enterica enterica serovar Typhi
gcguugguuaaggcggcug

SEQ ID NO: 1673574 - RNA, 17 nt, Salmonella enterica enterica serovar Typhi
gcguuguaaucgccuga

SEQ ID NO: 1673575 - RNA, 18 nt, Salmonella enterica enterica serovar Typhi
gcguuguacggauggggu

SEQ ID NO: 1673576 - RNA, 21 nt, Salmonella enterica enterica serovar Typhi
gcguuguuuuuucagaauuag

SEQ ID NO: 1673577 - RNA, 12 nt, Salmonella enterica enterica serovar Typhi
gcguuggcggcu

SEQ ID NO: 1673578 - RNA, 16 nt, Salmonella enterica enterica serovar Typhi
gcguugccuggccucc

SEQ ID NO: 1673579 - RNA, 18 nt, Salmonella enterica enterica serovar Typhi
gcguugccguaggcaacg

SEQ ID NO: 1673580 - RNA, 21 nt, Salmonella enterica enterica serovar Typhi
gcguucacaccgccgccagcc

SEQ ID NO: 1673581 - RNA, 23 nt, Salmonella enterica enterica serovar Typhi
gcguucauggcgcgacauggcga

SEQ ID NO: 1673582 - RNA, 12 nt, Salmonella enterica enterica serovar Typhi
gcguugcagcca

SEQ ID NO: 1673583 - RNA, 19 nt, Salmonella enterica enterica serovar Typhi
gcguuccaucacuuccugu

SEQ ID NO: 1673584 - RNA, 20 nt, Salmonella enterica enterica serovar Typhi
gcguccagcccguccagaua

SEQ ID NO: 1673585 - RNA, 22 nt, Salmonella enterica enterica serovar Typhi
gcguccaacuggcuuucaucca

SEQ ID NO: 1673586 - RNA, 14 nt, Salmonella enterica enterica serovar Typhi
gcguccagaugcaa

SEQ ID NO: 1673587 - RNA, 20 nt, Salmonella enterica enterica serovar Typhi
gcgucaucggcgcgcuggcg

SEQ ID NO: 1673588 - RNA, 19 nt, Salmonella enterica enterica serovar Typhi
gcgucaucggcgcgcuggc

SEQ ID NO: 1673589 - RNA, 18 nt, Salmonella enterica enterica serovar Typhi
gcgucccagcgggcugua

SEQ ID NO: 1673590 - RNA, 19 nt, Salmonella enterica enterica serovar Typhi
gcgucgccccaaucgccag

SEQ ID NO: 1673591 - RNA, 19 nt, Salmonella enterica enterica serovar Typhi
gcgucgccauaaagcugua

SEQ ID NO: 1673592 - RNA, 13 nt, Salmonella enterica enterica serovar Typhi
gcgucaaaacagg

SEQ ID NO: 1673593 - RNA, 14 nt, Salmonella enterica enterica serovar Typhi
gcguauugagcgca

SEQ ID NO: 1673594 - RNA, 24 nt, Salmonella enterica enterica serovar Typhi
gcguaggguagaucacgccagcgc

SEQ ID NO: 1673595 - RNA, 15 nt, Salmonella enterica enterica serovar Typhi
gcguagcgcgcggau

SEQ ID NO: 1673596 - RNA, 19 nt, Salmonella enterica enterica serovar Typhi
gcguagcguguauuccagu

SEQ ID NO: 1673597 - RNA, 21 nt, Salmonella enterica enterica serovar Typhi
gcguagcuggccuucuccacu

SEQ ID NO: 1673598 - RNA, 20 nt, Salmonella enterica enterica serovar Typhi
gcggugaucccaggccggca

SEQ ID NO: 1673599 - RNA, 19 nt, Salmonella enterica enterica serovar Typhi
gcgucaaauagagaaaaua

SEQ ID NO: 1673600 - RNA, 20 nt, Salmonella enterica enterica serovar Typhi
gcgucaaaaucccggcuggg

SEQ ID NO: 1673601 - RNA, 13 nt, Salmonella enterica enterica serovar Typhi
gcgucacaacagc

SEQ ID NO: 1673602 - RNA, 14 nt, Salmonella enterica enterica serovar Typhi
gcgucacccgccgg

SEQ ID NO: 1673603 - RNA, 15 nt, Salmonella enterica enterica serovar Typhi
gcgucagcauggugu

SEQ ID NO: 1673604 - RNA, 16 nt, Salmonella enterica enterica serovar Typhi
gcgucaggcuguuguu

SEQ ID NO: 1673605 - RNA, 20 nt, Salmonella enterica enterica serovar Typhi
gcgucaucauugcgccaaga

SEQ ID NO: 1673606 - RNA, 18 nt, Salmonella enterica enterica serovar Typhi
gcgucauagccgcgcguc

SEQ ID NO: 1673607 - RNA, 19 nt, Salmonella enterica enterica serovar Typhi
gcgucauaguuuuccagcc

SEQ ID NO: 1673608 - RNA, 22 nt, Salmonella enterica enterica serovar Typhi
gcgucauccaguguuaagaaga

SEQ ID NO: 1673609 - RNA, 15 nt, Salmonella enterica enterica serovar Typhi
gcgucauccugcagg

SEQ ID NO: 1673610 - RNA, 18 nt, Salmonella enterica enterica serovar Typhi
gcgucaggaacgcggcgc

SEQ ID NO: 1673611 - RNA, 13 nt, Salmonella enterica enterica serovar Typhi
gcgucagcgcggc

SEQ ID NO: 1673612 - RNA, 17 nt, Salmonella enterica enterica serovar Typhi
gcgucagcacgccgccc

SEQ ID NO: 1673613 - RNA, 20 nt, Salmonella enterica enterica serovar Typhi
gcgucagcguguaaucgccg

SEQ ID NO: 1673614 - RNA, 21 nt, Salmonella enterica enterica serovar Typhi
gcggcggggauaaucagcagc

SEQ ID NO: 1673615 - RNA, 18 nt, Salmonella enterica enterica serovar Typhi
gcggcggcaagcuggcga

SEQ ID NO: 1673616 - RNA, 18 nt, Salmonella enterica enterica serovar Typhi
gcggcggucugcgccugc

SEQ ID NO: 1673617 - RNA, 19 nt, Salmonella enterica enterica serovar Typhi
gcggcguacacuucauccg

SEQ ID NO: 1673618 - RNA, 22 nt, Salmonella enterica enterica serovar Typhi
gcggcguaaacacguuaucuga

SEQ ID NO: 1673619 - RNA, 21 nt, Salmonella enterica enterica serovar Typhi
gcggcgguuauccgccagcgc

SEQ ID NO: 1673620 - RNA, 22 nt, Salmonella enterica enterica serovar Typhi
gcggcgguuauccuccgggucg

SEQ ID NO: 1673621 - RNA, 15 nt, Salmonella enterica enterica serovar Typhi
gcggcgguucauccu

SEQ ID NO: 1673622 - RNA, 16 nt, Salmonella enterica enterica serovar Typhi
gcggcggguaaauaga

SEQ ID NO: 1673623 - RNA, 17 nt, Salmonella enterica enterica serovar Typhi
gcggcgccaacgcgcua

SEQ ID NO: 1673624 - RNA, 21 nt, Salmonella enterica enterica serovar Typhi
gcggcgauuuauagagcagca

SEQ ID NO: 1673625 - RNA, 16 nt, Salmonella enterica enterica serovar Typhi
gcggcgcagcgcgcga

SEQ ID NO: 1673626 - RNA, 17 nt, Salmonella enterica enterica serovar Typhi
gcggcgcaaaucgccau

SEQ ID NO: 1673627 - RNA, 16 nt, Salmonella enterica enterica serovar Typhi
gcggcuaauacgccag

SEQ ID NO: 1673628 - RNA, 19 nt, Salmonella enterica enterica serovar Typhi
gcggcuacgccugauaagc

SEQ ID NO: 1673629 - RNA, 20 nt, Salmonella enterica enterica serovar Typhi
gcggcguggaaccgccggag

SEQ ID NO: 1673630 - RNA, 14 nt, Salmonella enterica enterica serovar Typhi
gcggcguucaaaac

SEQ ID NO: 1673631 - RNA, 20 nt, Salmonella enterica enterica serovar Typhi
gcggcguaucauagcggcua

SEQ ID NO: 1673632 - RNA, 16 nt, Salmonella enterica enterica serovar Typhi
gcggcguagccgccga

SEQ ID NO: 1673633 - RNA, 17 nt, Salmonella enterica enterica serovar Typhi
gcggcgucugcaccggu

SEQ ID NO: 1673634 - RNA, 22 nt, Salmonella enterica enterica serovar Typhi
gcggcuuugcgccggcaguccu

SEQ ID NO: 1673635 - RNA, 13 nt, Salmonella enterica enterica serovar Typhi
gcggcuuuuucau

SEQ ID NO: 1673636 - RNA, 22 nt, Salmonella enterica enterica serovar Typhi
gcggcuugucauccugcucauc

SEQ ID NO: 1673637 - RNA, 19 nt, Salmonella enterica enterica serovar Typhi
gcggcuuuaaugccgccgu

SEQ ID NO: 1673638 - RNA, 14 nt, Salmonella enterica enterica serovar Typhi
gcggcucaccagcu

SEQ ID NO: 1673639 - RNA, 15 nt, Salmonella enterica enterica serovar Typhi
gcggcucaccagcug

SEQ ID NO: 1673640 - RNA, 21 nt, Salmonella enterica enterica serovar Typhi
gcggcuauugucugauggcgc

SEQ ID NO: 1673641 - RNA, 20 nt, Salmonella enterica enterica serovar Typhi
gcgguagaaaguacaucauu

SEQ ID NO: 1673642 - RNA, 14 nt, Salmonella enterica enterica serovar Typhi
gcgguaacaggcac

SEQ ID NO: 1673643 - RNA, 13 nt, Salmonella enterica enterica serovar Typhi
gcgguaagcuguu

SEQ ID NO: 1673644 - RNA, 16 nt, Salmonella enterica enterica serovar Typhi
gcgguaaucugccagc

SEQ ID NO: 1673645 - RNA, 19 nt, Salmonella enterica enterica serovar Typhi
gcggguaaacucacccagg

SEQ ID NO: 1673646 - RNA, 13 nt, Salmonella enterica enterica serovar Typhi
gcggguaaacaga

SEQ ID NO: 1673647 - RNA, 23 nt, Salmonella enterica enterica serovar Typhi
gcggucgauuuugccuucaauuc

SEQ ID NO: 1673648 - RNA, 12 nt, Salmonella enterica enterica serovar Typhi
gcggucuucacu

SEQ ID NO: 1673649 - RNA, 13 nt, Salmonella enterica enterica serovar Typhi
gcggugaaagaga

SEQ ID NO: 1673650 - RNA, 19 nt, Salmonella enterica enterica serovar Typhi
gcgggcguauagccaggca

SEQ ID NO: 1673651 - RNA, 19 nt, Salmonella enterica enterica serovar Typhi
gcgggcguuugcgcgcgcc

SEQ ID NO: 1673652 - RNA, 19 nt, Salmonella enterica enterica serovar Typhi
gcgggcugccccagacgcc

SEQ ID NO: 1673653 - RNA, 14 nt, Salmonella enterica enterica serovar Typhi
gcgccgcuccaggg

SEQ ID NO: 1673654 - RNA, 16 nt, Salmonella enterica enterica serovar Typhi
gcgccggacgccacgc

SEQ ID NO: 1673655 - RNA, 15 nt, Salmonella enterica enterica serovar Typhi
gcgccggacagcagc

SEQ ID NO: 1673656 - RNA, 13 nt, Salmonella enterica enterica serovar Typhi
gcgccggggcagc

SEQ ID NO: 1673657 - RNA, 23 nt, Salmonella enterica enterica serovar Typhi
gcgccggcugcgcugccagcugc

SEQ ID NO: 1673658 - RNA, 12 nt, Salmonella enterica enterica serovar Typhi
gcgcccagcgcc

SEQ ID NO: 1673659 - RNA, 16 nt, Salmonella enterica enterica serovar Typhi
gcgcccagccaaagcg

SEQ ID NO: 1673660 - RNA, 23 nt, Salmonella enterica enterica serovar Typhi
gcgccgccgaacagacggcggcu

SEQ ID NO: 1673661 - RNA, 13 nt, Salmonella enterica enterica serovar Typhi
gcgcccaggccaa

SEQ ID NO: 1673662 - RNA, 12 nt, Salmonella enterica enterica serovar Typhi
gcgccgccgccu

SEQ ID NO: 1673663 - RNA, 17 nt, Salmonella enterica enterica serovar Typhi
gcgccugcauacucaca

SEQ ID NO: 1673664 - RNA, 16 nt, Salmonella enterica enterica serovar Typhi
gcgccugcucagcauu

SEQ ID NO: 1673665 - RNA, 14 nt, Salmonella enterica enterica serovar Typhi
gcgccugcucccgc

SEQ ID NO: 1673666 - RNA, 23 nt, Salmonella enterica enterica serovar Typhi
gcgccuguaaggcucucuuacca

SEQ ID NO: 1673667 - RNA, 16 nt, Salmonella enterica enterica serovar Typhi
gcgccuguuagggcgc

SEQ ID NO: 1673668 - RNA, 17 nt, Salmonella enterica enterica serovar Typhi
gcgccuguuagggcgcg

SEQ ID NO: 1673669 - RNA, 18 nt, Salmonella enterica enterica serovar Typhi
gcgccuguuagggcgcgg

SEQ ID NO: 1673670 - RNA, 23 nt, Salmonella enterica enterica serovar Typhi
gcgccuguuagggcgcggcuggu

SEQ ID NO: 1673671 - RNA, 22 nt, Salmonella enterica enterica serovar Typhi
gcgccugucuccagcgccgcuu

SEQ ID NO: 1673672 - RNA, 20 nt, Salmonella enterica enterica serovar Typhi
gcgccugucgggccuacaga

SEQ ID NO: 1673673 - RNA, 13 nt, Salmonella enterica enterica serovar Typhi
gcgccuuccagca

SEQ ID NO: 1673674 - RNA, 15 nt, Salmonella enterica enterica serovar Typhi
gcgccuuccagcaau

SEQ ID NO: 1673675 - RNA, 20 nt, Salmonella enterica enterica serovar Typhi
gcgccuugucugaccgggcg

SEQ ID NO: 1673676 - RNA, 19 nt, Salmonella enterica enterica serovar Typhi
gcgccuccacaaagcgcga

SEQ ID NO: 1673677 - RNA, 21 nt, Salmonella enterica enterica serovar Typhi
gcgccuccgcguagcccagcg

SEQ ID NO: 1673678 - RNA, 17 nt, Salmonella enterica enterica serovar Typhi
gcgccuccccugccggc

SEQ ID NO: 1673679 - RNA, 19 nt, Salmonella enterica enterica serovar Typhi
gcgccugaagauacgccag

SEQ ID NO: 1673680 - RNA, 19 nt, Salmonella enterica enterica serovar Typhi
gcgcggcuaccggacugcu

SEQ ID NO: 1673681 - RNA, 14 nt, Salmonella enterica enterica serovar Typhi
gcgcggcguucugc

SEQ ID NO: 1673682 - RNA, 18 nt, Salmonella enterica enterica serovar Typhi
gcgcggucgcuucgccuu

SEQ ID NO: 1673683 - RNA, 20 nt, Salmonella enterica enterica serovar Typhi
gcgcgguauuucgccgccgc

SEQ ID NO: 1673684 - RNA, 21 nt, Salmonella enterica enterica serovar Typhi
gcgcggccucauggcggugcu

SEQ ID NO: 1673685 - RNA, 16 nt, Salmonella enterica enterica serovar Typhi
gcgcggccccaucagc

SEQ ID NO: 1673686 - RNA, 13 nt, Salmonella enterica enterica serovar Typhi
gcgcgcgggcgau

SEQ ID NO: 1673687 - RNA, 12 nt, Salmonella enterica enterica serovar Typhi
gcgcgcuccaga

SEQ ID NO: 1673688 - RNA, 15 nt, Salmonella enterica enterica serovar Typhi
gcgcgcacgcgggcc

SEQ ID NO: 1673689 - RNA, 19 nt, Salmonella enterica enterica serovar Typhi
gcgccuuuaauuccgccgg

SEQ ID NO: 1673690 - RNA, 16 nt, Salmonella enterica enterica serovar Typhi
gcgcgaaaagaaacug

SEQ ID NO: 1673691 - RNA, 20 nt, Salmonella enterica enterica serovar Typhi
gcgcgaugccugccgggccu

SEQ ID NO: 1673692 - RNA, 16 nt, Salmonella enterica enterica serovar Typhi
gcgcgaucuguuggug

SEQ ID NO: 1673693 - RNA, 16 nt, Salmonella enterica enterica serovar Typhi
gcgcgcccugcgggcc

SEQ ID NO: 1673694 - RNA, 14 nt, Salmonella enterica enterica serovar Typhi
gcgcgcgcaaagcg

SEQ ID NO: 1673695 - RNA, 22 nt, Salmonella enterica enterica serovar Typhi
gcgcgcggaacuuuaucaccag

SEQ ID NO: 1673696 - RNA, 20 nt, Salmonella enterica enterica serovar Typhi
gcgcgccuucgaaccgggua

SEQ ID NO: 1673697 - RNA, 14 nt, Salmonella enterica enterica serovar Typhi
gcgcgcgaugcugc

SEQ ID NO: 1673698 - RNA, 19 nt, Salmonella enterica enterica serovar Typhi
gcgcguccagccagcguuu

SEQ ID NO: 1673699 - RNA, 22 nt, Salmonella enterica enterica serovar Typhi
gcgcgucacaauaucgagauga

SEQ ID NO: 1673700 - RNA, 15 nt, Salmonella enterica enterica serovar Typhi
gcgcgucagcgccuc

SEQ ID NO: 1673701 - RNA, 16 nt, Salmonella enterica enterica serovar Typhi
gcgcucuuccgccagc

SEQ ID NO: 1673702 - RNA, 21 nt, Salmonella enterica enterica serovar Typhi
gcgcucuuuuucuuuucuccg

SEQ ID NO: 1673703 - RNA, 19 nt, Salmonella enterica enterica serovar Typhi
gcgcuggcaagcgccagca

SEQ ID NO: 1673704 - RNA, 13 nt, Salmonella enterica enterica serovar Typhi
gcgcuggcggcga

SEQ ID NO: 1673705 - RNA, 14 nt, Salmonella enterica enterica serovar Typhi
gcgcuggcgugguu

SEQ ID NO: 1673706 - RNA, 14 nt, Salmonella enterica enterica serovar Typhi
gcgcucuuuuuuaa

SEQ ID NO: 1673707 - RNA, 14 nt, Salmonella enterica enterica serovar Typhi
gcgcugaaguccgc

SEQ ID NO: 1673708 - RNA, 18 nt, Salmonella enterica enterica serovar Typhi
gcgcugaauagcgaccuu

SEQ ID NO: 1673709 - RNA, 13 nt, Salmonella enterica enterica serovar Typhi
gcggaacaccagc

SEQ ID NO: 1673710 - RNA, 21 nt, Salmonella enterica enterica serovar Typhi
gcggaaagcauucgcagcaga

SEQ ID NO: 1673711 - RNA, 20 nt, Salmonella enterica enterica serovar Typhi
gcggaaaggacguucuucuc

SEQ ID NO: 1673712 - RNA, 18 nt, Salmonella enterica enterica serovar Typhi
gcgcuuugccgcugcugc

SEQ ID NO: 1673713 - RNA, 20 nt, Salmonella enterica enterica serovar Typhi
gcgcuuuggguuaaugccag

SEQ ID NO: 1673714 - RNA, 17 nt, Salmonella enterica enterica serovar Typhi
gcgcuuucaaucgucag

SEQ ID NO: 1673715 - RNA, 15 nt, Salmonella enterica enterica serovar Typhi
gcgcuuucuucuuca

SEQ ID NO: 1673716 - RNA, 20 nt, Salmonella enterica enterica serovar Typhi
gcgcuuuuagccaguuggca

SEQ ID NO: 1673717 - RNA, 12 nt, Salmonella enterica enterica serovar Typhi
gcgcuuuguuuc

SEQ ID NO: 1673718 - RNA, 17 nt, Salmonella enterica enterica serovar Typhi
gcgcuuuugccgcgccc

SEQ ID NO: 1673719 - RNA, 12 nt, Salmonella enterica enterica serovar Typhi
gcgcuuuuucac

SEQ ID NO: 1673720 - RNA, 22 nt, Salmonella enterica enterica serovar Typhi
gcggaaggcgccucgcgcggcg

SEQ ID NO: 1673721 - RNA, 13 nt, Salmonella enterica enterica serovar Typhi
gcggaagaggcgc

SEQ ID NO: 1673722 - RNA, 14 nt, Salmonella enterica enterica serovar Typhi
gcggaagaggcgcc

SEQ ID NO: 1673723 - RNA, 18 nt, Salmonella enterica enterica serovar Typhi
gcggaacggcgagcuuua

SEQ ID NO: 1673724 - RNA, 13 nt, Salmonella enterica enterica serovar Typhi
gcggaaccauuuu

SEQ ID NO: 1673725 - RNA, 22 nt, Salmonella enterica enterica serovar Typhi
gcgcuugcauggcagccccggc

SEQ ID NO: 1673726 - RNA, 16 nt, Salmonella enterica enterica serovar Typhi
gcgcuucgccugccgg

SEQ ID NO: 1673727 - RNA, 22 nt, Salmonella enterica enterica serovar Typhi
gcgcuugccuuuacuguugccu

SEQ ID NO: 1673728 - RNA, 16 nt, Salmonella enterica enterica serovar Typhi
gcgcuuguaaauugcg

SEQ ID NO: 1673729 - RNA, 15 nt, Salmonella enterica enterica serovar Typhi
gcgcuucgccugccg

SEQ ID NO: 1673730 - RNA, 13 nt, Salmonella enterica enterica serovar Typhi
gcgcuucgccugc

SEQ ID NO: 1673731 - RNA, 16 nt, Salmonella enterica enterica serovar Typhi
gcgcuuccugcagugg

SEQ ID NO: 1673732 - RNA, 17 nt, Salmonella enterica enterica serovar Typhi
gcgcuuccugcagugga

SEQ ID NO: 1673733 - RNA, 13 nt, Salmonella enterica enterica serovar Typhi
gcgcuuaucgccg

SEQ ID NO: 1673734 - RNA, 14 nt, Salmonella enterica enterica serovar Typhi
gcgcuuccagcaug

SEQ ID NO: 1673735 - RNA, 16 nt, Salmonella enterica enterica serovar Typhi
gcggcaacucgugcag

SEQ ID NO: 1673736 - RNA, 23 nt, Salmonella enterica enterica serovar Typhi
gcggcaacccuuuggccaccagc

SEQ ID NO: 1673737 - RNA, 16 nt, Salmonella enterica enterica serovar Typhi
gcggcaaaauugauuc

SEQ ID NO: 1673738 - RNA, 13 nt, Salmonella enterica enterica serovar Typhi
gcggcaaaagagg

SEQ ID NO: 1673739 - RNA, 14 nt, Salmonella enterica enterica serovar Typhi
gcggauucuccagg

SEQ ID NO: 1673740 - RNA, 14 nt, Salmonella enterica enterica serovar Typhi
gcggcaauggccgc

SEQ ID NO: 1673741 - RNA, 16 nt, Salmonella enterica enterica serovar Typhi
gcggcaaugccgccgu

SEQ ID NO: 1673742 - RNA, 23 nt, Salmonella enterica enterica serovar Typhi
gcggcaaugagcggccagcgggc

SEQ ID NO: 1673743 - RNA, 17 nt, Salmonella enterica enterica serovar Typhi
gcggcaauggccgcagc

SEQ ID NO: 1673744 - RNA, 21 nt, Salmonella enterica enterica serovar Typhi
gcggcacacaacacggcggcu

SEQ ID NO: 1673745 - RNA, 22 nt, Salmonella enterica enterica serovar Typhi
gcggaugcgccauccaccaggc

SEQ ID NO: 1673746 - RNA, 19 nt, Salmonella enterica enterica serovar Typhi
gcggauuccaguagcgcgc

SEQ ID NO: 1673747 - RNA, 20 nt, Salmonella enterica enterica serovar Typhi
gcggauuccaguagcgcgcc

SEQ ID NO: 1673748 - RNA, 12 nt, Salmonella enterica enterica serovar Typhi
gcggauggcgcu

SEQ ID NO: 1673749 - RNA, 15 nt, Salmonella enterica enterica serovar Typhi
gcggaucggcgcaga

SEQ ID NO: 1673750 - RNA, 17 nt, Salmonella enterica enterica serovar Typhi
gcggaauccaucccccu

SEQ ID NO: 1673751 - RNA, 20 nt, Salmonella enterica enterica serovar Typhi
gcggaaugaccugagcgugc

SEQ ID NO: 1673752 - RNA, 20 nt, Salmonella enterica enterica serovar Typhi
gcggaaucgucacagacccc

SEQ ID NO: 1673753 - RNA, 15 nt, Salmonella enterica enterica serovar Typhi
gcggacacccgcagc

SEQ ID NO: 1673754 - RNA, 12 nt, Salmonella enterica enterica serovar Typhi
gcggacagcggc

SEQ ID NO: 1673755 - RNA, 14 nt, Salmonella enterica enterica serovar Typhi
gcggacaugguaau

SEQ ID NO: 1673756 - RNA, 13 nt, Salmonella enterica enterica serovar Typhi
gcggacgcagcuc

SEQ ID NO: 1673757 - RNA, 17 nt, Salmonella enterica enterica serovar Typhi
gcggagaucgcucccgc

SEQ ID NO: 1673758 - RNA, 16 nt, Salmonella enterica enterica serovar Typhi
gcggagaucgcucccg

SEQ ID NO: 1673759 - RNA, 17 nt, Salmonella enterica enterica serovar Typhi
gcggagaagacgccgcc

SEQ ID NO: 1673760 - RNA, 20 nt, Salmonella enterica enterica serovar Typhi
gcggagagaucgacagcgcg

SEQ ID NO: 1673761 - RNA, 13 nt, Salmonella enterica enterica serovar Typhi
gcggacgggcggu

SEQ ID NO: 1673762 - RNA, 19 nt, Salmonella enterica enterica serovar Typhi
gcggacguagcggcgccgg

SEQ ID NO: 1673763 - RNA, 19 nt, Salmonella enterica enterica serovar Typhi
gcggauacagcggcgcgcc

SEQ ID NO: 1673764 - RNA, 22 nt, Salmonella enterica enterica serovar Typhi
gcggaucaaacuccgcgcuggc

SEQ ID NO: 1673765 - RNA, 16 nt, Salmonella enterica enterica serovar Typhi
gcggauaugcagcagc

SEQ ID NO: 1673766 - RNA, 18 nt, Salmonella enterica enterica serovar Typhi
gcggaguuauacagugcc

SEQ ID NO: 1673767 - RNA, 23 nt, Salmonella enterica enterica serovar Typhi
gcggaguaaacugugugagcgcc

SEQ ID NO: 1673768 - RNA, 23 nt, Salmonella enterica enterica serovar Typhi
gcgaaaaucgguaacaucaagua

SEQ ID NO: 1673769 - RNA, 20 nt, Salmonella enterica enterica serovar Typhi
gcgaaaccgcuacccggcac

SEQ ID NO: 1673770 - RNA, 22 nt, Salmonella enterica enterica serovar Typhi
gcgaaaauaccccagcgcgccg

SEQ ID NO: 1673771 - RNA, 13 nt, Salmonella enterica enterica serovar Typhi
gccuaaauguucc

SEQ ID NO: 1673772 - RNA, 20 nt, Salmonella enterica enterica serovar Typhi
gcgaacagccccaccgccag

SEQ ID NO: 1673773 - RNA, 22 nt, Salmonella enterica enterica serovar Typhi
gcgaacaguacggucaggcuca

SEQ ID NO: 1673774 - RNA, 20 nt, Salmonella enterica enterica serovar Typhi
gcgaaagaagcgcuggagaa

SEQ ID NO: 1673775 - RNA, 21 nt, Salmonella enterica enterica serovar Typhi
gccguuuuaacgucauuacca

SEQ ID NO: 1673776 - RNA, 14 nt, Salmonella enterica enterica serovar Typhi
gccuaaaucgcugc

SEQ ID NO: 1673777 - RNA, 14 nt, Salmonella enterica enterica serovar Typhi
gccuaaagaaaaac

SEQ ID NO: 1673778 - RNA, 13 nt, Salmonella enterica enterica serovar Typhi
gccuaaaaaugag

SEQ ID NO: 1673779 - RNA, 18 nt, Salmonella enterica enterica serovar Typhi
gccguuuuagguucuuca

SEQ ID NO: 1673780 - RNA, 19 nt, Salmonella enterica enterica serovar Typhi
gccguuuuagguucuucaa

SEQ ID NO: 1673781 - RNA, 19 nt, Salmonella enterica enterica serovar Typhi
gccguuuuuaauuugcucc

SEQ ID NO: 1673782 - RNA, 16 nt, Salmonella enterica enterica serovar Typhi
gcgaauaacaucaucc

SEQ ID NO: 1673783 - RNA, 16 nt, Salmonella enterica enterica serovar Typhi
gcgaauaaucccggcg

SEQ ID NO: 1673784 - RNA, 14 nt, Salmonella enterica enterica serovar Typhi
gcgaauaaucgccg

SEQ ID NO: 1673785 - RNA, 18 nt, Salmonella enterica enterica serovar Typhi
gcgaaucauguuuuucuc

SEQ ID NO: 1673786 - RNA, 15 nt, Salmonella enterica enterica serovar Typhi
gcgaauagcgcgcua

SEQ ID NO: 1673787 - RNA, 15 nt, Salmonella enterica enterica serovar Typhi
gcgaauagccagaca

SEQ ID NO: 1673788 - RNA, 14 nt, Salmonella enterica enterica serovar Typhi
gcgaauaccuuccc

SEQ ID NO: 1673789 - RNA, 15 nt, Salmonella enterica enterica serovar Typhi
gcgaauaaucuguuu

SEQ ID NO: 1673790 - RNA, 22 nt, Salmonella enterica enterica serovar Typhi
gcgaagaucguuauccagcagc

SEQ ID NO: 1673791 - RNA, 13 nt, Salmonella enterica enterica serovar Typhi
gcgaaccggacca

SEQ ID NO: 1673792 - RNA, 20 nt, Salmonella enterica enterica serovar Typhi
gcgaauuuccugccagaccu

SEQ ID NO: 1673793 - RNA, 23 nt, Salmonella enterica enterica serovar Typhi
gcgaauuuauaagccugagcgcg

SEQ ID NO: 1673794 - RNA, 18 nt, Salmonella enterica enterica serovar Typhi
gcgaauuucaaucgccag

SEQ ID NO: 1673795 - RNA, 14 nt, Salmonella enterica enterica serovar Typhi
gcgacaucccagac

SEQ ID NO: 1673796 - RNA, 21 nt, Salmonella enterica enterica serovar Typhi
gcgacauuuuuguuaauauuc

SEQ ID NO: 1673797 - RNA, 16 nt, Salmonella enterica enterica serovar Typhi
gcgaccagcagcauca

SEQ ID NO: 1673798 - RNA, 18 nt, Salmonella enterica enterica serovar Typhi
gcgaccagcagaugcagu

SEQ ID NO: 1673799 - RNA, 18 nt, Salmonella enterica enterica serovar Typhi
gcgaccaccgucccagua

SEQ ID NO: 1673800 - RNA, 14 nt, Salmonella enterica enterica serovar Typhi
gcgaccacgccacc

SEQ ID NO: 1673801 - RNA, 20 nt, Salmonella enterica enterica serovar Typhi
gcgaccgaucaucauuccga

SEQ ID NO: 1673802 - RNA, 22 nt, Salmonella enterica enterica serovar Typhi
gcgaccgccaccauccggcgcu

SEQ ID NO: 1673803 - RNA, 23 nt, Salmonella enterica enterica serovar Typhi
gcgaccggcucgcuguucgccag

SEQ ID NO: 1673804 - RNA, 17 nt, Salmonella enterica enterica serovar Typhi
gcgaccgcuucgcuggc

SEQ ID NO: 1673805 - RNA, 22 nt, Salmonella enterica enterica serovar Typhi
gcgacgccagauuaucggccag

SEQ ID NO: 1673806 - RNA, 17 nt, Salmonella enterica enterica serovar Typhi
gcgacgccaaaccugcc

SEQ ID NO: 1673807 - RNA, 17 nt, Salmonella enterica enterica serovar Typhi
gcgacgcgccagccagc

SEQ ID NO: 1673808 - RNA, 16 nt, Salmonella enterica enterica serovar Typhi
gcgacgcgcgagcgca

SEQ ID NO: 1673809 - RNA, 14 nt, Salmonella enterica enterica serovar Typhi
gcgacgccgccauc

SEQ ID NO: 1673810 - RNA, 15 nt, Salmonella enterica enterica serovar Typhi
gcgacgcgccagcca

SEQ ID NO: 1673811 - RNA, 13 nt, Salmonella enterica enterica serovar Typhi
gcgagaccauauu

SEQ ID NO: 1673812 - RNA, 14 nt, Salmonella enterica enterica serovar Typhi
gcgagaaguucuca

SEQ ID NO: 1673813 - RNA, 14 nt, Salmonella enterica enterica serovar Typhi
gcgagacgccuggg

SEQ ID NO: 1673814 - RNA, 23 nt, Salmonella enterica enterica serovar Typhi
gcgacucgccguuuuaucgcccg

SEQ ID NO: 1673815 - RNA, 18 nt, Salmonella enterica enterica serovar Typhi
gcgacuuuuuucacccag

SEQ ID NO: 1673816 - RNA, 15 nt, Salmonella enterica enterica serovar Typhi
gcgacuuuaaucacc

SEQ ID NO: 1673817 - RNA, 15 nt, Salmonella enterica enterica serovar Typhi
gcgacggaccggcag

SEQ ID NO: 1673818 - RNA, 16 nt, Salmonella enterica enterica serovar Typhi
gcgacgguccuggcca

SEQ ID NO: 1673819 - RNA, 16 nt, Salmonella enterica enterica serovar Typhi
gcgacggcccaacagc

SEQ ID NO: 1673820 - RNA, 16 nt, Salmonella enterica enterica serovar Typhi
gcgacggcgcgccggc

SEQ ID NO: 1673821 - RNA, 15 nt, Salmonella enterica enterica serovar Typhi
gcgacggcgcuggcu

SEQ ID NO: 1673822 - RNA, 13 nt, Salmonella enterica enterica serovar Typhi
gcgacggcggcgu

SEQ ID NO: 1673823 - RNA, 18 nt, Salmonella enterica enterica serovar Typhi
gcgacguugucuucaucu

SEQ ID NO: 1673824 - RNA, 14 nt, Salmonella enterica enterica serovar Typhi
gcgacuaaccugau

SEQ ID NO: 1673825 - RNA, 13 nt, Salmonella enterica enterica serovar Typhi
gcgacucauccac

SEQ ID NO: 1673826 - RNA, 14 nt, Salmonella enterica enterica serovar Typhi
gcgaugccugccgg

SEQ ID NO: 1673827 - RNA, 17 nt, Salmonella enterica enterica serovar Typhi
gcgaucucuuuggccag

SEQ ID NO: 1673828 - RNA, 16 nt, Salmonella enterica enterica serovar Typhi
gcgaucggcuguaccu

SEQ ID NO: 1673829 - RNA, 17 nt, Salmonella enterica enterica serovar Typhi
gcgaucagcgccaccac

SEQ ID NO: 1673830 - RNA, 18 nt, Salmonella enterica enterica serovar Typhi
gcgaucacuaccgccauc

SEQ ID NO: 1673831 - RNA, 19 nt, Salmonella enterica enterica serovar Typhi
gcgaucagacgcugguugu

SEQ ID NO: 1673832 - RNA, 22 nt, Salmonella enterica enterica serovar Typhi
gcgaucagcucuucgcucugaa

SEQ ID NO: 1673833 - RNA, 15 nt, Salmonella enterica enterica serovar Typhi
gcgaucaagacaaaa

SEQ ID NO: 1673834 - RNA, 22 nt, Salmonella enterica enterica serovar Typhi
gcgaucaagacaaaagcuggug

SEQ ID NO: 1673835 - RNA, 16 nt, Salmonella enterica enterica serovar Typhi
gcgauauucgggcgca

SEQ ID NO: 1673836 - RNA, 14 nt, Salmonella enterica enterica serovar Typhi
gcgauaaaccagcc

SEQ ID NO: 1673837 - RNA, 20 nt, Salmonella enterica enterica serovar Typhi
gcgauaaggucgcuauccag

SEQ ID NO: 1673838 - RNA, 21 nt, Salmonella enterica enterica serovar Typhi
gcgaggugguucauaauaccu

SEQ ID NO: 1673839 - RNA, 18 nt, Salmonella enterica enterica serovar Typhi
gcgagucagacaccagcc

SEQ ID NO: 1673840 - RNA, 19 nt, Salmonella enterica enterica serovar Typhi
gcgagcguuuugaugucca

SEQ ID NO: 1673841 - RNA, 12 nt, Salmonella enterica enterica serovar Typhi
gcgcauccggca

SEQ ID NO: 1673842 - RNA, 23 nt, Salmonella enterica enterica serovar Typhi
gcgcaucucccugccagugaaag

SEQ ID NO: 1673843 - RNA, 18 nt, Salmonella enterica enterica serovar Typhi
gcgcauugcgccccagca

SEQ ID NO: 1673844 - RNA, 19 nt, Salmonella enterica enterica serovar Typhi
gcgcauugcgcuauuacuc

SEQ ID NO: 1673845 - RNA, 16 nt, Salmonella enterica enterica serovar Typhi
gcgcauuccagacccg

SEQ ID NO: 1673846 - RNA, 15 nt, Salmonella enterica enterica serovar Typhi
gcgcauucaccccag

SEQ ID NO: 1673847 - RNA, 21 nt, Salmonella enterica enterica serovar Typhi
gcgcauuaacgccaugcucau

SEQ ID NO: 1673848 - RNA, 19 nt, Salmonella enterica enterica serovar Typhi
gcgccaauccaugccggcu

SEQ ID NO: 1673849 - RNA, 20 nt, Salmonella enterica enterica serovar Typhi
gcgccaauggcgaucuuuug

SEQ ID NO: 1673850 - RNA, 13 nt, Salmonella enterica enterica serovar Typhi
gcgccaccacuga

SEQ ID NO: 1673851 - RNA, 15 nt, Salmonella enterica enterica serovar Typhi
gcgccaagcggcaac

SEQ ID NO: 1673852 - RNA, 21 nt, Salmonella enterica enterica serovar Typhi
gcgccaaucaccgccagcaac

SEQ ID NO: 1673853 - RNA, 19 nt, Salmonella enterica enterica serovar Typhi
gcgccaacggccucccagc

SEQ ID NO: 1673854 - RNA, 18 nt, Salmonella enterica enterica serovar Typhi
gcgccaaacgggcaagcc

SEQ ID NO: 1673855 - RNA, 21 nt, Salmonella enterica enterica serovar Typhi
gcgccaaacgggcaagccagc

SEQ ID NO: 1673856 - RNA, 18 nt, Salmonella enterica enterica serovar Typhi
gcgccaaaagaggcagca

SEQ ID NO: 1673857 - RNA, 17 nt, Salmonella enterica enterica serovar Typhi
gcgcauuucguggcgga

SEQ ID NO: 1673858 - RNA, 16 nt, Salmonella enterica enterica serovar Typhi
gcgcauuugcggcguc

SEQ ID NO: 1673859 - RNA, 17 nt, Salmonella enterica enterica serovar Typhi
gcgcauuuuacugccgu

SEQ ID NO: 1673860 - RNA, 20 nt, Salmonella enterica enterica serovar Typhi
gcgcauuuuauuuaaaaagg

SEQ ID NO: 1673861 - RNA, 22 nt, Salmonella enterica enterica serovar Typhi
gcgccaccgggcaacacacgcu

SEQ ID NO: 1673862 - RNA, 18 nt, Salmonella enterica enterica serovar Typhi
gcgccacgcgccagccgu

SEQ ID NO: 1673863 - RNA, 19 nt, Salmonella enterica enterica serovar Typhi
gcgccagcuuucggcgagc

SEQ ID NO: 1673864 - RNA, 15 nt, Salmonella enterica enterica serovar Typhi
gcgccagcccugcga

SEQ ID NO: 1673865 - RNA, 16 nt, Salmonella enterica enterica serovar Typhi
gcgccagccagucgcc

SEQ ID NO: 1673866 - RNA, 18 nt, Salmonella enterica enterica serovar Typhi
gcgccagccagucgccag

SEQ ID NO: 1673867 - RNA, 12 nt, Salmonella enterica enterica serovar Typhi
gcgccagcaggu

SEQ ID NO: 1673868 - RNA, 14 nt, Salmonella enterica enterica serovar Typhi
gcgccaucuccucc

SEQ ID NO: 1673869 - RNA, 17 nt, Salmonella enterica enterica serovar Typhi
gcgccaucuccuccuca

SEQ ID NO: 1673870 - RNA, 21 nt, Salmonella enterica enterica serovar Typhi
gcgccauauugcuguauuuua

SEQ ID NO: 1673871 - RNA, 16 nt, Salmonella enterica enterica serovar Typhi
gcgccauccggcacac

SEQ ID NO: 1673872 - RNA, 15 nt, Salmonella enterica enterica serovar Typhi
gcgccauccggcgcu

SEQ ID NO: 1673873 - RNA, 17 nt, Salmonella enterica enterica serovar Typhi
gcgccauccggcgcuga

SEQ ID NO: 1673874 - RNA, 20 nt, Salmonella enterica enterica serovar Typhi
gcgccauccaccaggcaugc

SEQ ID NO: 1673875 - RNA, 23 nt, Salmonella enterica enterica serovar Typhi
gcgccaucccaugcaccaguccc

SEQ ID NO: 1673876 - RNA, 14 nt, Salmonella enterica enterica serovar Typhi
gcgccaucaugcag

SEQ ID NO: 1673877 - RNA, 16 nt, Salmonella enterica enterica serovar Typhi
gcgccaucaggcacaa

SEQ ID NO: 1673878 - RNA, 18 nt, Salmonella enterica enterica serovar Typhi
gcgccaucaggcaucuga

SEQ ID NO: 1673879 - RNA, 12 nt, Salmonella enterica enterica serovar Typhi
gcgccauaaaaa

SEQ ID NO: 1673880 - RNA, 17 nt, Salmonella enterica enterica serovar Typhi
gcgccaggccauugcug

SEQ ID NO: 1673881 - RNA, 17 nt, Salmonella enterica enterica serovar Typhi
gcgccaggcccagccgc

SEQ ID NO: 1673882 - RNA, 20 nt, Salmonella enterica enterica serovar Typhi
gcgcacaauaccgagaaugu

SEQ ID NO: 1673883 - RNA, 17 nt, Salmonella enterica enterica serovar Typhi
gcgcaacuggcgccgga

SEQ ID NO: 1673884 - RNA, 22 nt, Salmonella enterica enterica serovar Typhi
gcgcaccuucaacagcucgcca

SEQ ID NO: 1673885 - RNA, 12 nt, Salmonella enterica enterica serovar Typhi
gcgcagagugac

SEQ ID NO: 1673886 - RNA, 19 nt, Salmonella enterica enterica serovar Typhi
gcgcagagugaccagcggu

SEQ ID NO: 1673887 - RNA, 16 nt, Salmonella enterica enterica serovar Typhi
gcgcagagugagcagg

SEQ ID NO: 1673888 - RNA, 14 nt, Salmonella enterica enterica serovar Typhi
gcgcagacacugcc

SEQ ID NO: 1673889 - RNA, 23 nt, Salmonella enterica enterica serovar Typhi
gcgcaggcucucggugguggcag

SEQ ID NO: 1673890 - RNA, 17 nt, Salmonella enterica enterica serovar Typhi
gcgcagggucugguggu

SEQ ID NO: 1673891 - RNA, 14 nt, Salmonella enterica enterica serovar Typhi
gcgcaggggcuauu

SEQ ID NO: 1673892 - RNA, 14 nt, Salmonella enterica enterica serovar Typhi
gcgcaggggcauuu

SEQ ID NO: 1673893 - RNA, 23 nt, Salmonella enterica enterica serovar Typhi
gcgcagguaguugucggcggucg

SEQ ID NO: 1673894 - RNA, 17 nt, Salmonella enterica enterica serovar Typhi
gcgcagcgcccagcagc

SEQ ID NO: 1673895 - RNA, 20 nt, Salmonella enterica enterica serovar Typhi
gcgcaguaaacuccucuucc

SEQ ID NO: 1673896 - RNA, 19 nt, Salmonella enterica enterica serovar Typhi
gcgcaguucgccgccagga

SEQ ID NO: 1673897 - RNA, 16 nt, Salmonella enterica enterica serovar Typhi
gcgcaguuccagcggc

SEQ ID NO: 1673898 - RNA, 23 nt, Salmonella enterica enterica serovar Typhi
gcgcauacucauuaccggcugcc

SEQ ID NO: 1673899 - RNA, 19 nt, Salmonella enterica enterica serovar Typhi
gcgcaucaacgccaggcag

SEQ ID NO: 1673900 - RNA, 19 nt, Salmonella enterica enterica serovar Typhi
gcgcauaccggccacgagc

SEQ ID NO: 1673901 - RNA, 23 nt, Salmonella enterica enterica serovar Typhi
gcgcauacgcuguccagucaaaa

SEQ ID NO: 1673902 - RNA, 20 nt, Salmonella enterica enterica serovar Typhi
gcgcauaaaaaaggccgcuu

SEQ ID NO: 1673903 - RNA, 18 nt, Salmonella enterica enterica serovar Typhi
gcgcauccaccagacccg

SEQ ID NO: 1673904 - RNA, 14 nt, Salmonella enterica enterica serovar Typhi
gcgcaucagaaaaa

SEQ ID NO: 1673905 - RNA, 18 nt, Salmonella enterica enterica serovar Typhi
gcugccuuauccggccug

SEQ ID NO: 1673906 - RNA, 18 nt, Salmonella enterica enterica serovar Typhi
gcugcgauaaugaagcau

SEQ ID NO: 1673907 - RNA, 14 nt, Salmonella enterica enterica serovar Typhi
gcugccucuuuguu

SEQ ID NO: 1673908 - RNA, 19 nt, Salmonella enterica enterica serovar Typhi
gcugccgcaacggucgguc

SEQ ID NO: 1673909 - RNA, 22 nt, Salmonella enterica enterica serovar Typhi
gcugccgauagcaucgcugaug

SEQ ID NO: 1673910 - RNA, 21 nt, Salmonella enterica enterica serovar Typhi
gcugcccugcgguagcuccag

SEQ ID NO: 1673911 - RNA, 22 nt, Salmonella enterica enterica serovar Typhi
gcugccgacaaagagcucccca

SEQ ID NO: 1673912 - RNA, 15 nt, Salmonella enterica enterica serovar Typhi
gcugccgaccuggcu

SEQ ID NO: 1673913 - RNA, 12 nt, Salmonella enterica enterica serovar Typhi
gcugccaucagg

SEQ ID NO: 1673914 - RNA, 17 nt, Salmonella enterica enterica serovar Typhi
gcugccauuaucaccau

SEQ ID NO: 1673915 - RNA, 15 nt, Salmonella enterica enterica serovar Typhi
gcugcaacucuccca

SEQ ID NO: 1673916 - RNA, 20 nt, Salmonella enterica enterica serovar Typhi
gcugcacccggagagaaaca

SEQ ID NO: 1673917 - RNA, 21 nt, Salmonella enterica enterica serovar Typhi
gcugcaucuuacugaccggcc

SEQ ID NO: 1673918 - RNA, 16 nt, Salmonella enterica enterica serovar Typhi
gcugcaucuuacugac

SEQ ID NO: 1673919 - RNA, 20 nt, Salmonella enterica enterica serovar Typhi
gcugcauccuguaccaccac

SEQ ID NO: 1673920 - RNA, 21 nt, Salmonella enterica enterica serovar Typhi
gcugcuucacguuuuccaggu

SEQ ID NO: 1673921 - RNA, 16 nt, Salmonella enterica enterica serovar Typhi
gcugcuggugcgccug

SEQ ID NO: 1673922 - RNA, 14 nt, Salmonella enterica enterica serovar Typhi
gcugcuguaacaga

SEQ ID NO: 1673923 - RNA, 22 nt, Salmonella enterica enterica serovar Typhi
gcugcuguaacagacgcaggcc

SEQ ID NO: 1673924 - RNA, 21 nt, Salmonella enterica enterica serovar Typhi
gcuggaaaaauaagagggcgc

SEQ ID NO: 1673925 - RNA, 19 nt, Salmonella enterica enterica serovar Typhi
gcugcuuuuugagcggcac

SEQ ID NO: 1673926 - RNA, 22 nt, Salmonella enterica enterica serovar Typhi
gcugcuugcuuuucaucaccau

SEQ ID NO: 1673927 - RNA, 22 nt, Salmonella enterica enterica serovar Typhi
gcuggauaccgcgccagcgaug

SEQ ID NO: 1673928 - RNA, 17 nt, Salmonella enterica enterica serovar Typhi
gcuggauagagcgcugc

SEQ ID NO: 1673929 - RNA, 21 nt, Salmonella enterica enterica serovar Typhi
gcuggagcaggugcggcuggg

SEQ ID NO: 1673930 - RNA, 23 nt, Salmonella enterica enterica serovar Typhi
gcuggacauguuccgccccgccu

SEQ ID NO: 1673931 - RNA, 14 nt, Salmonella enterica enterica serovar Typhi
gcuggcacuggcag

SEQ ID NO: 1673932 - RNA, 20 nt, Salmonella enterica enterica serovar Typhi
gcuggcaaaacgcauccagc

SEQ ID NO: 1673933 - RNA, 13 nt, Salmonella enterica enterica serovar Typhi
gcugcggcgugga

SEQ ID NO: 1673934 - RNA, 11 nt, Salmonella enterica enterica serovar Typhi
gcugcggauga

SEQ ID NO: 1673935 - RNA, 16 nt, Salmonella enterica enterica serovar Typhi
gcugcggaacaccagc

SEQ ID NO: 1673936 - RNA, 23 nt, Salmonella enterica enterica serovar Typhi
gcugcgccauauccucgcugggc

SEQ ID NO: 1673937 - RNA, 22 nt, Salmonella enterica enterica serovar Typhi
gcugcgccuggaaaaaagcgcc

SEQ ID NO: 1673938 - RNA, 12 nt, Salmonella enterica enterica serovar Typhi
gcugcucccuca

SEQ ID NO: 1673939 - RNA, 20 nt, Salmonella enterica enterica serovar Typhi
gcugcugaaagaagacgaaa

SEQ ID NO: 1673940 - RNA, 11 nt, Salmonella enterica enterica serovar Typhi
gcugcugaugg

SEQ ID NO: 1673941 - RNA, 22 nt, Salmonella enterica enterica serovar Typhi
gcugcugaccuuaauccagcag

SEQ ID NO: 1673942 - RNA, 23 nt, Salmonella enterica enterica serovar Typhi
gcugcugaccuuaauccagcagu

SEQ ID NO: 1673943 - RNA, 18 nt, Salmonella enterica enterica serovar Typhi
gcugcgucagcgcuugcc

SEQ ID NO: 1673944 - RNA, 13 nt, Salmonella enterica enterica serovar Typhi
gcuguagcugccc

SEQ ID NO: 1673945 - RNA, 22 nt, Salmonella enterica enterica serovar Typhi
gcuguaggcacuuuccagacca

SEQ ID NO: 1673946 - RNA, 22 nt, Salmonella enterica enterica serovar Typhi
gcuguaguuucagcccaaaagc

SEQ ID NO: 1673947 - RNA, 15 nt, Salmonella enterica enterica serovar Typhi
gcugucaccagcagc

SEQ ID NO: 1673948 - RNA, 15 nt, Salmonella enterica enterica serovar Typhi
gcuguauuucccucu

SEQ ID NO: 1673949 - RNA, 16 nt, Salmonella enterica enterica serovar Typhi
gcugucaucaaugagc

SEQ ID NO: 1673950 - RNA, 21 nt, Salmonella enterica enterica serovar Typhi
gcuguccagauagggccaggc

SEQ ID NO: 1673951 - RNA, 14 nt, Salmonella enterica enterica serovar Typhi
gcugucccagaguu

SEQ ID NO: 1673952 - RNA, 17 nt, Salmonella enterica enterica serovar Typhi
gcuguccuuaaccagcu

SEQ ID NO: 1673953 - RNA, 18 nt, Salmonella enterica enterica serovar Typhi
gcugucgaugauauccag

SEQ ID NO: 1673954 - RNA, 15 nt, Salmonella enterica enterica serovar Typhi
gcuguccagccgccc

SEQ ID NO: 1673955 - RNA, 18 nt, Salmonella enterica enterica serovar Typhi
gcuguaauagauaugaaa

SEQ ID NO: 1673956 - RNA, 14 nt, Salmonella enterica enterica serovar Typhi
gcuggugucgccgu

SEQ ID NO: 1673957 - RNA, 19 nt, Salmonella enterica enterica serovar Typhi
gcugguuaacgccgccauc

SEQ ID NO: 1673958 - RNA, 13 nt, Salmonella enterica enterica serovar Typhi
gcugguggugggc

SEQ ID NO: 1673959 - RNA, 22 nt, Salmonella enterica enterica serovar Typhi
gcuggugccaaucuccagcauc

SEQ ID NO: 1673960 - RNA, 15 nt, Salmonella enterica enterica serovar Typhi
gcuggugcugugccu

SEQ ID NO: 1673961 - RNA, 12 nt, Salmonella enterica enterica serovar Typhi
gcuggugguaaa

SEQ ID NO: 1673962 - RNA, 23 nt, Salmonella enterica enterica serovar Typhi
gcuguugugucccggcccauacu

SEQ ID NO: 1673963 - RNA, 21 nt, Salmonella enterica enterica serovar Typhi
gcuguuuagccgucucgguuc

SEQ ID NO: 1673964 - RNA, 15 nt, Salmonella enterica enterica serovar Typhi
gcuguuucuggucau

SEQ ID NO: 1673965 - RNA, 20 nt, Salmonella enterica enterica serovar Typhi
gcuguuucuggucauacugu

SEQ ID NO: 1673966 - RNA, 21 nt, Salmonella enterica enterica serovar Typhi
gcuguuuuucaucaucaucca

SEQ ID NO: 1673967 - RNA, 16 nt, Salmonella enterica enterica serovar Typhi
gcuguuaccguaagcg

SEQ ID NO: 1673968 - RNA, 15 nt, Salmonella enterica enterica serovar Typhi
gcuguuaguaagcug

SEQ ID NO: 1673969 - RNA, 19 nt, Salmonella enterica enterica serovar Typhi
gcuguuaaucucauaaaug

SEQ ID NO: 1673970 - RNA, 21 nt, Salmonella enterica enterica serovar Typhi
gcuguuccaccaacgaccauc

SEQ ID NO: 1673971 - RNA, 13 nt, Salmonella enterica enterica serovar Typhi
gcuguuccuggug

SEQ ID NO: 1673972 - RNA, 16 nt, Salmonella enterica enterica serovar Typhi
gcugugcuaucaggcc

SEQ ID NO: 1673973 - RNA, 13 nt, Salmonella enterica enterica serovar Typhi
gcugugccugccu

SEQ ID NO: 1673974 - RNA, 14 nt, Salmonella enterica enterica serovar Typhi
gcugugccugccug

SEQ ID NO: 1673975 - RNA, 15 nt, Salmonella enterica enterica serovar Typhi
gcuguggaaacugug

SEQ ID NO: 1673976 - RNA, 16 nt, Salmonella enterica enterica serovar Typhi
gcuguggaaacugugc

SEQ ID NO: 1673977 - RNA, 13 nt, Salmonella enterica enterica serovar Typhi
gcugugugaccag

SEQ ID NO: 1673978 - RNA, 16 nt, Salmonella enterica enterica serovar Typhi
gcugugugaccagcag

SEQ ID NO: 1673979 - RNA, 20 nt, Salmonella enterica enterica serovar Typhi
gcugucuaauugacggccac

SEQ ID NO: 1673980 - RNA, 16 nt, Salmonella enterica enterica serovar Typhi
gcugucggucagauuc

SEQ ID NO: 1673981 - RNA, 20 nt, Salmonella enterica enterica serovar Typhi
gcugucggucggcuuuuguu

SEQ ID NO: 1673982 - RNA, 15 nt, Salmonella enterica enterica serovar Typhi
gcugugcauaaauaa

SEQ ID NO: 1673983 - RNA, 22 nt, Salmonella enterica enterica serovar Typhi
gcugugagaaggugguggguaa

SEQ ID NO: 1673984 - RNA, 13 nt, Salmonella enterica enterica serovar Typhi
gcugugccaauaa

SEQ ID NO: 1673985 - RNA, 15 nt, Salmonella enterica enterica serovar Typhi
gcuggcuuaacucac

SEQ ID NO: 1673986 - RNA, 15 nt, Salmonella enterica enterica serovar Typhi
gcuggcguugagcgu

SEQ ID NO: 1673987 - RNA, 15 nt, Salmonella enterica enterica serovar Typhi
gcugggccugcuccg

SEQ ID NO: 1673988 - RNA, 20 nt, Salmonella enterica enterica serovar Typhi
gcuggguugauaccggagga

SEQ ID NO: 1673989 - RNA, 17 nt, Salmonella enterica enterica serovar Typhi
gcugggugagcgggcug

SEQ ID NO: 1673990 - RNA, 23 nt, Salmonella enterica enterica serovar Typhi
gcuggggcgcguuucauuaagcc

SEQ ID NO: 1673991 - RNA, 17 nt, Salmonella enterica enterica serovar Typhi
gcuggucgccgcccauc

SEQ ID NO: 1673992 - RNA, 18 nt, Salmonella enterica enterica serovar Typhi
gcuggucugaaucugcuc

SEQ ID NO: 1673993 - RNA, 21 nt, Salmonella enterica enterica serovar Typhi
gcuggugcagcccgucggcgu

SEQ ID NO: 1673994 - RNA, 15 nt, Salmonella enterica enterica serovar Typhi
gcuggucgccagcgc

SEQ ID NO: 1673995 - RNA, 13 nt, Salmonella enterica enterica serovar Typhi
gcuggucgagaua

SEQ ID NO: 1673996 - RNA, 21 nt, Salmonella enterica enterica serovar Typhi
gcuggucagcguacccgcggu

SEQ ID NO: 1673997 - RNA, 18 nt, Salmonella enterica enterica serovar Typhi
gcugguagacaaacagcg

SEQ ID NO: 1673998 - RNA, 15 nt, Salmonella enterica enterica serovar Typhi
gcuggcgcaacuggc

SEQ ID NO: 1673999 - RNA, 23 nt, Salmonella enterica enterica serovar Typhi
gcuggcgauauccgugccgccgc

SEQ ID NO: 1674000 - RNA, 18 nt, Salmonella enterica enterica serovar Typhi
gcuggcgcggggaacaca

SEQ ID NO: 1674001 - RNA, 15 nt, Salmonella enterica enterica serovar Typhi
gcuggcgcaugaucu

SEQ ID NO: 1674002 - RNA, 21 nt, Salmonella enterica enterica serovar Typhi
gcuggcgcgucacaacagccg

SEQ ID NO: 1674003 - RNA, 22 nt, Salmonella enterica enterica serovar Typhi
gcuggcgcucacgauaacgcag

SEQ ID NO: 1674004 - RNA, 14 nt, Salmonella enterica enterica serovar Typhi
gcuggcgcuguccu

SEQ ID NO: 1674005 - RNA, 13 nt, Salmonella enterica enterica serovar Typhi
gcuggcguccagc

SEQ ID NO: 1674006 - RNA, 19 nt, Salmonella enterica enterica serovar Typhi
gcuggcgucgccaaagcag

SEQ ID NO: 1674007 - RNA, 19 nt, Salmonella enterica enterica serovar Typhi
gcuggcgguuuuugugggu

SEQ ID NO: 1674008 - RNA, 21 nt, Salmonella enterica enterica serovar Typhi
gcuggcguacaguuucgccgu

SEQ ID NO: 1674009 - RNA, 14 nt, Salmonella enterica enterica serovar Typhi
gcuggcggucggga

SEQ ID NO: 1674010 - RNA, 21 nt, Salmonella enterica enterica serovar Typhi
gcuggccgaauagcugauaaa

SEQ ID NO: 1674011 - RNA, 14 nt, Salmonella enterica enterica serovar Typhi
gcuggcaggcgcga

SEQ ID NO: 1674012 - RNA, 16 nt, Salmonella enterica enterica serovar Typhi
gcuggcauaaccgcag

SEQ ID NO: 1674013 - RNA, 16 nt, Salmonella enterica enterica serovar Typhi
gcuuacuuuuagaauu

SEQ ID NO: 1674014 - RNA, 15 nt, Salmonella enterica enterica serovar Typhi
gcuuacggccaugga

SEQ ID NO: 1674015 - RNA, 15 nt, Salmonella enterica enterica serovar Typhi
gcuuacggcuauucc

SEQ ID NO: 1674016 - RNA, 21 nt, Salmonella enterica enterica serovar Typhi
gcuuacuuuuagaauuaucug

SEQ ID NO: 1674017 - RNA, 23 nt, Salmonella enterica enterica serovar Typhi
gcuuacuuuccaaaauccaggga

SEQ ID NO: 1674018 - RNA, 21 nt, Salmonella enterica enterica serovar Typhi
gcuuagaucguaucggcuggc

SEQ ID NO: 1674019 - RNA, 18 nt, Salmonella enterica enterica serovar Typhi
gcuuauaacccugucugc

SEQ ID NO: 1674020 - RNA, 12 nt, Salmonella enterica enterica serovar Typhi
gcuuagcuuccc

SEQ ID NO: 1674021 - RNA, 17 nt, Salmonella enterica enterica serovar Typhi
gcuuagcucaucagccu

SEQ ID NO: 1674022 - RNA, 21 nt, Salmonella enterica enterica serovar Typhi
gcuuauuagaggcguaaguaa

SEQ ID NO: 1674023 - RNA, 19 nt, Salmonella enterica enterica serovar Typhi
gcuuaucucuacuuuccug

SEQ ID NO: 1674024 - RNA, 18 nt, Salmonella enterica enterica serovar Typhi
gcuuaucugaccaugcca

SEQ ID NO: 1674025 - RNA, 18 nt, Salmonella enterica enterica serovar Typhi
gcuuaucugcugcugggu

SEQ ID NO: 1674026 - RNA, 16 nt, Salmonella enterica enterica serovar Typhi
gcuuauccggccuaca

SEQ ID NO: 1674027 - RNA, 21 nt, Salmonella enterica enterica serovar Typhi
gcuuaucgccaaaccagaccc

SEQ ID NO: 1674028 - RNA, 16 nt, Salmonella enterica enterica serovar Typhi
gcuuaucgccaaagau

SEQ ID NO: 1674029 - RNA, 20 nt, Salmonella enterica enterica serovar Typhi
gcuuaucacguagccagagc

SEQ ID NO: 1674030 - RNA, 16 nt, Salmonella enterica enterica serovar Typhi
gcuuaucaggccuaca

SEQ ID NO: 1674031 - RNA, 21 nt, Salmonella enterica enterica serovar Typhi
gcuuaucaguccccacauuac

SEQ ID NO: 1674032 - RNA, 13 nt, Salmonella enterica enterica serovar Typhi
gcuuacccagucu

SEQ ID NO: 1674033 - RNA, 22 nt, Salmonella enterica enterica serovar Typhi
gcuuaccggguuuggucaggua

SEQ ID NO: 1674034 - RNA, 19 nt, Salmonella enterica enterica serovar Typhi
gcuuaccguaucccaccau

SEQ ID NO: 1674035 - RNA, 23 nt, Salmonella enterica enterica serovar Typhi
gcuuaccuuguucuuccauugcu

SEQ ID NO: 1674036 - RNA, 13 nt, Salmonella enterica enterica serovar Typhi
gcuuaccagaccg

SEQ ID NO: 1674037 - RNA, 17 nt, Salmonella enterica enterica serovar Typhi
gcuuacaggcacgccug

SEQ ID NO: 1674038 - RNA, 17 nt, Salmonella enterica enterica serovar Typhi
gcuuacaauuuaucugc

SEQ ID NO: 1674039 - RNA, 16 nt, Salmonella enterica enterica serovar Typhi
gcuuacacagacugcu

SEQ ID NO: 1674040 - RNA, 18 nt, Salmonella enterica enterica serovar Typhi
gcuuacacagacugcuug

SEQ ID NO: 1674041 - RNA, 19 nt, Salmonella enterica enterica serovar Typhi
gcuuaaacaguauuuaugu

SEQ ID NO: 1674042 - RNA, 13 nt, Salmonella enterica enterica serovar Typhi
gcuuaaaaaaucc

SEQ ID NO: 1674043 - RNA, 19 nt, Salmonella enterica enterica serovar Typhi
gcuuaacgaugcggagaua

SEQ ID NO: 1674044 - RNA, 18 nt, Salmonella enterica enterica serovar Typhi
gcuuaacagaauugcgcc

SEQ ID NO: 1674045 - RNA, 18 nt, Salmonella enterica enterica serovar Typhi
gcuuaauggcgucaauca

SEQ ID NO: 1674046 - RNA, 16 nt, Salmonella enterica enterica serovar Typhi
gcuuaaucgagagcgg

SEQ ID NO: 1674047 - RNA, 12 nt, Salmonella enterica enterica serovar Typhi
gcuucaugcugg

SEQ ID NO: 1674048 - RNA, 19 nt, Salmonella enterica enterica serovar Typhi
gcuuccacgcacgccggcc

SEQ ID NO: 1674049 - RNA, 21 nt, Salmonella enterica enterica serovar Typhi
gcuucagucauaauccuuccu

SEQ ID NO: 1674050 - RNA, 12 nt, Salmonella enterica enterica serovar Typhi
gcuucagcgaca

SEQ ID NO: 1674051 - RNA, 22 nt, Salmonella enterica enterica serovar Typhi
gcuucaggauuuacugagcgcc

SEQ ID NO: 1674052 - RNA, 21 nt, Salmonella enterica enterica serovar Typhi
gcuucaggcucaucagcgcca

SEQ ID NO: 1674053 - RNA, 20 nt, Salmonella enterica enterica serovar Typhi
gcuucauaucgcccagcagc

SEQ ID NO: 1674054 - RNA, 19 nt, Salmonella enterica enterica serovar Typhi
gcuucaccgccagagcacg

SEQ ID NO: 1674055 - RNA, 20 nt, Salmonella enterica enterica serovar Typhi
gcuucaccggcgugcgcuua

SEQ ID NO: 1674056 - RNA, 23 nt, Salmonella enterica enterica serovar Typhi
gcuucacgagcggucaggccagc

SEQ ID NO: 1674057 - RNA, 22 nt, Salmonella enterica enterica serovar Typhi
gcuucaccguugugcuccagcg

SEQ ID NO: 1674058 - RNA, 13 nt, Salmonella enterica enterica serovar Typhi
gcuucaccucagc

SEQ ID NO: 1674059 - RNA, 11 nt, Salmonella enterica enterica serovar Typhi
gcuucacgcca

SEQ ID NO: 1674060 - RNA, 14 nt, Salmonella enterica enterica serovar Typhi
gcuucacgccacag

SEQ ID NO: 1674061 - RNA, 13 nt, Salmonella enterica enterica serovar Typhi
gcuucagagcagg

SEQ ID NO: 1674062 - RNA, 16 nt, Salmonella enterica enterica serovar Typhi
gcuucagccacuggcu

SEQ ID NO: 1674063 - RNA, 22 nt, Salmonella enterica enterica serovar Typhi
gcuucaauaaguuagcuuuuuu

SEQ ID NO: 1674064 - RNA, 21 nt, Salmonella enterica enterica serovar Typhi
gcuucaaucgucguuccgcca

SEQ ID NO: 1674065 - RNA, 14 nt, Salmonella enterica enterica serovar Typhi
gcuucaacagcggc

SEQ ID NO: 1674066 - RNA, 20 nt, Salmonella enterica enterica serovar Typhi
gcuucuuugaaauugaucac

SEQ ID NO: 1674067 - RNA, 21 nt, Salmonella enterica enterica serovar Typhi
gcuucuuugaagcguuccagu

SEQ ID NO: 1674068 - RNA, 23 nt, Salmonella enterica enterica serovar Typhi
gcuucuucacuaauuugaugccu

SEQ ID NO: 1674069 - RNA, 20 nt, Salmonella enterica enterica serovar Typhi
gcuucuguccuuucugcugc

SEQ ID NO: 1674070 - RNA, 15 nt, Salmonella enterica enterica serovar Typhi
gcuucuucgccagcu

SEQ ID NO: 1674071 - RNA, 18 nt, Salmonella enterica enterica serovar Typhi
gcuucuucuuuagauaau

SEQ ID NO: 1674072 - RNA, 21 nt, Salmonella enterica enterica serovar Typhi
gcuucguggcaaucagcaauu

SEQ ID NO: 1674073 - RNA, 14 nt, Salmonella enterica enterica serovar Typhi
gcuucgucuuuauu

SEQ ID NO: 1674074 - RNA, 15 nt, Salmonella enterica enterica serovar Typhi
gcuucgugagaagua

SEQ ID NO: 1674075 - RNA, 22 nt, Salmonella enterica enterica serovar Typhi
gcuucucacggauccagaacug

SEQ ID NO: 1674076 - RNA, 16 nt, Salmonella enterica enterica serovar Typhi
gcuucuauuaccgcag

SEQ ID NO: 1674077 - RNA, 17 nt, Salmonella enterica enterica serovar Typhi
gcuucugauacugcucc

SEQ ID NO: 1674078 - RNA, 21 nt, Salmonella enterica enterica serovar Typhi
gcuucugcgccuuuggcagga

SEQ ID NO: 1674079 - RNA, 16 nt, Salmonella enterica enterica serovar Typhi
gcuucugauacugcuc

SEQ ID NO: 1674080 - RNA, 19 nt, Salmonella enterica enterica serovar Typhi
gcuucucuucaaacucgcu

SEQ ID NO: 1674081 - RNA, 11 nt, Salmonella enterica enterica serovar Typhi
gcuucucccaa

SEQ ID NO: 1674082 - RNA, 14 nt, Salmonella enterica enterica serovar Typhi
gcuucgcuuaccag

SEQ ID NO: 1674083 - RNA, 15 nt, Salmonella enterica enterica serovar Typhi
gcuucggacuccuga

SEQ ID NO: 1674084 - RNA, 20 nt, Salmonella enterica enterica serovar Typhi
gcuuccuguuuaugacccug

SEQ ID NO: 1674085 - RNA, 22 nt, Salmonella enterica enterica serovar Typhi
gcuucgccaauaaugccgccgu

SEQ ID NO: 1674086 - RNA, 14 nt, Salmonella enterica enterica serovar Typhi
gcuuccugcagugg

SEQ ID NO: 1674087 - RNA, 19 nt, Salmonella enterica enterica serovar Typhi
gcuuccugcgcugucacca

SEQ ID NO: 1674088 - RNA, 15 nt, Salmonella enterica enterica serovar Typhi
gcuuccuguuuauga

SEQ ID NO: 1674089 - RNA, 15 nt, Salmonella enterica enterica serovar Typhi
gcuuccgccaugguu

SEQ ID NO: 1674090 - RNA, 17 nt, Salmonella enterica enterica serovar Typhi
gcuucccgaaaggaagc

SEQ ID NO: 1674091 - RNA, 14 nt, Salmonella enterica enterica serovar Typhi
gcuucccgaaagga

SEQ ID NO: 1674092 - RNA, 15 nt, Salmonella enterica enterica serovar Typhi
gcuucccccggcgcc

SEQ ID NO: 1674093 - RNA, 22 nt, Salmonella enterica enterica serovar Typhi
gcuuccaguugaaaaccacaau

SEQ ID NO: 1674094 - RNA, 17 nt, Salmonella enterica enterica serovar Typhi
gcuuccagcuccaucca

SEQ ID NO: 1674095 - RNA, 12 nt, Salmonella enterica enterica serovar Typhi
gcuuccagcaug

SEQ ID NO: 1674096 - RNA, 21 nt, Salmonella enterica enterica serovar Typhi
gcuuccagcgcgucggccggc

SEQ ID NO: 1674097 - RNA, 13 nt, Salmonella enterica enterica serovar Typhi
gcuuccagcucca

SEQ ID NO: 1674098 - RNA, 14 nt, Salmonella enterica enterica serovar Typhi
gcuugacucugaag

SEQ ID NO: 1674099 - RNA, 20 nt, Salmonella enterica enterica serovar Typhi
gcuugauacgccaucuuucu

SEQ ID NO: 1674100 - RNA, 14 nt, Salmonella enterica enterica serovar Typhi
gcuugauaaauauc

SEQ ID NO: 1674101 - RNA, 20 nt, Salmonella enterica enterica serovar Typhi
gcuugccacuacgcagcucc

SEQ ID NO: 1674102 - RNA, 19 nt, Salmonella enterica enterica serovar Typhi
gcuugcauugcuuuuaguu

SEQ ID NO: 1674103 - RNA, 16 nt, Salmonella enterica enterica serovar Typhi
gcuugccgaccgcaac

SEQ ID NO: 1674104 - RNA, 16 nt, Salmonella enterica enterica serovar Typhi
gcuugcgccaucaucc

SEQ ID NO: 1674105 - RNA, 19 nt, Salmonella enterica enterica serovar Typhi
gcuugcgccaucauccggc

SEQ ID NO: 1674106 - RNA, 19 nt, Salmonella enterica enterica serovar Typhi
gcuugccugugcccgcggu

SEQ ID NO: 1674107 - RNA, 21 nt, Salmonella enterica enterica serovar Typhi
gcuugccgucgucauaagcaa

SEQ ID NO: 1674108 - RNA, 12 nt, Salmonella enterica enterica serovar Typhi
gcuugccugcuu

SEQ ID NO: 1674109 - RNA, 15 nt, Salmonella enterica enterica serovar Typhi
gcuugcgcuauccgc

SEQ ID NO: 1674110 - RNA, 16 nt, Salmonella enterica enterica serovar Typhi
gcuugcugcguaaaag

SEQ ID NO: 1674111 - RNA, 20 nt, Salmonella enterica enterica serovar Typhi
gcuuggccaguggggcugcu

SEQ ID NO: 1674112 - RNA, 20 nt, Salmonella enterica enterica serovar Typhi
gcuugcguguuugggcgagg

SEQ ID NO: 1674113 - RNA, 15 nt, Salmonella enterica enterica serovar Typhi
gcuugucauccugcu

SEQ ID NO: 1674114 - RNA, 16 nt, Salmonella enterica enterica serovar Typhi
gcuugucauccugcuc

SEQ ID NO: 1674115 - RNA, 16 nt, Salmonella enterica enterica serovar Typhi
gcuugucgccaugcac

SEQ ID NO: 1674116 - RNA, 20 nt, Salmonella enterica enterica serovar Typhi
gcuuggcguauagccgcccc

SEQ ID NO: 1674117 - RNA, 17 nt, Salmonella enterica enterica serovar Typhi
gcuuguuguaaagaaau

SEQ ID NO: 1674118 - RNA, 19 nt, Salmonella enterica enterica serovar Typhi
gcuuguuguuuauccugca

SEQ ID NO: 1674119 - RNA, 17 nt, Salmonella enterica enterica serovar Typhi
gcuuuaauaccgguggc

SEQ ID NO: 1674120 - RNA, 20 nt, Salmonella enterica enterica serovar Typhi
gcuuuacccggcgcaaacag

SEQ ID NO: 1674121 - RNA, 17 nt, Salmonella enterica enterica serovar Typhi
gcuuuaaucaccauggc

SEQ ID NO: 1674122 - RNA, 21 nt, Salmonella enterica enterica serovar Typhi
gcuuuaaugcuuuaaaugccu

SEQ ID NO: 1674123 - RNA, 16 nt, Salmonella enterica enterica serovar Typhi
gcuuuaggguaucauu

SEQ ID NO: 1674124 - RNA, 12 nt, Salmonella enterica enterica serovar Typhi
gcuuuagcuuua

SEQ ID NO: 1674125 - RNA, 13 nt, Salmonella enterica enterica serovar Typhi
gcuuuuucaucau

SEQ ID NO: 1674126 - RNA, 15 nt, Salmonella enterica enterica serovar Typhi
gcuuuuugccgggcg

SEQ ID NO: 1674127 - RNA, 18 nt, Salmonella enterica enterica serovar Typhi
gcuuuuccuguucuggcu

SEQ ID NO: 1674128 - RNA, 17 nt, Salmonella enterica enterica serovar Typhi
gcuuuuaaaacuucccg

SEQ ID NO: 1674129 - RNA, 15 nt, Salmonella enterica enterica serovar Typhi
gcuuuucagcccagg

SEQ ID NO: 1674130 - RNA, 19 nt, Salmonella enterica enterica serovar Typhi
gcuuuucagcgucuuucuu

SEQ ID NO: 1674131 - RNA, 17 nt, Salmonella enterica enterica serovar Typhi
gcuuuucaugaaacucg

SEQ ID NO: 1674132 - RNA, 22 nt, Salmonella enterica enterica serovar Typhi
gcuuuucaugacgcucuccucc

SEQ ID NO: 1674133 - RNA, 17 nt, Salmonella enterica enterica serovar Typhi
gcuuugcguaaaaaaca

SEQ ID NO: 1674134 - RNA, 17 nt, Salmonella enterica enterica serovar Typhi
gcuuugcuuauccggcc

SEQ ID NO: 1674135 - RNA, 22 nt, Salmonella enterica enterica serovar Typhi
gcuuuguagcauaaucaggccc

SEQ ID NO: 1674136 - RNA, 18 nt, Salmonella enterica enterica serovar Typhi
gcuuuguaaaacauucaa

SEQ ID NO: 1674137 - RNA, 14 nt, Salmonella enterica enterica serovar Typhi
gcuuuggcaggccu

SEQ ID NO: 1674138 - RNA, 17 nt, Salmonella enterica enterica serovar Typhi
gcuuucagauuagccag

SEQ ID NO: 1674139 - RNA, 16 nt, Salmonella enterica enterica serovar Typhi
gcuuucaauaaaucaa

SEQ ID NO: 1674140 - RNA, 12 nt, Salmonella enterica enterica serovar Typhi
gcuuuauauaaa

SEQ ID NO: 1674141 - RNA, 22 nt, Salmonella enterica enterica serovar Typhi
gcuuuauucugucgccaccacu

SEQ ID NO: 1674142 - RNA, 16 nt, Salmonella enterica enterica serovar Typhi
gcuuuauuuuacaacu

SEQ ID NO: 1674143 - RNA, 21 nt, Salmonella enterica enterica serovar Typhi
gcuuuauucugucgccaccac

SEQ ID NO: 1674144 - RNA, 13 nt, Salmonella enterica enterica serovar Typhi
gcuuuccgccaug

SEQ ID NO: 1674145 - RNA, 19 nt, Salmonella enterica enterica serovar Typhi
gcuuuccggcgcuuccugc

SEQ ID NO: 1674146 - RNA, 22 nt, Salmonella enterica enterica serovar Typhi
gcuuuccggcgcuuccugcagu

SEQ ID NO: 1674147 - RNA, 22 nt, Salmonella enterica enterica serovar Typhi
gcuuucaucauaucuucccgau

SEQ ID NO: 1674148 - RNA, 17 nt, Salmonella enterica enterica serovar Typhi
gcuuuccagccaugcca

SEQ ID NO: 1674149 - RNA, 22 nt, Salmonella enterica enterica serovar Typhi
gcuuucggucguuugccgugca

SEQ ID NO: 1674150 - RNA, 14 nt, Salmonella enterica enterica serovar Typhi
gcuuucuucguuag

SEQ ID NO: 1674151 - RNA, 10 nt, Salmonella enterica enterica serovar Typhi
gcuuucuucu

SEQ ID NO: 1674152 - RNA, 19 nt, Salmonella enterica enterica serovar Typhi
gcuuucuguugauacagua

SEQ ID NO: 1674153 - RNA, 23 nt, Salmonella enterica enterica serovar Typhi
gcuuucuuccagguuaacccaca

SEQ ID NO: 1674154 - RNA, 15 nt, Salmonella enterica enterica serovar Typhi
gcuuucugagccgcc

SEQ ID NO: 1674155 - RNA, 19 nt, Salmonella enterica enterica serovar Typhi
gcuuugauauagggcuuga

SEQ ID NO: 1674156 - RNA, 23 nt, Salmonella enterica enterica serovar Typhi
gcuuucuuucuccagcguacugc

SEQ ID NO: 1674157 - RNA, 22 nt, Salmonella enterica enterica serovar Typhi
gcuuugaacagcgucauccagu

SEQ ID NO: 1674158 - RNA, 14 nt, Salmonella enterica enterica serovar Typhi
gcuuucuucuucac

SEQ ID NO: 1674159 - RNA, 20 nt, Salmonella enterica enterica serovar Typhi
ggaaacgcuauuuaacccug

SEQ ID NO: 1674160 - RNA, 22 nt, Salmonella enterica enterica serovar Typhi
ggaaaaugaugacucauuaaaa

SEQ ID NO: 1674161 - RNA, 22 nt, Salmonella enterica enterica serovar Typhi
ggaaagccccuaccgaggcagg

SEQ ID NO: 1674162 - RNA, 20 nt, Salmonella enterica enterica serovar Typhi
ggaaagcauucgcagcagac

SEQ ID NO: 1674163 - RNA, 14 nt, Salmonella enterica enterica serovar Typhi
ggaaagccccuacc

SEQ ID NO: 1674164 - RNA, 15 nt, Salmonella enterica enterica serovar Typhi
ggaaacuguaguaau

SEQ ID NO: 1674165 - RNA, 23 nt, Salmonella enterica enterica serovar Typhi
ggaaacugugcgacaaccugcgc

SEQ ID NO: 1674166 - RNA, 22 nt, Salmonella enterica enterica serovar Typhi
ggaaaacggccagugaaauaaa

SEQ ID NO: 1674167 - RNA, 21 nt, Salmonella enterica enterica serovar Typhi
ggaaaaguuguugaccaacaa

SEQ ID NO: 1674168 - RNA, 13 nt, Salmonella enterica enterica serovar Typhi
ggaaaauaauaau

SEQ ID NO: 1674169 - RNA, 13 nt, Salmonella enterica enterica serovar Typhi
ggaaaaauaagag

SEQ ID NO: 1674170 - RNA, 16 nt, Salmonella enterica enterica serovar Typhi
ggaaaaccccaucccg

SEQ ID NO: 1674171 - RNA, 13 nt, Salmonella enterica enterica serovar Typhi
ggaaaacagcgcc

SEQ ID NO: 1674172 - RNA, 17 nt, Salmonella enterica enterica serovar Typhi
ggaaaaaagcagcaucc

SEQ ID NO: 1674173 - RNA, 23 nt, Salmonella enterica enterica serovar Typhi
ggaaaaaagcgcccagcgccgga

SEQ ID NO: 1674174 - RNA, 20 nt, Salmonella enterica enterica serovar Typhi
ggaaaaaauacugauaaaaa

SEQ ID NO: 1674175 - RNA, 13 nt, Salmonella enterica enterica serovar Typhi
ggaaaaaaagaau

SEQ ID NO: 1674176 - RNA, 14 nt, Salmonella enterica enterica serovar Typhi
ggaaaaaaagaaua

SEQ ID NO: 1674177 - RNA, 22 nt, Salmonella enterica enterica serovar Typhi
gcuuuuuucucugcuuucggug

SEQ ID NO: 1674178 - RNA, 15 nt, Salmonella enterica enterica serovar Typhi
gcuuuuuucucugcu

SEQ ID NO: 1674179 - RNA, 15 nt, Salmonella enterica enterica serovar Typhi
gcuuuuuucaccuuu

SEQ ID NO: 1674180 - RNA, 17 nt, Salmonella enterica enterica serovar Typhi
gcuuuuuuauuguuucu

SEQ ID NO: 1674181 - RNA, 15 nt, Salmonella enterica enterica serovar Typhi
ggaacagggccgcau

SEQ ID NO: 1674182 - RNA, 18 nt, Salmonella enterica enterica serovar Typhi
ggaaccaaaugcccagcu

SEQ ID NO: 1674183 - RNA, 12 nt, Salmonella enterica enterica serovar Typhi
ggaacagauaaa

SEQ ID NO: 1674184 - RNA, 13 nt, Salmonella enterica enterica serovar Typhi
ggaacacucuaaa

SEQ ID NO: 1674185 - RNA, 15 nt, Salmonella enterica enterica serovar Typhi
ggaacacucuaaauc

SEQ ID NO: 1674186 - RNA, 13 nt, Salmonella enterica enterica serovar Typhi
ggaacccagcaaa

SEQ ID NO: 1674187 - RNA, 14 nt, Salmonella enterica enterica serovar Typhi
ggaaauaaagguuc

SEQ ID NO: 1674188 - RNA, 17 nt, Salmonella enterica enterica serovar Typhi
ggaaagugaaggccaga

SEQ ID NO: 1674189 - RNA, 21 nt, Salmonella enterica enterica serovar Typhi
ggaaaguaccaaaacagaaaa

SEQ ID NO: 1674190 - RNA, 21 nt, Salmonella enterica enterica serovar Typhi
ggaacaacggcacacaggccg

SEQ ID NO: 1674191 - RNA, 18 nt, Salmonella enterica enterica serovar Typhi
ggaagccguauaugaaua

SEQ ID NO: 1674192 - RNA, 23 nt, Salmonella enterica enterica serovar Typhi
ggaagcccucggcgaacaggcgu

SEQ ID NO: 1674193 - RNA, 15 nt, Salmonella enterica enterica serovar Typhi
ggaagcuucagcaaa

SEQ ID NO: 1674194 - RNA, 21 nt, Salmonella enterica enterica serovar Typhi
ggaagacauucacauauauuu

SEQ ID NO: 1674195 - RNA, 19 nt, Salmonella enterica enterica serovar Typhi
ggaagacuggcgcagcaaa

SEQ ID NO: 1674196 - RNA, 10 nt, Salmonella enterica enterica serovar Typhi
ggaacgcugu

SEQ ID NO: 1674197 - RNA, 24 nt, Salmonella enterica enterica serovar Typhi
ggaacggcauacugucgcgcggcg

SEQ ID NO: 1674198 - RNA, 18 nt, Salmonella enterica enterica serovar Typhi
ggaacuguucagccagca

SEQ ID NO: 1674199 - RNA, 21 nt, Salmonella enterica enterica serovar Typhi
ggaacugacuccagcugguau

SEQ ID NO: 1674200 - RNA, 18 nt, Salmonella enterica enterica serovar Typhi
ggaagaaacgcuuaaagc

SEQ ID NO: 1674201 - RNA, 23 nt, Salmonella enterica enterica serovar Typhi
ggaagaaacgcuuaaagcguucc

SEQ ID NO: 1674202 - RNA, 21 nt, Salmonella enterica enterica serovar Typhi
ggaacucugcgacgccaggcg

SEQ ID NO: 1674203 - RNA, 16 nt, Salmonella enterica enterica serovar Typhi
ggaacuggugaaacag

SEQ ID NO: 1674204 - RNA, 14 nt, Salmonella enterica enterica serovar Typhi
ggaacugcggccag

SEQ ID NO: 1674205 - RNA, 17 nt, Salmonella enterica enterica serovar Typhi
ggaacugacuccagcug

SEQ ID NO: 1674206 - RNA, 22 nt, Salmonella enterica enterica serovar Typhi
ggaaucacgcauaucccacugc

SEQ ID NO: 1674207 - RNA, 13 nt, Salmonella enterica enterica serovar Typhi
ggaaucagccagg

SEQ ID NO: 1674208 - RNA, 22 nt, Salmonella enterica enterica serovar Typhi
ggaaugccgugauaggagagca

SEQ ID NO: 1674209 - RNA, 20 nt, Salmonella enterica enterica serovar Typhi
ggaaugccccagguuauaga

SEQ ID NO: 1674210 - RNA, 19 nt, Salmonella enterica enterica serovar Typhi
ggaauggcacagcgcagca

SEQ ID NO: 1674211 - RNA, 15 nt, Salmonella enterica enterica serovar Typhi
ggaaggcgugcagcg

SEQ ID NO: 1674212 - RNA, 18 nt, Salmonella enterica enterica serovar Typhi
ggaaggauagccguauga

SEQ ID NO: 1674213 - RNA, 16 nt, Salmonella enterica enterica serovar Typhi
ggaauuuguugguuua

SEQ ID NO: 1674214 - RNA, 18 nt, Salmonella enterica enterica serovar Typhi
ggaauuuaucaacaaauu

SEQ ID NO: 1674215 - RNA, 17 nt, Salmonella enterica enterica serovar Typhi
ggaauuuaccggugcgg

SEQ ID NO: 1674216 - RNA, 13 nt, Salmonella enterica enterica serovar Typhi
ggaaugcuuuaca

SEQ ID NO: 1674217 - RNA, 20 nt, Salmonella enterica enterica serovar Typhi
ggacacccggcuuuugcuuu

SEQ ID NO: 1674218 - RNA, 13 nt, Salmonella enterica enterica serovar Typhi
ggacggcaucagg

SEQ ID NO: 1674219 - RNA, 12 nt, Salmonella enterica enterica serovar Typhi
ggacguugaaaa

SEQ ID NO: 1674220 - RNA, 21 nt, Salmonella enterica enterica serovar Typhi
ggacguggguuucaauauagc

SEQ ID NO: 1674221 - RNA, 13 nt, Salmonella enterica enterica serovar Typhi
ggacauaaacgcc

SEQ ID NO: 1674222 - RNA, 17 nt, Salmonella enterica enterica serovar Typhi
ggacauauuccagaagc

SEQ ID NO: 1674223 - RNA, 21 nt, Salmonella enterica enterica serovar Typhi
ggagacggccacccaucccca

SEQ ID NO: 1674224 - RNA, 15 nt, Salmonella enterica enterica serovar Typhi
ggagacagaacagga

SEQ ID NO: 1674225 - RNA, 21 nt, Salmonella enterica enterica serovar Typhi
ggacucaccguuacaaauagc

SEQ ID NO: 1674226 - RNA, 14 nt, Salmonella enterica enterica serovar Typhi
ggacuccaggcaac

SEQ ID NO: 1674227 - RNA, 15 nt, Salmonella enterica enterica serovar Typhi
ggacucccaggugug

SEQ ID NO: 1674228 - RNA, 22 nt, Salmonella enterica enterica serovar Typhi
ggagaacgguucauccagcagc

SEQ ID NO: 1674229 - RNA, 15 nt, Salmonella enterica enterica serovar Typhi
ggagagccagaagaa

SEQ ID NO: 1674230 - RNA, 13 nt, Salmonella enterica enterica serovar Typhi
ggagagcaguccu

SEQ ID NO: 1674231 - RNA, 16 nt, Salmonella enterica enterica serovar Typhi
ggagagcaguccuaaa

SEQ ID NO: 1674232 - RNA, 22 nt, Salmonella enterica enterica serovar Typhi
ggagagguuagcgcagggggga

SEQ ID NO: 1674233 - RNA, 18 nt, Salmonella enterica enterica serovar Typhi
ggagaggcguucaugccu

SEQ ID NO: 1674234 - RNA, 18 nt, Salmonella enterica enterica serovar Typhi
ggagccgccuggccuguc

SEQ ID NO: 1674235 - RNA, 16 nt, Salmonella enterica enterica serovar Typhi
ggagcguucaugcugg

SEQ ID NO: 1674236 - RNA, 21 nt, Salmonella enterica enterica serovar Typhi
ggagccaguuuucgacauauu

SEQ ID NO: 1674237 - RNA, 17 nt, Salmonella enterica enterica serovar Typhi
ggagauuucauccucuu

SEQ ID NO: 1674238 - RNA, 19 nt, Salmonella enterica enterica serovar Typhi
ggagcagacuguaaaucug

SEQ ID NO: 1674239 - RNA, 23 nt, Salmonella enterica enterica serovar Typhi
ggagguauccuccugccaggcgc

SEQ ID NO: 1674240 - RNA, 15 nt, Salmonella enterica enterica serovar Typhi
ggaggucauuauuca

SEQ ID NO: 1674241 - RNA, 14 nt, Salmonella enterica enterica serovar Typhi
ggaggugcucuccc

SEQ ID NO: 1674242 - RNA, 22 nt, Salmonella enterica enterica serovar Typhi
ggaggaacagcgccgucacccg

SEQ ID NO: 1674243 - RNA, 13 nt, Salmonella enterica enterica serovar Typhi
ggaggcgggcgcg

SEQ ID NO: 1674244 - RNA, 19 nt, Salmonella enterica enterica serovar Typhi
ggagggguuuucgccagca

SEQ ID NO: 1674245 - RNA, 12 nt, Salmonella enterica enterica serovar Typhi
ggauaaaaaagc

SEQ ID NO: 1674246 - RNA, 15 nt, Salmonella enterica enterica serovar Typhi
ggauaaaaucgccaa

SEQ ID NO: 1674247 - RNA, 20 nt, Salmonella enterica enterica serovar Typhi
ggauaaggcguuuacgcugc

SEQ ID NO: 1674248 - RNA, 19 nt, Salmonella enterica enterica serovar Typhi
ggauaagcggcagcgccau

SEQ ID NO: 1674249 - RNA, 19 nt, Salmonella enterica enterica serovar Typhi
ggauaagcccggcggaggc

SEQ ID NO: 1674250 - RNA, 19 nt, Salmonella enterica enterica serovar Typhi
ggauaacggcgcaaagaca

SEQ ID NO: 1674251 - RNA, 14 nt, Salmonella enterica enterica serovar Typhi
ggaucaucggccag

SEQ ID NO: 1674252 - RNA, 16 nt, Salmonella enterica enterica serovar Typhi
ggauauuggcguuaga

SEQ ID NO: 1674253 - RNA, 18 nt, Salmonella enterica enterica serovar Typhi
ggauauugccgaagacca

SEQ ID NO: 1674254 - RNA, 18 nt, Salmonella enterica enterica serovar Typhi
ggauauuacccggccagu

SEQ ID NO: 1674255 - RNA, 20 nt, Salmonella enterica enterica serovar Typhi
ggauaguacugaccagacag

SEQ ID NO: 1674256 - RNA, 21 nt, Salmonella enterica enterica serovar Typhi
ggauauaaaaaacauauaauu

SEQ ID NO: 1674257 - RNA, 14 nt, Salmonella enterica enterica serovar Typhi
ggauaauuuaucca

SEQ ID NO: 1674258 - RNA, 15 nt, Salmonella enterica enterica serovar Typhi
ggaucaucggccaga

SEQ ID NO: 1674259 - RNA, 19 nt, Salmonella enterica enterica serovar Typhi
ggaugcgccgcccaccgcc

SEQ ID NO: 1674260 - RNA, 22 nt, Salmonella enterica enterica serovar Typhi
ggaugcguaauccggccuggcg

SEQ ID NO: 1674261 - RNA, 23 nt, Salmonella enterica enterica serovar Typhi
ggaugacggcgaacggggagaca

SEQ ID NO: 1674262 - RNA, 17 nt, Salmonella enterica enterica serovar Typhi
ggaugaccaguuaagca

SEQ ID NO: 1674263 - RNA, 15 nt, Salmonella enterica enterica serovar Typhi
ggaugacagaaagcg

SEQ ID NO: 1674264 - RNA, 23 nt, Salmonella enterica enterica serovar Typhi
ggaucguucugcugauaauacug

SEQ ID NO: 1674265 - RNA, 22 nt, Salmonella enterica enterica serovar Typhi
ggaucgucucugagaucaaaca

SEQ ID NO: 1674266 - RNA, 15 nt, Salmonella enterica enterica serovar Typhi
ggaucgguuuauccc

SEQ ID NO: 1674267 - RNA, 21 nt, Salmonella enterica enterica serovar Typhi
ggaucggucuggcgcauaaug

SEQ ID NO: 1674268 - RNA, 18 nt, Salmonella enterica enterica serovar Typhi
ggaugugcauugacuacu

SEQ ID NO: 1674269 - RNA, 13 nt, Salmonella enterica enterica serovar Typhi
ggauguggugcgg

SEQ ID NO: 1674270 - RNA, 18 nt, Salmonella enterica enterica serovar Typhi
ggaugucggcuuacgccu

SEQ ID NO: 1674271 - RNA, 22 nt, Salmonella enterica enterica serovar Typhi
ggaugugaccuuugugcaggau

SEQ ID NO: 1674272 - RNA, 23 nt, Salmonella enterica enterica serovar Typhi
ggcaaacacaaucacgcccagcg

SEQ ID NO: 1674273 - RNA, 19 nt, Salmonella enterica enterica serovar Typhi
ggauucgccagcgugcuua

SEQ ID NO: 1674274 - RNA, 21 nt, Salmonella enterica enterica serovar Typhi
ggauucucuaacgucagcgcc

SEQ ID NO: 1674275 - RNA, 18 nt, Salmonella enterica enterica serovar Typhi
ggccacggagugcgcggc

SEQ ID NO: 1674276 - RNA, 17 nt, Salmonella enterica enterica serovar Typhi
ggccacggagugcgcgg

SEQ ID NO: 1674277 - RNA, 15 nt, Salmonella enterica enterica serovar Typhi
ggccagaugcggcga

SEQ ID NO: 1674278 - RNA, 15 nt, Salmonella enterica enterica serovar Typhi
ggcauuaacaaauca

SEQ ID NO: 1674279 - RNA, 17 nt, Salmonella enterica enterica serovar Typhi
ggcaugucugucuaugc

SEQ ID NO: 1674280 - RNA, 14 nt, Salmonella enterica enterica serovar Typhi
ggccaccagcgcca

SEQ ID NO: 1674281 - RNA, 12 nt, Salmonella enterica enterica serovar Typhi
ggccacccacca

SEQ ID NO: 1674282 - RNA, 19 nt, Salmonella enterica enterica serovar Typhi
ggccauuaagcuucgugag

SEQ ID NO: 1674283 - RNA, 17 nt, Salmonella enterica enterica serovar Typhi
ggccauugaagucccuu

SEQ ID NO: 1674284 - RNA, 14 nt, Salmonella enterica enterica serovar Typhi
ggccagcgcgcggc

SEQ ID NO: 1674285 - RNA, 16 nt, Salmonella enterica enterica serovar Typhi
ggccaggcacguuaaa

SEQ ID NO: 1674286 - RNA, 18 nt, Salmonella enterica enterica serovar Typhi
ggcccauaaacaggucac

SEQ ID NO: 1674287 - RNA, 17 nt, Salmonella enterica enterica serovar Typhi
ggcccaguguacugcca

SEQ ID NO: 1674288 - RNA, 15 nt, Salmonella enterica enterica serovar Typhi
ggccccaauuugcug

SEQ ID NO: 1674289 - RNA, 20 nt, Salmonella enterica enterica serovar Typhi
ggcccagcuaaaccacggaa

SEQ ID NO: 1674290 - RNA, 17 nt, Salmonella enterica enterica serovar Typhi
ggcccgccagcacagca

SEQ ID NO: 1674291 - RNA, 18 nt, Salmonella enterica enterica serovar Typhi
ggcccgccagcacagcaa

SEQ ID NO: 1674292 - RNA, 14 nt, Salmonella enterica enterica serovar Typhi
ggcccccuguucca

SEQ ID NO: 1674293 - RNA, 23 nt, Salmonella enterica enterica serovar Typhi
ggcccccuguuccagggcuucca

SEQ ID NO: 1674294 - RNA, 19 nt, Salmonella enterica enterica serovar Typhi
ggccgauauugcggccuuc

SEQ ID NO: 1674295 - RNA, 17 nt, Salmonella enterica enterica serovar Typhi
ggccgacaggcggccgc

SEQ ID NO: 1674296 - RNA, 20 nt, Salmonella enterica enterica serovar Typhi
ggccgcaaacagcacgcccu

SEQ ID NO: 1674297 - RNA, 16 nt, Salmonella enterica enterica serovar Typhi
ggccgauuucauucag

SEQ ID NO: 1674298 - RNA, 20 nt, Salmonella enterica enterica serovar Typhi
ggccgaaggaagauagcggg

SEQ ID NO: 1674299 - RNA, 14 nt, Salmonella enterica enterica serovar Typhi
ggcaaacauagccu

SEQ ID NO: 1674300 - RNA, 18 nt, Salmonella enterica enterica serovar Typhi
ggcaaaccauguacccuc

SEQ ID NO: 1674301 - RNA, 15 nt, Salmonella enterica enterica serovar Typhi
ggcaaaccccugcuc

SEQ ID NO: 1674302 - RNA, 23 nt, Salmonella enterica enterica serovar Typhi
ggcaaaccugcgguuaauacauc

SEQ ID NO: 1674303 - RNA, 17 nt, Salmonella enterica enterica serovar Typhi
ggcaaacggcgccagcu

SEQ ID NO: 1674304 - RNA, 19 nt, Salmonella enterica enterica serovar Typhi
ggcaccacgaccagacugg

SEQ ID NO: 1674305 - RNA, 16 nt, Salmonella enterica enterica serovar Typhi
ggcagcaauacgcccg

SEQ ID NO: 1674306 - RNA, 20 nt, Salmonella enterica enterica serovar Typhi
ggcagcaauacgcccgcccg

SEQ ID NO: 1674307 - RNA, 12 nt, Salmonella enterica enterica serovar Typhi
ggcagagcgcgc

SEQ ID NO: 1674308 - RNA, 16 nt, Salmonella enterica enterica serovar Typhi
ggcagaguccagcggc

SEQ ID NO: 1674309 - RNA, 14 nt, Salmonella enterica enterica serovar Typhi
ggcagauaugcggg

SEQ ID NO: 1674310 - RNA, 14 nt, Salmonella enterica enterica serovar Typhi
ggcagacggcuggg

SEQ ID NO: 1674311 - RNA, 15 nt, Salmonella enterica enterica serovar Typhi
ggcagaccggcagcc

SEQ ID NO: 1674312 - RNA, 14 nt, Salmonella enterica enterica serovar Typhi
ggcacugcaggcgg

SEQ ID NO: 1674313 - RNA, 22 nt, Salmonella enterica enterica serovar Typhi
ggcacucaccucuuccgccagg

SEQ ID NO: 1674314 - RNA, 18 nt, Salmonella enterica enterica serovar Typhi
ggcacuacgguccaguug

SEQ ID NO: 1674315 - RNA, 23 nt, Salmonella enterica enterica serovar Typhi
ggcagcaccggaacagaagccug

SEQ ID NO: 1674316 - RNA, 19 nt, Salmonella enterica enterica serovar Typhi
ggcagcacaaucagcgcgg

SEQ ID NO: 1674317 - RNA, 17 nt, Salmonella enterica enterica serovar Typhi
ggcagcaggaucuccag

SEQ ID NO: 1674318 - RNA, 14 nt, Salmonella enterica enterica serovar Typhi
ggcagcagcuucau

SEQ ID NO: 1674319 - RNA, 17 nt, Salmonella enterica enterica serovar Typhi
ggcagcauuguauuuca

SEQ ID NO: 1674320 - RNA, 12 nt, Salmonella enterica enterica serovar Typhi
ggcagccaggca

SEQ ID NO: 1674321 - RNA, 23 nt, Salmonella enterica enterica serovar Typhi
ggcagccaugcuauucagcaguu

SEQ ID NO: 1674322 - RNA, 18 nt, Salmonella enterica enterica serovar Typhi
ggcagccauucggcugcc

SEQ ID NO: 1674323 - RNA, 19 nt, Salmonella enterica enterica serovar Typhi
ggcagcccggcguugaaau

SEQ ID NO: 1674324 - RNA, 14 nt, Salmonella enterica enterica serovar Typhi
ggcagccgccacca

SEQ ID NO: 1674325 - RNA, 11 nt, Salmonella enterica enterica serovar Typhi
ggcagcucucc

SEQ ID NO: 1674326 - RNA, 15 nt, Salmonella enterica enterica serovar Typhi
ggcagcucugccugu

SEQ ID NO: 1674327 - RNA, 15 nt, Salmonella enterica enterica serovar Typhi
ggcagcucuuucaac

SEQ ID NO: 1674328 - RNA, 19 nt, Salmonella enterica enterica serovar Typhi
ggcaggaaauccagcagaa

SEQ ID NO: 1674329 - RNA, 14 nt, Salmonella enterica enterica serovar Typhi
ggcagcgucuuccc

SEQ ID NO: 1674330 - RNA, 14 nt, Salmonella enterica enterica serovar Typhi
ggcagcguccgcca

SEQ ID NO: 1674331 - RNA, 16 nt, Salmonella enterica enterica serovar Typhi
ggcagcguggcgagcu

SEQ ID NO: 1674332 - RNA, 15 nt, Salmonella enterica enterica serovar Typhi
ggcagcggcaagaca

SEQ ID NO: 1674333 - RNA, 17 nt, Salmonella enterica enterica serovar Typhi
ggcagcgcgccagcgcu

SEQ ID NO: 1674334 - RNA, 18 nt, Salmonella enterica enterica serovar Typhi
ggcagcgccagugacgcc

SEQ ID NO: 1674335 - RNA, 19 nt, Salmonella enterica enterica serovar Typhi
ggcagcgccugacggcgcu

SEQ ID NO: 1674336 - RNA, 21 nt, Salmonella enterica enterica serovar Typhi
ggcagcgcaacgcuuaauccc

SEQ ID NO: 1674337 - RNA, 13 nt, Salmonella enterica enterica serovar Typhi
ggcauagaaaaag

SEQ ID NO: 1674338 - RNA, 24 nt, Salmonella enterica enterica serovar Typhi
ggcagugaguaacguuaauacauc

SEQ ID NO: 1674339 - RNA, 18 nt, Salmonella enterica enterica serovar Typhi
ggcagucuggcggcagcc

SEQ ID NO: 1674340 - RNA, 13 nt, Salmonella enterica enterica serovar Typhi
ggcaggcucacca

SEQ ID NO: 1674341 - RNA, 11 nt, Salmonella enterica enterica serovar Typhi
ggcaggcggaa

SEQ ID NO: 1674342 - RNA, 17 nt, Salmonella enterica enterica serovar Typhi
ggcauggcucgccgcug

SEQ ID NO: 1674343 - RNA, 18 nt, Salmonella enterica enterica serovar Typhi
ggcaucgcccguuuuacc

SEQ ID NO: 1674344 - RNA, 20 nt, Salmonella enterica enterica serovar Typhi
uaaucgaaucgccucaacca

SEQ ID NO: 1674345 - RNA, 14 nt, Salmonella enterica enterica serovar Typhi
uaaucgaaauaaag

SEQ ID NO: 1674346 - RNA, 14 nt, Salmonella enterica enterica serovar Typhi
uaaucgaaucgccu

SEQ ID NO: 1674347 - RNA, 13 nt, Salmonella enterica enterica serovar Typhi
uaaugaauuuaau

SEQ ID NO: 1674348 - RNA, 17 nt, Salmonella enterica enterica serovar Typhi
uaaugaacaccagcaac

SEQ ID NO: 1674349 - RNA, 16 nt, Salmonella enterica enterica serovar Typhi
uaaugaagcauaaaaa

SEQ ID NO: 1674350 - RNA, 19 nt, Salmonella enterica enterica serovar Typhi
uaaugaagcauaaaaagac

SEQ ID NO: 1674351 - RNA, 18 nt, Salmonella enterica enterica serovar Typhi
uaaugacuuuuaaagacu

SEQ ID NO: 1674352 - RNA, 17 nt, Salmonella enterica enterica serovar Typhi
uaaugacuaauuauuau

SEQ ID NO: 1674353 - RNA, 16 nt, Salmonella enterica enterica serovar Typhi
uaaugacauagugcaa

SEQ ID NO: 1674354 - RNA, 16 nt, Salmonella enterica enterica serovar Typhi
uaaugacgauaaauaa

SEQ ID NO: 1674355 - RNA, 19 nt, Salmonella enterica enterica serovar Typhi
uaaugacgauaaauaagag

SEQ ID NO: 1674356 - RNA, 16 nt, Salmonella enterica enterica serovar Typhi
uaaugauccacaccgg

SEQ ID NO: 1674357 - RNA, 18 nt, Salmonella enterica enterica serovar Typhi
uaaugccuaucuugauau

SEQ ID NO: 1674358 - RNA, 14 nt, Salmonella enterica enterica serovar Typhi
uaaugccaucauca

SEQ ID NO: 1674359 - RNA, 22 nt, Salmonella enterica enterica serovar Typhi
uaaugcccggcccgucaucuuc

SEQ ID NO: 1674360 - RNA, 16 nt, Salmonella enterica enterica serovar Typhi
uaaugccuucugaaaa

SEQ ID NO: 1674361 - RNA, 17 nt, Salmonella enterica enterica serovar Typhi
uaaugcgcgcuucuuca

SEQ ID NO: 1674362 - RNA, 21 nt, Salmonella enterica enterica serovar Typhi
uaaugcagcgucugcccuccu

SEQ ID NO: 1674363 - RNA, 19 nt, Salmonella enterica enterica serovar Typhi
uaaugcaggcagcacugcu

SEQ ID NO: 1674364 - RNA, 17 nt, Salmonella enterica enterica serovar Typhi
uaaugcaauaaacuaag

SEQ ID NO: 1674365 - RNA, 19 nt, Salmonella enterica enterica serovar Typhi
uaaugguggaaugccccag

SEQ ID NO: 1674366 - RNA, 17 nt, Salmonella enterica enterica serovar Typhi
uaauggcgccgauaaca

SEQ ID NO: 1674367 - RNA, 19 nt, Salmonella enterica enterica serovar Typhi
uaauggcagaauaaaacag

SEQ ID NO: 1674368 - RNA, 18 nt, Salmonella enterica enterica serovar Typhi
uaauggcauaacgcugua

SEQ ID NO: 1674369 - RNA, 22 nt, Salmonella enterica enterica serovar Typhi
uaauuaauucuaaauugggaug

SEQ ID NO: 1674370 - RNA, 17 nt, Salmonella enterica enterica serovar Typhi
uaauguuuucugccagc

SEQ ID NO: 1674371 - RNA, 14 nt, Salmonella enterica enterica serovar Typhi
uaauguuugcgcca

SEQ ID NO: 1674372 - RNA, 21 nt, Salmonella enterica enterica serovar Typhi
uaauuacuccguuuuaaucuu

SEQ ID NO: 1674373 - RNA, 22 nt, Salmonella enterica enterica serovar Typhi
uaauuacuccguuuuaaucuuu

SEQ ID NO: 1674374 - RNA, 18 nt, Salmonella enterica enterica serovar Typhi
uaauucauaacaccaaua

SEQ ID NO: 1674375 - RNA, 17 nt, Salmonella enterica enterica serovar Typhi
uaauauaaccaauuuaa

SEQ ID NO: 1674376 - RNA, 20 nt, Salmonella enterica enterica serovar Typhi
uaauauaaccaauuuaaaau

SEQ ID NO: 1674377 - RNA, 12 nt, Salmonella enterica enterica serovar Typhi
uaauauacauuc

SEQ ID NO: 1674378 - RNA, 20 nt, Salmonella enterica enterica serovar Typhi
uaauauccaggagcauugga

SEQ ID NO: 1674379 - RNA, 13 nt, Salmonella enterica enterica serovar Typhi
uaacggaaucaga

SEQ ID NO: 1674380 - RNA, 16 nt, Salmonella enterica enterica serovar Typhi
uaacggcaaaaacguu

SEQ ID NO: 1674381 - RNA, 17 nt, Salmonella enterica enterica serovar Typhi
uaacggaaaagcauugc

SEQ ID NO: 1674382 - RNA, 16 nt, Salmonella enterica enterica serovar Typhi
uaacggaaaagcauug

SEQ ID NO: 1674383 - RNA, 15 nt, Salmonella enterica enterica serovar Typhi
uaacguuacauuuuc

SEQ ID NO: 1674384 - RNA, 22 nt, Salmonella enterica enterica serovar Typhi
uaacguguuuucgauuucauuc

SEQ ID NO: 1674385 - RNA, 15 nt, Salmonella enterica enterica serovar Typhi
uaacguuaaggaaac

SEQ ID NO: 1674386 - RNA, 22 nt, Salmonella enterica enterica serovar Typhi
uaacgucgcgguuacagucuuu

SEQ ID NO: 1674387 - RNA, 17 nt, Salmonella enterica enterica serovar Typhi
uaacguauuucuuuugc

SEQ ID NO: 1674388 - RNA, 17 nt, Salmonella enterica enterica serovar Typhi
uaaucaccugccagggu

SEQ ID NO: 1674389 - RNA, 22 nt, Salmonella enterica enterica serovar Typhi
uaaucacuaacugaccauauau

SEQ ID NO: 1674390 - RNA, 12 nt, Salmonella enterica enterica serovar Typhi
uaaucaccagcc

SEQ ID NO: 1674391 - RNA, 15 nt, Salmonella enterica enterica serovar Typhi
uaaucaccaccucaa

SEQ ID NO: 1674392 - RNA, 14 nt, Salmonella enterica enterica serovar Typhi
uaaucaccagcccg

SEQ ID NO: 1674393 - RNA, 20 nt, Salmonella enterica enterica serovar Typhi
uaauauugaccgcuuuuucc

SEQ ID NO: 1674394 - RNA, 13 nt, Salmonella enterica enterica serovar Typhi
uaauauuauugac

SEQ ID NO: 1674395 - RNA, 15 nt, Salmonella enterica enterica serovar Typhi
uaauauucauucugu

SEQ ID NO: 1674396 - RNA, 21 nt, Salmonella enterica enterica serovar Typhi
uaauauugaccgcuuuuucca

SEQ ID NO: 1674397 - RNA, 18 nt, Salmonella enterica enterica serovar Typhi
uaauccgugaauguccug

SEQ ID NO: 1674398 - RNA, 20 nt, Salmonella enterica enterica serovar Typhi
uaauccuuguccauguaaac

SEQ ID NO: 1674399 - RNA, 22 nt, Salmonella enterica enterica serovar Typhi
uaauccuuguccauguaaacuc

SEQ ID NO: 1674400 - RNA, 13 nt, Salmonella enterica enterica serovar Typhi
uaauccgcuccac

SEQ ID NO: 1674401 - RNA, 17 nt, Salmonella enterica enterica serovar Typhi
uaaucccgccagccuua

SEQ ID NO: 1674402 - RNA, 23 nt, Salmonella enterica enterica serovar Typhi
uaaucccgcggcggacagcggca

SEQ ID NO: 1674403 - RNA, 15 nt, Salmonella enterica enterica serovar Typhi
uacaaacgcaccgcc

SEQ ID NO: 1674404 - RNA, 23 nt, Salmonella enterica enterica serovar Typhi
uacaaagccaaaauuuucaauac

SEQ ID NO: 1674405 - RNA, 15 nt, Salmonella enterica enterica serovar Typhi
uacaaguaauaaaau

SEQ ID NO: 1674406 - RNA, 17 nt, Salmonella enterica enterica serovar Typhi
uacaaguaauaaaauaa

SEQ ID NO: 1674407 - RNA, 18 nt, Salmonella enterica enterica serovar Typhi
uacaccguaaagcaccau

SEQ ID NO: 1674408 - RNA, 10 nt, Salmonella enterica enterica serovar Typhi
uacaauuucg

SEQ ID NO: 1674409 - RNA, 16 nt, Salmonella enterica enterica serovar Typhi
uacaauucaacucacu

SEQ ID NO: 1674410 - RNA, 13 nt, Salmonella enterica enterica serovar Typhi
uacagccaccaug

SEQ ID NO: 1674411 - RNA, 17 nt, Salmonella enterica enterica serovar Typhi
uacagccaaaucagcag

SEQ ID NO: 1674412 - RNA, 18 nt, Salmonella enterica enterica serovar Typhi
uacagccaaaucagcagg

SEQ ID NO: 1674413 - RNA, 19 nt, Salmonella enterica enterica serovar Typhi
uacagcacgacguagccca

SEQ ID NO: 1674414 - RNA, 21 nt, Salmonella enterica enterica serovar Typhi
uacacugaagccuggugccca

SEQ ID NO: 1674415 - RNA, 16 nt, Salmonella enterica enterica serovar Typhi
uacacugauaccccag

SEQ ID NO: 1674416 - RNA, 18 nt, Salmonella enterica enterica serovar Typhi
uacaccuucacauuggca

SEQ ID NO: 1674417 - RNA, 15 nt, Salmonella enterica enterica serovar Typhi
uacacgccuuccucc

SEQ ID NO: 1674418 - RNA, 18 nt, Salmonella enterica enterica serovar Typhi
uacacgcgaauagccaga

SEQ ID NO: 1674419 - RNA, 22 nt, Salmonella enterica enterica serovar Typhi
uacagguugugcaucuccugac

SEQ ID NO: 1674420 - RNA, 21 nt, Salmonella enterica enterica serovar Typhi
uacaggauauacuucaucagg

SEQ ID NO: 1674421 - RNA, 16 nt, Salmonella enterica enterica serovar Typhi
uacaguuugucaucag

SEQ ID NO: 1674422 - RNA, 14 nt, Salmonella enterica enterica serovar Typhi
uacaguggaaagua

SEQ ID NO: 1674423 - RNA, 19 nt, Salmonella enterica enterica serovar Typhi
uacaguguaaaaauuuuug

SEQ ID NO: 1674424 - RNA, 13 nt, Salmonella enterica enterica serovar Typhi
uacaguagcaggg

SEQ ID NO: 1674425 - RNA, 16 nt, Salmonella enterica enterica serovar Typhi
uacaguaguuuucauc

SEQ ID NO: 1674426 - RNA, 17 nt, Salmonella enterica enterica serovar Typhi
uaauucucacagaauca

SEQ ID NO: 1674427 - RNA, 22 nt, Salmonella enterica enterica serovar Typhi
uaauuuaugauuuuaacaucac

SEQ ID NO: 1674428 - RNA, 15 nt, Salmonella enterica enterica serovar Typhi
uaauuuauccaguaa

SEQ ID NO: 1674429 - RNA, 16 nt, Salmonella enterica enterica serovar Typhi
uaauuucaauuuugcc

SEQ ID NO: 1674430 - RNA, 14 nt, Salmonella enterica enterica serovar Typhi
uaauuucagugaau

SEQ ID NO: 1674431 - RNA, 15 nt, Salmonella enterica enterica serovar Typhi
uaauuugcuccagaa

SEQ ID NO: 1674432 - RNA, 11 nt, Salmonella enterica enterica serovar Typhi
uaauuugauuu

SEQ ID NO: 1674433 - RNA, 15 nt, Salmonella enterica enterica serovar Typhi
uaauuugauuuauuu

SEQ ID NO: 1674434 - RNA, 15 nt, Salmonella enterica enterica serovar Typhi
uaauuugcaaaccau

SEQ ID NO: 1674435 - RNA, 17 nt, Salmonella enterica enterica serovar Typhi
uaauuugcaaaccauga

SEQ ID NO: 1674436 - RNA, 18 nt, Salmonella enterica enterica serovar Typhi
uacaaacaaauaaaucca

SEQ ID NO: 1674437 - RNA, 15 nt, Salmonella enterica enterica serovar Typhi
uacaaaauaagucau

SEQ ID NO: 1674438 - RNA, 21 nt, Salmonella enterica enterica serovar Typhi
uacaaaauaagucauaucaau

SEQ ID NO: 1674439 - RNA, 18 nt, Salmonella enterica enterica serovar Typhi
uacaaaacccauaucccc

SEQ ID NO: 1674440 - RNA, 23 nt, Salmonella enterica enterica serovar Typhi
uacaaaaaaugugagccauaaca

SEQ ID NO: 1674441 - RNA, 12 nt, Salmonella enterica enterica serovar Typhi
uacaaaaaauac

SEQ ID NO: 1674442 - RNA, 23 nt, Salmonella enterica enterica serovar Typhi
uaauuuucuucuggccauuucau

SEQ ID NO: 1674443 - RNA, 13 nt, Salmonella enterica enterica serovar Typhi
uaauuuugcgaug

SEQ ID NO: 1674444 - RNA, 17 nt, Salmonella enterica enterica serovar Typhi
uaauuuuacuuucauuc

SEQ ID NO: 1674445 - RNA, 22 nt, Salmonella enterica enterica serovar Typhi
uaauuuuauuauauuuaaaauu

SEQ ID NO: 1674446 - RNA, 20 nt, Salmonella enterica enterica serovar Typhi
uaauuuucccaguucaucca

SEQ ID NO: 1674447 - RNA, 19 nt, Salmonella enterica enterica serovar Typhi
uacgagugacauuauucac

SEQ ID NO: 1674448 - RNA, 19 nt, Salmonella enterica enterica serovar Typhi
uacgagugcguucuuccac

SEQ ID NO: 1674449 - RNA, 17 nt, Salmonella enterica enterica serovar Typhi
uacgauagcaauuaaua

SEQ ID NO: 1674450 - RNA, 14 nt, Salmonella enterica enterica serovar Typhi
uacgauaccccauc

SEQ ID NO: 1674451 - RNA, 15 nt, Salmonella enterica enterica serovar Typhi
uaccuuuaucuugac

SEQ ID NO: 1674452 - RNA, 23 nt, Salmonella enterica enterica serovar Typhi
uaccuuuuccggcggcaguccca

SEQ ID NO: 1674453 - RNA, 12 nt, Salmonella enterica enterica serovar Typhi
uaccuuuuccuc

SEQ ID NO: 1674454 - RNA, 15 nt, Salmonella enterica enterica serovar Typhi
uaccguaaaaugcug

SEQ ID NO: 1674455 - RNA, 22 nt, Salmonella enterica enterica serovar Typhi
uaccguaaaaugcuggugcauc

SEQ ID NO: 1674456 - RNA, 20 nt, Salmonella enterica enterica serovar Typhi
uaccggugcgccccagcaug

SEQ ID NO: 1674457 - RNA, 23 nt, Salmonella enterica enterica serovar Typhi
uaccuucuucacuaaaaacaggc

SEQ ID NO: 1674458 - RNA, 15 nt, Salmonella enterica enterica serovar Typhi
uaccuuguucuucca

SEQ ID NO: 1674459 - RNA, 13 nt, Salmonella enterica enterica serovar Typhi
uaccuauuuuaaa

SEQ ID NO: 1674460 - RNA, 20 nt, Salmonella enterica enterica serovar Typhi
uaccuauuuuaaauucccag

SEQ ID NO: 1674461 - RNA, 19 nt, Salmonella enterica enterica serovar Typhi
uaccuucccgcgauaaaaa

SEQ ID NO: 1674462 - RNA, 13 nt, Salmonella enterica enterica serovar Typhi
uaccuucugccgc

SEQ ID NO: 1674463 - RNA, 23 nt, Salmonella enterica enterica serovar Typhi
uaccuucggccuccgcuuccugc

SEQ ID NO: 1674464 - RNA, 23 nt, Salmonella enterica enterica serovar Typhi
uacgcggccaaaacccaccagca

SEQ ID NO: 1674465 - RNA, 15 nt, Salmonella enterica enterica serovar Typhi
uacgcgccugccuga

SEQ ID NO: 1674466 - RNA, 22 nt, Salmonella enterica enterica serovar Typhi
uacgcggcgcgcucuuuuucuu

SEQ ID NO: 1674467 - RNA, 17 nt, Salmonella enterica enterica serovar Typhi
uacgcgucaaagcacau

SEQ ID NO: 1674468 - RNA, 16 nt, Salmonella enterica enterica serovar Typhi
uacgcgggguaaaaug

SEQ ID NO: 1674469 - RNA, 14 nt, Salmonella enterica enterica serovar Typhi
uacggaaaaaauac

SEQ ID NO: 1674470 - RNA, 15 nt, Salmonella enterica enterica serovar Typhi
uacgcgucaauuacc

SEQ ID NO: 1674471 - RNA, 15 nt, Salmonella enterica enterica serovar Typhi
uacgcuauuuaaaaa

SEQ ID NO: 1674472 - RNA, 14 nt, Salmonella enterica enterica serovar Typhi
uacgcagcaggcag

SEQ ID NO: 1674473 - RNA, 23 nt, Salmonella enterica enterica serovar Typhi
uacgcagauaacuuccuuugccu

SEQ ID NO: 1674474 - RNA, 23 nt, Salmonella enterica enterica serovar Typhi
uacgaucgucuggcgagaacacg

SEQ ID NO: 1674475 - RNA, 21 nt, Salmonella enterica enterica serovar Typhi
uacgcaccagcucuacaucgc

SEQ ID NO: 1674476 - RNA, 20 nt, Salmonella enterica enterica serovar Typhi
uacgcagaucuuuuugcucc

SEQ ID NO: 1674477 - RNA, 18 nt, Salmonella enterica enterica serovar Typhi
uacgcagcgccuucgcuu

SEQ ID NO: 1674478 - RNA, 17 nt, Salmonella enterica enterica serovar Typhi
uacgcagcuuaaagcca

SEQ ID NO: 1674479 - RNA, 19 nt, Salmonella enterica enterica serovar Typhi
uacgcagcuuaaagccaau

SEQ ID NO: 1674480 - RNA, 18 nt, Salmonella enterica enterica serovar Typhi
uacgcaggacuuucgcuu

SEQ ID NO: 1674481 - RNA, 18 nt, Salmonella enterica enterica serovar Typhi
uacgcaucaccaggcaau

SEQ ID NO: 1674482 - RNA, 14 nt, Salmonella enterica enterica serovar Typhi
uacgcaucaccagg

SEQ ID NO: 1674483 - RNA, 16 nt, Salmonella enterica enterica serovar Typhi
uacggccauggaacau

SEQ ID NO: 1674484 - RNA, 20 nt, Salmonella enterica enterica serovar Typhi
uacggccacaaaacaggauu

SEQ ID NO: 1674485 - RNA, 22 nt, Salmonella enterica enterica serovar Typhi
uacggcugucaggagccaccgg

SEQ ID NO: 1674486 - RNA, 16 nt, Salmonella enterica enterica serovar Typhi
uacggcuccagcacau

SEQ ID NO: 1674487 - RNA, 20 nt, Salmonella enterica enterica serovar Typhi
uacggcaacgggacggcggc

SEQ ID NO: 1674488 - RNA, 22 nt, Salmonella enterica enterica serovar Typhi
uacggcaaacacaaucacgccc

SEQ ID NO: 1674489 - RNA, 14 nt, Salmonella enterica enterica serovar Typhi
uacggcaucggaac

SEQ ID NO: 1674490 - RNA, 16 nt, Salmonella enterica enterica serovar Typhi
uacgucauaucaucca

SEQ ID NO: 1674491 - RNA, 23 nt, Salmonella enterica enterica serovar Typhi
uacgucgcacggaucaucuaccc

SEQ ID NO: 1674492 - RNA, 12 nt, Salmonella enterica enterica serovar Typhi
uacguccauccg

SEQ ID NO: 1674493 - RNA, 17 nt, Salmonella enterica enterica serovar Typhi
uacgucauaucauccag

SEQ ID NO: 1674494 - RNA, 18 nt, Salmonella enterica enterica serovar Typhi
uacccaaauuaauuuauu

SEQ ID NO: 1674495 - RNA, 23 nt, Salmonella enterica enterica serovar Typhi
uaccaggcggcuuuuucaucauc

SEQ ID NO: 1674496 - RNA, 22 nt, Salmonella enterica enterica serovar Typhi
uaccaggcagcgcgccagcgcu

SEQ ID NO: 1674497 - RNA, 17 nt, Salmonella enterica enterica serovar Typhi
uaccagcgauaguuguu

SEQ ID NO: 1674498 - RNA, 14 nt, Salmonella enterica enterica serovar Typhi
uaccagcggcagcu

SEQ ID NO: 1674499 - RNA, 23 nt, Salmonella enterica enterica serovar Typhi
uaccagcgcgaacauuacauccu

SEQ ID NO: 1674500 - RNA, 15 nt, Salmonella enterica enterica serovar Typhi
uaccagcaucgcguu

SEQ ID NO: 1674501 - RNA, 16 nt, Salmonella enterica enterica serovar Typhi
uaccagcagcgccagc

SEQ ID NO: 1674502 - RNA, 18 nt, Salmonella enterica enterica serovar Typhi
uaccagaaccacuugaac

SEQ ID NO: 1674503 - RNA, 14 nt, Salmonella enterica enterica serovar Typhi
uaccagaaccacuu

SEQ ID NO: 1674504 - RNA, 14 nt, Salmonella enterica enterica serovar Typhi
uaccagcagcgcca

SEQ ID NO: 1674505 - RNA, 14 nt, Salmonella enterica enterica serovar Typhi
uaccagaaucaucg

SEQ ID NO: 1674506 - RNA, 16 nt, Salmonella enterica enterica serovar Typhi
uaccaccugccaaagc

SEQ ID NO: 1674507 - RNA, 22 nt, Salmonella enterica enterica serovar Typhi
uaccacuucggcagaaaaagua

SEQ ID NO: 1674508 - RNA, 20 nt, Salmonella enterica enterica serovar Typhi
uaccacgucugaagaaguuc

SEQ ID NO: 1674509 - RNA, 22 nt, Salmonella enterica enterica serovar Typhi
uaccacgccguagcugcgcgcc

SEQ ID NO: 1674510 - RNA, 21 nt, Salmonella enterica enterica serovar Typhi
uacauagaaaauauaugacaa

SEQ ID NO: 1674511 - RNA, 20 nt, Salmonella enterica enterica serovar Typhi
uacauaccccgcauuuaaca

SEQ ID NO: 1674512 - RNA, 14 nt, Salmonella enterica enterica serovar Typhi
uacauacauaccac

SEQ ID NO: 1674513 - RNA, 18 nt, Salmonella enterica enterica serovar Typhi
uaccggugcgauucagcg

SEQ ID NO: 1674514 - RNA, 16 nt, Salmonella enterica enterica serovar Typhi
uaccgcuaaaauaccc

SEQ ID NO: 1674515 - RNA, 19 nt, Salmonella enterica enterica serovar Typhi
uaccgggccuauauuucug

SEQ ID NO: 1674516 - RNA, 23 nt, Salmonella enterica enterica serovar Typhi
uaccgggccuccuuuccugugcu

SEQ ID NO: 1674517 - RNA, 15 nt, Salmonella enterica enterica serovar Typhi
uaccgcgucaucaaa

SEQ ID NO: 1674518 - RNA, 21 nt, Salmonella enterica enterica serovar Typhi
uaccgcgucaucaaauuucaa

SEQ ID NO: 1674519 - RNA, 22 nt, Salmonella enterica enterica serovar Typhi
uaccgcgcaguucaauauucac

SEQ ID NO: 1674520 - RNA, 17 nt, Salmonella enterica enterica serovar Typhi
uaccgccuucagcgcgc

SEQ ID NO: 1674521 - RNA, 14 nt, Salmonella enterica enterica serovar Typhi
uaccgccguagaaa

SEQ ID NO: 1674522 - RNA, 18 nt, Salmonella enterica enterica serovar Typhi
uaccgcaauaaacacgau

SEQ ID NO: 1674523 - RNA, 23 nt, Salmonella enterica enterica serovar Typhi
uaccgauuguuuggugcugaaau

SEQ ID NO: 1674524 - RNA, 13 nt, Salmonella enterica enterica serovar Typhi
uaccgcacaucac

SEQ ID NO: 1674525 - RNA, 18 nt, Salmonella enterica enterica serovar Typhi
uaccgcagcgaaugugcu

SEQ ID NO: 1674526 - RNA, 13 nt, Salmonella enterica enterica serovar Typhi
uaccgcagcgcgg

SEQ ID NO: 1674527 - RNA, 21 nt, Salmonella enterica enterica serovar Typhi
uaccgccaccuuucugcucca

SEQ ID NO: 1674528 - RNA, 14 nt, Salmonella enterica enterica serovar Typhi
uaccgccgagcauu

SEQ ID NO: 1674529 - RNA, 15 nt, Salmonella enterica enterica serovar Typhi
uaccgccgcgaaccu

SEQ ID NO: 1674530 - RNA, 22 nt, Salmonella enterica enterica serovar Typhi
uaccgccgcuuuucaggggucc

SEQ ID NO: 1674531 - RNA, 19 nt, Salmonella enterica enterica serovar Typhi
uacccuuuucuuuaaacaa

SEQ ID NO: 1674532 - RNA, 14 nt, Salmonella enterica enterica serovar Typhi
uacccuucagauau

SEQ ID NO: 1674533 - RNA, 19 nt, Salmonella enterica enterica serovar Typhi
uacccgauaccgccagccc

SEQ ID NO: 1674534 - RNA, 18 nt, Salmonella enterica enterica serovar Typhi
uaccccaggggcauauau

SEQ ID NO: 1674535 - RNA, 13 nt, Salmonella enterica enterica serovar Typhi
uaccccagcgcgc

SEQ ID NO: 1674536 - RNA, 20 nt, Salmonella enterica enterica serovar Typhi
uaccccaucauugacuucaa

SEQ ID NO: 1674537 - RNA, 19 nt, Salmonella enterica enterica serovar Typhi
uacccaacaccagacugau

SEQ ID NO: 1674538 - RNA, 22 nt, Salmonella enterica enterica serovar Typhi
uaccccgcacaaacgcuuuuuu

SEQ ID NO: 1674539 - RNA, 22 nt, Salmonella enterica enterica serovar Typhi
uaccccgcagcgaaaauccagu

SEQ ID NO: 1674540 - RNA, 15 nt, Salmonella enterica enterica serovar Typhi
uaccccgccagcagg

SEQ ID NO: 1674541 - RNA, 17 nt, Salmonella enterica enterica serovar Typhi
uaccccggcgcggcgcg

SEQ ID NO: 1674542 - RNA, 15 nt, Salmonella enterica enterica serovar Typhi
uacccgacucuuuuu

SEQ ID NO: 1674543 - RNA, 23 nt, Salmonella enterica enterica serovar Typhi
uaccccuguucaaaauagcuuuc

SEQ ID NO: 1674544 - RNA, 20 nt, Salmonella enterica enterica serovar Typhi
uacucagcgacguaaucuau

SEQ ID NO: 1674545 - RNA, 20 nt, Salmonella enterica enterica serovar Typhi
uacucagcacauucagagcg

SEQ ID NO: 1674546 - RNA, 20 nt, Salmonella enterica enterica serovar Typhi
uacucacauucauaaaagau

SEQ ID NO: 1674547 - RNA, 11 nt, Salmonella enterica enterica serovar Typhi
uacuauuuccu

SEQ ID NO: 1674548 - RNA, 16 nt, Salmonella enterica enterica serovar Typhi
uacgugaaacugauag

SEQ ID NO: 1674549 - RNA, 16 nt, Salmonella enterica enterica serovar Typhi
uacguuuauucuuuuc

SEQ ID NO: 1674550 - RNA, 16 nt, Salmonella enterica enterica serovar Typhi
uacuccugcaacagaa

SEQ ID NO: 1674551 - RNA, 14 nt, Salmonella enterica enterica serovar Typhi
uacuccguuuuaau

SEQ ID NO: 1674552 - RNA, 15 nt, Salmonella enterica enterica serovar Typhi
uacuccguuuuaauc

SEQ ID NO: 1674553 - RNA, 17 nt, Salmonella enterica enterica serovar Typhi
uacuccguuuuaaucuu

SEQ ID NO: 1674554 - RNA, 18 nt, Salmonella enterica enterica serovar Typhi
uacuccguuuuaaucuuu

SEQ ID NO: 1674555 - RNA, 22 nt, Salmonella enterica enterica serovar Typhi
uacucgccaauauccccagccc

SEQ ID NO: 1674556 - RNA, 21 nt, Salmonella enterica enterica serovar Typhi
uacucguaaucuaaaauuauu

SEQ ID NO: 1674557 - RNA, 22 nt, Salmonella enterica enterica serovar Typhi
uacuccagcagaccggcaaaaa

SEQ ID NO: 1674558 - RNA, 14 nt, Salmonella enterica enterica serovar Typhi
uacucaguuugccg

SEQ ID NO: 1674559 - RNA, 14 nt, Salmonella enterica enterica serovar Typhi
uacucagggcaaaa

SEQ ID NO: 1674560 - RNA, 21 nt, Salmonella enterica enterica serovar Typhi
uacugcgcucuaucaccgccc

SEQ ID NO: 1674561 - RNA, 18 nt, Salmonella enterica enterica serovar Typhi
uacugcgcguggcaaaua

SEQ ID NO: 1674562 - RNA, 18 nt, Salmonella enterica enterica serovar Typhi
uacugcuuagcucaucag

SEQ ID NO: 1674563 - RNA, 20 nt, Salmonella enterica enterica serovar Typhi
uacugcuuagcucaucagcc

SEQ ID NO: 1674564 - RNA, 16 nt, Salmonella enterica enterica serovar Typhi
uacugcccguggcgga

SEQ ID NO: 1674565 - RNA, 15 nt, Salmonella enterica enterica serovar Typhi
uacugccaaccauua

SEQ ID NO: 1674566 - RNA, 17 nt, Salmonella enterica enterica serovar Typhi
uacugagcgccucugau

SEQ ID NO: 1674567 - RNA, 17 nt, Salmonella enterica enterica serovar Typhi
uacugagcauccaccgg

SEQ ID NO: 1674568 - RNA, 12 nt, Salmonella enterica enterica serovar Typhi
uacucuuccucc

SEQ ID NO: 1674569 - RNA, 15 nt, Salmonella enterica enterica serovar Typhi
uacucuuccugcugc

SEQ ID NO: 1674570 - RNA, 19 nt, Salmonella enterica enterica serovar Typhi
uacucuuggagagcaucau

SEQ ID NO: 1674571 - RNA, 18 nt, Salmonella enterica enterica serovar Typhi
uacugaccaacaacagau

SEQ ID NO: 1674572 - RNA, 15 nt, Salmonella enterica enterica serovar Typhi
uacugaccagacagc

SEQ ID NO: 1674573 - RNA, 20 nt, Salmonella enterica enterica serovar Typhi
uacugaccaagcgucagcau

SEQ ID NO: 1674574 - RNA, 13 nt, Salmonella enterica enterica serovar Typhi
uacugaccagaca

SEQ ID NO: 1674575 - RNA, 20 nt, Salmonella enterica enterica serovar Typhi
uacugaaauuucuuuuccag

SEQ ID NO: 1674576 - RNA, 19 nt, Salmonella enterica enterica serovar Typhi
uacucuuugaacagccaga

SEQ ID NO: 1674577 - RNA, 15 nt, Salmonella enterica enterica serovar Typhi
uacucuuugaugguu

SEQ ID NO: 1674578 - RNA, 13 nt, Salmonella enterica enterica serovar Typhi
uacucuuuuuccg

SEQ ID NO: 1674579 - RNA, 17 nt, Salmonella enterica enterica serovar Typhi
uacuuucaaaauacugg

SEQ ID NO: 1674580 - RNA, 21 nt, Salmonella enterica enterica serovar Typhi
uacuuuauaaaucaggaaaaa

SEQ ID NO: 1674581 - RNA, 17 nt, Salmonella enterica enterica serovar Typhi
uacuugcgccgccaucc

SEQ ID NO: 1674582 - RNA, 23 nt, Salmonella enterica enterica serovar Typhi
uacuucuucaguuccgccagacu

SEQ ID NO: 1674583 - RNA, 14 nt, Salmonella enterica enterica serovar Typhi
uagaaaaaauuaaa

SEQ ID NO: 1674584 - RNA, 13 nt, Salmonella enterica enterica serovar Typhi
uagaaaaaauuaa

SEQ ID NO: 1674585 - RNA, 17 nt, Salmonella enterica enterica serovar Typhi
uacuuuggccuaacagu

SEQ ID NO: 1674586 - RNA, 11 nt, Salmonella enterica enterica serovar Typhi
uacuuuccuga

SEQ ID NO: 1674587 - RNA, 14 nt, Salmonella enterica enterica serovar Typhi
uacuuucuacaaau

SEQ ID NO: 1674588 - RNA, 11 nt, Salmonella enterica enterica serovar Typhi
uacuuuccagc

SEQ ID NO: 1674589 - RNA, 13 nt, Salmonella enterica enterica serovar Typhi
uacuuuccagcaa

SEQ ID NO: 1674590 - RNA, 21 nt, Salmonella enterica enterica serovar Typhi
uacuuucacuaccacuuucuu

SEQ ID NO: 1674591 - RNA, 19 nt, Salmonella enterica enterica serovar Typhi
uacuuauagcuggcuuuau

SEQ ID NO: 1674592 - RNA, 18 nt, Salmonella enterica enterica serovar Typhi
uacuuaauucugcugccu

SEQ ID NO: 1674593 - RNA, 22 nt, Salmonella enterica enterica serovar Typhi
uacuguuuuugcuuuaauauuc

SEQ ID NO: 1674594 - RNA, 22 nt, Salmonella enterica enterica serovar Typhi
uacuuccgguugaccgcauaau

SEQ ID NO: 1674595 - RNA, 19 nt, Salmonella enterica enterica serovar Typhi
uacuucguagacucaggcg

SEQ ID NO: 1674596 - RNA, 15 nt, Salmonella enterica enterica serovar Typhi
uacuucaggcugcca

SEQ ID NO: 1674597 - RNA, 14 nt, Salmonella enterica enterica serovar Typhi
uacuggaaaaaacg

SEQ ID NO: 1674598 - RNA, 15 nt, Salmonella enterica enterica serovar Typhi
uacuggaucauacau

SEQ ID NO: 1674599 - RNA, 22 nt, Salmonella enterica enterica serovar Typhi
uacuggaucgcuccauucuguc

SEQ ID NO: 1674600 - RNA, 23 nt, Salmonella enterica enterica serovar Typhi
uacuggccacggagugcgcggcg

SEQ ID NO: 1674601 - RNA, 15 nt, Salmonella enterica enterica serovar Typhi
uacuggcuaucuuua

SEQ ID NO: 1674602 - RNA, 17 nt, Salmonella enterica enterica serovar Typhi
uacuguggugugccugc

SEQ ID NO: 1674603 - RNA, 16 nt, Salmonella enterica enterica serovar Typhi
uaugauuauacuugcu

SEQ ID NO: 1674604 - RNA, 18 nt, Salmonella enterica enterica serovar Typhi
uaugaugccgcuucgcca

SEQ ID NO: 1674605 - RNA, 20 nt, Salmonella enterica enterica serovar Typhi
uaugaucgacaaugaucaga

SEQ ID NO: 1674606 - RNA, 18 nt, Salmonella enterica enterica serovar Typhi
uaugcagaaauggucagc

SEQ ID NO: 1674607 - RNA, 13 nt, Salmonella enterica enterica serovar Typhi
uaugcaugguguu

SEQ ID NO: 1674608 - RNA, 15 nt, Salmonella enterica enterica serovar Typhi
uaugauuuuaacauc

SEQ ID NO: 1674609 - RNA, 11 nt, Salmonella enterica enterica serovar Typhi
uaugcaaaaua

SEQ ID NO: 1674610 - RNA, 22 nt, Salmonella enterica enterica serovar Typhi
uaugagguugucuuugcugccg

SEQ ID NO: 1674611 - RNA, 24 nt, Salmonella enterica enterica serovar Typhi
uaugauaagccugacuacgucaga

SEQ ID NO: 1674612 - RNA, 21 nt, Salmonella enterica enterica serovar Typhi
uaugauagccguucuccagcg

SEQ ID NO: 1674613 - RNA, 23 nt, Salmonella enterica enterica serovar Typhi
uaugauagccguucuccagcguu

SEQ ID NO: 1674614 - RNA, 19 nt, Salmonella enterica enterica serovar Typhi
uaugaauuauuuucuaaaa

SEQ ID NO: 1674615 - RNA, 15 nt, Salmonella enterica enterica serovar Typhi
uaugacaacauaaag

SEQ ID NO: 1674616 - RNA, 23 nt, Salmonella enterica enterica serovar Typhi
uaugaccccuccggccagcgcca

SEQ ID NO: 1674617 - RNA, 15 nt, Salmonella enterica enterica serovar Typhi
uaugaccaauggcgc

SEQ ID NO: 1674618 - RNA, 17 nt, Salmonella enterica enterica serovar Typhi
uaugaccgagucuacau

SEQ ID NO: 1674619 - RNA, 13 nt, Salmonella enterica enterica serovar Typhi
uaugacguaagcg

SEQ ID NO: 1674620 - RNA, 18 nt, Salmonella enterica enterica serovar Typhi
uaugacugcgaauuuccu

SEQ ID NO: 1674621 - RNA, 18 nt, Salmonella enterica enterica serovar Typhi
uaucugcugacacccucu

SEQ ID NO: 1674622 - RNA, 12 nt, Salmonella enterica enterica serovar Typhi
uaucugcugcug

SEQ ID NO: 1674623 - RNA, 23 nt, Salmonella enterica enterica serovar Typhi
uaucuucggucgagcuuuugcug

SEQ ID NO: 1674624 - RNA, 20 nt, Salmonella enterica enterica serovar Typhi
uaucuucugcugcucccuca

SEQ ID NO: 1674625 - RNA, 12 nt, Salmonella enterica enterica serovar Typhi
uaucugcccuuu

SEQ ID NO: 1674626 - RNA, 15 nt, Salmonella enterica enterica serovar Typhi
uaucugcccuuucuu

SEQ ID NO: 1674627 - RNA, 18 nt, Salmonella enterica enterica serovar Typhi
uaucuugacaugaaaaau

SEQ ID NO: 1674628 - RNA, 13 nt, Salmonella enterica enterica serovar Typhi
uaucuugauauca

SEQ ID NO: 1674629 - RNA, 20 nt, Salmonella enterica enterica serovar Typhi
uaucuugaugauucacccuc

SEQ ID NO: 1674630 - RNA, 13 nt, Salmonella enterica enterica serovar Typhi
uaucuugcuuuau

SEQ ID NO: 1674631 - RNA, 22 nt, Salmonella enterica enterica serovar Typhi
uaugaaaccccaaaucagcaaa

SEQ ID NO: 1674632 - RNA, 13 nt, Salmonella enterica enterica serovar Typhi
uaugaaagagaaa

SEQ ID NO: 1674633 - RNA, 15 nt, Salmonella enterica enterica serovar Typhi
uaugaaauucuugcc

SEQ ID NO: 1674634 - RNA, 13 nt, Salmonella enterica enterica serovar Typhi
uaucuuuuuuagu

SEQ ID NO: 1674635 - RNA, 16 nt, Salmonella enterica enterica serovar Typhi
uaugaaucaucagaau

SEQ ID NO: 1674636 - RNA, 17 nt, Salmonella enterica enterica serovar Typhi
uaugaagagaaacauac

SEQ ID NO: 1674637 - RNA, 17 nt, Salmonella enterica enterica serovar Typhi
uauggguguagcucaua

SEQ ID NO: 1674638 - RNA, 12 nt, Salmonella enterica enterica serovar Typhi
uaugggcagcac

SEQ ID NO: 1674639 - RNA, 17 nt, Salmonella enterica enterica serovar Typhi
uaugggauaacgcagaa

SEQ ID NO: 1674640 - RNA, 22 nt, Salmonella enterica enterica serovar Typhi
uaugggauaacgcagaagacag

SEQ ID NO: 1674641 - RNA, 17 nt, Salmonella enterica enterica serovar Typhi
uaugguacacauauggg

SEQ ID NO: 1674642 - RNA, 21 nt, Salmonella enterica enterica serovar Typhi
uaugucaguaauauauuacga

SEQ ID NO: 1674643 - RNA, 18 nt, Salmonella enterica enterica serovar Typhi
uauguacgccaagcugca

SEQ ID NO: 1674644 - RNA, 22 nt, Salmonella enterica enterica serovar Typhi
uauguaggccugauaagguaaa

SEQ ID NO: 1674645 - RNA, 18 nt, Salmonella enterica enterica serovar Typhi
uauguuaggguagaaaaa

SEQ ID NO: 1674646 - RNA, 19 nt, Salmonella enterica enterica serovar Typhi
uaugugcaucggcacagcg

SEQ ID NO: 1674647 - RNA, 19 nt, Salmonella enterica enterica serovar Typhi
uauguuccuggauagauuu

SEQ ID NO: 1674648 - RNA, 16 nt, Salmonella enterica enterica serovar Typhi
uauguuguugagacgg

SEQ ID NO: 1674649 - RNA, 22 nt, Salmonella enterica enterica serovar Typhi
uauggcgcaaguguauggcugg

SEQ ID NO: 1674650 - RNA, 16 nt, Salmonella enterica enterica serovar Typhi
uauggaggauauaaaa

SEQ ID NO: 1674651 - RNA, 14 nt, Salmonella enterica enterica serovar Typhi
uaugcuguuuaugg

SEQ ID NO: 1674652 - RNA, 21 nt, Salmonella enterica enterica serovar Typhi
uaugcuccaguuguuccagca

SEQ ID NO: 1674653 - RNA, 18 nt, Salmonella enterica enterica serovar Typhi
uaugcguugacccgucca

SEQ ID NO: 1674654 - RNA, 17 nt, Salmonella enterica enterica serovar Typhi
uaugcucaacuuccaga

SEQ ID NO: 1674655 - RNA, 20 nt, Salmonella enterica enterica serovar Typhi
uaugcguuuuuaucuuucuu

SEQ ID NO: 1674656 - RNA, 15 nt, Salmonella enterica enterica serovar Typhi
uaugcggcgccauca

SEQ ID NO: 1674657 - RNA, 18 nt, Salmonella enterica enterica serovar Typhi
uaugcgcuuccagcauga

SEQ ID NO: 1674658 - RNA, 16 nt, Salmonella enterica enterica serovar Typhi
uaugcgcuuuuuucag

SEQ ID NO: 1674659 - RNA, 22 nt, Salmonella enterica enterica serovar Typhi
uaugcggucguauuaccaaccc

SEQ ID NO: 1674660 - RNA, 19 nt, Salmonella enterica enterica serovar Typhi
uaugcgggggcaguaaauu

SEQ ID NO: 1674661 - RNA, 14 nt, Salmonella enterica enterica serovar Typhi
uaugcgcuuccagc

SEQ ID NO: 1674662 - RNA, 14 nt, Salmonella enterica enterica serovar Typhi
uaugcgccuguuag

SEQ ID NO: 1674663 - RNA, 13 nt, Salmonella enterica enterica serovar Typhi
uaugccuuccaga

SEQ ID NO: 1674664 - RNA, 21 nt, Salmonella enterica enterica serovar Typhi
uaugccuuccagaaauaaaau

SEQ ID NO: 1674665 - RNA, 22 nt, Salmonella enterica enterica serovar Typhi
uaugcccggaugauuaucaucu

SEQ ID NO: 1674666 - RNA, 15 nt, Salmonella enterica enterica serovar Typhi
uaugccggagcgcuu

SEQ ID NO: 1674667 - RNA, 20 nt, Salmonella enterica enterica serovar Typhi
uaugcccgccgcuggcgggc

SEQ ID NO: 1674668 - RNA, 21 nt, Salmonella enterica enterica serovar Typhi
uauaguacgauagcaauuaau

SEQ ID NO: 1674669 - RNA, 14 nt, Salmonella enterica enterica serovar Typhi
uauagucuuaauuu

SEQ ID NO: 1674670 - RNA, 22 nt, Salmonella enterica enterica serovar Typhi
uauaguucgcauagaauuucag

SEQ ID NO: 1674671 - RNA, 20 nt, Salmonella enterica enterica serovar Typhi
uauaguggaacgucaggccg

SEQ ID NO: 1674672 - RNA, 17 nt, Salmonella enterica enterica serovar Typhi
uauauaauuuauagcca

SEQ ID NO: 1674673 - RNA, 15 nt, Salmonella enterica enterica serovar Typhi
uauauauuuucucaa

SEQ ID NO: 1674674 - RNA, 21 nt, Salmonella enterica enterica serovar Typhi
uauaucaggcaaaaaucguca

SEQ ID NO: 1674675 - RNA, 12 nt, Salmonella enterica enterica serovar Typhi
uauauaaaaaua

SEQ ID NO: 1674676 - RNA, 14 nt, Salmonella enterica enterica serovar Typhi
uauaguuuauugaa

SEQ ID NO: 1674677 - RNA, 12 nt, Salmonella enterica enterica serovar Typhi
uauauaauucau

SEQ ID NO: 1674678 - RNA, 23 nt, Salmonella enterica enterica serovar Typhi
uaucaagauaaaaagacagauag

SEQ ID NO: 1674679 - RNA, 14 nt, Salmonella enterica enterica serovar Typhi
uaucacugguuaua

SEQ ID NO: 1674680 - RNA, 22 nt, Salmonella enterica enterica serovar Typhi
uaucaaacugaaaaucaaauaa

SEQ ID NO: 1674681 - RNA, 15 nt, Salmonella enterica enterica serovar Typhi
uaucaagauaaaaag

SEQ ID NO: 1674682 - RNA, 18 nt, Salmonella enterica enterica serovar Typhi
uaucaagauaaaaagaca

SEQ ID NO: 1674683 - RNA, 13 nt, Salmonella enterica enterica serovar Typhi
uauauuuuucccu

SEQ ID NO: 1674684 - RNA, 22 nt, Salmonella enterica enterica serovar Typhi
uaucaaaaagacuccggcagca

SEQ ID NO: 1674685 - RNA, 13 nt, Salmonella enterica enterica serovar Typhi
uaucaaaccagcu

SEQ ID NO: 1674686 - RNA, 18 nt, Salmonella enterica enterica serovar Typhi
uauaugcaggcauaaaaa

SEQ ID NO: 1674687 - RNA, 22 nt, Salmonella enterica enterica serovar Typhi
uauaugcgacagaaauugaauu

SEQ ID NO: 1674688 - RNA, 15 nt, Salmonella enterica enterica serovar Typhi
uauaugcaaaacugu

SEQ ID NO: 1674689 - RNA, 20 nt, Salmonella enterica enterica serovar Typhi
uauccggcaucacaggcuua

SEQ ID NO: 1674690 - RNA, 14 nt, Salmonella enterica enterica serovar Typhi
uauccggcuuaucc

SEQ ID NO: 1674691 - RNA, 17 nt, Salmonella enterica enterica serovar Typhi
uauccggccugcaggca

SEQ ID NO: 1674692 - RNA, 18 nt, Salmonella enterica enterica serovar Typhi
uauccgcuauuaccagua

SEQ ID NO: 1674693 - RNA, 21 nt, Salmonella enterica enterica serovar Typhi
uauccggcacgguaaaccucu

SEQ ID NO: 1674694 - RNA, 16 nt, Salmonella enterica enterica serovar Typhi
uauccguccucuuucc

SEQ ID NO: 1674695 - RNA, 23 nt, Salmonella enterica enterica serovar Typhi
uaucccaaacgucguaaaaccug

SEQ ID NO: 1674696 - RNA, 12 nt, Salmonella enterica enterica serovar Typhi
uauccacccggu

SEQ ID NO: 1674697 - RNA, 12 nt, Salmonella enterica enterica serovar Typhi
uaucauuuccac

SEQ ID NO: 1674698 - RNA, 19 nt, Salmonella enterica enterica serovar Typhi
uaucagccauuaaccagau

SEQ ID NO: 1674699 - RNA, 15 nt, Salmonella enterica enterica serovar Typhi
uaucagacaaucugu

SEQ ID NO: 1674700 - RNA, 14 nt, Salmonella enterica enterica serovar Typhi
uaucagaccgacaa

SEQ ID NO: 1674701 - RNA, 17 nt, Salmonella enterica enterica serovar Typhi
uaucugcauaggcuuua

SEQ ID NO: 1674702 - RNA, 22 nt, Salmonella enterica enterica serovar Typhi
uaucuauuucuuagcgccagca

SEQ ID NO: 1674703 - RNA, 23 nt, Salmonella enterica enterica serovar Typhi
uaucggcguguuucaucucauca

SEQ ID NO: 1674704 - RNA, 19 nt, Salmonella enterica enterica serovar Typhi
uaucguaagccaccgccca

SEQ ID NO: 1674705 - RNA, 17 nt, Salmonella enterica enterica serovar Typhi
uaucguguuauuuucaa

SEQ ID NO: 1674706 - RNA, 12 nt, Salmonella enterica enterica serovar Typhi
uaucgucuuauu

SEQ ID NO: 1674707 - RNA, 14 nt, Salmonella enterica enterica serovar Typhi
uaucgggccuacca

SEQ ID NO: 1674708 - RNA, 12 nt, Salmonella enterica enterica serovar Typhi
uauccuggccug

SEQ ID NO: 1674709 - RNA, 19 nt, Salmonella enterica enterica serovar Typhi
uauccuggcgcguagaucu

SEQ ID NO: 1674710 - RNA, 17 nt, Salmonella enterica enterica serovar Typhi
uaucgccauauacgcca

SEQ ID NO: 1674711 - RNA, 20 nt, Salmonella enterica enterica serovar Typhi
uaucgccgaaagcgaucaca

SEQ ID NO: 1674712 - RNA, 14 nt, Salmonella enterica enterica serovar Typhi
uaucgccaaaccag

SEQ ID NO: 1674713 - RNA, 15 nt, Salmonella enterica enterica serovar Typhi
uauccugcccuuuac

SEQ ID NO: 1674714 - RNA, 14 nt, Salmonella enterica enterica serovar Typhi
uaucgccucccugc

SEQ ID NO: 1674715 - RNA, 19 nt, Salmonella enterica enterica serovar Typhi
uaucgccguaaccgccugc

SEQ ID NO: 1674716 - RNA, 24 nt, Salmonella enterica enterica serovar Typhi
uaucgccggcagacgauagcgggu

SEQ ID NO: 1674717 - RNA, 18 nt, Salmonella enterica enterica serovar Typhi
uaucggccggaugccagu

SEQ ID NO: 1674718 - RNA, 21 nt, Salmonella enterica enterica serovar Typhi
uaucgcugucggucagauuca

SEQ ID NO: 1674719 - RNA, 17 nt, Salmonella enterica enterica serovar Typhi
uaucgcuugauacgcca

SEQ ID NO: 1674720 - RNA, 14 nt, Salmonella enterica enterica serovar Typhi
uaucgcuccggaac

SEQ ID NO: 1674721 - RNA, 14 nt, Salmonella enterica enterica serovar Typhi
uaucgcugcccaga

SEQ ID NO: 1674722 - RNA, 14 nt, Salmonella enterica enterica serovar Typhi
uauaaaauauuugg

SEQ ID NO: 1674723 - RNA, 18 nt, Salmonella enterica enterica serovar Typhi
uauaaaaauagcuggcug

SEQ ID NO: 1674724 - RNA, 12 nt, Salmonella enterica enterica serovar Typhi
uauaaaaaccga

SEQ ID NO: 1674725 - RNA, 20 nt, Salmonella enterica enterica serovar Typhi
uauaaaacgucacaauacuu

SEQ ID NO: 1674726 - RNA, 21 nt, Salmonella enterica enterica serovar Typhi
uaguuuagcgagcguucugca

SEQ ID NO: 1674727 - RNA, 24 nt, Salmonella enterica enterica serovar Typhi
uaguuuauugagauaauuuaugau

SEQ ID NO: 1674728 - RNA, 20 nt, Salmonella enterica enterica serovar Typhi
uauaacuaaacucaucuuua

SEQ ID NO: 1674729 - RNA, 18 nt, Salmonella enterica enterica serovar Typhi
uauaacucuuaauuauaa

SEQ ID NO: 1674730 - RNA, 20 nt, Salmonella enterica enterica serovar Typhi
uauaacucuuaauuauaaag

SEQ ID NO: 1674731 - RNA, 15 nt, Salmonella enterica enterica serovar Typhi
uauaaccacgaaaau

SEQ ID NO: 1674732 - RNA, 21 nt, Salmonella enterica enterica serovar Typhi
uauaacccugucugcgcaacg

SEQ ID NO: 1674733 - RNA, 22 nt, Salmonella enterica enterica serovar Typhi
uauaaauuuauuuuuugcuggg

SEQ ID NO: 1674734 - RNA, 12 nt, Salmonella enterica enterica serovar Typhi
uauaacauaaau

SEQ ID NO: 1674735 - RNA, 13 nt, Salmonella enterica enterica serovar Typhi
uauaacuugcaaa

SEQ ID NO: 1674736 - RNA, 19 nt, Salmonella enterica enterica serovar Typhi
uauaagcgguauucagguu

SEQ ID NO: 1674737 - RNA, 16 nt, Salmonella enterica enterica serovar Typhi
uauaagcgugcaaccc

SEQ ID NO: 1674738 - RNA, 13 nt, Salmonella enterica enterica serovar Typhi
uauaaguaacugg

SEQ ID NO: 1674739 - RNA, 15 nt, Salmonella enterica enterica serovar Typhi
uaguacugaccagac

SEQ ID NO: 1674740 - RNA, 16 nt, Salmonella enterica enterica serovar Typhi
uaguacgcaaggaaau

SEQ ID NO: 1674741 - RNA, 20 nt, Salmonella enterica enterica serovar Typhi
uaguacgcaaggaaauauua

SEQ ID NO: 1674742 - RNA, 16 nt, Salmonella enterica enterica serovar Typhi
uaguacgcgcgccggu

SEQ ID NO: 1674743 - RNA, 18 nt, Salmonella enterica enterica serovar Typhi
uaguauuuacaaaaaaga

SEQ ID NO: 1674744 - RNA, 22 nt, Salmonella enterica enterica serovar Typhi
uaguauccccggcaaccuuaaa

SEQ ID NO: 1674745 - RNA, 20 nt, Salmonella enterica enterica serovar Typhi
uaguauggagcaggaaaaga

SEQ ID NO: 1674746 - RNA, 11 nt, Salmonella enterica enterica serovar Typhi
uaguccagcau

SEQ ID NO: 1674747 - RNA, 17 nt, Salmonella enterica enterica serovar Typhi
uagucauaauuaaaaag

SEQ ID NO: 1674748 - RNA, 14 nt, Salmonella enterica enterica serovar Typhi
uagucgagggugau

SEQ ID NO: 1674749 - RNA, 22 nt, Salmonella enterica enterica serovar Typhi
uagguucgguaugccuuccaga

SEQ ID NO: 1674750 - RNA, 13 nt, Salmonella enterica enterica serovar Typhi
uaguaaagaaauu

SEQ ID NO: 1674751 - RNA, 19 nt, Salmonella enterica enterica serovar Typhi
uaguaccgaacagccaggc

SEQ ID NO: 1674752 - RNA, 16 nt, Salmonella enterica enterica serovar Typhi
uaguaauaaagcguag

SEQ ID NO: 1674753 - RNA, 15 nt, Salmonella enterica enterica serovar Typhi
uaguaaugcaugguc

SEQ ID NO: 1674754 - RNA, 15 nt, Salmonella enterica enterica serovar Typhi
uaguaaucauacgcg

SEQ ID NO: 1674755 - RNA, 14 nt, Salmonella enterica enterica serovar Typhi
uagcgcuuuccugc

SEQ ID NO: 1674756 - RNA, 21 nt, Salmonella enterica enterica serovar Typhi
uagcggcagccaugcuauuca

SEQ ID NO: 1674757 - RNA, 18 nt, Salmonella enterica enterica serovar Typhi
uagcggcaugucugucua

SEQ ID NO: 1674758 - RNA, 16 nt, Salmonella enterica enterica serovar Typhi
uagcggcugcggcgca

SEQ ID NO: 1674759 - RNA, 16 nt, Salmonella enterica enterica serovar Typhi
uagcgggcaaugccac

SEQ ID NO: 1674760 - RNA, 16 nt, Salmonella enterica enterica serovar Typhi
uagcggguaaacagau

SEQ ID NO: 1674761 - RNA, 18 nt, Salmonella enterica enterica serovar Typhi
uagcgggcaaugccacca

SEQ ID NO: 1674762 - RNA, 21 nt, Salmonella enterica enterica serovar Typhi
uagcggcguuuauauaaaaau

SEQ ID NO: 1674763 - RNA, 19 nt, Salmonella enterica enterica serovar Typhi
uagcggcuaaucaccaccu

SEQ ID NO: 1674764 - RNA, 20 nt, Salmonella enterica enterica serovar Typhi
uagcggcuaaucaccaccuc

SEQ ID NO: 1674765 - RNA, 14 nt, Salmonella enterica enterica serovar Typhi
uagcggccagaugg

SEQ ID NO: 1674766 - RNA, 19 nt, Salmonella enterica enterica serovar Typhi
uagcguaucagacuuauac

SEQ ID NO: 1674767 - RNA, 17 nt, Salmonella enterica enterica serovar Typhi
uagcgucuuauccggcc

SEQ ID NO: 1674768 - RNA, 14 nt, Salmonella enterica enterica serovar Typhi
uagcgucuucagua

SEQ ID NO: 1674769 - RNA, 13 nt, Salmonella enterica enterica serovar Typhi
uagcuaauggcuu

SEQ ID NO: 1674770 - RNA, 19 nt, Salmonella enterica enterica serovar Typhi
uagcgcaggggggaaauga

SEQ ID NO: 1674771 - RNA, 17 nt, Salmonella enterica enterica serovar Typhi
uagcgcaaaagcgcgcc

SEQ ID NO: 1674772 - RNA, 18 nt, Salmonella enterica enterica serovar Typhi
uagcgcaaauauccuacc

SEQ ID NO: 1674773 - RNA, 14 nt, Salmonella enterica enterica serovar Typhi
uagcgcccuuuuuu

SEQ ID NO: 1674774 - RNA, 21 nt, Salmonella enterica enterica serovar Typhi
uagcgccuucaggcaucagau

SEQ ID NO: 1674775 - RNA, 14 nt, Salmonella enterica enterica serovar Typhi
uagcgccauauaaa

SEQ ID NO: 1674776 - RNA, 23 nt, Salmonella enterica enterica serovar Typhi
uagcgccccggugcuuucuccug

SEQ ID NO: 1674777 - RNA, 15 nt, Salmonella enterica enterica serovar Typhi
uagcgccagacagau

SEQ ID NO: 1674778 - RNA, 22 nt, Salmonella enterica enterica serovar Typhi
uagcgccagacagauaacacca

SEQ ID NO: 1674779 - RNA, 15 nt, Salmonella enterica enterica serovar Typhi
uagcgcgcuuccugc

SEQ ID NO: 1674780 - RNA, 12 nt, Salmonella enterica enterica serovar Typhi
uagcgccugcuc

SEQ ID NO: 1674781 - RNA, 23 nt, Salmonella enterica enterica serovar Typhi
uagcgcgacgccaaaccugccac

SEQ ID NO: 1674782 - RNA, 16 nt, Salmonella enterica enterica serovar Typhi
uagcgcgauuuucucg

SEQ ID NO: 1674783 - RNA, 21 nt, Salmonella enterica enterica serovar Typhi
uagcgcgcgcuaauuuucagg

SEQ ID NO: 1674784 - RNA, 16 nt, Salmonella enterica enterica serovar Typhi
uagcgcggcagcgcgc

SEQ ID NO: 1674785 - RNA, 19 nt, Salmonella enterica enterica serovar Typhi
uaggcguugaacauuucau

SEQ ID NO: 1674786 - RNA, 21 nt, Salmonella enterica enterica serovar Typhi
uaggccagacgaaguuuugcg

SEQ ID NO: 1674787 - RNA, 21 nt, Salmonella enterica enterica serovar Typhi
uaggccagccgacgcucuucc

SEQ ID NO: 1674788 - RNA, 20 nt, Salmonella enterica enterica serovar Typhi
uaggccagccgacgcucuuc

SEQ ID NO: 1674789 - RNA, 20 nt, Salmonella enterica enterica serovar Typhi
uaggccaaacuuacgcagcu

SEQ ID NO: 1674790 - RNA, 18 nt, Salmonella enterica enterica serovar Typhi
uagcuauuccaaaauaau

SEQ ID NO: 1674791 - RNA, 21 nt, Salmonella enterica enterica serovar Typhi
uagcuguaccagaucgccugc

SEQ ID NO: 1674792 - RNA, 12 nt, Salmonella enterica enterica serovar Typhi
uagcuaugguca

SEQ ID NO: 1674793 - RNA, 14 nt, Salmonella enterica enterica serovar Typhi
uagcuucagcggcg

SEQ ID NO: 1674794 - RNA, 11 nt, Salmonella enterica enterica serovar Typhi
uagcuuccagc

SEQ ID NO: 1674795 - RNA, 12 nt, Salmonella enterica enterica serovar Typhi
uagcuguucaau

SEQ ID NO: 1674796 - RNA, 19 nt, Salmonella enterica enterica serovar Typhi
uagcagcgaugacagcagg

SEQ ID NO: 1674797 - RNA, 15 nt, Salmonella enterica enterica serovar Typhi
uagcaacuuaauaau

SEQ ID NO: 1674798 - RNA, 14 nt, Salmonella enterica enterica serovar Typhi
uagcaaaaaugccg

SEQ ID NO: 1674799 - RNA, 21 nt, Salmonella enterica enterica serovar Typhi
uagcaaagcguacaugaauaa

SEQ ID NO: 1674800 - RNA, 13 nt, Salmonella enterica enterica serovar Typhi
uagcaacccacuu

SEQ ID NO: 1674801 - RNA, 22 nt, Salmonella enterica enterica serovar Typhi
uagcaacccacuuucggaaaaa

SEQ ID NO: 1674802 - RNA, 23 nt, Salmonella enterica enterica serovar Typhi
uagcauuuccgcaucguuaucau

SEQ ID NO: 1674803 - RNA, 15 nt, Salmonella enterica enterica serovar Typhi
uagccauuuaaugau

SEQ ID NO: 1674804 - RNA, 22 nt, Salmonella enterica enterica serovar Typhi
uagauggcguaucgcuugauac

SEQ ID NO: 1674805 - RNA, 22 nt, Salmonella enterica enterica serovar Typhi
uagaaaauaauucauauuagcu

SEQ ID NO: 1674806 - RNA, 17 nt, Salmonella enterica enterica serovar Typhi
ucagcagugcaaaggcc

SEQ ID NO: 1674807 - RNA, 20 nt, Salmonella enterica enterica serovar Typhi
ucagcauauccagcgccugc

SEQ ID NO: 1674808 - RNA, 15 nt, Salmonella enterica enterica serovar Typhi
ucagcagccgggcca

SEQ ID NO: 1674809 - RNA, 16 nt, Salmonella enterica enterica serovar Typhi
ucagcagcgauagacu

SEQ ID NO: 1674810 - RNA, 13 nt, Salmonella enterica enterica serovar Typhi
ucagcagaacaaa

SEQ ID NO: 1674811 - RNA, 18 nt, Salmonella enterica enterica serovar Typhi
ucagcagcaccgguuuuu

SEQ ID NO: 1674812 - RNA, 13 nt, Salmonella enterica enterica serovar Typhi
ucagcaaaugaac

SEQ ID NO: 1674813 - RNA, 13 nt, Salmonella enterica enterica serovar Typhi
ucagcaagaaguu

SEQ ID NO: 1674814 - RNA, 13 nt, Salmonella enterica enterica serovar Typhi
ucagcaacugcgu

SEQ ID NO: 1674815 - RNA, 16 nt, Salmonella enterica enterica serovar Typhi
ucagcaacggaagcug

SEQ ID NO: 1674816 - RNA, 18 nt, Salmonella enterica enterica serovar Typhi
ucagcaccuccagcgccu

SEQ ID NO: 1674817 - RNA, 20 nt, Salmonella enterica enterica serovar Typhi
ucagcaccucaucgcuaccu

SEQ ID NO: 1674818 - RNA, 13 nt, Salmonella enterica enterica serovar Typhi
ucagcaccuccag

SEQ ID NO: 1674819 - RNA, 20 nt, Salmonella enterica enterica serovar Typhi
ucagcaauuuuguuaaaucc

SEQ ID NO: 1674820 - RNA, 17 nt, Salmonella enterica enterica serovar Typhi
ucagcaauuucucgccc

SEQ ID NO: 1674821 - RNA, 17 nt, Salmonella enterica enterica serovar Typhi
ucagcccgcaaaggacc

SEQ ID NO: 1674822 - RNA, 18 nt, Salmonella enterica enterica serovar Typhi
ucagcccggacaucaucc

SEQ ID NO: 1674823 - RNA, 16 nt, Salmonella enterica enterica serovar Typhi
ucagccgauaagaacu

SEQ ID NO: 1674824 - RNA, 15 nt, Salmonella enterica enterica serovar Typhi
ucagcccuuauauca

SEQ ID NO: 1674825 - RNA, 22 nt, Salmonella enterica enterica serovar Typhi
ucagccgcgcuaucaaaaugca

SEQ ID NO: 1674826 - RNA, 14 nt, Salmonella enterica enterica serovar Typhi
ucagccuuuucaua

SEQ ID NO: 1674827 - RNA, 20 nt, Salmonella enterica enterica serovar Typhi
ucagcgaccgucguguuacc

SEQ ID NO: 1674828 - RNA, 12 nt, Salmonella enterica enterica serovar Typhi
ucagccugugca

SEQ ID NO: 1674829 - RNA, 16 nt, Salmonella enterica enterica serovar Typhi
ucagccgggcgggaac

SEQ ID NO: 1674830 - RNA, 13 nt, Salmonella enterica enterica serovar Typhi
ucagcauggugug

SEQ ID NO: 1674831 - RNA, 12 nt, Salmonella enterica enterica serovar Typhi
ucagcauggugu

SEQ ID NO: 1674832 - RNA, 21 nt, Salmonella enterica enterica serovar Typhi
ucagccauuaaccagauuacc

SEQ ID NO: 1674833 - RNA, 14 nt, Salmonella enterica enterica serovar Typhi
ucagccagaacgaa

SEQ ID NO: 1674834 - RNA, 16 nt, Salmonella enterica enterica serovar Typhi
ucagauccuucauuca

SEQ ID NO: 1674835 - RNA, 19 nt, Salmonella enterica enterica serovar Typhi
ucagauguccaccgauuuc

SEQ ID NO: 1674836 - RNA, 17 nt, Salmonella enterica enterica serovar Typhi
ucagaucuuauaugagc

SEQ ID NO: 1674837 - RNA, 20 nt, Salmonella enterica enterica serovar Typhi
ucagaucuuauaugagcggg

SEQ ID NO: 1674838 - RNA, 14 nt, Salmonella enterica enterica serovar Typhi
ucagcaaaaacauu

SEQ ID NO: 1674839 - RNA, 20 nt, Salmonella enterica enterica serovar Typhi
ucagcaaacggcuggauaac

SEQ ID NO: 1674840 - RNA, 11 nt, Salmonella enterica enterica serovar Typhi
ucagcaaaaac

SEQ ID NO: 1674841 - RNA, 18 nt, Salmonella enterica enterica serovar Typhi
ucagauuacccucugcgu

SEQ ID NO: 1674842 - RNA, 19 nt, Salmonella enterica enterica serovar Typhi
ucagauaucccaugaaacu

SEQ ID NO: 1674843 - RNA, 14 nt, Salmonella enterica enterica serovar Typhi
ucagauauuccagc

SEQ ID NO: 1674844 - RNA, 14 nt, Salmonella enterica enterica serovar Typhi
ucagauaauucuaa

SEQ ID NO: 1674845 - RNA, 18 nt, Salmonella enterica enterica serovar Typhi
ucagauacggcuccagca

SEQ ID NO: 1674846 - RNA, 21 nt, Salmonella enterica enterica serovar Typhi
ucagauaaacagguaaaacaa

SEQ ID NO: 1674847 - RNA, 15 nt, Salmonella enterica enterica serovar Typhi
ucagauaacgaacca

SEQ ID NO: 1674848 - RNA, 22 nt, Salmonella enterica enterica serovar Typhi
ucagaggccuuuugcagcagcg

SEQ ID NO: 1674849 - RNA, 17 nt, Salmonella enterica enterica serovar Typhi
ucagacguagcgccauc

SEQ ID NO: 1674850 - RNA, 20 nt, Salmonella enterica enterica serovar Typhi
ucagacucucaaugcccauc

SEQ ID NO: 1674851 - RNA, 15 nt, Salmonella enterica enterica serovar Typhi
ucagacggcugaccu

SEQ ID NO: 1674852 - RNA, 19 nt, Salmonella enterica enterica serovar Typhi
ucagacgcucagccuuaua

SEQ ID NO: 1674853 - RNA, 12 nt, Salmonella enterica enterica serovar Typhi
ucagacgcauca

SEQ ID NO: 1674854 - RNA, 16 nt, Salmonella enterica enterica serovar Typhi
ucagacgcucagccuu

SEQ ID NO: 1674855 - RNA, 13 nt, Salmonella enterica enterica serovar Typhi
ucagacgcugguu

SEQ ID NO: 1674856 - RNA, 19 nt, Salmonella enterica enterica serovar Typhi
ucagaccauaguccaugcc

SEQ ID NO: 1674857 - RNA, 21 nt, Salmonella enterica enterica serovar Typhi
ucagacaugauaaguuucucu

SEQ ID NO: 1674858 - RNA, 11 nt, Salmonella enterica enterica serovar Typhi
ucagacaggcc

SEQ ID NO: 1674859 - RNA, 18 nt, Salmonella enterica enterica serovar Typhi
ucagaagcuucgcgaacu

SEQ ID NO: 1674860 - RNA, 17 nt, Salmonella enterica enterica serovar Typhi
ucagaaccugcgauacc

SEQ ID NO: 1674861 - RNA, 15 nt, Salmonella enterica enterica serovar Typhi
ucagaauaugccagg

SEQ ID NO: 1674862 - RNA, 20 nt, Salmonella enterica enterica serovar Typhi
ucagaauaccgcguccuucu

SEQ ID NO: 1674863 - RNA, 13 nt, Salmonella enterica enterica serovar Typhi
ucagaauaaugcu

SEQ ID NO: 1674864 - RNA, 19 nt, Salmonella enterica enterica serovar Typhi
ucagaaaucggcagcaccc

SEQ ID NO: 1674865 - RNA, 15 nt, Salmonella enterica enterica serovar Typhi
ucagaaauaaaacca

SEQ ID NO: 1674866 - RNA, 20 nt, Salmonella enterica enterica serovar Typhi
ucacgcucgaguucuucacg

SEQ ID NO: 1674867 - RNA, 20 nt, Salmonella enterica enterica serovar Typhi
ucacgcucacgcagauauuc

SEQ ID NO: 1674868 - RNA, 16 nt, Salmonella enterica enterica serovar Typhi
ucacgcgccagcacca

SEQ ID NO: 1674869 - RNA, 17 nt, Salmonella enterica enterica serovar Typhi
ucacgcgccagcaccac

SEQ ID NO: 1674870 - RNA, 12 nt, Salmonella enterica enterica serovar Typhi
ucacgcggcgcg

SEQ ID NO: 1674871 - RNA, 12 nt, Salmonella enterica enterica serovar Typhi
ucacgcuggaua

SEQ ID NO: 1674872 - RNA, 21 nt, Salmonella enterica enterica serovar Typhi
ucacgcuuaucgccaaaccag

SEQ ID NO: 1674873 - RNA, 21 nt, Salmonella enterica enterica serovar Typhi
ucacgcuggugcgcgggagau

SEQ ID NO: 1674874 - RNA, 13 nt, Salmonella enterica enterica serovar Typhi
ucacgcuugcccg

SEQ ID NO: 1674875 - RNA, 23 nt, Salmonella enterica enterica serovar Typhi
ucacggccuucgcagaucgccug

SEQ ID NO: 1674876 - RNA, 18 nt, Salmonella enterica enterica serovar Typhi
ucacggcacgcccuucgu

SEQ ID NO: 1674877 - RNA, 22 nt, Salmonella enterica enterica serovar Typhi
ucacgguacgcaucaccaggca

SEQ ID NO: 1674878 - RNA, 18 nt, Salmonella enterica enterica serovar Typhi
ucacgguagaccaaaugg

SEQ ID NO: 1674879 - RNA, 17 nt, Salmonella enterica enterica serovar Typhi
ucacgggcguagucagc

SEQ ID NO: 1674880 - RNA, 15 nt, Salmonella enterica enterica serovar Typhi
ucacgguuucaacuu

SEQ ID NO: 1674881 - RNA, 16 nt, Salmonella enterica enterica serovar Typhi
ucacgguucgcaauca

SEQ ID NO: 1674882 - RNA, 18 nt, Salmonella enterica enterica serovar Typhi
ucacgguauucguuacca

SEQ ID NO: 1674883 - RNA, 23 nt, Salmonella enterica enterica serovar Typhi
ucacgguauucguuaccagcauc

SEQ ID NO: 1674884 - RNA, 22 nt, Salmonella enterica enterica serovar Typhi
ucacgcauugccacagccucag

SEQ ID NO: 1674885 - RNA, 20 nt, Salmonella enterica enterica serovar Typhi
ucacgccaucgacaaaggca

SEQ ID NO: 1674886 - RNA, 18 nt, Salmonella enterica enterica serovar Typhi
ucacgccaucagggacga

SEQ ID NO: 1674887 - RNA, 18 nt, Salmonella enterica enterica serovar Typhi
ucacgcccagcgcggccc

SEQ ID NO: 1674888 - RNA, 15 nt, Salmonella enterica enterica serovar Typhi
ucacgccguccagca

SEQ ID NO: 1674889 - RNA, 18 nt, Salmonella enterica enterica serovar Typhi
ucacgcagugcgcgaccg

SEQ ID NO: 1674890 - RNA, 21 nt, Salmonella enterica enterica serovar Typhi
ucacgcagcgcauccaccaga

SEQ ID NO: 1674891 - RNA, 20 nt, Salmonella enterica enterica serovar Typhi
ucacgcagcgugaagcugcc

SEQ ID NO: 1674892 - RNA, 17 nt, Salmonella enterica enterica serovar Typhi
ucacgcaaaugcagcgg

SEQ ID NO: 1674893 - RNA, 13 nt, Salmonella enterica enterica serovar Typhi
ucaccucccugca

SEQ ID NO: 1674894 - RNA, 18 nt, Salmonella enterica enterica serovar Typhi
ucaccucacuccagaccu

SEQ ID NO: 1674895 - RNA, 12 nt, Salmonella enterica enterica serovar Typhi
ucaccuccagca

SEQ ID NO: 1674896 - RNA, 20 nt, Salmonella enterica enterica serovar Typhi
ucaccucuuucuccacaucg

SEQ ID NO: 1674897 - RNA, 18 nt, Salmonella enterica enterica serovar Typhi
ucaccuggaugcugccug

SEQ ID NO: 1674898 - RNA, 21 nt, Salmonella enterica enterica serovar Typhi
ucaccuggauuccuccaauuc

SEQ ID NO: 1674899 - RNA, 16 nt, Salmonella enterica enterica serovar Typhi
ucaccugccagggugc

SEQ ID NO: 1674900 - RNA, 16 nt, Salmonella enterica enterica serovar Typhi
ucaccuggaugcugcc

SEQ ID NO: 1674901 - RNA, 20 nt, Salmonella enterica enterica serovar Typhi
ucaccuucggugaaaucacg

SEQ ID NO: 1674902 - RNA, 22 nt, Salmonella enterica enterica serovar Typhi
ucaccuucugugaaaguuucag

SEQ ID NO: 1674903 - RNA, 17 nt, Salmonella enterica enterica serovar Typhi
ucacgaaauaacgcacu

SEQ ID NO: 1674904 - RNA, 19 nt, Salmonella enterica enterica serovar Typhi
ucaccuuguaccuccugau

SEQ ID NO: 1674905 - RNA, 13 nt, Salmonella enterica enterica serovar Typhi
ucaccuugcugcg

SEQ ID NO: 1674906 - RNA, 21 nt, Salmonella enterica enterica serovar Typhi
ucaccuugcugcgcaggggcu

SEQ ID NO: 1674907 - RNA, 21 nt, Salmonella enterica enterica serovar Typhi
ucaccuuuacuuaauucugcu

SEQ ID NO: 1674908 - RNA, 17 nt, Salmonella enterica enterica serovar Typhi
ucaccuuucugccaggu

SEQ ID NO: 1674909 - RNA, 14 nt, Salmonella enterica enterica serovar Typhi
ucacgauaauguuu

SEQ ID NO: 1674910 - RNA, 17 nt, Salmonella enterica enterica serovar Typhi
ucacgaccaaccaacag

SEQ ID NO: 1674911 - RNA, 17 nt, Salmonella enterica enterica serovar Typhi
ucacgacuuauugcacc

SEQ ID NO: 1674912 - RNA, 14 nt, Salmonella enterica enterica serovar Typhi
ucacguuuuuacuc

SEQ ID NO: 1674913 - RNA, 15 nt, Salmonella enterica enterica serovar Typhi
ucacguuuacuaaaa

SEQ ID NO: 1674914 - RNA, 18 nt, Salmonella enterica enterica serovar Typhi
ucacguuuugcagcgcca

SEQ ID NO: 1674915 - RNA, 14 nt, Salmonella enterica enterica serovar Typhi
ucacguucgguacg

SEQ ID NO: 1674916 - RNA, 22 nt, Salmonella enterica enterica serovar Typhi
ucacgucgcgaagcugugcguu

SEQ ID NO: 1674917 - RNA, 18 nt, Salmonella enterica enterica serovar Typhi
ucacgucgcgcgccgccu

SEQ ID NO: 1674918 - RNA, 17 nt, Salmonella enterica enterica serovar Typhi
ucacgucgcccaccgca

SEQ ID NO: 1674919 - RNA, 15 nt, Salmonella enterica enterica serovar Typhi
ucacguagcggcgcg

SEQ ID NO: 1674920 - RNA, 19 nt, Salmonella enterica enterica serovar Typhi
ucacguagcguaucagacu

SEQ ID NO: 1674921 - RNA, 18 nt, Salmonella enterica enterica serovar Typhi
ucacuacccggaggcaau

SEQ ID NO: 1674922 - RNA, 18 nt, Salmonella enterica enterica serovar Typhi
ucacuccuuagauuaauc

SEQ ID NO: 1674923 - RNA, 17 nt, Salmonella enterica enterica serovar Typhi
ucacuccuaagagaaaa

SEQ ID NO: 1674924 - RNA, 13 nt, Salmonella enterica enterica serovar Typhi
ucacuuguucaau

SEQ ID NO: 1674925 - RNA, 15 nt, Salmonella enterica enterica serovar Typhi
ucacuuguucaauau

SEQ ID NO: 1674926 - RNA, 17 nt, Salmonella enterica enterica serovar Typhi
ucacuuguucaauauuc

SEQ ID NO: 1674927 - RNA, 17 nt, Salmonella enterica enterica serovar Typhi
ucacuuguucuucuguu

SEQ ID NO: 1674928 - RNA, 21 nt, Salmonella enterica enterica serovar Typhi
ucacuuccgccaccacgccca

SEQ ID NO: 1674929 - RNA, 14 nt, Salmonella enterica enterica serovar Typhi
ucacuucaucauca

SEQ ID NO: 1674930 - RNA, 24 nt, Salmonella enterica enterica serovar Typhi
ucacuuaucaaaccagcuuuucau

SEQ ID NO: 1674931 - RNA, 14 nt, Salmonella enterica enterica serovar Typhi
ucacuuaucccugc

SEQ ID NO: 1674932 - RNA, 12 nt, Salmonella enterica enterica serovar Typhi
ucacuuauaaau

SEQ ID NO: 1674933 - RNA, 17 nt, Salmonella enterica enterica serovar Typhi
ucacuggcggcaagcug

SEQ ID NO: 1674934 - RNA, 21 nt, Salmonella enterica enterica serovar Typhi
ucacugguuauaugaauaaac

SEQ ID NO: 1674935 - RNA, 15 nt, Salmonella enterica enterica serovar Typhi
ucacugaaccugccu

SEQ ID NO: 1674936 - RNA, 16 nt, Salmonella enterica enterica serovar Typhi
ucacugaaccugccuu

SEQ ID NO: 1674937 - RNA, 19 nt, Salmonella enterica enterica serovar Typhi
ucacugacuauccacagcg

SEQ ID NO: 1674938 - RNA, 18 nt, Salmonella enterica enterica serovar Typhi
ucacugccguacaaaccg

SEQ ID NO: 1674939 - RNA, 18 nt, Salmonella enterica enterica serovar Typhi
ucaaucacaaaauggcug

SEQ ID NO: 1674940 - RNA, 22 nt, Salmonella enterica enterica serovar Typhi
ucaaucacugaugccacacccu

SEQ ID NO: 1674941 - RNA, 18 nt, Salmonella enterica enterica serovar Typhi
ucaauauugaacauuuuu

SEQ ID NO: 1674942 - RNA, 16 nt, Salmonella enterica enterica serovar Typhi
ucaauaucauagugcc

SEQ ID NO: 1674943 - RNA, 20 nt, Salmonella enterica enterica serovar Typhi
ucaauacgagugacauuauu

SEQ ID NO: 1674944 - RNA, 17 nt, Salmonella enterica enterica serovar Typhi
ucaauaccuuaguaaaa

SEQ ID NO: 1674945 - RNA, 19 nt, Salmonella enterica enterica serovar Typhi
ucaauaauauuaucauaau

SEQ ID NO: 1674946 - RNA, 14 nt, Salmonella enterica enterica serovar Typhi
ucaauaagauaucc

SEQ ID NO: 1674947 - RNA, 12 nt, Salmonella enterica enterica serovar Typhi
ucaauaacgaag

SEQ ID NO: 1674948 - RNA, 16 nt, Salmonella enterica enterica serovar Typhi
ucaauaaccgccagca

SEQ ID NO: 1674949 - RNA, 20 nt, Salmonella enterica enterica serovar Typhi
ucaagcugauugauuuugua

SEQ ID NO: 1674950 - RNA, 22 nt, Salmonella enterica enterica serovar Typhi
ucaagcguuuccagaguacauu

SEQ ID NO: 1674951 - RNA, 21 nt, Salmonella enterica enterica serovar Typhi
ucaagcgguagcguuauccag

SEQ ID NO: 1674952 - RNA, 19 nt, Salmonella enterica enterica serovar Typhi
ucaaggcauccagcagucg

SEQ ID NO: 1674953 - RNA, 21 nt, Salmonella enterica enterica serovar Typhi
ucaagcuuugcguaaaaaaca

SEQ ID NO: 1674954 - RNA, 13 nt, Salmonella enterica enterica serovar Typhi
ucaaggcaauaga

SEQ ID NO: 1674955 - RNA, 23 nt, Salmonella enterica enterica serovar Typhi
ucaaggauggagauaucaccauc

SEQ ID NO: 1674956 - RNA, 14 nt, Salmonella enterica enterica serovar Typhi
ucaagucccccccc

SEQ ID NO: 1674957 - RNA, 13 nt, Salmonella enterica enterica serovar Typhi
ucaaguacagcuu

SEQ ID NO: 1674958 - RNA, 16 nt, Salmonella enterica enterica serovar Typhi
ucaauaaaucaacaua

SEQ ID NO: 1674959 - RNA, 14 nt, Salmonella enterica enterica serovar Typhi
ucaauaaacuggag

SEQ ID NO: 1674960 - RNA, 16 nt, Salmonella enterica enterica serovar Typhi
ucaauaaacuggagca

SEQ ID NO: 1674961 - RNA, 21 nt, Salmonella enterica enterica serovar Typhi
ucaauaaacauuuuuuuugca

SEQ ID NO: 1674962 - RNA, 16 nt, Salmonella enterica enterica serovar Typhi
ucaauaaacagcuccg

SEQ ID NO: 1674963 - RNA, 17 nt, Salmonella enterica enterica serovar Typhi
ucaaguuuagaaaaaau

SEQ ID NO: 1674964 - RNA, 21 nt, Salmonella enterica enterica serovar Typhi
ucaaguuuagaaaaaauuaaa

SEQ ID NO: 1674965 - RNA, 19 nt, Salmonella enterica enterica serovar Typhi
ucaaugucugauggcgcug

SEQ ID NO: 1674966 - RNA, 24 nt, Salmonella enterica enterica serovar Typhi
ucaauguauuguucaugcaauucc

SEQ ID NO: 1674967 - RNA, 22 nt, Salmonella enterica enterica serovar Typhi
ucaauggcgcgaagugccaggu

SEQ ID NO: 1674968 - RNA, 23 nt, Salmonella enterica enterica serovar Typhi
ucaauggcgcgaagugccagguu

SEQ ID NO: 1674969 - RNA, 14 nt, Salmonella enterica enterica serovar Typhi
ucaaugcacgccac

SEQ ID NO: 1674970 - RNA, 16 nt, Salmonella enterica enterica serovar Typhi
ucaaugcccagcgcaa

SEQ ID NO: 1674971 - RNA, 14 nt, Salmonella enterica enterica serovar Typhi
ucaaucuucccgca

SEQ ID NO: 1674972 - RNA, 17 nt, Salmonella enterica enterica serovar Typhi
ucaaucggcgauagagu

SEQ ID NO: 1674973 - RNA, 22 nt, Salmonella enterica enterica serovar Typhi
ucaaucacuugaagccuuucug

SEQ ID NO: 1674974 - RNA, 14 nt, Salmonella enterica enterica serovar Typhi
ucaaucacuuauca

SEQ ID NO: 1674975 - RNA, 15 nt, Salmonella enterica enterica serovar Typhi
ucaaucacuuaucaa

SEQ ID NO: 1674976 - RNA, 14 nt, Salmonella enterica enterica serovar Typhi
ucacaaauuaaaaa

SEQ ID NO: 1674977 - RNA, 23 nt, Salmonella enterica enterica serovar Typhi
ucacaaacaccaccaguaaccgc

SEQ ID NO: 1674978 - RNA, 14 nt, Salmonella enterica enterica serovar Typhi
ucacaaacaccacc

SEQ ID NO: 1674979 - RNA, 13 nt, Salmonella enterica enterica serovar Typhi
ucaauuuuucgcc

SEQ ID NO: 1674980 - RNA, 18 nt, Salmonella enterica enterica serovar Typhi
ucaauuuuucgcccggcu

SEQ ID NO: 1674981 - RNA, 15 nt, Salmonella enterica enterica serovar Typhi
ucacaaaauggcuga

SEQ ID NO: 1674982 - RNA, 12 nt, Salmonella enterica enterica serovar Typhi
ucaauuuccagu

SEQ ID NO: 1674983 - RNA, 14 nt, Salmonella enterica enterica serovar Typhi
ucaauuccacaggc

SEQ ID NO: 1674984 - RNA, 19 nt, Salmonella enterica enterica serovar Typhi
ucaauuccuuuuaauuuaa

SEQ ID NO: 1674985 - RNA, 19 nt, Salmonella enterica enterica serovar Typhi
ucaauugugugcacugcac

SEQ ID NO: 1674986 - RNA, 21 nt, Salmonella enterica enterica serovar Typhi
ucaccccgucauauuacauag

SEQ ID NO: 1674987 - RNA, 22 nt, Salmonella enterica enterica serovar Typhi
ucaccccagcgguaaaaucugu

SEQ ID NO: 1674988 - RNA, 21 nt, Salmonella enterica enterica serovar Typhi
ucacccgaaucacugacggaa

SEQ ID NO: 1674989 - RNA, 14 nt, Salmonella enterica enterica serovar Typhi
ucacccgauaaaau

SEQ ID NO: 1674990 - RNA, 18 nt, Salmonella enterica enterica serovar Typhi
ucacccgccggcagcagc

SEQ ID NO: 1674991 - RNA, 14 nt, Salmonella enterica enterica serovar Typhi
ucacccugaauuuc

SEQ ID NO: 1674992 - RNA, 18 nt, Salmonella enterica enterica serovar Typhi
ucacccggauacgcggca

SEQ ID NO: 1674993 - RNA, 19 nt, Salmonella enterica enterica serovar Typhi
ucacccgccggcagcagcu

SEQ ID NO: 1674994 - RNA, 19 nt, Salmonella enterica enterica serovar Typhi
ucaccgcaaauucgucgcc

SEQ ID NO: 1674995 - RNA, 13 nt, Salmonella enterica enterica serovar Typhi
ucaccgccagagc

SEQ ID NO: 1674996 - RNA, 17 nt, Salmonella enterica enterica serovar Typhi
ucaccgaugacauuacc

SEQ ID NO: 1674997 - RNA, 15 nt, Salmonella enterica enterica serovar Typhi
ucaccgaccugccuu

SEQ ID NO: 1674998 - RNA, 19 nt, Salmonella enterica enterica serovar Typhi
ucaccggauacccagccac

SEQ ID NO: 1674999 - RNA, 18 nt, Salmonella enterica enterica serovar Typhi
ucaccguggcaaaaucca

SEQ ID NO: 1675000 - RNA, 19 nt, Salmonella enterica enterica serovar Typhi
ucaccguggcaucaucaaa

SEQ ID NO: 1675001 - RNA, 21 nt, Salmonella enterica enterica serovar Typhi
ucaccguauuaucaaaucuuc

SEQ ID NO: 1675002 - RNA, 20 nt, Salmonella enterica enterica serovar Typhi
ucaccgucacugaaccugcc

SEQ ID NO: 1675003 - RNA, 18 nt, Salmonella enterica enterica serovar Typhi
ucaccguccgccaggccc

SEQ ID NO: 1675004 - RNA, 18 nt, Salmonella enterica enterica serovar Typhi
ucaccguuuaaaaacauc

SEQ ID NO: 1675005 - RNA, 19 nt, Salmonella enterica enterica serovar Typhi
ucaccguuuaaaaacauca

SEQ ID NO: 1675006 - RNA, 16 nt, Salmonella enterica enterica serovar Typhi
ucaccaucauaaagcc

SEQ ID NO: 1675007 - RNA, 16 nt, Salmonella enterica enterica serovar Typhi
ucaccaucccaugaug

SEQ ID NO: 1675008 - RNA, 20 nt, Salmonella enterica enterica serovar Typhi
ucaccauaauuaccggcaca

SEQ ID NO: 1675009 - RNA, 17 nt, Salmonella enterica enterica serovar Typhi
ucaccauuaacaucaga

SEQ ID NO: 1675010 - RNA, 19 nt, Salmonella enterica enterica serovar Typhi
ucaccaucguugccagcgg

SEQ ID NO: 1675011 - RNA, 18 nt, Salmonella enterica enterica serovar Typhi
ucacccacaggagccagu

SEQ ID NO: 1675012 - RNA, 15 nt, Salmonella enterica enterica serovar Typhi
ucaccauucauguuu

SEQ ID NO: 1675013 - RNA, 24 nt, Salmonella enterica enterica serovar Typhi
ucacccagucgcagccacccuggc

SEQ ID NO: 1675014 - RNA, 15 nt, Salmonella enterica enterica serovar Typhi
ucacccacuuguagc

SEQ ID NO: 1675015 - RNA, 20 nt, Salmonella enterica enterica serovar Typhi
ucaccccaacaaauagcaca

SEQ ID NO: 1675016 - RNA, 22 nt, Salmonella enterica enterica serovar Typhi
ucacccaugccgcgacgaaguc

SEQ ID NO: 1675017 - RNA, 16 nt, Salmonella enterica enterica serovar Typhi
ucaccaccgcaggcag

SEQ ID NO: 1675018 - RNA, 19 nt, Salmonella enterica enterica serovar Typhi
ucaccacgggguuggcccu

SEQ ID NO: 1675019 - RNA, 20 nt, Salmonella enterica enterica serovar Typhi
ucaccacgggguuggcccuc

SEQ ID NO: 1675020 - RNA, 21 nt, Salmonella enterica enterica serovar Typhi
ucaccagcccuuccaccaguu

SEQ ID NO: 1675021 - RNA, 22 nt, Salmonella enterica enterica serovar Typhi
ucaccaggcguaagaucccagg

SEQ ID NO: 1675022 - RNA, 18 nt, Salmonella enterica enterica serovar Typhi
ucaccagcugacgcagca

SEQ ID NO: 1675023 - RNA, 18 nt, Salmonella enterica enterica serovar Typhi
ucaccaguccggcagaaa

SEQ ID NO: 1675024 - RNA, 15 nt, Salmonella enterica enterica serovar Typhi
ucaccagugauuggc

SEQ ID NO: 1675025 - RNA, 14 nt, Salmonella enterica enterica serovar Typhi
ucaccacaaaggcg

SEQ ID NO: 1675026 - RNA, 15 nt, Salmonella enterica enterica serovar Typhi
ucaccaaaaggcaga

SEQ ID NO: 1675027 - RNA, 14 nt, Salmonella enterica enterica serovar Typhi
ucaccaacugcuga

SEQ ID NO: 1675028 - RNA, 21 nt, Salmonella enterica enterica serovar Typhi
ucacauuggcaaaccccugcu

SEQ ID NO: 1675029 - RNA, 18 nt, Salmonella enterica enterica serovar Typhi
ucacaugcuuauccagcu

SEQ ID NO: 1675030 - RNA, 11 nt, Salmonella enterica enterica serovar Typhi
ucacaucauua

SEQ ID NO: 1675031 - RNA, 15 nt, Salmonella enterica enterica serovar Typhi
ucacaucgcccugau

SEQ ID NO: 1675032 - RNA, 22 nt, Salmonella enterica enterica serovar Typhi
ucacaucguuggcgccaaaacc

SEQ ID NO: 1675033 - RNA, 20 nt, Salmonella enterica enterica serovar Typhi
ucacaucguaaaucagcgug

SEQ ID NO: 1675034 - RNA, 17 nt, Salmonella enterica enterica serovar Typhi
ucacaucguaaaucagc

SEQ ID NO: 1675035 - RNA, 17 nt, Salmonella enterica enterica serovar Typhi
ucacauacagcacuucc

SEQ ID NO: 1675036 - RNA, 17 nt, Salmonella enterica enterica serovar Typhi
ucacaucaaagccccau

SEQ ID NO: 1675037 - RNA, 17 nt, Salmonella enterica enterica serovar Typhi
ucacauauucaauaaua

SEQ ID NO: 1675038 - RNA, 17 nt, Salmonella enterica enterica serovar Typhi
ucacagcgguuacgcua

SEQ ID NO: 1675039 - RNA, 16 nt, Salmonella enterica enterica serovar Typhi
ucacaggcuuggcagc

SEQ ID NO: 1675040 - RNA, 22 nt, Salmonella enterica enterica serovar Typhi
ucacagacaucggagauuucau

SEQ ID NO: 1675041 - RNA, 16 nt, Salmonella enterica enterica serovar Typhi
ucacacgcucacccag

SEQ ID NO: 1675042 - RNA, 15 nt, Salmonella enterica enterica serovar Typhi
ucacacugcgccgcc

SEQ ID NO: 1675043 - RNA, 22 nt, Salmonella enterica enterica serovar Typhi
ucacaccggcggagucgguaca

SEQ ID NO: 1675044 - RNA, 13 nt, Salmonella enterica enterica serovar Typhi
ucacaaccuccac

SEQ ID NO: 1675045 - RNA, 16 nt, Salmonella enterica enterica serovar Typhi
ucacaaauuaaaaauc

SEQ ID NO: 1675046 - RNA, 15 nt, Salmonella enterica enterica serovar Typhi
ucacaagcuguuucu

SEQ ID NO: 1675047 - RNA, 21 nt, Salmonella enterica enterica serovar Typhi
ucacaccaacgcuggcccggc

SEQ ID NO: 1675048 - RNA, 19 nt, Salmonella enterica enterica serovar Typhi
ucacacauaagcacaccau

SEQ ID NO: 1675049 - RNA, 14 nt, Salmonella enterica enterica serovar Typhi
ucacacauaucgcc

SEQ ID NO: 1675050 - RNA, 23 nt, Salmonella enterica enterica serovar Typhi
ucacaauguuuuuguaccaggcc

SEQ ID NO: 1675051 - RNA, 17 nt, Salmonella enterica enterica serovar Typhi
ucacaaucagccacggc

SEQ ID NO: 1675052 - RNA, 22 nt, Salmonella enterica enterica serovar Typhi
uauucauaacgccgaugccgcc

SEQ ID NO: 1675053 - RNA, 12 nt, Salmonella enterica enterica serovar Typhi
uauucaggugga

SEQ ID NO: 1675054 - RNA, 16 nt, Salmonella enterica enterica serovar Typhi
uauucaucaaaaugca

SEQ ID NO: 1675055 - RNA, 22 nt, Salmonella enterica enterica serovar Typhi
uauucauucacccaauaaauaa

SEQ ID NO: 1675056 - RNA, 21 nt, Salmonella enterica enterica serovar Typhi
uauuccagccaggaauggcua

SEQ ID NO: 1675057 - RNA, 16 nt, Salmonella enterica enterica serovar Typhi
uauuccaaaauaauaa

SEQ ID NO: 1675058 - RNA, 16 nt, Salmonella enterica enterica serovar Typhi
uauuccggcgcuggcg

SEQ ID NO: 1675059 - RNA, 20 nt, Salmonella enterica enterica serovar Typhi
uauucgacuguuguucuuca

SEQ ID NO: 1675060 - RNA, 14 nt, Salmonella enterica enterica serovar Typhi
uauuccuuaucaca

SEQ ID NO: 1675061 - RNA, 17 nt, Salmonella enterica enterica serovar Typhi
uauucccauuccugcaa

SEQ ID NO: 1675062 - RNA, 21 nt, Salmonella enterica enterica serovar Typhi
uauucacacgcucacccaguu

SEQ ID NO: 1675063 - RNA, 16 nt, Salmonella enterica enterica serovar Typhi
uauucaccucccugca

SEQ ID NO: 1675064 - RNA, 13 nt, Salmonella enterica enterica serovar Typhi
uauucaggccucc

SEQ ID NO: 1675065 - RNA, 15 nt, Salmonella enterica enterica serovar Typhi
uauucaggccuccug

SEQ ID NO: 1675066 - RNA, 17 nt, Salmonella enterica enterica serovar Typhi
uauucagggcuuuauuu

SEQ ID NO: 1675067 - RNA, 22 nt, Salmonella enterica enterica serovar Typhi
uauuauuuugggaauggaaaca

SEQ ID NO: 1675068 - RNA, 12 nt, Salmonella enterica enterica serovar Typhi
uauucaauaaua

SEQ ID NO: 1675069 - RNA, 22 nt, Salmonella enterica enterica serovar Typhi
uauucaacgccaucuuccucac

SEQ ID NO: 1675070 - RNA, 21 nt, Salmonella enterica enterica serovar Typhi
uauucugggcuuacuuuccaa

SEQ ID NO: 1675071 - RNA, 16 nt, Salmonella enterica enterica serovar Typhi
uauugaacauuuuuuc

SEQ ID NO: 1675072 - RNA, 17 nt, Salmonella enterica enterica serovar Typhi
uauugaacauuuuuuca

SEQ ID NO: 1675073 - RNA, 16 nt, Salmonella enterica enterica serovar Typhi
uauugaagauguagac

SEQ ID NO: 1675074 - RNA, 23 nt, Salmonella enterica enterica serovar Typhi
uauugaagugcgaaauuuaauau

SEQ ID NO: 1675075 - RNA, 16 nt, Salmonella enterica enterica serovar Typhi
uauugaauaguuacca

SEQ ID NO: 1675076 - RNA, 13 nt, Salmonella enterica enterica serovar Typhi
uauucgcuuguuu

SEQ ID NO: 1675077 - RNA, 13 nt, Salmonella enterica enterica serovar Typhi
uauucuauuccuu

SEQ ID NO: 1675078 - RNA, 16 nt, Salmonella enterica enterica serovar Typhi
uauuaccucgcgcuua

SEQ ID NO: 1675079 - RNA, 18 nt, Salmonella enterica enterica serovar Typhi
uauuacccaacaccagac

SEQ ID NO: 1675080 - RNA, 15 nt, Salmonella enterica enterica serovar Typhi
uauuaccaaugagcu

SEQ ID NO: 1675081 - RNA, 18 nt, Salmonella enterica enterica serovar Typhi
uauuacauagaaaauaua

SEQ ID NO: 1675082 - RNA, 19 nt, Salmonella enterica enterica serovar Typhi
uauuacaugccguuaauaa

SEQ ID NO: 1675083 - RNA, 19 nt, Salmonella enterica enterica serovar Typhi
uauuacgcaucauauaacc

SEQ ID NO: 1675084 - RNA, 22 nt, Salmonella enterica enterica serovar Typhi
uauuacgcaagaucacauacaa

SEQ ID NO: 1675085 - RNA, 15 nt, Salmonella enterica enterica serovar Typhi
uauuacugauaaagu

SEQ ID NO: 1675086 - RNA, 18 nt, Salmonella enterica enterica serovar Typhi
uauuacuaauaaaauuca

SEQ ID NO: 1675087 - RNA, 19 nt, Salmonella enterica enterica serovar Typhi
uauuaauuaaggaugaacu

SEQ ID NO: 1675088 - RNA, 13 nt, Salmonella enterica enterica serovar Typhi
uauuacaacguuc

SEQ ID NO: 1675089 - RNA, 14 nt, Salmonella enterica enterica serovar Typhi
uauuacaagaaagu

SEQ ID NO: 1675090 - RNA, 12 nt, Salmonella enterica enterica serovar Typhi
uauuaacgcuuu

SEQ ID NO: 1675091 - RNA, 23 nt, Salmonella enterica enterica serovar Typhi
uauuaaagcacaagaacuuaaau

SEQ ID NO: 1675092 - RNA, 19 nt, Salmonella enterica enterica serovar Typhi
uauuaaaguucagccgaua

SEQ ID NO: 1675093 - RNA, 13 nt, Salmonella enterica enterica serovar Typhi
uauuaugcugcuc

SEQ ID NO: 1675094 - RNA, 19 nt, Salmonella enterica enterica serovar Typhi
uauuauuacgcaucauaua

SEQ ID NO: 1675095 - RNA, 13 nt, Salmonella enterica enterica serovar Typhi
uauuauuauuacg

SEQ ID NO: 1675096 - RNA, 19 nt, Salmonella enterica enterica serovar Typhi
uauuauugcccuuuuguuu

SEQ ID NO: 1675097 - RNA, 20 nt, Salmonella enterica enterica serovar Typhi
uauuauauagacuccgucaa

SEQ ID NO: 1675098 - RNA, 14 nt, Salmonella enterica enterica serovar Typhi
uauuauauuuaaaa

SEQ ID NO: 1675099 - RNA, 22 nt, Salmonella enterica enterica serovar Typhi
uauuaucaaaucuucauuucau

SEQ ID NO: 1675100 - RNA, 20 nt, Salmonella enterica enterica serovar Typhi
uauuaugcguuuuuaucuuu

SEQ ID NO: 1675101 - RNA, 15 nt, Salmonella enterica enterica serovar Typhi
uauuaucugauucaa

SEQ ID NO: 1675102 - RNA, 20 nt, Salmonella enterica enterica serovar Typhi
uauuaucugauucaauuaau

SEQ ID NO: 1675103 - RNA, 16 nt, Salmonella enterica enterica serovar Typhi
uauuacugauaaaguu

SEQ ID NO: 1675104 - RNA, 16 nt, Salmonella enterica enterica serovar Typhi
uauuacuggaucauac

SEQ ID NO: 1675105 - RNA, 20 nt, Salmonella enterica enterica serovar Typhi
uauuagaauucccuauguaa

SEQ ID NO: 1675106 - RNA, 15 nt, Salmonella enterica enterica serovar Typhi
uauuagccaaagcgg

SEQ ID NO: 1675107 - RNA, 12 nt, Salmonella enterica enterica serovar Typhi
uauuauaaaaua

SEQ ID NO: 1675108 - RNA, 23 nt, Salmonella enterica enterica serovar Typhi
uauuuauuugguuucuagucgcc

SEQ ID NO: 1675109 - RNA, 14 nt, Salmonella enterica enterica serovar Typhi
uauuuauuuuuagu

SEQ ID NO: 1675110 - RNA, 15 nt, Salmonella enterica enterica serovar Typhi
uauuuaucaaaaaga

SEQ ID NO: 1675111 - RNA, 21 nt, Salmonella enterica enterica serovar Typhi
uauuucggcacugacucuucc

SEQ ID NO: 1675112 - RNA, 15 nt, Salmonella enterica enterica serovar Typhi
uauuuccucagaaag

SEQ ID NO: 1675113 - RNA, 18 nt, Salmonella enterica enterica serovar Typhi
uauuucucuugcagacag

SEQ ID NO: 1675114 - RNA, 15 nt, Salmonella enterica enterica serovar Typhi
uauuucugaaaaacc

SEQ ID NO: 1675115 - RNA, 17 nt, Salmonella enterica enterica serovar Typhi
uauuuccauuuuucaga

SEQ ID NO: 1675116 - RNA, 15 nt, Salmonella enterica enterica serovar Typhi
uauuuccagaaauca

SEQ ID NO: 1675117 - RNA, 17 nt, Salmonella enterica enterica serovar Typhi
uauuuccaccuucucuu

SEQ ID NO: 1675118 - RNA, 13 nt, Salmonella enterica enterica serovar Typhi
uauuucaguacag

SEQ ID NO: 1675119 - RNA, 13 nt, Salmonella enterica enterica serovar Typhi
uauuucagacuua

SEQ ID NO: 1675120 - RNA, 18 nt, Salmonella enterica enterica serovar Typhi
uauuucacguuucaucuc

SEQ ID NO: 1675121 - RNA, 13 nt, Salmonella enterica enterica serovar Typhi
uauuugugaccaa

SEQ ID NO: 1675122 - RNA, 17 nt, Salmonella enterica enterica serovar Typhi
uauuuguguauuuuuuu

SEQ ID NO: 1675123 - RNA, 14 nt, Salmonella enterica enterica serovar Typhi
uauuuguuccggca

SEQ ID NO: 1675124 - RNA, 15 nt, Salmonella enterica enterica serovar Typhi
uauuuguuccggcaa

SEQ ID NO: 1675125 - RNA, 16 nt, Salmonella enterica enterica serovar Typhi
uauuuuacuugccauu

SEQ ID NO: 1675126 - RNA, 19 nt, Salmonella enterica enterica serovar Typhi
uauuucugugagugcgcca

SEQ ID NO: 1675127 - RNA, 22 nt, Salmonella enterica enterica serovar Typhi
uauuucuuagcacccaccauca

SEQ ID NO: 1675128 - RNA, 19 nt, Salmonella enterica enterica serovar Typhi
uauuuagccguucaugcac

SEQ ID NO: 1675129 - RNA, 19 nt, Salmonella enterica enterica serovar Typhi
uauuuaccgcuggcgucug

SEQ ID NO: 1675130 - RNA, 18 nt, Salmonella enterica enterica serovar Typhi
uauuuaauaagcauauau

SEQ ID NO: 1675131 - RNA, 15 nt, Salmonella enterica enterica serovar Typhi
uauuuaauacaucag

SEQ ID NO: 1675132 - RNA, 13 nt, Salmonella enterica enterica serovar Typhi
uauugucaugcua

SEQ ID NO: 1675133 - RNA, 22 nt, Salmonella enterica enterica serovar Typhi
uauugucgcccugcaauucaua

SEQ ID NO: 1675134 - RNA, 20 nt, Salmonella enterica enterica serovar Typhi
uauugugaaccauggcaaca

SEQ ID NO: 1675135 - RNA, 14 nt, Salmonella enterica enterica serovar Typhi
uauugugagaaaag

SEQ ID NO: 1675136 - RNA, 13 nt, Salmonella enterica enterica serovar Typhi
uauugugucacca

SEQ ID NO: 1675137 - RNA, 17 nt, Salmonella enterica enterica serovar Typhi
uauuguuuagacagaca

SEQ ID NO: 1675138 - RNA, 13 nt, Salmonella enterica enterica serovar Typhi
uauuuaaaauucc

SEQ ID NO: 1675139 - RNA, 22 nt, Salmonella enterica enterica serovar Typhi
uauugcuucguggcaaucagca

SEQ ID NO: 1675140 - RNA, 19 nt, Salmonella enterica enterica serovar Typhi
uauugccuaagauggcgcc

SEQ ID NO: 1675141 - RNA, 22 nt, Salmonella enterica enterica serovar Typhi
uauugcauggcaauuaaauuag

SEQ ID NO: 1675142 - RNA, 20 nt, Salmonella enterica enterica serovar Typhi
uauugccacaauaucaucgu

SEQ ID NO: 1675143 - RNA, 16 nt, Salmonella enterica enterica serovar Typhi
uauugccauaaauaca

SEQ ID NO: 1675144 - RNA, 14 nt, Salmonella enterica enterica serovar Typhi
uauugauuuuuaaa

SEQ ID NO: 1675145 - RNA, 15 nt, Salmonella enterica enterica serovar Typhi
uauugauuuuuaaaa

SEQ ID NO: 1675146 - RNA, 12 nt, Salmonella enterica enterica serovar Typhi
uauugagauaau

SEQ ID NO: 1675147 - RNA, 22 nt, Salmonella enterica enterica serovar Typhi
ucaacuuccaccaccuccugcu

SEQ ID NO: 1675148 - RNA, 20 nt, Salmonella enterica enterica serovar Typhi
ucaacuuauccauuagcgcc

SEQ ID NO: 1675149 - RNA, 14 nt, Salmonella enterica enterica serovar Typhi
ucaagcaguuccag

SEQ ID NO: 1675150 - RNA, 14 nt, Salmonella enterica enterica serovar Typhi
ucaagcaacuguag

SEQ ID NO: 1675151 - RNA, 17 nt, Salmonella enterica enterica serovar Typhi
ucaagcaacuguagaau

SEQ ID NO: 1675152 - RNA, 21 nt, Salmonella enterica enterica serovar Typhi
ucaagccgggcggcugugucc

SEQ ID NO: 1675153 - RNA, 19 nt, Salmonella enterica enterica serovar Typhi
ucaagcauaucaaacugaa

SEQ ID NO: 1675154 - RNA, 16 nt, Salmonella enterica enterica serovar Typhi
ucaagaucgcgcagca

SEQ ID NO: 1675155 - RNA, 21 nt, Salmonella enterica enterica serovar Typhi
ucaagaucgcgcagcaggcca

SEQ ID NO: 1675156 - RNA, 19 nt, Salmonella enterica enterica serovar Typhi
ucaacgauagagugaaggc

SEQ ID NO: 1675157 - RNA, 21 nt, Salmonella enterica enterica serovar Typhi
ucaacgaggugaauaaauccu

SEQ ID NO: 1675158 - RNA, 20 nt, Salmonella enterica enterica serovar Typhi
ucaaccguuucuuuuucgau

SEQ ID NO: 1675159 - RNA, 15 nt, Salmonella enterica enterica serovar Typhi
ucaaccucuauaacu

SEQ ID NO: 1675160 - RNA, 14 nt, Salmonella enterica enterica serovar Typhi
ucaacguuuuucag

SEQ ID NO: 1675161 - RNA, 16 nt, Salmonella enterica enterica serovar Typhi
ucaacugucgaucggu

SEQ ID NO: 1675162 - RNA, 23 nt, Salmonella enterica enterica serovar Typhi
ucaacuguaccugauccagcucu

SEQ ID NO: 1675163 - RNA, 21 nt, Salmonella enterica enterica serovar Typhi
ucaacuggaugacugaauuau

SEQ ID NO: 1675164 - RNA, 21 nt, Salmonella enterica enterica serovar Typhi
ucaacuguaccugauccagcu

SEQ ID NO: 1675165 - RNA, 14 nt, Salmonella enterica enterica serovar Typhi
ucaacucuccuuuc

SEQ ID NO: 1675166 - RNA, 19 nt, Salmonella enterica enterica serovar Typhi
ucaacuccugcaucgauuc

SEQ ID NO: 1675167 - RNA, 21 nt, Salmonella enterica enterica serovar Typhi
ucaacuauuaaagcacaagaa

SEQ ID NO: 1675168 - RNA, 17 nt, Salmonella enterica enterica serovar Typhi
ucaaaugaucguuuuuu

SEQ ID NO: 1675169 - RNA, 22 nt, Salmonella enterica enterica serovar Typhi
ucaaaucuucauuucauugcgu

SEQ ID NO: 1675170 - RNA, 17 nt, Salmonella enterica enterica serovar Typhi
ucaaaugcgaaaaaaag

SEQ ID NO: 1675171 - RNA, 12 nt, Salmonella enterica enterica serovar Typhi
ucaaauauauug

SEQ ID NO: 1675172 - RNA, 23 nt, Salmonella enterica enterica serovar Typhi
ucaaauccagcucaguuuccagc

SEQ ID NO: 1675173 - RNA, 17 nt, Salmonella enterica enterica serovar Typhi
ucaaauuccagcaauga

SEQ ID NO: 1675174 - RNA, 21 nt, Salmonella enterica enterica serovar Typhi
ucaaauucacccguuauucau

SEQ ID NO: 1675175 - RNA, 19 nt, Salmonella enterica enterica serovar Typhi
ucaacaacuucaaaauagg

SEQ ID NO: 1675176 - RNA, 17 nt, Salmonella enterica enterica serovar Typhi
ucaacagcgcggcagac

SEQ ID NO: 1675177 - RNA, 19 nt, Salmonella enterica enterica serovar Typhi
ucaacaaucguuaauucau

SEQ ID NO: 1675178 - RNA, 12 nt, Salmonella enterica enterica serovar Typhi
ucaacaauuacg

SEQ ID NO: 1675179 - RNA, 16 nt, Salmonella enterica enterica serovar Typhi
ucaacacuuagaacgc

SEQ ID NO: 1675180 - RNA, 16 nt, Salmonella enterica enterica serovar Typhi
ucaacacgcagaccca

SEQ ID NO: 1675181 - RNA, 21 nt, Salmonella enterica enterica serovar Typhi
ucaaccagccgaucaucacga

SEQ ID NO: 1675182 - RNA, 20 nt, Salmonella enterica enterica serovar Typhi
ucaaccaccaccgauaaacg

SEQ ID NO: 1675183 - RNA, 20 nt, Salmonella enterica enterica serovar Typhi
ucaacccgaucgccauccug

SEQ ID NO: 1675184 - RNA, 19 nt, Salmonella enterica enterica serovar Typhi
ucaacccaguuuuuauccu

SEQ ID NO: 1675185 - RNA, 20 nt, Salmonella enterica enterica serovar Typhi
ucaaccaucaaaaaaaauag

SEQ ID NO: 1675186 - RNA, 13 nt, Salmonella enterica enterica serovar Typhi
ucaacaucauuaa

SEQ ID NO: 1675187 - RNA, 16 nt, Salmonella enterica enterica serovar Typhi
ucaacauacgccgcca

SEQ ID NO: 1675188 - RNA, 16 nt, Salmonella enterica enterica serovar Typhi
ucaacauacugauuuc

SEQ ID NO: 1675189 - RNA, 21 nt, Salmonella enterica enterica serovar Typhi
ucaacauauuuuucacacaua

SEQ ID NO: 1675190 - RNA, 21 nt, Salmonella enterica enterica serovar Typhi
ucaacaucagcgcuaccagcg

SEQ ID NO: 1675191 - RNA, 14 nt, Salmonella enterica enterica serovar Typhi
ucaacauuauuaaa

SEQ ID NO: 1675192 - RNA, 15 nt, Salmonella enterica enterica serovar Typhi
ucaacauuauuaaaa

SEQ ID NO: 1675193 - RNA, 17 nt, Salmonella enterica enterica serovar Typhi
ucaaauaccuuuucauu

SEQ ID NO: 1675194 - RNA, 19 nt, Salmonella enterica enterica serovar Typhi
ucaaaguugguucccagca

SEQ ID NO: 1675195 - RNA, 22 nt, Salmonella enterica enterica serovar Typhi
ucaaaggccugcaucaacaggc

SEQ ID NO: 1675196 - RNA, 17 nt, Salmonella enterica enterica serovar Typhi
ucaaaggccugcaucaa

SEQ ID NO: 1675197 - RNA, 20 nt, Salmonella enterica enterica serovar Typhi
ucaaagggcccguggaaaaa

SEQ ID NO: 1675198 - RNA, 13 nt, Salmonella enterica enterica serovar Typhi
ucaaagaccuccg

SEQ ID NO: 1675199 - RNA, 18 nt, Salmonella enterica enterica serovar Typhi
ucaaagcguaccgucugg

SEQ ID NO: 1675200 - RNA, 20 nt, Salmonella enterica enterica serovar Typhi
ucaaacuugcccagcgccuu

SEQ ID NO: 1675201 - RNA, 18 nt, Salmonella enterica enterica serovar Typhi
ucaaacuuuuaaauugaa

SEQ ID NO: 1675202 - RNA, 13 nt, Salmonella enterica enterica serovar Typhi
ucaaacuuuuaua

SEQ ID NO: 1675203 - RNA, 22 nt, Salmonella enterica enterica serovar Typhi
ucaaagaacagggggcgcauca

SEQ ID NO: 1675204 - RNA, 21 nt, Salmonella enterica enterica serovar Typhi
ucaaagaagcggaaaccccag

SEQ ID NO: 1675205 - RNA, 19 nt, Salmonella enterica enterica serovar Typhi
ucaaacucuuccgggcuga

SEQ ID NO: 1675206 - RNA, 23 nt, Salmonella enterica enterica serovar Typhi
ucaaacucgcugccgaccuggcu

SEQ ID NO: 1675207 - RNA, 22 nt, Salmonella enterica enterica serovar Typhi
ucaaacugacugaugcuggcgc

SEQ ID NO: 1675208 - RNA, 20 nt, Salmonella enterica enterica serovar Typhi
ucaaacccuuccagacagcu

SEQ ID NO: 1675209 - RNA, 12 nt, Salmonella enterica enterica serovar Typhi
ucaaacgcagca

SEQ ID NO: 1675210 - RNA, 19 nt, Salmonella enterica enterica serovar Typhi
ucaaacaggcgaaaacgua

SEQ ID NO: 1675211 - RNA, 21 nt, Salmonella enterica enterica serovar Typhi
ucaaacaggcugucugccaug

SEQ ID NO: 1675212 - RNA, 16 nt, Salmonella enterica enterica serovar Typhi
ucaaacaggcugucug

SEQ ID NO: 1675213 - RNA, 14 nt, Salmonella enterica enterica serovar Typhi
ucaaaccagcuuuu

SEQ ID NO: 1675214 - RNA, 20 nt, Salmonella enterica enterica serovar Typhi
ucaaacacaaauuucgagca

SEQ ID NO: 1675215 - RNA, 19 nt, Salmonella enterica enterica serovar Typhi
ucaaaauggaaaauaauaa

SEQ ID NO: 1675216 - RNA, 17 nt, Salmonella enterica enterica serovar Typhi
ucaaaauggaaaauaau

SEQ ID NO: 1675217 - RNA, 15 nt, Salmonella enterica enterica serovar Typhi
ucaaaaucgcgcccc

SEQ ID NO: 1675218 - RNA, 16 nt, Salmonella enterica enterica serovar Typhi
uauuuucaaaaacaag

SEQ ID NO: 1675219 - RNA, 23 nt, Salmonella enterica enterica serovar Typhi
uauuuuggcucccgaacgauaau

SEQ ID NO: 1675220 - RNA, 14 nt, Salmonella enterica enterica serovar Typhi
uauuuuuucugcua

SEQ ID NO: 1675221 - RNA, 18 nt, Salmonella enterica enterica serovar Typhi
uauuuuucagcuucuguc

SEQ ID NO: 1675222 - RNA, 12 nt, Salmonella enterica enterica serovar Typhi
uauuuuuaaaua

SEQ ID NO: 1675223 - RNA, 20 nt, Salmonella enterica enterica serovar Typhi
uauuuugguguaacagcaac

SEQ ID NO: 1675224 - RNA, 15 nt, Salmonella enterica enterica serovar Typhi
ucaaaacaggucugu

SEQ ID NO: 1675225 - RNA, 14 nt, Salmonella enterica enterica serovar Typhi
ucaaaacgacauaa

SEQ ID NO: 1675226 - RNA, 18 nt, Salmonella enterica enterica serovar Typhi
ucaaaagauugauuuauu

SEQ ID NO: 1675227 - RNA, 19 nt, Salmonella enterica enterica serovar Typhi
ucaaaacuacgccaaugaa

SEQ ID NO: 1675228 - RNA, 14 nt, Salmonella enterica enterica serovar Typhi
ucaaaauaaaauua

SEQ ID NO: 1675229 - RNA, 18 nt, Salmonella enterica enterica serovar Typhi
ucaaaauaacgcuucacc

SEQ ID NO: 1675230 - RNA, 17 nt, Salmonella enterica enterica serovar Typhi
ucaaaagugaucauggu

SEQ ID NO: 1675231 - RNA, 15 nt, Salmonella enterica enterica serovar Typhi
ucaaaaaaaaccaga

SEQ ID NO: 1675232 - RNA, 19 nt, Salmonella enterica enterica serovar Typhi
uauuuuuuuuguuuucgau

SEQ ID NO: 1675233 - RNA, 11 nt, Salmonella enterica enterica serovar Typhi
ucaaaaaagag

SEQ ID NO: 1675234 - RNA, 14 nt, Salmonella enterica enterica serovar Typhi
ucaaaaaauaucuc

SEQ ID NO: 1675235 - RNA, 14 nt, Salmonella enterica enterica serovar Typhi
ucaaaaaaucagca

SEQ ID NO: 1675236 - RNA, 19 nt, Salmonella enterica enterica serovar Typhi
ucaaaaauagcauuaagcu

SEQ ID NO: 1675237 - RNA, 18 nt, Salmonella enterica enterica serovar Typhi
ucaaaaaguugucuuccu

SEQ ID NO: 1675238 - RNA, 14 nt, Salmonella enterica enterica serovar Typhi
ucaaaaauaaaaac

SEQ ID NO: 1675239 - RNA, 19 nt, Salmonella enterica enterica serovar Typhi
guuucagcaccuccagcgc

SEQ ID NO: 1675240 - RNA, 17 nt, Salmonella enterica enterica serovar Typhi
guuucacguccugguua

SEQ ID NO: 1675241 - RNA, 16 nt, Salmonella enterica enterica serovar Typhi
guuucauggcuuuguu

SEQ ID NO: 1675242 - RNA, 20 nt, Salmonella enterica enterica serovar Typhi
guuuccacugagcuucaccg

SEQ ID NO: 1675243 - RNA, 14 nt, Salmonella enterica enterica serovar Typhi
guuucagugauaaa

SEQ ID NO: 1675244 - RNA, 17 nt, Salmonella enterica enterica serovar Typhi
guuucacgcucuucgcc

SEQ ID NO: 1675245 - RNA, 18 nt, Salmonella enterica enterica serovar Typhi
guuucacaucgccaguua

SEQ ID NO: 1675246 - RNA, 22 nt, Salmonella enterica enterica serovar Typhi
guuucaacuuccaccaccuccu

SEQ ID NO: 1675247 - RNA, 18 nt, Salmonella enterica enterica serovar Typhi
guuuauucaucuccucuu

SEQ ID NO: 1675248 - RNA, 20 nt, Salmonella enterica enterica serovar Typhi
guuuauugagauaauuuaug

SEQ ID NO: 1675249 - RNA, 15 nt, Salmonella enterica enterica serovar Typhi
guuuauucagaaaau

SEQ ID NO: 1675250 - RNA, 13 nt, Salmonella enterica enterica serovar Typhi
guuuauucaucuc

SEQ ID NO: 1675251 - RNA, 14 nt, Salmonella enterica enterica serovar Typhi
guuuagaaaauaua

SEQ ID NO: 1675252 - RNA, 15 nt, Salmonella enterica enterica serovar Typhi
guuguuaauuugauu

SEQ ID NO: 1675253 - RNA, 16 nt, Salmonella enterica enterica serovar Typhi
guugugguuaaacaca

SEQ ID NO: 1675254 - RNA, 22 nt, Salmonella enterica enterica serovar Typhi
guugugcagaaucauuaauaca

SEQ ID NO: 1675255 - RNA, 19 nt, Salmonella enterica enterica serovar Typhi
guuuaauaccgcguaaaaa

SEQ ID NO: 1675256 - RNA, 12 nt, Salmonella enterica enterica serovar Typhi
guuuaaucgccc

SEQ ID NO: 1675257 - RNA, 19 nt, Salmonella enterica enterica serovar Typhi
guuuaauucuuugagcauc

SEQ ID NO: 1675258 - RNA, 22 nt, Salmonella enterica enterica serovar Typhi
guucugcugauaauacugccgc

SEQ ID NO: 1675259 - RNA, 20 nt, Salmonella enterica enterica serovar Typhi
guucugcgucgcgcauggca

SEQ ID NO: 1675260 - RNA, 16 nt, Salmonella enterica enterica serovar Typhi
guugucgagguuauaa

SEQ ID NO: 1675261 - RNA, 15 nt, Salmonella enterica enterica serovar Typhi
guugucuuugcugcc

SEQ ID NO: 1675262 - RNA, 20 nt, Salmonella enterica enterica serovar Typhi
guugucuucaccuugcugcg

SEQ ID NO: 1675263 - RNA, 14 nt, Salmonella enterica enterica serovar Typhi
guugucuucaucua

SEQ ID NO: 1675264 - RNA, 19 nt, Salmonella enterica enterica serovar Typhi
guuguccggcgaccuuauu

SEQ ID NO: 1675265 - RNA, 18 nt, Salmonella enterica enterica serovar Typhi
guuugccagcaccagcag

SEQ ID NO: 1675266 - RNA, 21 nt, Salmonella enterica enterica serovar Typhi
guuugccgcauacaucgcaga

SEQ ID NO: 1675267 - RNA, 12 nt, Salmonella enterica enterica serovar Typhi
guuugcgcgucg

SEQ ID NO: 1675268 - RNA, 13 nt, Salmonella enterica enterica serovar Typhi
guuucuucaucaa

SEQ ID NO: 1675269 - RNA, 15 nt, Salmonella enterica enterica serovar Typhi
guuucuucgcuggcg

SEQ ID NO: 1675270 - RNA, 15 nt, Salmonella enterica enterica serovar Typhi
guuucuacaauagag

SEQ ID NO: 1675271 - RNA, 18 nt, Salmonella enterica enterica serovar Typhi
guuucuggcaacagccau

SEQ ID NO: 1675272 - RNA, 14 nt, Salmonella enterica enterica serovar Typhi
guuuguaaaaauag

SEQ ID NO: 1675273 - RNA, 14 nt, Salmonella enterica enterica serovar Typhi
guuuguaaaauaca

SEQ ID NO: 1675274 - RNA, 15 nt, Salmonella enterica enterica serovar Typhi
guuuggcaaucaaau

SEQ ID NO: 1675275 - RNA, 21 nt, Salmonella enterica enterica serovar Typhi
guuuggcaaucaaauccagcu

SEQ ID NO: 1675276 - RNA, 22 nt, Salmonella enterica enterica serovar Typhi
guuuggcaaucaaauccagcuc

SEQ ID NO: 1675277 - RNA, 15 nt, Salmonella enterica enterica serovar Typhi
guuuguuuaauuuug

SEQ ID NO: 1675278 - RNA, 13 nt, Salmonella enterica enterica serovar Typhi
guuuuaaaaauaa

SEQ ID NO: 1675279 - RNA, 13 nt, Salmonella enterica enterica serovar Typhi
guuugucucaggu

SEQ ID NO: 1675280 - RNA, 14 nt, Salmonella enterica enterica serovar Typhi
guuugucauccaga

SEQ ID NO: 1675281 - RNA, 15 nt, Salmonella enterica enterica serovar Typhi
guuuguaggccggau

SEQ ID NO: 1675282 - RNA, 12 nt, Salmonella enterica enterica serovar Typhi
guuuuccagcuc

SEQ ID NO: 1675283 - RNA, 20 nt, Salmonella enterica enterica serovar Typhi
guuuuauugcuucagccaga

SEQ ID NO: 1675284 - RNA, 22 nt, Salmonella enterica enterica serovar Typhi
guuuuccaggugcugccacauc

SEQ ID NO: 1675285 - RNA, 19 nt, Salmonella enterica enterica serovar Typhi
guuuucgucccagcgcacc

SEQ ID NO: 1675286 - RNA, 17 nt, Salmonella enterica enterica serovar Typhi
guuuuacgccgcuaaaa

SEQ ID NO: 1675287 - RNA, 13 nt, Salmonella enterica enterica serovar Typhi
guuuuaauuccug

SEQ ID NO: 1675288 - RNA, 11 nt, Salmonella enterica enterica serovar Typhi
guuuuaucaug

SEQ ID NO: 1675289 - RNA, 17 nt, Salmonella enterica enterica serovar Typhi
guuuuauccccuucagg

SEQ ID NO: 1675290 - RNA, 20 nt, Salmonella enterica enterica serovar Typhi
guuuuagcagaguaugcugc

SEQ ID NO: 1675291 - RNA, 16 nt, Salmonella enterica enterica serovar Typhi
uaaaacgacucaucag

SEQ ID NO: 1675292 - RNA, 12 nt, Salmonella enterica enterica serovar Typhi
uaaaaccuggca

SEQ ID NO: 1675293 - RNA, 23 nt, Salmonella enterica enterica serovar Typhi
uaaaaccguagauuuucaucaua

SEQ ID NO: 1675294 - RNA, 23 nt, Salmonella enterica enterica serovar Typhi
uaaaagaagaaaccgcagaaaaa

SEQ ID NO: 1675295 - RNA, 17 nt, Salmonella enterica enterica serovar Typhi
uaaaacuggcuaucgcc

SEQ ID NO: 1675296 - RNA, 20 nt, Salmonella enterica enterica serovar Typhi
uaaaaacaauaaauaacgug

SEQ ID NO: 1675297 - RNA, 15 nt, Salmonella enterica enterica serovar Typhi
uaaaaacaauaaaua

SEQ ID NO: 1675298 - RNA, 10 nt, Salmonella enterica enterica serovar Typhi
uaaaaaccag

SEQ ID NO: 1675299 - RNA, 17 nt, Salmonella enterica enterica serovar Typhi
uaaaaauauuucagcag

SEQ ID NO: 1675300 - RNA, 13 nt, Salmonella enterica enterica serovar Typhi
uaaaauaaacacu

SEQ ID NO: 1675301 - RNA, 23 nt, Salmonella enterica enterica serovar Typhi
uaaaauaaacacuaaaucauaau

SEQ ID NO: 1675302 - RNA, 21 nt, Salmonella enterica enterica serovar Typhi
uaaaauacgcucaauauacuu

SEQ ID NO: 1675303 - RNA, 18 nt, Salmonella enterica enterica serovar Typhi
uaaaauaccgccugccga

SEQ ID NO: 1675304 - RNA, 14 nt, Salmonella enterica enterica serovar Typhi
uaaaaucaacgcuc

SEQ ID NO: 1675305 - RNA, 23 nt, Salmonella enterica enterica serovar Typhi
uaaaaucacuaagaccagcauca

SEQ ID NO: 1675306 - RNA, 15 nt, Salmonella enterica enterica serovar Typhi
guuuuuuaauauaag

SEQ ID NO: 1675307 - RNA, 14 nt, Salmonella enterica enterica serovar Typhi
guuuuuucguucca

SEQ ID NO: 1675308 - RNA, 14 nt, Salmonella enterica enterica serovar Typhi
guuuuuuccagcgc

SEQ ID NO: 1675309 - RNA, 22 nt, Salmonella enterica enterica serovar Typhi
uaaaaaaaccucuaccuacaca

SEQ ID NO: 1675310 - RNA, 12 nt, Salmonella enterica enterica serovar Typhi
uaaaaaaauaaa

SEQ ID NO: 1675311 - RNA, 16 nt, Salmonella enterica enterica serovar Typhi
uaaaaaaauaaaaaag

SEQ ID NO: 1675312 - RNA, 19 nt, Salmonella enterica enterica serovar Typhi
uaaaaaaauaaaaaaggca

SEQ ID NO: 1675313 - RNA, 23 nt, Salmonella enterica enterica serovar Typhi
uaaaaaaggcagaagaaucugcc

SEQ ID NO: 1675314 - RNA, 18 nt, Salmonella enterica enterica serovar Typhi
uaaaaaagucacuuacuu

SEQ ID NO: 1675315 - RNA, 21 nt, Salmonella enterica enterica serovar Typhi
uaaaaaaggccgcuuaauaau

SEQ ID NO: 1675316 - RNA, 21 nt, Salmonella enterica enterica serovar Typhi
uaaaaaaggggagucgguacu

SEQ ID NO: 1675317 - RNA, 17 nt, Salmonella enterica enterica serovar Typhi
uaaaaaauccugcacuu

SEQ ID NO: 1675318 - RNA, 11 nt, Salmonella enterica enterica serovar Typhi
uaaaaaacagg

SEQ ID NO: 1675319 - RNA, 18 nt, Salmonella enterica enterica serovar Typhi
uaaaaaacaccugucugu

SEQ ID NO: 1675320 - RNA, 22 nt, Salmonella enterica enterica serovar Typhi
guuuugcaggaaaaacuguccc

SEQ ID NO: 1675321 - RNA, 18 nt, Salmonella enterica enterica serovar Typhi
guuuugcugauaugaaac

SEQ ID NO: 1675322 - RNA, 12 nt, Salmonella enterica enterica serovar Typhi
guuuugcucagu

SEQ ID NO: 1675323 - RNA, 14 nt, Salmonella enterica enterica serovar Typhi
guuuugcccauuuc

SEQ ID NO: 1675324 - RNA, 15 nt, Salmonella enterica enterica serovar Typhi
guuuugucaucagau

SEQ ID NO: 1675325 - RNA, 16 nt, Salmonella enterica enterica serovar Typhi
guuuucucauccagcu

SEQ ID NO: 1675326 - RNA, 14 nt, Salmonella enterica enterica serovar Typhi
guuuuucaucauca

SEQ ID NO: 1675327 - RNA, 19 nt, Salmonella enterica enterica serovar Typhi
guuuuuccccguugcucau

SEQ ID NO: 1675328 - RNA, 16 nt, Salmonella enterica enterica serovar Typhi
guuuuucccgcuggcu

SEQ ID NO: 1675329 - RNA, 19 nt, Salmonella enterica enterica serovar Typhi
guuuuuccgugaaugccaa

SEQ ID NO: 1675330 - RNA, 18 nt, Salmonella enterica enterica serovar Typhi
guuuuuccuuucugcgcc

SEQ ID NO: 1675331 - RNA, 16 nt, Salmonella enterica enterica serovar Typhi
guuuuucgaaaauuuc

SEQ ID NO: 1675332 - RNA, 17 nt, Salmonella enterica enterica serovar Typhi
guuuuucgaaaauuucg

SEQ ID NO: 1675333 - RNA, 13 nt, Salmonella enterica enterica serovar Typhi
guuuuugaaccau

SEQ ID NO: 1675334 - RNA, 14 nt, Salmonella enterica enterica serovar Typhi
guuuuucucaucaa

SEQ ID NO: 1675335 - RNA, 13 nt, Salmonella enterica enterica serovar Typhi
guuuuuauacauu

SEQ ID NO: 1675336 - RNA, 21 nt, Salmonella enterica enterica serovar Typhi
guuuuuagccuguuauucaau

SEQ ID NO: 1675337 - RNA, 15 nt, Salmonella enterica enterica serovar Typhi
guuuuuauuuuucuu

SEQ ID NO: 1675338 - RNA, 21 nt, Salmonella enterica enterica serovar Typhi
uaaccauacugacuuaauaac

SEQ ID NO: 1675339 - RNA, 21 nt, Salmonella enterica enterica serovar Typhi
uaaccagucguuaucugacau

SEQ ID NO: 1675340 - RNA, 22 nt, Salmonella enterica enterica serovar Typhi
uaacauuugccgggccaacaga

SEQ ID NO: 1675341 - RNA, 18 nt, Salmonella enterica enterica serovar Typhi
uaacauuuaagaaacaau

SEQ ID NO: 1675342 - RNA, 15 nt, Salmonella enterica enterica serovar Typhi
uaacauuucagucua

SEQ ID NO: 1675343 - RNA, 19 nt, Salmonella enterica enterica serovar Typhi
uaacagccgcggaccuuuu

SEQ ID NO: 1675344 - RNA, 16 nt, Salmonella enterica enterica serovar Typhi
uaacagcgcgaccagc

SEQ ID NO: 1675345 - RNA, 18 nt, Salmonella enterica enterica serovar Typhi
uaacaucuuccaugccuu

SEQ ID NO: 1675346 - RNA, 21 nt, Salmonella enterica enterica serovar Typhi
uaacagacgcaucuuuuuccc

SEQ ID NO: 1675347 - RNA, 19 nt, Salmonella enterica enterica serovar Typhi
uaacagagagggaaaaaaa

SEQ ID NO: 1675348 - RNA, 16 nt, Salmonella enterica enterica serovar Typhi
uaacgcuuauccggcc

SEQ ID NO: 1675349 - RNA, 14 nt, Salmonella enterica enterica serovar Typhi
uaacgcugcaaagu

SEQ ID NO: 1675350 - RNA, 21 nt, Salmonella enterica enterica serovar Typhi
uaacgcuguaccggcagguga

SEQ ID NO: 1675351 - RNA, 14 nt, Salmonella enterica enterica serovar Typhi
uaacgcuaugcuua

SEQ ID NO: 1675352 - RNA, 19 nt, Salmonella enterica enterica serovar Typhi
uaacgcagaagacagaagc

SEQ ID NO: 1675353 - RNA, 23 nt, Salmonella enterica enterica serovar Typhi
uaacgcaggcgauagccccagua

SEQ ID NO: 1675354 - RNA, 22 nt, Salmonella enterica enterica serovar Typhi
uaacgcacuaccagaaacaaca

SEQ ID NO: 1675355 - RNA, 15 nt, Salmonella enterica enterica serovar Typhi
uaacgcaacaacagu

SEQ ID NO: 1675356 - RNA, 18 nt, Salmonella enterica enterica serovar Typhi
uaacgcacuuuuccagcc

SEQ ID NO: 1675357 - RNA, 15 nt, Salmonella enterica enterica serovar Typhi
uaacgaugaugaaaa

SEQ ID NO: 1675358 - RNA, 20 nt, Salmonella enterica enterica serovar Typhi
uaacgauuuccccuguacac

SEQ ID NO: 1675359 - RNA, 20 nt, Salmonella enterica enterica serovar Typhi
uaacgauacccaccagcgug

SEQ ID NO: 1675360 - RNA, 12 nt, Salmonella enterica enterica serovar Typhi
uaacgauaaaau

SEQ ID NO: 1675361 - RNA, 20 nt, Salmonella enterica enterica serovar Typhi
uaacgaaccaucauuaauau

SEQ ID NO: 1675362 - RNA, 22 nt, Salmonella enterica enterica serovar Typhi
uaacgaaaagggucauaaccgg

SEQ ID NO: 1675363 - RNA, 15 nt, Salmonella enterica enterica serovar Typhi
uaaccguucuuccug

SEQ ID NO: 1675364 - RNA, 19 nt, Salmonella enterica enterica serovar Typhi
uaaccguaacgcuccugga

SEQ ID NO: 1675365 - RNA, 18 nt, Salmonella enterica enterica serovar Typhi
uaaccuauuuuacaaaau

SEQ ID NO: 1675366 - RNA, 14 nt, Salmonella enterica enterica serovar Typhi
uaaccuauuuugca

SEQ ID NO: 1675367 - RNA, 15 nt, Salmonella enterica enterica serovar Typhi
uaaccgcccgcggcg

SEQ ID NO: 1675368 - RNA, 23 nt, Salmonella enterica enterica serovar Typhi
uaaccgcuaaacagcaaaucggg

SEQ ID NO: 1675369 - RNA, 17 nt, Salmonella enterica enterica serovar Typhi
uaaccgcgaucgaugug

SEQ ID NO: 1675370 - RNA, 22 nt, Salmonella enterica enterica serovar Typhi
uaaccggacgauuuaagcuuaa

SEQ ID NO: 1675371 - RNA, 20 nt, Salmonella enterica enterica serovar Typhi
uaaauuuaacucguccuguu

SEQ ID NO: 1675372 - RNA, 15 nt, Salmonella enterica enterica serovar Typhi
uaaauugaguggaca

SEQ ID NO: 1675373 - RNA, 16 nt, Salmonella enterica enterica serovar Typhi
uaaauucugucucaau

SEQ ID NO: 1675374 - RNA, 13 nt, Salmonella enterica enterica serovar Typhi
uaaauucgcuacg

SEQ ID NO: 1675375 - RNA, 18 nt, Salmonella enterica enterica serovar Typhi
uaaauuccggcucgccuu

SEQ ID NO: 1675376 - RNA, 14 nt, Salmonella enterica enterica serovar Typhi
uaaauucauauuua

SEQ ID NO: 1675377 - RNA, 14 nt, Salmonella enterica enterica serovar Typhi
uaaauuaacaccca

SEQ ID NO: 1675378 - RNA, 20 nt, Salmonella enterica enterica serovar Typhi
uaaauuaaugauuaaaauaa

SEQ ID NO: 1675379 - RNA, 14 nt, Salmonella enterica enterica serovar Typhi
uaaauuacuuauga

SEQ ID NO: 1675380 - RNA, 14 nt, Salmonella enterica enterica serovar Typhi
uaacaaugccucga

SEQ ID NO: 1675381 - RNA, 20 nt, Salmonella enterica enterica serovar Typhi
uaacaaauuaaauccugaaa

SEQ ID NO: 1675382 - RNA, 11 nt, Salmonella enterica enterica serovar Typhi
uaacaaaucau

SEQ ID NO: 1675383 - RNA, 17 nt, Salmonella enterica enterica serovar Typhi
uaacaaaucacaaggaa

SEQ ID NO: 1675384 - RNA, 23 nt, Salmonella enterica enterica serovar Typhi
uaacaaaccgguaaucccuucac

SEQ ID NO: 1675385 - RNA, 20 nt, Salmonella enterica enterica serovar Typhi
uaacaaaccgguaaucccuu

SEQ ID NO: 1675386 - RNA, 17 nt, Salmonella enterica enterica serovar Typhi
uaacacacuuucugcuu

SEQ ID NO: 1675387 - RNA, 17 nt, Salmonella enterica enterica serovar Typhi
uaacacaaucaggcgca

SEQ ID NO: 1675388 - RNA, 12 nt, Salmonella enterica enterica serovar Typhi
uaacacaugcaa

SEQ ID NO: 1675389 - RNA, 17 nt, Salmonella enterica enterica serovar Typhi
uaaauuuccgcagccag

SEQ ID NO: 1675390 - RNA, 22 nt, Salmonella enterica enterica serovar Typhi
uaaauuucaacccgaucgccau

SEQ ID NO: 1675391 - RNA, 17 nt, Salmonella enterica enterica serovar Typhi
uaaauuuauuuuuugcu

SEQ ID NO: 1675392 - RNA, 22 nt, Salmonella enterica enterica serovar Typhi
uaaauuuaugguuccugaaaua

SEQ ID NO: 1675393 - RNA, 12 nt, Salmonella enterica enterica serovar Typhi
uaaaccucuuug

SEQ ID NO: 1675394 - RNA, 19 nt, Salmonella enterica enterica serovar Typhi
uaaacgaucgguuaucacg

SEQ ID NO: 1675395 - RNA, 20 nt, Salmonella enterica enterica serovar Typhi
uaaaccuguuuguuuauugu

SEQ ID NO: 1675396 - RNA, 13 nt, Salmonella enterica enterica serovar Typhi
uaaacguuccugc

SEQ ID NO: 1675397 - RNA, 15 nt, Salmonella enterica enterica serovar Typhi
uaaacgugccacagu

SEQ ID NO: 1675398 - RNA, 12 nt, Salmonella enterica enterica serovar Typhi
uaaacgucccug

SEQ ID NO: 1675399 - RNA, 15 nt, Salmonella enterica enterica serovar Typhi
uaaaccaaagcagag

SEQ ID NO: 1675400 - RNA, 23 nt, Salmonella enterica enterica serovar Typhi
uaaaccgcugccacacucucucc

SEQ ID NO: 1675401 - RNA, 15 nt, Salmonella enterica enterica serovar Typhi
uaaaccguuuuuccg

SEQ ID NO: 1675402 - RNA, 21 nt, Salmonella enterica enterica serovar Typhi
uaaaccggucucuuaaugcca

SEQ ID NO: 1675403 - RNA, 21 nt, Salmonella enterica enterica serovar Typhi
uaaagccauccaucuccggca

SEQ ID NO: 1675404 - RNA, 14 nt, Salmonella enterica enterica serovar Typhi
uaaagcaucagacu

SEQ ID NO: 1675405 - RNA, 15 nt, Salmonella enterica enterica serovar Typhi
uaaagcccuguuauu

SEQ ID NO: 1675406 - RNA, 19 nt, Salmonella enterica enterica serovar Typhi
uaaagcccgguucaccguu

SEQ ID NO: 1675407 - RNA, 19 nt, Salmonella enterica enterica serovar Typhi
uaaagcagugcaguauugc

SEQ ID NO: 1675408 - RNA, 22 nt, Salmonella enterica enterica serovar Typhi
uaaaggucaaacaccugaacca

SEQ ID NO: 1675409 - RNA, 19 nt, Salmonella enterica enterica serovar Typhi
uaaagcgcucguuauaauu

SEQ ID NO: 1675410 - RNA, 13 nt, Salmonella enterica enterica serovar Typhi
uaaagccuucaug

SEQ ID NO: 1675411 - RNA, 15 nt, Salmonella enterica enterica serovar Typhi
uaaagccuucaugcu

SEQ ID NO: 1675412 - RNA, 20 nt, Salmonella enterica enterica serovar Typhi
uaaagccucucguaagagag

SEQ ID NO: 1675413 - RNA, 21 nt, Salmonella enterica enterica serovar Typhi
uaaacuucacgucgcucacau

SEQ ID NO: 1675414 - RNA, 18 nt, Salmonella enterica enterica serovar Typhi
uaaagacgguaaucagac

SEQ ID NO: 1675415 - RNA, 23 nt, Salmonella enterica enterica serovar Typhi
uaaaggucggcugcccugcggua

SEQ ID NO: 1675416 - RNA, 17 nt, Salmonella enterica enterica serovar Typhi
uaaaguuuuucauaucc

SEQ ID NO: 1675417 - RNA, 12 nt, Salmonella enterica enterica serovar Typhi
uaaauaaacagc

SEQ ID NO: 1675418 - RNA, 17 nt, Salmonella enterica enterica serovar Typhi
uaaauagcaauuauauu

SEQ ID NO: 1675419 - RNA, 14 nt, Salmonella enterica enterica serovar Typhi
uaaauagcaauuau

SEQ ID NO: 1675420 - RNA, 18 nt, Salmonella enterica enterica serovar Typhi
uaaauagacuguugaaag

SEQ ID NO: 1675421 - RNA, 16 nt, Salmonella enterica enterica serovar Typhi
uaaauagagaaaucaa

SEQ ID NO: 1675422 - RNA, 14 nt, Salmonella enterica enterica serovar Typhi
uaaauagaaaauaa

SEQ ID NO: 1675423 - RNA, 15 nt, Salmonella enterica enterica serovar Typhi
uaaauagaaaauaau

SEQ ID NO: 1675424 - RNA, 16 nt, Salmonella enterica enterica serovar Typhi
uaaauaacaaaugaag

SEQ ID NO: 1675425 - RNA, 22 nt, Salmonella enterica enterica serovar Typhi
uaaauaaauaguaaauagaaaa

SEQ ID NO: 1675426 - RNA, 19 nt, Salmonella enterica enterica serovar Typhi
uaaauacaauucaacucac

SEQ ID NO: 1675427 - RNA, 13 nt, Salmonella enterica enterica serovar Typhi
uaaauaauuuugu

SEQ ID NO: 1675428 - RNA, 17 nt, Salmonella enterica enterica serovar Typhi
uaaaugcuugcuuuagc

SEQ ID NO: 1675429 - RNA, 20 nt, Salmonella enterica enterica serovar Typhi
uaaaugaauuauuuuuucau

SEQ ID NO: 1675430 - RNA, 14 nt, Salmonella enterica enterica serovar Typhi
uaaaugaacuuaca

SEQ ID NO: 1675431 - RNA, 20 nt, Salmonella enterica enterica serovar Typhi
uaaaucaauagauuauucgu

SEQ ID NO: 1675432 - RNA, 22 nt, Salmonella enterica enterica serovar Typhi
uaaaucugccgucaucgacuuc

SEQ ID NO: 1675433 - RNA, 14 nt, Salmonella enterica enterica serovar Typhi
uaaaucugccguca

SEQ ID NO: 1675434 - RNA, 19 nt, Salmonella enterica enterica serovar Typhi
gucugccaugccuuugacu

SEQ ID NO: 1675435 - RNA, 18 nt, Salmonella enterica enterica serovar Typhi
gucugcgcccaccgggag

SEQ ID NO: 1675436 - RNA, 20 nt, Salmonella enterica enterica serovar Typhi
gucugcccggcaaccugagc

SEQ ID NO: 1675437 - RNA, 14 nt, Salmonella enterica enterica serovar Typhi
gucugcgcgcuggu

SEQ ID NO: 1675438 - RNA, 16 nt, Salmonella enterica enterica serovar Typhi
gucugcgcgcuggugu

SEQ ID NO: 1675439 - RNA, 22 nt, Salmonella enterica enterica serovar Typhi
gucugaaggcguaugaaugaaa

SEQ ID NO: 1675440 - RNA, 16 nt, Salmonella enterica enterica serovar Typhi
gucugcaaaauuugug

SEQ ID NO: 1675441 - RNA, 14 nt, Salmonella enterica enterica serovar Typhi
gucucuucuuccgc

SEQ ID NO: 1675442 - RNA, 20 nt, Salmonella enterica enterica serovar Typhi
gucucuucaugcauaaccgc

SEQ ID NO: 1675443 - RNA, 18 nt, Salmonella enterica enterica serovar Typhi
gucugaagaaguucuucu

SEQ ID NO: 1675444 - RNA, 23 nt, Salmonella enterica enterica serovar Typhi
gucucuuuagaaaaagaaaccuc

SEQ ID NO: 1675445 - RNA, 15 nt, Salmonella enterica enterica serovar Typhi
gucuccucaugccuc

SEQ ID NO: 1675446 - RNA, 19 nt, Salmonella enterica enterica serovar Typhi
gucuccugaacuuuuugca

SEQ ID NO: 1675447 - RNA, 13 nt, Salmonella enterica enterica serovar Typhi
gucugguggucua

SEQ ID NO: 1675448 - RNA, 19 nt, Salmonella enterica enterica serovar Typhi
gucugguacggccaccagg

SEQ ID NO: 1675449 - RNA, 18 nt, Salmonella enterica enterica serovar Typhi
gucuggguuugcagcaga

SEQ ID NO: 1675450 - RNA, 13 nt, Salmonella enterica enterica serovar Typhi
gucugcuggccaa

SEQ ID NO: 1675451 - RNA, 13 nt, Salmonella enterica enterica serovar Typhi
gucuggauauaaa

SEQ ID NO: 1675452 - RNA, 16 nt, Salmonella enterica enterica serovar Typhi
gucuggcgcuaaaauc

SEQ ID NO: 1675453 - RNA, 23 nt, Salmonella enterica enterica serovar Typhi
gucuucacucugggauuugcgaa

SEQ ID NO: 1675454 - RNA, 21 nt, Salmonella enterica enterica serovar Typhi
gucuucaacguuccuucagga

SEQ ID NO: 1675455 - RNA, 16 nt, Salmonella enterica enterica serovar Typhi
gucuucacucaccaca

SEQ ID NO: 1675456 - RNA, 18 nt, Salmonella enterica enterica serovar Typhi
gucuucaggucauucagg

SEQ ID NO: 1675457 - RNA, 18 nt, Salmonella enterica enterica serovar Typhi
gucuucaucagccagcau

SEQ ID NO: 1675458 - RNA, 11 nt, Salmonella enterica enterica serovar Typhi
gucuuccagca

SEQ ID NO: 1675459 - RNA, 21 nt, Salmonella enterica enterica serovar Typhi
gucuuccagcauucuauuguu

SEQ ID NO: 1675460 - RNA, 21 nt, Salmonella enterica enterica serovar Typhi
gucuguuucaacgcauccagc

SEQ ID NO: 1675461 - RNA, 17 nt, Salmonella enterica enterica serovar Typhi
gucuuaaaugccgccgg

SEQ ID NO: 1675462 - RNA, 18 nt, Salmonella enterica enterica serovar Typhi
gucuuaaccuuuuguauc

SEQ ID NO: 1675463 - RNA, 17 nt, Salmonella enterica enterica serovar Typhi
gucuuaaagaaaaagaa

SEQ ID NO: 1675464 - RNA, 13 nt, Salmonella enterica enterica serovar Typhi
gucuuaaauauga

SEQ ID NO: 1675465 - RNA, 12 nt, Salmonella enterica enterica serovar Typhi
gucuugccuguc

SEQ ID NO: 1675466 - RNA, 14 nt, Salmonella enterica enterica serovar Typhi
gucuugucaggcuc

SEQ ID NO: 1675467 - RNA, 21 nt, Salmonella enterica enterica serovar Typhi
gucuugguauggauggcuggg

SEQ ID NO: 1675468 - RNA, 23 nt, Salmonella enterica enterica serovar Typhi
gucuugauuucaggugcuuaucu

SEQ ID NO: 1675469 - RNA, 18 nt, Salmonella enterica enterica serovar Typhi
gucuucuuaguaacauaa

SEQ ID NO: 1675470 - RNA, 21 nt, Salmonella enterica enterica serovar Typhi
gucuucgcacugcccuucccg

SEQ ID NO: 1675471 - RNA, 13 nt, Salmonella enterica enterica serovar Typhi
gucuuccugcggu

SEQ ID NO: 1675472 - RNA, 16 nt, Salmonella enterica enterica serovar Typhi
gucuucgaccgccaua

SEQ ID NO: 1675473 - RNA, 21 nt, Salmonella enterica enterica serovar Typhi
gucuuuugaauaguaacuggc

SEQ ID NO: 1675474 - RNA, 13 nt, Salmonella enterica enterica serovar Typhi
gucuuuuucucaa

SEQ ID NO: 1675475 - RNA, 23 nt, Salmonella enterica enterica serovar Typhi
gugaaaaagcggcuguagccagc

SEQ ID NO: 1675476 - RNA, 21 nt, Salmonella enterica enterica serovar Typhi
gugaaaaacgggagauuguua

SEQ ID NO: 1675477 - RNA, 14 nt, Salmonella enterica enterica serovar Typhi
gucuuuuucaucuu

SEQ ID NO: 1675478 - RNA, 22 nt, Salmonella enterica enterica serovar Typhi
gugaaaaaauaucgcugcccag

SEQ ID NO: 1675479 - RNA, 19 nt, Salmonella enterica enterica serovar Typhi
gugaaacagguuuaaacga

SEQ ID NO: 1675480 - RNA, 17 nt, Salmonella enterica enterica serovar Typhi
gugaaaccggcgcgccu

SEQ ID NO: 1675481 - RNA, 14 nt, Salmonella enterica enterica serovar Typhi
gugaaacuguuuua

SEQ ID NO: 1675482 - RNA, 22 nt, Salmonella enterica enterica serovar Typhi
gucuuugcguuuacuuacaaau

SEQ ID NO: 1675483 - RNA, 16 nt, Salmonella enterica enterica serovar Typhi
gucuuuguugccuucg

SEQ ID NO: 1675484 - RNA, 18 nt, Salmonella enterica enterica serovar Typhi
gucuuuguugguauucau

SEQ ID NO: 1675485 - RNA, 15 nt, Salmonella enterica enterica serovar Typhi
gugaaccauggcaac

SEQ ID NO: 1675486 - RNA, 19 nt, Salmonella enterica enterica serovar Typhi
gugaacauuacaauguaca

SEQ ID NO: 1675487 - RNA, 17 nt, Salmonella enterica enterica serovar Typhi
gugaacgguugagcuuu

SEQ ID NO: 1675488 - RNA, 12 nt, Salmonella enterica enterica serovar Typhi
gugaagaaaaag

SEQ ID NO: 1675489 - RNA, 19 nt, Salmonella enterica enterica serovar Typhi
gugaagaaucuguauaaaa

SEQ ID NO: 1675490 - RNA, 15 nt, Salmonella enterica enterica serovar Typhi
gugaagauuagcaga

SEQ ID NO: 1675491 - RNA, 16 nt, Salmonella enterica enterica serovar Typhi
gugaagacgacgggaa

SEQ ID NO: 1675492 - RNA, 21 nt, Salmonella enterica enterica serovar Typhi
gugaaauuauuccuuaucaca

SEQ ID NO: 1675493 - RNA, 11 nt, Salmonella enterica enterica serovar Typhi
gugaaauaaau

SEQ ID NO: 1675494 - RNA, 14 nt, Salmonella enterica enterica serovar Typhi
gugaauauggaaag

SEQ ID NO: 1675495 - RNA, 17 nt, Salmonella enterica enterica serovar Typhi
gugaaugcacuguuucu

SEQ ID NO: 1675496 - RNA, 20 nt, Salmonella enterica enterica serovar Typhi
gugaauuaugaccaauguua

SEQ ID NO: 1675497 - RNA, 14 nt, Salmonella enterica enterica serovar Typhi
gugaauguccugcg

SEQ ID NO: 1675498 - RNA, 16 nt, Salmonella enterica enterica serovar Typhi
gugacaaucuccuccg

SEQ ID NO: 1675499 - RNA, 16 nt, Salmonella enterica enterica serovar Typhi
gugaauaccagcggca

SEQ ID NO: 1675500 - RNA, 18 nt, Salmonella enterica enterica serovar Typhi
gugaauagguauguagua

SEQ ID NO: 1675501 - RNA, 17 nt, Salmonella enterica enterica serovar Typhi
gugaauagguauguagu

SEQ ID NO: 1675502 - RNA, 13 nt, Salmonella enterica enterica serovar Typhi
gugaauauucaga

SEQ ID NO: 1675503 - RNA, 18 nt, Salmonella enterica enterica serovar Typhi
gugaaggccaaguuuaga

SEQ ID NO: 1675504 - RNA, 17 nt, Salmonella enterica enterica serovar Typhi
gugaaggcaaaacacca

SEQ ID NO: 1675505 - RNA, 21 nt, Salmonella enterica enterica serovar Typhi
gugaggcagauaugcgggcuc

SEQ ID NO: 1675506 - RNA, 16 nt, Salmonella enterica enterica serovar Typhi
gugaguaaagagauca

SEQ ID NO: 1675507 - RNA, 21 nt, Salmonella enterica enterica serovar Typhi
gugaguccccaggagcauaga

SEQ ID NO: 1675508 - RNA, 15 nt, Salmonella enterica enterica serovar Typhi
gugagcucauccagc

SEQ ID NO: 1675509 - RNA, 14 nt, Salmonella enterica enterica serovar Typhi
gugagcucuuucug

SEQ ID NO: 1675510 - RNA, 15 nt, Salmonella enterica enterica serovar Typhi
gugagccuaaaacau

SEQ ID NO: 1675511 - RNA, 14 nt, Salmonella enterica enterica serovar Typhi
gugauagcgcgcca

SEQ ID NO: 1675512 - RNA, 12 nt, Salmonella enterica enterica serovar Typhi
gugauauagcaa

SEQ ID NO: 1675513 - RNA, 18 nt, Salmonella enterica enterica serovar Typhi
gugauaaauacgcugcgg

SEQ ID NO: 1675514 - RNA, 22 nt, Salmonella enterica enterica serovar Typhi
gugauaaauacgcugcggccug

SEQ ID NO: 1675515 - RNA, 12 nt, Salmonella enterica enterica serovar Typhi
gugauaauagug

SEQ ID NO: 1675516 - RNA, 19 nt, Salmonella enterica enterica serovar Typhi
gugauccaccaccagcauc

SEQ ID NO: 1675517 - RNA, 21 nt, Salmonella enterica enterica serovar Typhi
gugagacgcagccucucuucu

SEQ ID NO: 1675518 - RNA, 13 nt, Salmonella enterica enterica serovar Typhi
gugacuaaaagac

SEQ ID NO: 1675519 - RNA, 19 nt, Salmonella enterica enterica serovar Typhi
gugacgccgccauccggua

SEQ ID NO: 1675520 - RNA, 13 nt, Salmonella enterica enterica serovar Typhi
gugacgccaggca

SEQ ID NO: 1675521 - RNA, 20 nt, Salmonella enterica enterica serovar Typhi
gugacgccaugcaaaaaaga

SEQ ID NO: 1675522 - RNA, 16 nt, Salmonella enterica enterica serovar Typhi
gugacgcaggccgggu

SEQ ID NO: 1675523 - RNA, 19 nt, Salmonella enterica enterica serovar Typhi
gugacggaggucauuccug

SEQ ID NO: 1675524 - RNA, 21 nt, Salmonella enterica enterica serovar Typhi
gugacggcaaaguuccagguu

SEQ ID NO: 1675525 - RNA, 22 nt, Salmonella enterica enterica serovar Typhi
gugacggcggaaauuagcccgc

SEQ ID NO: 1675526 - RNA, 14 nt, Salmonella enterica enterica serovar Typhi
gugaccgauaaaaa

SEQ ID NO: 1675527 - RNA, 17 nt, Salmonella enterica enterica serovar Typhi
gugaccgccuuaaaauu

SEQ ID NO: 1675528 - RNA, 13 nt, Salmonella enterica enterica serovar Typhi
gugccugcuccgc

SEQ ID NO: 1675529 - RNA, 18 nt, Salmonella enterica enterica serovar Typhi
gugccugcuccgccaggg

SEQ ID NO: 1675530 - RNA, 14 nt, Salmonella enterica enterica serovar Typhi
gugccuggauaaau

SEQ ID NO: 1675531 - RNA, 15 nt, Salmonella enterica enterica serovar Typhi
gugccugacagcaau

SEQ ID NO: 1675532 - RNA, 16 nt, Salmonella enterica enterica serovar Typhi
gugccguguaaggcaa

SEQ ID NO: 1675533 - RNA, 23 nt, Salmonella enterica enterica serovar Typhi
gugccgugagcgcguaggccaga

SEQ ID NO: 1675534 - RNA, 12 nt, Salmonella enterica enterica serovar Typhi
gugcccagagcg

SEQ ID NO: 1675535 - RNA, 15 nt, Salmonella enterica enterica serovar Typhi
gugccgacgccagcc

SEQ ID NO: 1675536 - RNA, 20 nt, Salmonella enterica enterica serovar Typhi
gugccgacgccagccauuaa

SEQ ID NO: 1675537 - RNA, 13 nt, Salmonella enterica enterica serovar Typhi
gugccaugaguaa

SEQ ID NO: 1675538 - RNA, 22 nt, Salmonella enterica enterica serovar Typhi
gugcauguaaauaaggcugcgc

SEQ ID NO: 1675539 - RNA, 11 nt, Salmonella enterica enterica serovar Typhi
gugcauggugu

SEQ ID NO: 1675540 - RNA, 19 nt, Salmonella enterica enterica serovar Typhi
gugccaguaacucaucgcc

SEQ ID NO: 1675541 - RNA, 19 nt, Salmonella enterica enterica serovar Typhi
gugccggaaagacggcagc

SEQ ID NO: 1675542 - RNA, 13 nt, Salmonella enterica enterica serovar Typhi
gugcaggccggau

SEQ ID NO: 1675543 - RNA, 15 nt, Salmonella enterica enterica serovar Typhi
gugcaggagcaguga

SEQ ID NO: 1675544 - RNA, 14 nt, Salmonella enterica enterica serovar Typhi
gugcagaacaucaa

SEQ ID NO: 1675545 - RNA, 17 nt, Salmonella enterica enterica serovar Typhi
gugcagcguuuccagcc

SEQ ID NO: 1675546 - RNA, 20 nt, Salmonella enterica enterica serovar Typhi
gugcauccccugaaacaggu

SEQ ID NO: 1675547 - RNA, 20 nt, Salmonella enterica enterica serovar Typhi
gugcauccggacgccagugc

SEQ ID NO: 1675548 - RNA, 17 nt, Salmonella enterica enterica serovar Typhi
gugcagugacagaggaa

SEQ ID NO: 1675549 - RNA, 18 nt, Salmonella enterica enterica serovar Typhi
gugcaaacgauaaaagcu

SEQ ID NO: 1675550 - RNA, 21 nt, Salmonella enterica enterica serovar Typhi
gugcaaacgauaaaagcucug

SEQ ID NO: 1675551 - RNA, 17 nt, Salmonella enterica enterica serovar Typhi
gugcaccguaucggcag

SEQ ID NO: 1675552 - RNA, 20 nt, Salmonella enterica enterica serovar Typhi
gugauuuuugacccgcagca

SEQ ID NO: 1675553 - RNA, 15 nt, Salmonella enterica enterica serovar Typhi
gugaucugguuuggu

SEQ ID NO: 1675554 - RNA, 11 nt, Salmonella enterica enterica serovar Typhi
gugcagaacau

SEQ ID NO: 1675555 - RNA, 14 nt, Salmonella enterica enterica serovar Typhi
guucaagucucgcc

SEQ ID NO: 1675556 - RNA, 18 nt, Salmonella enterica enterica serovar Typhi
guucaauagagcgcagca

SEQ ID NO: 1675557 - RNA, 23 nt, Salmonella enterica enterica serovar Typhi
guucaauacccuuuucuuuaaac

SEQ ID NO: 1675558 - RNA, 15 nt, Salmonella enterica enterica serovar Typhi
guucacagauugcug

SEQ ID NO: 1675559 - RNA, 17 nt, Salmonella enterica enterica serovar Typhi
guuauuuucaaaaacaa

SEQ ID NO: 1675560 - RNA, 19 nt, Salmonella enterica enterica serovar Typhi
guuauuuucaaaaacaagg

SEQ ID NO: 1675561 - RNA, 20 nt, Salmonella enterica enterica serovar Typhi
guucaaaacgcuaacgcguu

SEQ ID NO: 1675562 - RNA, 16 nt, Salmonella enterica enterica serovar Typhi
guucaaaucgaugcca

SEQ ID NO: 1675563 - RNA, 19 nt, Salmonella enterica enterica serovar Typhi
guucaaauucuucccggcg

SEQ ID NO: 1675564 - RNA, 20 nt, Salmonella enterica enterica serovar Typhi
guucaaccugcgcugacggc

SEQ ID NO: 1675565 - RNA, 16 nt, Salmonella enterica enterica serovar Typhi
guuaugcauugcugau

SEQ ID NO: 1675566 - RNA, 20 nt, Salmonella enterica enterica serovar Typhi
guuaugccgacaguuuuacc

SEQ ID NO: 1675567 - RNA, 17 nt, Salmonella enterica enterica serovar Typhi
guuaucguagugccaca

SEQ ID NO: 1675568 - RNA, 14 nt, Salmonella enterica enterica serovar Typhi
guuaucucgccagg

SEQ ID NO: 1675569 - RNA, 20 nt, Salmonella enterica enterica serovar Typhi
guuaucugacauauacaaac

SEQ ID NO: 1675570 - RNA, 14 nt, Salmonella enterica enterica serovar Typhi
guuaucucuauuga

SEQ ID NO: 1675571 - RNA, 14 nt, Salmonella enterica enterica serovar Typhi
guuauucgcuggcc

SEQ ID NO: 1675572 - RNA, 15 nt, Salmonella enterica enterica serovar Typhi
guuauuaaguuuuac

SEQ ID NO: 1675573 - RNA, 14 nt, Salmonella enterica enterica serovar Typhi
guuaucccugcuga

SEQ ID NO: 1675574 - RNA, 19 nt, Salmonella enterica enterica serovar Typhi
guuauccgccggagggcga

SEQ ID NO: 1675575 - RNA, 17 nt, Salmonella enterica enterica serovar Typhi
guuaucaaaaaaaacca

SEQ ID NO: 1675576 - RNA, 11 nt, Salmonella enterica enterica serovar Typhi
guuauaugaau

SEQ ID NO: 1675577 - RNA, 14 nt, Salmonella enterica enterica serovar Typhi
guuauaugaauaaa

SEQ ID NO: 1675578 - RNA, 21 nt, Salmonella enterica enterica serovar Typhi
guuauaaauccccgccgccau

SEQ ID NO: 1675579 - RNA, 21 nt, Salmonella enterica enterica serovar Typhi
guuauagacgccggucaugcc

SEQ ID NO: 1675580 - RNA, 14 nt, Salmonella enterica enterica serovar Typhi
guuauacagugcca

SEQ ID NO: 1675581 - RNA, 19 nt, Salmonella enterica enterica serovar Typhi
guuaccccaucauugacuu

SEQ ID NO: 1675582 - RNA, 13 nt, Salmonella enterica enterica serovar Typhi
guuaccagcauca

SEQ ID NO: 1675583 - RNA, 20 nt, Salmonella enterica enterica serovar Typhi
guuaccauccauuaaaaucu

SEQ ID NO: 1675584 - RNA, 14 nt, Salmonella enterica enterica serovar Typhi
guuaccgccgagca

SEQ ID NO: 1675585 - RNA, 16 nt, Salmonella enterica enterica serovar Typhi
guuagcauuauuuuua

SEQ ID NO: 1675586 - RNA, 14 nt, Salmonella enterica enterica serovar Typhi
guuacccgccaguc

SEQ ID NO: 1675587 - RNA, 12 nt, Salmonella enterica enterica serovar Typhi
guuagccccuua

SEQ ID NO: 1675588 - RNA, 20 nt, Salmonella enterica enterica serovar Typhi
guuccgccaggcgagcacac

SEQ ID NO: 1675589 - RNA, 23 nt, Salmonella enterica enterica serovar Typhi
guuccgcgacaaugauuugcaac

SEQ ID NO: 1675590 - RNA, 17 nt, Salmonella enterica enterica serovar Typhi
guuccgcgauuuccugu

SEQ ID NO: 1675591 - RNA, 16 nt, Salmonella enterica enterica serovar Typhi
guuccgccagauacaa

SEQ ID NO: 1675592 - RNA, 16 nt, Salmonella enterica enterica serovar Typhi
guuccagccgccaggc

SEQ ID NO: 1675593 - RNA, 12 nt, Salmonella enterica enterica serovar Typhi
guuccagcagcu

SEQ ID NO: 1675594 - RNA, 21 nt, Salmonella enterica enterica serovar Typhi
guuccagcagcucaucaauaa

SEQ ID NO: 1675595 - RNA, 13 nt, Salmonella enterica enterica serovar Typhi
guuccaggcgcgc

SEQ ID NO: 1675596 - RNA, 13 nt, Salmonella enterica enterica serovar Typhi
guucaucgguuuu

SEQ ID NO: 1675597 - RNA, 20 nt, Salmonella enterica enterica serovar Typhi
guucaucgugaaauuauucc

SEQ ID NO: 1675598 - RNA, 21 nt, Salmonella enterica enterica serovar Typhi
guucaucgcuggcguacgcca

SEQ ID NO: 1675599 - RNA, 22 nt, Salmonella enterica enterica serovar Typhi
guucaugccgacgauuugcgcu

SEQ ID NO: 1675600 - RNA, 15 nt, Salmonella enterica enterica serovar Typhi
guucaugcacucgcg

SEQ ID NO: 1675601 - RNA, 21 nt, Salmonella enterica enterica serovar Typhi
guuccacgggaucguuuuauc

SEQ ID NO: 1675602 - RNA, 22 nt, Salmonella enterica enterica serovar Typhi
guuccacgggaucguuuuaucu

SEQ ID NO: 1675603 - RNA, 22 nt, Salmonella enterica enterica serovar Typhi
guucaucaggcaauaaacauca

SEQ ID NO: 1675604 - RNA, 21 nt, Salmonella enterica enterica serovar Typhi
guucaccguuuaaaaacauca

SEQ ID NO: 1675605 - RNA, 18 nt, Salmonella enterica enterica serovar Typhi
guucacgaucaccuggug

SEQ ID NO: 1675606 - RNA, 13 nt, Salmonella enterica enterica serovar Typhi
guucaccggcggc

SEQ ID NO: 1675607 - RNA, 18 nt, Salmonella enterica enterica serovar Typhi
guucacgcagcgcaucca

SEQ ID NO: 1675608 - RNA, 20 nt, Salmonella enterica enterica serovar Typhi
guucaccaccacccagugcc

SEQ ID NO: 1675609 - RNA, 17 nt, Salmonella enterica enterica serovar Typhi
guucucgcgccgccugc

SEQ ID NO: 1675610 - RNA, 20 nt, Salmonella enterica enterica serovar Typhi
guucucgcgccgccugcacg

SEQ ID NO: 1675611 - RNA, 19 nt, Salmonella enterica enterica serovar Typhi
guucugagcggauucgacu

SEQ ID NO: 1675612 - RNA, 22 nt, Salmonella enterica enterica serovar Typhi
guucugcauaucgccuugcugc

SEQ ID NO: 1675613 - RNA, 20 nt, Salmonella enterica enterica serovar Typhi
guucugcgccauuuccagcc

SEQ ID NO: 1675614 - RNA, 13 nt, Salmonella enterica enterica serovar Typhi
guucucacccaug

SEQ ID NO: 1675615 - RNA, 23 nt, Salmonella enterica enterica serovar Typhi
guucgguauaugaaucaucagaa

SEQ ID NO: 1675616 - RNA, 21 nt, Salmonella enterica enterica serovar Typhi
guucgucccugcaacgccugc

SEQ ID NO: 1675617 - RNA, 16 nt, Salmonella enterica enterica serovar Typhi
guuccggcagacggcu

SEQ ID NO: 1675618 - RNA, 16 nt, Salmonella enterica enterica serovar Typhi
guuccuuuacuucuuu

SEQ ID NO: 1675619 - RNA, 24 nt, Salmonella enterica enterica serovar Typhi
guucgaaucccgucguagccacca

SEQ ID NO: 1675620 - RNA, 20 nt, Salmonella enterica enterica serovar Typhi
gugucagacaccgggcuauu

SEQ ID NO: 1675621 - RNA, 14 nt, Salmonella enterica enterica serovar Typhi
gugucacucaucgg

SEQ ID NO: 1675622 - RNA, 19 nt, Salmonella enterica enterica serovar Typhi
gugucauaacgaccaaaca

SEQ ID NO: 1675623 - RNA, 19 nt, Salmonella enterica enterica serovar Typhi
guguaggaaaggcagagaa

SEQ ID NO: 1675624 - RNA, 19 nt, Salmonella enterica enterica serovar Typhi
guguagaauguaggccggg

SEQ ID NO: 1675625 - RNA, 19 nt, Salmonella enterica enterica serovar Typhi
gugucguuuucacuuguuc

SEQ ID NO: 1675626 - RNA, 15 nt, Salmonella enterica enterica serovar Typhi
gugucucgucgccag

SEQ ID NO: 1675627 - RNA, 17 nt, Salmonella enterica enterica serovar Typhi
gugucucgucgccaggg

SEQ ID NO: 1675628 - RNA, 14 nt, Salmonella enterica enterica serovar Typhi
guguccgccugcug

SEQ ID NO: 1675629 - RNA, 23 nt, Salmonella enterica enterica serovar Typhi
gugucgaugagcucguuauaagc

SEQ ID NO: 1675630 - RNA, 15 nt, Salmonella enterica enterica serovar Typhi
gugucgccauaaauc

SEQ ID NO: 1675631 - RNA, 21 nt, Salmonella enterica enterica serovar Typhi
guguuauauucccgaaaggug

SEQ ID NO: 1675632 - RNA, 16 nt, Salmonella enterica enterica serovar Typhi
gugugggcacucgaag

SEQ ID NO: 1675633 - RNA, 13 nt, Salmonella enterica enterica serovar Typhi
guuaaaucauaac

SEQ ID NO: 1675634 - RNA, 23 nt, Salmonella enterica enterica serovar Typhi
guuaaaucgcgcaaauauuacaa

SEQ ID NO: 1675635 - RNA, 17 nt, Salmonella enterica enterica serovar Typhi
guuaaauucauauuuaa

SEQ ID NO: 1675636 - RNA, 15 nt, Salmonella enterica enterica serovar Typhi
guuaaaaccggcugc

SEQ ID NO: 1675637 - RNA, 23 nt, Salmonella enterica enterica serovar Typhi
guuaacucaagcgaauccagauc

SEQ ID NO: 1675638 - RNA, 14 nt, Salmonella enterica enterica serovar Typhi
guuaacucaaggua

SEQ ID NO: 1675639 - RNA, 17 nt, Salmonella enterica enterica serovar Typhi
guuaacuggcgcaucug

SEQ ID NO: 1675640 - RNA, 22 nt, Salmonella enterica enterica serovar Typhi
guuaaucauuuucuuugcagcu

SEQ ID NO: 1675641 - RNA, 14 nt, Salmonella enterica enterica serovar Typhi
guuaagcauuucgc

SEQ ID NO: 1675642 - RNA, 23 nt, Salmonella enterica enterica serovar Typhi
guuaauccuuagaauguuuuuua

SEQ ID NO: 1675643 - RNA, 21 nt, Salmonella enterica enterica serovar Typhi
guuaauccagagcggauaaau

SEQ ID NO: 1675644 - RNA, 16 nt, Salmonella enterica enterica serovar Typhi
guuaaugccaucauca

SEQ ID NO: 1675645 - RNA, 22 nt, Salmonella enterica enterica serovar Typhi
guuaauggccugaugacgcugc

SEQ ID NO: 1675646 - RNA, 14 nt, Salmonella enterica enterica serovar Typhi
guggcaccugcugu

SEQ ID NO: 1675647 - RNA, 17 nt, Salmonella enterica enterica serovar Typhi
guggagggguauuuauc

SEQ ID NO: 1675648 - RNA, 18 nt, Salmonella enterica enterica serovar Typhi
guggagggguauuuaucc

SEQ ID NO: 1675649 - RNA, 23 nt, Salmonella enterica enterica serovar Typhi
guggacaaucaggcugcggauga

SEQ ID NO: 1675650 - RNA, 15 nt, Salmonella enterica enterica serovar Typhi
guggaaucagccagg

SEQ ID NO: 1675651 - RNA, 22 nt, Salmonella enterica enterica serovar Typhi
guggagaggccaccagcgccag

SEQ ID NO: 1675652 - RNA, 13 nt, Salmonella enterica enterica serovar Typhi
guggaaucagcca

SEQ ID NO: 1675653 - RNA, 22 nt, Salmonella enterica enterica serovar Typhi
gugcgccagccuuaucccaucc

SEQ ID NO: 1675654 - RNA, 18 nt, Salmonella enterica enterica serovar Typhi
gugcgcagccccagcgcc

SEQ ID NO: 1675655 - RNA, 14 nt, Salmonella enterica enterica serovar Typhi
gugggccguuccgc

SEQ ID NO: 1675656 - RNA, 16 nt, Salmonella enterica enterica serovar Typhi
gugggcggcaccagcg

SEQ ID NO: 1675657 - RNA, 15 nt, Salmonella enterica enterica serovar Typhi
gugggcuaugcucca

SEQ ID NO: 1675658 - RNA, 21 nt, Salmonella enterica enterica serovar Typhi
guggucgcggcucaccagcug

SEQ ID NO: 1675659 - RNA, 22 nt, Salmonella enterica enterica serovar Typhi
guggucgacauauucaugguuc

SEQ ID NO: 1675660 - RNA, 14 nt, Salmonella enterica enterica serovar Typhi
guggcgucggcugu

SEQ ID NO: 1675661 - RNA, 17 nt, Salmonella enterica enterica serovar Typhi
guggcuaauuucaauuu

SEQ ID NO: 1675662 - RNA, 12 nt, Salmonella enterica enterica serovar Typhi
guggccguggug

SEQ ID NO: 1675663 - RNA, 17 nt, Salmonella enterica enterica serovar Typhi
guggccugcagagcggc

SEQ ID NO: 1675664 - RNA, 22 nt, Salmonella enterica enterica serovar Typhi
guggccgagaguccagcgccag

SEQ ID NO: 1675665 - RNA, 12 nt, Salmonella enterica enterica serovar Typhi
guggcaucauca

SEQ ID NO: 1675666 - RNA, 23 nt, Salmonella enterica enterica serovar Typhi
guggccgauauggccguuuucau

SEQ ID NO: 1675667 - RNA, 22 nt, Salmonella enterica enterica serovar Typhi
guaaaacgccaagaaugaaaca

SEQ ID NO: 1675668 - RNA, 23 nt, Salmonella enterica enterica serovar Typhi
guaauugcgccguucacuucaaa

SEQ ID NO: 1675669 - RNA, 22 nt, Salmonella enterica enterica serovar Typhi
guaauucucacagaaucaucag

SEQ ID NO: 1675670 - RNA, 15 nt, Salmonella enterica enterica serovar Typhi
guaauucagcucgcu

SEQ ID NO: 1675671 - RNA, 17 nt, Salmonella enterica enterica serovar Typhi
guaaucuuccacccgcg

SEQ ID NO: 1675672 - RNA, 16 nt, Salmonella enterica enterica serovar Typhi
guaaugaacaccagca

SEQ ID NO: 1675673 - RNA, 20 nt, Salmonella enterica enterica serovar Typhi
guaaugaucagaacucacau

SEQ ID NO: 1675674 - RNA, 21 nt, Salmonella enterica enterica serovar Typhi
guacaaaccccacccacugau

SEQ ID NO: 1675675 - RNA, 13 nt, Salmonella enterica enterica serovar Typhi
guacaaacaaaua

SEQ ID NO: 1675676 - RNA, 21 nt, Salmonella enterica enterica serovar Typhi
guacaaacaaauaaauccaug

SEQ ID NO: 1675677 - RNA, 14 nt, Salmonella enterica enterica serovar Typhi
guaauuuuucuccc

SEQ ID NO: 1675678 - RNA, 13 nt, Salmonella enterica enterica serovar Typhi
guacaaaaaaugu

SEQ ID NO: 1675679 - RNA, 19 nt, Salmonella enterica enterica serovar Typhi
guaauuugaacauauccgc

SEQ ID NO: 1675680 - RNA, 17 nt, Salmonella enterica enterica serovar Typhi
guaauuucauagaccgc

SEQ ID NO: 1675681 - RNA, 20 nt, Salmonella enterica enterica serovar Typhi
guacagcuuaaucaccagcg

SEQ ID NO: 1675682 - RNA, 17 nt, Salmonella enterica enterica serovar Typhi
guacagccuaaaaaacc

SEQ ID NO: 1675683 - RNA, 16 nt, Salmonella enterica enterica serovar Typhi
guacaggccgccgccu

SEQ ID NO: 1675684 - RNA, 16 nt, Salmonella enterica enterica serovar Typhi
guacauaacagcagca

SEQ ID NO: 1675685 - RNA, 17 nt, Salmonella enterica enterica serovar Typhi
guacagcaauaaaagga

SEQ ID NO: 1675686 - RNA, 17 nt, Salmonella enterica enterica serovar Typhi
guacacacgcgcugacc

SEQ ID NO: 1675687 - RNA, 13 nt, Salmonella enterica enterica serovar Typhi
guacaccugcagg

SEQ ID NO: 1675688 - RNA, 20 nt, Salmonella enterica enterica serovar Typhi
guacacuucagccagacgcu

SEQ ID NO: 1675689 - RNA, 17 nt, Salmonella enterica enterica serovar Typhi
guacacuucauccggcg

SEQ ID NO: 1675690 - RNA, 20 nt, Salmonella enterica enterica serovar Typhi
guacgcgucugaaugacgcc

SEQ ID NO: 1675691 - RNA, 22 nt, Salmonella enterica enterica serovar Typhi
guacucggcuacgaaccgagcg

SEQ ID NO: 1675692 - RNA, 21 nt, Salmonella enterica enterica serovar Typhi
guacgcccgugacgccaggca

SEQ ID NO: 1675693 - RNA, 16 nt, Salmonella enterica enterica serovar Typhi
guacgccuaaaugaac

SEQ ID NO: 1675694 - RNA, 11 nt, Salmonella enterica enterica serovar Typhi
guacgccgcca

SEQ ID NO: 1675695 - RNA, 22 nt, Salmonella enterica enterica serovar Typhi
guacgcgcgucguauaugccaa

SEQ ID NO: 1675696 - RNA, 16 nt, Salmonella enterica enterica serovar Typhi
guacgccugucgcaac

SEQ ID NO: 1675697 - RNA, 20 nt, Salmonella enterica enterica serovar Typhi
guacugcccguggcggaggu

SEQ ID NO: 1675698 - RNA, 11 nt, Salmonella enterica enterica serovar Typhi
guacuuucaaa

SEQ ID NO: 1675699 - RNA, 13 nt, Salmonella enterica enterica serovar Typhi
guacuuucacuac

SEQ ID NO: 1675700 - RNA, 16 nt, Salmonella enterica enterica serovar Typhi
guacuuucaaauagcu

SEQ ID NO: 1675701 - RNA, 21 nt, Salmonella enterica enterica serovar Typhi
guacuuucuacaaauguuguc

SEQ ID NO: 1675702 - RNA, 13 nt, Salmonella enterica enterica serovar Typhi
guacuuuucaucc

SEQ ID NO: 1675703 - RNA, 17 nt, Salmonella enterica enterica serovar Typhi
guacuuuugcuuccagu

SEQ ID NO: 1675704 - RNA, 22 nt, Salmonella enterica enterica serovar Typhi
guaccuuucucuuucccaggcc

SEQ ID NO: 1675705 - RNA, 20 nt, Salmonella enterica enterica serovar Typhi
guaccugcggcaauggcuca

SEQ ID NO: 1675706 - RNA, 20 nt, Salmonella enterica enterica serovar Typhi
guaccuuuaucuugaccuga

SEQ ID NO: 1675707 - RNA, 16 nt, Salmonella enterica enterica serovar Typhi
guacaucgcgcugacc

SEQ ID NO: 1675708 - RNA, 23 nt, Salmonella enterica enterica serovar Typhi
guacauauacugucuuguggaac

SEQ ID NO: 1675709 - RNA, 13 nt, Salmonella enterica enterica serovar Typhi
guacaucauuggc

SEQ ID NO: 1675710 - RNA, 18 nt, Salmonella enterica enterica serovar Typhi
guaccacgccgcacacag

SEQ ID NO: 1675711 - RNA, 16 nt, Salmonella enterica enterica serovar Typhi
guaccagcgcccgagc

SEQ ID NO: 1675712 - RNA, 12 nt, Salmonella enterica enterica serovar Typhi
guaccagcagcg

SEQ ID NO: 1675713 - RNA, 18 nt, Salmonella enterica enterica serovar Typhi
guaccagaaugcccugcu

SEQ ID NO: 1675714 - RNA, 16 nt, Salmonella enterica enterica serovar Typhi
guagacaaacagcgcg

SEQ ID NO: 1675715 - RNA, 20 nt, Salmonella enterica enterica serovar Typhi
guagcagcgaugacagcagg

SEQ ID NO: 1675716 - RNA, 20 nt, Salmonella enterica enterica serovar Typhi
guagauggcgcuaaaaccgu

SEQ ID NO: 1675717 - RNA, 19 nt, Salmonella enterica enterica serovar Typhi
guagccacgcccgccgccu

SEQ ID NO: 1675718 - RNA, 17 nt, Salmonella enterica enterica serovar Typhi
guagccacgcccgccgc

SEQ ID NO: 1675719 - RNA, 20 nt, Salmonella enterica enterica serovar Typhi
guagccaaaauuuacgggga

SEQ ID NO: 1675720 - RNA, 20 nt, Salmonella enterica enterica serovar Typhi
guagccagagcgcgcuggca

SEQ ID NO: 1675721 - RNA, 21 nt, Salmonella enterica enterica serovar Typhi
guagcggcaacagcaccagaa

SEQ ID NO: 1675722 - RNA, 20 nt, Salmonella enterica enterica serovar Typhi
guagcggaaccagccaugcc

SEQ ID NO: 1675723 - RNA, 18 nt, Salmonella enterica enterica serovar Typhi
guagcggcaacagcacca

SEQ ID NO: 1675724 - RNA, 14 nt, Salmonella enterica enterica serovar Typhi
guauaggccaggcu

SEQ ID NO: 1675725 - RNA, 18 nt, Salmonella enterica enterica serovar Typhi
guaucaaacccuuccaga

SEQ ID NO: 1675726 - RNA, 14 nt, Salmonella enterica enterica serovar Typhi
guauagaaauagcc

SEQ ID NO: 1675727 - RNA, 14 nt, Salmonella enterica enterica serovar Typhi
guauagccaggcag

SEQ ID NO: 1675728 - RNA, 14 nt, Salmonella enterica enterica serovar Typhi
guagcuucugucug

SEQ ID NO: 1675729 - RNA, 21 nt, Salmonella enterica enterica serovar Typhi
guagcgucagguagcccggca

SEQ ID NO: 1675730 - RNA, 20 nt, Salmonella enterica enterica serovar Typhi
guagcgucaauacaccucgg

SEQ ID NO: 1675731 - RNA, 14 nt, Salmonella enterica enterica serovar Typhi
guaucacgcgugcg

SEQ ID NO: 1675732 - RNA, 16 nt, Salmonella enterica enterica serovar Typhi
guaucacugaagagag

SEQ ID NO: 1675733 - RNA, 18 nt, Salmonella enterica enterica serovar Typhi
guaucacugauauaaccc

SEQ ID NO: 1675734 - RNA, 16 nt, Salmonella enterica enterica serovar Typhi
guauccauaauuuucc

SEQ ID NO: 1675735 - RNA, 16 nt, Salmonella enterica enterica serovar Typhi
guauccagcaacagug

SEQ ID NO: 1675736 - RNA, 21 nt, Salmonella enterica enterica serovar Typhi
guauccacccgguuuaccauu

SEQ ID NO: 1675737 - RNA, 11 nt, Salmonella enterica enterica serovar Typhi
guaucaucgcu

SEQ ID NO: 1675738 - RNA, 14 nt, Salmonella enterica enterica serovar Typhi
guauccauugccag

SEQ ID NO: 1675739 - RNA, 12 nt, Salmonella enterica enterica serovar Typhi
guaucccgccag

SEQ ID NO: 1675740 - RNA, 13 nt, Salmonella enterica enterica serovar Typhi
guaucccgccagc

SEQ ID NO: 1675741 - RNA, 19 nt, Salmonella enterica enterica serovar Typhi
guauccccagucuuccugc

SEQ ID NO: 1675742 - RNA, 16 nt, Salmonella enterica enterica serovar Typhi
guaucccgccagcggc

SEQ ID NO: 1675743 - RNA, 13 nt, Salmonella enterica enterica serovar Typhi
guauccuccugcc

SEQ ID NO: 1675744 - RNA, 12 nt, Salmonella enterica enterica serovar Typhi
guauccgccaua

SEQ ID NO: 1675745 - RNA, 19 nt, Salmonella enterica enterica serovar Typhi
guauccggccugcagggaa

SEQ ID NO: 1675746 - RNA, 16 nt, Salmonella enterica enterica serovar Typhi
guauccggucaauaca

SEQ ID NO: 1675747 - RNA, 22 nt, Salmonella enterica enterica serovar Typhi
guauuacaaguaauaaaauaau

SEQ ID NO: 1675748 - RNA, 17 nt, Salmonella enterica enterica serovar Typhi
guauuaacgcuuugcca

SEQ ID NO: 1675749 - RNA, 18 nt, Salmonella enterica enterica serovar Typhi
guauuaacagcuucuucu

SEQ ID NO: 1675750 - RNA, 19 nt, Salmonella enterica enterica serovar Typhi
guauguuaggguagaaaaa

SEQ ID NO: 1675751 - RNA, 20 nt, Salmonella enterica enterica serovar Typhi
guaugauuuucuuauuacaa

SEQ ID NO: 1675752 - RNA, 14 nt, Salmonella enterica enterica serovar Typhi
guaugcagccaggc

SEQ ID NO: 1675753 - RNA, 19 nt, Salmonella enterica enterica serovar Typhi
guaugccgcacaaaauuuu

SEQ ID NO: 1675754 - RNA, 22 nt, Salmonella enterica enterica serovar Typhi
guaugccucgcgcaccauaaua

SEQ ID NO: 1675755 - RNA, 13 nt, Salmonella enterica enterica serovar Typhi
guaugccuuccag

SEQ ID NO: 1675756 - RNA, 13 nt, Salmonella enterica enterica serovar Typhi
guaucgcucugcu

SEQ ID NO: 1675757 - RNA, 14 nt, Salmonella enterica enterica serovar Typhi
guauccuuccagcc

SEQ ID NO: 1675758 - RNA, 22 nt, Salmonella enterica enterica serovar Typhi
guaucuucgccguguucuuacc

SEQ ID NO: 1675759 - RNA, 19 nt, Salmonella enterica enterica serovar Typhi
guaucugucccagccuucc

SEQ ID NO: 1675760 - RNA, 12 nt, Salmonella enterica enterica serovar Typhi
gucaaauccauc

SEQ ID NO: 1675761 - RNA, 17 nt, Salmonella enterica enterica serovar Typhi
gucaauaaacuggagca

SEQ ID NO: 1675762 - RNA, 18 nt, Salmonella enterica enterica serovar Typhi
gucaauaaagacuggccc

SEQ ID NO: 1675763 - RNA, 14 nt, Salmonella enterica enterica serovar Typhi
gucaauaagccaga

SEQ ID NO: 1675764 - RNA, 13 nt, Salmonella enterica enterica serovar Typhi
gucaaacgcuauc

SEQ ID NO: 1675765 - RNA, 17 nt, Salmonella enterica enterica serovar Typhi
gucaaauagagaaaaua

SEQ ID NO: 1675766 - RNA, 16 nt, Salmonella enterica enterica serovar Typhi
gucaauauuaaugcug

SEQ ID NO: 1675767 - RNA, 17 nt, Salmonella enterica enterica serovar Typhi
gucaaucgccugcugua

SEQ ID NO: 1675768 - RNA, 12 nt, Salmonella enterica enterica serovar Typhi
gucaaucaucag

SEQ ID NO: 1675769 - RNA, 20 nt, Salmonella enterica enterica serovar Typhi
gucaccagcagcauuucaaa

SEQ ID NO: 1675770 - RNA, 14 nt, Salmonella enterica enterica serovar Typhi
gucacauccagaca

SEQ ID NO: 1675771 - RNA, 19 nt, Salmonella enterica enterica serovar Typhi
gucacgauaaccaggucac

SEQ ID NO: 1675772 - RNA, 16 nt, Salmonella enterica enterica serovar Typhi
gucacgacguauuaaa

SEQ ID NO: 1675773 - RNA, 16 nt, Salmonella enterica enterica serovar Typhi
guauucggaauaaugu

SEQ ID NO: 1675774 - RNA, 16 nt, Salmonella enterica enterica serovar Typhi
guauucggcuuaccca

SEQ ID NO: 1675775 - RNA, 20 nt, Salmonella enterica enterica serovar Typhi
guauucugcgccagccagcu

SEQ ID NO: 1675776 - RNA, 14 nt, Salmonella enterica enterica serovar Typhi
guauucuuacccac

SEQ ID NO: 1675777 - RNA, 16 nt, Salmonella enterica enterica serovar Typhi
guauugauuuuuaaaa

SEQ ID NO: 1675778 - RNA, 14 nt, Salmonella enterica enterica serovar Typhi
guauugcaccuggg

SEQ ID NO: 1675779 - RNA, 15 nt, Salmonella enterica enterica serovar Typhi
guauugcaccuggga

SEQ ID NO: 1675780 - RNA, 23 nt, Salmonella enterica enterica serovar Typhi
guauucaacgccaucuuccucac

SEQ ID NO: 1675781 - RNA, 15 nt, Salmonella enterica enterica serovar Typhi
guauucauaccuuua

SEQ ID NO: 1675782 - RNA, 16 nt, Salmonella enterica enterica serovar Typhi
guauugcuuucaauuu

SEQ ID NO: 1675783 - RNA, 22 nt, Salmonella enterica enterica serovar Typhi
guauugcuuucaauuuccgcac

SEQ ID NO: 1675784 - RNA, 13 nt, Salmonella enterica enterica serovar Typhi
guauuuauccagc

SEQ ID NO: 1675785 - RNA, 11 nt, Salmonella enterica enterica serovar Typhi
guauuuuauuu

SEQ ID NO: 1675786 - RNA, 17 nt, Salmonella enterica enterica serovar Typhi
guauuuccauuuuucag

SEQ ID NO: 1675787 - RNA, 23 nt, Salmonella enterica enterica serovar Typhi
guauuucgacuuucuucggauua

SEQ ID NO: 1675788 - RNA, 18 nt, Salmonella enterica enterica serovar Typhi
guauuucgcagcggucag

SEQ ID NO: 1675789 - RNA, 17 nt, Salmonella enterica enterica serovar Typhi
guauuucugaaaaaccg

SEQ ID NO: 1675790 - RNA, 18 nt, Salmonella enterica enterica serovar Typhi
guauuucugaaaaaccgu

SEQ ID NO: 1675791 - RNA, 17 nt, Salmonella enterica enterica serovar Typhi
gucaugcgggagcuugg

SEQ ID NO: 1675792 - RNA, 21 nt, Salmonella enterica enterica serovar Typhi
gucaucggcuuuuuucaacca

SEQ ID NO: 1675793 - RNA, 22 nt, Salmonella enterica enterica serovar Typhi
gucaugccuucauagagaaguc

SEQ ID NO: 1675794 - RNA, 23 nt, Salmonella enterica enterica serovar Typhi
gucaucgcucaucucaagcccca

SEQ ID NO: 1675795 - RNA, 16 nt, Salmonella enterica enterica serovar Typhi
gucaucgccuucaucc

SEQ ID NO: 1675796 - RNA, 16 nt, Salmonella enterica enterica serovar Typhi
gucaucgcaaauucug

SEQ ID NO: 1675797 - RNA, 23 nt, Salmonella enterica enterica serovar Typhi
gucaucgcggaaagcaaugucgc

SEQ ID NO: 1675798 - RNA, 23 nt, Salmonella enterica enterica serovar Typhi
gucauguccagggcauucauugu

SEQ ID NO: 1675799 - RNA, 15 nt, Salmonella enterica enterica serovar Typhi
gucauguccagggca

SEQ ID NO: 1675800 - RNA, 21 nt, Salmonella enterica enterica serovar Typhi
guccacauccagcgccagcgc

SEQ ID NO: 1675801 - RNA, 16 nt, Salmonella enterica enterica serovar Typhi
guccacacaggccugc

SEQ ID NO: 1675802 - RNA, 12 nt, Salmonella enterica enterica serovar Typhi
gucauccuuccc

SEQ ID NO: 1675803 - RNA, 17 nt, Salmonella enterica enterica serovar Typhi
gucaucccgaaccuggu

SEQ ID NO: 1675804 - RNA, 11 nt, Salmonella enterica enterica serovar Typhi
gucauccgcgu

SEQ ID NO: 1675805 - RNA, 15 nt, Salmonella enterica enterica serovar Typhi
gucaucauuacaggc

SEQ ID NO: 1675806 - RNA, 18 nt, Salmonella enterica enterica serovar Typhi
gucaucauuacaggcgaa

SEQ ID NO: 1675807 - RNA, 12 nt, Salmonella enterica enterica serovar Typhi
gucaucccgaac

SEQ ID NO: 1675808 - RNA, 13 nt, Salmonella enterica enterica serovar Typhi
gucaucauaauuc

SEQ ID NO: 1675809 - RNA, 22 nt, Salmonella enterica enterica serovar Typhi
gucaucaggcgguguuguuuua

SEQ ID NO: 1675810 - RNA, 15 nt, Salmonella enterica enterica serovar Typhi
gucauaucauccagc

SEQ ID NO: 1675811 - RNA, 20 nt, Salmonella enterica enterica serovar Typhi
gucauaucugaugcucgccg

SEQ ID NO: 1675812 - RNA, 20 nt, Salmonella enterica enterica serovar Typhi
gucaucaaauuaucuguuga

SEQ ID NO: 1675813 - RNA, 20 nt, Salmonella enterica enterica serovar Typhi
guccacguucaaaucgauga

SEQ ID NO: 1675814 - RNA, 22 nt, Salmonella enterica enterica serovar Typhi
guccagaggaucuggacgccaa

SEQ ID NO: 1675815 - RNA, 19 nt, Salmonella enterica enterica serovar Typhi
guccagauagggccaggcg

SEQ ID NO: 1675816 - RNA, 16 nt, Salmonella enterica enterica serovar Typhi
guccagccggugguuc

SEQ ID NO: 1675817 - RNA, 13 nt, Salmonella enterica enterica serovar Typhi
guccagcgcguga

SEQ ID NO: 1675818 - RNA, 20 nt, Salmonella enterica enterica serovar Typhi
guccagcgcggguucuuucc

SEQ ID NO: 1675819 - RNA, 19 nt, Salmonella enterica enterica serovar Typhi
gucgaauuccgccugcugu

SEQ ID NO: 1675820 - RNA, 19 nt, Salmonella enterica enterica serovar Typhi
gucgagaaaccgcucgccg

SEQ ID NO: 1675821 - RNA, 23 nt, Salmonella enterica enterica serovar Typhi
gucgaagagcacuuugguaaaac

SEQ ID NO: 1675822 - RNA, 18 nt, Salmonella enterica enterica serovar Typhi
gucgaacuuacgacgcgc

SEQ ID NO: 1675823 - RNA, 22 nt, Salmonella enterica enterica serovar Typhi
gucgaacugaauagucggcugc

SEQ ID NO: 1675824 - RNA, 22 nt, Salmonella enterica enterica serovar Typhi
guccuuuacugcgccagccugc

SEQ ID NO: 1675825 - RNA, 20 nt, Salmonella enterica enterica serovar Typhi
gucccggcgucauacugcca

SEQ ID NO: 1675826 - RNA, 17 nt, Salmonella enterica enterica serovar Typhi
gucccggcaauacugga

SEQ ID NO: 1675827 - RNA, 13 nt, Salmonella enterica enterica serovar Typhi
gucccggcagugc

SEQ ID NO: 1675828 - RNA, 18 nt, Salmonella enterica enterica serovar Typhi
gucccggcagugcauaaa

SEQ ID NO: 1675829 - RNA, 16 nt, Salmonella enterica enterica serovar Typhi
guccauuuuuuaucug

SEQ ID NO: 1675830 - RNA, 24 nt, Salmonella enterica enterica serovar Typhi
guccauuuauugcagguauugagu

SEQ ID NO: 1675831 - RNA, 16 nt, Salmonella enterica enterica serovar Typhi
guccauugcgagaaaa

SEQ ID NO: 1675832 - RNA, 21 nt, Salmonella enterica enterica serovar Typhi
guccauuacucucauguucaa

SEQ ID NO: 1675833 - RNA, 18 nt, Salmonella enterica enterica serovar Typhi
guccauugcgagaaaaaa

SEQ ID NO: 1675834 - RNA, 14 nt, Salmonella enterica enterica serovar Typhi
guccgacauuagcg

SEQ ID NO: 1675835 - RNA, 21 nt, Salmonella enterica enterica serovar Typhi
gucccuuucccuuccagcgac

SEQ ID NO: 1675836 - RNA, 14 nt, Salmonella enterica enterica serovar Typhi
gucccugaagaaaa

SEQ ID NO: 1675837 - RNA, 17 nt, Salmonella enterica enterica serovar Typhi
gucccucuccagggcaa

SEQ ID NO: 1675838 - RNA, 22 nt, Salmonella enterica enterica serovar Typhi
guccgcucacgauaaugaaccu

SEQ ID NO: 1675839 - RNA, 15 nt, Salmonella enterica enterica serovar Typhi
gucgaugauuuucaa

SEQ ID NO: 1675840 - RNA, 15 nt, Salmonella enterica enterica serovar Typhi
gucgaugucgccgcc

SEQ ID NO: 1675841 - RNA, 18 nt, Salmonella enterica enterica serovar Typhi
gucgcgccauuccgcaga

SEQ ID NO: 1675842 - RNA, 18 nt, Salmonella enterica enterica serovar Typhi
gucgcgacguccgccaac

SEQ ID NO: 1675843 - RNA, 17 nt, Salmonella enterica enterica serovar Typhi
gucggcaaucaccugca

SEQ ID NO: 1675844 - RNA, 14 nt, Salmonella enterica enterica serovar Typhi
gucggagccaauaa

SEQ ID NO: 1675845 - RNA, 18 nt, Salmonella enterica enterica serovar Typhi
gucgcgguugucggcgcg

SEQ ID NO: 1675846 - RNA, 16 nt, Salmonella enterica enterica serovar Typhi
gucgcuauggugcggg

SEQ ID NO: 1675847 - RNA, 20 nt, Salmonella enterica enterica serovar Typhi
gucggcgucugcgcgcuggu

SEQ ID NO: 1675848 - RNA, 19 nt, Salmonella enterica enterica serovar Typhi
gucggcgccaucaugcagc

SEQ ID NO: 1675849 - RNA, 15 nt, Salmonella enterica enterica serovar Typhi
gucggguucgcgcgc

SEQ ID NO: 1675850 - RNA, 17 nt, Salmonella enterica enterica serovar Typhi
gucgggccgcgcugcgc

SEQ ID NO: 1675851 - RNA, 13 nt, Salmonella enterica enterica serovar Typhi
gucgggaauugcc

SEQ ID NO: 1675852 - RNA, 14 nt, Salmonella enterica enterica serovar Typhi
gucgugccuuccgc

SEQ ID NO: 1675853 - RNA, 13 nt, Salmonella enterica enterica serovar Typhi
gucguucacguaa

SEQ ID NO: 1675854 - RNA, 22 nt, Salmonella enterica enterica serovar Typhi
gucguuacugcucguagcguuu

SEQ ID NO: 1675855 - RNA, 21 nt, Salmonella enterica enterica serovar Typhi
gucgugccugacguccacgga

SEQ ID NO: 1675856 - RNA, 18 nt, Salmonella enterica enterica serovar Typhi
gucgugcaaccgccugca

SEQ ID NO: 1675857 - RNA, 18 nt, Salmonella enterica enterica serovar Typhi
gucguccucaggccggau

SEQ ID NO: 1675858 - RNA, 17 nt, Salmonella enterica enterica serovar Typhi
gucguauuuauuuucug

SEQ ID NO: 1675859 - RNA, 13 nt, Salmonella enterica enterica serovar Typhi
gucguccacucuu

SEQ ID NO: 1675860 - RNA, 13 nt, Salmonella enterica enterica serovar Typhi
gucguccccugga

SEQ ID NO: 1675861 - RNA, 21 nt, Salmonella enterica enterica serovar Typhi
gucguccgcgcccaucuccag

SEQ ID NO: 1675862 - RNA, 21 nt, Salmonella enterica enterica serovar Typhi
gucgucgauuuucugcucaau

SEQ ID NO: 1675863 - RNA, 22 nt, Salmonella enterica enterica serovar Typhi
gucguauccccagucuuccugc

SEQ ID NO: 1675864 - RNA, 16 nt, Salmonella enterica enterica serovar Typhi
gucgucauaucgaugg

SEQ ID NO: 1675865 - RNA, 16 nt, Salmonella enterica enterica serovar Typhi
gucguaaaacugcacc

SEQ ID NO: 1675866 - RNA, 22 nt, Salmonella enterica enterica serovar Typhi
gucguaccguuaaucgauuuuc

SEQ ID NO: 1675867 - RNA, 17 nt, Salmonella enterica enterica serovar Typhi
gucuauugccuaaauaa

SEQ ID NO: 1675868 - RNA, 17 nt, Salmonella enterica enterica serovar Typhi
gucucccaaaugaaaaa

SEQ ID NO: 1675869 - RNA, 13 nt, Salmonella enterica enterica serovar Typhi
gucucccuccugc

SEQ ID NO: 1675870 - RNA, 16 nt, Salmonella enterica enterica serovar Typhi
gucucccuccugcucc

SEQ ID NO: 1675871 - RNA, 15 nt, Salmonella enterica enterica serovar Typhi
gucuccucagcaggc

SEQ ID NO: 1675872 - RNA, 16 nt, Salmonella enterica enterica serovar Typhi
gucuccucagcaggcg

SEQ ID NO: 1675873 - RNA, 16 nt, Salmonella enterica enterica serovar Typhi
gucucccaaaugaaaa

SEQ ID NO: 1675874 - RNA, 20 nt, Salmonella enterica enterica serovar Typhi
gucuccagcucauuuuuaca

SEQ ID NO: 1675875 - RNA, 20 nt, Salmonella enterica enterica serovar Typhi
gucuaauugacggccaccau

SEQ ID NO: 1675876 - RNA, 20 nt, Salmonella enterica enterica serovar Typhi
gucuacccgguguaaaaaau

SEQ ID NO: 1675877 - RNA, 16 nt, Salmonella enterica enterica serovar Typhi
gucguuccgccaggcg

SEQ ID NO: 1675878 - RNA, 15 nt, Salmonella enterica enterica serovar Typhi
gggacacugccggcu

SEQ ID NO: 1675879 - RNA, 23 nt, Salmonella enterica enterica serovar Typhi
gggacgaauuuccagcgggcgau

SEQ ID NO: 1675880 - RNA, 16 nt, Salmonella enterica enterica serovar Typhi
gggacggcggccagca

SEQ ID NO: 1675881 - RNA, 17 nt, Salmonella enterica enterica serovar Typhi
gggacgcugcgcggcga

SEQ ID NO: 1675882 - RNA, 23 nt, Salmonella enterica enterica serovar Typhi
gggacguuucgauaaccaccagc

SEQ ID NO: 1675883 - RNA, 22 nt, Salmonella enterica enterica serovar Typhi
gggacuucaggcauccagaccc

SEQ ID NO: 1675884 - RNA, 14 nt, Salmonella enterica enterica serovar Typhi
ggcuuugcugcugc

SEQ ID NO: 1675885 - RNA, 24 nt, Salmonella enterica enterica serovar Typhi
gggaagcacauccauguacuccug

SEQ ID NO: 1675886 - RNA, 18 nt, Salmonella enterica enterica serovar Typhi
gggaagaugugccacucc

SEQ ID NO: 1675887 - RNA, 22 nt, Salmonella enterica enterica serovar Typhi
gggaagacuauuaccaccguua

SEQ ID NO: 1675888 - RNA, 24 nt, Salmonella enterica enterica serovar Typhi
gggaagaucauuaucaauagcuuc

SEQ ID NO: 1675889 - RNA, 23 nt, Salmonella enterica enterica serovar Typhi
gggaaguugcccuuaucuggaug

SEQ ID NO: 1675890 - RNA, 23 nt, Salmonella enterica enterica serovar Typhi
gggaaggggauucuccggcgcgg

SEQ ID NO: 1675891 - RNA, 15 nt, Salmonella enterica enterica serovar Typhi
gggaauaugauuuaa

SEQ ID NO: 1675892 - RNA, 18 nt, Salmonella enterica enterica serovar Typhi
ggcugucggcagaaccug

SEQ ID NO: 1675893 - RNA, 22 nt, Salmonella enterica enterica serovar Typhi
ggccgccagcgugacccagaca

SEQ ID NO: 1675894 - RNA, 13 nt, Salmonella enterica enterica serovar Typhi
ggccgcagcgcca

SEQ ID NO: 1675895 - RNA, 23 nt, Salmonella enterica enterica serovar Typhi
ggcuguggcguuuuaccgcccga

SEQ ID NO: 1675896 - RNA, 18 nt, Salmonella enterica enterica serovar Typhi
ggcuucaaccguuucuuu

SEQ ID NO: 1675897 - RNA, 16 nt, Salmonella enterica enterica serovar Typhi
ggcuucaaccuccugc

SEQ ID NO: 1675898 - RNA, 13 nt, Salmonella enterica enterica serovar Typhi
ggcuuuauauaaa

SEQ ID NO: 1675899 - RNA, 23 nt, Salmonella enterica enterica serovar Typhi
ggcuuuauccugaccgcuccagu

SEQ ID NO: 1675900 - RNA, 15 nt, Salmonella enterica enterica serovar Typhi
ggcuugcaggauguc

SEQ ID NO: 1675901 - RNA, 20 nt, Salmonella enterica enterica serovar Typhi
gggccauacacucaaccaac

SEQ ID NO: 1675902 - RNA, 17 nt, Salmonella enterica enterica serovar Typhi
gggccagcucuuuucug

SEQ ID NO: 1675903 - RNA, 15 nt, Salmonella enterica enterica serovar Typhi
gggccagcagccagg

SEQ ID NO: 1675904 - RNA, 10 nt, Salmonella enterica enterica serovar Typhi
gggccgccgc

SEQ ID NO: 1675905 - RNA, 23 nt, Salmonella enterica enterica serovar Typhi
gggcacgcugaccacgccgccgc

SEQ ID NO: 1675906 - RNA, 13 nt, Salmonella enterica enterica serovar Typhi
gggcaacggccag

SEQ ID NO: 1675907 - RNA, 16 nt, Salmonella enterica enterica serovar Typhi
gggcagcagcaggcug

SEQ ID NO: 1675908 - RNA, 19 nt, Salmonella enterica enterica serovar Typhi
gggcacuccggcucgcaca

SEQ ID NO: 1675909 - RNA, 14 nt, Salmonella enterica enterica serovar Typhi
gggcagacuuucug

SEQ ID NO: 1675910 - RNA, 20 nt, Salmonella enterica enterica serovar Typhi
gggcagacauucgcgcacgg

SEQ ID NO: 1675911 - RNA, 20 nt, Salmonella enterica enterica serovar Typhi
gggcagaaacguaccugaga

SEQ ID NO: 1675912 - RNA, 21 nt, Salmonella enterica enterica serovar Typhi
gggcaaaagggccauggcugg

SEQ ID NO: 1675913 - RNA, 16 nt, Salmonella enterica enterica serovar Typhi
gggauuugaugcccaa

SEQ ID NO: 1675914 - RNA, 16 nt, Salmonella enterica enterica serovar Typhi
gggauuaucaggauga

SEQ ID NO: 1675915 - RNA, 16 nt, Salmonella enterica enterica serovar Typhi
gggaucgguuuauccc

SEQ ID NO: 1675916 - RNA, 22 nt, Salmonella enterica enterica serovar Typhi
ggggguaacguuguccagcaga

SEQ ID NO: 1675917 - RNA, 24 nt, Salmonella enterica enterica serovar Typhi
gggguaaacaccggggcauuucca

SEQ ID NO: 1675918 - RNA, 19 nt, Salmonella enterica enterica serovar Typhi
ggggucggcgcuaaugugg

SEQ ID NO: 1675919 - RNA, 18 nt, Salmonella enterica enterica serovar Typhi
gggguauucgcggccaga

SEQ ID NO: 1675920 - RNA, 21 nt, Salmonella enterica enterica serovar Typhi
gggggaaaugagaaaaggaag

SEQ ID NO: 1675921 - RNA, 14 nt, Salmonella enterica enterica serovar Typhi
ggggcuuaacccac

SEQ ID NO: 1675922 - RNA, 14 nt, Salmonella enterica enterica serovar Typhi
ggggcuccugcgcc

SEQ ID NO: 1675923 - RNA, 22 nt, Salmonella enterica enterica serovar Typhi
gggugcaaagaaacguucaucc

SEQ ID NO: 1675924 - RNA, 14 nt, Salmonella enterica enterica serovar Typhi
gggugcaaagaaac

SEQ ID NO: 1675925 - RNA, 17 nt, Salmonella enterica enterica serovar Typhi
gggugcagcgucaggaa

SEQ ID NO: 1675926 - RNA, 22 nt, Salmonella enterica enterica serovar Typhi
gggucgacguuguccggcgacc

SEQ ID NO: 1675927 - RNA, 18 nt, Salmonella enterica enterica serovar Typhi
gggucgccgcgcccagca

SEQ ID NO: 1675928 - RNA, 18 nt, Salmonella enterica enterica serovar Typhi
ggguaagcgcuagcgcca

SEQ ID NO: 1675929 - RNA, 21 nt, Salmonella enterica enterica serovar Typhi
ggguaaauagacuguugaaag

SEQ ID NO: 1675930 - RNA, 21 nt, Salmonella enterica enterica serovar Typhi
ggguaaacaccggggcauuuc

SEQ ID NO: 1675931 - RNA, 22 nt, Salmonella enterica enterica serovar Typhi
gggucacauccagacagccgac

SEQ ID NO: 1675932 - RNA, 23 nt, Salmonella enterica enterica serovar Typhi
ggguauuuuagcgguaagagcgu

SEQ ID NO: 1675933 - RNA, 22 nt, Salmonella enterica enterica serovar Typhi
gggguugaugguuauuccuugu

SEQ ID NO: 1675934 - RNA, 21 nt, Salmonella enterica enterica serovar Typhi
gggguuuuggccggaccugcg

SEQ ID NO: 1675935 - RNA, 22 nt, Salmonella enterica enterica serovar Typhi
gggcguuugcgcgcgccacgca

SEQ ID NO: 1675936 - RNA, 15 nt, Salmonella enterica enterica serovar Typhi
gggcgggcagcagca

SEQ ID NO: 1675937 - RNA, 17 nt, Salmonella enterica enterica serovar Typhi
gggcuaugcuccaguug

SEQ ID NO: 1675938 - RNA, 23 nt, Salmonella enterica enterica serovar Typhi
gggccuacagguacagaugcugu

SEQ ID NO: 1675939 - RNA, 20 nt, Salmonella enterica enterica serovar Typhi
gggccugagcgcgcagcugg

SEQ ID NO: 1675940 - RNA, 13 nt, Salmonella enterica enterica serovar Typhi
gggcgcugauuuu

SEQ ID NO: 1675941 - RNA, 18 nt, Salmonella enterica enterica serovar Typhi
gggcggacgaugaaccug

SEQ ID NO: 1675942 - RNA, 20 nt, Salmonella enterica enterica serovar Typhi
gggcuuccacccgggaagcc

SEQ ID NO: 1675943 - RNA, 12 nt, Salmonella enterica enterica serovar Typhi
gggcuuaaucag

SEQ ID NO: 1675944 - RNA, 13 nt, Salmonella enterica enterica serovar Typhi
ggggcaguaaauu

SEQ ID NO: 1675945 - RNA, 14 nt, Salmonella enterica enterica serovar Typhi
ggggccgggaaaga

SEQ ID NO: 1675946 - RNA, 12 nt, Salmonella enterica enterica serovar Typhi
ggggcgcagaag

SEQ ID NO: 1675947 - RNA, 19 nt, Salmonella enterica enterica serovar Typhi
ggucaaaugcgaaaaaaag

SEQ ID NO: 1675948 - RNA, 13 nt, Salmonella enterica enterica serovar Typhi
ggucaaucaucag

SEQ ID NO: 1675949 - RNA, 23 nt, Salmonella enterica enterica serovar Typhi
ggucacacuuaccgggcaucuga

SEQ ID NO: 1675950 - RNA, 12 nt, Salmonella enterica enterica serovar Typhi
gguauccuccug

SEQ ID NO: 1675951 - RNA, 20 nt, Salmonella enterica enterica serovar Typhi
gguaucauuaugggcagcac

SEQ ID NO: 1675952 - RNA, 19 nt, Salmonella enterica enterica serovar Typhi
gguauucguuaccagcauc

SEQ ID NO: 1675953 - RNA, 18 nt, Salmonella enterica enterica serovar Typhi
gguauuucugaaaaaccg

SEQ ID NO: 1675954 - RNA, 15 nt, Salmonella enterica enterica serovar Typhi
gguauugcuuucaau

SEQ ID NO: 1675955 - RNA, 15 nt, Salmonella enterica enterica serovar Typhi
ggucaaacaccugaa

SEQ ID NO: 1675956 - RNA, 14 nt, Salmonella enterica enterica serovar Typhi
ggucaaaagcugca

SEQ ID NO: 1675957 - RNA, 19 nt, Salmonella enterica enterica serovar Typhi
gguauagaauacuuccugc

SEQ ID NO: 1675958 - RNA, 20 nt, Salmonella enterica enterica serovar Typhi
gggugguuucccugaccagu

SEQ ID NO: 1675959 - RNA, 14 nt, Salmonella enterica enterica serovar Typhi
gguagccgacggcc

SEQ ID NO: 1675960 - RNA, 19 nt, Salmonella enterica enterica serovar Typhi
ggucagcaacgccuccagc

SEQ ID NO: 1675961 - RNA, 13 nt, Salmonella enterica enterica serovar Typhi
ggucaucugguca

SEQ ID NO: 1675962 - RNA, 21 nt, Salmonella enterica enterica serovar Typhi
ggucaucgaaggcaucuucag

SEQ ID NO: 1675963 - RNA, 19 nt, Salmonella enterica enterica serovar Typhi
ggucaucaccuccagcacg

SEQ ID NO: 1675964 - RNA, 16 nt, Salmonella enterica enterica serovar Typhi
ggucaucaccuccagc

SEQ ID NO: 1675965 - RNA, 21 nt, Salmonella enterica enterica serovar Typhi
ggugcaaagaaacguucaucc

SEQ ID NO: 1675966 - RNA, 23 nt, Salmonella enterica enterica serovar Typhi
ggugauuucgcccgcauucgcgg

SEQ ID NO: 1675967 - RNA, 22 nt, Salmonella enterica enterica serovar Typhi
ggugaguaauaacaaaaaacau

SEQ ID NO: 1675968 - RNA, 15 nt, Salmonella enterica enterica serovar Typhi
ggugauggacgacga

SEQ ID NO: 1675969 - RNA, 17 nt, Salmonella enterica enterica serovar Typhi
ggugccauuccagccgg

SEQ ID NO: 1675970 - RNA, 23 nt, Salmonella enterica enterica serovar Typhi
ggugccauauuguucaguuucaa

SEQ ID NO: 1675971 - RNA, 15 nt, Salmonella enterica enterica serovar Typhi
ggugaauaaauccuu

SEQ ID NO: 1675972 - RNA, 23 nt, Salmonella enterica enterica serovar Typhi
ggucugcauucaggccucugcuu

SEQ ID NO: 1675973 - RNA, 19 nt, Salmonella enterica enterica serovar Typhi
ggucugcgcgccgcaggcc

SEQ ID NO: 1675974 - RNA, 22 nt, Salmonella enterica enterica serovar Typhi
ggucuggauuacaaaaauagac

SEQ ID NO: 1675975 - RNA, 18 nt, Salmonella enterica enterica serovar Typhi
ggugacaugaaaauauga

SEQ ID NO: 1675976 - RNA, 13 nt, Salmonella enterica enterica serovar Typhi
ggucuccaucaga

SEQ ID NO: 1675977 - RNA, 19 nt, Salmonella enterica enterica serovar Typhi
ggucucauagcgccccagu

SEQ ID NO: 1675978 - RNA, 21 nt, Salmonella enterica enterica serovar Typhi
ggucguacuaaagagcgccug

SEQ ID NO: 1675979 - RNA, 21 nt, Salmonella enterica enterica serovar Typhi
ggucuccgccuggaacccagg

SEQ ID NO: 1675980 - RNA, 21 nt, Salmonella enterica enterica serovar Typhi
ggucucucgugcaggccggau

SEQ ID NO: 1675981 - RNA, 16 nt, Salmonella enterica enterica serovar Typhi
ggucgcuauccagcag

SEQ ID NO: 1675982 - RNA, 19 nt, Salmonella enterica enterica serovar Typhi
gguccggcgcuaaccagcg

SEQ ID NO: 1675983 - RNA, 21 nt, Salmonella enterica enterica serovar Typhi
gguccggcgcuaaccagcgcu

SEQ ID NO: 1675984 - RNA, 14 nt, Salmonella enterica enterica serovar Typhi
gguuugcagcagag

SEQ ID NO: 1675985 - RNA, 23 nt, Salmonella enterica enterica serovar Typhi
gguuugacccauuuuaaaaguua

SEQ ID NO: 1675986 - RNA, 14 nt, Salmonella enterica enterica serovar Typhi
gguuucuucgcugg

SEQ ID NO: 1675987 - RNA, 11 nt, Salmonella enterica enterica serovar Typhi
gguuucuuuuu

SEQ ID NO: 1675988 - RNA, 19 nt, Salmonella enterica enterica serovar Typhi
gguuucguggcgcuguucu

SEQ ID NO: 1675989 - RNA, 13 nt, Salmonella enterica enterica serovar Typhi
gguuucccaguca

SEQ ID NO: 1675990 - RNA, 18 nt, Salmonella enterica enterica serovar Typhi
guaaaaauuguuccugua

SEQ ID NO: 1675991 - RNA, 15 nt, Salmonella enterica enterica serovar Typhi
gguuuuuuuacucug

SEQ ID NO: 1675992 - RNA, 19 nt, Salmonella enterica enterica serovar Typhi
gguuuuuuuauaacauaaa

SEQ ID NO: 1675993 - RNA, 13 nt, Salmonella enterica enterica serovar Typhi
guaaaaaaauaaa

SEQ ID NO: 1675994 - RNA, 18 nt, Salmonella enterica enterica serovar Typhi
gguuuucauccacccugg

SEQ ID NO: 1675995 - RNA, 22 nt, Salmonella enterica enterica serovar Typhi
gguucguacccgcaggccuggc

SEQ ID NO: 1675996 - RNA, 18 nt, Salmonella enterica enterica serovar Typhi
gguucucugccaucaucc

SEQ ID NO: 1675997 - RNA, 17 nt, Salmonella enterica enterica serovar Typhi
gguugcuucuguccuuu

SEQ ID NO: 1675998 - RNA, 17 nt, Salmonella enterica enterica serovar Typhi
gguugcgaauaaacaca

SEQ ID NO: 1675999 - RNA, 18 nt, Salmonella enterica enterica serovar Typhi
gguugccagaggcagcac

SEQ ID NO: 1676000 - RNA, 15 nt, Salmonella enterica enterica serovar Typhi
gguugcccgcaggcu

SEQ ID NO: 1676001 - RNA, 17 nt, Salmonella enterica enterica serovar Typhi
gguugcccgcaggcuuc

SEQ ID NO: 1676002 - RNA, 14 nt, Salmonella enterica enterica serovar Typhi
gguugccgcaaaug

SEQ ID NO: 1676003 - RNA, 23 nt, Salmonella enterica enterica serovar Typhi
gguugcccgguggcgcugcgcuu

SEQ ID NO: 1676004 - RNA, 14 nt, Salmonella enterica enterica serovar Typhi
gguugugccaguaa

SEQ ID NO: 1676005 - RNA, 22 nt, Salmonella enterica enterica serovar Typhi
gguuggucacaaaggccagcag

SEQ ID NO: 1676006 - RNA, 15 nt, Salmonella enterica enterica serovar Typhi
gguugucucaaaaaa

SEQ ID NO: 1676007 - RNA, 13 nt, Salmonella enterica enterica serovar Typhi
gguuggccagcau

SEQ ID NO: 1676008 - RNA, 21 nt, Salmonella enterica enterica serovar Typhi
gguucgaacgacagaauaugc

SEQ ID NO: 1676009 - RNA, 22 nt, Salmonella enterica enterica serovar Typhi
gguuccguucccaaugcuuucg

SEQ ID NO: 1676010 - RNA, 18 nt, Salmonella enterica enterica serovar Typhi
gguucccugcgccaggcc

SEQ ID NO: 1676011 - RNA, 16 nt, Salmonella enterica enterica serovar Typhi
gguucacaauacagaa

SEQ ID NO: 1676012 - RNA, 18 nt, Salmonella enterica enterica serovar Typhi
gguucaauaugccaggca

SEQ ID NO: 1676013 - RNA, 16 nt, Salmonella enterica enterica serovar Typhi
gguucaccaccaccca

SEQ ID NO: 1676014 - RNA, 21 nt, Salmonella enterica enterica serovar Typhi
gguucaccaccacccagugcc

SEQ ID NO: 1676015 - RNA, 22 nt, Salmonella enterica enterica serovar Typhi
gguucaccagcgcgccgccgcc

SEQ ID NO: 1676016 - RNA, 19 nt, Salmonella enterica enterica serovar Typhi
gguucaacgcgcugcagcu

SEQ ID NO: 1676017 - RNA, 19 nt, Salmonella enterica enterica serovar Typhi
gguucaaccgaaagaagaa

SEQ ID NO: 1676018 - RNA, 15 nt, Salmonella enterica enterica serovar Typhi
gguucaagucccccc

SEQ ID NO: 1676019 - RNA, 13 nt, Salmonella enterica enterica serovar Typhi
gguuaauggcagc

SEQ ID NO: 1676020 - RNA, 15 nt, Salmonella enterica enterica serovar Typhi
gguuacaacccgacc

SEQ ID NO: 1676021 - RNA, 20 nt, Salmonella enterica enterica serovar Typhi
gguuacaacugcgaggucac

SEQ ID NO: 1676022 - RNA, 18 nt, Salmonella enterica enterica serovar Typhi
ggugcuuagcuggccaau

SEQ ID NO: 1676023 - RNA, 14 nt, Salmonella enterica enterica serovar Typhi
ggugcccgcgugga

SEQ ID NO: 1676024 - RNA, 17 nt, Salmonella enterica enterica serovar Typhi
ggugcucucccagcuga

SEQ ID NO: 1676025 - RNA, 13 nt, Salmonella enterica enterica serovar Typhi
ggugcuguucuuc

SEQ ID NO: 1676026 - RNA, 15 nt, Salmonella enterica enterica serovar Typhi
ggugggugaugacgg

SEQ ID NO: 1676027 - RNA, 16 nt, Salmonella enterica enterica serovar Typhi
ggugguuucccugacc

SEQ ID NO: 1676028 - RNA, 20 nt, Salmonella enterica enterica serovar Typhi
gguguaaaccaggcauuuua

SEQ ID NO: 1676029 - RNA, 16 nt, Salmonella enterica enterica serovar Typhi
gguguagcucauaacu

SEQ ID NO: 1676030 - RNA, 13 nt, Salmonella enterica enterica serovar Typhi
cuccaauaaauau

SEQ ID NO: 1676031 - RNA, 13 nt, Salmonella enterica enterica serovar Typhi
cuccacauccugu

SEQ ID NO: 1676032 - RNA, 18 nt, Salmonella enterica enterica serovar Typhi
cuccaccgugucauagcc

SEQ ID NO: 1676033 - RNA, 17 nt, Salmonella enterica enterica serovar Typhi
cuccacugucaaaaaua

SEQ ID NO: 1676034 - RNA, 23 nt, Salmonella enterica enterica serovar Typhi
cuccacugucaaaaauaacaggc

SEQ ID NO: 1676035 - RNA, 17 nt, Salmonella enterica enterica serovar Typhi
cuccagaccgcugcgga

SEQ ID NO: 1676036 - RNA, 22 nt, Salmonella enterica enterica serovar Typhi
cuccagaagaucuaaagccagu

SEQ ID NO: 1676037 - RNA, 12 nt, Salmonella enterica enterica serovar Typhi
cuccagaagcau

SEQ ID NO: 1676038 - RNA, 20 nt, Salmonella enterica enterica serovar Typhi
cuccagcacgcgcugcgccg

SEQ ID NO: 1676039 - RNA, 16 nt, Salmonella enterica enterica serovar Typhi
cuccagcacauccuca

SEQ ID NO: 1676040 - RNA, 17 nt, Salmonella enterica enterica serovar Typhi
cuccagacgaugauaau

SEQ ID NO: 1676041 - RNA, 16 nt, Salmonella enterica enterica serovar Typhi
cucauuucacuauaaa

SEQ ID NO: 1676042 - RNA, 16 nt, Salmonella enterica enterica serovar Typhi
cucauuuuauccaaca

SEQ ID NO: 1676043 - RNA, 13 nt, Salmonella enterica enterica serovar Typhi
cucauuuucuuua

SEQ ID NO: 1676044 - RNA, 20 nt, Salmonella enterica enterica serovar Typhi
cucauuuuguugcuccagca

SEQ ID NO: 1676045 - RNA, 22 nt, Salmonella enterica enterica serovar Typhi
cucauuuugccguugcuguucc

SEQ ID NO: 1676046 - RNA, 13 nt, Salmonella enterica enterica serovar Typhi
cucaggacgccag

SEQ ID NO: 1676047 - RNA, 13 nt, Salmonella enterica enterica serovar Typhi
cucaggcgagccc

SEQ ID NO: 1676048 - RNA, 22 nt, Salmonella enterica enterica serovar Typhi
cucaggcggggaguggugaucg

SEQ ID NO: 1676049 - RNA, 14 nt, Salmonella enterica enterica serovar Typhi
cucauuaaaaaaac

SEQ ID NO: 1676050 - RNA, 16 nt, Salmonella enterica enterica serovar Typhi
cucauucagcaacugc

SEQ ID NO: 1676051 - RNA, 15 nt, Salmonella enterica enterica serovar Typhi
cucauucagcggcug

SEQ ID NO: 1676052 - RNA, 19 nt, Salmonella enterica enterica serovar Typhi
cucauuaccgaccuguacc

SEQ ID NO: 1676053 - RNA, 18 nt, Salmonella enterica enterica serovar Typhi
cucauuaugccucccguu

SEQ ID NO: 1676054 - RNA, 23 nt, Salmonella enterica enterica serovar Typhi
cucauuauuaaauuaacacccaa

SEQ ID NO: 1676055 - RNA, 17 nt, Salmonella enterica enterica serovar Typhi
cucccaggcgcgcagcu

SEQ ID NO: 1676056 - RNA, 23 nt, Salmonella enterica enterica serovar Typhi
cucccaaacucgggaaaauagcc

SEQ ID NO: 1676057 - RNA, 19 nt, Salmonella enterica enterica serovar Typhi
cuccauuuuggggaaaaua

SEQ ID NO: 1676058 - RNA, 17 nt, Salmonella enterica enterica serovar Typhi
cuccauggucagacgcu

SEQ ID NO: 1676059 - RNA, 16 nt, Salmonella enterica enterica serovar Typhi
cuccagccucgcgcau

SEQ ID NO: 1676060 - RNA, 15 nt, Salmonella enterica enterica serovar Typhi
cuccagcgauaaacg

SEQ ID NO: 1676061 - RNA, 17 nt, Salmonella enterica enterica serovar Typhi
cuccagcgcauugccuu

SEQ ID NO: 1676062 - RNA, 13 nt, Salmonella enterica enterica serovar Typhi
cuccaugcccaca

SEQ ID NO: 1676063 - RNA, 19 nt, Salmonella enterica enterica serovar Typhi
cuccagcagacgcugcuuc

SEQ ID NO: 1676064 - RNA, 15 nt, Salmonella enterica enterica serovar Typhi
cuccagccgcugccu

SEQ ID NO: 1676065 - RNA, 21 nt, Salmonella enterica enterica serovar Typhi
cuccccggcuugcggggagaa

SEQ ID NO: 1676066 - RNA, 17 nt, Salmonella enterica enterica serovar Typhi
cucccgucgccuguuuc

SEQ ID NO: 1676067 - RNA, 16 nt, Salmonella enterica enterica serovar Typhi
cucccucacccuucac

SEQ ID NO: 1676068 - RNA, 13 nt, Salmonella enterica enterica serovar Typhi
cucccucaaccag

SEQ ID NO: 1676069 - RNA, 14 nt, Salmonella enterica enterica serovar Typhi
cucccccggcacca

SEQ ID NO: 1676070 - RNA, 18 nt, Salmonella enterica enterica serovar Typhi
cuccccacgaaagucugu

SEQ ID NO: 1676071 - RNA, 22 nt, Salmonella enterica enterica serovar Typhi
cuccccaggcgcuauucccagg

SEQ ID NO: 1676072 - RNA, 18 nt, Salmonella enterica enterica serovar Typhi
cucccccaccgacacaaa

SEQ ID NO: 1676073 - RNA, 21 nt, Salmonella enterica enterica serovar Typhi
cuccccaggcgcuauucccag

SEQ ID NO: 1676074 - RNA, 21 nt, Salmonella enterica enterica serovar Typhi
cuccgguaucgccggcagacg

SEQ ID NO: 1676075 - RNA, 12 nt, Salmonella enterica enterica serovar Typhi
cuccgucaaaga

SEQ ID NO: 1676076 - RNA, 16 nt, Salmonella enterica enterica serovar Typhi
cuccuaagagaaaacc

SEQ ID NO: 1676077 - RNA, 12 nt, Salmonella enterica enterica serovar Typhi
cuccucagcagg

SEQ ID NO: 1676078 - RNA, 15 nt, Salmonella enterica enterica serovar Typhi
cuccucaacagacau

SEQ ID NO: 1676079 - RNA, 15 nt, Salmonella enterica enterica serovar Typhi
cuccuaagagaaaac

SEQ ID NO: 1676080 - RNA, 13 nt, Salmonella enterica enterica serovar Typhi
cuccggcggguaa

SEQ ID NO: 1676081 - RNA, 13 nt, Salmonella enterica enterica serovar Typhi
cuccggacgcacc

SEQ ID NO: 1676082 - RNA, 19 nt, Salmonella enterica enterica serovar Typhi
cuccgcguaccucagcaug

SEQ ID NO: 1676083 - RNA, 16 nt, Salmonella enterica enterica serovar Typhi
cuccgcggggaucggu

SEQ ID NO: 1676084 - RNA, 12 nt, Salmonella enterica enterica serovar Typhi
cuccgacaacaa

SEQ ID NO: 1676085 - RNA, 16 nt, Salmonella enterica enterica serovar Typhi
cuccgaggaacgugag

SEQ ID NO: 1676086 - RNA, 19 nt, Salmonella enterica enterica serovar Typhi
cuccgaauaauccuucccg

SEQ ID NO: 1676087 - RNA, 21 nt, Salmonella enterica enterica serovar Typhi
cuccgaauaauccuucccgcu

SEQ ID NO: 1676088 - RNA, 18 nt, Salmonella enterica enterica serovar Typhi
cucgccgguagccagcca

SEQ ID NO: 1676089 - RNA, 16 nt, Salmonella enterica enterica serovar Typhi
cucgcgauccgccagc

SEQ ID NO: 1676090 - RNA, 13 nt, Salmonella enterica enterica serovar Typhi
cucgcgccgccug

SEQ ID NO: 1676091 - RNA, 14 nt, Salmonella enterica enterica serovar Typhi
cucgcgcaguucca

SEQ ID NO: 1676092 - RNA, 22 nt, Salmonella enterica enterica serovar Typhi
cucgcgcaucaggaucuucauc

SEQ ID NO: 1676093 - RNA, 12 nt, Salmonella enterica enterica serovar Typhi
cucgcgcaugac

SEQ ID NO: 1676094 - RNA, 14 nt, Salmonella enterica enterica serovar Typhi
cucgcccgccagau

SEQ ID NO: 1676095 - RNA, 20 nt, Salmonella enterica enterica serovar Typhi
cucgccgacggucaaacuga

SEQ ID NO: 1676096 - RNA, 19 nt, Salmonella enterica enterica serovar Typhi
cucgccgacaugcuccugc

SEQ ID NO: 1676097 - RNA, 17 nt, Salmonella enterica enterica serovar Typhi
cucgccgccucccccuc

SEQ ID NO: 1676098 - RNA, 18 nt, Salmonella enterica enterica serovar Typhi
cucgccgccucccccuca

SEQ ID NO: 1676099 - RNA, 20 nt, Salmonella enterica enterica serovar Typhi
cucgccacgguuggcccagc

SEQ ID NO: 1676100 - RNA, 17 nt, Salmonella enterica enterica serovar Typhi
cucgccaaugccgcagc

SEQ ID NO: 1676101 - RNA, 13 nt, Salmonella enterica enterica serovar Typhi
cucgccauaaaga

SEQ ID NO: 1676102 - RNA, 12 nt, Salmonella enterica enterica serovar Typhi
cucgccagugcg

SEQ ID NO: 1676103 - RNA, 11 nt, Salmonella enterica enterica serovar Typhi
cucgccagcgc

SEQ ID NO: 1676104 - RNA, 20 nt, Salmonella enterica enterica serovar Typhi
cucgcaugcauagccgcugc

SEQ ID NO: 1676105 - RNA, 14 nt, Salmonella enterica enterica serovar Typhi
cucgcauccuccau

SEQ ID NO: 1676106 - RNA, 20 nt, Salmonella enterica enterica serovar Typhi
cucgcacugauagccgccag

SEQ ID NO: 1676107 - RNA, 17 nt, Salmonella enterica enterica serovar Typhi
cucgcacuggcgagcgg

SEQ ID NO: 1676108 - RNA, 13 nt, Salmonella enterica enterica serovar Typhi
cucgcaaaacaug

SEQ ID NO: 1676109 - RNA, 15 nt, Salmonella enterica enterica serovar Typhi
cucgacgcacuccag

SEQ ID NO: 1676110 - RNA, 22 nt, Salmonella enterica enterica serovar Typhi
cucgauuccugacgcacagugu

SEQ ID NO: 1676111 - RNA, 17 nt, Salmonella enterica enterica serovar Typhi
cucgaccaguuuuuccg

SEQ ID NO: 1676112 - RNA, 12 nt, Salmonella enterica enterica serovar Typhi
cucgaagaugag

SEQ ID NO: 1676113 - RNA, 15 nt, Salmonella enterica enterica serovar Typhi
cucggucaacauucc

SEQ ID NO: 1676114 - RNA, 15 nt, Salmonella enterica enterica serovar Typhi
cucggugccgcugcu

SEQ ID NO: 1676115 - RNA, 19 nt, Salmonella enterica enterica serovar Typhi
cucgguggauaaauuuguc

SEQ ID NO: 1676116 - RNA, 17 nt, Salmonella enterica enterica serovar Typhi
cucggcggucagccaca

SEQ ID NO: 1676117 - RNA, 18 nt, Salmonella enterica enterica serovar Typhi
cucggcggucagccacau

SEQ ID NO: 1676118 - RNA, 18 nt, Salmonella enterica enterica serovar Typhi
cucgcgggcauacucucc

SEQ ID NO: 1676119 - RNA, 23 nt, Salmonella enterica enterica serovar Typhi
cucgcugauacgcuggcacagga

SEQ ID NO: 1676120 - RNA, 22 nt, Salmonella enterica enterica serovar Typhi
cucgcugauacgcuggcacagg

SEQ ID NO: 1676121 - RNA, 21 nt, Salmonella enterica enterica serovar Typhi
cucgcuggugccaaucuccag

SEQ ID NO: 1676122 - RNA, 19 nt, Salmonella enterica enterica serovar Typhi
cucgcuguauuucccucuc

SEQ ID NO: 1676123 - RNA, 23 nt, Salmonella enterica enterica serovar Typhi
cucgcuuaaaccaccauacccag

SEQ ID NO: 1676124 - RNA, 22 nt, Salmonella enterica enterica serovar Typhi
cucuaaaucuuuuugugcaauc

SEQ ID NO: 1676125 - RNA, 22 nt, Salmonella enterica enterica serovar Typhi
cucuaacgucagcgccacccau

SEQ ID NO: 1676126 - RNA, 24 nt, Salmonella enterica enterica serovar Typhi
cucuaacgucagcgccacccauuu

SEQ ID NO: 1676127 - RNA, 19 nt, Salmonella enterica enterica serovar Typhi
cucguucgauagcguuuuc

SEQ ID NO: 1676128 - RNA, 13 nt, Salmonella enterica enterica serovar Typhi
cucuaaaaaggaa

SEQ ID NO: 1676129 - RNA, 14 nt, Salmonella enterica enterica serovar Typhi
cucguguaaggcuu

SEQ ID NO: 1676130 - RNA, 21 nt, Salmonella enterica enterica serovar Typhi
cucguguaaggcuuccggcag

SEQ ID NO: 1676131 - RNA, 19 nt, Salmonella enterica enterica serovar Typhi
cucgucuguuuugccuugc

SEQ ID NO: 1676132 - RNA, 11 nt, Salmonella enterica enterica serovar Typhi
cuauuuuucac

SEQ ID NO: 1676133 - RNA, 13 nt, Salmonella enterica enterica serovar Typhi
cuauuugcagauu

SEQ ID NO: 1676134 - RNA, 14 nt, Salmonella enterica enterica serovar Typhi
cuauuuccagaaau

SEQ ID NO: 1676135 - RNA, 23 nt, Salmonella enterica enterica serovar Typhi
cuauuuucuacucgggccagcuc

SEQ ID NO: 1676136 - RNA, 13 nt, Salmonella enterica enterica serovar Typhi
cuauuuucucuuc

SEQ ID NO: 1676137 - RNA, 19 nt, Salmonella enterica enterica serovar Typhi
cuauuuucucuuccacaaa

SEQ ID NO: 1676138 - RNA, 19 nt, Salmonella enterica enterica serovar Typhi
cuauuuuaaauucccagcg

SEQ ID NO: 1676139 - RNA, 17 nt, Salmonella enterica enterica serovar Typhi
cuauuuaacccugguuu

SEQ ID NO: 1676140 - RNA, 22 nt, Salmonella enterica enterica serovar Typhi
cuauuucaguacagccaaaaau

SEQ ID NO: 1676141 - RNA, 13 nt, Salmonella enterica enterica serovar Typhi
cuauucuucaucg

SEQ ID NO: 1676142 - RNA, 19 nt, Salmonella enterica enterica serovar Typhi
cuauugaaaaagccgcgcc

SEQ ID NO: 1676143 - RNA, 21 nt, Salmonella enterica enterica serovar Typhi
cuauuccuguauaauuauuug

SEQ ID NO: 1676144 - RNA, 17 nt, Salmonella enterica enterica serovar Typhi
cuauugccuaaauaacu

SEQ ID NO: 1676145 - RNA, 22 nt, Salmonella enterica enterica serovar Typhi
cuaucugacagccaaacugcug

SEQ ID NO: 1676146 - RNA, 23 nt, Salmonella enterica enterica serovar Typhi
cuauagaaugcaagcagcauaau

SEQ ID NO: 1676147 - RNA, 17 nt, Salmonella enterica enterica serovar Typhi
cuauagagagauggaac

SEQ ID NO: 1676148 - RNA, 20 nt, Salmonella enterica enterica serovar Typhi
cuaugaagagaaacauacug

SEQ ID NO: 1676149 - RNA, 14 nt, Salmonella enterica enterica serovar Typhi
cuaucuucgauaaa

SEQ ID NO: 1676150 - RNA, 13 nt, Salmonella enterica enterica serovar Typhi
cuaugauaagccu

SEQ ID NO: 1676151 - RNA, 23 nt, Salmonella enterica enterica serovar Typhi
cuauggcggagggauuuuaaacc

SEQ ID NO: 1676152 - RNA, 14 nt, Salmonella enterica enterica serovar Typhi
cuauucccaggcaa

SEQ ID NO: 1676153 - RNA, 16 nt, Salmonella enterica enterica serovar Typhi
cuauuccaguuuuuau

SEQ ID NO: 1676154 - RNA, 12 nt, Salmonella enterica enterica serovar Typhi
cuauucagcagu

SEQ ID NO: 1676155 - RNA, 20 nt, Salmonella enterica enterica serovar Typhi
cuauuaguucugaggcuauu

SEQ ID NO: 1676156 - RNA, 13 nt, Salmonella enterica enterica serovar Typhi
cuauuaucagaau

SEQ ID NO: 1676157 - RNA, 17 nt, Salmonella enterica enterica serovar Typhi
cuauuaguucugaggcu

SEQ ID NO: 1676158 - RNA, 22 nt, Salmonella enterica enterica serovar Typhi
cucaauccuucuaccuucaccc

SEQ ID NO: 1676159 - RNA, 15 nt, Salmonella enterica enterica serovar Typhi
cucaaucugaugaug

SEQ ID NO: 1676160 - RNA, 15 nt, Salmonella enterica enterica serovar Typhi
cucaaugauuuccgc

SEQ ID NO: 1676161 - RNA, 23 nt, Salmonella enterica enterica serovar Typhi
cucaccaguccggcagaaagcag

SEQ ID NO: 1676162 - RNA, 21 nt, Salmonella enterica enterica serovar Typhi
cucacccauuuuauccucuuc

SEQ ID NO: 1676163 - RNA, 13 nt, Salmonella enterica enterica serovar Typhi
cucaccaccgccg

SEQ ID NO: 1676164 - RNA, 14 nt, Salmonella enterica enterica serovar Typhi
cucaccaguagcgc

SEQ ID NO: 1676165 - RNA, 22 nt, Salmonella enterica enterica serovar Typhi
cucaccaguagcgcgacgccaa

SEQ ID NO: 1676166 - RNA, 14 nt, Salmonella enterica enterica serovar Typhi
cucaauuuuacagc

SEQ ID NO: 1676167 - RNA, 16 nt, Salmonella enterica enterica serovar Typhi
cucagccagaaacggu

SEQ ID NO: 1676168 - RNA, 14 nt, Salmonella enterica enterica serovar Typhi
cucagcuugcgcug

SEQ ID NO: 1676169 - RNA, 23 nt, Salmonella enterica enterica serovar Typhi
cucagcgccacgcccaacauaaa

SEQ ID NO: 1676170 - RNA, 21 nt, Salmonella enterica enterica serovar Typhi
cucacgcuuaucgccaaacca

SEQ ID NO: 1676171 - RNA, 18 nt, Salmonella enterica enterica serovar Typhi
cucacgcucauagccgcu

SEQ ID NO: 1676172 - RNA, 14 nt, Salmonella enterica enterica serovar Typhi
cucacggucuccug

SEQ ID NO: 1676173 - RNA, 18 nt, Salmonella enterica enterica serovar Typhi
cucacuuuucuuuccugc

SEQ ID NO: 1676174 - RNA, 20 nt, Salmonella enterica enterica serovar Typhi
cucagaaaauuauuuuaaau

SEQ ID NO: 1676175 - RNA, 13 nt, Salmonella enterica enterica serovar Typhi
cucagccacccac

SEQ ID NO: 1676176 - RNA, 23 nt, Salmonella enterica enterica serovar Typhi
cucagcauagcgcugaaacggga

SEQ ID NO: 1676177 - RNA, 14 nt, Salmonella enterica enterica serovar Typhi
cuaggaacagugac

SEQ ID NO: 1676178 - RNA, 14 nt, Salmonella enterica enterica serovar Typhi
cuauaaaccacggu

SEQ ID NO: 1676179 - RNA, 22 nt, Salmonella enterica enterica serovar Typhi
cuauaaguacgcggucgccugc

SEQ ID NO: 1676180 - RNA, 11 nt, Salmonella enterica enterica serovar Typhi
cuauaaaaauc

SEQ ID NO: 1676181 - RNA, 17 nt, Salmonella enterica enterica serovar Typhi
cuacgcuuauccggcuu

SEQ ID NO: 1676182 - RNA, 18 nt, Salmonella enterica enterica serovar Typhi
cuacgcuucguauuucuu

SEQ ID NO: 1676183 - RNA, 14 nt, Salmonella enterica enterica serovar Typhi
cuacggcccuggcu

SEQ ID NO: 1676184 - RNA, 16 nt, Salmonella enterica enterica serovar Typhi
cuacggcccuggcuca

SEQ ID NO: 1676185 - RNA, 15 nt, Salmonella enterica enterica serovar Typhi
cuacgguaaaccagg

SEQ ID NO: 1676186 - RNA, 14 nt, Salmonella enterica enterica serovar Typhi
cuacguuccaugcg

SEQ ID NO: 1676187 - RNA, 19 nt, Salmonella enterica enterica serovar Typhi
cuacguugaccucaucacc

SEQ ID NO: 1676188 - RNA, 13 nt, Salmonella enterica enterica serovar Typhi
cuacguucaucag

SEQ ID NO: 1676189 - RNA, 22 nt, Salmonella enterica enterica serovar Typhi
cuagccgccguguugugugccg

SEQ ID NO: 1676190 - RNA, 21 nt, Salmonella enterica enterica serovar Typhi
cuagccaauaaucgaaauaaa

SEQ ID NO: 1676191 - RNA, 13 nt, Salmonella enterica enterica serovar Typhi
cuagaacauuucc

SEQ ID NO: 1676192 - RNA, 22 nt, Salmonella enterica enterica serovar Typhi
cuacaccugggcuugcuuuucu

SEQ ID NO: 1676193 - RNA, 16 nt, Salmonella enterica enterica serovar Typhi
cuacacgucuccucag

SEQ ID NO: 1676194 - RNA, 18 nt, Salmonella enterica enterica serovar Typhi
cuacaccguauccggccu

SEQ ID NO: 1676195 - RNA, 19 nt, Salmonella enterica enterica serovar Typhi
cuacaccguauccggccug

SEQ ID NO: 1676196 - RNA, 20 nt, Salmonella enterica enterica serovar Typhi
cuacaaucgugugaugcacc

SEQ ID NO: 1676197 - RNA, 20 nt, Salmonella enterica enterica serovar Typhi
cuacaauggaaaaaucugua

SEQ ID NO: 1676198 - RNA, 16 nt, Salmonella enterica enterica serovar Typhi
cuaccugcgagcugua

SEQ ID NO: 1676199 - RNA, 19 nt, Salmonella enterica enterica serovar Typhi
cuaccgucgacgucuuucu

SEQ ID NO: 1676200 - RNA, 14 nt, Salmonella enterica enterica serovar Typhi
cuaccgggcaaaca

SEQ ID NO: 1676201 - RNA, 17 nt, Salmonella enterica enterica serovar Typhi
cuaccggggcgcucgcc

SEQ ID NO: 1676202 - RNA, 20 nt, Salmonella enterica enterica serovar Typhi
cuaccgcucaggcgcgcgcu

SEQ ID NO: 1676203 - RNA, 15 nt, Salmonella enterica enterica serovar Typhi
cuaccgccaccaucg

SEQ ID NO: 1676204 - RNA, 14 nt, Salmonella enterica enterica serovar Typhi
cuaccgaggcaggg

SEQ ID NO: 1676205 - RNA, 23 nt, Salmonella enterica enterica serovar Typhi
cuacccagacaagcacauaacug

SEQ ID NO: 1676206 - RNA, 14 nt, Salmonella enterica enterica serovar Typhi
cuaccaggcaaagc

SEQ ID NO: 1676207 - RNA, 16 nt, Salmonella enterica enterica serovar Typhi
cuaccaacugagcuaa

SEQ ID NO: 1676208 - RNA, 18 nt, Salmonella enterica enterica serovar Typhi
cuaccaauuccaccaccu

SEQ ID NO: 1676209 - RNA, 17 nt, Salmonella enterica enterica serovar Typhi
cuaccaacaaaucauuu

SEQ ID NO: 1676210 - RNA, 20 nt, Salmonella enterica enterica serovar Typhi
cuaccacccagccagacgcc

SEQ ID NO: 1676211 - RNA, 19 nt, Salmonella enterica enterica serovar Typhi
cuaccacucccaaauuuug

SEQ ID NO: 1676212 - RNA, 16 nt, Salmonella enterica enterica serovar Typhi
cguaccgaagaacaua

SEQ ID NO: 1676213 - RNA, 18 nt, Salmonella enterica enterica serovar Typhi
cguaccgcguuuaacgca

SEQ ID NO: 1676214 - RNA, 21 nt, Salmonella enterica enterica serovar Typhi
cguacccggcuuacaacauug

SEQ ID NO: 1676215 - RNA, 17 nt, Salmonella enterica enterica serovar Typhi
cguacgccuaaaugaac

SEQ ID NO: 1676216 - RNA, 20 nt, Salmonella enterica enterica serovar Typhi
cguaccgucuggcgaggcgc

SEQ ID NO: 1676217 - RNA, 16 nt, Salmonella enterica enterica serovar Typhi
cguaccugcgcgcagg

SEQ ID NO: 1676218 - RNA, 19 nt, Salmonella enterica enterica serovar Typhi
cguacucggauagcuacga

SEQ ID NO: 1676219 - RNA, 22 nt, Salmonella enterica enterica serovar Typhi
cguacucagaucggcagacagu

SEQ ID NO: 1676220 - RNA, 21 nt, Salmonella enterica enterica serovar Typhi
cguacucuaggcgcugcuggc

SEQ ID NO: 1676221 - RNA, 22 nt, Salmonella enterica enterica serovar Typhi
cguacucuaggcgcugcuggca

SEQ ID NO: 1676222 - RNA, 15 nt, Salmonella enterica enterica serovar Typhi
cguacggcugccuuu

SEQ ID NO: 1676223 - RNA, 14 nt, Salmonella enterica enterica serovar Typhi
cguacggcuucaau

SEQ ID NO: 1676224 - RNA, 14 nt, Salmonella enterica enterica serovar Typhi
cguaccaggcagcg

SEQ ID NO: 1676225 - RNA, 17 nt, Salmonella enterica enterica serovar Typhi
cguaccaggcagcgcgc

SEQ ID NO: 1676226 - RNA, 21 nt, Salmonella enterica enterica serovar Typhi
cguacacaggggccacaggcg

SEQ ID NO: 1676227 - RNA, 15 nt, Salmonella enterica enterica serovar Typhi
cguacaugaauaaua

SEQ ID NO: 1676228 - RNA, 19 nt, Salmonella enterica enterica serovar Typhi
cguacaggcggaaaucaac

SEQ ID NO: 1676229 - RNA, 17 nt, Salmonella enterica enterica serovar Typhi
cguacauaacagcagca

SEQ ID NO: 1676230 - RNA, 15 nt, Salmonella enterica enterica serovar Typhi
cguaauugcgccugg

SEQ ID NO: 1676231 - RNA, 17 nt, Salmonella enterica enterica serovar Typhi
cguaauuguugccccgc

SEQ ID NO: 1676232 - RNA, 18 nt, Salmonella enterica enterica serovar Typhi
cguaauuugcgacauggc

SEQ ID NO: 1676233 - RNA, 22 nt, Salmonella enterica enterica serovar Typhi
cguaauuaaccgcgccgcuggc

SEQ ID NO: 1676234 - RNA, 20 nt, Salmonella enterica enterica serovar Typhi
cguaguagguauccagcaga

SEQ ID NO: 1676235 - RNA, 20 nt, Salmonella enterica enterica serovar Typhi
cguauccccagucuuccugc

SEQ ID NO: 1676236 - RNA, 17 nt, Salmonella enterica enterica serovar Typhi
cguaucgcccagauggc

SEQ ID NO: 1676237 - RNA, 22 nt, Salmonella enterica enterica serovar Typhi
cguaggccugauaagcgcagcg

SEQ ID NO: 1676238 - RNA, 13 nt, Salmonella enterica enterica serovar Typhi
cguagguaagaua

SEQ ID NO: 1676239 - RNA, 19 nt, Salmonella enterica enterica serovar Typhi
cguaggguagaucacgcca

SEQ ID NO: 1676240 - RNA, 17 nt, Salmonella enterica enterica serovar Typhi
cguagaacagcaugaau

SEQ ID NO: 1676241 - RNA, 15 nt, Salmonella enterica enterica serovar Typhi
cguagaacgggccga

SEQ ID NO: 1676242 - RNA, 15 nt, Salmonella enterica enterica serovar Typhi
cguagaucuuuugcg

SEQ ID NO: 1676243 - RNA, 17 nt, Salmonella enterica enterica serovar Typhi
cguagccgaacaguuuc

SEQ ID NO: 1676244 - RNA, 16 nt, Salmonella enterica enterica serovar Typhi
cguagccgcagaacca

SEQ ID NO: 1676245 - RNA, 18 nt, Salmonella enterica enterica serovar Typhi
cguagccgcagaaccauu

SEQ ID NO: 1676246 - RNA, 19 nt, Salmonella enterica enterica serovar Typhi
cguagcccagcgccgcauc

SEQ ID NO: 1676247 - RNA, 12 nt, Salmonella enterica enterica serovar Typhi
cguagcagcgcg

SEQ ID NO: 1676248 - RNA, 12 nt, Salmonella enterica enterica serovar Typhi
cguagcaaauag

SEQ ID NO: 1676249 - RNA, 14 nt, Salmonella enterica enterica serovar Typhi
cguagccgcgcgcc

SEQ ID NO: 1676250 - RNA, 12 nt, Salmonella enterica enterica serovar Typhi
cguccgccuccg

SEQ ID NO: 1676251 - RNA, 18 nt, Salmonella enterica enterica serovar Typhi
cguccgcagccgacgcau

SEQ ID NO: 1676252 - RNA, 16 nt, Salmonella enterica enterica serovar Typhi
cguccgccagaugcac

SEQ ID NO: 1676253 - RNA, 12 nt, Salmonella enterica enterica serovar Typhi
cguccgccaggc

SEQ ID NO: 1676254 - RNA, 14 nt, Salmonella enterica enterica serovar Typhi
cguccgccaggccc

SEQ ID NO: 1676255 - RNA, 19 nt, Salmonella enterica enterica serovar Typhi
cgucccuuucccuuccagc

SEQ ID NO: 1676256 - RNA, 13 nt, Salmonella enterica enterica serovar Typhi
cgucccucgccgg

SEQ ID NO: 1676257 - RNA, 19 nt, Salmonella enterica enterica serovar Typhi
cgucccguuuuucccgcug

SEQ ID NO: 1676258 - RNA, 22 nt, Salmonella enterica enterica serovar Typhi
cguccagccagcguuucuggaa

SEQ ID NO: 1676259 - RNA, 22 nt, Salmonella enterica enterica serovar Typhi
cguccagauacgcgccggccgg

SEQ ID NO: 1676260 - RNA, 16 nt, Salmonella enterica enterica serovar Typhi
cguccccguucugacc

SEQ ID NO: 1676261 - RNA, 13 nt, Salmonella enterica enterica serovar Typhi
cgucauuuaccag

SEQ ID NO: 1676262 - RNA, 21 nt, Salmonella enterica enterica serovar Typhi
cgucauugaccggaaaaaaau

SEQ ID NO: 1676263 - RNA, 18 nt, Salmonella enterica enterica serovar Typhi
cgucaucgggcuguuauu

SEQ ID NO: 1676264 - RNA, 14 nt, Salmonella enterica enterica serovar Typhi
cguccacucuuccg

SEQ ID NO: 1676265 - RNA, 19 nt, Salmonella enterica enterica serovar Typhi
cguccacucuuccgggcga

SEQ ID NO: 1676266 - RNA, 21 nt, Salmonella enterica enterica serovar Typhi
cguccacacgccuggccaggc

SEQ ID NO: 1676267 - RNA, 13 nt, Salmonella enterica enterica serovar Typhi
cguccacauccag

SEQ ID NO: 1676268 - RNA, 18 nt, Salmonella enterica enterica serovar Typhi
cguccacauccagcgcca

SEQ ID NO: 1676269 - RNA, 16 nt, Salmonella enterica enterica serovar Typhi
cgucagcacgccgccc

SEQ ID NO: 1676270 - RNA, 18 nt, Salmonella enterica enterica serovar Typhi
cgucaggaucguaacagg

SEQ ID NO: 1676271 - RNA, 22 nt, Salmonella enterica enterica serovar Typhi
cgucagaugcguuuucugcauu

SEQ ID NO: 1676272 - RNA, 19 nt, Salmonella enterica enterica serovar Typhi
cgucagacggcuccagcgc

SEQ ID NO: 1676273 - RNA, 21 nt, Salmonella enterica enterica serovar Typhi
cgucaggccgccgcaaaagcc

SEQ ID NO: 1676274 - RNA, 14 nt, Salmonella enterica enterica serovar Typhi
cgucauccugcagg

SEQ ID NO: 1676275 - RNA, 17 nt, Salmonella enterica enterica serovar Typhi
cguauucggaauaaugu

SEQ ID NO: 1676276 - RNA, 20 nt, Salmonella enterica enterica serovar Typhi
cguaucggugcguuuaaaga

SEQ ID NO: 1676277 - RNA, 17 nt, Salmonella enterica enterica serovar Typhi
cguaucugucccagccu

SEQ ID NO: 1676278 - RNA, 15 nt, Salmonella enterica enterica serovar Typhi
cguauucuuacccac

SEQ ID NO: 1676279 - RNA, 16 nt, Salmonella enterica enterica serovar Typhi
cgucaaaacagauucc

SEQ ID NO: 1676280 - RNA, 17 nt, Salmonella enterica enterica serovar Typhi
cguauuucacuuuugcc

SEQ ID NO: 1676281 - RNA, 14 nt, Salmonella enterica enterica serovar Typhi
cgucacgaccggcg

SEQ ID NO: 1676282 - RNA, 15 nt, Salmonella enterica enterica serovar Typhi
cgucaccgaauagcg

SEQ ID NO: 1676283 - RNA, 15 nt, Salmonella enterica enterica serovar Typhi
cgucaccgggcugca

SEQ ID NO: 1676284 - RNA, 13 nt, Salmonella enterica enterica serovar Typhi
cgugccuuccgca

SEQ ID NO: 1676285 - RNA, 22 nt, Salmonella enterica enterica serovar Typhi
cgugccguagaaaaugcgcugg

SEQ ID NO: 1676286 - RNA, 18 nt, Salmonella enterica enterica serovar Typhi
cgugcucucaccaucaua

SEQ ID NO: 1676287 - RNA, 18 nt, Salmonella enterica enterica serovar Typhi
cgugcucuucguggaacu

SEQ ID NO: 1676288 - RNA, 20 nt, Salmonella enterica enterica serovar Typhi
cgugcugaucccgcgcgccu

SEQ ID NO: 1676289 - RNA, 14 nt, Salmonella enterica enterica serovar Typhi
cgugccgaccagcg

SEQ ID NO: 1676290 - RNA, 22 nt, Salmonella enterica enterica serovar Typhi
cgugauugagcagaucagcacg

SEQ ID NO: 1676291 - RNA, 22 nt, Salmonella enterica enterica serovar Typhi
cgugagcugucgcucgcggcag

SEQ ID NO: 1676292 - RNA, 15 nt, Salmonella enterica enterica serovar Typhi
cgugaggcugaagcg

SEQ ID NO: 1676293 - RNA, 17 nt, Salmonella enterica enterica serovar Typhi
cgugagcgcgucaucau

SEQ ID NO: 1676294 - RNA, 19 nt, Salmonella enterica enterica serovar Typhi
cgugcaaaaucacgcggcg

SEQ ID NO: 1676295 - RNA, 13 nt, Salmonella enterica enterica serovar Typhi
cgugcagcgccgc

SEQ ID NO: 1676296 - RNA, 17 nt, Salmonella enterica enterica serovar Typhi
cgugcaguuuugcuuca

SEQ ID NO: 1676297 - RNA, 14 nt, Salmonella enterica enterica serovar Typhi
cgugaauauggaaa

SEQ ID NO: 1676298 - RNA, 19 nt, Salmonella enterica enterica serovar Typhi
cgugaaugguuucccaggu

SEQ ID NO: 1676299 - RNA, 19 nt, Salmonella enterica enterica serovar Typhi
cgugaauguccugcggcac

SEQ ID NO: 1676300 - RNA, 21 nt, Salmonella enterica enterica serovar Typhi
cgugagccgaaauccaccagc

SEQ ID NO: 1676301 - RNA, 13 nt, Salmonella enterica enterica serovar Typhi
cgugagcgcgccg

SEQ ID NO: 1676302 - RNA, 17 nt, Salmonella enterica enterica serovar Typhi
cgugagccggacacugc

SEQ ID NO: 1676303 - RNA, 20 nt, Salmonella enterica enterica serovar Typhi
cgugaauugcgguuuauccc

SEQ ID NO: 1676304 - RNA, 22 nt, Salmonella enterica enterica serovar Typhi
cgugagaucguuauuaaacaga

SEQ ID NO: 1676305 - RNA, 21 nt, Salmonella enterica enterica serovar Typhi
cgucuccggcgcgccgcuggc

SEQ ID NO: 1676306 - RNA, 13 nt, Salmonella enterica enterica serovar Typhi
cgucuauagauga

SEQ ID NO: 1676307 - RNA, 18 nt, Salmonella enterica enterica serovar Typhi
cgucuggcgaaaacggcg

SEQ ID NO: 1676308 - RNA, 19 nt, Salmonella enterica enterica serovar Typhi
cgucugguacggccaccag

SEQ ID NO: 1676309 - RNA, 15 nt, Salmonella enterica enterica serovar Typhi
cgucuguguuuaucc

SEQ ID NO: 1676310 - RNA, 18 nt, Salmonella enterica enterica serovar Typhi
cgucugcugaaaugccug

SEQ ID NO: 1676311 - RNA, 16 nt, Salmonella enterica enterica serovar Typhi
cgucggugcccggcug

SEQ ID NO: 1676312 - RNA, 16 nt, Salmonella enterica enterica serovar Typhi
cgucggugcugccgcu

SEQ ID NO: 1676313 - RNA, 23 nt, Salmonella enterica enterica serovar Typhi
cgucgggccgcgcugcgccugcu

SEQ ID NO: 1676314 - RNA, 14 nt, Salmonella enterica enterica serovar Typhi
cgucggucgcguag

SEQ ID NO: 1676315 - RNA, 23 nt, Salmonella enterica enterica serovar Typhi
cgucgucaaaggaauagccgcgc

SEQ ID NO: 1676316 - RNA, 17 nt, Salmonella enterica enterica serovar Typhi
cgucguccacucuuccg

SEQ ID NO: 1676317 - RNA, 19 nt, Salmonella enterica enterica serovar Typhi
cgucgugcugggcgcgccu

SEQ ID NO: 1676318 - RNA, 17 nt, Salmonella enterica enterica serovar Typhi
cgucgugcagcgccgcc

SEQ ID NO: 1676319 - RNA, 21 nt, Salmonella enterica enterica serovar Typhi
cgucgugaguggcggcgcgca

SEQ ID NO: 1676320 - RNA, 17 nt, Salmonella enterica enterica serovar Typhi
cgucguuucguguuguc

SEQ ID NO: 1676321 - RNA, 16 nt, Salmonella enterica enterica serovar Typhi
cgucgcgcgccgccuc

SEQ ID NO: 1676322 - RNA, 16 nt, Salmonella enterica enterica serovar Typhi
cgucgccauccggcga

SEQ ID NO: 1676323 - RNA, 22 nt, Salmonella enterica enterica serovar Typhi
cgucgccauauccaagccccuc

SEQ ID NO: 1676324 - RNA, 20 nt, Salmonella enterica enterica serovar Typhi
cgucgccaaagcagcugcug

SEQ ID NO: 1676325 - RNA, 14 nt, Salmonella enterica enterica serovar Typhi
cgucggcaccauuc

SEQ ID NO: 1676326 - RNA, 23 nt, Salmonella enterica enterica serovar Typhi
cuaacgcaacggaaggaaauaac

SEQ ID NO: 1676327 - RNA, 17 nt, Salmonella enterica enterica serovar Typhi
cuaacgaaaccggcggc

SEQ ID NO: 1676328 - RNA, 19 nt, Salmonella enterica enterica serovar Typhi
cuaacgccugauccggccu

SEQ ID NO: 1676329 - RNA, 14 nt, Salmonella enterica enterica serovar Typhi
cuaacgcucuucuc

SEQ ID NO: 1676330 - RNA, 20 nt, Salmonella enterica enterica serovar Typhi
cuaacugguacguccauccg

SEQ ID NO: 1676331 - RNA, 14 nt, Salmonella enterica enterica serovar Typhi
cuaacuggaaaaag

SEQ ID NO: 1676332 - RNA, 17 nt, Salmonella enterica enterica serovar Typhi
cuaacucaauaacgacu

SEQ ID NO: 1676333 - RNA, 23 nt, Salmonella enterica enterica serovar Typhi
cuaaaccgucauuuaccagugcu

SEQ ID NO: 1676334 - RNA, 20 nt, Salmonella enterica enterica serovar Typhi
cuaaaccagauguacagaau

SEQ ID NO: 1676335 - RNA, 13 nt, Salmonella enterica enterica serovar Typhi
cuaaaccacggaa

SEQ ID NO: 1676336 - RNA, 21 nt, Salmonella enterica enterica serovar Typhi
cuaaaccacaugaccagcgcc

SEQ ID NO: 1676337 - RNA, 16 nt, Salmonella enterica enterica serovar Typhi
cuaaaccuucgcuuuu

SEQ ID NO: 1676338 - RNA, 16 nt, Salmonella enterica enterica serovar Typhi
cuaauaaaauaacuau

SEQ ID NO: 1676339 - RNA, 18 nt, Salmonella enterica enterica serovar Typhi
cuaauaaaauaacuauaa

SEQ ID NO: 1676340 - RNA, 20 nt, Salmonella enterica enterica serovar Typhi
cuaauaaaauaacuauaauu

SEQ ID NO: 1676341 - RNA, 14 nt, Salmonella enterica enterica serovar Typhi
cuaaguaaggagga

SEQ ID NO: 1676342 - RNA, 20 nt, Salmonella enterica enterica serovar Typhi
cuaagggguugaugccgacc

SEQ ID NO: 1676343 - RNA, 16 nt, Salmonella enterica enterica serovar Typhi
cuaagccggcaggcag

SEQ ID NO: 1676344 - RNA, 12 nt, Salmonella enterica enterica serovar Typhi
cuaagccagaag

SEQ ID NO: 1676345 - RNA, 21 nt, Salmonella enterica enterica serovar Typhi
cuaagagccugucccaccagg

SEQ ID NO: 1676346 - RNA, 21 nt, Salmonella enterica enterica serovar Typhi
cuaagagugacgguuuucacu

SEQ ID NO: 1676347 - RNA, 14 nt, Salmonella enterica enterica serovar Typhi
cuaagaccagcauc

SEQ ID NO: 1676348 - RNA, 13 nt, Salmonella enterica enterica serovar Typhi
cuaagagaaaacc

SEQ ID NO: 1676349 - RNA, 18 nt, Salmonella enterica enterica serovar Typhi
cuaagaccagcaccaucu

SEQ ID NO: 1676350 - RNA, 19 nt, Salmonella enterica enterica serovar Typhi
cuaauuaaucugucgaugc

SEQ ID NO: 1676351 - RNA, 14 nt, Salmonella enterica enterica serovar Typhi
cuaauuaauucuaa

SEQ ID NO: 1676352 - RNA, 12 nt, Salmonella enterica enterica serovar Typhi
cuaauuaucugc

SEQ ID NO: 1676353 - RNA, 12 nt, Salmonella enterica enterica serovar Typhi
cuaauuccagga

SEQ ID NO: 1676354 - RNA, 13 nt, Salmonella enterica enterica serovar Typhi
cuaauuguuugua

SEQ ID NO: 1676355 - RNA, 18 nt, Salmonella enterica enterica serovar Typhi
cuaauuuuacuuucauuc

SEQ ID NO: 1676356 - RNA, 13 nt, Salmonella enterica enterica serovar Typhi
cuaauuucaauuu

SEQ ID NO: 1676357 - RNA, 14 nt, Salmonella enterica enterica serovar Typhi
cuaauuucaauuuu

SEQ ID NO: 1676358 - RNA, 13 nt, Salmonella enterica enterica serovar Typhi
cuaauuuuacuuu

SEQ ID NO: 1676359 - RNA, 15 nt, Salmonella enterica enterica serovar Typhi
cuaauuuucagggug

SEQ ID NO: 1676360 - RNA, 22 nt, Salmonella enterica enterica serovar Typhi
cuaauaaauauucaucaaaaug

SEQ ID NO: 1676361 - RNA, 16 nt, Salmonella enterica enterica serovar Typhi
cuaauaccgagaaugc

SEQ ID NO: 1676362 - RNA, 15 nt, Salmonella enterica enterica serovar Typhi
cuaauggcaauaaua

SEQ ID NO: 1676363 - RNA, 19 nt, Salmonella enterica enterica serovar Typhi
cuaaugggccagauucuua

SEQ ID NO: 1676364 - RNA, 16 nt, Salmonella enterica enterica serovar Typhi
cuaaugauuaucuuuu

SEQ ID NO: 1676365 - RNA, 17 nt, Salmonella enterica enterica serovar Typhi
cuaaugacauagugcaa

SEQ ID NO: 1676366 - RNA, 17 nt, Salmonella enterica enterica serovar Typhi
cuaaugagccagaugga

SEQ ID NO: 1676367 - RNA, 23 nt, Salmonella enterica enterica serovar Typhi
cuaaucgccacgacgcugguucc

SEQ ID NO: 1676368 - RNA, 22 nt, Salmonella enterica enterica serovar Typhi
cuaauccccauuuuuuucagcc

SEQ ID NO: 1676369 - RNA, 16 nt, Salmonella enterica enterica serovar Typhi
cguuguccagcggcca

SEQ ID NO: 1676370 - RNA, 21 nt, Salmonella enterica enterica serovar Typhi
cguugucauggcgccaccagc

SEQ ID NO: 1676371 - RNA, 14 nt, Salmonella enterica enterica serovar Typhi
cguuguccagcaga

SEQ ID NO: 1676372 - RNA, 13 nt, Salmonella enterica enterica serovar Typhi
cguuguauaaaca

SEQ ID NO: 1676373 - RNA, 15 nt, Salmonella enterica enterica serovar Typhi
cguugugcaagcuca

SEQ ID NO: 1676374 - RNA, 21 nt, Salmonella enterica enterica serovar Typhi
cguugugcuccagcgugugau

SEQ ID NO: 1676375 - RNA, 17 nt, Salmonella enterica enterica serovar Typhi
cguuguguccagggugu

SEQ ID NO: 1676376 - RNA, 16 nt, Salmonella enterica enterica serovar Typhi
cguugccagcggccag

SEQ ID NO: 1676377 - RNA, 22 nt, Salmonella enterica enterica serovar Typhi
cguugaugugcccguuccaggc

SEQ ID NO: 1676378 - RNA, 21 nt, Salmonella enterica enterica serovar Typhi
cguugauguuuuuaaaagaag

SEQ ID NO: 1676379 - RNA, 13 nt, Salmonella enterica enterica serovar Typhi
cguuucuacaaua

SEQ ID NO: 1676380 - RNA, 16 nt, Salmonella enterica enterica serovar Typhi
cguuucucgcgaccag

SEQ ID NO: 1676381 - RNA, 20 nt, Salmonella enterica enterica serovar Typhi
cguuuuaacgucauuaccag

SEQ ID NO: 1676382 - RNA, 13 nt, Salmonella enterica enterica serovar Typhi
cguuuguaacagc

SEQ ID NO: 1676383 - RNA, 21 nt, Salmonella enterica enterica serovar Typhi
cguuuguaacagcaggacccg

SEQ ID NO: 1676384 - RNA, 18 nt, Salmonella enterica enterica serovar Typhi
cguuucgauaaccaccag

SEQ ID NO: 1676385 - RNA, 22 nt, Salmonella enterica enterica serovar Typhi
cguuucgauaaccaccagcgga

SEQ ID NO: 1676386 - RNA, 16 nt, Salmonella enterica enterica serovar Typhi
cguuucgccaguuuac

SEQ ID NO: 1676387 - RNA, 15 nt, Salmonella enterica enterica serovar Typhi
cguuguuuggguaac

SEQ ID NO: 1676388 - RNA, 22 nt, Salmonella enterica enterica serovar Typhi
cguuuuucugaagcguaacagc

SEQ ID NO: 1676389 - RNA, 18 nt, Salmonella enterica enterica serovar Typhi
cguuuuucccgcuggcug

SEQ ID NO: 1676390 - RNA, 15 nt, Salmonella enterica enterica serovar Typhi
cguuuuucucaucaa

SEQ ID NO: 1676391 - RNA, 15 nt, Salmonella enterica enterica serovar Typhi
cguuuuccagcucac

SEQ ID NO: 1676392 - RNA, 20 nt, Salmonella enterica enterica serovar Typhi
cguuuucccggcaauuaccg

SEQ ID NO: 1676393 - RNA, 13 nt, Salmonella enterica enterica serovar Typhi
cguuuucaauaau

SEQ ID NO: 1676394 - RNA, 15 nt, Salmonella enterica enterica serovar Typhi
cguuuucaugcacga

SEQ ID NO: 1676395 - RNA, 17 nt, Salmonella enterica enterica serovar Typhi
cguuuugcgacuucaga

SEQ ID NO: 1676396 - RNA, 13 nt, Salmonella enterica enterica serovar Typhi
cguuuugcucuuc

SEQ ID NO: 1676397 - RNA, 20 nt, Salmonella enterica enterica serovar Typhi
cguuuugcucuucuuccggc

SEQ ID NO: 1676398 - RNA, 16 nt, Salmonella enterica enterica serovar Typhi
cguuuucgucaacaua

SEQ ID NO: 1676399 - RNA, 16 nt, Salmonella enterica enterica serovar Typhi
cuaaacagcaaaucgg

SEQ ID NO: 1676400 - RNA, 17 nt, Salmonella enterica enterica serovar Typhi
cguuacccagacagcaa

SEQ ID NO: 1676401 - RNA, 18 nt, Salmonella enterica enterica serovar Typhi
cguuaccagcaucaauag

SEQ ID NO: 1676402 - RNA, 22 nt, Salmonella enterica enterica serovar Typhi
cguuaauccaaauccgcauuuc

SEQ ID NO: 1676403 - RNA, 22 nt, Salmonella enterica enterica serovar Typhi
cguggccagcaugcccgccagc

SEQ ID NO: 1676404 - RNA, 13 nt, Salmonella enterica enterica serovar Typhi
cguuaaucggcac

SEQ ID NO: 1676405 - RNA, 18 nt, Salmonella enterica enterica serovar Typhi
cguuaaucgauuuucucc

SEQ ID NO: 1676406 - RNA, 21 nt, Salmonella enterica enterica serovar Typhi
cguuaaucgauuuucuccgga

SEQ ID NO: 1676407 - RNA, 20 nt, Salmonella enterica enterica serovar Typhi
cguuaaugcuguccugcaaa

SEQ ID NO: 1676408 - RNA, 23 nt, Salmonella enterica enterica serovar Typhi
cguuaauugauggcaccaccugg

SEQ ID NO: 1676409 - RNA, 16 nt, Salmonella enterica enterica serovar Typhi
cguggcaaggaacagu

SEQ ID NO: 1676410 - RNA, 21 nt, Salmonella enterica enterica serovar Typhi
cguggauuuuuugucuguaua

SEQ ID NO: 1676411 - RNA, 14 nt, Salmonella enterica enterica serovar Typhi
cguggccaaaaaau

SEQ ID NO: 1676412 - RNA, 21 nt, Salmonella enterica enterica serovar Typhi
cguggcauucgcuugcccggc

SEQ ID NO: 1676413 - RNA, 12 nt, Salmonella enterica enterica serovar Typhi
cguggcaucuua

SEQ ID NO: 1676414 - RNA, 15 nt, Salmonella enterica enterica serovar Typhi
cguuacuucccccau

SEQ ID NO: 1676415 - RNA, 20 nt, Salmonella enterica enterica serovar Typhi
cguuacggcugaagcugccg

SEQ ID NO: 1676416 - RNA, 13 nt, Salmonella enterica enterica serovar Typhi
cguuacgcauuuc

SEQ ID NO: 1676417 - RNA, 16 nt, Salmonella enterica enterica serovar Typhi
cguuaccgccgagcau

SEQ ID NO: 1676418 - RNA, 23 nt, Salmonella enterica enterica serovar Typhi
cguuaccggcuccggcaaauucu

SEQ ID NO: 1676419 - RNA, 19 nt, Salmonella enterica enterica serovar Typhi
cguuagcgacggcgcgccg

SEQ ID NO: 1676420 - RNA, 15 nt, Salmonella enterica enterica serovar Typhi
cguuaggccacuuca

SEQ ID NO: 1676421 - RNA, 20 nt, Salmonella enterica enterica serovar Typhi
cguuagauauagcuuuucaa

SEQ ID NO: 1676422 - RNA, 21 nt, Salmonella enterica enterica serovar Typhi
cguuagcacauuggcgagcag

SEQ ID NO: 1676423 - RNA, 19 nt, Salmonella enterica enterica serovar Typhi
cguuacuuucauaauguuc

SEQ ID NO: 1676424 - RNA, 15 nt, Salmonella enterica enterica serovar Typhi
cguuauccagcagcc

SEQ ID NO: 1676425 - RNA, 14 nt, Salmonella enterica enterica serovar Typhi
cguuauucgcuggc

SEQ ID NO: 1676426 - RNA, 18 nt, Salmonella enterica enterica serovar Typhi
cguuaucguagugccaca

SEQ ID NO: 1676427 - RNA, 17 nt, Salmonella enterica enterica serovar Typhi
cguuaucugaccuacag

SEQ ID NO: 1676428 - RNA, 16 nt, Salmonella enterica enterica serovar Typhi
cguuaucuguaauuga

SEQ ID NO: 1676429 - RNA, 20 nt, Salmonella enterica enterica serovar Typhi
cguuauugaccaucgccagc

SEQ ID NO: 1676430 - RNA, 15 nt, Salmonella enterica enterica serovar Typhi
cguuauuuuccugaa

SEQ ID NO: 1676431 - RNA, 18 nt, Salmonella enterica enterica serovar Typhi
cguucaaaaucaaacaga

SEQ ID NO: 1676432 - RNA, 19 nt, Salmonella enterica enterica serovar Typhi
cguucacaccgccgccagc

SEQ ID NO: 1676433 - RNA, 21 nt, Salmonella enterica enterica serovar Typhi
cguucacaccgccgccagcca

SEQ ID NO: 1676434 - RNA, 11 nt, Salmonella enterica enterica serovar Typhi
cguucacgccg

SEQ ID NO: 1676435 - RNA, 15 nt, Salmonella enterica enterica serovar Typhi
cguucacgccgccau

SEQ ID NO: 1676436 - RNA, 17 nt, Salmonella enterica enterica serovar Typhi
cguucagcauauccagc

SEQ ID NO: 1676437 - RNA, 19 nt, Salmonella enterica enterica serovar Typhi
cguucagcccuuauaucau

SEQ ID NO: 1676438 - RNA, 22 nt, Salmonella enterica enterica serovar Typhi
cguucuaucagguaucccgcca

SEQ ID NO: 1676439 - RNA, 19 nt, Salmonella enterica enterica serovar Typhi
cguucucaauccgcagcag

SEQ ID NO: 1676440 - RNA, 20 nt, Salmonella enterica enterica serovar Typhi
cguucucacggucuccugaa

SEQ ID NO: 1676441 - RNA, 22 nt, Salmonella enterica enterica serovar Typhi
cguugaguauugacgaaaagau

SEQ ID NO: 1676442 - RNA, 15 nt, Salmonella enterica enterica serovar Typhi
cguugauagacgaca

SEQ ID NO: 1676443 - RNA, 13 nt, Salmonella enterica enterica serovar Typhi
cugacagauaucu

SEQ ID NO: 1676444 - RNA, 17 nt, Salmonella enterica enterica serovar Typhi
cugacagccaaacugcu

SEQ ID NO: 1676445 - RNA, 23 nt, Salmonella enterica enterica serovar Typhi
cugacaggccggauuagcgacag

SEQ ID NO: 1676446 - RNA, 15 nt, Salmonella enterica enterica serovar Typhi
cugacagugacggca

SEQ ID NO: 1676447 - RNA, 23 nt, Salmonella enterica enterica serovar Typhi
cugacauauacaaaccaccacca

SEQ ID NO: 1676448 - RNA, 16 nt, Salmonella enterica enterica serovar Typhi
cugacauaaucaugaa

SEQ ID NO: 1676449 - RNA, 13 nt, Salmonella enterica enterica serovar Typhi
cugacauaaucau

SEQ ID NO: 1676450 - RNA, 23 nt, Salmonella enterica enterica serovar Typhi
cugacagagcucgucaaaaauca

SEQ ID NO: 1676451 - RNA, 23 nt, Salmonella enterica enterica serovar Typhi
cugaauuuacgccguccggcgaa

SEQ ID NO: 1676452 - RNA, 18 nt, Salmonella enterica enterica serovar Typhi
cugacagggucgcaauac

SEQ ID NO: 1676453 - RNA, 19 nt, Salmonella enterica enterica serovar Typhi
cugaccgguaaauuucacu

SEQ ID NO: 1676454 - RNA, 13 nt, Salmonella enterica enterica serovar Typhi
cugaccgcuccag

SEQ ID NO: 1676455 - RNA, 17 nt, Salmonella enterica enterica serovar Typhi
cugacguagauucugau

SEQ ID NO: 1676456 - RNA, 16 nt, Salmonella enterica enterica serovar Typhi
cugacggugguaaauc

SEQ ID NO: 1676457 - RNA, 22 nt, Salmonella enterica enterica serovar Typhi
cugacggugauguuggcccgga

SEQ ID NO: 1676458 - RNA, 14 nt, Salmonella enterica enterica serovar Typhi
cugacugcugucau

SEQ ID NO: 1676459 - RNA, 13 nt, Salmonella enterica enterica serovar Typhi
cugacuguaauuu

SEQ ID NO: 1676460 - RNA, 19 nt, Salmonella enterica enterica serovar Typhi
cugacugcgugagugugga

SEQ ID NO: 1676461 - RNA, 16 nt, Salmonella enterica enterica serovar Typhi
cugacguugcgggccu

SEQ ID NO: 1676462 - RNA, 15 nt, Salmonella enterica enterica serovar Typhi
cugacuguucacgca

SEQ ID NO: 1676463 - RNA, 17 nt, Salmonella enterica enterica serovar Typhi
cugacgccauucauucc

SEQ ID NO: 1676464 - RNA, 18 nt, Salmonella enterica enterica serovar Typhi
cugacgcccaucagcauc

SEQ ID NO: 1676465 - RNA, 16 nt, Salmonella enterica enterica serovar Typhi
cugacgccaggccauc

SEQ ID NO: 1676466 - RNA, 16 nt, Salmonella enterica enterica serovar Typhi
cugacgcagcaguucc

SEQ ID NO: 1676467 - RNA, 19 nt, Salmonella enterica enterica serovar Typhi
cugacgggcauuguuaauc

SEQ ID NO: 1676468 - RNA, 21 nt, Salmonella enterica enterica serovar Typhi
cugacgggcauuguuaaucca

SEQ ID NO: 1676469 - RNA, 15 nt, Salmonella enterica enterica serovar Typhi
cugacgcaaucuguu

SEQ ID NO: 1676470 - RNA, 12 nt, Salmonella enterica enterica serovar Typhi
cugacgcagcag

SEQ ID NO: 1676471 - RNA, 16 nt, Salmonella enterica enterica serovar Typhi
cugacgauaucgucac

SEQ ID NO: 1676472 - RNA, 17 nt, Salmonella enterica enterica serovar Typhi
cugacgacgccagcccu

SEQ ID NO: 1676473 - RNA, 19 nt, Salmonella enterica enterica serovar Typhi
cugaaugcccuuuuccaga

SEQ ID NO: 1676474 - RNA, 21 nt, Salmonella enterica enterica serovar Typhi
cugaaugccuuuuacaauaac

SEQ ID NO: 1676475 - RNA, 14 nt, Salmonella enterica enterica serovar Typhi
cugaaugcucucau

SEQ ID NO: 1676476 - RNA, 16 nt, Salmonella enterica enterica serovar Typhi
cugaauuaucaggguu

SEQ ID NO: 1676477 - RNA, 22 nt, Salmonella enterica enterica serovar Typhi
cugaaucagugcaucuucacug

SEQ ID NO: 1676478 - RNA, 20 nt, Salmonella enterica enterica serovar Typhi
cugaauaugcgucagauguu

SEQ ID NO: 1676479 - RNA, 18 nt, Salmonella enterica enterica serovar Typhi
cugaauauggccaguccc

SEQ ID NO: 1676480 - RNA, 17 nt, Salmonella enterica enterica serovar Typhi
cugaauauuaaaguuca

SEQ ID NO: 1676481 - RNA, 23 nt, Salmonella enterica enterica serovar Typhi
cugaaucagauacggcuccagca

SEQ ID NO: 1676482 - RNA, 15 nt, Salmonella enterica enterica serovar Typhi
cucuacuuuccugaa

SEQ ID NO: 1676483 - RNA, 19 nt, Salmonella enterica enterica serovar Typhi
cucuacuuuccugaaggua

SEQ ID NO: 1676484 - RNA, 17 nt, Salmonella enterica enterica serovar Typhi
cugaaguaucgacgcag

SEQ ID NO: 1676485 - RNA, 11 nt, Salmonella enterica enterica serovar Typhi
cugaauaaucg

SEQ ID NO: 1676486 - RNA, 21 nt, Salmonella enterica enterica serovar Typhi
cugaauaaugguaaauuuauc

SEQ ID NO: 1676487 - RNA, 13 nt, Salmonella enterica enterica serovar Typhi
cugaauagccagc

SEQ ID NO: 1676488 - RNA, 17 nt, Salmonella enterica enterica serovar Typhi
cugaauagcuuucaccg

SEQ ID NO: 1676489 - RNA, 13 nt, Salmonella enterica enterica serovar Typhi
cugauucaauuaa

SEQ ID NO: 1676490 - RNA, 13 nt, Salmonella enterica enterica serovar Typhi
cugauuuuacuga

SEQ ID NO: 1676491 - RNA, 14 nt, Salmonella enterica enterica serovar Typhi
cugauuuucuccag

SEQ ID NO: 1676492 - RNA, 19 nt, Salmonella enterica enterica serovar Typhi
cugauuucgacgauaaaaa

SEQ ID NO: 1676493 - RNA, 20 nt, Salmonella enterica enterica serovar Typhi
cugauuucgacgauaaaaaa

SEQ ID NO: 1676494 - RNA, 14 nt, Salmonella enterica enterica serovar Typhi
cugauguuccggca

SEQ ID NO: 1676495 - RNA, 21 nt, Salmonella enterica enterica serovar Typhi
cugauguuugcgcucuuuuuu

SEQ ID NO: 1676496 - RNA, 17 nt, Salmonella enterica enterica serovar Typhi
cugauuaauaugaacca

SEQ ID NO: 1676497 - RNA, 19 nt, Salmonella enterica enterica serovar Typhi
cugaugcuggcagaaggca

SEQ ID NO: 1676498 - RNA, 13 nt, Salmonella enterica enterica serovar Typhi
cugaugcugugca

SEQ ID NO: 1676499 - RNA, 17 nt, Salmonella enterica enterica serovar Typhi
cugaugagcaggccagg

SEQ ID NO: 1676500 - RNA, 20 nt, Salmonella enterica enterica serovar Typhi
cugauggucgcucuggucga

SEQ ID NO: 1676501 - RNA, 17 nt, Salmonella enterica enterica serovar Typhi
cugauggcuuugcuguc

SEQ ID NO: 1676502 - RNA, 18 nt, Salmonella enterica enterica serovar Typhi
cugauggcgcuacguuua

SEQ ID NO: 1676503 - RNA, 14 nt, Salmonella enterica enterica serovar Typhi
cugauggcguucca

SEQ ID NO: 1676504 - RNA, 21 nt, Salmonella enterica enterica serovar Typhi
cugauggcgaaaaugguuuug

SEQ ID NO: 1676505 - RNA, 21 nt, Salmonella enterica enterica serovar Typhi
cugauggcguggcgcaguaaa

SEQ ID NO: 1676506 - RNA, 15 nt, Salmonella enterica enterica serovar Typhi
cugauauaacccuca

SEQ ID NO: 1676507 - RNA, 22 nt, Salmonella enterica enterica serovar Typhi
cugagcgaauccccgggaacau

SEQ ID NO: 1676508 - RNA, 19 nt, Salmonella enterica enterica serovar Typhi
cugagaaaaauacgccaga

SEQ ID NO: 1676509 - RNA, 13 nt, Salmonella enterica enterica serovar Typhi
cugagaaaaauac

SEQ ID NO: 1676510 - RNA, 17 nt, Salmonella enterica enterica serovar Typhi
cugagcgccgccaagau

SEQ ID NO: 1676511 - RNA, 19 nt, Salmonella enterica enterica serovar Typhi
cugagcgcgagcaugugua

SEQ ID NO: 1676512 - RNA, 12 nt, Salmonella enterica enterica serovar Typhi
cugagcgcgcag

SEQ ID NO: 1676513 - RNA, 16 nt, Salmonella enterica enterica serovar Typhi
cugagcucacuuuuug

SEQ ID NO: 1676514 - RNA, 17 nt, Salmonella enterica enterica serovar Typhi
cugagcuaaucacccac

SEQ ID NO: 1676515 - RNA, 20 nt, Salmonella enterica enterica serovar Typhi
cugaggcguugcuccagcag

SEQ ID NO: 1676516 - RNA, 20 nt, Salmonella enterica enterica serovar Typhi
cugaguauaaaacucgccgc

SEQ ID NO: 1676517 - RNA, 22 nt, Salmonella enterica enterica serovar Typhi
cugaguauaaaacucgccgcga

SEQ ID NO: 1676518 - RNA, 12 nt, Salmonella enterica enterica serovar Typhi
cugaguauguua

SEQ ID NO: 1676519 - RNA, 14 nt, Salmonella enterica enterica serovar Typhi
cugauaagcacagg

SEQ ID NO: 1676520 - RNA, 16 nt, Salmonella enterica enterica serovar Typhi
cugauagcaaucaucc

SEQ ID NO: 1676521 - RNA, 17 nt, Salmonella enterica enterica serovar Typhi
cugauagcauuguaucc

SEQ ID NO: 1676522 - RNA, 16 nt, Salmonella enterica enterica serovar Typhi
cugauagccgccagug

SEQ ID NO: 1676523 - RNA, 19 nt, Salmonella enterica enterica serovar Typhi
cugauagggacacauuucu

SEQ ID NO: 1676524 - RNA, 23 nt, Salmonella enterica enterica serovar Typhi
cugcacgucgcgcucgcucauca

SEQ ID NO: 1676525 - RNA, 16 nt, Salmonella enterica enterica serovar Typhi
cugcacguaccugcuc

SEQ ID NO: 1676526 - RNA, 15 nt, Salmonella enterica enterica serovar Typhi
cugcacggcauacuc

SEQ ID NO: 1676527 - RNA, 17 nt, Salmonella enterica enterica serovar Typhi
cugcacccggagagaaa

SEQ ID NO: 1676528 - RNA, 16 nt, Salmonella enterica enterica serovar Typhi
cugcaacagcaccagc

SEQ ID NO: 1676529 - RNA, 13 nt, Salmonella enterica enterica serovar Typhi
cugauuuuuccau

SEQ ID NO: 1676530 - RNA, 21 nt, Salmonella enterica enterica serovar Typhi
cugcaaaucugccgucaucga

SEQ ID NO: 1676531 - RNA, 18 nt, Salmonella enterica enterica serovar Typhi
cugcaaaucuucggcaaa

SEQ ID NO: 1676532 - RNA, 20 nt, Salmonella enterica enterica serovar Typhi
cugcacauucagguggcuga

SEQ ID NO: 1676533 - RNA, 23 nt, Salmonella enterica enterica serovar Typhi
cugcacauugcaggcuuuuucau

SEQ ID NO: 1676534 - RNA, 14 nt, Salmonella enterica enterica serovar Typhi
cugcacuuccugcg

SEQ ID NO: 1676535 - RNA, 19 nt, Salmonella enterica enterica serovar Typhi
cugcacuuuaagcggcagc

SEQ ID NO: 1676536 - RNA, 22 nt, Salmonella enterica enterica serovar Typhi
cugcacguuuugcucuucuucc

SEQ ID NO: 1676537 - RNA, 22 nt, Salmonella enterica enterica serovar Typhi
cugcacuuuaaaccacaccuga

SEQ ID NO: 1676538 - RNA, 20 nt, Salmonella enterica enterica serovar Typhi
cugcagacccacuuucagcu

SEQ ID NO: 1676539 - RNA, 22 nt, Salmonella enterica enterica serovar Typhi
cugcagaaucccgauaaucaau

SEQ ID NO: 1676540 - RNA, 13 nt, Salmonella enterica enterica serovar Typhi
cugcagcgccaga

SEQ ID NO: 1676541 - RNA, 11 nt, Salmonella enterica enterica serovar Typhi
cugcaggccaa

SEQ ID NO: 1676542 - RNA, 21 nt, Salmonella enterica enterica serovar Typhi
cugcauacucacauucauaaa

SEQ ID NO: 1676543 - RNA, 13 nt, Salmonella enterica enterica serovar Typhi
cugcaucaacagg

SEQ ID NO: 1676544 - RNA, 12 nt, Salmonella enterica enterica serovar Typhi
cugcauauuuuu

SEQ ID NO: 1676545 - RNA, 15 nt, Salmonella enterica enterica serovar Typhi
cugcauauuuuucau

SEQ ID NO: 1676546 - RNA, 13 nt, Salmonella enterica enterica serovar Typhi
cugcagggccgcg

SEQ ID NO: 1676547 - RNA, 18 nt, Salmonella enterica enterica serovar Typhi
cugccgguuggucaauaa

SEQ ID NO: 1676548 - RNA, 19 nt, Salmonella enterica enterica serovar Typhi
cugccuuuguacagcuugc

SEQ ID NO: 1676549 - RNA, 18 nt, Salmonella enterica enterica serovar Typhi
cugccuuuuuuauugccu

SEQ ID NO: 1676550 - RNA, 19 nt, Salmonella enterica enterica serovar Typhi
cugccuuuaacaaauuaaa

SEQ ID NO: 1676551 - RNA, 12 nt, Salmonella enterica enterica serovar Typhi
cugccguccuga

SEQ ID NO: 1676552 - RNA, 14 nt, Salmonella enterica enterica serovar Typhi
cugccgucgcggcu

SEQ ID NO: 1676553 - RNA, 14 nt, Salmonella enterica enterica serovar Typhi
cugccgucccagcg

SEQ ID NO: 1676554 - RNA, 14 nt, Salmonella enterica enterica serovar Typhi
cugccguccgcucu

SEQ ID NO: 1676555 - RNA, 18 nt, Salmonella enterica enterica serovar Typhi
cugccgucccagcggaug

SEQ ID NO: 1676556 - RNA, 21 nt, Salmonella enterica enterica serovar Typhi
cugccgccgucaucugcgccg

SEQ ID NO: 1676557 - RNA, 15 nt, Salmonella enterica enterica serovar Typhi
cugccgauacguccc

SEQ ID NO: 1676558 - RNA, 21 nt, Salmonella enterica enterica serovar Typhi
cugcccuggugagcuccagcc

SEQ ID NO: 1676559 - RNA, 23 nt, Salmonella enterica enterica serovar Typhi
cugcccuguucggcgcggaaggu

SEQ ID NO: 1676560 - RNA, 13 nt, Salmonella enterica enterica serovar Typhi
cugcccugcggua

SEQ ID NO: 1676561 - RNA, 17 nt, Salmonella enterica enterica serovar Typhi
cugcccuuuuagcacuu

SEQ ID NO: 1676562 - RNA, 23 nt, Salmonella enterica enterica serovar Typhi
cugccgacaagguugaucaggaa

SEQ ID NO: 1676563 - RNA, 18 nt, Salmonella enterica enterica serovar Typhi
cugccccggugagcgccg

SEQ ID NO: 1676564 - RNA, 17 nt, Salmonella enterica enterica serovar Typhi
cugccccggugagcgcc

SEQ ID NO: 1676565 - RNA, 18 nt, Salmonella enterica enterica serovar Typhi
cugccccgccacagccgc

SEQ ID NO: 1676566 - RNA, 20 nt, Salmonella enterica enterica serovar Typhi
cugccccgccacagccgcau

SEQ ID NO: 1676567 - RNA, 13 nt, Salmonella enterica enterica serovar Typhi
cugccauucccag

SEQ ID NO: 1676568 - RNA, 16 nt, Salmonella enterica enterica serovar Typhi
cugccauuaucaccau

SEQ ID NO: 1676569 - RNA, 13 nt, Salmonella enterica enterica serovar Typhi
cugcaucagcucg

SEQ ID NO: 1676570 - RNA, 15 nt, Salmonella enterica enterica serovar Typhi
cugcaucaccucaga

SEQ ID NO: 1676571 - RNA, 16 nt, Salmonella enterica enterica serovar Typhi
cugccacaucgccagc

SEQ ID NO: 1676572 - RNA, 19 nt, Salmonella enterica enterica serovar Typhi
cugccaguaguugaauaac

SEQ ID NO: 1676573 - RNA, 23 nt, Salmonella enterica enterica serovar Typhi
cugcggaacuaacccgcagccgg

SEQ ID NO: 1676574 - RNA, 13 nt, Salmonella enterica enterica serovar Typhi
cugcggaauuuua

SEQ ID NO: 1676575 - RNA, 15 nt, Salmonella enterica enterica serovar Typhi
cugcggaacaccagc

SEQ ID NO: 1676576 - RNA, 19 nt, Salmonella enterica enterica serovar Typhi
cugcggaacuaacccgcag

SEQ ID NO: 1676577 - RNA, 16 nt, Salmonella enterica enterica serovar Typhi
cugcgcuuuggguuaa

SEQ ID NO: 1676578 - RNA, 22 nt, Salmonella enterica enterica serovar Typhi
cugcgacgccaggcgccacgau

SEQ ID NO: 1676579 - RNA, 15 nt, Salmonella enterica enterica serovar Typhi
cugcgaacagcgcuc

SEQ ID NO: 1676580 - RNA, 23 nt, Salmonella enterica enterica serovar Typhi
cugcggcccauaaacaggucaca

SEQ ID NO: 1676581 - RNA, 21 nt, Salmonella enterica enterica serovar Typhi
cugcggccaugaucgccgcca

SEQ ID NO: 1676582 - RNA, 21 nt, Salmonella enterica enterica serovar Typhi
cugcggcacgaaaaauaaaaa

SEQ ID NO: 1676583 - RNA, 14 nt, Salmonella enterica enterica serovar Typhi
cugcggccugccca

SEQ ID NO: 1676584 - RNA, 17 nt, Salmonella enterica enterica serovar Typhi
cugcggccuugccgcca

SEQ ID NO: 1676585 - RNA, 16 nt, Salmonella enterica enterica serovar Typhi
cugcggucaggaauga

SEQ ID NO: 1676586 - RNA, 18 nt, Salmonella enterica enterica serovar Typhi
cugcgguaaucugccagc

SEQ ID NO: 1676587 - RNA, 15 nt, Salmonella enterica enterica serovar Typhi
cugcgugaagacaca

SEQ ID NO: 1676588 - RNA, 16 nt, Salmonella enterica enterica serovar Typhi
cugcgugaagacacaa

SEQ ID NO: 1676589 - RNA, 16 nt, Salmonella enterica enterica serovar Typhi
cugcgucgcgcgcguu

SEQ ID NO: 1676590 - RNA, 18 nt, Salmonella enterica enterica serovar Typhi
cugcucauuuaugcgcug

SEQ ID NO: 1676591 - RNA, 12 nt, Salmonella enterica enterica serovar Typhi
cugcuccaugac

SEQ ID NO: 1676592 - RNA, 23 nt, Salmonella enterica enterica serovar Typhi
cugcgugccguugaccagcugac

SEQ ID NO: 1676593 - RNA, 18 nt, Salmonella enterica enterica serovar Typhi
cugcugaccuuaauccag

SEQ ID NO: 1676594 - RNA, 23 nt, Salmonella enterica enterica serovar Typhi
cugcugacaaaaacggcuuuaau

SEQ ID NO: 1676595 - RNA, 19 nt, Salmonella enterica enterica serovar Typhi
cugcugacguagauucuga

SEQ ID NO: 1676596 - RNA, 15 nt, Salmonella enterica enterica serovar Typhi
cugcugacguuugca

SEQ ID NO: 1676597 - RNA, 16 nt, Salmonella enterica enterica serovar Typhi
cugcugagugacgggc

SEQ ID NO: 1676598 - RNA, 22 nt, Salmonella enterica enterica serovar Typhi
cugcugauaguccaguacccgc

SEQ ID NO: 1676599 - RNA, 11 nt, Salmonella enterica enterica serovar Typhi
cugcugauaau

SEQ ID NO: 1676600 - RNA, 15 nt, Salmonella enterica enterica serovar Typhi
cugcugauaauacug

SEQ ID NO: 1676601 - RNA, 15 nt, Salmonella enterica enterica serovar Typhi
aaacuauccuggccu

SEQ ID NO: 1676602 - RNA, 15 nt, Salmonella enterica enterica serovar Typhi
cugcugaacacaaug

SEQ ID NO: 1676603 - RNA, 12 nt, Salmonella enterica enterica serovar Typhi
cugcugugcaua

SEQ ID NO: 1676604 - RNA, 16 nt, Salmonella enterica enterica serovar Typhi
cugcuguaacagacgc

SEQ ID NO: 1676605 - RNA, 15 nt, Salmonella enterica enterica serovar Typhi
cugcuguagcugucc

SEQ ID NO: 1676606 - RNA, 22 nt, Salmonella enterica enterica serovar Typhi
cugcuguaacagacgcaggccg

SEQ ID NO: 1676607 - RNA, 18 nt, Salmonella enterica enterica serovar Typhi
cugcuucggaaugacaaa

SEQ ID NO: 1676608 - RNA, 22 nt, Salmonella enterica enterica serovar Typhi
cugcuguuaaccuugcgccucu

SEQ ID NO: 1676609 - RNA, 23 nt, Salmonella enterica enterica serovar Typhi
cugcuggcggaauccaucccccu

SEQ ID NO: 1676610 - RNA, 14 nt, Salmonella enterica enterica serovar Typhi
cugcuggccuucca

SEQ ID NO: 1676611 - RNA, 13 nt, Salmonella enterica enterica serovar Typhi
cugcugaugccag

SEQ ID NO: 1676612 - RNA, 13 nt, Salmonella enterica enterica serovar Typhi
cugcuucuggcuu

SEQ ID NO: 1676613 - RNA, 22 nt, Salmonella enterica enterica serovar Typhi
cuggaagaaaucguugccuuug

SEQ ID NO: 1676614 - RNA, 15 nt, Salmonella enterica enterica serovar Typhi
cuggaagaacuggau

SEQ ID NO: 1676615 - RNA, 17 nt, Salmonella enterica enterica serovar Typhi
cuggaagaacuggauga

SEQ ID NO: 1676616 - RNA, 15 nt, Salmonella enterica enterica serovar Typhi
cugcuuguucuuuuc

SEQ ID NO: 1676617 - RNA, 20 nt, Salmonella enterica enterica serovar Typhi
cugcuuguuuaauggcagaa

SEQ ID NO: 1676618 - RNA, 22 nt, Salmonella enterica enterica serovar Typhi
cuggaacaguaaucgcacggcu

SEQ ID NO: 1676619 - RNA, 20 nt, Salmonella enterica enterica serovar Typhi
cuggauaauaagacgccagu

SEQ ID NO: 1676620 - RNA, 14 nt, Salmonella enterica enterica serovar Typhi
cuggauaaaagguc

SEQ ID NO: 1676621 - RNA, 19 nt, Salmonella enterica enterica serovar Typhi
cuggauaccgcgccagcga

SEQ ID NO: 1676622 - RNA, 16 nt, Salmonella enterica enterica serovar Typhi
cuggcacagggcaaua

SEQ ID NO: 1676623 - RNA, 18 nt, Salmonella enterica enterica serovar Typhi
cuggauuacaaaaauaga

SEQ ID NO: 1676624 - RNA, 13 nt, Salmonella enterica enterica serovar Typhi
cuggauuccucca

SEQ ID NO: 1676625 - RNA, 14 nt, Salmonella enterica enterica serovar Typhi
cuggauuaucaaua

SEQ ID NO: 1676626 - RNA, 18 nt, Salmonella enterica enterica serovar Typhi
cuggaaguuuugcuggaa

SEQ ID NO: 1676627 - RNA, 20 nt, Salmonella enterica enterica serovar Typhi
cuggaagcgaucaagacaaa

SEQ ID NO: 1676628 - RNA, 20 nt, Salmonella enterica enterica serovar Typhi
cuggagugacuaaaagacgc

SEQ ID NO: 1676629 - RNA, 16 nt, Salmonella enterica enterica serovar Typhi
cuggagggguuucccc

SEQ ID NO: 1676630 - RNA, 21 nt, Salmonella enterica enterica serovar Typhi
cuggagcgcauuuuacugccg

SEQ ID NO: 1676631 - RNA, 20 nt, Salmonella enterica enterica serovar Typhi
cuggagcaggugcggcuggg

SEQ ID NO: 1676632 - RNA, 18 nt, Salmonella enterica enterica serovar Typhi
cuggagcaggaaaucaua

SEQ ID NO: 1676633 - RNA, 15 nt, Salmonella enterica enterica serovar Typhi
cuggagaaugggauu

SEQ ID NO: 1676634 - RNA, 19 nt, Salmonella enterica enterica serovar Typhi
cuggagagcagcgccagcg

SEQ ID NO: 1676635 - RNA, 23 nt, Salmonella enterica enterica serovar Typhi
cuggcggugcggucacaggcaua

SEQ ID NO: 1676636 - RNA, 20 nt, Salmonella enterica enterica serovar Typhi
cuggcggucgggaacgcugu

SEQ ID NO: 1676637 - RNA, 21 nt, Salmonella enterica enterica serovar Typhi
cuggcgggcagccuucaaguu

SEQ ID NO: 1676638 - RNA, 22 nt, Salmonella enterica enterica serovar Typhi
cuggcgguaugaaagccaucgc

SEQ ID NO: 1676639 - RNA, 20 nt, Salmonella enterica enterica serovar Typhi
cuggcgguaaauacgcggca

SEQ ID NO: 1676640 - RNA, 16 nt, Salmonella enterica enterica serovar Typhi
cuggcgucuguccggc

SEQ ID NO: 1676641 - RNA, 19 nt, Salmonella enterica enterica serovar Typhi
cuggcgugacguguggcgc

SEQ ID NO: 1676642 - RNA, 19 nt, Salmonella enterica enterica serovar Typhi
cuggcguccagcccgucca

SEQ ID NO: 1676643 - RNA, 15 nt, Salmonella enterica enterica serovar Typhi
aaacuccgcgcuggc

SEQ ID NO: 1676644 - RNA, 19 nt, Salmonella enterica enterica serovar Typhi
aaacucgacacacucaucu

SEQ ID NO: 1676645 - RNA, 22 nt, Salmonella enterica enterica serovar Typhi
aaacuccauuaaauuacuuguu

SEQ ID NO: 1676646 - RNA, 16 nt, Salmonella enterica enterica serovar Typhi
aaacuccaccugaucg

SEQ ID NO: 1676647 - RNA, 13 nt, Salmonella enterica enterica serovar Typhi
cuggcucagacca

SEQ ID NO: 1676648 - RNA, 17 nt, Salmonella enterica enterica serovar Typhi
cuggcugcugauggucu

SEQ ID NO: 1676649 - RNA, 14 nt, Salmonella enterica enterica serovar Typhi
cuggcugagaaaaa

SEQ ID NO: 1676650 - RNA, 15 nt, Salmonella enterica enterica serovar Typhi
cuggcuacguacaca

SEQ ID NO: 1676651 - RNA, 15 nt, Salmonella enterica enterica serovar Typhi
cuggcuaucgccgua

SEQ ID NO: 1676652 - RNA, 14 nt, Salmonella enterica enterica serovar Typhi
cuggcucacugacu

SEQ ID NO: 1676653 - RNA, 19 nt, Salmonella enterica enterica serovar Typhi
cuggcucacugacuaucca

SEQ ID NO: 1676654 - RNA, 17 nt, Salmonella enterica enterica serovar Typhi
cuggcguuaucguccgu

SEQ ID NO: 1676655 - RNA, 19 nt, Salmonella enterica enterica serovar Typhi
cuggcgucuguccggcgcu

SEQ ID NO: 1676656 - RNA, 13 nt, Salmonella enterica enterica serovar Typhi
cuggcguuaucau

SEQ ID NO: 1676657 - RNA, 16 nt, Salmonella enterica enterica serovar Typhi
cuggcuuuggcuaauu

SEQ ID NO: 1676658 - RNA, 19 nt, Salmonella enterica enterica serovar Typhi
cuggcuuugcgccacuuca

SEQ ID NO: 1676659 - RNA, 17 nt, Salmonella enterica enterica serovar Typhi
cugggaaguugcccuua

SEQ ID NO: 1676660 - RNA, 17 nt, Salmonella enterica enterica serovar Typhi
cugggaauaggccgcca

SEQ ID NO: 1676661 - RNA, 18 nt, Salmonella enterica enterica serovar Typhi
cuggcuuacaggcacgcc

SEQ ID NO: 1676662 - RNA, 15 nt, Salmonella enterica enterica serovar Typhi
cuggcuuacucgccc

SEQ ID NO: 1676663 - RNA, 13 nt, Salmonella enterica enterica serovar Typhi
cuggcuucagccu

SEQ ID NO: 1676664 - RNA, 16 nt, Salmonella enterica enterica serovar Typhi
cuggcuucagccugug

SEQ ID NO: 1676665 - RNA, 18 nt, Salmonella enterica enterica serovar Typhi
cuggcuucagccugugca

SEQ ID NO: 1676666 - RNA, 16 nt, Salmonella enterica enterica serovar Typhi
cuggcugugccaauaa

SEQ ID NO: 1676667 - RNA, 22 nt, Salmonella enterica enterica serovar Typhi
cuggcuguccuugcgccaucgg

SEQ ID NO: 1676668 - RNA, 22 nt, Salmonella enterica enterica serovar Typhi
cugggcacgcuaugguacggcg

SEQ ID NO: 1676669 - RNA, 18 nt, Salmonella enterica enterica serovar Typhi
cugggauaagcagaacaa

SEQ ID NO: 1676670 - RNA, 15 nt, Salmonella enterica enterica serovar Typhi
cugggagccgcugcu

SEQ ID NO: 1676671 - RNA, 21 nt, Salmonella enterica enterica serovar Typhi
cugggauucggcaacacccac

SEQ ID NO: 1676672 - RNA, 18 nt, Salmonella enterica enterica serovar Typhi
cuggcgacauuaaaggac

SEQ ID NO: 1676673 - RNA, 17 nt, Salmonella enterica enterica serovar Typhi
cuggcgaccgccaccau

SEQ ID NO: 1676674 - RNA, 19 nt, Salmonella enterica enterica serovar Typhi
cuggcgagaaagugguggg

SEQ ID NO: 1676675 - RNA, 18 nt, Salmonella enterica enterica serovar Typhi
cuggccugcagaccuaua

SEQ ID NO: 1676676 - RNA, 20 nt, Salmonella enterica enterica serovar Typhi
cuggccuacggaaagcuguu

SEQ ID NO: 1676677 - RNA, 17 nt, Salmonella enterica enterica serovar Typhi
cuggccguuuucccggc

SEQ ID NO: 1676678 - RNA, 15 nt, Salmonella enterica enterica serovar Typhi
cuggccgcgauggug

SEQ ID NO: 1676679 - RNA, 18 nt, Salmonella enterica enterica serovar Typhi
cuggccgcgcuuuuuuaa

SEQ ID NO: 1676680 - RNA, 23 nt, Salmonella enterica enterica serovar Typhi
cuggcagcagugacauuuaucuu

SEQ ID NO: 1676681 - RNA, 16 nt, Salmonella enterica enterica serovar Typhi
cuggcagaugaacaua

SEQ ID NO: 1676682 - RNA, 15 nt, Salmonella enterica enterica serovar Typhi
cuggcagaaggcaug

SEQ ID NO: 1676683 - RNA, 16 nt, Salmonella enterica enterica serovar Typhi
cuggcagcggcaguaa

SEQ ID NO: 1676684 - RNA, 13 nt, Salmonella enterica enterica serovar Typhi
cuggcagccucgu

SEQ ID NO: 1676685 - RNA, 19 nt, Salmonella enterica enterica serovar Typhi
cuggcagcgccugacggcg

SEQ ID NO: 1676686 - RNA, 20 nt, Salmonella enterica enterica serovar Typhi
cuggcaguccacguagcugc

SEQ ID NO: 1676687 - RNA, 23 nt, Salmonella enterica enterica serovar Typhi
cuggcgcuguaauagauaugaaa

SEQ ID NO: 1676688 - RNA, 17 nt, Salmonella enterica enterica serovar Typhi
cuggcgcugaccgcccc

SEQ ID NO: 1676689 - RNA, 19 nt, Salmonella enterica enterica serovar Typhi
cuggcggaauggcgggcgc

SEQ ID NO: 1676690 - RNA, 17 nt, Salmonella enterica enterica serovar Typhi
cuggcggagcugcgcuu

SEQ ID NO: 1676691 - RNA, 19 nt, Salmonella enterica enterica serovar Typhi
cuggcgcuuuuccagcacg

SEQ ID NO: 1676692 - RNA, 16 nt, Salmonella enterica enterica serovar Typhi
cuggcgcgugcccagu

SEQ ID NO: 1676693 - RNA, 18 nt, Salmonella enterica enterica serovar Typhi
cuggcgcucaaucagaau

SEQ ID NO: 1676694 - RNA, 17 nt, Salmonella enterica enterica serovar Typhi
cuggcgcggggaacacu

SEQ ID NO: 1676695 - RNA, 19 nt, Salmonella enterica enterica serovar Typhi
cuggcgcggggaacacuaa

SEQ ID NO: 1676696 - RNA, 17 nt, Salmonella enterica enterica serovar Typhi
cuggcgcggggaacacc

SEQ ID NO: 1676697 - RNA, 19 nt, Salmonella enterica enterica serovar Typhi
cuggcgcggggaacaccca

SEQ ID NO: 1676698 - RNA, 16 nt, Salmonella enterica enterica serovar Typhi
cuggcgcggggaacac

SEQ ID NO: 1676699 - RNA, 18 nt, Salmonella enterica enterica serovar Typhi
cuggcgcggggaacacac

SEQ ID NO: 1676700 - RNA, 19 nt, Salmonella enterica enterica serovar Typhi
cuggcgcggggaacacacg

SEQ ID NO: 1676701 - RNA, 18 nt, Salmonella enterica enterica serovar Typhi
cuggcggccccucuucca

SEQ ID NO: 1676702 - RNA, 19 nt, Salmonella enterica enterica serovar Typhi
aaacucacguuccccagca

SEQ ID NO: 1676703 - RNA, 13 nt, Salmonella enterica enterica serovar Typhi
aaacucagcaaua

SEQ ID NO: 1676704 - RNA, 15 nt, Salmonella enterica enterica serovar Typhi
cuggcgcaaaugggc

SEQ ID NO: 1676705 - RNA, 14 nt, Salmonella enterica enterica serovar Typhi
cuggcgcaaccggc

SEQ ID NO: 1676706 - RNA, 12 nt, Salmonella enterica enterica serovar Typhi
cuggcgccggag

SEQ ID NO: 1676707 - RNA, 13 nt, Salmonella enterica enterica serovar Typhi
cuggcgccgcaag

SEQ ID NO: 1676708 - RNA, 17 nt, Salmonella enterica enterica serovar Typhi
cuguuccagccgcccgc

SEQ ID NO: 1676709 - RNA, 14 nt, Salmonella enterica enterica serovar Typhi
cuguuccaggcgaa

SEQ ID NO: 1676710 - RNA, 15 nt, Salmonella enterica enterica serovar Typhi
cuguuccagcugcga

SEQ ID NO: 1676711 - RNA, 22 nt, Salmonella enterica enterica serovar Typhi
cuguuaccaaugccaaaaaaac

SEQ ID NO: 1676712 - RNA, 14 nt, Salmonella enterica enterica serovar Typhi
cuguucacauccag

SEQ ID NO: 1676713 - RNA, 23 nt, Salmonella enterica enterica serovar Typhi
cuguucagaaaucggcagcaccc

SEQ ID NO: 1676714 - RNA, 20 nt, Salmonella enterica enterica serovar Typhi
cuguucaaguggcaaucgac

SEQ ID NO: 1676715 - RNA, 13 nt, Salmonella enterica enterica serovar Typhi
cuguucacaucca

SEQ ID NO: 1676716 - RNA, 21 nt, Salmonella enterica enterica serovar Typhi
cuguugaguucccuucuccuc

SEQ ID NO: 1676717 - RNA, 22 nt, Salmonella enterica enterica serovar Typhi
cuguugaguucccuucuccuca

SEQ ID NO: 1676718 - RNA, 21 nt, Salmonella enterica enterica serovar Typhi
cuguugaauaucgcuuuuucu

SEQ ID NO: 1676719 - RNA, 17 nt, Salmonella enterica enterica serovar Typhi
cuguucuugcugcugcu

SEQ ID NO: 1676720 - RNA, 18 nt, Salmonella enterica enterica serovar Typhi
cuguuccagguucaagcu

SEQ ID NO: 1676721 - RNA, 16 nt, Salmonella enterica enterica serovar Typhi
cuguucuacuacagaa

SEQ ID NO: 1676722 - RNA, 17 nt, Salmonella enterica enterica serovar Typhi
cuguguugcucaaaaaa

SEQ ID NO: 1676723 - RNA, 17 nt, Salmonella enterica enterica serovar Typhi
cugugugggcacucgaa

SEQ ID NO: 1676724 - RNA, 13 nt, Salmonella enterica enterica serovar Typhi
cuguguuuuuucg

SEQ ID NO: 1676725 - RNA, 17 nt, Salmonella enterica enterica serovar Typhi
cuguuaaaaccggcugc

SEQ ID NO: 1676726 - RNA, 20 nt, Salmonella enterica enterica serovar Typhi
cuguguacgcguucugaaua

SEQ ID NO: 1676727 - RNA, 17 nt, Salmonella enterica enterica serovar Typhi
cugugguugcccgcagg

SEQ ID NO: 1676728 - RNA, 13 nt, Salmonella enterica enterica serovar Typhi
cuguuggcauccu

SEQ ID NO: 1676729 - RNA, 19 nt, Salmonella enterica enterica serovar Typhi
cuguuggacugucuuguuu

SEQ ID NO: 1676730 - RNA, 18 nt, Salmonella enterica enterica serovar Typhi
cuguugcugugcauaucu

SEQ ID NO: 1676731 - RNA, 20 nt, Salmonella enterica enterica serovar Typhi
cuguugaugauaaccgccgc

SEQ ID NO: 1676732 - RNA, 20 nt, Salmonella enterica enterica serovar Typhi
cuguugccuuugcgcgcgau

SEQ ID NO: 1676733 - RNA, 15 nt, Salmonella enterica enterica serovar Typhi
cuguuugugguuggu

SEQ ID NO: 1676734 - RNA, 22 nt, Salmonella enterica enterica serovar Typhi
cuguuugcugacaaucugcugg

SEQ ID NO: 1676735 - RNA, 14 nt, Salmonella enterica enterica serovar Typhi
cuguuuuauuuccu

SEQ ID NO: 1676736 - RNA, 15 nt, Salmonella enterica enterica serovar Typhi
cuguuuucacucuuu

SEQ ID NO: 1676737 - RNA, 14 nt, Salmonella enterica enterica serovar Typhi
cuguuuuccgcuuu

SEQ ID NO: 1676738 - RNA, 15 nt, Salmonella enterica enterica serovar Typhi
cuuaaaccugcgccg

SEQ ID NO: 1676739 - RNA, 20 nt, Salmonella enterica enterica serovar Typhi
cuuaaacagcgaucacgccg

SEQ ID NO: 1676740 - RNA, 21 nt, Salmonella enterica enterica serovar Typhi
cuuaaacaucgcccuccagcu

SEQ ID NO: 1676741 - RNA, 14 nt, Salmonella enterica enterica serovar Typhi
cuuacuuugcgccc

SEQ ID NO: 1676742 - RNA, 22 nt, Salmonella enterica enterica serovar Typhi
cuuacuuuccaaaauccaggga

SEQ ID NO: 1676743 - RNA, 16 nt, Salmonella enterica enterica serovar Typhi
cuuauacaggcgcagg

SEQ ID NO: 1676744 - RNA, 18 nt, Salmonella enterica enterica serovar Typhi
cuuauacccuuguaaauu

SEQ ID NO: 1676745 - RNA, 16 nt, Salmonella enterica enterica serovar Typhi
cuuauacugauaaacu

SEQ ID NO: 1676746 - RNA, 19 nt, Salmonella enterica enterica serovar Typhi
cuuauacugauaaacuauc

SEQ ID NO: 1676747 - RNA, 20 nt, Salmonella enterica enterica serovar Typhi
cuuauccaaauccuuaauca

SEQ ID NO: 1676748 - RNA, 13 nt, Salmonella enterica enterica serovar Typhi
cuuaucccagccg

SEQ ID NO: 1676749 - RNA, 20 nt, Salmonella enterica enterica serovar Typhi
cuuauccccauucugcugau

SEQ ID NO: 1676750 - RNA, 19 nt, Salmonella enterica enterica serovar Typhi
cuuaucucuacuuuccuga

SEQ ID NO: 1676751 - RNA, 13 nt, Salmonella enterica enterica serovar Typhi
cuuaucuggauga

SEQ ID NO: 1676752 - RNA, 23 nt, Salmonella enterica enterica serovar Typhi
cuuauuagaggcguaaguaaaag

SEQ ID NO: 1676753 - RNA, 17 nt, Salmonella enterica enterica serovar Typhi
cuuacacacccggccua

SEQ ID NO: 1676754 - RNA, 13 nt, Salmonella enterica enterica serovar Typhi
cuuacaauuuauc

SEQ ID NO: 1676755 - RNA, 17 nt, Salmonella enterica enterica serovar Typhi
cuuacaggcgcaucaga

SEQ ID NO: 1676756 - RNA, 20 nt, Salmonella enterica enterica serovar Typhi
cuuacaacauuguuauguuu

SEQ ID NO: 1676757 - RNA, 13 nt, Salmonella enterica enterica serovar Typhi
cuuacaaaaaaua

SEQ ID NO: 1676758 - RNA, 16 nt, Salmonella enterica enterica serovar Typhi
cuuacaaaaaauacau

SEQ ID NO: 1676759 - RNA, 22 nt, Salmonella enterica enterica serovar Typhi
cuuacguuucucacuaauuuga

SEQ ID NO: 1676760 - RNA, 15 nt, Salmonella enterica enterica serovar Typhi
cuuacgcggcgcgcu

SEQ ID NO: 1676761 - RNA, 22 nt, Salmonella enterica enterica serovar Typhi
cuuacgcggcgcgcucuuuuuc

SEQ ID NO: 1676762 - RNA, 14 nt, Salmonella enterica enterica serovar Typhi
cuuacgcuccugcg

SEQ ID NO: 1676763 - RNA, 21 nt, Salmonella enterica enterica serovar Typhi
cuuacggacugcggccugcaa

SEQ ID NO: 1676764 - RNA, 18 nt, Salmonella enterica enterica serovar Typhi
cuuacuuuccaaaaucca

SEQ ID NO: 1676765 - RNA, 14 nt, Salmonella enterica enterica serovar Typhi
cuuacuuguaggcc

SEQ ID NO: 1676766 - RNA, 21 nt, Salmonella enterica enterica serovar Typhi
cuuacguucgaugacuuguuc

SEQ ID NO: 1676767 - RNA, 13 nt, Salmonella enterica enterica serovar Typhi
cuuaauaacagcg

SEQ ID NO: 1676768 - RNA, 21 nt, Salmonella enterica enterica serovar Typhi
cuuaagaauguccaucucuuu

SEQ ID NO: 1676769 - RNA, 18 nt, Salmonella enterica enterica serovar Typhi
cuuaagaauguccaucuc

SEQ ID NO: 1676770 - RNA, 23 nt, Salmonella enterica enterica serovar Typhi
cuuaauacccauuucuucuucaa

SEQ ID NO: 1676771 - RNA, 19 nt, Salmonella enterica enterica serovar Typhi
cuuaauuugcuguuuuuug

SEQ ID NO: 1676772 - RNA, 17 nt, Salmonella enterica enterica serovar Typhi
cuuaauacgcagaucuu

SEQ ID NO: 1676773 - RNA, 18 nt, Salmonella enterica enterica serovar Typhi
cuuaauacccauuucuuc

SEQ ID NO: 1676774 - RNA, 12 nt, Salmonella enterica enterica serovar Typhi
cuucagagcagg

SEQ ID NO: 1676775 - RNA, 12 nt, Salmonella enterica enterica serovar Typhi
cuucagccagac

SEQ ID NO: 1676776 - RNA, 18 nt, Salmonella enterica enterica serovar Typhi
cuucauaggugaacauga

SEQ ID NO: 1676777 - RNA, 17 nt, Salmonella enterica enterica serovar Typhi
cuucagcgacaucguca

SEQ ID NO: 1676778 - RNA, 20 nt, Salmonella enterica enterica serovar Typhi
cuucagcggcgcguugccgc

SEQ ID NO: 1676779 - RNA, 13 nt, Salmonella enterica enterica serovar Typhi
cuucaugcacaaa

SEQ ID NO: 1676780 - RNA, 17 nt, Salmonella enterica enterica serovar Typhi
cuucaucggauagauga

SEQ ID NO: 1676781 - RNA, 18 nt, Salmonella enterica enterica serovar Typhi
cuucaucgcgccuccccu

SEQ ID NO: 1676782 - RNA, 16 nt, Salmonella enterica enterica serovar Typhi
cuucaucgauggcgcc

SEQ ID NO: 1676783 - RNA, 23 nt, Salmonella enterica enterica serovar Typhi
cuucaaggcucaauacgcauaau

SEQ ID NO: 1676784 - RNA, 21 nt, Salmonella enterica enterica serovar Typhi
cuucaagguucgacucgagca

SEQ ID NO: 1676785 - RNA, 14 nt, Salmonella enterica enterica serovar Typhi
cuucaacagcggcg

SEQ ID NO: 1676786 - RNA, 23 nt, Salmonella enterica enterica serovar Typhi
cuucaaauauauugaaaagggac

SEQ ID NO: 1676787 - RNA, 22 nt, Salmonella enterica enterica serovar Typhi
cuucaagcuggugcuuuaugua

SEQ ID NO: 1676788 - RNA, 17 nt, Salmonella enterica enterica serovar Typhi
cuuauugaugacgcuua

SEQ ID NO: 1676789 - RNA, 16 nt, Salmonella enterica enterica serovar Typhi
cuucaauaucaacgac

SEQ ID NO: 1676790 - RNA, 18 nt, Salmonella enterica enterica serovar Typhi
cuucacaaacaauuuccc

SEQ ID NO: 1676791 - RNA, 19 nt, Salmonella enterica enterica serovar Typhi
cuucaauuuuccagauagc

SEQ ID NO: 1676792 - RNA, 21 nt, Salmonella enterica enterica serovar Typhi
cuucaauuugaccugaccugg

SEQ ID NO: 1676793 - RNA, 17 nt, Salmonella enterica enterica serovar Typhi
cuucacuucacaaacaa

SEQ ID NO: 1676794 - RNA, 14 nt, Salmonella enterica enterica serovar Typhi
cuucacgcuaaucc

SEQ ID NO: 1676795 - RNA, 21 nt, Salmonella enterica enterica serovar Typhi
cuucacucugggauuugcgaa

SEQ ID NO: 1676796 - RNA, 15 nt, Salmonella enterica enterica serovar Typhi
cuucacgccauccag

SEQ ID NO: 1676797 - RNA, 19 nt, Salmonella enterica enterica serovar Typhi
cuucacgccauccaguuua

SEQ ID NO: 1676798 - RNA, 14 nt, Salmonella enterica enterica serovar Typhi
cuucaccuugcugc

SEQ ID NO: 1676799 - RNA, 19 nt, Salmonella enterica enterica serovar Typhi
cuucacgcagugcgcgacc

SEQ ID NO: 1676800 - RNA, 15 nt, Salmonella enterica enterica serovar Typhi
cuucaccggcgugcg

SEQ ID NO: 1676801 - RNA, 14 nt, Salmonella enterica enterica serovar Typhi
cuucaccggcgugc

SEQ ID NO: 1676802 - RNA, 21 nt, Salmonella enterica enterica serovar Typhi
cuucaccguugugcuccagcg

SEQ ID NO: 1676803 - RNA, 17 nt, Salmonella enterica enterica serovar Typhi
cuucaccucagucgcuu

SEQ ID NO: 1676804 - RNA, 18 nt, Salmonella enterica enterica serovar Typhi
cuuccaccaccuccugcu

SEQ ID NO: 1676805 - RNA, 23 nt, Salmonella enterica enterica serovar Typhi
cuuccagcaaaccuuccgccagg

SEQ ID NO: 1676806 - RNA, 15 nt, Salmonella enterica enterica serovar Typhi
cuuccagcagccagc

SEQ ID NO: 1676807 - RNA, 19 nt, Salmonella enterica enterica serovar Typhi
cuuccagcauucuauuguu

SEQ ID NO: 1676808 - RNA, 13 nt, Salmonella enterica enterica serovar Typhi
cuuccagcaaacc

SEQ ID NO: 1676809 - RNA, 15 nt, Salmonella enterica enterica serovar Typhi
cuuccagcaauucgu

SEQ ID NO: 1676810 - RNA, 14 nt, Salmonella enterica enterica serovar Typhi
cuuccagcaccgcg

SEQ ID NO: 1676811 - RNA, 13 nt, Salmonella enterica enterica serovar Typhi
aaacuuaucucuu

SEQ ID NO: 1676812 - RNA, 17 nt, Salmonella enterica enterica serovar Typhi
cuuccaugccuucauaa

SEQ ID NO: 1676813 - RNA, 15 nt, Salmonella enterica enterica serovar Typhi
cuuccaucagccagg

SEQ ID NO: 1676814 - RNA, 23 nt, Salmonella enterica enterica serovar Typhi
cuuccccggcagccucaggccug

SEQ ID NO: 1676815 - RNA, 16 nt, Salmonella enterica enterica serovar Typhi
cuuccccgaucagaaa

SEQ ID NO: 1676816 - RNA, 23 nt, Salmonella enterica enterica serovar Typhi
cuucccauauuuuuucugccagu

SEQ ID NO: 1676817 - RNA, 17 nt, Salmonella enterica enterica serovar Typhi
cuuccuuugccuuucuu

SEQ ID NO: 1676818 - RNA, 16 nt, Salmonella enterica enterica serovar Typhi
cuuccugagcagacau

SEQ ID NO: 1676819 - RNA, 22 nt, Salmonella enterica enterica serovar Typhi
cuuccgccauacccggcuccca

SEQ ID NO: 1676820 - RNA, 22 nt, Salmonella enterica enterica serovar Typhi
cuuccgcaauacagcccgccag

SEQ ID NO: 1676821 - RNA, 20 nt, Salmonella enterica enterica serovar Typhi
cuucgccccggcgagugccu

SEQ ID NO: 1676822 - RNA, 20 nt, Salmonella enterica enterica serovar Typhi
cuucgccaucuccaucauuu

SEQ ID NO: 1676823 - RNA, 21 nt, Salmonella enterica enterica serovar Typhi
cuucgccaacuuuuugcgcaa

SEQ ID NO: 1676824 - RNA, 13 nt, Salmonella enterica enterica serovar Typhi
cuucgcaaucucc

SEQ ID NO: 1676825 - RNA, 18 nt, Salmonella enterica enterica serovar Typhi
cuucgcagaucgccugga

SEQ ID NO: 1676826 - RNA, 21 nt, Salmonella enterica enterica serovar Typhi
cuucgauaguccauuuuccua

SEQ ID NO: 1676827 - RNA, 16 nt, Salmonella enterica enterica serovar Typhi
cuggugggacuguuca

SEQ ID NO: 1676828 - RNA, 20 nt, Salmonella enterica enterica serovar Typhi
cugguggugccgacgccagc

SEQ ID NO: 1676829 - RNA, 22 nt, Salmonella enterica enterica serovar Typhi
cugguggucuaugguacacaua

SEQ ID NO: 1676830 - RNA, 18 nt, Salmonella enterica enterica serovar Typhi
cuggugugguuauuucug

SEQ ID NO: 1676831 - RNA, 14 nt, Salmonella enterica enterica serovar Typhi
cuggugucuuuuuc

SEQ ID NO: 1676832 - RNA, 16 nt, Salmonella enterica enterica serovar Typhi
cuggugugaacaucac

SEQ ID NO: 1676833 - RNA, 18 nt, Salmonella enterica enterica serovar Typhi
cuggugccaaucuccagc

SEQ ID NO: 1676834 - RNA, 17 nt, Salmonella enterica enterica serovar Typhi
cuggugcgaauaagcuc

SEQ ID NO: 1676835 - RNA, 18 nt, Salmonella enterica enterica serovar Typhi
cuggugcugugccugccu

SEQ ID NO: 1676836 - RNA, 22 nt, Salmonella enterica enterica serovar Typhi
cugguuucuccggccagucugg

SEQ ID NO: 1676837 - RNA, 15 nt, Salmonella enterica enterica serovar Typhi
cugguuguuucuuaa

SEQ ID NO: 1676838 - RNA, 12 nt, Salmonella enterica enterica serovar Typhi
cugguugucuca

SEQ ID NO: 1676839 - RNA, 20 nt, Salmonella enterica enterica serovar Typhi
cugguuaaugaccugccgcg

SEQ ID NO: 1676840 - RNA, 22 nt, Salmonella enterica enterica serovar Typhi
cugguuaaugccuucgccgccg

SEQ ID NO: 1676841 - RNA, 13 nt, Salmonella enterica enterica serovar Typhi
cugguucaacauc

SEQ ID NO: 1676842 - RNA, 13 nt, Salmonella enterica enterica serovar Typhi
cugguuauaugaa

SEQ ID NO: 1676843 - RNA, 17 nt, Salmonella enterica enterica serovar Typhi
cugguucgaauccaggu

SEQ ID NO: 1676844 - RNA, 14 nt, Salmonella enterica enterica serovar Typhi
cugguucgaaucca

SEQ ID NO: 1676845 - RNA, 14 nt, Salmonella enterica enterica serovar Typhi
cugguugaccggaa

SEQ ID NO: 1676846 - RNA, 17 nt, Salmonella enterica enterica serovar Typhi
cuguaacuucggccagc

SEQ ID NO: 1676847 - RNA, 23 nt, Salmonella enterica enterica serovar Typhi
cuguaauagauaugaaagaagga

SEQ ID NO: 1676848 - RNA, 17 nt, Salmonella enterica enterica serovar Typhi
cuguaauagugcgcggg

SEQ ID NO: 1676849 - RNA, 20 nt, Salmonella enterica enterica serovar Typhi
cuguaacaacuguuuuucac

SEQ ID NO: 1676850 - RNA, 14 nt, Salmonella enterica enterica serovar Typhi
cuguaacacugccg

SEQ ID NO: 1676851 - RNA, 20 nt, Salmonella enterica enterica serovar Typhi
cuguaaccccagcaucugca

SEQ ID NO: 1676852 - RNA, 14 nt, Salmonella enterica enterica serovar Typhi
cuguaaccccugcg

SEQ ID NO: 1676853 - RNA, 23 nt, Salmonella enterica enterica serovar Typhi
cuguaaaucgcgcccgacauggc

SEQ ID NO: 1676854 - RNA, 17 nt, Salmonella enterica enterica serovar Typhi
cuguaaacguuccugcc

SEQ ID NO: 1676855 - RNA, 23 nt, Salmonella enterica enterica serovar Typhi
cuguaaaagggauacgguuuuuu

SEQ ID NO: 1676856 - RNA, 12 nt, Salmonella enterica enterica serovar Typhi
cuguaaaaggga

SEQ ID NO: 1676857 - RNA, 16 nt, Salmonella enterica enterica serovar Typhi
cuguacggaauaagcg

SEQ ID NO: 1676858 - RNA, 20 nt, Salmonella enterica enterica serovar Typhi
cuguacggagcuaauaugaa

SEQ ID NO: 1676859 - RNA, 19 nt, Salmonella enterica enterica serovar Typhi
cuguacgcgggaaauaccu

SEQ ID NO: 1676860 - RNA, 15 nt, Salmonella enterica enterica serovar Typhi
cuguacgcccagccg

SEQ ID NO: 1676861 - RNA, 13 nt, Salmonella enterica enterica serovar Typhi
cuguacgccucuu

SEQ ID NO: 1676862 - RNA, 18 nt, Salmonella enterica enterica serovar Typhi
cuguaccugauccagcuc

SEQ ID NO: 1676863 - RNA, 17 nt, Salmonella enterica enterica serovar Typhi
cuguaccgcguccugac

SEQ ID NO: 1676864 - RNA, 12 nt, Salmonella enterica enterica serovar Typhi
cuguaccaggac

SEQ ID NO: 1676865 - RNA, 15 nt, Salmonella enterica enterica serovar Typhi
cuguaccaggacgca

SEQ ID NO: 1676866 - RNA, 14 nt, Salmonella enterica enterica serovar Typhi
cuguaccaccacgc

SEQ ID NO: 1676867 - RNA, 16 nt, Salmonella enterica enterica serovar Typhi
cuguaccaccacgccc

SEQ ID NO: 1676868 - RNA, 19 nt, Salmonella enterica enterica serovar Typhi
cuguacaaaaucaucauca

SEQ ID NO: 1676869 - RNA, 13 nt, Salmonella enterica enterica serovar Typhi
cuguacauaucca

SEQ ID NO: 1676870 - RNA, 17 nt, Salmonella enterica enterica serovar Typhi
cuguaaugucuggugca

SEQ ID NO: 1676871 - RNA, 23 nt, Salmonella enterica enterica serovar Typhi
cuguaauuauaaauauuaaugaa

SEQ ID NO: 1676872 - RNA, 17 nt, Salmonella enterica enterica serovar Typhi
cugggucacgauaacca

SEQ ID NO: 1676873 - RNA, 15 nt, Salmonella enterica enterica serovar Typhi
cuggguaugcagugg

SEQ ID NO: 1676874 - RNA, 23 nt, Salmonella enterica enterica serovar Typhi
cugggugaugcgggacugcugcu

SEQ ID NO: 1676875 - RNA, 18 nt, Salmonella enterica enterica serovar Typhi
cuggguagcuucugucug

SEQ ID NO: 1676876 - RNA, 12 nt, Salmonella enterica enterica serovar Typhi
cugguaaaccgg

SEQ ID NO: 1676877 - RNA, 16 nt, Salmonella enterica enterica serovar Typhi
cugguaacggcacugc

SEQ ID NO: 1676878 - RNA, 23 nt, Salmonella enterica enterica serovar Typhi
cugguaaccguaacgcuccugga

SEQ ID NO: 1676879 - RNA, 20 nt, Salmonella enterica enterica serovar Typhi
cuggguuagccaaacucuga

SEQ ID NO: 1676880 - RNA, 18 nt, Salmonella enterica enterica serovar Typhi
cuggguuccgggcgcacc

SEQ ID NO: 1676881 - RNA, 21 nt, Salmonella enterica enterica serovar Typhi
cugggcuuuauccugaccgcu

SEQ ID NO: 1676882 - RNA, 14 nt, Salmonella enterica enterica serovar Typhi
cugggcugagaaaa

SEQ ID NO: 1676883 - RNA, 22 nt, Salmonella enterica enterica serovar Typhi
cugggcgagggaggcaaucgca

SEQ ID NO: 1676884 - RNA, 17 nt, Salmonella enterica enterica serovar Typhi
cugggcgacuucauuca

SEQ ID NO: 1676885 - RNA, 19 nt, Salmonella enterica enterica serovar Typhi
cugggcgcaugaggccugu

SEQ ID NO: 1676886 - RNA, 12 nt, Salmonella enterica enterica serovar Typhi
cugguaguccuc

SEQ ID NO: 1676887 - RNA, 18 nt, Salmonella enterica enterica serovar Typhi
cugguauaggccaggcua

SEQ ID NO: 1676888 - RNA, 15 nt, Salmonella enterica enterica serovar Typhi
cugguauugaauauu

SEQ ID NO: 1676889 - RNA, 19 nt, Salmonella enterica enterica serovar Typhi
cuggucaacacgcggucgu

SEQ ID NO: 1676890 - RNA, 17 nt, Salmonella enterica enterica serovar Typhi
cugguaagagagccuua

SEQ ID NO: 1676891 - RNA, 15 nt, Salmonella enterica enterica serovar Typhi
cugguaaggcaaaua

SEQ ID NO: 1676892 - RNA, 21 nt, Salmonella enterica enterica serovar Typhi
cugguacguccauccgccggg

SEQ ID NO: 1676893 - RNA, 21 nt, Salmonella enterica enterica serovar Typhi
cugguagcccucgcaaagcug

SEQ ID NO: 1676894 - RNA, 18 nt, Salmonella enterica enterica serovar Typhi
cuggucggcgaccagcag

SEQ ID NO: 1676895 - RNA, 13 nt, Salmonella enterica enterica serovar Typhi
cuggucgggcagg

SEQ ID NO: 1676896 - RNA, 18 nt, Salmonella enterica enterica serovar Typhi
cuggucggugauugucca

SEQ ID NO: 1676897 - RNA, 18 nt, Salmonella enterica enterica serovar Typhi
cuggucugaaucugcucc

SEQ ID NO: 1676898 - RNA, 20 nt, Salmonella enterica enterica serovar Typhi
cuggugaaacguguuuaucc

SEQ ID NO: 1676899 - RNA, 20 nt, Salmonella enterica enterica serovar Typhi
cuggugagguuucagcaccu

SEQ ID NO: 1676900 - RNA, 18 nt, Salmonella enterica enterica serovar Typhi
cuggugacgaugauaaca

SEQ ID NO: 1676901 - RNA, 21 nt, Salmonella enterica enterica serovar Typhi
cugugccagcucguuauuucc

SEQ ID NO: 1676902 - RNA, 21 nt, Salmonella enterica enterica serovar Typhi
cugugccgcuggugcuacggg

SEQ ID NO: 1676903 - RNA, 15 nt, Salmonella enterica enterica serovar Typhi
cugugccugccugug

SEQ ID NO: 1676904 - RNA, 14 nt, Salmonella enterica enterica serovar Typhi
cugugcgacaaccu

SEQ ID NO: 1676905 - RNA, 13 nt, Salmonella enterica enterica serovar Typhi
cugugccugccug

SEQ ID NO: 1676906 - RNA, 20 nt, Salmonella enterica enterica serovar Typhi
cugugccgucguacucacca

SEQ ID NO: 1676907 - RNA, 13 nt, Salmonella enterica enterica serovar Typhi
cugugcgccugcu

SEQ ID NO: 1676908 - RNA, 13 nt, Salmonella enterica enterica serovar Typhi
cugugcgagacca

SEQ ID NO: 1676909 - RNA, 15 nt, Salmonella enterica enterica serovar Typhi
cugugcggaauagcc

SEQ ID NO: 1676910 - RNA, 20 nt, Salmonella enterica enterica serovar Typhi
cugugcucgauauauuuucc

SEQ ID NO: 1676911 - RNA, 17 nt, Salmonella enterica enterica serovar Typhi
cugugcuaucaggccua

SEQ ID NO: 1676912 - RNA, 18 nt, Salmonella enterica enterica serovar Typhi
cugugcucgauauauuuu

SEQ ID NO: 1676913 - RNA, 15 nt, Salmonella enterica enterica serovar Typhi
cuguggaaaaucugg

SEQ ID NO: 1676914 - RNA, 14 nt, Salmonella enterica enterica serovar Typhi
cuguggaaacugug

SEQ ID NO: 1676915 - RNA, 17 nt, Salmonella enterica enterica serovar Typhi
cuguggaggguaagaaa

SEQ ID NO: 1676916 - RNA, 13 nt, Salmonella enterica enterica serovar Typhi
cugugccagccca

SEQ ID NO: 1676917 - RNA, 23 nt, Salmonella enterica enterica serovar Typhi
cugugcaacaucuuaccggugcg

SEQ ID NO: 1676918 - RNA, 18 nt, Salmonella enterica enterica serovar Typhi
cugugcauaucuggcgag

SEQ ID NO: 1676919 - RNA, 16 nt, Salmonella enterica enterica serovar Typhi
cugugagccuaaaaca

SEQ ID NO: 1676920 - RNA, 18 nt, Salmonella enterica enterica serovar Typhi
cugugagaaggugguggg

SEQ ID NO: 1676921 - RNA, 23 nt, Salmonella enterica enterica serovar Typhi
cugugacaucgccccggccuuau

SEQ ID NO: 1676922 - RNA, 16 nt, Salmonella enterica enterica serovar Typhi
cugugauugaauucac

SEQ ID NO: 1676923 - RNA, 16 nt, Salmonella enterica enterica serovar Typhi
cugucgcucgcggcag

SEQ ID NO: 1676924 - RNA, 23 nt, Salmonella enterica enterica serovar Typhi
cugucgcuaaagcacuccccggc

SEQ ID NO: 1676925 - RNA, 20 nt, Salmonella enterica enterica serovar Typhi
cugucgccgcguaaauccac

SEQ ID NO: 1676926 - RNA, 15 nt, Salmonella enterica enterica serovar Typhi
cugucgccaccacuc

SEQ ID NO: 1676927 - RNA, 15 nt, Salmonella enterica enterica serovar Typhi
cugucgccgcccguc

SEQ ID NO: 1676928 - RNA, 13 nt, Salmonella enterica enterica serovar Typhi
cugucgccaccac

SEQ ID NO: 1676929 - RNA, 14 nt, Salmonella enterica enterica serovar Typhi
cugucgccaccacu

SEQ ID NO: 1676930 - RNA, 16 nt, Salmonella enterica enterica serovar Typhi
cugucgggagccucuu

SEQ ID NO: 1676931 - RNA, 19 nt, Salmonella enterica enterica serovar Typhi
cugucggcagaaccugacc

SEQ ID NO: 1676932 - RNA, 15 nt, Salmonella enterica enterica serovar Typhi
cugucggcagaaccu

SEQ ID NO: 1676933 - RNA, 16 nt, Salmonella enterica enterica serovar Typhi
cugucgauaaacucau

SEQ ID NO: 1676934 - RNA, 15 nt, Salmonella enterica enterica serovar Typhi
cugucugccaugccu

SEQ ID NO: 1676935 - RNA, 14 nt, Salmonella enterica enterica serovar Typhi
cugucugaaucagu

SEQ ID NO: 1676936 - RNA, 20 nt, Salmonella enterica enterica serovar Typhi
cugucugcaagagaaauaac

SEQ ID NO: 1676937 - RNA, 14 nt, Salmonella enterica enterica serovar Typhi
cugucuuguuuuuc

SEQ ID NO: 1676938 - RNA, 14 nt, Salmonella enterica enterica serovar Typhi
cugucuuguggaac

SEQ ID NO: 1676939 - RNA, 15 nt, Salmonella enterica enterica serovar Typhi
cugucuuguuuuucu

SEQ ID NO: 1676940 - RNA, 14 nt, Salmonella enterica enterica serovar Typhi
cugugaaguaauuc

SEQ ID NO: 1676941 - RNA, 15 nt, Salmonella enterica enterica serovar Typhi
cugucggucagauuc

SEQ ID NO: 1676942 - RNA, 13 nt, Salmonella enterica enterica serovar Typhi
cugucguauuuau

SEQ ID NO: 1676943 - RNA, 16 nt, Salmonella enterica enterica serovar Typhi
cugucguauuuauuuu

SEQ ID NO: 1676944 - RNA, 19 nt, Salmonella enterica enterica serovar Typhi
cugucguauuuauuuucug

SEQ ID NO: 1676945 - RNA, 17 nt, Salmonella enterica enterica serovar Typhi
cugucggucagauucag

SEQ ID NO: 1676946 - RNA, 23 nt, Salmonella enterica enterica serovar Typhi
cuguccagccgcccuucuccggu

SEQ ID NO: 1676947 - RNA, 17 nt, Salmonella enterica enterica serovar Typhi
cugucccagccuuccug

SEQ ID NO: 1676948 - RNA, 18 nt, Salmonella enterica enterica serovar Typhi
cuguccaugacgaccaca

SEQ ID NO: 1676949 - RNA, 19 nt, Salmonella enterica enterica serovar Typhi
cugucccagccuuccuggu

SEQ ID NO: 1676950 - RNA, 21 nt, Salmonella enterica enterica serovar Typhi
cuguccgccuuaucaggccug

SEQ ID NO: 1676951 - RNA, 19 nt, Salmonella enterica enterica serovar Typhi
cuguccggguaucugggcg

SEQ ID NO: 1676952 - RNA, 18 nt, Salmonella enterica enterica serovar Typhi
cuguccgcccaguaccag

SEQ ID NO: 1676953 - RNA, 19 nt, Salmonella enterica enterica serovar Typhi
aaacugcauccccugcagg

SEQ ID NO: 1676954 - RNA, 13 nt, Salmonella enterica enterica serovar Typhi
cugucaccagcag

SEQ ID NO: 1676955 - RNA, 22 nt, Salmonella enterica enterica serovar Typhi
aaacugacaucccccucuugcc

SEQ ID NO: 1676956 - RNA, 17 nt, Salmonella enterica enterica serovar Typhi
cugucagaaaucugaau

SEQ ID NO: 1676957 - RNA, 18 nt, Salmonella enterica enterica serovar Typhi
cugucagaaaucugaaug

SEQ ID NO: 1676958 - RNA, 12 nt, Salmonella enterica enterica serovar Typhi
cugucaucauca

SEQ ID NO: 1676959 - RNA, 23 nt, Salmonella enterica enterica serovar Typhi
cugucaucgaaggcgauaccggu

SEQ ID NO: 1676960 - RNA, 19 nt, Salmonella enterica enterica serovar Typhi
aaacucuguguuaugaaug

SEQ ID NO: 1676961 - RNA, 21 nt, Salmonella enterica enterica serovar Typhi
cuguaucuucgccguauucuu

SEQ ID NO: 1676962 - RNA, 15 nt, Salmonella enterica enterica serovar Typhi
cuguaucaaaccaac

SEQ ID NO: 1676963 - RNA, 15 nt, Salmonella enterica enterica serovar Typhi
cuguauaaacucagc

SEQ ID NO: 1676964 - RNA, 14 nt, Salmonella enterica enterica serovar Typhi
cuguacgccucuuu

SEQ ID NO: 1676965 - RNA, 23 nt, Salmonella enterica enterica serovar Typhi
cuguagauagcuauccacgcaga

SEQ ID NO: 1676966 - RNA, 17 nt, Salmonella enterica enterica serovar Typhi
cuguagauaccuacuuu

SEQ ID NO: 1676967 - RNA, 18 nt, Salmonella enterica enterica serovar Typhi
cuguagauaccuacuuua

SEQ ID NO: 1676968 - RNA, 20 nt, Salmonella enterica enterica serovar Typhi
cuguagcaguggagaggcca

SEQ ID NO: 1676969 - RNA, 20 nt, Salmonella enterica enterica serovar Typhi
cuguagcgcuuuggagguca

SEQ ID NO: 1676970 - RNA, 22 nt, Salmonella enterica enterica serovar Typhi
cuguagggcacugggcgauacc

SEQ ID NO: 1676971 - RNA, 18 nt, Salmonella enterica enterica serovar Typhi
cuguaggaucaaccaccu

SEQ ID NO: 1676972 - RNA, 15 nt, Salmonella enterica enterica serovar Typhi
cuguauaaaauauuu

SEQ ID NO: 1676973 - RNA, 13 nt, Salmonella enterica enterica serovar Typhi
gaagaaaaagaag

SEQ ID NO: 1676974 - RNA, 19 nt, Salmonella enterica enterica serovar Typhi
gaagaaaccgcagaaaaag

SEQ ID NO: 1676975 - RNA, 17 nt, Salmonella enterica enterica serovar Typhi
gaacuuccgccaccacc

SEQ ID NO: 1676976 - RNA, 19 nt, Salmonella enterica enterica serovar Typhi
gaacuggguaugcaguggg

SEQ ID NO: 1676977 - RNA, 14 nt, Salmonella enterica enterica serovar Typhi
gaacuggugaaaca

SEQ ID NO: 1676978 - RNA, 17 nt, Salmonella enterica enterica serovar Typhi
gaacugggugccgugaa

SEQ ID NO: 1676979 - RNA, 16 nt, Salmonella enterica enterica serovar Typhi
gaacuguucagccagc

SEQ ID NO: 1676980 - RNA, 15 nt, Salmonella enterica enterica serovar Typhi
gaacuuacccagcaa

SEQ ID NO: 1676981 - RNA, 14 nt, Salmonella enterica enterica serovar Typhi
gaagaacuggauga

SEQ ID NO: 1676982 - RNA, 22 nt, Salmonella enterica enterica serovar Typhi
aaagauaaccauuucaaacguu

SEQ ID NO: 1676983 - RNA, 20 nt, Salmonella enterica enterica serovar Typhi
gaagcccaacuacacucuua

SEQ ID NO: 1676984 - RNA, 14 nt, Salmonella enterica enterica serovar Typhi
gaagccaucaaauu

SEQ ID NO: 1676985 - RNA, 21 nt, Salmonella enterica enterica serovar Typhi
gaagccauccucacgcaacca

SEQ ID NO: 1676986 - RNA, 17 nt, Salmonella enterica enterica serovar Typhi
gaagcacgacacaaaag

SEQ ID NO: 1676987 - RNA, 17 nt, Salmonella enterica enterica serovar Typhi
gaagauaaacagcagcg

SEQ ID NO: 1676988 - RNA, 16 nt, Salmonella enterica enterica serovar Typhi
gaagagugaauaacaa

SEQ ID NO: 1676989 - RNA, 19 nt, Salmonella enterica enterica serovar Typhi
gaagagugaauaacaaccg

SEQ ID NO: 1676990 - RNA, 21 nt, Salmonella enterica enterica serovar Typhi
gaagaguuaacuucuccgcca

SEQ ID NO: 1676991 - RNA, 20 nt, Salmonella enterica enterica serovar Typhi
gaagauagcgggcaaugcca

SEQ ID NO: 1676992 - RNA, 18 nt, Salmonella enterica enterica serovar Typhi
gaagcgcguucgucccac

SEQ ID NO: 1676993 - RNA, 20 nt, Salmonella enterica enterica serovar Typhi
gaagcgcguuggcguuaccu

SEQ ID NO: 1676994 - RNA, 21 nt, Salmonella enterica enterica serovar Typhi
gaagcgcgcgcacaacgugca

SEQ ID NO: 1676995 - RNA, 14 nt, Salmonella enterica enterica serovar Typhi
gaagcgcaguguua

SEQ ID NO: 1676996 - RNA, 23 nt, Salmonella enterica enterica serovar Typhi
gaagcccggccacagcgccagac

SEQ ID NO: 1676997 - RNA, 17 nt, Salmonella enterica enterica serovar Typhi
gaagcccggccacagcg

SEQ ID NO: 1676998 - RNA, 17 nt, Salmonella enterica enterica serovar Typhi
gaagcgauuuauccacc

SEQ ID NO: 1676999 - RNA, 18 nt, Salmonella enterica enterica serovar Typhi
gaagcccaugauggugaa

SEQ ID NO: 1677000 - RNA, 22 nt, Salmonella enterica enterica serovar Typhi
gaagcccaugauggugaacaga

SEQ ID NO: 1677001 - RNA, 21 nt, Salmonella enterica enterica serovar Typhi
gaaggcaucuucagacaguuu

SEQ ID NO: 1677002 - RNA, 15 nt, Salmonella enterica enterica serovar Typhi
gaaggcaacgccgcc

SEQ ID NO: 1677003 - RNA, 16 nt, Salmonella enterica enterica serovar Typhi
gaagcguuccgccacu

SEQ ID NO: 1677004 - RNA, 12 nt, Salmonella enterica enterica serovar Typhi
gaaggacaagcu

SEQ ID NO: 1677005 - RNA, 15 nt, Salmonella enterica enterica serovar Typhi
aaagaucgcugcaau

SEQ ID NO: 1677006 - RNA, 15 nt, Salmonella enterica enterica serovar Typhi
aaagaucauuccuga

SEQ ID NO: 1677007 - RNA, 16 nt, Salmonella enterica enterica serovar Typhi
gaaguuuugcuggaau

SEQ ID NO: 1677008 - RNA, 17 nt, Salmonella enterica enterica serovar Typhi
gaagucgaaauuuucuu

SEQ ID NO: 1677009 - RNA, 12 nt, Salmonella enterica enterica serovar Typhi
gaauaccacugu

SEQ ID NO: 1677010 - RNA, 15 nt, Salmonella enterica enterica serovar Typhi
gaauaaucccggcgc

SEQ ID NO: 1677011 - RNA, 19 nt, Salmonella enterica enterica serovar Typhi
gaauaauaauacaccgcca

SEQ ID NO: 1677012 - RNA, 15 nt, Salmonella enterica enterica serovar Typhi
gaauacccaacugua

SEQ ID NO: 1677013 - RNA, 19 nt, Salmonella enterica enterica serovar Typhi
gaauacccgcccgguuuug

SEQ ID NO: 1677014 - RNA, 15 nt, Salmonella enterica enterica serovar Typhi
gaauaccugaaagag

SEQ ID NO: 1677015 - RNA, 13 nt, Salmonella enterica enterica serovar Typhi
gaauaaacucccg

SEQ ID NO: 1677016 - RNA, 15 nt, Salmonella enterica enterica serovar Typhi
gaauagccagccccc

SEQ ID NO: 1677017 - RNA, 19 nt, Salmonella enterica enterica serovar Typhi
gaauagaguaauacaucca

SEQ ID NO: 1677018 - RNA, 16 nt, Salmonella enterica enterica serovar Typhi
gaauagaggcgcuggc

SEQ ID NO: 1677019 - RNA, 19 nt, Salmonella enterica enterica serovar Typhi
gaauagccugggcaaggcu

SEQ ID NO: 1677020 - RNA, 23 nt, Salmonella enterica enterica serovar Typhi
gaauagccccucaauuauguauu

SEQ ID NO: 1677021 - RNA, 23 nt, Salmonella enterica enterica serovar Typhi
gaauagcccucgguggauaaauu

SEQ ID NO: 1677022 - RNA, 15 nt, Salmonella enterica enterica serovar Typhi
gaauagcguauuuuu

SEQ ID NO: 1677023 - RNA, 22 nt, Salmonella enterica enterica serovar Typhi
gaauagcguauuuuuguacuuu

SEQ ID NO: 1677024 - RNA, 22 nt, Salmonella enterica enterica serovar Typhi
aaagauuuaucaauuuuuaaaa

SEQ ID NO: 1677025 - RNA, 18 nt, Salmonella enterica enterica serovar Typhi
aaagauuagccccagcgc

SEQ ID NO: 1677026 - RNA, 22 nt, Salmonella enterica enterica serovar Typhi
aaagauuauuuuaucaucagca

SEQ ID NO: 1677027 - RNA, 12 nt, Salmonella enterica enterica serovar Typhi
gaauccagcagg

SEQ ID NO: 1677028 - RNA, 22 nt, Salmonella enterica enterica serovar Typhi
gaauccacuccguguugcugcc

SEQ ID NO: 1677029 - RNA, 19 nt, Salmonella enterica enterica serovar Typhi
gaaucccauuagccacccc

SEQ ID NO: 1677030 - RNA, 16 nt, Salmonella enterica enterica serovar Typhi
gaauccagguacccca

SEQ ID NO: 1677031 - RNA, 14 nt, Salmonella enterica enterica serovar Typhi
gaaucaguauccac

SEQ ID NO: 1677032 - RNA, 16 nt, Salmonella enterica enterica serovar Typhi
gaaucagugcaucuuc

SEQ ID NO: 1677033 - RNA, 18 nt, Salmonella enterica enterica serovar Typhi
gaaucaguaacacaauca

SEQ ID NO: 1677034 - RNA, 15 nt, Salmonella enterica enterica serovar Typhi
gaaucacauccgcca

SEQ ID NO: 1677035 - RNA, 12 nt, Salmonella enterica enterica serovar Typhi
gaaugaaacagu

SEQ ID NO: 1677036 - RNA, 18 nt, Salmonella enterica enterica serovar Typhi
gaaugaaaaaaaaauuac

SEQ ID NO: 1677037 - RNA, 23 nt, Salmonella enterica enterica serovar Typhi
gaaucuggucggugauauauuca

SEQ ID NO: 1677038 - RNA, 16 nt, Salmonella enterica enterica serovar Typhi
gaaucuguauaaaaua

SEQ ID NO: 1677039 - RNA, 16 nt, Salmonella enterica enterica serovar Typhi
gaaucugguuguuucg

SEQ ID NO: 1677040 - RNA, 13 nt, Salmonella enterica enterica serovar Typhi
gaaucgccagcau

SEQ ID NO: 1677041 - RNA, 14 nt, Salmonella enterica enterica serovar Typhi
gaaugguucccuga

SEQ ID NO: 1677042 - RNA, 23 nt, Salmonella enterica enterica serovar Typhi
gaauggugcggccuuacccauac

SEQ ID NO: 1677043 - RNA, 17 nt, Salmonella enterica enterica serovar Typhi
gaauguauaauccaaca

SEQ ID NO: 1677044 - RNA, 15 nt, Salmonella enterica enterica serovar Typhi
gaauguagcgcccuu

SEQ ID NO: 1677045 - RNA, 14 nt, Salmonella enterica enterica serovar Typhi
gaaugugcaccuua

SEQ ID NO: 1677046 - RNA, 20 nt, Salmonella enterica enterica serovar Typhi
gaauguuccccguugagaau

SEQ ID NO: 1677047 - RNA, 23 nt, Salmonella enterica enterica serovar Typhi
gaaugccgcccauccagagcagu

SEQ ID NO: 1677048 - RNA, 23 nt, Salmonella enterica enterica serovar Typhi
gaaugcgcgcgugaccccaggca

SEQ ID NO: 1677049 - RNA, 18 nt, Salmonella enterica enterica serovar Typhi
gaaugccggauggcggcg

SEQ ID NO: 1677050 - RNA, 23 nt, Salmonella enterica enterica serovar Typhi
gaaugccauauuuuuccagcgcc

SEQ ID NO: 1677051 - RNA, 18 nt, Salmonella enterica enterica serovar Typhi
gaaugcccacuccggcgu

SEQ ID NO: 1677052 - RNA, 18 nt, Salmonella enterica enterica serovar Typhi
gaaugccgaauggcgggc

SEQ ID NO: 1677053 - RNA, 16 nt, Salmonella enterica enterica serovar Typhi
gaaugcccuuuuccag

SEQ ID NO: 1677054 - RNA, 19 nt, Salmonella enterica enterica serovar Typhi
gaauuauuaaaucaauacu

SEQ ID NO: 1677055 - RNA, 13 nt, Salmonella enterica enterica serovar Typhi
gaauuauuaccaa

SEQ ID NO: 1677056 - RNA, 15 nt, Salmonella enterica enterica serovar Typhi
gaauuaucaggguua

SEQ ID NO: 1677057 - RNA, 13 nt, Salmonella enterica enterica serovar Typhi
gaauugcaaggcg

SEQ ID NO: 1677058 - RNA, 14 nt, Salmonella enterica enterica serovar Typhi
gaauuauuucagga

SEQ ID NO: 1677059 - RNA, 16 nt, Salmonella enterica enterica serovar Typhi
gaauuaagcaauccau

SEQ ID NO: 1677060 - RNA, 17 nt, Salmonella enterica enterica serovar Typhi
gaauugcgguuuauccc

SEQ ID NO: 1677061 - RNA, 13 nt, Salmonella enterica enterica serovar Typhi
gaauugguagacg

SEQ ID NO: 1677062 - RNA, 16 nt, Salmonella enterica enterica serovar Typhi
gaauuuaaauagcaau

SEQ ID NO: 1677063 - RNA, 16 nt, Salmonella enterica enterica serovar Typhi
gaauuuaucccguggu

SEQ ID NO: 1677064 - RNA, 14 nt, Salmonella enterica enterica serovar Typhi
gacaaaaauuaaaa

SEQ ID NO: 1677065 - RNA, 13 nt, Salmonella enterica enterica serovar Typhi
gacaaaaauacca

SEQ ID NO: 1677066 - RNA, 13 nt, Salmonella enterica enterica serovar Typhi
gaauuucaccacc

SEQ ID NO: 1677067 - RNA, 20 nt, Salmonella enterica enterica serovar Typhi
gaauuuuuccagcucagaaa

SEQ ID NO: 1677068 - RNA, 14 nt, Salmonella enterica enterica serovar Typhi
gacaaacccuguau

SEQ ID NO: 1677069 - RNA, 15 nt, Salmonella enterica enterica serovar Typhi
gacaaccagcgaaau

SEQ ID NO: 1677070 - RNA, 21 nt, Salmonella enterica enterica serovar Typhi
gacaaaaucuuuccagcucca

SEQ ID NO: 1677071 - RNA, 15 nt, Salmonella enterica enterica serovar Typhi
gacaaaaggugucac

SEQ ID NO: 1677072 - RNA, 19 nt, Salmonella enterica enterica serovar Typhi
gacaaaagauuuaucaauu

SEQ ID NO: 1677073 - RNA, 18 nt, Salmonella enterica enterica serovar Typhi
gacaaggcgcgccagcgc

SEQ ID NO: 1677074 - RNA, 17 nt, Salmonella enterica enterica serovar Typhi
gacaacgccgccuggca

SEQ ID NO: 1677075 - RNA, 18 nt, Salmonella enterica enterica serovar Typhi
gacaacgcuccagcaguu

SEQ ID NO: 1677076 - RNA, 15 nt, Salmonella enterica enterica serovar Typhi
gacaaugaaccagcc

SEQ ID NO: 1677077 - RNA, 19 nt, Salmonella enterica enterica serovar Typhi
gacaauacuuaaaccugcg

SEQ ID NO: 1677078 - RNA, 18 nt, Salmonella enterica enterica serovar Typhi
gacaauaaacuggcugug

SEQ ID NO: 1677079 - RNA, 16 nt, Salmonella enterica enterica serovar Typhi
gacacccaauccggcu

SEQ ID NO: 1677080 - RNA, 15 nt, Salmonella enterica enterica serovar Typhi
gacacauuugauacu

SEQ ID NO: 1677081 - RNA, 22 nt, Salmonella enterica enterica serovar Typhi
gacaauuuugauaagagaaaau

SEQ ID NO: 1677082 - RNA, 23 nt, Salmonella enterica enterica serovar Typhi
gacaauuuugauaagagaaaaua

SEQ ID NO: 1677083 - RNA, 16 nt, Salmonella enterica enterica serovar Typhi
gacuagacagccucuc

SEQ ID NO: 1677084 - RNA, 14 nt, Salmonella enterica enterica serovar Typhi
gacuacgucagaug

SEQ ID NO: 1677085 - RNA, 15 nt, Salmonella enterica enterica serovar Typhi
gacuaauuauuuuuc

SEQ ID NO: 1677086 - RNA, 17 nt, Salmonella enterica enterica serovar Typhi
gacuauggucugaaaga

SEQ ID NO: 1677087 - RNA, 18 nt, Salmonella enterica enterica serovar Typhi
gacuauuccgcaaacgcc

SEQ ID NO: 1677088 - RNA, 14 nt, Salmonella enterica enterica serovar Typhi
gacuauucuucccc

SEQ ID NO: 1677089 - RNA, 16 nt, Salmonella enterica enterica serovar Typhi
gacuaucccucugaaa

SEQ ID NO: 1677090 - RNA, 18 nt, Salmonella enterica enterica serovar Typhi
gacuauccagccagggau

SEQ ID NO: 1677091 - RNA, 22 nt, Salmonella enterica enterica serovar Typhi
gacuaucgaaagagcaaauacu

SEQ ID NO: 1677092 - RNA, 17 nt, Salmonella enterica enterica serovar Typhi
gacuaucagaaaaaauu

SEQ ID NO: 1677093 - RNA, 17 nt, Salmonella enterica enterica serovar Typhi
gacguucaauucauaga

SEQ ID NO: 1677094 - RNA, 17 nt, Salmonella enterica enterica serovar Typhi
gacgugugauuguggcg

SEQ ID NO: 1677095 - RNA, 14 nt, Salmonella enterica enterica serovar Typhi
gacuaaaacgugcu

SEQ ID NO: 1677096 - RNA, 15 nt, Salmonella enterica enterica serovar Typhi
gacguucgacccgca

SEQ ID NO: 1677097 - RNA, 16 nt, Salmonella enterica enterica serovar Typhi
gacuaaaagacgccau

SEQ ID NO: 1677098 - RNA, 16 nt, Salmonella enterica enterica serovar Typhi
gacuaauggcauuucc

SEQ ID NO: 1677099 - RNA, 15 nt, Salmonella enterica enterica serovar Typhi
gacuaaccuugauuc

SEQ ID NO: 1677100 - RNA, 19 nt, Salmonella enterica enterica serovar Typhi
gacggcguaagucgcgcau

SEQ ID NO: 1677101 - RNA, 14 nt, Salmonella enterica enterica serovar Typhi
gacggcggaccccu

SEQ ID NO: 1677102 - RNA, 15 nt, Salmonella enterica enterica serovar Typhi
gacggcuaagcugau

SEQ ID NO: 1677103 - RNA, 20 nt, Salmonella enterica enterica serovar Typhi
gacggcuaauaugccaggcu

SEQ ID NO: 1677104 - RNA, 19 nt, Salmonella enterica enterica serovar Typhi
gacguaggccgaauaagac

SEQ ID NO: 1677105 - RNA, 14 nt, Salmonella enterica enterica serovar Typhi
gacggugagcugaa

SEQ ID NO: 1677106 - RNA, 21 nt, Salmonella enterica enterica serovar Typhi
gacgcuuugcauuaucgaugc

SEQ ID NO: 1677107 - RNA, 14 nt, Salmonella enterica enterica serovar Typhi
gacggaaaccagca

SEQ ID NO: 1677108 - RNA, 13 nt, Salmonella enterica enterica serovar Typhi
gacggaaaccagc

SEQ ID NO: 1677109 - RNA, 21 nt, Salmonella enterica enterica serovar Typhi
gacggcccaacagcaauguuu

SEQ ID NO: 1677110 - RNA, 11 nt, Salmonella enterica enterica serovar Typhi
gacggagaaaa

SEQ ID NO: 1677111 - RNA, 22 nt, Salmonella enterica enterica serovar Typhi
gacggacucgcgcagaaucagc

SEQ ID NO: 1677112 - RNA, 12 nt, Salmonella enterica enterica serovar Typhi
gacggagaaaaa

SEQ ID NO: 1677113 - RNA, 20 nt, Salmonella enterica enterica serovar Typhi
gaccugcagcuccgcaauuu

SEQ ID NO: 1677114 - RNA, 21 nt, Salmonella enterica enterica serovar Typhi
gaccugccgcgccugauucau

SEQ ID NO: 1677115 - RNA, 22 nt, Salmonella enterica enterica serovar Typhi
gaccugccuuucccauccgccg

SEQ ID NO: 1677116 - RNA, 18 nt, Salmonella enterica enterica serovar Typhi
gaccugagcgugcaaugu

SEQ ID NO: 1677117 - RNA, 16 nt, Salmonella enterica enterica serovar Typhi
gaccugcaacuccaca

SEQ ID NO: 1677118 - RNA, 23 nt, Salmonella enterica enterica serovar Typhi
gaccugcaacuccacaaauagca

SEQ ID NO: 1677119 - RNA, 17 nt, Salmonella enterica enterica serovar Typhi
gaccugcuccaugacgu

SEQ ID NO: 1677120 - RNA, 13 nt, Salmonella enterica enterica serovar Typhi
gaccggcccgcuu

SEQ ID NO: 1677121 - RNA, 22 nt, Salmonella enterica enterica serovar Typhi
gaccugaauauucggcuccagg

SEQ ID NO: 1677122 - RNA, 18 nt, Salmonella enterica enterica serovar Typhi
gaccucuuuaucuuuuag

SEQ ID NO: 1677123 - RNA, 17 nt, Salmonella enterica enterica serovar Typhi
gaccggacguugaaaaa

SEQ ID NO: 1677124 - RNA, 23 nt, Salmonella enterica enterica serovar Typhi
gaccggcaaaaagaaucgccagu

SEQ ID NO: 1677125 - RNA, 15 nt, Salmonella enterica enterica serovar Typhi
gaccgcuuuuuccag

SEQ ID NO: 1677126 - RNA, 23 nt, Salmonella enterica enterica serovar Typhi
gaccgcuuuagccaguagcuggu

SEQ ID NO: 1677127 - RNA, 21 nt, Salmonella enterica enterica serovar Typhi
gacgacgcagcuucgccgcgu

SEQ ID NO: 1677128 - RNA, 13 nt, Salmonella enterica enterica serovar Typhi
gacgaacaacauc

SEQ ID NO: 1677129 - RNA, 15 nt, Salmonella enterica enterica serovar Typhi
gacgcagcucauacc

SEQ ID NO: 1677130 - RNA, 21 nt, Salmonella enterica enterica serovar Typhi
gacgcagcaguuccccgccgc

SEQ ID NO: 1677131 - RNA, 21 nt, Salmonella enterica enterica serovar Typhi
gacgauacucagccccaggcc

SEQ ID NO: 1677132 - RNA, 18 nt, Salmonella enterica enterica serovar Typhi
gacgagguuuccggcggg

SEQ ID NO: 1677133 - RNA, 20 nt, Salmonella enterica enterica serovar Typhi
gacgacuucacccgcgggcg

SEQ ID NO: 1677134 - RNA, 21 nt, Salmonella enterica enterica serovar Typhi
gacgacguucgauacuauaac

SEQ ID NO: 1677135 - RNA, 19 nt, Salmonella enterica enterica serovar Typhi
gacgaaguccuucacaaac

SEQ ID NO: 1677136 - RNA, 17 nt, Salmonella enterica enterica serovar Typhi
gacgacgccagccagcc

SEQ ID NO: 1677137 - RNA, 23 nt, Salmonella enterica enterica serovar Typhi
gacgccccauguggccagcggcc

SEQ ID NO: 1677138 - RNA, 23 nt, Salmonella enterica enterica serovar Typhi
gacgccaccggguuaaagcccug

SEQ ID NO: 1677139 - RNA, 17 nt, Salmonella enterica enterica serovar Typhi
gacgcaucuuuuucccg

SEQ ID NO: 1677140 - RNA, 21 nt, Salmonella enterica enterica serovar Typhi
gacgccaauuccuaucaguac

SEQ ID NO: 1677141 - RNA, 14 nt, Salmonella enterica enterica serovar Typhi
gacgcccaaccagu

SEQ ID NO: 1677142 - RNA, 14 nt, Salmonella enterica enterica serovar Typhi
gacgccagcgggug

SEQ ID NO: 1677143 - RNA, 17 nt, Salmonella enterica enterica serovar Typhi
gacgccauaucgccgcc

SEQ ID NO: 1677144 - RNA, 16 nt, Salmonella enterica enterica serovar Typhi
gacgccaugcaaaaaa

SEQ ID NO: 1677145 - RNA, 14 nt, Salmonella enterica enterica serovar Typhi
gaccccaauagcga

SEQ ID NO: 1677146 - RNA, 12 nt, Salmonella enterica enterica serovar Typhi
gacccccuccuu

SEQ ID NO: 1677147 - RNA, 14 nt, Salmonella enterica enterica serovar Typhi
gaccccucuucuuu

SEQ ID NO: 1677148 - RNA, 19 nt, Salmonella enterica enterica serovar Typhi
gaccccuccggccagcgcc

SEQ ID NO: 1677149 - RNA, 21 nt, Salmonella enterica enterica serovar Typhi
gaccccguccguucacuaacg

SEQ ID NO: 1677150 - RNA, 18 nt, Salmonella enterica enterica serovar Typhi
gaccccggccucgcccgc

SEQ ID NO: 1677151 - RNA, 19 nt, Salmonella enterica enterica serovar Typhi
gaccgacauaaaacccgcc

SEQ ID NO: 1677152 - RNA, 19 nt, Salmonella enterica enterica serovar Typhi
gaccgacaagccccccgca

SEQ ID NO: 1677153 - RNA, 17 nt, Salmonella enterica enterica serovar Typhi
gaccgagacccagcgcg

SEQ ID NO: 1677154 - RNA, 23 nt, Salmonella enterica enterica serovar Typhi
gaccgacgcguuuuccagcacca

SEQ ID NO: 1677155 - RNA, 18 nt, Salmonella enterica enterica serovar Typhi
gaccgagacccagcgcga

SEQ ID NO: 1677156 - RNA, 13 nt, Salmonella enterica enterica serovar Typhi
gaccgccagcaga

SEQ ID NO: 1677157 - RNA, 18 nt, Salmonella enterica enterica serovar Typhi
gaccgccgaguccgaggc

SEQ ID NO: 1677158 - RNA, 22 nt, Salmonella enterica enterica serovar Typhi
gaccgccugcaucaccucagaa

SEQ ID NO: 1677159 - RNA, 12 nt, Salmonella enterica enterica serovar Typhi
gaccauccacca

SEQ ID NO: 1677160 - RNA, 14 nt, Salmonella enterica enterica serovar Typhi
gaccaucggccgcu

SEQ ID NO: 1677161 - RNA, 15 nt, Salmonella enterica enterica serovar Typhi
gaccaucucuuccgc

SEQ ID NO: 1677162 - RNA, 19 nt, Salmonella enterica enterica serovar Typhi
gaccauauucacgcagcuu

SEQ ID NO: 1677163 - RNA, 14 nt, Salmonella enterica enterica serovar Typhi
gaccauauucacgc

SEQ ID NO: 1677164 - RNA, 19 nt, Salmonella enterica enterica serovar Typhi
gaccauaaauagccgaccg

SEQ ID NO: 1677165 - RNA, 16 nt, Salmonella enterica enterica serovar Typhi
gaccauaaaugaaaug

SEQ ID NO: 1677166 - RNA, 22 nt, Salmonella enterica enterica serovar Typhi
gaccaguuuuugcgccagcgca

SEQ ID NO: 1677167 - RNA, 18 nt, Salmonella enterica enterica serovar Typhi
gaccauaaauagccgacc

SEQ ID NO: 1677168 - RNA, 19 nt, Salmonella enterica enterica serovar Typhi
gacccagcgcgaauuugcc

SEQ ID NO: 1677169 - RNA, 17 nt, Salmonella enterica enterica serovar Typhi
gaccauugcguauuuca

SEQ ID NO: 1677170 - RNA, 20 nt, Salmonella enterica enterica serovar Typhi
gaccauuggcaccaccagga

SEQ ID NO: 1677171 - RNA, 22 nt, Salmonella enterica enterica serovar Typhi
gaccaugcauauaagagacgcc

SEQ ID NO: 1677172 - RNA, 12 nt, Salmonella enterica enterica serovar Typhi
gaccaugauauc

SEQ ID NO: 1677173 - RNA, 16 nt, Salmonella enterica enterica serovar Typhi
gaccaccgcaucggca

SEQ ID NO: 1677174 - RNA, 13 nt, Salmonella enterica enterica serovar Typhi
gaccaccgcgcua

SEQ ID NO: 1677175 - RNA, 22 nt, Salmonella enterica enterica serovar Typhi
gaccaccgcgcuagugccgcca

SEQ ID NO: 1677176 - RNA, 15 nt, Salmonella enterica enterica serovar Typhi
gaccacgaaucagga

SEQ ID NO: 1677177 - RNA, 16 nt, Salmonella enterica enterica serovar Typhi
gaccacgaaucaggau

SEQ ID NO: 1677178 - RNA, 20 nt, Salmonella enterica enterica serovar Typhi
gaccagcugacgacgccagc

SEQ ID NO: 1677179 - RNA, 21 nt, Salmonella enterica enterica serovar Typhi
gaccagcugacgacgccagcc

SEQ ID NO: 1677180 - RNA, 14 nt, Salmonella enterica enterica serovar Typhi
gaccacgccgccgc

SEQ ID NO: 1677181 - RNA, 23 nt, Salmonella enterica enterica serovar Typhi
gaccacgccaucaacagcggaga

SEQ ID NO: 1677182 - RNA, 13 nt, Salmonella enterica enterica serovar Typhi
gacaguggcuuua

SEQ ID NO: 1677183 - RNA, 18 nt, Salmonella enterica enterica serovar Typhi
gacaguguucccugcgcu

SEQ ID NO: 1677184 - RNA, 23 nt, Salmonella enterica enterica serovar Typhi
gacagugauuuacuccaaaaaua

SEQ ID NO: 1677185 - RNA, 17 nt, Salmonella enterica enterica serovar Typhi
gacagugaacggcauaa

SEQ ID NO: 1677186 - RNA, 11 nt, Salmonella enterica enterica serovar Typhi
gacagugcuau

SEQ ID NO: 1677187 - RNA, 20 nt, Salmonella enterica enterica serovar Typhi
gacaucauccccggcaggcu

SEQ ID NO: 1677188 - RNA, 17 nt, Salmonella enterica enterica serovar Typhi
gacaucagccagccgcc

SEQ ID NO: 1677189 - RNA, 18 nt, Salmonella enterica enterica serovar Typhi
gacauccagcauuucgac

SEQ ID NO: 1677190 - RNA, 16 nt, Salmonella enterica enterica serovar Typhi
gacaucccagacaaaa

SEQ ID NO: 1677191 - RNA, 17 nt, Salmonella enterica enterica serovar Typhi
gacauggcaauggcuuc

SEQ ID NO: 1677192 - RNA, 23 nt, Salmonella enterica enterica serovar Typhi
gacauccucuucauaacgacauu

SEQ ID NO: 1677193 - RNA, 12 nt, Salmonella enterica enterica serovar Typhi
gaccaauauccg

SEQ ID NO: 1677194 - RNA, 21 nt, Salmonella enterica enterica serovar Typhi
gaccaauagagagcgacagcc

SEQ ID NO: 1677195 - RNA, 21 nt, Salmonella enterica enterica serovar Typhi
gaccaauaaaggucggcugcc

SEQ ID NO: 1677196 - RNA, 22 nt, Salmonella enterica enterica serovar Typhi
gaccaauaaaggucggcugccc

SEQ ID NO: 1677197 - RNA, 22 nt, Salmonella enterica enterica serovar Typhi
gaccacaccgucaacaucaucc

SEQ ID NO: 1677198 - RNA, 19 nt, Salmonella enterica enterica serovar Typhi
gacauuguucuaaacguuc

SEQ ID NO: 1677199 - RNA, 16 nt, Salmonella enterica enterica serovar Typhi
gacagauuuggucagu

SEQ ID NO: 1677200 - RNA, 16 nt, Salmonella enterica enterica serovar Typhi
gacagauuuugcacuu

SEQ ID NO: 1677201 - RNA, 23 nt, Salmonella enterica enterica serovar Typhi
gacagauuuugcacuuuugccag

SEQ ID NO: 1677202 - RNA, 19 nt, Salmonella enterica enterica serovar Typhi
gacagauuggucagcagcc

SEQ ID NO: 1677203 - RNA, 18 nt, Salmonella enterica enterica serovar Typhi
gacagccagcauuuccag

SEQ ID NO: 1677204 - RNA, 19 nt, Salmonella enterica enterica serovar Typhi
gacagccagcauuuccagc

SEQ ID NO: 1677205 - RNA, 18 nt, Salmonella enterica enterica serovar Typhi
gacagcauuuuucacagu

SEQ ID NO: 1677206 - RNA, 19 nt, Salmonella enterica enterica serovar Typhi
gacagaucgguuuaucccc

SEQ ID NO: 1677207 - RNA, 17 nt, Salmonella enterica enterica serovar Typhi
gacagauaacaccagcg

SEQ ID NO: 1677208 - RNA, 16 nt, Salmonella enterica enterica serovar Typhi
gacagagaaccugaac

SEQ ID NO: 1677209 - RNA, 19 nt, Salmonella enterica enterica serovar Typhi
gacagagcucgucaaaaau

SEQ ID NO: 1677210 - RNA, 13 nt, Salmonella enterica enterica serovar Typhi
gacacccgcagcc

SEQ ID NO: 1677211 - RNA, 20 nt, Salmonella enterica enterica serovar Typhi
gacagcccggcguguuucag

SEQ ID NO: 1677212 - RNA, 16 nt, Salmonella enterica enterica serovar Typhi
gacaggcgcagaguga

SEQ ID NO: 1677213 - RNA, 22 nt, Salmonella enterica enterica serovar Typhi
gacagggcgugaaccagcaucc

SEQ ID NO: 1677214 - RNA, 20 nt, Salmonella enterica enterica serovar Typhi
gacagggcgugaaccagcau

SEQ ID NO: 1677215 - RNA, 18 nt, Salmonella enterica enterica serovar Typhi
gacaguauagaaauagcc

SEQ ID NO: 1677216 - RNA, 13 nt, Salmonella enterica enterica serovar Typhi
gaaagcugccuuu

SEQ ID NO: 1677217 - RNA, 21 nt, Salmonella enterica enterica serovar Typhi
gaaagcuguacuuugccgggg

SEQ ID NO: 1677218 - RNA, 20 nt, Salmonella enterica enterica serovar Typhi
gaaagcuguacuuugccggg

SEQ ID NO: 1677219 - RNA, 14 nt, Salmonella enterica enterica serovar Typhi
gaaauaaucuguag

SEQ ID NO: 1677220 - RNA, 23 nt, Salmonella enterica enterica serovar Typhi
gaaauaacguuacauuuuccaug

SEQ ID NO: 1677221 - RNA, 17 nt, Salmonella enterica enterica serovar Typhi
gaaauaacgcacuacca

SEQ ID NO: 1677222 - RNA, 18 nt, Salmonella enterica enterica serovar Typhi
gaaauaacgcacuaccag

SEQ ID NO: 1677223 - RNA, 13 nt, Salmonella enterica enterica serovar Typhi
gaaauaacagacu

SEQ ID NO: 1677224 - RNA, 22 nt, Salmonella enterica enterica serovar Typhi
gaaaguaccaaaacagaaaaga

SEQ ID NO: 1677225 - RNA, 19 nt, Salmonella enterica enterica serovar Typhi
gaaaucagagacaaauaca

SEQ ID NO: 1677226 - RNA, 23 nt, Salmonella enterica enterica serovar Typhi
gaaaucacaaacaccaccaguaa

SEQ ID NO: 1677227 - RNA, 21 nt, Salmonella enterica enterica serovar Typhi
gaaauaccgguaaucaagccu

SEQ ID NO: 1677228 - RNA, 18 nt, Salmonella enterica enterica serovar Typhi
gaaauauuauuccgguuc

SEQ ID NO: 1677229 - RNA, 14 nt, Salmonella enterica enterica serovar Typhi
gaaauacugugccc

SEQ ID NO: 1677230 - RNA, 19 nt, Salmonella enterica enterica serovar Typhi
gaaauagacgagcgaaaaa

SEQ ID NO: 1677231 - RNA, 18 nt, Salmonella enterica enterica serovar Typhi
gaaaaucgcugcgcccga

SEQ ID NO: 1677232 - RNA, 14 nt, Salmonella enterica enterica serovar Typhi
gaaaaucgucucuc

SEQ ID NO: 1677233 - RNA, 13 nt, Salmonella enterica enterica serovar Typhi
gaaaaucugguuu

SEQ ID NO: 1677234 - RNA, 20 nt, Salmonella enterica enterica serovar Typhi
gaaaaugagagacggagaaa

SEQ ID NO: 1677235 - RNA, 17 nt, Salmonella enterica enterica serovar Typhi
gaaaaugguuuugccca

SEQ ID NO: 1677236 - RNA, 14 nt, Salmonella enterica enterica serovar Typhi
gaaaaugugcaaag

SEQ ID NO: 1677237 - RNA, 23 nt, Salmonella enterica enterica serovar Typhi
gaaaaugccagcgauuauuucau

SEQ ID NO: 1677238 - RNA, 19 nt, Salmonella enterica enterica serovar Typhi
gaaaaugcguccagaggau

SEQ ID NO: 1677239 - RNA, 18 nt, Salmonella enterica enterica serovar Typhi
gaaaaugcgccaggaaac

SEQ ID NO: 1677240 - RNA, 21 nt, Salmonella enterica enterica serovar Typhi
gaaacuccuccgggaaaacau

SEQ ID NO: 1677241 - RNA, 22 nt, Salmonella enterica enterica serovar Typhi
gaaacuccuccgggaaaacauc

SEQ ID NO: 1677242 - RNA, 21 nt, Salmonella enterica enterica serovar Typhi
gaaacucgacgggaaucuccg

SEQ ID NO: 1677243 - RNA, 22 nt, Salmonella enterica enterica serovar Typhi
gaaacucgcuguggccaggcac

SEQ ID NO: 1677244 - RNA, 21 nt, Salmonella enterica enterica serovar Typhi
gaaacugaaccaacagcuggg

SEQ ID NO: 1677245 - RNA, 18 nt, Salmonella enterica enterica serovar Typhi
gaaacugcauaucgccgc

SEQ ID NO: 1677246 - RNA, 15 nt, Salmonella enterica enterica serovar Typhi
gaaacugccuaaauu

SEQ ID NO: 1677247 - RNA, 18 nt, Salmonella enterica enterica serovar Typhi
gaaacugcugccgcagca

SEQ ID NO: 1677248 - RNA, 14 nt, Salmonella enterica enterica serovar Typhi
gaaagcaacagcaa

SEQ ID NO: 1677249 - RNA, 21 nt, Salmonella enterica enterica serovar Typhi
gaaagauuacuucaggcugcc

SEQ ID NO: 1677250 - RNA, 20 nt, Salmonella enterica enterica serovar Typhi
gaaagauuucaucaggcuga

SEQ ID NO: 1677251 - RNA, 13 nt, Salmonella enterica enterica serovar Typhi
gaaagcacuucuc

SEQ ID NO: 1677252 - RNA, 15 nt, Salmonella enterica enterica serovar Typhi
gaaauucgcagcgca

SEQ ID NO: 1677253 - RNA, 18 nt, Salmonella enterica enterica serovar Typhi
gaaauugcagggugcagc

SEQ ID NO: 1677254 - RNA, 13 nt, Salmonella enterica enterica serovar Typhi
gaaauuugcagcg

SEQ ID NO: 1677255 - RNA, 17 nt, Salmonella enterica enterica serovar Typhi
gaaauucuaugccaggc

SEQ ID NO: 1677256 - RNA, 22 nt, Salmonella enterica enterica serovar Typhi
gaaauucugacgcagcuucuga

SEQ ID NO: 1677257 - RNA, 16 nt, Salmonella enterica enterica serovar Typhi
gaaauugaauuauaau

SEQ ID NO: 1677258 - RNA, 18 nt, Salmonella enterica enterica serovar Typhi
aaagagagcgccaaaaag

SEQ ID NO: 1677259 - RNA, 23 nt, Salmonella enterica enterica serovar Typhi
aaagagaacgacgcauaaaaaau

SEQ ID NO: 1677260 - RNA, 17 nt, Salmonella enterica enterica serovar Typhi
gaaauccucuauuuuuu

SEQ ID NO: 1677261 - RNA, 16 nt, Salmonella enterica enterica serovar Typhi
gaaaucggcagcaccc

SEQ ID NO: 1677262 - RNA, 22 nt, Salmonella enterica enterica serovar Typhi
gaaaucgccgggcuauccggcu

SEQ ID NO: 1677263 - RNA, 19 nt, Salmonella enterica enterica serovar Typhi
gaaaucuuucuccugguuu

SEQ ID NO: 1677264 - RNA, 15 nt, Salmonella enterica enterica serovar Typhi
gaaaugagaaaagga

SEQ ID NO: 1677265 - RNA, 22 nt, Salmonella enterica enterica serovar Typhi
gaaaugagcgcgccaaccugcu

SEQ ID NO: 1677266 - RNA, 18 nt, Salmonella enterica enterica serovar Typhi
gaacaggccaaacccugc

SEQ ID NO: 1677267 - RNA, 21 nt, Salmonella enterica enterica serovar Typhi
gaacagcgucauccaguguua

SEQ ID NO: 1677268 - RNA, 19 nt, Salmonella enterica enterica serovar Typhi
gaacaggccaaacccugcg

SEQ ID NO: 1677269 - RNA, 16 nt, Salmonella enterica enterica serovar Typhi
gaacaguuucgccagc

SEQ ID NO: 1677270 - RNA, 13 nt, Salmonella enterica enterica serovar Typhi
gaacauaugaagg

SEQ ID NO: 1677271 - RNA, 17 nt, Salmonella enterica enterica serovar Typhi
gaacauaacgggaauaa

SEQ ID NO: 1677272 - RNA, 17 nt, Salmonella enterica enterica serovar Typhi
gaacauaaaaacgcgcu

SEQ ID NO: 1677273 - RNA, 19 nt, Salmonella enterica enterica serovar Typhi
gaacagcacguuaccggcg

SEQ ID NO: 1677274 - RNA, 13 nt, Salmonella enterica enterica serovar Typhi
gaacagccaggcu

SEQ ID NO: 1677275 - RNA, 17 nt, Salmonella enterica enterica serovar Typhi
gaacagcgucauccagu

SEQ ID NO: 1677276 - RNA, 17 nt, Salmonella enterica enterica serovar Typhi
gaacaauaacaccacaa

SEQ ID NO: 1677277 - RNA, 19 nt, Salmonella enterica enterica serovar Typhi
gaacaauagacgcuacugu

SEQ ID NO: 1677278 - RNA, 20 nt, Salmonella enterica enterica serovar Typhi
gaacaaguucuucgaagcac

SEQ ID NO: 1677279 - RNA, 14 nt, Salmonella enterica enterica serovar Typhi
gaacaaaagaaagc

SEQ ID NO: 1677280 - RNA, 14 nt, Salmonella enterica enterica serovar Typhi
gaacacuaaaacac

SEQ ID NO: 1677281 - RNA, 16 nt, Salmonella enterica enterica serovar Typhi
gaacaccucauauuug

SEQ ID NO: 1677282 - RNA, 15 nt, Salmonella enterica enterica serovar Typhi
gaacggcauaaucug

SEQ ID NO: 1677283 - RNA, 22 nt, Salmonella enterica enterica serovar Typhi
gaacggguaaaugcgcgcggcu

SEQ ID NO: 1677284 - RNA, 18 nt, Salmonella enterica enterica serovar Typhi
gaacggcuaggguggcgc

SEQ ID NO: 1677285 - RNA, 19 nt, Salmonella enterica enterica serovar Typhi
gaacggcuuuccagcagcc

SEQ ID NO: 1677286 - RNA, 22 nt, Salmonella enterica enterica serovar Typhi
gaacguuaucggcauaggcuau

SEQ ID NO: 1677287 - RNA, 14 nt, Salmonella enterica enterica serovar Typhi
gaacguaauggcau

SEQ ID NO: 1677288 - RNA, 16 nt, Salmonella enterica enterica serovar Typhi
gaacgccuuauccggc

SEQ ID NO: 1677289 - RNA, 18 nt, Salmonella enterica enterica serovar Typhi
gaacgcuggcggcaggcc

SEQ ID NO: 1677290 - RNA, 18 nt, Salmonella enterica enterica serovar Typhi
gaacgcuggcacuuuccg

SEQ ID NO: 1677291 - RNA, 20 nt, Salmonella enterica enterica serovar Typhi
gaacgccgcuagcggcggcc

SEQ ID NO: 1677292 - RNA, 12 nt, Salmonella enterica enterica serovar Typhi
gaacgccaggcc

SEQ ID NO: 1677293 - RNA, 22 nt, Salmonella enterica enterica serovar Typhi
gaacugauggcgcuaagccagc

SEQ ID NO: 1677294 - RNA, 11 nt, Salmonella enterica enterica serovar Typhi
gaacugcagcg

SEQ ID NO: 1677295 - RNA, 20 nt, Salmonella enterica enterica serovar Typhi
gaacugauggcgcuaagcca

SEQ ID NO: 1677296 - RNA, 20 nt, Salmonella enterica enterica serovar Typhi
gaacugaauagucggcugcu

SEQ ID NO: 1677297 - RNA, 13 nt, Salmonella enterica enterica serovar Typhi
gaacucuuucaga

SEQ ID NO: 1677298 - RNA, 15 nt, Salmonella enterica enterica serovar Typhi
gaacaucagccagca

SEQ ID NO: 1677299 - RNA, 18 nt, Salmonella enterica enterica serovar Typhi
gaacaucaagcgguagcg

SEQ ID NO: 1677300 - RNA, 18 nt, Salmonella enterica enterica serovar Typhi
gaacaucacgaugaaagg

SEQ ID NO: 1677301 - RNA, 15 nt, Salmonella enterica enterica serovar Typhi
gaacauccucuccug

SEQ ID NO: 1677302 - RNA, 18 nt, Salmonella enterica enterica serovar Typhi
gaacauuggaauauccgc

SEQ ID NO: 1677303 - RNA, 16 nt, Salmonella enterica enterica serovar Typhi
gaacauuuaagauuua

SEQ ID NO: 1677304 - RNA, 22 nt, Salmonella enterica enterica serovar Typhi
gaacauugccccucccugaauc

SEQ ID NO: 1677305 - RNA, 14 nt, Salmonella enterica enterica serovar Typhi
gaacauuacauccu

SEQ ID NO: 1677306 - RNA, 21 nt, Salmonella enterica enterica serovar Typhi
gaaccaacgcauaaaaacgug

SEQ ID NO: 1677307 - RNA, 18 nt, Salmonella enterica enterica serovar Typhi
gaaccaacugccaaacca

SEQ ID NO: 1677308 - RNA, 15 nt, Salmonella enterica enterica serovar Typhi
gaaccaacagcuggg

SEQ ID NO: 1677309 - RNA, 20 nt, Salmonella enterica enterica serovar Typhi
gaacccaucagggaaaaaug

SEQ ID NO: 1677310 - RNA, 18 nt, Salmonella enterica enterica serovar Typhi
gaaccaucauuaauauaa

SEQ ID NO: 1677311 - RNA, 16 nt, Salmonella enterica enterica serovar Typhi
gaaccaucauuaauau

SEQ ID NO: 1677312 - RNA, 15 nt, Salmonella enterica enterica serovar Typhi
gaaccagcaucccac

SEQ ID NO: 1677313 - RNA, 21 nt, Salmonella enterica enterica serovar Typhi
gaaccagcggcaccagcacga

SEQ ID NO: 1677314 - RNA, 18 nt, Salmonella enterica enterica serovar Typhi
gaaccgccgacccccucc

SEQ ID NO: 1677315 - RNA, 20 nt, Salmonella enterica enterica serovar Typhi
gaaccggguauugaauccau

SEQ ID NO: 1677316 - RNA, 18 nt, Salmonella enterica enterica serovar Typhi
gaaccguaaacgccugca

SEQ ID NO: 1677317 - RNA, 22 nt, Salmonella enterica enterica serovar Typhi
gaaccucaccguccgccaggcc

SEQ ID NO: 1677318 - RNA, 22 nt, Salmonella enterica enterica serovar Typhi
gaaccguugcgcccaucaucau

SEQ ID NO: 1677319 - RNA, 19 nt, Salmonella enterica enterica serovar Typhi
gaaccguucgaguguaucu

SEQ ID NO: 1677320 - RNA, 18 nt, Salmonella enterica enterica serovar Typhi
gaaccguggccuccggca

SEQ ID NO: 1677321 - RNA, 19 nt, Salmonella enterica enterica serovar Typhi
gaaccuggcgguaaauacg

SEQ ID NO: 1677322 - RNA, 22 nt, Salmonella enterica enterica serovar Typhi
gaaccuggcagaaaggugaaaa

SEQ ID NO: 1677323 - RNA, 16 nt, Salmonella enterica enterica serovar Typhi
cuuuugcgccuuccag

SEQ ID NO: 1677324 - RNA, 23 nt, Salmonella enterica enterica serovar Typhi
cuuuugccgcgacuuccgucucc

SEQ ID NO: 1677325 - RNA, 18 nt, Salmonella enterica enterica serovar Typhi
cuuuugccgucaggucau

SEQ ID NO: 1677326 - RNA, 13 nt, Salmonella enterica enterica serovar Typhi
cuuuugccgcgcc

SEQ ID NO: 1677327 - RNA, 22 nt, Salmonella enterica enterica serovar Typhi
cuuuugcccgguggcgcugcgc

SEQ ID NO: 1677328 - RNA, 19 nt, Salmonella enterica enterica serovar Typhi
cuuuugucguccccuggac

SEQ ID NO: 1677329 - RNA, 14 nt, Salmonella enterica enterica serovar Typhi
cuuuugcuuccagu

SEQ ID NO: 1677330 - RNA, 20 nt, Salmonella enterica enterica serovar Typhi
cuuuugcgcguuccccaaca

SEQ ID NO: 1677331 - RNA, 14 nt, Salmonella enterica enterica serovar Typhi
cuuuucuagccaau

SEQ ID NO: 1677332 - RNA, 18 nt, Salmonella enterica enterica serovar Typhi
cuuuucggguguccacuc

SEQ ID NO: 1677333 - RNA, 16 nt, Salmonella enterica enterica serovar Typhi
cuuuucggguaaauca

SEQ ID NO: 1677334 - RNA, 14 nt, Salmonella enterica enterica serovar Typhi
cuuuucgggcacug

SEQ ID NO: 1677335 - RNA, 16 nt, Salmonella enterica enterica serovar Typhi
cuuuucgggcacuggc

SEQ ID NO: 1677336 - RNA, 22 nt, Salmonella enterica enterica serovar Typhi
cuuuucugucguguccuugcca

SEQ ID NO: 1677337 - RNA, 18 nt, Salmonella enterica enterica serovar Typhi
cuuuucacgcauugccac

SEQ ID NO: 1677338 - RNA, 21 nt, Salmonella enterica enterica serovar Typhi
cuuuucaagaauuacaucaau

SEQ ID NO: 1677339 - RNA, 17 nt, Salmonella enterica enterica serovar Typhi
cuuuucaggucuggauu

SEQ ID NO: 1677340 - RNA, 21 nt, Salmonella enterica enterica serovar Typhi
cuuuucagcccaggcuuuagu

SEQ ID NO: 1677341 - RNA, 18 nt, Salmonella enterica enterica serovar Typhi
cuuuucaggcgcugucug

SEQ ID NO: 1677342 - RNA, 22 nt, Salmonella enterica enterica serovar Typhi
cuuuucauccacagcgccagaa

SEQ ID NO: 1677343 - RNA, 18 nt, Salmonella enterica enterica serovar Typhi
cuuuucccgccagcugcg

SEQ ID NO: 1677344 - RNA, 11 nt, Salmonella enterica enterica serovar Typhi
cuuuuccagcc

SEQ ID NO: 1677345 - RNA, 23 nt, Salmonella enterica enterica serovar Typhi
cuuuuccaguaagaucaccuucu

SEQ ID NO: 1677346 - RNA, 17 nt, Salmonella enterica enterica serovar Typhi
cuuuuccagcacgccca

SEQ ID NO: 1677347 - RNA, 22 nt, Salmonella enterica enterica serovar Typhi
cuuuuauuauuuugauacucau

SEQ ID NO: 1677348 - RNA, 19 nt, Salmonella enterica enterica serovar Typhi
cuuuuagaauuaucugaaa

SEQ ID NO: 1677349 - RNA, 16 nt, Salmonella enterica enterica serovar Typhi
cuuuuacccuucaugu

SEQ ID NO: 1677350 - RNA, 23 nt, Salmonella enterica enterica serovar Typhi
cuuuuacaggccggacaggcgac

SEQ ID NO: 1677351 - RNA, 23 nt, Salmonella enterica enterica serovar Typhi
cuuuuaacauaagugauacaugc

SEQ ID NO: 1677352 - RNA, 23 nt, Salmonella enterica enterica serovar Typhi
cuuuuaacaaaucgacagccagc

SEQ ID NO: 1677353 - RNA, 18 nt, Salmonella enterica enterica serovar Typhi
cuuuuaaaaaucagucac

SEQ ID NO: 1677354 - RNA, 18 nt, Salmonella enterica enterica serovar Typhi
cuuuuaaagacuuugaug

SEQ ID NO: 1677355 - RNA, 23 nt, Salmonella enterica enterica serovar Typhi
cuuuuaaacgugcggcggccucu

SEQ ID NO: 1677356 - RNA, 14 nt, Salmonella enterica enterica serovar Typhi
cuuuuaacaaaucg

SEQ ID NO: 1677357 - RNA, 22 nt, Salmonella enterica enterica serovar Typhi
cuuuuaacaaaucgacagccag

SEQ ID NO: 1677358 - RNA, 21 nt, Salmonella enterica enterica serovar Typhi
gaaaaagcggcuguagccagc

SEQ ID NO: 1677359 - RNA, 19 nt, Salmonella enterica enterica serovar Typhi
gaaaaagccaaaaggcgcc

SEQ ID NO: 1677360 - RNA, 20 nt, Salmonella enterica enterica serovar Typhi
gaaaaaaacgcauugcagca

SEQ ID NO: 1677361 - RNA, 20 nt, Salmonella enterica enterica serovar Typhi
gaaaaaaauuucugccgaca

SEQ ID NO: 1677362 - RNA, 14 nt, Salmonella enterica enterica serovar Typhi
cuuuuuuauuguuu

SEQ ID NO: 1677363 - RNA, 18 nt, Salmonella enterica enterica serovar Typhi
cuuuuuuuuaugccucuu

SEQ ID NO: 1677364 - RNA, 12 nt, Salmonella enterica enterica serovar Typhi
cuuuuuuaaacg

SEQ ID NO: 1677365 - RNA, 19 nt, Salmonella enterica enterica serovar Typhi
cuuuuuuagucuccugcca

SEQ ID NO: 1677366 - RNA, 12 nt, Salmonella enterica enterica serovar Typhi
gaaaagcagagg

SEQ ID NO: 1677367 - RNA, 16 nt, Salmonella enterica enterica serovar Typhi
gaaaagaccaguggac

SEQ ID NO: 1677368 - RNA, 12 nt, Salmonella enterica enterica serovar Typhi
gaaaacugcgcc

SEQ ID NO: 1677369 - RNA, 14 nt, Salmonella enterica enterica serovar Typhi
gaaaauaacaauau

SEQ ID NO: 1677370 - RNA, 19 nt, Salmonella enterica enterica serovar Typhi
gaaaauaacaauauuaaau

SEQ ID NO: 1677371 - RNA, 16 nt, Salmonella enterica enterica serovar Typhi
gaaaagcagccagacc

SEQ ID NO: 1677372 - RNA, 15 nt, Salmonella enterica enterica serovar Typhi
gaaaauaauucuuaa

SEQ ID NO: 1677373 - RNA, 22 nt, Salmonella enterica enterica serovar Typhi
gaaaaucacuaucaguuuuggc

SEQ ID NO: 1677374 - RNA, 13 nt, Salmonella enterica enterica serovar Typhi
gaaaauacucccg

SEQ ID NO: 1677375 - RNA, 17 nt, Salmonella enterica enterica serovar Typhi
gaaaauaccgcacauca

SEQ ID NO: 1677376 - RNA, 22 nt, Salmonella enterica enterica serovar Typhi
gaaaacggccagugaaauaaau

SEQ ID NO: 1677377 - RNA, 17 nt, Salmonella enterica enterica serovar Typhi
gaaaaccuuugcugacg

SEQ ID NO: 1677378 - RNA, 19 nt, Salmonella enterica enterica serovar Typhi
gaaaacagcgccggcagca

SEQ ID NO: 1677379 - RNA, 20 nt, Salmonella enterica enterica serovar Typhi
gaaaacagcgccggcagcag

SEQ ID NO: 1677380 - RNA, 21 nt, Salmonella enterica enterica serovar Typhi
gaaaacaccagggauuuugcu

SEQ ID NO: 1677381 - RNA, 18 nt, Salmonella enterica enterica serovar Typhi
gaaaaccacaaucacagc

SEQ ID NO: 1677382 - RNA, 23 nt, Salmonella enterica enterica serovar Typhi
cuuuacgcagauaacuuccuuug

SEQ ID NO: 1677383 - RNA, 14 nt, Salmonella enterica enterica serovar Typhi
cuuuaccgugaaug

SEQ ID NO: 1677384 - RNA, 14 nt, Salmonella enterica enterica serovar Typhi
cuuuacccagcggg

SEQ ID NO: 1677385 - RNA, 19 nt, Salmonella enterica enterica serovar Typhi
cuuuacccgggccaucuuu

SEQ ID NO: 1677386 - RNA, 13 nt, Salmonella enterica enterica serovar Typhi
cuuuaauauucau

SEQ ID NO: 1677387 - RNA, 20 nt, Salmonella enterica enterica serovar Typhi
cuuuaaucacccgcgccagc

SEQ ID NO: 1677388 - RNA, 14 nt, Salmonella enterica enterica serovar Typhi
cuucggccuccgcu

SEQ ID NO: 1677389 - RNA, 15 nt, Salmonella enterica enterica serovar Typhi
aaagaccaauacuga

SEQ ID NO: 1677390 - RNA, 19 nt, Salmonella enterica enterica serovar Typhi
aaagaccauccgguuuuaa

SEQ ID NO: 1677391 - RNA, 14 nt, Salmonella enterica enterica serovar Typhi
cuucgcucugaauc

SEQ ID NO: 1677392 - RNA, 18 nt, Salmonella enterica enterica serovar Typhi
cuucggacuccugacgcu

SEQ ID NO: 1677393 - RNA, 22 nt, Salmonella enterica enterica serovar Typhi
cuuucagccgacuaucuucuuc

SEQ ID NO: 1677394 - RNA, 18 nt, Salmonella enterica enterica serovar Typhi
cuuucaccggucgcaaga

SEQ ID NO: 1677395 - RNA, 13 nt, Salmonella enterica enterica serovar Typhi
cuuucaccgccuc

SEQ ID NO: 1677396 - RNA, 20 nt, Salmonella enterica enterica serovar Typhi
cuuucagccgacuaucuucu

SEQ ID NO: 1677397 - RNA, 20 nt, Salmonella enterica enterica serovar Typhi
cuuucaguuucggccccccc

SEQ ID NO: 1677398 - RNA, 18 nt, Salmonella enterica enterica serovar Typhi
cuuuaggguaucauuucc

SEQ ID NO: 1677399 - RNA, 21 nt, Salmonella enterica enterica serovar Typhi
cuuuaggguaucauuuccaca

SEQ ID NO: 1677400 - RNA, 14 nt, Salmonella enterica enterica serovar Typhi
cuuuaggcaggaaa

SEQ ID NO: 1677401 - RNA, 20 nt, Salmonella enterica enterica serovar Typhi
cuuuaggcggcgccgcgccg

SEQ ID NO: 1677402 - RNA, 13 nt, Salmonella enterica enterica serovar Typhi
cuuuauauaaaaa

SEQ ID NO: 1677403 - RNA, 12 nt, Salmonella enterica enterica serovar Typhi
cuuuauauuuuu

SEQ ID NO: 1677404 - RNA, 14 nt, Salmonella enterica enterica serovar Typhi
cuuuauucgcuugu

SEQ ID NO: 1677405 - RNA, 14 nt, Salmonella enterica enterica serovar Typhi
cuuuaucguaaccg

SEQ ID NO: 1677406 - RNA, 13 nt, Salmonella enterica enterica serovar Typhi
cuuugcaaucgac

SEQ ID NO: 1677407 - RNA, 12 nt, Salmonella enterica enterica serovar Typhi
cuuugcucuccu

SEQ ID NO: 1677408 - RNA, 17 nt, Salmonella enterica enterica serovar Typhi
cuuugcguaaaaaacau

SEQ ID NO: 1677409 - RNA, 20 nt, Salmonella enterica enterica serovar Typhi
cuuugcguaaaaaacaucau

SEQ ID NO: 1677410 - RNA, 21 nt, Salmonella enterica enterica serovar Typhi
cuuugcgcucaugcgccuggc

SEQ ID NO: 1677411 - RNA, 22 nt, Salmonella enterica enterica serovar Typhi
cuuugaccagcaucgccgguag

SEQ ID NO: 1677412 - RNA, 20 nt, Salmonella enterica enterica serovar Typhi
cuuugacgccgggaaauuuu

SEQ ID NO: 1677413 - RNA, 18 nt, Salmonella enterica enterica serovar Typhi
cuuugaccagcaucgccg

SEQ ID NO: 1677414 - RNA, 11 nt, Salmonella enterica enterica serovar Typhi
cuuugcugcug

SEQ ID NO: 1677415 - RNA, 22 nt, Salmonella enterica enterica serovar Typhi
cuuugucgcgguuaaggaugua

SEQ ID NO: 1677416 - RNA, 16 nt, Salmonella enterica enterica serovar Typhi
cuuugugcaggaucaa

SEQ ID NO: 1677417 - RNA, 21 nt, Salmonella enterica enterica serovar Typhi
cuuugugaucugguuugguaa

SEQ ID NO: 1677418 - RNA, 21 nt, Salmonella enterica enterica serovar Typhi
cuuugucgaaauugccgcccg

SEQ ID NO: 1677419 - RNA, 21 nt, Salmonella enterica enterica serovar Typhi
cuuuguucuguugaguucccu

SEQ ID NO: 1677420 - RNA, 17 nt, Salmonella enterica enterica serovar Typhi
cuuuguugaucucauug

SEQ ID NO: 1677421 - RNA, 13 nt, Salmonella enterica enterica serovar Typhi
cuuucucgggccu

SEQ ID NO: 1677422 - RNA, 18 nt, Salmonella enterica enterica serovar Typhi
cuuucucgggccuguucc

SEQ ID NO: 1677423 - RNA, 18 nt, Salmonella enterica enterica serovar Typhi
cuuucuugccacuggccu

SEQ ID NO: 1677424 - RNA, 12 nt, Salmonella enterica enterica serovar Typhi
cuuucuugccac

SEQ ID NO: 1677425 - RNA, 20 nt, Salmonella enterica enterica serovar Typhi
cuuucuuuuuauauuccccu

SEQ ID NO: 1677426 - RNA, 18 nt, Salmonella enterica enterica serovar Typhi
cuuuccaaaauccaggga

SEQ ID NO: 1677427 - RNA, 21 nt, Salmonella enterica enterica serovar Typhi
cuuucauuggauaaaguuuuc

SEQ ID NO: 1677428 - RNA, 16 nt, Salmonella enterica enterica serovar Typhi
cuuucauuucuuuaau

SEQ ID NO: 1677429 - RNA, 13 nt, Salmonella enterica enterica serovar Typhi
cuuucaucaaacg

SEQ ID NO: 1677430 - RNA, 12 nt, Salmonella enterica enterica serovar Typhi
cuuucaucuuua

SEQ ID NO: 1677431 - RNA, 18 nt, Salmonella enterica enterica serovar Typhi
cuuucauuacgcuuccug

SEQ ID NO: 1677432 - RNA, 12 nt, Salmonella enterica enterica serovar Typhi
cuuucuacaaau

SEQ ID NO: 1677433 - RNA, 19 nt, Salmonella enterica enterica serovar Typhi
cuuuccgacccuuauguca

SEQ ID NO: 1677434 - RNA, 15 nt, Salmonella enterica enterica serovar Typhi
cuuuccgcaccgcuu

SEQ ID NO: 1677435 - RNA, 18 nt, Salmonella enterica enterica serovar Typhi
gauaugcuugccggaugc

SEQ ID NO: 1677436 - RNA, 17 nt, Salmonella enterica enterica serovar Typhi
gauauggaugcgcugcu

SEQ ID NO: 1677437 - RNA, 18 nt, Salmonella enterica enterica serovar Typhi
gauaugcgacgaaagcgg

SEQ ID NO: 1677438 - RNA, 23 nt, Salmonella enterica enterica serovar Typhi
gauaugaauaauuucggcggcgc

SEQ ID NO: 1677439 - RNA, 14 nt, Salmonella enterica enterica serovar Typhi
gauaugaauaauuu

SEQ ID NO: 1677440 - RNA, 12 nt, Salmonella enterica enterica serovar Typhi
gauaucuuccag

SEQ ID NO: 1677441 - RNA, 17 nt, Salmonella enterica enterica serovar Typhi
gauauauggcgggaaau

SEQ ID NO: 1677442 - RNA, 18 nt, Salmonella enterica enterica serovar Typhi
gauauaucgcgucaucaa

SEQ ID NO: 1677443 - RNA, 23 nt, Salmonella enterica enterica serovar Typhi
gauauaucuucaucguuucugcc

SEQ ID NO: 1677444 - RNA, 14 nt, Salmonella enterica enterica serovar Typhi
gauauagucgccca

SEQ ID NO: 1677445 - RNA, 19 nt, Salmonella enterica enterica serovar Typhi
gauauagcggugcguuucc

SEQ ID NO: 1677446 - RNA, 23 nt, Salmonella enterica enterica serovar Typhi
gauauagcugcgauccaggucuu

SEQ ID NO: 1677447 - RNA, 22 nt, Salmonella enterica enterica serovar Typhi
gauauaccaugcugccauuuua

SEQ ID NO: 1677448 - RNA, 14 nt, Salmonella enterica enterica serovar Typhi
gauagugccugccg

SEQ ID NO: 1677449 - RNA, 18 nt, Salmonella enterica enterica serovar Typhi
gauagucauugacagcaa

SEQ ID NO: 1677450 - RNA, 14 nt, Salmonella enterica enterica serovar Typhi
gauagggccaggcg

SEQ ID NO: 1677451 - RNA, 22 nt, Salmonella enterica enterica serovar Typhi
gauagguucaauaugccaggca

SEQ ID NO: 1677452 - RNA, 13 nt, Salmonella enterica enterica serovar Typhi
gauagggcagcag

SEQ ID NO: 1677453 - RNA, 18 nt, Salmonella enterica enterica serovar Typhi
gauagcuuuguauauguu

SEQ ID NO: 1677454 - RNA, 21 nt, Salmonella enterica enterica serovar Typhi
gauagcaaucauccugauuuu

SEQ ID NO: 1677455 - RNA, 17 nt, Salmonella enterica enterica serovar Typhi
gauaggagacgccgccc

SEQ ID NO: 1677456 - RNA, 20 nt, Salmonella enterica enterica serovar Typhi
gauaagcaccguaaacggcu

SEQ ID NO: 1677457 - RNA, 22 nt, Salmonella enterica enterica serovar Typhi
gauaagacugauauccauuggg

SEQ ID NO: 1677458 - RNA, 15 nt, Salmonella enterica enterica serovar Typhi
gauaacguauuucuu

SEQ ID NO: 1677459 - RNA, 19 nt, Salmonella enterica enterica serovar Typhi
gauaagaaagauaaaauac

SEQ ID NO: 1677460 - RNA, 20 nt, Salmonella enterica enterica serovar Typhi
gauaagcgugcgccauccgg

SEQ ID NO: 1677461 - RNA, 17 nt, Salmonella enterica enterica serovar Typhi
gauacgauguaaaaaug

SEQ ID NO: 1677462 - RNA, 14 nt, Salmonella enterica enterica serovar Typhi
gauacgccagguua

SEQ ID NO: 1677463 - RNA, 20 nt, Salmonella enterica enterica serovar Typhi
gauacgcgucaaagcacaug

SEQ ID NO: 1677464 - RNA, 19 nt, Salmonella enterica enterica serovar Typhi
gauaagcuaguaaagaaau

SEQ ID NO: 1677465 - RNA, 19 nt, Salmonella enterica enterica serovar Typhi
gauagaaccacgcaaaggc

SEQ ID NO: 1677466 - RNA, 16 nt, Salmonella enterica enterica serovar Typhi
gauagagguuaccggg

SEQ ID NO: 1677467 - RNA, 16 nt, Salmonella enterica enterica serovar Typhi
gauagaaguuaugcau

SEQ ID NO: 1677468 - RNA, 19 nt, Salmonella enterica enterica serovar Typhi
gauagacggcugaauguuc

SEQ ID NO: 1677469 - RNA, 18 nt, Salmonella enterica enterica serovar Typhi
gauacgcgucaaauagag

SEQ ID NO: 1677470 - RNA, 20 nt, Salmonella enterica enterica serovar Typhi
gauacuccauugucggcagc

SEQ ID NO: 1677471 - RNA, 12 nt, Salmonella enterica enterica serovar Typhi
gauacugcaacg

SEQ ID NO: 1677472 - RNA, 17 nt, Salmonella enterica enterica serovar Typhi
gauacugcaacgccaga

SEQ ID NO: 1677473 - RNA, 21 nt, Salmonella enterica enterica serovar Typhi
gauacugccgcccaucgccac

SEQ ID NO: 1677474 - RNA, 21 nt, Salmonella enterica enterica serovar Typhi
gauacugcaacgccagaugcg

SEQ ID NO: 1677475 - RNA, 21 nt, Salmonella enterica enterica serovar Typhi
gauacuggaagugauccuuca

SEQ ID NO: 1677476 - RNA, 13 nt, Salmonella enterica enterica serovar Typhi
gaucagcaaaaua

SEQ ID NO: 1677477 - RNA, 12 nt, Salmonella enterica enterica serovar Typhi
gaucagaaaacc

SEQ ID NO: 1677478 - RNA, 22 nt, Salmonella enterica enterica serovar Typhi
gaucagaaauucgcagcgcagg

SEQ ID NO: 1677479 - RNA, 15 nt, Salmonella enterica enterica serovar Typhi
gaucacgccagcgcu

SEQ ID NO: 1677480 - RNA, 14 nt, Salmonella enterica enterica serovar Typhi
gaucaccagcccuu

SEQ ID NO: 1677481 - RNA, 17 nt, Salmonella enterica enterica serovar Typhi
gaucacccacaccacag

SEQ ID NO: 1677482 - RNA, 16 nt, Salmonella enterica enterica serovar Typhi
gaucacccacaucagc

SEQ ID NO: 1677483 - RNA, 18 nt, Salmonella enterica enterica serovar Typhi
gaucaauaaaauuaucca

SEQ ID NO: 1677484 - RNA, 21 nt, Salmonella enterica enterica serovar Typhi
gaucaauaaaauuauccaguu

SEQ ID NO: 1677485 - RNA, 14 nt, Salmonella enterica enterica serovar Typhi
gaucaggucugaga

SEQ ID NO: 1677486 - RNA, 19 nt, Salmonella enterica enterica serovar Typhi
gaucauaagggagcugacu

SEQ ID NO: 1677487 - RNA, 20 nt, Salmonella enterica enterica serovar Typhi
gaucaggccgcagacggaga

SEQ ID NO: 1677488 - RNA, 18 nt, Salmonella enterica enterica serovar Typhi
gaucaggaaaucuuccag

SEQ ID NO: 1677489 - RNA, 15 nt, Salmonella enterica enterica serovar Typhi
gaucagcgccacgca

SEQ ID NO: 1677490 - RNA, 15 nt, Salmonella enterica enterica serovar Typhi
gaucaucauggcuga

SEQ ID NO: 1677491 - RNA, 13 nt, Salmonella enterica enterica serovar Typhi
gaucaucuucacu

SEQ ID NO: 1677492 - RNA, 19 nt, Salmonella enterica enterica serovar Typhi
gaucaucacgaaauaacgc

SEQ ID NO: 1677493 - RNA, 13 nt, Salmonella enterica enterica serovar Typhi
gaucauaaugacg

SEQ ID NO: 1677494 - RNA, 23 nt, Salmonella enterica enterica serovar Typhi
gaucaucuucacuucacaaacaa

SEQ ID NO: 1677495 - RNA, 19 nt, Salmonella enterica enterica serovar Typhi
gaucaugaggaugagcguu

SEQ ID NO: 1677496 - RNA, 20 nt, Salmonella enterica enterica serovar Typhi
gaucaugccgcccaggccau

SEQ ID NO: 1677497 - RNA, 14 nt, Salmonella enterica enterica serovar Typhi
gaucauggcucaga

SEQ ID NO: 1677498 - RNA, 15 nt, Salmonella enterica enterica serovar Typhi
gaucucauaaacgcc

SEQ ID NO: 1677499 - RNA, 16 nt, Salmonella enterica enterica serovar Typhi
gaucuacggaucccuu

SEQ ID NO: 1677500 - RNA, 21 nt, Salmonella enterica enterica serovar Typhi
gaucuacgcuauuuccagaaa

SEQ ID NO: 1677501 - RNA, 19 nt, Salmonella enterica enterica serovar Typhi
gaucuaaagccaguuucuc

SEQ ID NO: 1677502 - RNA, 23 nt, Salmonella enterica enterica serovar Typhi
gaucucauaaacgccuggaguga

SEQ ID NO: 1677503 - RNA, 15 nt, Salmonella enterica enterica serovar Typhi
gaucucaugcaacug

SEQ ID NO: 1677504 - RNA, 12 nt, Salmonella enterica enterica serovar Typhi
gaucuccagaag

SEQ ID NO: 1677505 - RNA, 17 nt, Salmonella enterica enterica serovar Typhi
gaucucgauauucacac

SEQ ID NO: 1677506 - RNA, 22 nt, Salmonella enterica enterica serovar Typhi
gaucucuugcauaauauccagg

SEQ ID NO: 1677507 - RNA, 12 nt, Salmonella enterica enterica serovar Typhi
gaucucucccug

SEQ ID NO: 1677508 - RNA, 20 nt, Salmonella enterica enterica serovar Typhi
gaucuggcgcuuuuccagca

SEQ ID NO: 1677509 - RNA, 15 nt, Salmonella enterica enterica serovar Typhi
gaucugguuauccac

SEQ ID NO: 1677510 - RNA, 15 nt, Salmonella enterica enterica serovar Typhi
gaucuguaggccgga

SEQ ID NO: 1677511 - RNA, 23 nt, Salmonella enterica enterica serovar Typhi
gaucguuauccagcagccacagg

SEQ ID NO: 1677512 - RNA, 19 nt, Salmonella enterica enterica serovar Typhi
gaucguuauuaaacagaca

SEQ ID NO: 1677513 - RNA, 20 nt, Salmonella enterica enterica serovar Typhi
gaucgucauauguugcgcuu

SEQ ID NO: 1677514 - RNA, 17 nt, Salmonella enterica enterica serovar Typhi
gaucguaugcgccuguu

SEQ ID NO: 1677515 - RNA, 21 nt, Salmonella enterica enterica serovar Typhi
gaucguaugcagccaggccau

SEQ ID NO: 1677516 - RNA, 15 nt, Salmonella enterica enterica serovar Typhi
gaucguaggcggcgg

SEQ ID NO: 1677517 - RNA, 16 nt, Salmonella enterica enterica serovar Typhi
gaucguaggcggcgga

SEQ ID NO: 1677518 - RNA, 21 nt, Salmonella enterica enterica serovar Typhi
gaucggccagauaguggcuga

SEQ ID NO: 1677519 - RNA, 14 nt, Salmonella enterica enterica serovar Typhi
gaucggcuggcgca

SEQ ID NO: 1677520 - RNA, 14 nt, Salmonella enterica enterica serovar Typhi
gaucggcgcaggga

SEQ ID NO: 1677521 - RNA, 15 nt, Salmonella enterica enterica serovar Typhi
gaucgggcuuccagc

SEQ ID NO: 1677522 - RNA, 14 nt, Salmonella enterica enterica serovar Typhi
gaucgguuuauccc

SEQ ID NO: 1677523 - RNA, 16 nt, Salmonella enterica enterica serovar Typhi
gaucggguuuuccuga

SEQ ID NO: 1677524 - RNA, 10 nt, Salmonella enterica enterica serovar Typhi
gaucgccugg

SEQ ID NO: 1677525 - RNA, 23 nt, Salmonella enterica enterica serovar Typhi
gaucgccgccgcgagcagcgaaa

SEQ ID NO: 1677526 - RNA, 22 nt, Salmonella enterica enterica serovar Typhi
gaucgccgguuuugguaucuuc

SEQ ID NO: 1677527 - RNA, 17 nt, Salmonella enterica enterica serovar Typhi
gaucgccauccugcacc

SEQ ID NO: 1677528 - RNA, 18 nt, Salmonella enterica enterica serovar Typhi
aaagccgaugacaucuca

SEQ ID NO: 1677529 - RNA, 23 nt, Salmonella enterica enterica serovar Typhi
aaagccccuuccucgggaggggc

SEQ ID NO: 1677530 - RNA, 13 nt, Salmonella enterica enterica serovar Typhi
aaagcccaucagc

SEQ ID NO: 1677531 - RNA, 15 nt, Salmonella enterica enterica serovar Typhi
aaagccaguuucucu

SEQ ID NO: 1677532 - RNA, 16 nt, Salmonella enterica enterica serovar Typhi
aaagccaucaauccau

SEQ ID NO: 1677533 - RNA, 23 nt, Salmonella enterica enterica serovar Typhi
aaagccaucuucgguaauacaau

SEQ ID NO: 1677534 - RNA, 17 nt, Salmonella enterica enterica serovar Typhi
aaagccacgcaagcagc

SEQ ID NO: 1677535 - RNA, 18 nt, Salmonella enterica enterica serovar Typhi
gauccugcggcauuagca

SEQ ID NO: 1677536 - RNA, 16 nt, Salmonella enterica enterica serovar Typhi
gauccugcaacagcac

SEQ ID NO: 1677537 - RNA, 14 nt, Salmonella enterica enterica serovar Typhi
gauccguuucagaa

SEQ ID NO: 1677538 - RNA, 20 nt, Salmonella enterica enterica serovar Typhi
gauccguucgaucagcuggc

SEQ ID NO: 1677539 - RNA, 22 nt, Salmonella enterica enterica serovar Typhi
gauccguucgaucagcuggcuu

SEQ ID NO: 1677540 - RNA, 14 nt, Salmonella enterica enterica serovar Typhi
gauccguaaccagu

SEQ ID NO: 1677541 - RNA, 22 nt, Salmonella enterica enterica serovar Typhi
gauccguaaccagucguuaucu

SEQ ID NO: 1677542 - RNA, 20 nt, Salmonella enterica enterica serovar Typhi
gaucgcauuuaaucgccugc

SEQ ID NO: 1677543 - RNA, 20 nt, Salmonella enterica enterica serovar Typhi
gaucgaucucgauauucaca

SEQ ID NO: 1677544 - RNA, 13 nt, Salmonella enterica enterica serovar Typhi
gaucgacaaugau

SEQ ID NO: 1677545 - RNA, 18 nt, Salmonella enterica enterica serovar Typhi
gaucgaaugaaaauguau

SEQ ID NO: 1677546 - RNA, 15 nt, Salmonella enterica enterica serovar Typhi
gaucgacaaugauca

SEQ ID NO: 1677547 - RNA, 15 nt, Salmonella enterica enterica serovar Typhi
gauccuucauucaga

SEQ ID NO: 1677548 - RNA, 22 nt, Salmonella enterica enterica serovar Typhi
aaagccgcccugcggacaggcg

SEQ ID NO: 1677549 - RNA, 23 nt, Salmonella enterica enterica serovar Typhi
gauccaacacaucgacaugcaga

SEQ ID NO: 1677550 - RNA, 16 nt, Salmonella enterica enterica serovar Typhi
gauccaccaccagcau

SEQ ID NO: 1677551 - RNA, 20 nt, Salmonella enterica enterica serovar Typhi
gauccaccaccagcaucacg

SEQ ID NO: 1677552 - RNA, 20 nt, Salmonella enterica enterica serovar Typhi
gauccagaacugcgaaauca

SEQ ID NO: 1677553 - RNA, 22 nt, Salmonella enterica enterica serovar Typhi
gaucccagcgaacugauaaaag

SEQ ID NO: 1677554 - RNA, 23 nt, Salmonella enterica enterica serovar Typhi
gaucccagggcggcgucgccaga

SEQ ID NO: 1677555 - RNA, 22 nt, Salmonella enterica enterica serovar Typhi
gauccagcgauugacgguuugu

SEQ ID NO: 1677556 - RNA, 21 nt, Salmonella enterica enterica serovar Typhi
gauccggcauccaaccgaaca

SEQ ID NO: 1677557 - RNA, 19 nt, Salmonella enterica enterica serovar Typhi
gaucccuaauaaaauaacu

SEQ ID NO: 1677558 - RNA, 21 nt, Salmonella enterica enterica serovar Typhi
gauccgacaugaugccaaaua

SEQ ID NO: 1677559 - RNA, 20 nt, Salmonella enterica enterica serovar Typhi
gauccgaugcgcuuuacugu

SEQ ID NO: 1677560 - RNA, 14 nt, Salmonella enterica enterica serovar Typhi
gaucccgacucuga

SEQ ID NO: 1677561 - RNA, 15 nt, Salmonella enterica enterica serovar Typhi
gaucccgcgcgccuc

SEQ ID NO: 1677562 - RNA, 20 nt, Salmonella enterica enterica serovar Typhi
gauccccucuuccaucagcc

SEQ ID NO: 1677563 - RNA, 20 nt, Salmonella enterica enterica serovar Typhi
gaucccgggcgauaaaccag

SEQ ID NO: 1677564 - RNA, 14 nt, Salmonella enterica enterica serovar Typhi
gaucccuaauaaaa

SEQ ID NO: 1677565 - RNA, 20 nt, Salmonella enterica enterica serovar Typhi
gaggaguaguuaaaaaaggu

SEQ ID NO: 1677566 - RNA, 20 nt, Salmonella enterica enterica serovar Typhi
gaggcauaccgcccagaacg

SEQ ID NO: 1677567 - RNA, 12 nt, Salmonella enterica enterica serovar Typhi
gaggagcuggag

SEQ ID NO: 1677568 - RNA, 16 nt, Salmonella enterica enterica serovar Typhi
gaggagcuggagcagg

SEQ ID NO: 1677569 - RNA, 18 nt, Salmonella enterica enterica serovar Typhi
gaggaaaccuuucuucuc

SEQ ID NO: 1677570 - RNA, 15 nt, Salmonella enterica enterica serovar Typhi
gaggaacaucagcca

SEQ ID NO: 1677571 - RNA, 17 nt, Salmonella enterica enterica serovar Typhi
gaggaacuguucagcca

SEQ ID NO: 1677572 - RNA, 19 nt, Salmonella enterica enterica serovar Typhi
gaggacuguacaagaaggg

SEQ ID NO: 1677573 - RNA, 20 nt, Salmonella enterica enterica serovar Typhi
gaggaagcugcgcagcacuu

SEQ ID NO: 1677574 - RNA, 13 nt, Salmonella enterica enterica serovar Typhi
gagcugcgguggu

SEQ ID NO: 1677575 - RNA, 18 nt, Salmonella enterica enterica serovar Typhi
gaguaaugacaaaaauua

SEQ ID NO: 1677576 - RNA, 18 nt, Salmonella enterica enterica serovar Typhi
gaguaauccauagccaac

SEQ ID NO: 1677577 - RNA, 16 nt, Salmonella enterica enterica serovar Typhi
gaguaaugaccacacc

SEQ ID NO: 1677578 - RNA, 16 nt, Salmonella enterica enterica serovar Typhi
gaguaaauaaaucagc

SEQ ID NO: 1677579 - RNA, 14 nt, Salmonella enterica enterica serovar Typhi
gaguaacgggcagc

SEQ ID NO: 1677580 - RNA, 22 nt, Salmonella enterica enterica serovar Typhi
gaggguuuucaauuccacaggc

SEQ ID NO: 1677581 - RNA, 16 nt, Salmonella enterica enterica serovar Typhi
gaggcgcagccgccau

SEQ ID NO: 1677582 - RNA, 23 nt, Salmonella enterica enterica serovar Typhi
gaggcgcagccgccauccggcaa

SEQ ID NO: 1677583 - RNA, 15 nt, Salmonella enterica enterica serovar Typhi
gaguucgguuaacug

SEQ ID NO: 1677584 - RNA, 18 nt, Salmonella enterica enterica serovar Typhi
gaguucguuaaucucaaa

SEQ ID NO: 1677585 - RNA, 19 nt, Salmonella enterica enterica serovar Typhi
gauaaaauccgaaaugacc

SEQ ID NO: 1677586 - RNA, 13 nt, Salmonella enterica enterica serovar Typhi
gauaaaauuguua

SEQ ID NO: 1677587 - RNA, 16 nt, Salmonella enterica enterica serovar Typhi
gaguuugcaauccaga

SEQ ID NO: 1677588 - RNA, 16 nt, Salmonella enterica enterica serovar Typhi
gauaaaacgcaggcag

SEQ ID NO: 1677589 - RNA, 15 nt, Salmonella enterica enterica serovar Typhi
gauaaaccaggcagc

SEQ ID NO: 1677590 - RNA, 22 nt, Salmonella enterica enterica serovar Typhi
gauaaaccaacagccgccuguu

SEQ ID NO: 1677591 - RNA, 15 nt, Salmonella enterica enterica serovar Typhi
gauaaaccaacagcc

SEQ ID NO: 1677592 - RNA, 14 nt, Salmonella enterica enterica serovar Typhi
gauaaacagcagcg

SEQ ID NO: 1677593 - RNA, 14 nt, Salmonella enterica enterica serovar Typhi
gauaaccaggucac

SEQ ID NO: 1677594 - RNA, 18 nt, Salmonella enterica enterica serovar Typhi
gauaaagauauucuccuc

SEQ ID NO: 1677595 - RNA, 22 nt, Salmonella enterica enterica serovar Typhi
gauaaacggcuuuaguucagca

SEQ ID NO: 1677596 - RNA, 19 nt, Salmonella enterica enterica serovar Typhi
gauaaacugacaucccccu

SEQ ID NO: 1677597 - RNA, 20 nt, Salmonella enterica enterica serovar Typhi
gauaaagaccggcacaaccg

SEQ ID NO: 1677598 - RNA, 20 nt, Salmonella enterica enterica serovar Typhi
gauaacggucgcucccuacc

SEQ ID NO: 1677599 - RNA, 22 nt, Salmonella enterica enterica serovar Typhi
gauaacgcuaugcuuauccggc

SEQ ID NO: 1677600 - RNA, 22 nt, Salmonella enterica enterica serovar Typhi
gauaacgcgauggccaaauaac

SEQ ID NO: 1677601 - RNA, 15 nt, Salmonella enterica enterica serovar Typhi
gauaacgcgcuggcg

SEQ ID NO: 1677602 - RNA, 18 nt, Salmonella enterica enterica serovar Typhi
gauaaccuguaaauaaua

SEQ ID NO: 1677603 - RNA, 14 nt, Salmonella enterica enterica serovar Typhi
gauaaccgccgcca

SEQ ID NO: 1677604 - RNA, 16 nt, Salmonella enterica enterica serovar Typhi
gauaaccuuccggcac

SEQ ID NO: 1677605 - RNA, 15 nt, Salmonella enterica enterica serovar Typhi
gauaacgcaacaaca

SEQ ID NO: 1677606 - RNA, 18 nt, Salmonella enterica enterica serovar Typhi
gagugacgguuuucacug

SEQ ID NO: 1677607 - RNA, 11 nt, Salmonella enterica enterica serovar Typhi
gagugaacacg

SEQ ID NO: 1677608 - RNA, 19 nt, Salmonella enterica enterica serovar Typhi
gaguguggaaaacagcgcc

SEQ ID NO: 1677609 - RNA, 16 nt, Salmonella enterica enterica serovar Typhi
gaguguuggucuuggu

SEQ ID NO: 1677610 - RNA, 12 nt, Salmonella enterica enterica serovar Typhi
gaguuccuccug

SEQ ID NO: 1677611 - RNA, 12 nt, Salmonella enterica enterica serovar Typhi
gaguggcggcgc

SEQ ID NO: 1677612 - RNA, 21 nt, Salmonella enterica enterica serovar Typhi
gaguauuuaccuacuguggug

SEQ ID NO: 1677613 - RNA, 21 nt, Salmonella enterica enterica serovar Typhi
gaguaugcccgcgagagauua

SEQ ID NO: 1677614 - RNA, 16 nt, Salmonella enterica enterica serovar Typhi
gaguccugccggacug

SEQ ID NO: 1677615 - RNA, 18 nt, Salmonella enterica enterica serovar Typhi
gagucaaaagauugauuu

SEQ ID NO: 1677616 - RNA, 20 nt, Salmonella enterica enterica serovar Typhi
gagccgcccggcgcgcugga

SEQ ID NO: 1677617 - RNA, 18 nt, Salmonella enterica enterica serovar Typhi
gagccgaaauccaccagc

SEQ ID NO: 1677618 - RNA, 21 nt, Salmonella enterica enterica serovar Typhi
gagccacgcggcaucaggcau

SEQ ID NO: 1677619 - RNA, 23 nt, Salmonella enterica enterica serovar Typhi
gagccaccggcagggccaguucu

SEQ ID NO: 1677620 - RNA, 19 nt, Salmonella enterica enterica serovar Typhi
gagccacuauccagucagc

SEQ ID NO: 1677621 - RNA, 14 nt, Salmonella enterica enterica serovar Typhi
gagccgucgccggc

SEQ ID NO: 1677622 - RNA, 13 nt, Salmonella enterica enterica serovar Typhi
gagcgccaaaaag

SEQ ID NO: 1677623 - RNA, 13 nt, Salmonella enterica enterica serovar Typhi
gagcgcaggcgag

SEQ ID NO: 1677624 - RNA, 22 nt, Salmonella enterica enterica serovar Typhi
gagcgcauacgcuguccaguca

SEQ ID NO: 1677625 - RNA, 23 nt, Salmonella enterica enterica serovar Typhi
gagcgaguacguaaugugaaaaa

SEQ ID NO: 1677626 - RNA, 13 nt, Salmonella enterica enterica serovar Typhi
gagcgcaaacauc

SEQ ID NO: 1677627 - RNA, 16 nt, Salmonella enterica enterica serovar Typhi
gagcgccucugauuuu

SEQ ID NO: 1677628 - RNA, 15 nt, Salmonella enterica enterica serovar Typhi
gagcgcgaaaucaaa

SEQ ID NO: 1677629 - RNA, 17 nt, Salmonella enterica enterica serovar Typhi
gagcgccagcaacagcg

SEQ ID NO: 1677630 - RNA, 16 nt, Salmonella enterica enterica serovar Typhi
gagcgccaaaaagaaa

SEQ ID NO: 1677631 - RNA, 15 nt, Salmonella enterica enterica serovar Typhi
gagcggucaggccag

SEQ ID NO: 1677632 - RNA, 22 nt, Salmonella enterica enterica serovar Typhi
gagcggcgacuagucgcccgcu

SEQ ID NO: 1677633 - RNA, 15 nt, Salmonella enterica enterica serovar Typhi
gagcggccaaaggga

SEQ ID NO: 1677634 - RNA, 15 nt, Salmonella enterica enterica serovar Typhi
gagcgcgucagcgcc

SEQ ID NO: 1677635 - RNA, 12 nt, Salmonella enterica enterica serovar Typhi
gagcgcgcuggc

SEQ ID NO: 1677636 - RNA, 14 nt, Salmonella enterica enterica serovar Typhi
gagcgcgcgcgccu

SEQ ID NO: 1677637 - RNA, 19 nt, Salmonella enterica enterica serovar Typhi
gagcggauaauccgccacu

SEQ ID NO: 1677638 - RNA, 17 nt, Salmonella enterica enterica serovar Typhi
gagcgcguccagacguu

SEQ ID NO: 1677639 - RNA, 19 nt, Salmonella enterica enterica serovar Typhi
gagcguucgcguagcgccc

SEQ ID NO: 1677640 - RNA, 22 nt, Salmonella enterica enterica serovar Typhi
gagcuaaucaauaaguuuuuuc

SEQ ID NO: 1677641 - RNA, 17 nt, Salmonella enterica enterica serovar Typhi
gagcgucucauccggca

SEQ ID NO: 1677642 - RNA, 19 nt, Salmonella enterica enterica serovar Typhi
gagcguagaccgcccagga

SEQ ID NO: 1677643 - RNA, 13 nt, Salmonella enterica enterica serovar Typhi
gagcguauccagc

SEQ ID NO: 1677644 - RNA, 21 nt, Salmonella enterica enterica serovar Typhi
gagcgguuuuuuuguggccug

SEQ ID NO: 1677645 - RNA, 18 nt, Salmonella enterica enterica serovar Typhi
gagcgucuuuuaucccca

SEQ ID NO: 1677646 - RNA, 21 nt, Salmonella enterica enterica serovar Typhi
gagcguuacgggaacagaauu

SEQ ID NO: 1677647 - RNA, 16 nt, Salmonella enterica enterica serovar Typhi
gagcagcuuggcggcu

SEQ ID NO: 1677648 - RNA, 15 nt, Salmonella enterica enterica serovar Typhi
gagccaaacacuucc

SEQ ID NO: 1677649 - RNA, 21 nt, Salmonella enterica enterica serovar Typhi
aaagcacaucagcaaaugaac

SEQ ID NO: 1677650 - RNA, 18 nt, Salmonella enterica enterica serovar Typhi
aaagcacugcugcugaaa

SEQ ID NO: 1677651 - RNA, 21 nt, Salmonella enterica enterica serovar Typhi
aaagcacugcugcugaaagaa

SEQ ID NO: 1677652 - RNA, 22 nt, Salmonella enterica enterica serovar Typhi
aaagcacugcugcugaaagaag

SEQ ID NO: 1677653 - RNA, 23 nt, Salmonella enterica enterica serovar Typhi
aaagcacugcugcugaaagaaga

SEQ ID NO: 1677654 - RNA, 17 nt, Salmonella enterica enterica serovar Typhi
gagcaacagaaaccaua

SEQ ID NO: 1677655 - RNA, 20 nt, Salmonella enterica enterica serovar Typhi
gagcaaaccgacccaaaaau

SEQ ID NO: 1677656 - RNA, 14 nt, Salmonella enterica enterica serovar Typhi
gagcaaauacugga

SEQ ID NO: 1677657 - RNA, 22 nt, Salmonella enterica enterica serovar Typhi
gagcaaauacuggaaaaaacgg

SEQ ID NO: 1677658 - RNA, 12 nt, Salmonella enterica enterica serovar Typhi
gagcaauaacgu

SEQ ID NO: 1677659 - RNA, 20 nt, Salmonella enterica enterica serovar Typhi
gagcaacguuuugcacagug

SEQ ID NO: 1677660 - RNA, 18 nt, Salmonella enterica enterica serovar Typhi
gagcagauuuuucgccag

SEQ ID NO: 1677661 - RNA, 22 nt, Salmonella enterica enterica serovar Typhi
gagaggcugaaggcgcuccccu

SEQ ID NO: 1677662 - RNA, 13 nt, Salmonella enterica enterica serovar Typhi
gagagucgccagg

SEQ ID NO: 1677663 - RNA, 20 nt, Salmonella enterica enterica serovar Typhi
gagaguaaaaccggcacauc

SEQ ID NO: 1677664 - RNA, 14 nt, Salmonella enterica enterica serovar Typhi
gacucauggacaaa

SEQ ID NO: 1677665 - RNA, 20 nt, Salmonella enterica enterica serovar Typhi
gacucauucagcaacugcgu

SEQ ID NO: 1677666 - RNA, 17 nt, Salmonella enterica enterica serovar Typhi
gacucaucgccgcaaug

SEQ ID NO: 1677667 - RNA, 19 nt, Salmonella enterica enterica serovar Typhi
gacucaucgccgcaaugac

SEQ ID NO: 1677668 - RNA, 22 nt, Salmonella enterica enterica serovar Typhi
gacucaggguuuuacgcuggac

SEQ ID NO: 1677669 - RNA, 13 nt, Salmonella enterica enterica serovar Typhi
gacucagggugac

SEQ ID NO: 1677670 - RNA, 20 nt, Salmonella enterica enterica serovar Typhi
gacucaccccuucuuuaucu

SEQ ID NO: 1677671 - RNA, 21 nt, Salmonella enterica enterica serovar Typhi
gacucaaacagauagccauca

SEQ ID NO: 1677672 - RNA, 13 nt, Salmonella enterica enterica serovar Typhi
gacucaaagaaaa

SEQ ID NO: 1677673 - RNA, 20 nt, Salmonella enterica enterica serovar Typhi
gagauguuuuaccaguacaa

SEQ ID NO: 1677674 - RNA, 16 nt, Salmonella enterica enterica serovar Typhi
gagaucgguaauuucc

SEQ ID NO: 1677675 - RNA, 17 nt, Salmonella enterica enterica serovar Typhi
gagaucgguaauuucca

SEQ ID NO: 1677676 - RNA, 18 nt, Salmonella enterica enterica serovar Typhi
gagaucgguaauuuccac

SEQ ID NO: 1677677 - RNA, 20 nt, Salmonella enterica enterica serovar Typhi
gagaucgguaauuuccacgc

SEQ ID NO: 1677678 - RNA, 21 nt, Salmonella enterica enterica serovar Typhi
gagaucgguaauuuccacgcc

SEQ ID NO: 1677679 - RNA, 15 nt, Salmonella enterica enterica serovar Typhi
gagauuuaucuucuc

SEQ ID NO: 1677680 - RNA, 17 nt, Salmonella enterica enterica serovar Typhi
gagcaaaaccagacgcc

SEQ ID NO: 1677681 - RNA, 15 nt, Salmonella enterica enterica serovar Typhi
gagauucaauaaugu

SEQ ID NO: 1677682 - RNA, 14 nt, Salmonella enterica enterica serovar Typhi
gagauucugcaggc

SEQ ID NO: 1677683 - RNA, 17 nt, Salmonella enterica enterica serovar Typhi
gagauucugcaggccaa

SEQ ID NO: 1677684 - RNA, 13 nt, Salmonella enterica enterica serovar Typhi
gaugauauccagc

SEQ ID NO: 1677685 - RNA, 12 nt, Salmonella enterica enterica serovar Typhi
gaugaucuucau

SEQ ID NO: 1677686 - RNA, 13 nt, Salmonella enterica enterica serovar Typhi
gaugaucuucaua

SEQ ID NO: 1677687 - RNA, 17 nt, Salmonella enterica enterica serovar Typhi
aaagccucuuuugcauu

SEQ ID NO: 1677688 - RNA, 20 nt, Salmonella enterica enterica serovar Typhi
aaagccugcacauugcaggc

SEQ ID NO: 1677689 - RNA, 17 nt, Salmonella enterica enterica serovar Typhi
aaagccggcggaaaaaa

SEQ ID NO: 1677690 - RNA, 13 nt, Salmonella enterica enterica serovar Typhi
gaugauggcggcu

SEQ ID NO: 1677691 - RNA, 18 nt, Salmonella enterica enterica serovar Typhi
gaugagcucaaauaugau

SEQ ID NO: 1677692 - RNA, 18 nt, Salmonella enterica enterica serovar Typhi
gaugacccgcaauauuaa

SEQ ID NO: 1677693 - RNA, 17 nt, Salmonella enterica enterica serovar Typhi
gaugaccauaaaugaaa

SEQ ID NO: 1677694 - RNA, 20 nt, Salmonella enterica enterica serovar Typhi
gaugaccaguuaagcaaaaa

SEQ ID NO: 1677695 - RNA, 16 nt, Salmonella enterica enterica serovar Typhi
gaugaccauaaaugaa

SEQ ID NO: 1677696 - RNA, 19 nt, Salmonella enterica enterica serovar Typhi
gaugacucauuaaaaaaac

SEQ ID NO: 1677697 - RNA, 19 nt, Salmonella enterica enterica serovar Typhi
gaugacucccaguccggua

SEQ ID NO: 1677698 - RNA, 19 nt, Salmonella enterica enterica serovar Typhi
gaucuugucacaauaacgc

SEQ ID NO: 1677699 - RNA, 15 nt, Salmonella enterica enterica serovar Typhi
gaucuuuccuuuuuc

SEQ ID NO: 1677700 - RNA, 13 nt, Salmonella enterica enterica serovar Typhi
gaucuuugccgcg

SEQ ID NO: 1677701 - RNA, 11 nt, Salmonella enterica enterica serovar Typhi
gaugaaaaaga

SEQ ID NO: 1677702 - RNA, 23 nt, Salmonella enterica enterica serovar Typhi
gaucuuccugcgcgccaaaccgu

SEQ ID NO: 1677703 - RNA, 19 nt, Salmonella enterica enterica serovar Typhi
gaucuuaucuuucagcgcc

SEQ ID NO: 1677704 - RNA, 19 nt, Salmonella enterica enterica serovar Typhi
gaucuuauaugagcgggcc

SEQ ID NO: 1677705 - RNA, 19 nt, Salmonella enterica enterica serovar Typhi
gaugaauuccugcggcggu

SEQ ID NO: 1677706 - RNA, 20 nt, Salmonella enterica enterica serovar Typhi
gaugaaccauaucaaacagg

SEQ ID NO: 1677707 - RNA, 11 nt, Salmonella enterica enterica serovar Typhi
gaugaaagguc

SEQ ID NO: 1677708 - RNA, 14 nt, Salmonella enterica enterica serovar Typhi
gaugcguucaaaga

SEQ ID NO: 1677709 - RNA, 16 nt, Salmonella enterica enterica serovar Typhi
gaugcuauaccgcccg

SEQ ID NO: 1677710 - RNA, 22 nt, Salmonella enterica enterica serovar Typhi
gaugcuaaccucuauaguaaau

SEQ ID NO: 1677711 - RNA, 18 nt, Salmonella enterica enterica serovar Typhi
gaugcgggccgacaaaaa

SEQ ID NO: 1677712 - RNA, 19 nt, Salmonella enterica enterica serovar Typhi
gaugcgggcgaucggcugu

SEQ ID NO: 1677713 - RNA, 17 nt, Salmonella enterica enterica serovar Typhi
gaugcguauccagcgcg

SEQ ID NO: 1677714 - RNA, 16 nt, Salmonella enterica enterica serovar Typhi
gaugcgcugcgcgcga

SEQ ID NO: 1677715 - RNA, 14 nt, Salmonella enterica enterica serovar Typhi
gaugcggaagagaa

SEQ ID NO: 1677716 - RNA, 21 nt, Salmonella enterica enterica serovar Typhi
gaugcgccugucuccagcgcc

SEQ ID NO: 1677717 - RNA, 18 nt, Salmonella enterica enterica serovar Typhi
gaugcgccaguucagcgu

SEQ ID NO: 1677718 - RNA, 20 nt, Salmonella enterica enterica serovar Typhi
gaugcgccagccagucgcca

SEQ ID NO: 1677719 - RNA, 22 nt, Salmonella enterica enterica serovar Typhi
gaugcgccgacugaacauagcc

SEQ ID NO: 1677720 - RNA, 18 nt, Salmonella enterica enterica serovar Typhi
gaugccggauaauacgaa

SEQ ID NO: 1677721 - RNA, 15 nt, Salmonella enterica enterica serovar Typhi
gaugcauaaaaaaac

SEQ ID NO: 1677722 - RNA, 19 nt, Salmonella enterica enterica serovar Typhi
gaugcccagguuagcagcc

SEQ ID NO: 1677723 - RNA, 15 nt, Salmonella enterica enterica serovar Typhi
gaugcccguaaagcu

SEQ ID NO: 1677724 - RNA, 14 nt, Salmonella enterica enterica serovar Typhi
gaugcaggcgccug

SEQ ID NO: 1677725 - RNA, 22 nt, Salmonella enterica enterica serovar Typhi
gaugcaccuuucuccugcgcuu

SEQ ID NO: 1677726 - RNA, 11 nt, Salmonella enterica enterica serovar Typhi
gaugcagcacc

SEQ ID NO: 1677727 - RNA, 15 nt, Salmonella enterica enterica serovar Typhi
gaugcaaugcagaug

SEQ ID NO: 1677728 - RNA, 14 nt, Salmonella enterica enterica serovar Typhi
gaugauucacccuc

SEQ ID NO: 1677729 - RNA, 19 nt, Salmonella enterica enterica serovar Typhi
aaagcgaauaacauaauau

SEQ ID NO: 1677730 - RNA, 13 nt, Salmonella enterica enterica serovar Typhi
aaagcgaauaauu

SEQ ID NO: 1677731 - RNA, 13 nt, Salmonella enterica enterica serovar Typhi
gauggcgcgcuua

SEQ ID NO: 1677732 - RNA, 19 nt, Salmonella enterica enterica serovar Typhi
gauggcgagaagcugggcg

SEQ ID NO: 1677733 - RNA, 16 nt, Salmonella enterica enterica serovar Typhi
gauggcgaucagcgcc

SEQ ID NO: 1677734 - RNA, 15 nt, Salmonella enterica enterica serovar Typhi
gauggcggcugcgcc

SEQ ID NO: 1677735 - RNA, 15 nt, Salmonella enterica enterica serovar Typhi
gauggcgcuccugaa

SEQ ID NO: 1677736 - RNA, 17 nt, Salmonella enterica enterica serovar Typhi
gauggcgcuccugaauc

SEQ ID NO: 1677737 - RNA, 18 nt, Salmonella enterica enterica serovar Typhi
gauggccgccgagcugug

SEQ ID NO: 1677738 - RNA, 16 nt, Salmonella enterica enterica serovar Typhi
gaugcugcguuuuuuc

SEQ ID NO: 1677739 - RNA, 19 nt, Salmonella enterica enterica serovar Typhi
gaugcugucuuagugaaag

SEQ ID NO: 1677740 - RNA, 15 nt, Salmonella enterica enterica serovar Typhi
gauggaacagacgcc

SEQ ID NO: 1677741 - RNA, 19 nt, Salmonella enterica enterica serovar Typhi
gauggcacgauaaccagau

SEQ ID NO: 1677742 - RNA, 13 nt, Salmonella enterica enterica serovar Typhi
gauggcaaauaau

SEQ ID NO: 1677743 - RNA, 15 nt, Salmonella enterica enterica serovar Typhi
gauggauaaccugcc

SEQ ID NO: 1677744 - RNA, 17 nt, Salmonella enterica enterica serovar Typhi
gauggacuugugcagug

SEQ ID NO: 1677745 - RNA, 17 nt, Salmonella enterica enterica serovar Typhi
gauggaacgcauccagc

SEQ ID NO: 1677746 - RNA, 17 nt, Salmonella enterica enterica serovar Typhi
gaugggcuucagauguu

SEQ ID NO: 1677747 - RNA, 19 nt, Salmonella enterica enterica serovar Typhi
gauggcuaugaagcuggag

SEQ ID NO: 1677748 - RNA, 14 nt, Salmonella enterica enterica serovar Typhi
gaugggcaaugcca

SEQ ID NO: 1677749 - RNA, 22 nt, Salmonella enterica enterica serovar Typhi
gauggugcagccccggcggcgu

SEQ ID NO: 1677750 - RNA, 16 nt, Salmonella enterica enterica serovar Typhi
gauguaguuguucuuu

SEQ ID NO: 1677751 - RNA, 22 nt, Salmonella enterica enterica serovar Typhi
gauguacuguauucgguggaaa

SEQ ID NO: 1677752 - RNA, 20 nt, Salmonella enterica enterica serovar Typhi
gauguccaggcgacaugaca

SEQ ID NO: 1677753 - RNA, 16 nt, Salmonella enterica enterica serovar Typhi
gauguccgcagccgca

SEQ ID NO: 1677754 - RNA, 22 nt, Salmonella enterica enterica serovar Typhi
gaugucauccgguucacccacu

SEQ ID NO: 1677755 - RNA, 17 nt, Salmonella enterica enterica serovar Typhi
gaugguggugcaagcac

SEQ ID NO: 1677756 - RNA, 23 nt, Salmonella enterica enterica serovar Typhi
gaugguuaaauucauauuuaaau

SEQ ID NO: 1677757 - RNA, 16 nt, Salmonella enterica enterica serovar Typhi
gaugguuauuuucaga

SEQ ID NO: 1677758 - RNA, 23 nt, Salmonella enterica enterica serovar Typhi
gauuaccauugaucaggcaaaaa

SEQ ID NO: 1677759 - RNA, 17 nt, Salmonella enterica enterica serovar Typhi
gauuaaugauuugcuuu

SEQ ID NO: 1677760 - RNA, 16 nt, Salmonella enterica enterica serovar Typhi
gauuaaucagcagaua

SEQ ID NO: 1677761 - RNA, 21 nt, Salmonella enterica enterica serovar Typhi
gauuaaugauuugcuuuauuu

SEQ ID NO: 1677762 - RNA, 18 nt, Salmonella enterica enterica serovar Typhi
gauuaaugcuccaauaaa

SEQ ID NO: 1677763 - RNA, 14 nt, Salmonella enterica enterica serovar Typhi
gauuagcagagcgg

SEQ ID NO: 1677764 - RNA, 16 nt, Salmonella enterica enterica serovar Typhi
gauuacgacccacaau

SEQ ID NO: 1677765 - RNA, 16 nt, Salmonella enterica enterica serovar Typhi
gauuacggaacaaaac

SEQ ID NO: 1677766 - RNA, 18 nt, Salmonella enterica enterica serovar Typhi
gauuacucucuugccagc

SEQ ID NO: 1677767 - RNA, 20 nt, Salmonella enterica enterica serovar Typhi
gauuacucucuugccagcgc

SEQ ID NO: 1677768 - RNA, 22 nt, Salmonella enterica enterica serovar Typhi
gauuaccgggauuuccauauua

SEQ ID NO: 1677769 - RNA, 11 nt, Salmonella enterica enterica serovar Typhi
gauuauccagu

SEQ ID NO: 1677770 - RNA, 12 nt, Salmonella enterica enterica serovar Typhi
gauuauagagag

SEQ ID NO: 1677771 - RNA, 15 nt, Salmonella enterica enterica serovar Typhi
gauuauuuucacgcc

SEQ ID NO: 1677772 - RNA, 15 nt, Salmonella enterica enterica serovar Typhi
gauuauuguuaaaaa

SEQ ID NO: 1677773 - RNA, 14 nt, Salmonella enterica enterica serovar Typhi
gaugucucagcgca

SEQ ID NO: 1677774 - RNA, 13 nt, Salmonella enterica enterica serovar Typhi
gaugugauaaaug

SEQ ID NO: 1677775 - RNA, 20 nt, Salmonella enterica enterica serovar Typhi
gaugucggcguaaauccagc

SEQ ID NO: 1677776 - RNA, 23 nt, Salmonella enterica enterica serovar Typhi
gaugugauuuuugacccgcagca

SEQ ID NO: 1677777 - RNA, 19 nt, Salmonella enterica enterica serovar Typhi
gaugugcuuuuuauuuuuc

SEQ ID NO: 1677778 - RNA, 17 nt, Salmonella enterica enterica serovar Typhi
gauguuacgacccagcg

SEQ ID NO: 1677779 - RNA, 21 nt, Salmonella enterica enterica serovar Typhi
gauguucgcgauuuucaucaa

SEQ ID NO: 1677780 - RNA, 14 nt, Salmonella enterica enterica serovar Typhi
gauguuuuuaaaag

SEQ ID NO: 1677781 - RNA, 15 nt, Salmonella enterica enterica serovar Typhi
gauuaacggcaaaaa

SEQ ID NO: 1677782 - RNA, 17 nt, Salmonella enterica enterica serovar Typhi
gauuaagcgaauccagc

SEQ ID NO: 1677783 - RNA, 19 nt, Salmonella enterica enterica serovar Typhi
gauuaaagauaagcacaug

SEQ ID NO: 1677784 - RNA, 15 nt, Salmonella enterica enterica serovar Typhi
gauucugccaguuca

SEQ ID NO: 1677785 - RNA, 13 nt, Salmonella enterica enterica serovar Typhi
gauugaauaaugc

SEQ ID NO: 1677786 - RNA, 14 nt, Salmonella enterica enterica serovar Typhi
gauugcaagaauau

SEQ ID NO: 1677787 - RNA, 21 nt, Salmonella enterica enterica serovar Typhi
gauugaggcggguaauuugcg

SEQ ID NO: 1677788 - RNA, 20 nt, Salmonella enterica enterica serovar Typhi
gauugauuuauucacuggca

SEQ ID NO: 1677789 - RNA, 17 nt, Salmonella enterica enterica serovar Typhi
gauugauuuuguaaucu

SEQ ID NO: 1677790 - RNA, 19 nt, Salmonella enterica enterica serovar Typhi
gauuggcugugacaauuca

SEQ ID NO: 1677791 - RNA, 18 nt, Salmonella enterica enterica serovar Typhi
gauuccaugcccaguuca

SEQ ID NO: 1677792 - RNA, 16 nt, Salmonella enterica enterica serovar Typhi
gauucgccguucuguu

SEQ ID NO: 1677793 - RNA, 20 nt, Salmonella enterica enterica serovar Typhi
gauucguuuuuacacugaag

SEQ ID NO: 1677794 - RNA, 16 nt, Salmonella enterica enterica serovar Typhi
gauucaggccgccagc

SEQ ID NO: 1677795 - RNA, 13 nt, Salmonella enterica enterica serovar Typhi
gauucagcauugg

SEQ ID NO: 1677796 - RNA, 16 nt, Salmonella enterica enterica serovar Typhi
gauucaccaacugcug

SEQ ID NO: 1677797 - RNA, 22 nt, Salmonella enterica enterica serovar Typhi
gauucaacguuucgcuaucgcc

SEQ ID NO: 1677798 - RNA, 23 nt, Salmonella enterica enterica serovar Typhi
gauuguuucggauaauucugacu

SEQ ID NO: 1677799 - RNA, 16 nt, Salmonella enterica enterica serovar Typhi
gauuuaagcuuaauuu

SEQ ID NO: 1677800 - RNA, 14 nt, Salmonella enterica enterica serovar Typhi
gauuuaaaacaagc

SEQ ID NO: 1677801 - RNA, 18 nt, Salmonella enterica enterica serovar Typhi
gauuuaaaacaagcagua

SEQ ID NO: 1677802 - RNA, 16 nt, Salmonella enterica enterica serovar Typhi
gauuuccauauuaacg

SEQ ID NO: 1677803 - RNA, 13 nt, Salmonella enterica enterica serovar Typhi
gauuuccagcgcc

SEQ ID NO: 1677804 - RNA, 20 nt, Salmonella enterica enterica serovar Typhi
gauuuccggaaugguauaaa

SEQ ID NO: 1677805 - RNA, 16 nt, Salmonella enterica enterica serovar Typhi
gauuucaucaggcuga

SEQ ID NO: 1677806 - RNA, 14 nt, Salmonella enterica enterica serovar Typhi
gauuucauccucuu

SEQ ID NO: 1677807 - RNA, 14 nt, Salmonella enterica enterica serovar Typhi
gauuuaucuucucu

SEQ ID NO: 1677808 - RNA, 15 nt, Salmonella enterica enterica serovar Typhi
gauuuauagagcagc

SEQ ID NO: 1677809 - RNA, 12 nt, Salmonella enterica enterica serovar Typhi
gauuuaugaaua

SEQ ID NO: 1677810 - RNA, 18 nt, Salmonella enterica enterica serovar Typhi
gauuugcaaccgcucuuu

SEQ ID NO: 1677811 - RNA, 23 nt, Salmonella enterica enterica serovar Typhi
gauuuguacguauuuacaaauga

SEQ ID NO: 1677812 - RNA, 14 nt, Salmonella enterica enterica serovar Typhi
gauuugcccuucca

SEQ ID NO: 1677813 - RNA, 17 nt, Salmonella enterica enterica serovar Typhi
gauuugcccuuccagca

SEQ ID NO: 1677814 - RNA, 16 nt, Salmonella enterica enterica serovar Typhi
gauuugccgcgccuuc

SEQ ID NO: 1677815 - RNA, 19 nt, Salmonella enterica enterica serovar Typhi
gauuugcgaaucauguuuu

SEQ ID NO: 1677816 - RNA, 20 nt, Salmonella enterica enterica serovar Typhi
gauuucgacgauaaaaaaag

SEQ ID NO: 1677817 - RNA, 17 nt, Salmonella enterica enterica serovar Typhi
gauuucgccccacuggc

SEQ ID NO: 1677818 - RNA, 17 nt, Salmonella enterica enterica serovar Typhi
gauuucuugagcggcau

SEQ ID NO: 1677819 - RNA, 15 nt, Salmonella enterica enterica serovar Typhi
gauuucuuaauuccu

SEQ ID NO: 1677820 - RNA, 21 nt, Salmonella enterica enterica serovar Typhi
gauuuuaagcauccaggaagu

SEQ ID NO: 1677821 - RNA, 21 nt, Salmonella enterica enterica serovar Typhi
gauuuucuuauuacaagaaag

SEQ ID NO: 1677822 - RNA, 13 nt, Salmonella enterica enterica serovar Typhi
gauuuugaaggug

SEQ ID NO: 1677823 - RNA, 13 nt, Salmonella enterica enterica serovar Typhi
gauuuucuuuaau

SEQ ID NO: 1677824 - RNA, 20 nt, Salmonella enterica enterica serovar Typhi
gauuuucccuucugaaauga

SEQ ID NO: 1677825 - RNA, 17 nt, Salmonella enterica enterica serovar Typhi
gauuuuccguuaagcug

SEQ ID NO: 1677826 - RNA, 19 nt, Salmonella enterica enterica serovar Typhi
gcaaaaauaggcuuuugau

SEQ ID NO: 1677827 - RNA, 19 nt, Salmonella enterica enterica serovar Typhi
gcaaaauggcaauugcgcc

SEQ ID NO: 1677828 - RNA, 15 nt, Salmonella enterica enterica serovar Typhi
gcaaacaacccggcu

SEQ ID NO: 1677829 - RNA, 15 nt, Salmonella enterica enterica serovar Typhi
gcaaaauucacacca

SEQ ID NO: 1677830 - RNA, 16 nt, Salmonella enterica enterica serovar Typhi
gcaaaauuccggcuga

SEQ ID NO: 1677831 - RNA, 15 nt, Salmonella enterica enterica serovar Typhi
gcaaaauauauaauu

SEQ ID NO: 1677832 - RNA, 15 nt, Salmonella enterica enterica serovar Typhi
gcaaaaccagacgcc

SEQ ID NO: 1677833 - RNA, 18 nt, Salmonella enterica enterica serovar Typhi
gcaaaaccuucauaaaua

SEQ ID NO: 1677834 - RNA, 14 nt, Salmonella enterica enterica serovar Typhi
gcaaaaaucagccc

SEQ ID NO: 1677835 - RNA, 13 nt, Salmonella enterica enterica serovar Typhi
gcaaaaauuugcg

SEQ ID NO: 1677836 - RNA, 15 nt, Salmonella enterica enterica serovar Typhi
gcaaaacgccgcaga

SEQ ID NO: 1677837 - RNA, 12 nt, Salmonella enterica enterica serovar Typhi
gcaaaagaaaaa

SEQ ID NO: 1677838 - RNA, 22 nt, Salmonella enterica enterica serovar Typhi
gcaaaagaggcuaauuaucugc

SEQ ID NO: 1677839 - RNA, 14 nt, Salmonella enterica enterica serovar Typhi
gcaaacuuugcgcc

SEQ ID NO: 1677840 - RNA, 18 nt, Salmonella enterica enterica serovar Typhi
gcaaacgguuaauacuga

SEQ ID NO: 1677841 - RNA, 16 nt, Salmonella enterica enterica serovar Typhi
gcaaagcacugcugcu

SEQ ID NO: 1677842 - RNA, 18 nt, Salmonella enterica enterica serovar Typhi
gcaaagcacugcugcuga

SEQ ID NO: 1677843 - RNA, 17 nt, Salmonella enterica enterica serovar Typhi
gcaaagaagggcagggg

SEQ ID NO: 1677844 - RNA, 17 nt, Salmonella enterica enterica serovar Typhi
gcaaagcgacgcgcggu

SEQ ID NO: 1677845 - RNA, 16 nt, Salmonella enterica enterica serovar Typhi
gcaaagcguugcaacc

SEQ ID NO: 1677846 - RNA, 15 nt, Salmonella enterica enterica serovar Typhi
gcaaagcucaacgca

SEQ ID NO: 1677847 - RNA, 18 nt, Salmonella enterica enterica serovar Typhi
gcaaagcucaacgcaggc

SEQ ID NO: 1677848 - RNA, 19 nt, Salmonella enterica enterica serovar Typhi
gcaaagcccacgcccugca

SEQ ID NO: 1677849 - RNA, 14 nt, Salmonella enterica enterica serovar Typhi
gcaaacgccgccug

SEQ ID NO: 1677850 - RNA, 14 nt, Salmonella enterica enterica serovar Typhi
gcaaacgccugcuc

SEQ ID NO: 1677851 - RNA, 13 nt, Salmonella enterica enterica serovar Typhi
gcaaaccucuccc

SEQ ID NO: 1677852 - RNA, 20 nt, Salmonella enterica enterica serovar Typhi
gcaaaccgggguaucuguuu

SEQ ID NO: 1677853 - RNA, 20 nt, Salmonella enterica enterica serovar Typhi
gcaaaccggguaacaacauu

SEQ ID NO: 1677854 - RNA, 20 nt, Salmonella enterica enterica serovar Typhi
gcaaacggcacuacagcccu

SEQ ID NO: 1677855 - RNA, 23 nt, Salmonella enterica enterica serovar Typhi
gcaaacgguaaacgugccacagu

SEQ ID NO: 1677856 - RNA, 16 nt, Salmonella enterica enterica serovar Typhi
gcaaacgguuaauacu

SEQ ID NO: 1677857 - RNA, 14 nt, Salmonella enterica enterica serovar Typhi
gcaaacgggauucc

SEQ ID NO: 1677858 - RNA, 14 nt, Salmonella enterica enterica serovar Typhi
gcaaacucagcggc

SEQ ID NO: 1677859 - RNA, 15 nt, Salmonella enterica enterica serovar Typhi
gcaaacucagcggcu

SEQ ID NO: 1677860 - RNA, 18 nt, Salmonella enterica enterica serovar Typhi
gcaaacucagcggcucug

SEQ ID NO: 1677861 - RNA, 15 nt, Salmonella enterica enterica serovar Typhi
gcaaacugaucgagg

SEQ ID NO: 1677862 - RNA, 15 nt, Salmonella enterica enterica serovar Typhi
gcaaacugccaggca

SEQ ID NO: 1677863 - RNA, 21 nt, Salmonella enterica enterica serovar Typhi
gcaaaccgaauucguccacac

SEQ ID NO: 1677864 - RNA, 18 nt, Salmonella enterica enterica serovar Typhi
gcaaacagagcgccggca

SEQ ID NO: 1677865 - RNA, 16 nt, Salmonella enterica enterica serovar Typhi
gcaaacaccucagcca

SEQ ID NO: 1677866 - RNA, 17 nt, Salmonella enterica enterica serovar Typhi
gcaaacaguacgcccgc

SEQ ID NO: 1677867 - RNA, 18 nt, Salmonella enterica enterica serovar Typhi
gcaaacaccucagccacc

SEQ ID NO: 1677868 - RNA, 14 nt, Salmonella enterica enterica serovar Typhi
gcaaacagcuucau

SEQ ID NO: 1677869 - RNA, 19 nt, Salmonella enterica enterica serovar Typhi
gcaaauagguuuuaugcau

SEQ ID NO: 1677870 - RNA, 19 nt, Salmonella enterica enterica serovar Typhi
gcaaauaccacaucagacc

SEQ ID NO: 1677871 - RNA, 16 nt, Salmonella enterica enterica serovar Typhi
gcaaauacaucgccac

SEQ ID NO: 1677872 - RNA, 15 nt, Salmonella enterica enterica serovar Typhi
gcaaauaccacauca

SEQ ID NO: 1677873 - RNA, 15 nt, Salmonella enterica enterica serovar Typhi
gcaaagguugccgca

SEQ ID NO: 1677874 - RNA, 22 nt, Salmonella enterica enterica serovar Typhi
gcaaagucgaacgacugaguau

SEQ ID NO: 1677875 - RNA, 19 nt, Salmonella enterica enterica serovar Typhi
gcaaaguacgggugaagca

SEQ ID NO: 1677876 - RNA, 17 nt, Salmonella enterica enterica serovar Typhi
gcaaaguggguauauuu

SEQ ID NO: 1677877 - RNA, 19 nt, Salmonella enterica enterica serovar Typhi
gcaaaucagcuacuuuaaa

SEQ ID NO: 1677878 - RNA, 20 nt, Salmonella enterica enterica serovar Typhi
gcaaaucccugaucggccag

SEQ ID NO: 1677879 - RNA, 20 nt, Salmonella enterica enterica serovar Typhi
gcaaaucgcccaucacaugu

SEQ ID NO: 1677880 - RNA, 22 nt, Salmonella enterica enterica serovar Typhi
gcaaaucugccgucaucgacuu

SEQ ID NO: 1677881 - RNA, 21 nt, Salmonella enterica enterica serovar Typhi
gcaaaugauuaucuccaucuu

SEQ ID NO: 1677882 - RNA, 16 nt, Salmonella enterica enterica serovar Typhi
gcaaaugccaucccau

SEQ ID NO: 1677883 - RNA, 23 nt, Salmonella enterica enterica serovar Typhi
gcaaauucuguaucgcuuauuuu

SEQ ID NO: 1677884 - RNA, 13 nt, Salmonella enterica enterica serovar Typhi
gcaaauucuuuuc

SEQ ID NO: 1677885 - RNA, 12 nt, Salmonella enterica enterica serovar Typhi
gcaacaaagccu

SEQ ID NO: 1677886 - RNA, 14 nt, Salmonella enterica enterica serovar Typhi
gcaacauagcaucg

SEQ ID NO: 1677887 - RNA, 17 nt, Salmonella enterica enterica serovar Typhi
gcaacauaaauaaacag

SEQ ID NO: 1677888 - RNA, 20 nt, Salmonella enterica enterica serovar Typhi
gcaacagugggcuaugaaga

SEQ ID NO: 1677889 - RNA, 18 nt, Salmonella enterica enterica serovar Typhi
gcaacaguugcuggagca

SEQ ID NO: 1677890 - RNA, 16 nt, Salmonella enterica enterica serovar Typhi
gcaacaugcccaccgg

SEQ ID NO: 1677891 - RNA, 16 nt, Salmonella enterica enterica serovar Typhi
gcaacauggacaccgg

SEQ ID NO: 1677892 - RNA, 13 nt, Salmonella enterica enterica serovar Typhi
gcaaccaggucac

SEQ ID NO: 1677893 - RNA, 21 nt, Salmonella enterica enterica serovar Typhi
gcaaccccuugcggugcagca

SEQ ID NO: 1677894 - RNA, 21 nt, Salmonella enterica enterica serovar Typhi
gcaacccguaccuccagcgac

SEQ ID NO: 1677895 - RNA, 18 nt, Salmonella enterica enterica serovar Typhi
gcaacagcaagucgcggg

SEQ ID NO: 1677896 - RNA, 17 nt, Salmonella enterica enterica serovar Typhi
gcaacagcaccagcagg

SEQ ID NO: 1677897 - RNA, 22 nt, Salmonella enterica enterica serovar Typhi
gcaacagggugauuucgcccgc

SEQ ID NO: 1677898 - RNA, 15 nt, Salmonella enterica enterica serovar Typhi
gcaacaguugcugga

SEQ ID NO: 1677899 - RNA, 13 nt, Salmonella enterica enterica serovar Typhi
gcaacagucagcu

SEQ ID NO: 1677900 - RNA, 16 nt, Salmonella enterica enterica serovar Typhi
gcaacagcaccagcag

SEQ ID NO: 1677901 - RNA, 12 nt, Salmonella enterica enterica serovar Typhi
gcaacagcacca

SEQ ID NO: 1677902 - RNA, 11 nt, Salmonella enterica enterica serovar Typhi
gcaacaacagu

SEQ ID NO: 1677903 - RNA, 22 nt, Salmonella enterica enterica serovar Typhi
gcaacaaacauaagcaaauccu

SEQ ID NO: 1677904 - RNA, 18 nt, Salmonella enterica enterica serovar Typhi
gcaacacagccagcacga

SEQ ID NO: 1677905 - RNA, 21 nt, Salmonella enterica enterica serovar Typhi
gcaacacgacaaaagcaucaa

SEQ ID NO: 1677906 - RNA, 22 nt, Salmonella enterica enterica serovar Typhi
gcccgcuucacgcgcggcuacu

SEQ ID NO: 1677907 - RNA, 22 nt, Salmonella enterica enterica serovar Typhi
gcccggaaauggguaucuucau

SEQ ID NO: 1677908 - RNA, 20 nt, Salmonella enterica enterica serovar Typhi
gcccggacgaaccuggcggu

SEQ ID NO: 1677909 - RNA, 19 nt, Salmonella enterica enterica serovar Typhi
gcccggacgccguccaggc

SEQ ID NO: 1677910 - RNA, 21 nt, Salmonella enterica enterica serovar Typhi
gcccggacaaggcgcgccagc

SEQ ID NO: 1677911 - RNA, 18 nt, Salmonella enterica enterica serovar Typhi
gcccggacgaaccuggcg

SEQ ID NO: 1677912 - RNA, 11 nt, Salmonella enterica enterica serovar Typhi
gcccgcggcga

SEQ ID NO: 1677913 - RNA, 13 nt, Salmonella enterica enterica serovar Typhi
gcccgcgcguuca

SEQ ID NO: 1677914 - RNA, 19 nt, Salmonella enterica enterica serovar Typhi
gcccgggcacgauggccug

SEQ ID NO: 1677915 - RNA, 22 nt, Salmonella enterica enterica serovar Typhi
gcccgggagaacgccgggccug

SEQ ID NO: 1677916 - RNA, 14 nt, Salmonella enterica enterica serovar Typhi
gcccggcuucccau

SEQ ID NO: 1677917 - RNA, 19 nt, Salmonella enterica enterica serovar Typhi
gcccgggacugacugagcc

SEQ ID NO: 1677918 - RNA, 18 nt, Salmonella enterica enterica serovar Typhi
gcccggcgcgcuggaggc

SEQ ID NO: 1677919 - RNA, 13 nt, Salmonella enterica enterica serovar Typhi
gcccggcgcggca

SEQ ID NO: 1677920 - RNA, 14 nt, Salmonella enterica enterica serovar Typhi
gcccggcgccagcu

SEQ ID NO: 1677921 - RNA, 21 nt, Salmonella enterica enterica serovar Typhi
gcccggcguucucccgggccg

SEQ ID NO: 1677922 - RNA, 15 nt, Salmonella enterica enterica serovar Typhi
gcccggcguugaaau

SEQ ID NO: 1677923 - RNA, 14 nt, Salmonella enterica enterica serovar Typhi
gcccggcaggcugg

SEQ ID NO: 1677924 - RNA, 21 nt, Salmonella enterica enterica serovar Typhi
gcccggaugauuaucaucuau

SEQ ID NO: 1677925 - RNA, 17 nt, Salmonella enterica enterica serovar Typhi
gcccggcgcgacaccuu

SEQ ID NO: 1677926 - RNA, 17 nt, Salmonella enterica enterica serovar Typhi
gcccgaugagcuugcac

SEQ ID NO: 1677927 - RNA, 19 nt, Salmonella enterica enterica serovar Typhi
gcccgauagcguaaagaaa

SEQ ID NO: 1677928 - RNA, 13 nt, Salmonella enterica enterica serovar Typhi
gcccgauaaacaa

SEQ ID NO: 1677929 - RNA, 19 nt, Salmonella enterica enterica serovar Typhi
gcccgccgcgaccagcagc

SEQ ID NO: 1677930 - RNA, 18 nt, Salmonella enterica enterica serovar Typhi
gcccgccgccugaugcug

SEQ ID NO: 1677931 - RNA, 23 nt, Salmonella enterica enterica serovar Typhi
gccccgucagucgccagaaggca

SEQ ID NO: 1677932 - RNA, 14 nt, Salmonella enterica enterica serovar Typhi
gccccuaaggcagc

SEQ ID NO: 1677933 - RNA, 20 nt, Salmonella enterica enterica serovar Typhi
gccccggucaacgcgccgcc

SEQ ID NO: 1677934 - RNA, 17 nt, Salmonella enterica enterica serovar Typhi
gccccggucaacgcgcc

SEQ ID NO: 1677935 - RNA, 18 nt, Salmonella enterica enterica serovar Typhi
gccccggucaacgcgccg

SEQ ID NO: 1677936 - RNA, 17 nt, Salmonella enterica enterica serovar Typhi
gccccggugagcgccgc

SEQ ID NO: 1677937 - RNA, 22 nt, Salmonella enterica enterica serovar Typhi
gccccggugcuuucuccugcgg

SEQ ID NO: 1677938 - RNA, 16 nt, Salmonella enterica enterica serovar Typhi
gccccggugagcgccg

SEQ ID NO: 1677939 - RNA, 12 nt, Salmonella enterica enterica serovar Typhi
gccccggcggcg

SEQ ID NO: 1677940 - RNA, 20 nt, Salmonella enterica enterica serovar Typhi
gccccgccgcgcggccccau

SEQ ID NO: 1677941 - RNA, 15 nt, Salmonella enterica enterica serovar Typhi
gcccauugaaaucgc

SEQ ID NO: 1677942 - RNA, 12 nt, Salmonella enterica enterica serovar Typhi
gccccaucagca

SEQ ID NO: 1677943 - RNA, 16 nt, Salmonella enterica enterica serovar Typhi
gccccaucagcacaug

SEQ ID NO: 1677944 - RNA, 21 nt, Salmonella enterica enterica serovar Typhi
gcccaucgcgccaugauucau

SEQ ID NO: 1677945 - RNA, 15 nt, Salmonella enterica enterica serovar Typhi
gcccauucaacgggc

SEQ ID NO: 1677946 - RNA, 18 nt, Salmonella enterica enterica serovar Typhi
gcccauuccgccaacggu

SEQ ID NO: 1677947 - RNA, 16 nt, Salmonella enterica enterica serovar Typhi
gccccauguggccagc

SEQ ID NO: 1677948 - RNA, 17 nt, Salmonella enterica enterica serovar Typhi
gccccauguggccagcg

SEQ ID NO: 1677949 - RNA, 16 nt, Salmonella enterica enterica serovar Typhi
gcccccggccauagcg

SEQ ID NO: 1677950 - RNA, 20 nt, Salmonella enterica enterica serovar Typhi
gcccacgcaaaauggccugc

SEQ ID NO: 1677951 - RNA, 13 nt, Salmonella enterica enterica serovar Typhi
gcccacgcccaga

SEQ ID NO: 1677952 - RNA, 15 nt, Salmonella enterica enterica serovar Typhi
gcccacgcccagagc

SEQ ID NO: 1677953 - RNA, 18 nt, Salmonella enterica enterica serovar Typhi
gcccaccugaaaaagggu

SEQ ID NO: 1677954 - RNA, 16 nt, Salmonella enterica enterica serovar Typhi
gcccacucauccagca

SEQ ID NO: 1677955 - RNA, 14 nt, Salmonella enterica enterica serovar Typhi
gcccagaacggcag

SEQ ID NO: 1677956 - RNA, 19 nt, Salmonella enterica enterica serovar Typhi
gcccacggaugaucuucau

SEQ ID NO: 1677957 - RNA, 14 nt, Salmonella enterica enterica serovar Typhi
gcccacaggcaggg

SEQ ID NO: 1677958 - RNA, 15 nt, Salmonella enterica enterica serovar Typhi
gcccaccaucagacc

SEQ ID NO: 1677959 - RNA, 22 nt, Salmonella enterica enterica serovar Typhi
gcccaccggagcggcguccgcc

SEQ ID NO: 1677960 - RNA, 18 nt, Salmonella enterica enterica serovar Typhi
gcccaccgcgcgcgcggc

SEQ ID NO: 1677961 - RNA, 23 nt, Salmonella enterica enterica serovar Typhi
gcccaccggagcggcguccgcca

SEQ ID NO: 1677962 - RNA, 23 nt, Salmonella enterica enterica serovar Typhi
gcccaggcggguagucccaggau

SEQ ID NO: 1677963 - RNA, 12 nt, Salmonella enterica enterica serovar Typhi
gcccagcuuagu

SEQ ID NO: 1677964 - RNA, 20 nt, Salmonella enterica enterica serovar Typhi
gcccagcuaaaccacggaau

SEQ ID NO: 1677965 - RNA, 21 nt, Salmonella enterica enterica serovar Typhi
gcccagcauauuaacagugag

SEQ ID NO: 1677966 - RNA, 13 nt, Salmonella enterica enterica serovar Typhi
gcccagcauuacu

SEQ ID NO: 1677967 - RNA, 21 nt, Salmonella enterica enterica serovar Typhi
gcccagacaaagggcacaccg

SEQ ID NO: 1677968 - RNA, 16 nt, Salmonella enterica enterica serovar Typhi
gcccauccagagcagu

SEQ ID NO: 1677969 - RNA, 11 nt, Salmonella enterica enterica serovar Typhi
gcccauacugg

SEQ ID NO: 1677970 - RNA, 14 nt, Salmonella enterica enterica serovar Typhi
gcccaucagcgcca

SEQ ID NO: 1677971 - RNA, 18 nt, Salmonella enterica enterica serovar Typhi
gcccaucagcgccagccc

SEQ ID NO: 1677972 - RNA, 20 nt, Salmonella enterica enterica serovar Typhi
gcccaucagcgccagcccug

SEQ ID NO: 1677973 - RNA, 16 nt, Salmonella enterica enterica serovar Typhi
gcccaucgcgccauga

SEQ ID NO: 1677974 - RNA, 13 nt, Salmonella enterica enterica serovar Typhi
gcccauccgucag

SEQ ID NO: 1677975 - RNA, 14 nt, Salmonella enterica enterica serovar Typhi
gcccaucgccacag

SEQ ID NO: 1677976 - RNA, 15 nt, Salmonella enterica enterica serovar Typhi
gcccaucgccacagc

SEQ ID NO: 1677977 - RNA, 13 nt, Salmonella enterica enterica serovar Typhi
gcccauaaagaaa

SEQ ID NO: 1677978 - RNA, 21 nt, Salmonella enterica enterica serovar Typhi
gcccagguuagcagccacaca

SEQ ID NO: 1677979 - RNA, 20 nt, Salmonella enterica enterica serovar Typhi
gcccaucagcaucccaccgg

SEQ ID NO: 1677980 - RNA, 19 nt, Salmonella enterica enterica serovar Typhi
gcccauaccacaacagaau

SEQ ID NO: 1677981 - RNA, 16 nt, Salmonella enterica enterica serovar Typhi
gccaugcucauccaac

SEQ ID NO: 1677982 - RNA, 19 nt, Salmonella enterica enterica serovar Typhi
gccaugcucauccaacugc

SEQ ID NO: 1677983 - RNA, 22 nt, Salmonella enterica enterica serovar Typhi
gccaugcucauccaacugcgcc

SEQ ID NO: 1677984 - RNA, 21 nt, Salmonella enterica enterica serovar Typhi
gccaugcugugugaccagcag

SEQ ID NO: 1677985 - RNA, 20 nt, Salmonella enterica enterica serovar Typhi
gccauguuaauaccagcgcc

SEQ ID NO: 1677986 - RNA, 13 nt, Salmonella enterica enterica serovar Typhi
gccauuaaccaga

SEQ ID NO: 1677987 - RNA, 17 nt, Salmonella enterica enterica serovar Typhi
gccauuauuguguucuc

SEQ ID NO: 1677988 - RNA, 13 nt, Salmonella enterica enterica serovar Typhi
gccauuauuuauu

SEQ ID NO: 1677989 - RNA, 14 nt, Salmonella enterica enterica serovar Typhi
gccauuaucaccau

SEQ ID NO: 1677990 - RNA, 22 nt, Salmonella enterica enterica serovar Typhi
gccauuaucaccauucccagcg

SEQ ID NO: 1677991 - RNA, 16 nt, Salmonella enterica enterica serovar Typhi
gccauuaugcaggccg

SEQ ID NO: 1677992 - RNA, 18 nt, Salmonella enterica enterica serovar Typhi
gccaugccuuugacucug

SEQ ID NO: 1677993 - RNA, 15 nt, Salmonella enterica enterica serovar Typhi
gccaucuuuuuucac

SEQ ID NO: 1677994 - RNA, 14 nt, Salmonella enterica enterica serovar Typhi
gccaugccaucggc

SEQ ID NO: 1677995 - RNA, 14 nt, Salmonella enterica enterica serovar Typhi
gccaugaaaaaaac

SEQ ID NO: 1677996 - RNA, 15 nt, Salmonella enterica enterica serovar Typhi
gccaucuuccucaca

SEQ ID NO: 1677997 - RNA, 19 nt, Salmonella enterica enterica serovar Typhi
gccaucuuuacccugagcc

SEQ ID NO: 1677998 - RNA, 19 nt, Salmonella enterica enterica serovar Typhi
gcccaacagcaauguuuca

SEQ ID NO: 1677999 - RNA, 20 nt, Salmonella enterica enterica serovar Typhi
gcccaaugcuuagucagccu

SEQ ID NO: 1678000 - RNA, 15 nt, Salmonella enterica enterica serovar Typhi
gcccaaugcccccau

SEQ ID NO: 1678001 - RNA, 19 nt, Salmonella enterica enterica serovar Typhi
gccauugcugucgacaaua

SEQ ID NO: 1678002 - RNA, 21 nt, Salmonella enterica enterica serovar Typhi
gccauugcuaggaacagugac

SEQ ID NO: 1678003 - RNA, 16 nt, Salmonella enterica enterica serovar Typhi
gccauucacgcugggu

SEQ ID NO: 1678004 - RNA, 21 nt, Salmonella enterica enterica serovar Typhi
gccauugccaggacugacgga

SEQ ID NO: 1678005 - RNA, 20 nt, Salmonella enterica enterica serovar Typhi
gccauuucaauaauauguuc

SEQ ID NO: 1678006 - RNA, 20 nt, Salmonella enterica enterica serovar Typhi
gcccaaauaaaagccgccgu

SEQ ID NO: 1678007 - RNA, 16 nt, Salmonella enterica enterica serovar Typhi
gcccaaauaguccagc

SEQ ID NO: 1678008 - RNA, 16 nt, Salmonella enterica enterica serovar Typhi
gccaggccgcggcugu

SEQ ID NO: 1678009 - RNA, 13 nt, Salmonella enterica enterica serovar Typhi
gccauauugcugu

SEQ ID NO: 1678010 - RNA, 19 nt, Salmonella enterica enterica serovar Typhi
gccauauuuuuucaggaag

SEQ ID NO: 1678011 - RNA, 20 nt, Salmonella enterica enterica serovar Typhi
gccauauuguucaguuucaa

SEQ ID NO: 1678012 - RNA, 18 nt, Salmonella enterica enterica serovar Typhi
gccauauuuaccuuuucc

SEQ ID NO: 1678013 - RNA, 20 nt, Salmonella enterica enterica serovar Typhi
gccauauuaugcuggccugc

SEQ ID NO: 1678014 - RNA, 21 nt, Salmonella enterica enterica serovar Typhi
gccauauggcauucgcagagg

SEQ ID NO: 1678015 - RNA, 15 nt, Salmonella enterica enterica serovar Typhi
gccauauguuccacc

SEQ ID NO: 1678016 - RNA, 18 nt, Salmonella enterica enterica serovar Typhi
gccauaucggcacugcuu

SEQ ID NO: 1678017 - RNA, 21 nt, Salmonella enterica enterica serovar Typhi
gccauaucaccgcugacugaa

SEQ ID NO: 1678018 - RNA, 14 nt, Salmonella enterica enterica serovar Typhi
gccauauacgccac

SEQ ID NO: 1678019 - RNA, 21 nt, Salmonella enterica enterica serovar Typhi
gccaucaugcccacaggcagg

SEQ ID NO: 1678020 - RNA, 14 nt, Salmonella enterica enterica serovar Typhi
gccaucaugcccac

SEQ ID NO: 1678021 - RNA, 18 nt, Salmonella enterica enterica serovar Typhi
gccauccugaguauaaaa

SEQ ID NO: 1678022 - RNA, 12 nt, Salmonella enterica enterica serovar Typhi
gccaucaggcag

SEQ ID NO: 1678023 - RNA, 19 nt, Salmonella enterica enterica serovar Typhi
gccaucaggcaugccaaac

SEQ ID NO: 1678024 - RNA, 15 nt, Salmonella enterica enterica serovar Typhi
gccaucuccggcagc

SEQ ID NO: 1678025 - RNA, 13 nt, Salmonella enterica enterica serovar Typhi
gccaucuccugcg

SEQ ID NO: 1678026 - RNA, 17 nt, Salmonella enterica enterica serovar Typhi
gccaucugugccagccc

SEQ ID NO: 1678027 - RNA, 17 nt, Salmonella enterica enterica serovar Typhi
gccaucuggccuggcga

SEQ ID NO: 1678028 - RNA, 15 nt, Salmonella enterica enterica serovar Typhi
gccaucgacagcgcc

SEQ ID NO: 1678029 - RNA, 22 nt, Salmonella enterica enterica serovar Typhi
gccaucgacagcgccauauaaa

SEQ ID NO: 1678030 - RNA, 23 nt, Salmonella enterica enterica serovar Typhi
gccauccugccgcaccagucggc

SEQ ID NO: 1678031 - RNA, 22 nt, Salmonella enterica enterica serovar Typhi
gccauccuguucaagcaauaau

SEQ ID NO: 1678032 - RNA, 13 nt, Salmonella enterica enterica serovar Typhi
gccgauacugccc

SEQ ID NO: 1678033 - RNA, 20 nt, Salmonella enterica enterica serovar Typhi
gccgauaguggucgccacgc

SEQ ID NO: 1678034 - RNA, 18 nt, Salmonella enterica enterica serovar Typhi
gccgauagcaucgcugau

SEQ ID NO: 1678035 - RNA, 16 nt, Salmonella enterica enterica serovar Typhi
gccgauauugccuuca

SEQ ID NO: 1678036 - RNA, 17 nt, Salmonella enterica enterica serovar Typhi
gccgauaaccagcgcgc

SEQ ID NO: 1678037 - RNA, 21 nt, Salmonella enterica enterica serovar Typhi
gccgauaaccagcgcgccgcc

SEQ ID NO: 1678038 - RNA, 22 nt, Salmonella enterica enterica serovar Typhi
gccgauaaccagcgcgccgcca

SEQ ID NO: 1678039 - RNA, 16 nt, Salmonella enterica enterica serovar Typhi
gccgagcaacagaaac

SEQ ID NO: 1678040 - RNA, 18 nt, Salmonella enterica enterica serovar Typhi
gccgagcauuuccgcagc

SEQ ID NO: 1678041 - RNA, 16 nt, Salmonella enterica enterica serovar Typhi
gccgcacgccugcggc

SEQ ID NO: 1678042 - RNA, 16 nt, Salmonella enterica enterica serovar Typhi
gccgcacuccccagaa

SEQ ID NO: 1678043 - RNA, 22 nt, Salmonella enterica enterica serovar Typhi
gccgcagaaaauggucugccag

SEQ ID NO: 1678044 - RNA, 14 nt, Salmonella enterica enterica serovar Typhi
gccgcaaacgccga

SEQ ID NO: 1678045 - RNA, 23 nt, Salmonella enterica enterica serovar Typhi
gccgcaaaugaccagaucaacau

SEQ ID NO: 1678046 - RNA, 17 nt, Salmonella enterica enterica serovar Typhi
gccgcaaacagcacgcc

SEQ ID NO: 1678047 - RNA, 21 nt, Salmonella enterica enterica serovar Typhi
gccgcaaacgccgaagccagc

SEQ ID NO: 1678048 - RNA, 12 nt, Salmonella enterica enterica serovar Typhi
gccgcaaaagcc

SEQ ID NO: 1678049 - RNA, 20 nt, Salmonella enterica enterica serovar Typhi
gccgaugaaagagcgcgcgc

SEQ ID NO: 1678050 - RNA, 18 nt, Salmonella enterica enterica serovar Typhi
gccgcauccuguuuuuuc

SEQ ID NO: 1678051 - RNA, 12 nt, Salmonella enterica enterica serovar Typhi
gccgccagaauc

SEQ ID NO: 1678052 - RNA, 14 nt, Salmonella enterica enterica serovar Typhi
gccgcagcccgccc

SEQ ID NO: 1678053 - RNA, 18 nt, Salmonella enterica enterica serovar Typhi
gccgcagccgcucagggu

SEQ ID NO: 1678054 - RNA, 13 nt, Salmonella enterica enterica serovar Typhi
gccgcauccggca

SEQ ID NO: 1678055 - RNA, 18 nt, Salmonella enterica enterica serovar Typhi
gccgaaagcgaucacauu

SEQ ID NO: 1678056 - RNA, 18 nt, Salmonella enterica enterica serovar Typhi
gcccuugccgcuuccagu

SEQ ID NO: 1678057 - RNA, 19 nt, Salmonella enterica enterica serovar Typhi
gccgaacaacacggcggcc

SEQ ID NO: 1678058 - RNA, 12 nt, Salmonella enterica enterica serovar Typhi
gccgaacagacg

SEQ ID NO: 1678059 - RNA, 21 nt, Salmonella enterica enterica serovar Typhi
gcccuugaucggguuuuccug

SEQ ID NO: 1678060 - RNA, 13 nt, Salmonella enterica enterica serovar Typhi
gcccugugccgcu

SEQ ID NO: 1678061 - RNA, 18 nt, Salmonella enterica enterica serovar Typhi
gcccugugccgcuggugc

SEQ ID NO: 1678062 - RNA, 14 nt, Salmonella enterica enterica serovar Typhi
gcccuguccuccau

SEQ ID NO: 1678063 - RNA, 18 nt, Salmonella enterica enterica serovar Typhi
gcccuggugagcuccagc

SEQ ID NO: 1678064 - RNA, 18 nt, Salmonella enterica enterica serovar Typhi
gcccugccggaaaaugcg

SEQ ID NO: 1678065 - RNA, 20 nt, Salmonella enterica enterica serovar Typhi
gcccugcgccagcauggcgu

SEQ ID NO: 1678066 - RNA, 17 nt, Salmonella enterica enterica serovar Typhi
gcccugcggacaggcga

SEQ ID NO: 1678067 - RNA, 19 nt, Salmonella enterica enterica serovar Typhi
gcccugcggaaccgcccau

SEQ ID NO: 1678068 - RNA, 16 nt, Salmonella enterica enterica serovar Typhi
gcccugcuguuccagu

SEQ ID NO: 1678069 - RNA, 14 nt, Salmonella enterica enterica serovar Typhi
gcccugcuggcgca

SEQ ID NO: 1678070 - RNA, 20 nt, Salmonella enterica enterica serovar Typhi
gcccuggguugcccaaaugc

SEQ ID NO: 1678071 - RNA, 22 nt, Salmonella enterica enterica serovar Typhi
gccgaccgccaggucggcuuuu

SEQ ID NO: 1678072 - RNA, 14 nt, Salmonella enterica enterica serovar Typhi
gccgaccauccaga

SEQ ID NO: 1678073 - RNA, 21 nt, Salmonella enterica enterica serovar Typhi
gccgacccgcaucgccgcggc

SEQ ID NO: 1678074 - RNA, 22 nt, Salmonella enterica enterica serovar Typhi
gccgaccauuggcaccaccagg

SEQ ID NO: 1678075 - RNA, 22 nt, Salmonella enterica enterica serovar Typhi
gccgacccaccugacuguucac

SEQ ID NO: 1678076 - RNA, 16 nt, Salmonella enterica enterica serovar Typhi
gccgaauggcgggccu

SEQ ID NO: 1678077 - RNA, 14 nt, Salmonella enterica enterica serovar Typhi
gccgacaaccagcg

SEQ ID NO: 1678078 - RNA, 17 nt, Salmonella enterica enterica serovar Typhi
gccgaccaccauccggc

SEQ ID NO: 1678079 - RNA, 22 nt, Salmonella enterica enterica serovar Typhi
gccgaccacuucaacgccgcgc

SEQ ID NO: 1678080 - RNA, 16 nt, Salmonella enterica enterica serovar Typhi
gccgaacucuuccacc

SEQ ID NO: 1678081 - RNA, 18 nt, Salmonella enterica enterica serovar Typhi
gccgcugucgccagaaug

SEQ ID NO: 1678082 - RNA, 17 nt, Salmonella enterica enterica serovar Typhi
gccgcuggcgaccagcc

SEQ ID NO: 1678083 - RNA, 13 nt, Salmonella enterica enterica serovar Typhi
gccgcuggcuggc

SEQ ID NO: 1678084 - RNA, 23 nt, Salmonella enterica enterica serovar Typhi
gccgcucucuucgugacccgcca

SEQ ID NO: 1678085 - RNA, 23 nt, Salmonella enterica enterica serovar Typhi
gccgcuccggguuuucaauaauc

SEQ ID NO: 1678086 - RNA, 14 nt, Salmonella enterica enterica serovar Typhi
gccgcucacaaccg

SEQ ID NO: 1678087 - RNA, 14 nt, Salmonella enterica enterica serovar Typhi
gccgcuccagggau

SEQ ID NO: 1678088 - RNA, 14 nt, Salmonella enterica enterica serovar Typhi
gccgcucccgcaug

SEQ ID NO: 1678089 - RNA, 18 nt, Salmonella enterica enterica serovar Typhi
gccgcuagcugcagcgcu

SEQ ID NO: 1678090 - RNA, 15 nt, Salmonella enterica enterica serovar Typhi
gccgcuaucugcucc

SEQ ID NO: 1678091 - RNA, 19 nt, Salmonella enterica enterica serovar Typhi
gccgcuaugcaauuguucc

SEQ ID NO: 1678092 - RNA, 21 nt, Salmonella enterica enterica serovar Typhi
gccgcuaucgaccagcaccug

SEQ ID NO: 1678093 - RNA, 22 nt, Salmonella enterica enterica serovar Typhi
gccgcuaucgaccagcaccugc

SEQ ID NO: 1678094 - RNA, 16 nt, Salmonella enterica enterica serovar Typhi
gccgcguuucucgccg

SEQ ID NO: 1678095 - RNA, 16 nt, Salmonella enterica enterica serovar Typhi
gccgcguuuugccgcu

SEQ ID NO: 1678096 - RNA, 13 nt, Salmonella enterica enterica serovar Typhi
gccgcgugcucgc

SEQ ID NO: 1678097 - RNA, 17 nt, Salmonella enterica enterica serovar Typhi
gccgcgugcucgcggcg

SEQ ID NO: 1678098 - RNA, 18 nt, Salmonella enterica enterica serovar Typhi
gccgcgucccgaccagga

SEQ ID NO: 1678099 - RNA, 23 nt, Salmonella enterica enterica serovar Typhi
gccgcguaaucuucgcggcugcc

SEQ ID NO: 1678100 - RNA, 15 nt, Salmonella enterica enterica serovar Typhi
gccgcggucgagcau

SEQ ID NO: 1678101 - RNA, 19 nt, Salmonella enterica enterica serovar Typhi
gccgcgcuuucaguaauaa

SEQ ID NO: 1678102 - RNA, 21 nt, Salmonella enterica enterica serovar Typhi
gccgcgggaaauaccaaauau

SEQ ID NO: 1678103 - RNA, 15 nt, Salmonella enterica enterica serovar Typhi
gccgcccgccugagc

SEQ ID NO: 1678104 - RNA, 23 nt, Salmonella enterica enterica serovar Typhi
gccgcccgcaugguaaacgcauc

SEQ ID NO: 1678105 - RNA, 13 nt, Salmonella enterica enterica serovar Typhi
gccgccagcaaua

SEQ ID NO: 1678106 - RNA, 14 nt, Salmonella enterica enterica serovar Typhi
gccgccagcaaacu

SEQ ID NO: 1678107 - RNA, 17 nt, Salmonella enterica enterica serovar Typhi
gccgccagcaccgccgc

SEQ ID NO: 1678108 - RNA, 21 nt, Salmonella enterica enterica serovar Typhi
aaagcuccggacgcaccagcc

SEQ ID NO: 1678109 - RNA, 12 nt, Salmonella enterica enterica serovar Typhi
gccgccgcagca

SEQ ID NO: 1678110 - RNA, 18 nt, Salmonella enterica enterica serovar Typhi
gccgccgcaccacugcug

SEQ ID NO: 1678111 - RNA, 17 nt, Salmonella enterica enterica serovar Typhi
aaagcugcgaucaaguu

SEQ ID NO: 1678112 - RNA, 19 nt, Salmonella enterica enterica serovar Typhi
gccgccgcaacgcgcacgg

SEQ ID NO: 1678113 - RNA, 15 nt, Salmonella enterica enterica serovar Typhi
aaagcugcaccagga

SEQ ID NO: 1678114 - RNA, 20 nt, Salmonella enterica enterica serovar Typhi
aaagcugcaccaggagcaaa

SEQ ID NO: 1678115 - RNA, 15 nt, Salmonella enterica enterica serovar Typhi
gccgccgcagcagau

SEQ ID NO: 1678116 - RNA, 17 nt, Salmonella enterica enterica serovar Typhi
gccgcgcccuaacaggc

SEQ ID NO: 1678117 - RNA, 18 nt, Salmonella enterica enterica serovar Typhi
gccgcgcccuaacaggcg

SEQ ID NO: 1678118 - RNA, 14 nt, Salmonella enterica enterica serovar Typhi
gccgcgcccugcgg

SEQ ID NO: 1678119 - RNA, 17 nt, Salmonella enterica enterica serovar Typhi
gccgcgccgacauagcu

SEQ ID NO: 1678120 - RNA, 17 nt, Salmonella enterica enterica serovar Typhi
gccgcgccggacuccag

SEQ ID NO: 1678121 - RNA, 21 nt, Salmonella enterica enterica serovar Typhi
gccgcgccggacuccagcaac

SEQ ID NO: 1678122 - RNA, 22 nt, Salmonella enterica enterica serovar Typhi
gccgcgcuaucaaaaugcaccg

SEQ ID NO: 1678123 - RNA, 20 nt, Salmonella enterica enterica serovar Typhi
gccgcgcgguauuucgcaac

SEQ ID NO: 1678124 - RNA, 13 nt, Salmonella enterica enterica serovar Typhi
gccgcgcuggaua

SEQ ID NO: 1678125 - RNA, 16 nt, Salmonella enterica enterica serovar Typhi
gccgccuuggcgaccu

SEQ ID NO: 1678126 - RNA, 13 nt, Salmonella enterica enterica serovar Typhi
gccgccuggccug

SEQ ID NO: 1678127 - RNA, 14 nt, Salmonella enterica enterica serovar Typhi
gccgcgaccagcag

SEQ ID NO: 1678128 - RNA, 23 nt, Salmonella enterica enterica serovar Typhi
gccgcgauacauugucgcagcgc

SEQ ID NO: 1678129 - RNA, 14 nt, Salmonella enterica enterica serovar Typhi
gccgcgaucgcggc

SEQ ID NO: 1678130 - RNA, 20 nt, Salmonella enterica enterica serovar Typhi
gccgccgugauaaauacgcu

SEQ ID NO: 1678131 - RNA, 16 nt, Salmonella enterica enterica serovar Typhi
gccgccguuuuauuug

SEQ ID NO: 1678132 - RNA, 14 nt, Salmonella enterica enterica serovar Typhi
gccagacgcgcagc

SEQ ID NO: 1678133 - RNA, 16 nt, Salmonella enterica enterica serovar Typhi
gccagacgccagccac

SEQ ID NO: 1678134 - RNA, 18 nt, Salmonella enterica enterica serovar Typhi
gccagaccgcuuaacucc

SEQ ID NO: 1678135 - RNA, 17 nt, Salmonella enterica enterica serovar Typhi
gccagacgggccaggcg

SEQ ID NO: 1678136 - RNA, 20 nt, Salmonella enterica enterica serovar Typhi
gccagacggcgcccagccug

SEQ ID NO: 1678137 - RNA, 13 nt, Salmonella enterica enterica serovar Typhi
gccagagcgcgcu

SEQ ID NO: 1678138 - RNA, 18 nt, Salmonella enterica enterica serovar Typhi
gccagacucgcucccuuc

SEQ ID NO: 1678139 - RNA, 19 nt, Salmonella enterica enterica serovar Typhi
gccagagagaugccgccgg

SEQ ID NO: 1678140 - RNA, 14 nt, Salmonella enterica enterica serovar Typhi
gccagagagcguuu

SEQ ID NO: 1678141 - RNA, 13 nt, Salmonella enterica enterica serovar Typhi
gccagacccgcgc

SEQ ID NO: 1678142 - RNA, 22 nt, Salmonella enterica enterica serovar Typhi
gccagacagcauuuuucacagu

SEQ ID NO: 1678143 - RNA, 18 nt, Salmonella enterica enterica serovar Typhi
gccagaaaaaaaagcgcc

SEQ ID NO: 1678144 - RNA, 22 nt, Salmonella enterica enterica serovar Typhi
gccagaagagaauggccagcac

SEQ ID NO: 1678145 - RNA, 16 nt, Salmonella enterica enterica serovar Typhi
gccacgcgccagccgu

SEQ ID NO: 1678146 - RNA, 20 nt, Salmonella enterica enterica serovar Typhi
gccacuucuuccagcggcag

SEQ ID NO: 1678147 - RNA, 20 nt, Salmonella enterica enterica serovar Typhi
gccacggagcauaauuuucc

SEQ ID NO: 1678148 - RNA, 19 nt, Salmonella enterica enterica serovar Typhi
gccagcaaugccgccgcca

SEQ ID NO: 1678149 - RNA, 14 nt, Salmonella enterica enterica serovar Typhi
gccagcaccagcag

SEQ ID NO: 1678150 - RNA, 16 nt, Salmonella enterica enterica serovar Typhi
gccagcaacccaccug

SEQ ID NO: 1678151 - RNA, 17 nt, Salmonella enterica enterica serovar Typhi
gccagcaaggcaagaaa

SEQ ID NO: 1678152 - RNA, 17 nt, Salmonella enterica enterica serovar Typhi
gccagcaauacccagaa

SEQ ID NO: 1678153 - RNA, 17 nt, Salmonella enterica enterica serovar Typhi
gccagcaccugauagug

SEQ ID NO: 1678154 - RNA, 16 nt, Salmonella enterica enterica serovar Typhi
gccagcaccagcauua

SEQ ID NO: 1678155 - RNA, 18 nt, Salmonella enterica enterica serovar Typhi
gccagauggauaaccugc

SEQ ID NO: 1678156 - RNA, 13 nt, Salmonella enterica enterica serovar Typhi
gccagcaaacugg

SEQ ID NO: 1678157 - RNA, 15 nt, Salmonella enterica enterica serovar Typhi
gccagauaaauagcg

SEQ ID NO: 1678158 - RNA, 19 nt, Salmonella enterica enterica serovar Typhi
gccagaggcagcacaucaa

SEQ ID NO: 1678159 - RNA, 16 nt, Salmonella enterica enterica serovar Typhi
gccagagcgcgcuggc

SEQ ID NO: 1678160 - RNA, 18 nt, Salmonella enterica enterica serovar Typhi
gccagaucgauacgccac

SEQ ID NO: 1678161 - RNA, 17 nt, Salmonella enterica enterica serovar Typhi
gccagauaaucgccgcc

SEQ ID NO: 1678162 - RNA, 15 nt, Salmonella enterica enterica serovar Typhi
gccaccagcacagcc

SEQ ID NO: 1678163 - RNA, 17 nt, Salmonella enterica enterica serovar Typhi
gccaccggauugccuuc

SEQ ID NO: 1678164 - RNA, 17 nt, Salmonella enterica enterica serovar Typhi
gccaccgcuauucuuca

SEQ ID NO: 1678165 - RNA, 17 nt, Salmonella enterica enterica serovar Typhi
gccaccgcuccgcgcau

SEQ ID NO: 1678166 - RNA, 22 nt, Salmonella enterica enterica serovar Typhi
gccaccaucgucgccagaccca

SEQ ID NO: 1678167 - RNA, 14 nt, Salmonella enterica enterica serovar Typhi
gccaccgccgccac

SEQ ID NO: 1678168 - RNA, 21 nt, Salmonella enterica enterica serovar Typhi
gccacgcagauaucuuccagc

SEQ ID NO: 1678169 - RNA, 16 nt, Salmonella enterica enterica serovar Typhi
gccacgcaagcagcac

SEQ ID NO: 1678170 - RNA, 11 nt, Salmonella enterica enterica serovar Typhi
gccacgccaau

SEQ ID NO: 1678171 - RNA, 17 nt, Salmonella enterica enterica serovar Typhi
gccacgccaccgggccg

SEQ ID NO: 1678172 - RNA, 22 nt, Salmonella enterica enterica serovar Typhi
gccacgccccuaaggcagcaag

SEQ ID NO: 1678173 - RNA, 22 nt, Salmonella enterica enterica serovar Typhi
gccacgcgaugcaaccccugac

SEQ ID NO: 1678174 - RNA, 22 nt, Salmonella enterica enterica serovar Typhi
gccacgccgcuccacagcaaau

SEQ ID NO: 1678175 - RNA, 13 nt, Salmonella enterica enterica serovar Typhi
gccacgccgccau

SEQ ID NO: 1678176 - RNA, 22 nt, Salmonella enterica enterica serovar Typhi
gccacgccgaggcauucagcca

SEQ ID NO: 1678177 - RNA, 14 nt, Salmonella enterica enterica serovar Typhi
gccacgccgccauc

SEQ ID NO: 1678178 - RNA, 17 nt, Salmonella enterica enterica serovar Typhi
gccaaagggagcagacu

SEQ ID NO: 1678179 - RNA, 20 nt, Salmonella enterica enterica serovar Typhi
gccaaauacgucgcacggau

SEQ ID NO: 1678180 - RNA, 18 nt, Salmonella enterica enterica serovar Typhi
gccaaaucuguucugucc

SEQ ID NO: 1678181 - RNA, 22 nt, Salmonella enterica enterica serovar Typhi
gccaaauagcgccagacagaua

SEQ ID NO: 1678182 - RNA, 11 nt, Salmonella enterica enterica serovar Typhi
gccaaauguau

SEQ ID NO: 1678183 - RNA, 14 nt, Salmonella enterica enterica serovar Typhi
gccacaacgccuga

SEQ ID NO: 1678184 - RNA, 17 nt, Salmonella enterica enterica serovar Typhi
gccacaauggcaggcag

SEQ ID NO: 1678185 - RNA, 14 nt, Salmonella enterica enterica serovar Typhi
gccacaauugccag

SEQ ID NO: 1678186 - RNA, 16 nt, Salmonella enterica enterica serovar Typhi
gccacaauugccagca

SEQ ID NO: 1678187 - RNA, 13 nt, Salmonella enterica enterica serovar Typhi
gccacaauauccg

SEQ ID NO: 1678188 - RNA, 14 nt, Salmonella enterica enterica serovar Typhi
gccacacccauagc

SEQ ID NO: 1678189 - RNA, 18 nt, Salmonella enterica enterica serovar Typhi
gccacaccacaugcgagc

SEQ ID NO: 1678190 - RNA, 16 nt, Salmonella enterica enterica serovar Typhi
gccaccagaucuucaa

SEQ ID NO: 1678191 - RNA, 17 nt, Salmonella enterica enterica serovar Typhi
gccaccacgccgagaaa

SEQ ID NO: 1678192 - RNA, 16 nt, Salmonella enterica enterica serovar Typhi
gccacaugcggcaggc

SEQ ID NO: 1678193 - RNA, 12 nt, Salmonella enterica enterica serovar Typhi
gccacauugacc

SEQ ID NO: 1678194 - RNA, 12 nt, Salmonella enterica enterica serovar Typhi
gccaccaaaaac

SEQ ID NO: 1678195 - RNA, 13 nt, Salmonella enterica enterica serovar Typhi
gccacaucgccag

SEQ ID NO: 1678196 - RNA, 12 nt, Salmonella enterica enterica serovar Typhi
gccacauacugc

SEQ ID NO: 1678197 - RNA, 15 nt, Salmonella enterica enterica serovar Typhi
gccacauacugcuuu

SEQ ID NO: 1678198 - RNA, 21 nt, Salmonella enterica enterica serovar Typhi
gccagccugaacaucuuccag

SEQ ID NO: 1678199 - RNA, 23 nt, Salmonella enterica enterica serovar Typhi
gccagccugugaucggagaaaua

SEQ ID NO: 1678200 - RNA, 19 nt, Salmonella enterica enterica serovar Typhi
gccagccggauacugcgcu

SEQ ID NO: 1678201 - RNA, 14 nt, Salmonella enterica enterica serovar Typhi
gccagccccagaaa

SEQ ID NO: 1678202 - RNA, 20 nt, Salmonella enterica enterica serovar Typhi
gccagccccugcggauuacg

SEQ ID NO: 1678203 - RNA, 21 nt, Salmonella enterica enterica serovar Typhi
gccagcccucuucuucuuccg

SEQ ID NO: 1678204 - RNA, 20 nt, Salmonella enterica enterica serovar Typhi
gccagccgcgccaucuccuc

SEQ ID NO: 1678205 - RNA, 14 nt, Salmonella enterica enterica serovar Typhi
gccagcgccuuagg

SEQ ID NO: 1678206 - RNA, 18 nt, Salmonella enterica enterica serovar Typhi
gccagcgccguuguccgu

SEQ ID NO: 1678207 - RNA, 16 nt, Salmonella enterica enterica serovar Typhi
gccagcgccgccgcuu

SEQ ID NO: 1678208 - RNA, 21 nt, Salmonella enterica enterica serovar Typhi
gccagcgaccaccgucccagu

SEQ ID NO: 1678209 - RNA, 15 nt, Salmonella enterica enterica serovar Typhi
gccagcgaaguaauc

SEQ ID NO: 1678210 - RNA, 12 nt, Salmonella enterica enterica serovar Typhi
gccagccuuccc

SEQ ID NO: 1678211 - RNA, 21 nt, Salmonella enterica enterica serovar Typhi
gccagcgauuccgucaggaac

SEQ ID NO: 1678212 - RNA, 19 nt, Salmonella enterica enterica serovar Typhi
gccagcgauggggcaagcu

SEQ ID NO: 1678213 - RNA, 14 nt, Salmonella enterica enterica serovar Typhi
gccagcgcauacuu

SEQ ID NO: 1678214 - RNA, 16 nt, Salmonella enterica enterica serovar Typhi
gccagcauuuccagcu

SEQ ID NO: 1678215 - RNA, 18 nt, Salmonella enterica enterica serovar Typhi
gccagcauuuccagcugg

SEQ ID NO: 1678216 - RNA, 16 nt, Salmonella enterica enterica serovar Typhi
gccagcaugguuaaaa

SEQ ID NO: 1678217 - RNA, 15 nt, Salmonella enterica enterica serovar Typhi
gccagcauacagcuu

SEQ ID NO: 1678218 - RNA, 23 nt, Salmonella enterica enterica serovar Typhi
gccagcauaugcacacgcagcug

SEQ ID NO: 1678219 - RNA, 21 nt, Salmonella enterica enterica serovar Typhi
gccagcaucaugggcucauca

SEQ ID NO: 1678220 - RNA, 13 nt, Salmonella enterica enterica serovar Typhi
gccagcauauaaa

SEQ ID NO: 1678221 - RNA, 13 nt, Salmonella enterica enterica serovar Typhi
gccagccauuaaa

SEQ ID NO: 1678222 - RNA, 19 nt, Salmonella enterica enterica serovar Typhi
gccagccagucgccaggca

SEQ ID NO: 1678223 - RNA, 16 nt, Salmonella enterica enterica serovar Typhi
gccagccauccccaua

SEQ ID NO: 1678224 - RNA, 18 nt, Salmonella enterica enterica serovar Typhi
gccagccaaauagcgcca

SEQ ID NO: 1678225 - RNA, 17 nt, Salmonella enterica enterica serovar Typhi
gccagccagcgccacca

SEQ ID NO: 1678226 - RNA, 19 nt, Salmonella enterica enterica serovar Typhi
gccagcagcgcaccugccc

SEQ ID NO: 1678227 - RNA, 18 nt, Salmonella enterica enterica serovar Typhi
gccagcagcgcaucaucc

SEQ ID NO: 1678228 - RNA, 16 nt, Salmonella enterica enterica serovar Typhi
gccagcagguuaaaca

SEQ ID NO: 1678229 - RNA, 19 nt, Salmonella enterica enterica serovar Typhi
gccagcagcucaacggcag

SEQ ID NO: 1678230 - RNA, 16 nt, Salmonella enterica enterica serovar Typhi
gccagcucuuuucugg

SEQ ID NO: 1678231 - RNA, 16 nt, Salmonella enterica enterica serovar Typhi
gccagcuuaaaucgcg

SEQ ID NO: 1678232 - RNA, 16 nt, Salmonella enterica enterica serovar Typhi
gccagcuucgcugcgc

SEQ ID NO: 1678233 - RNA, 20 nt, Salmonella enterica enterica serovar Typhi
gccaggaaccgcggucggca

SEQ ID NO: 1678234 - RNA, 17 nt, Salmonella enterica enterica serovar Typhi
gccaggaauggcuacug

SEQ ID NO: 1678235 - RNA, 15 nt, Salmonella enterica enterica serovar Typhi
gccaggaacgagcug

SEQ ID NO: 1678236 - RNA, 18 nt, Salmonella enterica enterica serovar Typhi
gccagcuuucggcgagcu

SEQ ID NO: 1678237 - RNA, 22 nt, Salmonella enterica enterica serovar Typhi
gccaggccguugugucccugga

SEQ ID NO: 1678238 - RNA, 19 nt, Salmonella enterica enterica serovar Typhi
gccaggccagauggcuuua

SEQ ID NO: 1678239 - RNA, 16 nt, Salmonella enterica enterica serovar Typhi
gccaggccauugcuga

SEQ ID NO: 1678240 - RNA, 13 nt, Salmonella enterica enterica serovar Typhi
gccaggcccagcc

SEQ ID NO: 1678241 - RNA, 16 nt, Salmonella enterica enterica serovar Typhi
gccaggcccaugauca

SEQ ID NO: 1678242 - RNA, 18 nt, Salmonella enterica enterica serovar Typhi
gccaggcaaucagcagcc

SEQ ID NO: 1678243 - RNA, 16 nt, Salmonella enterica enterica serovar Typhi
gccaggcaaucagcag

SEQ ID NO: 1678244 - RNA, 21 nt, Salmonella enterica enterica serovar Typhi
gccaggacugacggaagagcu

SEQ ID NO: 1678245 - RNA, 17 nt, Salmonella enterica enterica serovar Typhi
gccaggaucgccgccgc

SEQ ID NO: 1678246 - RNA, 18 nt, Salmonella enterica enterica serovar Typhi
gccagcgugacccagaca

SEQ ID NO: 1678247 - RNA, 20 nt, Salmonella enterica enterica serovar Typhi
gccagcgucucagcaggcgg

SEQ ID NO: 1678248 - RNA, 19 nt, Salmonella enterica enterica serovar Typhi
gccagcguggaugaacuca

SEQ ID NO: 1678249 - RNA, 18 nt, Salmonella enterica enterica serovar Typhi
gccagcgucucagcaggc

SEQ ID NO: 1678250 - RNA, 13 nt, Salmonella enterica enterica serovar Typhi
gccagcguauuuu

SEQ ID NO: 1678251 - RNA, 13 nt, Salmonella enterica enterica serovar Typhi
gccagcgggcgca

SEQ ID NO: 1678252 - RNA, 17 nt, Salmonella enterica enterica serovar Typhi
gccagcuccugcgggcu

SEQ ID NO: 1678253 - RNA, 16 nt, Salmonella enterica enterica serovar Typhi
gccagcguugaccagc

SEQ ID NO: 1678254 - RNA, 19 nt, Salmonella enterica enterica serovar Typhi
gccagcguuagcacauugg

SEQ ID NO: 1678255 - RNA, 16 nt, Salmonella enterica enterica serovar Typhi
gccagcuaauuuuacu

SEQ ID NO: 1678256 - RNA, 18 nt, Salmonella enterica enterica serovar Typhi
gccagcucaugcgcggcg

SEQ ID NO: 1678257 - RNA, 23 nt, Salmonella enterica enterica serovar Typhi
gccagcucaugcaagacaucuaa

SEQ ID NO: 1678258 - RNA, 20 nt, Salmonella enterica enterica serovar Typhi
gccagcuacgacaagcuguu

SEQ ID NO: 1678259 - RNA, 15 nt, Salmonella enterica enterica serovar Typhi
gccagcucaaaugac

SEQ ID NO: 1678260 - RNA, 22 nt, Salmonella enterica enterica serovar Typhi
gccagcgcugcauuugcugccg

SEQ ID NO: 1678261 - RNA, 18 nt, Salmonella enterica enterica serovar Typhi
gccagcgcugagaugacc

SEQ ID NO: 1678262 - RNA, 14 nt, Salmonella enterica enterica serovar Typhi
gccagcggccagcc

SEQ ID NO: 1678263 - RNA, 21 nt, Salmonella enterica enterica serovar Typhi
gccagcggcguuuuuuccugc

SEQ ID NO: 1678264 - RNA, 19 nt, Salmonella enterica enterica serovar Typhi
gccagcggcugcuccccca

SEQ ID NO: 1678265 - RNA, 24 nt, Salmonella enterica enterica serovar Typhi
gccagcgcuacccgcugacgcugc

SEQ ID NO: 1678266 - RNA, 14 nt, Salmonella enterica enterica serovar Typhi
gccagcgcgggcga

SEQ ID NO: 1678267 - RNA, 16 nt, Salmonella enterica enterica serovar Typhi
gcauuuucaaugucgc

SEQ ID NO: 1678268 - RNA, 13 nt, Salmonella enterica enterica serovar Typhi
gccaaacugcugg

SEQ ID NO: 1678269 - RNA, 17 nt, Salmonella enterica enterica serovar Typhi
gcauuuucuuauuuauu

SEQ ID NO: 1678270 - RNA, 13 nt, Salmonella enterica enterica serovar Typhi
gccaaagauuagc

SEQ ID NO: 1678271 - RNA, 20 nt, Salmonella enterica enterica serovar Typhi
gccaaagaaacgcugaucua

SEQ ID NO: 1678272 - RNA, 13 nt, Salmonella enterica enterica serovar Typhi
gcauuuccagcug

SEQ ID NO: 1678273 - RNA, 24 nt, Salmonella enterica enterica serovar Typhi
gcauuucaaagcguucugaacugu

SEQ ID NO: 1678274 - RNA, 13 nt, Salmonella enterica enterica serovar Typhi
gcauuuaucaauc

SEQ ID NO: 1678275 - RNA, 18 nt, Salmonella enterica enterica serovar Typhi
gcauuucaagcaggcgau

SEQ ID NO: 1678276 - RNA, 20 nt, Salmonella enterica enterica serovar Typhi
gcauuucgccaguuccauca

SEQ ID NO: 1678277 - RNA, 22 nt, Salmonella enterica enterica serovar Typhi
gcauuugcgucguuaacugcau

SEQ ID NO: 1678278 - RNA, 18 nt, Salmonella enterica enterica serovar Typhi
gcauuugcuuucaucaau

SEQ ID NO: 1678279 - RNA, 14 nt, Salmonella enterica enterica serovar Typhi
gcauuacgcuggcc

SEQ ID NO: 1678280 - RNA, 14 nt, Salmonella enterica enterica serovar Typhi
gcauucgcuccuca

SEQ ID NO: 1678281 - RNA, 16 nt, Salmonella enterica enterica serovar Typhi
gcauucgcuccucagc

SEQ ID NO: 1678282 - RNA, 17 nt, Salmonella enterica enterica serovar Typhi
gcauucgaauccuccug

SEQ ID NO: 1678283 - RNA, 16 nt, Salmonella enterica enterica serovar Typhi
gcauugcucaacugga

SEQ ID NO: 1678284 - RNA, 14 nt, Salmonella enterica enterica serovar Typhi
gcauucuaaauccu

SEQ ID NO: 1678285 - RNA, 19 nt, Salmonella enterica enterica serovar Typhi
gcaugauggcgaacagccc

SEQ ID NO: 1678286 - RNA, 13 nt, Salmonella enterica enterica serovar Typhi
gcaucuuuguucu

SEQ ID NO: 1678287 - RNA, 16 nt, Salmonella enterica enterica serovar Typhi
gcaugcaucucuucaa

SEQ ID NO: 1678288 - RNA, 19 nt, Salmonella enterica enterica serovar Typhi
gcaucugggcugagaaaaa

SEQ ID NO: 1678289 - RNA, 21 nt, Salmonella enterica enterica serovar Typhi
gcaucugggcugagaaaaauu

SEQ ID NO: 1678290 - RNA, 12 nt, Salmonella enterica enterica serovar Typhi
gcaucuuauauu

SEQ ID NO: 1678291 - RNA, 17 nt, Salmonella enterica enterica serovar Typhi
gcaucuuacugaccggc

SEQ ID NO: 1678292 - RNA, 13 nt, Salmonella enterica enterica serovar Typhi
gcaucuucagaca

SEQ ID NO: 1678293 - RNA, 14 nt, Salmonella enterica enterica serovar Typhi
gcaucuuuaaccgc

SEQ ID NO: 1678294 - RNA, 14 nt, Salmonella enterica enterica serovar Typhi
gcauuaagcugaua

SEQ ID NO: 1678295 - RNA, 13 nt, Salmonella enterica enterica serovar Typhi
gcauuaauuucuu

SEQ ID NO: 1678296 - RNA, 14 nt, Salmonella enterica enterica serovar Typhi
gcauguaguaagcc

SEQ ID NO: 1678297 - RNA, 14 nt, Salmonella enterica enterica serovar Typhi
gcauggcaauuaaa

SEQ ID NO: 1678298 - RNA, 23 nt, Salmonella enterica enterica serovar Typhi
gcauggcagccccggcauccagu

SEQ ID NO: 1678299 - RNA, 15 nt, Salmonella enterica enterica serovar Typhi
gcauggagcaucagc

SEQ ID NO: 1678300 - RNA, 22 nt, Salmonella enterica enterica serovar Typhi
gcauggacuauggucugaaaga

SEQ ID NO: 1678301 - RNA, 12 nt, Salmonella enterica enterica serovar Typhi
gcauaagccuca

SEQ ID NO: 1678302 - RNA, 18 nt, Salmonella enterica enterica serovar Typhi
gcauaauaaagcagcggc

SEQ ID NO: 1678303 - RNA, 20 nt, Salmonella enterica enterica serovar Typhi
gcauaauuguggaaauaaga

SEQ ID NO: 1678304 - RNA, 13 nt, Salmonella enterica enterica serovar Typhi
gcauaauaugcaa

SEQ ID NO: 1678305 - RNA, 10 nt, Salmonella enterica enterica serovar Typhi
gcauaauaug

SEQ ID NO: 1678306 - RNA, 15 nt, Salmonella enterica enterica serovar Typhi
gcauaauauccagga

SEQ ID NO: 1678307 - RNA, 19 nt, Salmonella enterica enterica serovar Typhi
gcauaaugacguccaggcc

SEQ ID NO: 1678308 - RNA, 21 nt, Salmonella enterica enterica serovar Typhi
gcauagauaacgaugugacug

SEQ ID NO: 1678309 - RNA, 18 nt, Salmonella enterica enterica serovar Typhi
gcauagcgccuucaggca

SEQ ID NO: 1678310 - RNA, 18 nt, Salmonella enterica enterica serovar Typhi
gcauagcuguuccgcaac

SEQ ID NO: 1678311 - RNA, 16 nt, Salmonella enterica enterica serovar Typhi
gcaucaaauaccuuuu

SEQ ID NO: 1678312 - RNA, 13 nt, Salmonella enterica enterica serovar Typhi
gcaucaaauaccu

SEQ ID NO: 1678313 - RNA, 18 nt, Salmonella enterica enterica serovar Typhi
gcaucaaacuucguuacu

SEQ ID NO: 1678314 - RNA, 15 nt, Salmonella enterica enterica serovar Typhi
gcauauuucuaauga

SEQ ID NO: 1678315 - RNA, 22 nt, Salmonella enterica enterica serovar Typhi
gcauauucauaucgaagcccag

SEQ ID NO: 1678316 - RNA, 14 nt, Salmonella enterica enterica serovar Typhi
gcaucauccccacc

SEQ ID NO: 1678317 - RNA, 13 nt, Salmonella enterica enterica serovar Typhi
gcaucaacgccag

SEQ ID NO: 1678318 - RNA, 22 nt, Salmonella enterica enterica serovar Typhi
gcaucaagcugcuggcgagcag

SEQ ID NO: 1678319 - RNA, 22 nt, Salmonella enterica enterica serovar Typhi
gcaucguuugcaguuccgcaau

SEQ ID NO: 1678320 - RNA, 15 nt, Salmonella enterica enterica serovar Typhi
gcaucgauuccgccu

SEQ ID NO: 1678321 - RNA, 18 nt, Salmonella enterica enterica serovar Typhi
gcaucuaccgcauacuga

SEQ ID NO: 1678322 - RNA, 13 nt, Salmonella enterica enterica serovar Typhi
gcaucugcgcaac

SEQ ID NO: 1678323 - RNA, 19 nt, Salmonella enterica enterica serovar Typhi
gcaucugcgcaacuggaag

SEQ ID NO: 1678324 - RNA, 21 nt, Salmonella enterica enterica serovar Typhi
gcaucugaucuacaaucgucu

SEQ ID NO: 1678325 - RNA, 22 nt, Salmonella enterica enterica serovar Typhi
gcaucuacccguacauuauugc

SEQ ID NO: 1678326 - RNA, 20 nt, Salmonella enterica enterica serovar Typhi
gcaucgacauccgauuucau

SEQ ID NO: 1678327 - RNA, 13 nt, Salmonella enterica enterica serovar Typhi
gcaucgacgccag

SEQ ID NO: 1678328 - RNA, 18 nt, Salmonella enterica enterica serovar Typhi
gcauccgugaccugcuga

SEQ ID NO: 1678329 - RNA, 13 nt, Salmonella enterica enterica serovar Typhi
gcauccucuuucc

SEQ ID NO: 1678330 - RNA, 23 nt, Salmonella enterica enterica serovar Typhi
gcauccugcggguucaucgccac

SEQ ID NO: 1678331 - RNA, 17 nt, Salmonella enterica enterica serovar Typhi
gcaucaucucccaggcc

SEQ ID NO: 1678332 - RNA, 15 nt, Salmonella enterica enterica serovar Typhi
gcaucauucaucucg

SEQ ID NO: 1678333 - RNA, 13 nt, Salmonella enterica enterica serovar Typhi
gcauccagcucau

SEQ ID NO: 1678334 - RNA, 17 nt, Salmonella enterica enterica serovar Typhi
gcauccagacccacagc

SEQ ID NO: 1678335 - RNA, 21 nt, Salmonella enterica enterica serovar Typhi
gcauccagacccacagccggu

SEQ ID NO: 1678336 - RNA, 16 nt, Salmonella enterica enterica serovar Typhi
gcauccaccgcggagu

SEQ ID NO: 1678337 - RNA, 22 nt, Salmonella enterica enterica serovar Typhi
gcagcugcuguaugauuucacc

SEQ ID NO: 1678338 - RNA, 15 nt, Salmonella enterica enterica serovar Typhi
gcaacccuuuuucaa

SEQ ID NO: 1678339 - RNA, 19 nt, Salmonella enterica enterica serovar Typhi
gcaaccgacgggcgcuggu

SEQ ID NO: 1678340 - RNA, 19 nt, Salmonella enterica enterica serovar Typhi
gcagcguugcuuuguaugu

SEQ ID NO: 1678341 - RNA, 15 nt, Salmonella enterica enterica serovar Typhi
gcagcgucaucaggc

SEQ ID NO: 1678342 - RNA, 19 nt, Salmonella enterica enterica serovar Typhi
gcagcguauugagcuggau

SEQ ID NO: 1678343 - RNA, 14 nt, Salmonella enterica enterica serovar Typhi
gcagcuuauuccag

SEQ ID NO: 1678344 - RNA, 13 nt, Salmonella enterica enterica serovar Typhi
gcagcugggccug

SEQ ID NO: 1678345 - RNA, 16 nt, Salmonella enterica enterica serovar Typhi
gcagcugggccugcuc

SEQ ID NO: 1678346 - RNA, 20 nt, Salmonella enterica enterica serovar Typhi
gcagcugcuuaacuucugca

SEQ ID NO: 1678347 - RNA, 12 nt, Salmonella enterica enterica serovar Typhi
gcagcuuccagc

SEQ ID NO: 1678348 - RNA, 19 nt, Salmonella enterica enterica serovar Typhi
gcagcuucagcaucaucuc

SEQ ID NO: 1678349 - RNA, 22 nt, Salmonella enterica enterica serovar Typhi
gcagcuucgccgcguaaucuuc

SEQ ID NO: 1678350 - RNA, 14 nt, Salmonella enterica enterica serovar Typhi
gcaggaacagauac

SEQ ID NO: 1678351 - RNA, 15 nt, Salmonella enterica enterica serovar Typhi
gcaggaacggcagga

SEQ ID NO: 1678352 - RNA, 16 nt, Salmonella enterica enterica serovar Typhi
gcaggaaggaauuaug

SEQ ID NO: 1678353 - RNA, 24 nt, Salmonella enterica enterica serovar Typhi
gcaggaaggaauuaugcagacgcu

SEQ ID NO: 1678354 - RNA, 15 nt, Salmonella enterica enterica serovar Typhi
gcagcuuggcggcuu

SEQ ID NO: 1678355 - RNA, 19 nt, Salmonella enterica enterica serovar Typhi
gcaggaaauccagcagaau

SEQ ID NO: 1678356 - RNA, 19 nt, Salmonella enterica enterica serovar Typhi
gcaggagggagguucgccu

SEQ ID NO: 1678357 - RNA, 18 nt, Salmonella enterica enterica serovar Typhi
gcaggauccccaucccaa

SEQ ID NO: 1678358 - RNA, 20 nt, Salmonella enterica enterica serovar Typhi
gcaggagcggagagagcgcu

SEQ ID NO: 1678359 - RNA, 22 nt, Salmonella enterica enterica serovar Typhi
gcaggcgauagccccaguaaau

SEQ ID NO: 1678360 - RNA, 20 nt, Salmonella enterica enterica serovar Typhi
gcaggcuaacgcgccccagg

SEQ ID NO: 1678361 - RNA, 23 nt, Salmonella enterica enterica serovar Typhi
gcaggcucccuuauacaggcgca

SEQ ID NO: 1678362 - RNA, 23 nt, Salmonella enterica enterica serovar Typhi
gcaggcgcggcaaugccgcgcuu

SEQ ID NO: 1678363 - RNA, 17 nt, Salmonella enterica enterica serovar Typhi
gcaggcuggagagcaac

SEQ ID NO: 1678364 - RNA, 20 nt, Salmonella enterica enterica serovar Typhi
gcaguggcauguucccaugu

SEQ ID NO: 1678365 - RNA, 18 nt, Salmonella enterica enterica serovar Typhi
gcaguggcauguucccau

SEQ ID NO: 1678366 - RNA, 16 nt, Salmonella enterica enterica serovar Typhi
gcaguucccuacucuc

SEQ ID NO: 1678367 - RNA, 17 nt, Salmonella enterica enterica serovar Typhi
gcaguguaucgaagauc

SEQ ID NO: 1678368 - RNA, 17 nt, Salmonella enterica enterica serovar Typhi
gcauaaauuggcucaga

SEQ ID NO: 1678369 - RNA, 18 nt, Salmonella enterica enterica serovar Typhi
gcauaaccgcagcgcggc

SEQ ID NO: 1678370 - RNA, 19 nt, Salmonella enterica enterica serovar Typhi
gcauaaccgcgcguaaauc

SEQ ID NO: 1678371 - RNA, 23 nt, Salmonella enterica enterica serovar Typhi
gcauaaaugccuuauccggccug

SEQ ID NO: 1678372 - RNA, 15 nt, Salmonella enterica enterica serovar Typhi
gcauaaaaaaggcuc

SEQ ID NO: 1678373 - RNA, 19 nt, Salmonella enterica enterica serovar Typhi
gcauaaaaaaugagaaagg

SEQ ID NO: 1678374 - RNA, 17 nt, Salmonella enterica enterica serovar Typhi
gcauaaaaccgccgccc

SEQ ID NO: 1678375 - RNA, 14 nt, Salmonella enterica enterica serovar Typhi
gcaguuggcggagg

SEQ ID NO: 1678376 - RNA, 18 nt, Salmonella enterica enterica serovar Typhi
gcaguugggcgcgcgacu

SEQ ID NO: 1678377 - RNA, 15 nt, Salmonella enterica enterica serovar Typhi
gcaguuuaaaucaca

SEQ ID NO: 1678378 - RNA, 22 nt, Salmonella enterica enterica serovar Typhi
gcagucaaaacgacauaaccgg

SEQ ID NO: 1678379 - RNA, 17 nt, Salmonella enterica enterica serovar Typhi
gcaguauugcaccagga

SEQ ID NO: 1678380 - RNA, 14 nt, Salmonella enterica enterica serovar Typhi
gcaguauuaccgaa

SEQ ID NO: 1678381 - RNA, 19 nt, Salmonella enterica enterica serovar Typhi
gcaguaacgcacuuuucca

SEQ ID NO: 1678382 - RNA, 20 nt, Salmonella enterica enterica serovar Typhi
gcaggguauuugugcccgcg

SEQ ID NO: 1678383 - RNA, 20 nt, Salmonella enterica enterica serovar Typhi
gcaggggcucuaaaaaggaa

SEQ ID NO: 1678384 - RNA, 15 nt, Salmonella enterica enterica serovar Typhi
gcaggggcuccugcg

SEQ ID NO: 1678385 - RNA, 12 nt, Salmonella enterica enterica serovar Typhi
gcagggcugcug

SEQ ID NO: 1678386 - RNA, 21 nt, Salmonella enterica enterica serovar Typhi
gcagucacuuucagauuuuua

SEQ ID NO: 1678387 - RNA, 21 nt, Salmonella enterica enterica serovar Typhi
gcagugaguaacguuaauaca

SEQ ID NO: 1678388 - RNA, 15 nt, Salmonella enterica enterica serovar Typhi
gcagugacagaggaa

SEQ ID NO: 1678389 - RNA, 16 nt, Salmonella enterica enterica serovar Typhi
gcagugaccagcauca

SEQ ID NO: 1678390 - RNA, 13 nt, Salmonella enterica enterica serovar Typhi
gcgcuggaggcgg

SEQ ID NO: 1678391 - RNA, 13 nt, Salmonella enterica enterica serovar Typhi
gcgcugcgcggcg

SEQ ID NO: 1678392 - RNA, 18 nt, Salmonella enterica enterica serovar Typhi
gcgcugcgcuuacccagu

SEQ ID NO: 1678393 - RNA, 22 nt, Salmonella enterica enterica serovar Typhi
gcgcugcgcuuaccgggccuac

SEQ ID NO: 1678394 - RNA, 22 nt, Salmonella enterica enterica serovar Typhi
gcgcugccgucaaugccuggca

SEQ ID NO: 1678395 - RNA, 23 nt, Salmonella enterica enterica serovar Typhi
gcgcugccgucaaugccuggcag

SEQ ID NO: 1678396 - RNA, 18 nt, Salmonella enterica enterica serovar Typhi
gcgcugcauuugcugccg

SEQ ID NO: 1678397 - RNA, 22 nt, Salmonella enterica enterica serovar Typhi
gcgcggcggacaacgcuccagc

SEQ ID NO: 1678398 - RNA, 24 nt, Salmonella enterica enterica serovar Typhi
gcgcucgcucaucacaucgcgcag

SEQ ID NO: 1678399 - RNA, 23 nt, Salmonella enterica enterica serovar Typhi
gcgcucgcuuuuacucuuccugc

SEQ ID NO: 1678400 - RNA, 14 nt, Salmonella enterica enterica serovar Typhi
gcgcugaucgccac

SEQ ID NO: 1678401 - RNA, 17 nt, Salmonella enterica enterica serovar Typhi
gcgcucuaucgccgccc

SEQ ID NO: 1678402 - RNA, 20 nt, Salmonella enterica enterica serovar Typhi
gcggaagcgaauggcggcac

SEQ ID NO: 1678403 - RNA, 21 nt, Salmonella enterica enterica serovar Typhi
gcggaagccacguucuuccag

SEQ ID NO: 1678404 - RNA, 21 nt, Salmonella enterica enterica serovar Typhi
gcggaaaggacguucuucucc

SEQ ID NO: 1678405 - RNA, 24 nt, Salmonella enterica enterica serovar Typhi
gcgcuuuuggcggccagcguguca

SEQ ID NO: 1678406 - RNA, 14 nt, Salmonella enterica enterica serovar Typhi
gcggaaaaaagcag

SEQ ID NO: 1678407 - RNA, 19 nt, Salmonella enterica enterica serovar Typhi
gcgcuguuggcauccugcg

SEQ ID NO: 1678408 - RNA, 13 nt, Salmonella enterica enterica serovar Typhi
gcgcuguuguucc

SEQ ID NO: 1678409 - RNA, 22 nt, Salmonella enterica enterica serovar Typhi
gcgcuggguacguucggacugg

SEQ ID NO: 1678410 - RNA, 17 nt, Salmonella enterica enterica serovar Typhi
gcgcuggguacguucgg

SEQ ID NO: 1678411 - RNA, 17 nt, Salmonella enterica enterica serovar Typhi
gcgcugggccgggccug

SEQ ID NO: 1678412 - RNA, 14 nt, Salmonella enterica enterica serovar Typhi
gcgcugggccgggc

SEQ ID NO: 1678413 - RNA, 17 nt, Salmonella enterica enterica serovar Typhi
gcgcugucaccagcagc

SEQ ID NO: 1678414 - RNA, 23 nt, Salmonella enterica enterica serovar Typhi
gcgcuguauaaucccgcggcgga

SEQ ID NO: 1678415 - RNA, 15 nt, Salmonella enterica enterica serovar Typhi
gcgcugguggcgguc

SEQ ID NO: 1678416 - RNA, 18 nt, Salmonella enterica enterica serovar Typhi
gcgcuggugacaucgccg

SEQ ID NO: 1678417 - RNA, 14 nt, Salmonella enterica enterica serovar Typhi
gcgcuggcgagcga

SEQ ID NO: 1678418 - RNA, 14 nt, Salmonella enterica enterica serovar Typhi
gcgcuggcgcgucu

SEQ ID NO: 1678419 - RNA, 20 nt, Salmonella enterica enterica serovar Typhi
gcgcuggcgccgcaaaccag

SEQ ID NO: 1678420 - RNA, 15 nt, Salmonella enterica enterica serovar Typhi
gcgcuggcggcgacg

SEQ ID NO: 1678421 - RNA, 19 nt, Salmonella enterica enterica serovar Typhi
gcgcuggcugaaucccugu

SEQ ID NO: 1678422 - RNA, 12 nt, Salmonella enterica enterica serovar Typhi
gcgcuggcuggc

SEQ ID NO: 1678423 - RNA, 20 nt, Salmonella enterica enterica serovar Typhi
gcggcaaagauaaucugaau

SEQ ID NO: 1678424 - RNA, 16 nt, Salmonella enterica enterica serovar Typhi
gcggcaaagauaaucu

SEQ ID NO: 1678425 - RNA, 19 nt, Salmonella enterica enterica serovar Typhi
gcggcaaaaucuuuuucgc

SEQ ID NO: 1678426 - RNA, 12 nt, Salmonella enterica enterica serovar Typhi
gcggcagcuuca

SEQ ID NO: 1678427 - RNA, 16 nt, Salmonella enterica enterica serovar Typhi
gcggcagcucugccug

SEQ ID NO: 1678428 - RNA, 13 nt, Salmonella enterica enterica serovar Typhi
gcggcaggcaaaa

SEQ ID NO: 1678429 - RNA, 19 nt, Salmonella enterica enterica serovar Typhi
gcggaaucacgcauauccc

SEQ ID NO: 1678430 - RNA, 17 nt, Salmonella enterica enterica serovar Typhi
gcggaccagcgugcgcu

SEQ ID NO: 1678431 - RNA, 21 nt, Salmonella enterica enterica serovar Typhi
gcggaauccaucccccugccg

SEQ ID NO: 1678432 - RNA, 15 nt, Salmonella enterica enterica serovar Typhi
gcggaaguagagaac

SEQ ID NO: 1678433 - RNA, 23 nt, Salmonella enterica enterica serovar Typhi
gcggaagaggcgccuggcaccau

SEQ ID NO: 1678434 - RNA, 17 nt, Salmonella enterica enterica serovar Typhi
gcggauugauuuuucug

SEQ ID NO: 1678435 - RNA, 13 nt, Salmonella enterica enterica serovar Typhi
gcggauugccgcg

SEQ ID NO: 1678436 - RNA, 17 nt, Salmonella enterica enterica serovar Typhi
gcggcagggcagcgagc

SEQ ID NO: 1678437 - RNA, 20 nt, Salmonella enterica enterica serovar Typhi
gcggcagggcggucugguac

SEQ ID NO: 1678438 - RNA, 16 nt, Salmonella enterica enterica serovar Typhi
gcggcaucaggcauag

SEQ ID NO: 1678439 - RNA, 16 nt, Salmonella enterica enterica serovar Typhi
gcggcaugauccacca

SEQ ID NO: 1678440 - RNA, 17 nt, Salmonella enterica enterica serovar Typhi
gcggcauuaaagccgcc

SEQ ID NO: 1678441 - RNA, 20 nt, Salmonella enterica enterica serovar Typhi
gcggcccauucaacgggcga

SEQ ID NO: 1678442 - RNA, 11 nt, Salmonella enterica enterica serovar Typhi
gcggcccaaug

SEQ ID NO: 1678443 - RNA, 12 nt, Salmonella enterica enterica serovar Typhi
gcggccagcaug

SEQ ID NO: 1678444 - RNA, 23 nt, Salmonella enterica enterica serovar Typhi
gcggcccgugguuuuacugcaag

SEQ ID NO: 1678445 - RNA, 21 nt, Salmonella enterica enterica serovar Typhi
gcgggagauggcguggccaag

SEQ ID NO: 1678446 - RNA, 14 nt, Salmonella enterica enterica serovar Typhi
gcgggacugcugcu

SEQ ID NO: 1678447 - RNA, 19 nt, Salmonella enterica enterica serovar Typhi
gcggggauaaucagcagcg

SEQ ID NO: 1678448 - RNA, 17 nt, Salmonella enterica enterica serovar Typhi
gcggggauaaucagcag

SEQ ID NO: 1678449 - RNA, 23 nt, Salmonella enterica enterica serovar Typhi
gcgggcugccccagacgcccuuc

SEQ ID NO: 1678450 - RNA, 14 nt, Salmonella enterica enterica serovar Typhi
gcggggaacaccca

SEQ ID NO: 1678451 - RNA, 23 nt, Salmonella enterica enterica serovar Typhi
gcgggcguugcugcacgucgcgc

SEQ ID NO: 1678452 - RNA, 14 nt, Salmonella enterica enterica serovar Typhi
gcgggugaugacgc

SEQ ID NO: 1678453 - RNA, 19 nt, Salmonella enterica enterica serovar Typhi
gcgggugcgcagccccagc

SEQ ID NO: 1678454 - RNA, 16 nt, Salmonella enterica enterica serovar Typhi
gcgguaaggcaccggu

SEQ ID NO: 1678455 - RNA, 16 nt, Salmonella enterica enterica serovar Typhi
gcgguaagagagugag

SEQ ID NO: 1678456 - RNA, 22 nt, Salmonella enterica enterica serovar Typhi
gcggcgcgucuucccggcgcuc

SEQ ID NO: 1678457 - RNA, 19 nt, Salmonella enterica enterica serovar Typhi
gcggcgcuuugcuucucgc

SEQ ID NO: 1678458 - RNA, 22 nt, Salmonella enterica enterica serovar Typhi
gcggcggacaugguaauaacgc

SEQ ID NO: 1678459 - RNA, 14 nt, Salmonella enterica enterica serovar Typhi
gcggcgcgcccggc

SEQ ID NO: 1678460 - RNA, 16 nt, Salmonella enterica enterica serovar Typhi
gcggcgccaucaccau

SEQ ID NO: 1678461 - RNA, 14 nt, Salmonella enterica enterica serovar Typhi
gcggcgccaguacu

SEQ ID NO: 1678462 - RNA, 16 nt, Salmonella enterica enterica serovar Typhi
gcggcgugaccgccuu

SEQ ID NO: 1678463 - RNA, 16 nt, Salmonella enterica enterica serovar Typhi
gcggcguggggcgggc

SEQ ID NO: 1678464 - RNA, 16 nt, Salmonella enterica enterica serovar Typhi
gcggcguguggcugug

SEQ ID NO: 1678465 - RNA, 18 nt, Salmonella enterica enterica serovar Typhi
gcggcguaccgcgcgccc

SEQ ID NO: 1678466 - RNA, 23 nt, Salmonella enterica enterica serovar Typhi
gcggcucaccagcugacgcagca

SEQ ID NO: 1678467 - RNA, 17 nt, Salmonella enterica enterica serovar Typhi
gcggcggucugcgccug

SEQ ID NO: 1678468 - RNA, 16 nt, Salmonella enterica enterica serovar Typhi
gcggcgguucauccug

SEQ ID NO: 1678469 - RNA, 19 nt, Salmonella enterica enterica serovar Typhi
gcggcgguuauccgccagc

SEQ ID NO: 1678470 - RNA, 17 nt, Salmonella enterica enterica serovar Typhi
gcggcguaccgcgcgcc

SEQ ID NO: 1678471 - RNA, 21 nt, Salmonella enterica enterica serovar Typhi
gcggcguaaaagcgauaaaga

SEQ ID NO: 1678472 - RNA, 12 nt, Salmonella enterica enterica serovar Typhi
gcgcgacgccga

SEQ ID NO: 1678473 - RNA, 18 nt, Salmonella enterica enterica serovar Typhi
gcgcgacgguaaggcuau

SEQ ID NO: 1678474 - RNA, 20 nt, Salmonella enterica enterica serovar Typhi
gcgcgaucucuuuggccagu

SEQ ID NO: 1678475 - RNA, 21 nt, Salmonella enterica enterica serovar Typhi
gcgcgagaaguucucacccau

SEQ ID NO: 1678476 - RNA, 19 nt, Salmonella enterica enterica serovar Typhi
gcgcgccaauggccgcccc

SEQ ID NO: 1678477 - RNA, 19 nt, Salmonella enterica enterica serovar Typhi
gcgcgcaucgggccguccg

SEQ ID NO: 1678478 - RNA, 18 nt, Salmonella enterica enterica serovar Typhi
gcgccuuuuggcagcagc

SEQ ID NO: 1678479 - RNA, 17 nt, Salmonella enterica enterica serovar Typhi
gcgcgaaaaauaggaug

SEQ ID NO: 1678480 - RNA, 20 nt, Salmonella enterica enterica serovar Typhi
gcgccuuucgauaacccgcu

SEQ ID NO: 1678481 - RNA, 22 nt, Salmonella enterica enterica serovar Typhi
gcgcgacauccgcuuuugguuu

SEQ ID NO: 1678482 - RNA, 23 nt, Salmonella enterica enterica serovar Typhi
gcgccuuaaaccgucgggcgucg

SEQ ID NO: 1678483 - RNA, 20 nt, Salmonella enterica enterica serovar Typhi
gcgccugucuccagcgccgc

SEQ ID NO: 1678484 - RNA, 19 nt, Salmonella enterica enterica serovar Typhi
gcgccuguuagggcgcggc

SEQ ID NO: 1678485 - RNA, 15 nt, Salmonella enterica enterica serovar Typhi
gcgcgccgcgcagca

SEQ ID NO: 1678486 - RNA, 12 nt, Salmonella enterica enterica serovar Typhi
gcgcgccgcagc

SEQ ID NO: 1678487 - RNA, 13 nt, Salmonella enterica enterica serovar Typhi
gcgcgccgcagcg

SEQ ID NO: 1678488 - RNA, 14 nt, Salmonella enterica enterica serovar Typhi
gcgcgccgcccugc

SEQ ID NO: 1678489 - RNA, 12 nt, Salmonella enterica enterica serovar Typhi
gcgcgccgccuc

SEQ ID NO: 1678490 - RNA, 21 nt, Salmonella enterica enterica serovar Typhi
gcgcgcggauauggcggcggc

SEQ ID NO: 1678491 - RNA, 13 nt, Salmonella enterica enterica serovar Typhi
gcgcgcgcgccug

SEQ ID NO: 1678492 - RNA, 12 nt, Salmonella enterica enterica serovar Typhi
gcgcgcuggagg

SEQ ID NO: 1678493 - RNA, 17 nt, Salmonella enterica enterica serovar Typhi
gcgcgcuugcauugcuc

SEQ ID NO: 1678494 - RNA, 19 nt, Salmonella enterica enterica serovar Typhi
gcgcgcuucguuuuccgca

SEQ ID NO: 1678495 - RNA, 14 nt, Salmonella enterica enterica serovar Typhi
gcgcggcagcgcgc

SEQ ID NO: 1678496 - RNA, 17 nt, Salmonella enterica enterica serovar Typhi
gcgcggcaucgccgccc

SEQ ID NO: 1678497 - RNA, 20 nt, Salmonella enterica enterica serovar Typhi
gcgcggcaucgccgcccagu

SEQ ID NO: 1678498 - RNA, 21 nt, Salmonella enterica enterica serovar Typhi
gcgcggcaucgccgcccagug

SEQ ID NO: 1678499 - RNA, 20 nt, Salmonella enterica enterica serovar Typhi
gcgcggccuuugccuucgcc

SEQ ID NO: 1678500 - RNA, 21 nt, Salmonella enterica enterica serovar Typhi
gcgccuggaugaagcagacau

SEQ ID NO: 1678501 - RNA, 18 nt, Salmonella enterica enterica serovar Typhi
gcgccugcugccagccgc

SEQ ID NO: 1678502 - RNA, 14 nt, Salmonella enterica enterica serovar Typhi
gcgccugcugccug

SEQ ID NO: 1678503 - RNA, 12 nt, Salmonella enterica enterica serovar Typhi
gcgccugcugcg

SEQ ID NO: 1678504 - RNA, 22 nt, Salmonella enterica enterica serovar Typhi
gcgccuguaaggcucucuuacc

SEQ ID NO: 1678505 - RNA, 21 nt, Salmonella enterica enterica serovar Typhi
gcgccugugaaacggcggacg

SEQ ID NO: 1678506 - RNA, 14 nt, Salmonella enterica enterica serovar Typhi
gcgccugccauagc

SEQ ID NO: 1678507 - RNA, 18 nt, Salmonella enterica enterica serovar Typhi
gcgccugcauacucacau

SEQ ID NO: 1678508 - RNA, 13 nt, Salmonella enterica enterica serovar Typhi
gcgccugcgcggc

SEQ ID NO: 1678509 - RNA, 14 nt, Salmonella enterica enterica serovar Typhi
gcgccugcgcugca

SEQ ID NO: 1678510 - RNA, 17 nt, Salmonella enterica enterica serovar Typhi
gcgccugaugccgccgu

SEQ ID NO: 1678511 - RNA, 16 nt, Salmonella enterica enterica serovar Typhi
gcgccugacgcggacg

SEQ ID NO: 1678512 - RNA, 21 nt, Salmonella enterica enterica serovar Typhi
gcgccugacgcggacgccacc

SEQ ID NO: 1678513 - RNA, 19 nt, Salmonella enterica enterica serovar Typhi
gcgccugaauguacgcaua

SEQ ID NO: 1678514 - RNA, 15 nt, Salmonella enterica enterica serovar Typhi
gcgccgugcccagca

SEQ ID NO: 1678515 - RNA, 21 nt, Salmonella enterica enterica serovar Typhi
gcgccguucgggguugauggu

SEQ ID NO: 1678516 - RNA, 17 nt, Salmonella enterica enterica serovar Typhi
gcgccuaccgccauaga

SEQ ID NO: 1678517 - RNA, 15 nt, Salmonella enterica enterica serovar Typhi
gcgccuagcgcgcgc

SEQ ID NO: 1678518 - RNA, 17 nt, Salmonella enterica enterica serovar Typhi
gcgccguugaaaucggu

SEQ ID NO: 1678519 - RNA, 23 nt, Salmonella enterica enterica serovar Typhi
gcgccuccgcguagcccagcgcc

SEQ ID NO: 1678520 - RNA, 14 nt, Salmonella enterica enterica serovar Typhi
gcgccucgcgcggc

SEQ ID NO: 1678521 - RNA, 14 nt, Salmonella enterica enterica serovar Typhi
gcgccggggugcug

SEQ ID NO: 1678522 - RNA, 19 nt, Salmonella enterica enterica serovar Typhi
gcgccggguuuggcgggcu

SEQ ID NO: 1678523 - RNA, 16 nt, Salmonella enterica enterica serovar Typhi
gcgccggucgccagca

SEQ ID NO: 1678524 - RNA, 16 nt, Salmonella enterica enterica serovar Typhi
gcgccgguuucuccag

SEQ ID NO: 1678525 - RNA, 21 nt, Salmonella enterica enterica serovar Typhi
gcgccgucaggcuugccgcgc

SEQ ID NO: 1678526 - RNA, 22 nt, Salmonella enterica enterica serovar Typhi
gcgccgccagcgacauggcggu

SEQ ID NO: 1678527 - RNA, 13 nt, Salmonella enterica enterica serovar Typhi
gcgccgcgccacc

SEQ ID NO: 1678528 - RNA, 21 nt, Salmonella enterica enterica serovar Typhi
gcgccgccucgcgauccgcca

SEQ ID NO: 1678529 - RNA, 21 nt, Salmonella enterica enterica serovar Typhi
gcgccgcuacguaccgcuucc

SEQ ID NO: 1678530 - RNA, 16 nt, Salmonella enterica enterica serovar Typhi
gcgccggauuuaccag

SEQ ID NO: 1678531 - RNA, 23 nt, Salmonella enterica enterica serovar Typhi
gcgccgcuggcgaccagccugcc

SEQ ID NO: 1678532 - RNA, 15 nt, Salmonella enterica enterica serovar Typhi
gcgccgcuuccggca

SEQ ID NO: 1678533 - RNA, 15 nt, Salmonella enterica enterica serovar Typhi
gcgccgaucaucccg

SEQ ID NO: 1678534 - RNA, 18 nt, Salmonella enterica enterica serovar Typhi
gcgccgcaaugccgccug

SEQ ID NO: 1678535 - RNA, 20 nt, Salmonella enterica enterica serovar Typhi
gcgccgauaacacggcuggc

SEQ ID NO: 1678536 - RNA, 17 nt, Salmonella enterica enterica serovar Typhi
gcgccgccaacgccaac

SEQ ID NO: 1678537 - RNA, 15 nt, Salmonella enterica enterica serovar Typhi
gcgccgccagcgaca

SEQ ID NO: 1678538 - RNA, 19 nt, Salmonella enterica enterica serovar Typhi
gcgccgacaucgccaccgc

SEQ ID NO: 1678539 - RNA, 23 nt, Salmonella enterica enterica serovar Typhi
gcgcccugggcuucgucgagcag

SEQ ID NO: 1678540 - RNA, 13 nt, Salmonella enterica enterica serovar Typhi
gcgccaucaggcc

SEQ ID NO: 1678541 - RNA, 18 nt, Salmonella enterica enterica serovar Typhi
gcgccauccaccaggcau

SEQ ID NO: 1678542 - RNA, 16 nt, Salmonella enterica enterica serovar Typhi
gcgccauauccgcaga

SEQ ID NO: 1678543 - RNA, 22 nt, Salmonella enterica enterica serovar Typhi
gcgccauauccucgcugggcca

SEQ ID NO: 1678544 - RNA, 19 nt, Salmonella enterica enterica serovar Typhi
gcgccauacuuacugcugu

SEQ ID NO: 1678545 - RNA, 18 nt, Salmonella enterica enterica serovar Typhi
gcgccaucagacucucaa

SEQ ID NO: 1678546 - RNA, 23 nt, Salmonella enterica enterica serovar Typhi
gcgccaugaucgauagcgacggc

SEQ ID NO: 1678547 - RNA, 13 nt, Salmonella enterica enterica serovar Typhi
gcgccaugaagau

SEQ ID NO: 1678548 - RNA, 21 nt, Salmonella enterica enterica serovar Typhi
gcgccauccugccgcaccagu

SEQ ID NO: 1678549 - RNA, 11 nt, Salmonella enterica enterica serovar Typhi
gcgccaucggc

SEQ ID NO: 1678550 - RNA, 15 nt, Salmonella enterica enterica serovar Typhi
gcgcccacgcgcggc

SEQ ID NO: 1678551 - RNA, 23 nt, Salmonella enterica enterica serovar Typhi
gcgcccacgcgcggcaucauuua

SEQ ID NO: 1678552 - RNA, 20 nt, Salmonella enterica enterica serovar Typhi
gcgccauuccugccgccgca

SEQ ID NO: 1678553 - RNA, 19 nt, Salmonella enterica enterica serovar Typhi
gcgccauguucauaaagug

SEQ ID NO: 1678554 - RNA, 23 nt, Salmonella enterica enterica serovar Typhi
gcgccauguugcguaaauaaaua

SEQ ID NO: 1678555 - RNA, 19 nt, Salmonella enterica enterica serovar Typhi
gcgccauuccugccgccgc

SEQ ID NO: 1678556 - RNA, 12 nt, Salmonella enterica enterica serovar Typhi
gcgccaggccau

SEQ ID NO: 1678557 - RNA, 16 nt, Salmonella enterica enterica serovar Typhi
gcgccaggccauugcu

SEQ ID NO: 1678558 - RNA, 15 nt, Salmonella enterica enterica serovar Typhi
gcgccaggaaacucg

SEQ ID NO: 1678559 - RNA, 13 nt, Salmonella enterica enterica serovar Typhi
gcgccaggaaacu

SEQ ID NO: 1678560 - RNA, 22 nt, Salmonella enterica enterica serovar Typhi
gcgccagcuccauagaaaucag

SEQ ID NO: 1678561 - RNA, 17 nt, Salmonella enterica enterica serovar Typhi
gcgccagcgugcuaagc

SEQ ID NO: 1678562 - RNA, 21 nt, Salmonella enterica enterica serovar Typhi
gcgccagcgugcuaagcugga

SEQ ID NO: 1678563 - RNA, 16 nt, Salmonella enterica enterica serovar Typhi
gcgccagguaaguuca

SEQ ID NO: 1678564 - RNA, 20 nt, Salmonella enterica enterica serovar Typhi
gcgccaguaaugccgugccg

SEQ ID NO: 1678565 - RNA, 23 nt, Salmonella enterica enterica serovar Typhi
gcgccaguuggcguaccaucagc

SEQ ID NO: 1678566 - RNA, 14 nt, Salmonella enterica enterica serovar Typhi
gcgccaguuuuucc

SEQ ID NO: 1678567 - RNA, 21 nt, Salmonella enterica enterica serovar Typhi
gcgccaguuuuuccuguuccu

SEQ ID NO: 1678568 - RNA, 20 nt, Salmonella enterica enterica serovar Typhi
gcgcccgacgcgccacuucc

SEQ ID NO: 1678569 - RNA, 12 nt, Salmonella enterica enterica serovar Typhi
gcgccccgccgc

SEQ ID NO: 1678570 - RNA, 18 nt, Salmonella enterica enterica serovar Typhi
gcgccccgccgcgcggcc

SEQ ID NO: 1678571 - RNA, 13 nt, Salmonella enterica enterica serovar Typhi
gcgccccggcggc

SEQ ID NO: 1678572 - RNA, 14 nt, Salmonella enterica enterica serovar Typhi
gcgccccggcggcg

SEQ ID NO: 1678573 - RNA, 12 nt, Salmonella enterica enterica serovar Typhi
gcgcccccagca

SEQ ID NO: 1678574 - RNA, 20 nt, Salmonella enterica enterica serovar Typhi
gcgcccauuccgccugccgc

SEQ ID NO: 1678575 - RNA, 12 nt, Salmonella enterica enterica serovar Typhi
gcgccccagcac

SEQ ID NO: 1678576 - RNA, 13 nt, Salmonella enterica enterica serovar Typhi
gcgccccagcaca

SEQ ID NO: 1678577 - RNA, 14 nt, Salmonella enterica enterica serovar Typhi
gcgcccaucuccag

SEQ ID NO: 1678578 - RNA, 16 nt, Salmonella enterica enterica serovar Typhi
gcgcccauccgcccac

SEQ ID NO: 1678579 - RNA, 23 nt, Salmonella enterica enterica serovar Typhi
gcgcccgccugcuguaaccccug

SEQ ID NO: 1678580 - RNA, 17 nt, Salmonella enterica enterica serovar Typhi
gcgcccgccaucgcccg

SEQ ID NO: 1678581 - RNA, 16 nt, Salmonella enterica enterica serovar Typhi
gcgagaauuuuaugga

SEQ ID NO: 1678582 - RNA, 18 nt, Salmonella enterica enterica serovar Typhi
gcgagaagcugggcguca

SEQ ID NO: 1678583 - RNA, 16 nt, Salmonella enterica enterica serovar Typhi
gcgacucggugccgcu

SEQ ID NO: 1678584 - RNA, 15 nt, Salmonella enterica enterica serovar Typhi
gcgagaagcugggcg

SEQ ID NO: 1678585 - RNA, 21 nt, Salmonella enterica enterica serovar Typhi
gcgacuaugccggcugcagca

SEQ ID NO: 1678586 - RNA, 23 nt, Salmonella enterica enterica serovar Typhi
gcgacuacgguaaaccaggccag

SEQ ID NO: 1678587 - RNA, 18 nt, Salmonella enterica enterica serovar Typhi
gcgacuaacgucuuaucc

SEQ ID NO: 1678588 - RNA, 11 nt, Salmonella enterica enterica serovar Typhi
gcgagcccugu

SEQ ID NO: 1678589 - RNA, 18 nt, Salmonella enterica enterica serovar Typhi
gcgagaguaagcccaaag

SEQ ID NO: 1678590 - RNA, 18 nt, Salmonella enterica enterica serovar Typhi
gcgagcaguucagcagca

SEQ ID NO: 1678591 - RNA, 16 nt, Salmonella enterica enterica serovar Typhi
gcgaagugcagcguuu

SEQ ID NO: 1678592 - RNA, 23 nt, Salmonella enterica enterica serovar Typhi
gcgaaguagauuacgaaugugca

SEQ ID NO: 1678593 - RNA, 20 nt, Salmonella enterica enterica serovar Typhi
gcgaaggggcgggcagcagc

SEQ ID NO: 1678594 - RNA, 14 nt, Salmonella enterica enterica serovar Typhi
gcgaaggcggcggc

SEQ ID NO: 1678595 - RNA, 20 nt, Salmonella enterica enterica serovar Typhi
gcgacguuaucucgccagga

SEQ ID NO: 1678596 - RNA, 17 nt, Salmonella enterica enterica serovar Typhi
gcgacggcguaagcgcu

SEQ ID NO: 1678597 - RNA, 20 nt, Salmonella enterica enterica serovar Typhi
gcgaauaaucaaccauacau

SEQ ID NO: 1678598 - RNA, 16 nt, Salmonella enterica enterica serovar Typhi
gcgacggaccggcagc

SEQ ID NO: 1678599 - RNA, 16 nt, Salmonella enterica enterica serovar Typhi
gcgacggacucgcgca

SEQ ID NO: 1678600 - RNA, 17 nt, Salmonella enterica enterica serovar Typhi
gcgauaaaccaacagcc

SEQ ID NO: 1678601 - RNA, 13 nt, Salmonella enterica enterica serovar Typhi
gcgauaaaccagc

SEQ ID NO: 1678602 - RNA, 21 nt, Salmonella enterica enterica serovar Typhi
gcgauaaaaauauccgccauc

SEQ ID NO: 1678603 - RNA, 13 nt, Salmonella enterica enterica serovar Typhi
gcgauagcugcug

SEQ ID NO: 1678604 - RNA, 13 nt, Salmonella enterica enterica serovar Typhi
gcgauaaaguaug

SEQ ID NO: 1678605 - RNA, 19 nt, Salmonella enterica enterica serovar Typhi
gcgauaaccgccgccgcgc

SEQ ID NO: 1678606 - RNA, 20 nt, Salmonella enterica enterica serovar Typhi
gcgagcugccaguucauucc

SEQ ID NO: 1678607 - RNA, 22 nt, Salmonella enterica enterica serovar Typhi
gcgaggaacaucagccagcagc

SEQ ID NO: 1678608 - RNA, 20 nt, Salmonella enterica enterica serovar Typhi
gcgaucgcgccggucgccag

SEQ ID NO: 1678609 - RNA, 13 nt, Salmonella enterica enterica serovar Typhi
gcgaucgcuucca

SEQ ID NO: 1678610 - RNA, 14 nt, Salmonella enterica enterica serovar Typhi
gcgaucgcgccagc

SEQ ID NO: 1678611 - RNA, 23 nt, Salmonella enterica enterica serovar Typhi
gcgauauuucuccgcccauccag

SEQ ID NO: 1678612 - RNA, 18 nt, Salmonella enterica enterica serovar Typhi
gcgaucaagacaaaagcu

SEQ ID NO: 1678613 - RNA, 23 nt, Salmonella enterica enterica serovar Typhi
gcgaucuuuuguuuaccccaggc

SEQ ID NO: 1678614 - RNA, 21 nt, Salmonella enterica enterica serovar Typhi
gcgaugaccaucaaauaauac

SEQ ID NO: 1678615 - RNA, 14 nt, Salmonella enterica enterica serovar Typhi
gcgaugagcgccag

SEQ ID NO: 1678616 - RNA, 23 nt, Salmonella enterica enterica serovar Typhi
gcgaugaguaaaauuuuuuucau

SEQ ID NO: 1678617 - RNA, 16 nt, Salmonella enterica enterica serovar Typhi
gcgauggugcggcgca

SEQ ID NO: 1678618 - RNA, 16 nt, Salmonella enterica enterica serovar Typhi
gcgauguccgguccgg

SEQ ID NO: 1678619 - RNA, 11 nt, Salmonella enterica enterica serovar Typhi
gcgaugguagg

SEQ ID NO: 1678620 - RNA, 18 nt, Salmonella enterica enterica serovar Typhi
gcgcaaacgcgugcuggu

SEQ ID NO: 1678621 - RNA, 18 nt, Salmonella enterica enterica serovar Typhi
gcgcaaacggaucuucca

SEQ ID NO: 1678622 - RNA, 18 nt, Salmonella enterica enterica serovar Typhi
gcgcaaacuaccgggccu

SEQ ID NO: 1678623 - RNA, 22 nt, Salmonella enterica enterica serovar Typhi
gcgcaaacuucacauuuuuauc

SEQ ID NO: 1678624 - RNA, 21 nt, Salmonella enterica enterica serovar Typhi
gcgauuguuauccccccgccg

SEQ ID NO: 1678625 - RNA, 19 nt, Salmonella enterica enterica serovar Typhi
gcgauuuauagagcagcac

SEQ ID NO: 1678626 - RNA, 16 nt, Salmonella enterica enterica serovar Typhi
gcgauguuggguuucg

SEQ ID NO: 1678627 - RNA, 19 nt, Salmonella enterica enterica serovar Typhi
gcgauguuuacugcggcgc

SEQ ID NO: 1678628 - RNA, 16 nt, Salmonella enterica enterica serovar Typhi
gcgauguuuauugaaa

SEQ ID NO: 1678629 - RNA, 22 nt, Salmonella enterica enterica serovar Typhi
gcgauguuuucccucgccccgg

SEQ ID NO: 1678630 - RNA, 13 nt, Salmonella enterica enterica serovar Typhi
gcgauuacgccag

SEQ ID NO: 1678631 - RNA, 16 nt, Salmonella enterica enterica serovar Typhi
gcgauucgcccacgga

SEQ ID NO: 1678632 - RNA, 17 nt, Salmonella enterica enterica serovar Typhi
gcgauucagcgcaggca

SEQ ID NO: 1678633 - RNA, 15 nt, Salmonella enterica enterica serovar Typhi
gcgcaaggccgagcg

SEQ ID NO: 1678634 - RNA, 16 nt, Salmonella enterica enterica serovar Typhi
gcgcaauccgcgccgc

SEQ ID NO: 1678635 - RNA, 21 nt, Salmonella enterica enterica serovar Typhi
gcgcaauaaauucgaaauaaa

SEQ ID NO: 1678636 - RNA, 18 nt, Salmonella enterica enterica serovar Typhi
gcgcaaccgacgggcgcu

SEQ ID NO: 1678637 - RNA, 14 nt, Salmonella enterica enterica serovar Typhi
gcgcaauaugguau

SEQ ID NO: 1678638 - RNA, 19 nt, Salmonella enterica enterica serovar Typhi
gcgcacauuuacgccagcc

SEQ ID NO: 1678639 - RNA, 14 nt, Salmonella enterica enterica serovar Typhi
gcgcaguggcgggu

SEQ ID NO: 1678640 - RNA, 17 nt, Salmonella enterica enterica serovar Typhi
gcgcagugaccagcauc

SEQ ID NO: 1678641 - RNA, 13 nt, Salmonella enterica enterica serovar Typhi
gcgcagucacaga

SEQ ID NO: 1678642 - RNA, 14 nt, Salmonella enterica enterica serovar Typhi
gcgcagucacagau

SEQ ID NO: 1678643 - RNA, 15 nt, Salmonella enterica enterica serovar Typhi
gcgcaggcgggggcg

SEQ ID NO: 1678644 - RNA, 14 nt, Salmonella enterica enterica serovar Typhi
gcgcaggcgagcgg

SEQ ID NO: 1678645 - RNA, 15 nt, Salmonella enterica enterica serovar Typhi
gcgcaggcgagcggc

SEQ ID NO: 1678646 - RNA, 20 nt, Salmonella enterica enterica serovar Typhi
gcgcagcgccaucaggcaau

SEQ ID NO: 1678647 - RNA, 18 nt, Salmonella enterica enterica serovar Typhi
gcgcagcgccaucaggcc

SEQ ID NO: 1678648 - RNA, 18 nt, Salmonella enterica enterica serovar Typhi
gcgcagcgccauccggca

SEQ ID NO: 1678649 - RNA, 21 nt, Salmonella enterica enterica serovar Typhi
gcgcagcgcgcgacccagcgc

SEQ ID NO: 1678650 - RNA, 19 nt, Salmonella enterica enterica serovar Typhi
gcgcagcgcgucggcgggc

SEQ ID NO: 1678651 - RNA, 16 nt, Salmonella enterica enterica serovar Typhi
gcgcagcugggccugc

SEQ ID NO: 1678652 - RNA, 23 nt, Salmonella enterica enterica serovar Typhi
gcgcagauuuugcagauccgcga

SEQ ID NO: 1678653 - RNA, 18 nt, Salmonella enterica enterica serovar Typhi
gcgcagcaucucauccac

SEQ ID NO: 1678654 - RNA, 15 nt, Salmonella enterica enterica serovar Typhi
gcgcagaagcuacuu

SEQ ID NO: 1678655 - RNA, 15 nt, Salmonella enterica enterica serovar Typhi
gcgcacggcgcgucc

SEQ ID NO: 1678656 - RNA, 13 nt, Salmonella enterica enterica serovar Typhi
gcgccacgccacc

SEQ ID NO: 1678657 - RNA, 19 nt, Salmonella enterica enterica serovar Typhi
gcgccacgccaccgggccg

SEQ ID NO: 1678658 - RNA, 15 nt, Salmonella enterica enterica serovar Typhi
gcgccacgcccacgc

SEQ ID NO: 1678659 - RNA, 21 nt, Salmonella enterica enterica serovar Typhi
gcgccacgcgaugcaaccccu

SEQ ID NO: 1678660 - RNA, 16 nt, Salmonella enterica enterica serovar Typhi
gcgccacgcgccaggu

SEQ ID NO: 1678661 - RNA, 22 nt, Salmonella enterica enterica serovar Typhi
gcgccagaaagguauuaaguga

SEQ ID NO: 1678662 - RNA, 17 nt, Salmonella enterica enterica serovar Typhi
gcgccacuuuuccggca

SEQ ID NO: 1678663 - RNA, 13 nt, Salmonella enterica enterica serovar Typhi
gcgccagaggcgu

SEQ ID NO: 1678664 - RNA, 14 nt, Salmonella enterica enterica serovar Typhi
gcgccagcggcugc

SEQ ID NO: 1678665 - RNA, 19 nt, Salmonella enterica enterica serovar Typhi
gcgccagcguaaucggcag

SEQ ID NO: 1678666 - RNA, 15 nt, Salmonella enterica enterica serovar Typhi
gcgccagcggcggcu

SEQ ID NO: 1678667 - RNA, 16 nt, Salmonella enterica enterica serovar Typhi
gcgccagcgccgccuc

SEQ ID NO: 1678668 - RNA, 15 nt, Salmonella enterica enterica serovar Typhi
gcgccagcgccgccu

SEQ ID NO: 1678669 - RNA, 17 nt, Salmonella enterica enterica serovar Typhi
gcgccagccgcgccauc

SEQ ID NO: 1678670 - RNA, 17 nt, Salmonella enterica enterica serovar Typhi
gcgccagcgauggggca

SEQ ID NO: 1678671 - RNA, 21 nt, Salmonella enterica enterica serovar Typhi
gcgccagccgcgccaucuccu

SEQ ID NO: 1678672 - RNA, 14 nt, Salmonella enterica enterica serovar Typhi
gcgccagccuuccc

SEQ ID NO: 1678673 - RNA, 11 nt, Salmonella enterica enterica serovar Typhi
gcgccagcaug

SEQ ID NO: 1678674 - RNA, 14 nt, Salmonella enterica enterica serovar Typhi
gcgccagcaguggg

SEQ ID NO: 1678675 - RNA, 14 nt, Salmonella enterica enterica serovar Typhi
gcgccagccagcgc

SEQ ID NO: 1678676 - RNA, 19 nt, Salmonella enterica enterica serovar Typhi
gcgccagccagcgccacca

SEQ ID NO: 1678677 - RNA, 13 nt, Salmonella enterica enterica serovar Typhi
gcgccagccagcu

SEQ ID NO: 1678678 - RNA, 20 nt, Salmonella enterica enterica serovar Typhi
gcgccagccagucgccaggc

SEQ ID NO: 1678679 - RNA, 12 nt, Salmonella enterica enterica serovar Typhi
gcgccagccagc

SEQ ID NO: 1678680 - RNA, 17 nt, Salmonella enterica enterica serovar Typhi
gcgccaaugcgaaaaua

SEQ ID NO: 1678681 - RNA, 22 nt, Salmonella enterica enterica serovar Typhi
gcgccaaugcgaaaauacuccc

SEQ ID NO: 1678682 - RNA, 19 nt, Salmonella enterica enterica serovar Typhi
gcgccaaaagaggcagcaa

SEQ ID NO: 1678683 - RNA, 17 nt, Salmonella enterica enterica serovar Typhi
gcgccaaaagaggcagc

SEQ ID NO: 1678684 - RNA, 20 nt, Salmonella enterica enterica serovar Typhi
gcgccaaagcaaucgccagc

SEQ ID NO: 1678685 - RNA, 19 nt, Salmonella enterica enterica serovar Typhi
gcgccaaccgugagcgcgc

SEQ ID NO: 1678686 - RNA, 19 nt, Salmonella enterica enterica serovar Typhi
gcgcauugccugaaccggu

SEQ ID NO: 1678687 - RNA, 21 nt, Salmonella enterica enterica serovar Typhi
gcgcauucucugucgccgccc

SEQ ID NO: 1678688 - RNA, 15 nt, Salmonella enterica enterica serovar Typhi
gcgcauuccagaccc

SEQ ID NO: 1678689 - RNA, 15 nt, Salmonella enterica enterica serovar Typhi
gcgcauggccauaga

SEQ ID NO: 1678690 - RNA, 11 nt, Salmonella enterica enterica serovar Typhi
gcgcauggcca

SEQ ID NO: 1678691 - RNA, 15 nt, Salmonella enterica enterica serovar Typhi
gcgcauguaaccaaa

SEQ ID NO: 1678692 - RNA, 17 nt, Salmonella enterica enterica serovar Typhi
gcgcauuaacgccaugc

SEQ ID NO: 1678693 - RNA, 16 nt, Salmonella enterica enterica serovar Typhi
gcgcauccaccagacc

SEQ ID NO: 1678694 - RNA, 15 nt, Salmonella enterica enterica serovar Typhi
gcgcaucauggucgu

SEQ ID NO: 1678695 - RNA, 12 nt, Salmonella enterica enterica serovar Typhi
gcgcaucaguac

SEQ ID NO: 1678696 - RNA, 15 nt, Salmonella enterica enterica serovar Typhi
gcgcaucagaaaaac

SEQ ID NO: 1678697 - RNA, 21 nt, Salmonella enterica enterica serovar Typhi
gcgcaguuuacgcagcgccuu

SEQ ID NO: 1678698 - RNA, 15 nt, Salmonella enterica enterica serovar Typhi
gcgcauacuuauaca

SEQ ID NO: 1678699 - RNA, 19 nt, Salmonella enterica enterica serovar Typhi
gcgcauagauauaacccag

SEQ ID NO: 1678700 - RNA, 17 nt, Salmonella enterica enterica serovar Typhi
gcgcauaggcuuugcug

SEQ ID NO: 1678701 - RNA, 17 nt, Salmonella enterica enterica serovar Typhi
gcgcauccgcggcgcuu

SEQ ID NO: 1678702 - RNA, 22 nt, Salmonella enterica enterica serovar Typhi
gcgcauccgggccgcuagcugc

SEQ ID NO: 1678703 - RNA, 18 nt, Salmonella enterica enterica serovar Typhi
gcgcaucuggucauggcu

SEQ ID NO: 1678704 - RNA, 12 nt, Salmonella enterica enterica serovar Typhi
gcgcauggaaga

SEQ ID NO: 1678705 - RNA, 22 nt, Salmonella enterica enterica serovar Typhi
gccguauuucacuuuugccggu

SEQ ID NO: 1678706 - RNA, 15 nt, Salmonella enterica enterica serovar Typhi
gccgucacagagagc

SEQ ID NO: 1678707 - RNA, 16 nt, Salmonella enterica enterica serovar Typhi
gccguauucuuaccca

SEQ ID NO: 1678708 - RNA, 23 nt, Salmonella enterica enterica serovar Typhi
gccggaaaggauauaagcgccau

SEQ ID NO: 1678709 - RNA, 22 nt, Salmonella enterica enterica serovar Typhi
gccggaaagaauaaucgccgcc

SEQ ID NO: 1678710 - RNA, 20 nt, Salmonella enterica enterica serovar Typhi
gccggaaaggcgcaacgucg

SEQ ID NO: 1678711 - RNA, 21 nt, Salmonella enterica enterica serovar Typhi
gccggaaagggugcccgccug

SEQ ID NO: 1678712 - RNA, 16 nt, Salmonella enterica enterica serovar Typhi
gccggaaaucgcggcg

SEQ ID NO: 1678713 - RNA, 16 nt, Salmonella enterica enterica serovar Typhi
gccgcuuuccgccgca

SEQ ID NO: 1678714 - RNA, 20 nt, Salmonella enterica enterica serovar Typhi
gccgcuuugcgaacagcgca

SEQ ID NO: 1678715 - RNA, 16 nt, Salmonella enterica enterica serovar Typhi
gccgcuuuugccgcga

SEQ ID NO: 1678716 - RNA, 19 nt, Salmonella enterica enterica serovar Typhi
gccgcuuuugccgcgacuu

SEQ ID NO: 1678717 - RNA, 18 nt, Salmonella enterica enterica serovar Typhi
gccgcuuuuuucagcggc

SEQ ID NO: 1678718 - RNA, 20 nt, Salmonella enterica enterica serovar Typhi
gccggaaaaaaugggcugga

SEQ ID NO: 1678719 - RNA, 22 nt, Salmonella enterica enterica serovar Typhi
gccggaaaaaaugggcuggaaa

SEQ ID NO: 1678720 - RNA, 19 nt, Salmonella enterica enterica serovar Typhi
gccggaaaagcgcuggcug

SEQ ID NO: 1678721 - RNA, 21 nt, Salmonella enterica enterica serovar Typhi
gccggaaaagcgcuggcuggc

SEQ ID NO: 1678722 - RNA, 15 nt, Salmonella enterica enterica serovar Typhi
gccgcuucgccacuc

SEQ ID NO: 1678723 - RNA, 19 nt, Salmonella enterica enterica serovar Typhi
gccgcuuacugugccgccg

SEQ ID NO: 1678724 - RNA, 13 nt, Salmonella enterica enterica serovar Typhi
gccgucuucuucu

SEQ ID NO: 1678725 - RNA, 18 nt, Salmonella enterica enterica serovar Typhi
gccgucggcaauaaacuc

SEQ ID NO: 1678726 - RNA, 12 nt, Salmonella enterica enterica serovar Typhi
gccgucccagcg

SEQ ID NO: 1678727 - RNA, 14 nt, Salmonella enterica enterica serovar Typhi
gccguccauccggc

SEQ ID NO: 1678728 - RNA, 15 nt, Salmonella enterica enterica serovar Typhi
gccgucacaggcggc

SEQ ID NO: 1678729 - RNA, 14 nt, Salmonella enterica enterica serovar Typhi
gccuaaugagccag

SEQ ID NO: 1678730 - RNA, 17 nt, Salmonella enterica enterica serovar Typhi
gccguugugcugguuga

SEQ ID NO: 1678731 - RNA, 15 nt, Salmonella enterica enterica serovar Typhi
gccuaaugagccaga

SEQ ID NO: 1678732 - RNA, 21 nt, Salmonella enterica enterica serovar Typhi
gccuacaaaaucgcccaggcc

SEQ ID NO: 1678733 - RNA, 12 nt, Salmonella enterica enterica serovar Typhi
gccuacaagaau

SEQ ID NO: 1678734 - RNA, 14 nt, Salmonella enterica enterica serovar Typhi
gccuagcgcgcgca

SEQ ID NO: 1678735 - RNA, 22 nt, Salmonella enterica enterica serovar Typhi
gccuacagaacugcacgaaaug

SEQ ID NO: 1678736 - RNA, 19 nt, Salmonella enterica enterica serovar Typhi
gccguguugugugccgcgc

SEQ ID NO: 1678737 - RNA, 16 nt, Salmonella enterica enterica serovar Typhi
gccguuaacuggcgca

SEQ ID NO: 1678738 - RNA, 15 nt, Salmonella enterica enterica serovar Typhi
gccguuaccgccgag

SEQ ID NO: 1678739 - RNA, 17 nt, Salmonella enterica enterica serovar Typhi
gccguuaccgccgagca

SEQ ID NO: 1678740 - RNA, 13 nt, Salmonella enterica enterica serovar Typhi
gccguuccgcaac

SEQ ID NO: 1678741 - RNA, 14 nt, Salmonella enterica enterica serovar Typhi
gccguuccauucca

SEQ ID NO: 1678742 - RNA, 13 nt, Salmonella enterica enterica serovar Typhi
gccgugaucccaa

SEQ ID NO: 1678743 - RNA, 17 nt, Salmonella enterica enterica serovar Typhi
gccgugaauuucugcug

SEQ ID NO: 1678744 - RNA, 16 nt, Salmonella enterica enterica serovar Typhi
gccgugaaauauccuc

SEQ ID NO: 1678745 - RNA, 15 nt, Salmonella enterica enterica serovar Typhi
gccgugaacgccaaa

SEQ ID NO: 1678746 - RNA, 22 nt, Salmonella enterica enterica serovar Typhi
gccguggaccguauagcccaga

SEQ ID NO: 1678747 - RNA, 18 nt, Salmonella enterica enterica serovar Typhi
gccucccaguucccccgg

SEQ ID NO: 1678748 - RNA, 13 nt, Salmonella enterica enterica serovar Typhi
gccuccccugccg

SEQ ID NO: 1678749 - RNA, 12 nt, Salmonella enterica enterica serovar Typhi
gccucccugccu

SEQ ID NO: 1678750 - RNA, 20 nt, Salmonella enterica enterica serovar Typhi
gccuccauuuuggggaaaau

SEQ ID NO: 1678751 - RNA, 15 nt, Salmonella enterica enterica serovar Typhi
gccuccgcuuccugc

SEQ ID NO: 1678752 - RNA, 20 nt, Salmonella enterica enterica serovar Typhi
gccuccggaugacgccgcuu

SEQ ID NO: 1678753 - RNA, 16 nt, Salmonella enterica enterica serovar Typhi
gccuccggaucgacag

SEQ ID NO: 1678754 - RNA, 16 nt, Salmonella enterica enterica serovar Typhi
gccuccguaugaccgc

SEQ ID NO: 1678755 - RNA, 20 nt, Salmonella enterica enterica serovar Typhi
gccuccuggcuuaccugcuc

SEQ ID NO: 1678756 - RNA, 11 nt, Salmonella enterica enterica serovar Typhi
gccucauugau

SEQ ID NO: 1678757 - RNA, 20 nt, Salmonella enterica enterica serovar Typhi
gccucaucgacagacuucac

SEQ ID NO: 1678758 - RNA, 16 nt, Salmonella enterica enterica serovar Typhi
gccucaucggcguugc

SEQ ID NO: 1678759 - RNA, 12 nt, Salmonella enterica enterica serovar Typhi
gccuccagcagc

SEQ ID NO: 1678760 - RNA, 22 nt, Salmonella enterica enterica serovar Typhi
gccuccagacuggcgaccgcca

SEQ ID NO: 1678761 - RNA, 14 nt, Salmonella enterica enterica serovar Typhi
gccuaucaugcugc

SEQ ID NO: 1678762 - RNA, 10 nt, Salmonella enterica enterica serovar Typhi
gccucaggcg

SEQ ID NO: 1678763 - RNA, 17 nt, Salmonella enterica enterica serovar Typhi
gccucgcgauccgccag

SEQ ID NO: 1678764 - RNA, 16 nt, Salmonella enterica enterica serovar Typhi
gccucgcgauccgcca

SEQ ID NO: 1678765 - RNA, 22 nt, Salmonella enterica enterica serovar Typhi
gccucgcgcauccgggccgcua

SEQ ID NO: 1678766 - RNA, 21 nt, Salmonella enterica enterica serovar Typhi
gccucgcucucuuucaccagc

SEQ ID NO: 1678767 - RNA, 22 nt, Salmonella enterica enterica serovar Typhi
gccucgcugauacgcaccagcu

SEQ ID NO: 1678768 - RNA, 22 nt, Salmonella enterica enterica serovar Typhi
gccucguguaaggcuuccggca

SEQ ID NO: 1678769 - RNA, 17 nt, Salmonella enterica enterica serovar Typhi
gccucggguggcaucug

SEQ ID NO: 1678770 - RNA, 16 nt, Salmonella enterica enterica serovar Typhi
gccucuucaaauuugu

SEQ ID NO: 1678771 - RNA, 19 nt, Salmonella enterica enterica serovar Typhi
gccucuucacauaauggag

SEQ ID NO: 1678772 - RNA, 16 nt, Salmonella enterica enterica serovar Typhi
gccucucccagcauga

SEQ ID NO: 1678773 - RNA, 16 nt, Salmonella enterica enterica serovar Typhi
gccucugauuuuucca

SEQ ID NO: 1678774 - RNA, 22 nt, Salmonella enterica enterica serovar Typhi
gccucuggccgcgcuuuuuuaa

SEQ ID NO: 1678775 - RNA, 23 nt, Salmonella enterica enterica serovar Typhi
gccugccguaaacaggcaggccc

SEQ ID NO: 1678776 - RNA, 15 nt, Salmonella enterica enterica serovar Typhi
gccugccguccugau

SEQ ID NO: 1678777 - RNA, 15 nt, Salmonella enterica enterica serovar Typhi
gccugccguuuuuaa

SEQ ID NO: 1678778 - RNA, 16 nt, Salmonella enterica enterica serovar Typhi
gccugccgucgcggcu

SEQ ID NO: 1678779 - RNA, 21 nt, Salmonella enterica enterica serovar Typhi
gccugcgcuggaaucauccac

SEQ ID NO: 1678780 - RNA, 21 nt, Salmonella enterica enterica serovar Typhi
gccugcgcggcaauuuccgcu

SEQ ID NO: 1678781 - RNA, 22 nt, Salmonella enterica enterica serovar Typhi
gccugccgucuuuuagcaucag

SEQ ID NO: 1678782 - RNA, 12 nt, Salmonella enterica enterica serovar Typhi
gccugcgcggca

SEQ ID NO: 1678783 - RNA, 16 nt, Salmonella enterica enterica serovar Typhi
gccugccgcaucugac

SEQ ID NO: 1678784 - RNA, 16 nt, Salmonella enterica enterica serovar Typhi
gccugcccugcggcag

SEQ ID NO: 1678785 - RNA, 21 nt, Salmonella enterica enterica serovar Typhi
gccugcggauucaggacgaga

SEQ ID NO: 1678786 - RNA, 18 nt, Salmonella enterica enterica serovar Typhi
gccugcuggaaaggccgc

SEQ ID NO: 1678787 - RNA, 14 nt, Salmonella enterica enterica serovar Typhi
gccugcuggagccg

SEQ ID NO: 1678788 - RNA, 14 nt, Salmonella enterica enterica serovar Typhi
gccugcugccugca

SEQ ID NO: 1678789 - RNA, 21 nt, Salmonella enterica enterica serovar Typhi
gccuggcccggcaguugcugg

SEQ ID NO: 1678790 - RNA, 13 nt, Salmonella enterica enterica serovar Typhi
gccuggcccguuc

SEQ ID NO: 1678791 - RNA, 15 nt, Salmonella enterica enterica serovar Typhi
gccuggcgcagcgcu

SEQ ID NO: 1678792 - RNA, 14 nt, Salmonella enterica enterica serovar Typhi
gccuggcgcagcgc

SEQ ID NO: 1678793 - RNA, 12 nt, Salmonella enterica enterica serovar Typhi
gccuggccuccg

SEQ ID NO: 1678794 - RNA, 15 nt, Salmonella enterica enterica serovar Typhi
gccugcuggucugaa

SEQ ID NO: 1678795 - RNA, 21 nt, Salmonella enterica enterica serovar Typhi
gccuucaauuugaccugaccu

SEQ ID NO: 1678796 - RNA, 20 nt, Salmonella enterica enterica serovar Typhi
gccuucacacugcgccgcca

SEQ ID NO: 1678797 - RNA, 17 nt, Salmonella enterica enterica serovar Typhi
gccuucacacugcgccg

SEQ ID NO: 1678798 - RNA, 18 nt, Salmonella enterica enterica serovar Typhi
gccuucaaauauauugaa

SEQ ID NO: 1678799 - RNA, 18 nt, Salmonella enterica enterica serovar Typhi
gccuucaauuugaccuga

SEQ ID NO: 1678800 - RNA, 23 nt, Salmonella enterica enterica serovar Typhi
gccuuaucgagugucaauaagcc

SEQ ID NO: 1678801 - RNA, 16 nt, Salmonella enterica enterica serovar Typhi
gccuucaacgcucagu

SEQ ID NO: 1678802 - RNA, 19 nt, Salmonella enterica enterica serovar Typhi
gccuuauuuuucagcgcca

SEQ ID NO: 1678803 - RNA, 23 nt, Salmonella enterica enterica serovar Typhi
gccuguuuaaugauucuguguuu

SEQ ID NO: 1678804 - RNA, 22 nt, Salmonella enterica enterica serovar Typhi
gccuguagcagcgccagcgugc

SEQ ID NO: 1678805 - RNA, 19 nt, Salmonella enterica enterica serovar Typhi
gccugucacguaaaauuag

SEQ ID NO: 1678806 - RNA, 19 nt, Salmonella enterica enterica serovar Typhi
gccuguuagggcgcggcug

SEQ ID NO: 1678807 - RNA, 16 nt, Salmonella enterica enterica serovar Typhi
gccuguuauucaauuc

SEQ ID NO: 1678808 - RNA, 14 nt, Salmonella enterica enterica serovar Typhi
gccuguugauuacg

SEQ ID NO: 1678809 - RNA, 18 nt, Salmonella enterica enterica serovar Typhi
gccuguucuucaguaauu

SEQ ID NO: 1678810 - RNA, 16 nt, Salmonella enterica enterica serovar Typhi
gccugggauaagcaga

SEQ ID NO: 1678811 - RNA, 19 nt, Salmonella enterica enterica serovar Typhi
gcgaacaaagccccgggcg

SEQ ID NO: 1678812 - RNA, 20 nt, Salmonella enterica enterica serovar Typhi
gcgaacaguguaaacgccag

SEQ ID NO: 1678813 - RNA, 21 nt, Salmonella enterica enterica serovar Typhi
gcgaaaugcgaauccggcggc

SEQ ID NO: 1678814 - RNA, 12 nt, Salmonella enterica enterica serovar Typhi
gcgaaagaaaau

SEQ ID NO: 1678815 - RNA, 17 nt, Salmonella enterica enterica serovar Typhi
gccuuuuuuaauccagg

SEQ ID NO: 1678816 - RNA, 22 nt, Salmonella enterica enterica serovar Typhi
gccuuuuucaacagcacccagg

SEQ ID NO: 1678817 - RNA, 20 nt, Salmonella enterica enterica serovar Typhi
gccuuuuugcagcgcggcca

SEQ ID NO: 1678818 - RNA, 22 nt, Salmonella enterica enterica serovar Typhi
gccuuuucauauggaagcuguu

SEQ ID NO: 1678819 - RNA, 20 nt, Salmonella enterica enterica serovar Typhi
gccuuuucccccagcauuuu

SEQ ID NO: 1678820 - RNA, 20 nt, Salmonella enterica enterica serovar Typhi
gcgaaccggaccagcacaaa

SEQ ID NO: 1678821 - RNA, 21 nt, Salmonella enterica enterica serovar Typhi
gcgaacgacucacgcgcgcuu

SEQ ID NO: 1678822 - RNA, 20 nt, Salmonella enterica enterica serovar Typhi
gcgaacggcuuuccagcagc

SEQ ID NO: 1678823 - RNA, 13 nt, Salmonella enterica enterica serovar Typhi
gccuuuauuucaa

SEQ ID NO: 1678824 - RNA, 15 nt, Salmonella enterica enterica serovar Typhi
gccuuuggccuggag

SEQ ID NO: 1678825 - RNA, 21 nt, Salmonella enterica enterica serovar Typhi
gccuuuuaucaaugcacugac

SEQ ID NO: 1678826 - RNA, 17 nt, Salmonella enterica enterica serovar Typhi
gccuuucagaucggcaa

SEQ ID NO: 1678827 - RNA, 17 nt, Salmonella enterica enterica serovar Typhi
gccuuucagaugguuug

SEQ ID NO: 1678828 - RNA, 15 nt, Salmonella enterica enterica serovar Typhi
gccuucgccuucacg

SEQ ID NO: 1678829 - RNA, 20 nt, Salmonella enterica enterica serovar Typhi
gccuucgcggugaucccagg

SEQ ID NO: 1678830 - RNA, 24 nt, Salmonella enterica enterica serovar Typhi
gccuucggccugaaucagcaucuu

SEQ ID NO: 1678831 - RNA, 15 nt, Salmonella enterica enterica serovar Typhi
gccuucagcgcgccc

SEQ ID NO: 1678832 - RNA, 17 nt, Salmonella enterica enterica serovar Typhi
gccuucgauuaacgcau

SEQ ID NO: 1678833 - RNA, 13 nt, Salmonella enterica enterica serovar Typhi
ggcgcgaaagcgc

SEQ ID NO: 1678834 - RNA, 22 nt, Salmonella enterica enterica serovar Typhi
ggcgcgaaacugcugccgcagc

SEQ ID NO: 1678835 - RNA, 22 nt, Salmonella enterica enterica serovar Typhi
ggcgcgacuuuaaucaccugcc

SEQ ID NO: 1678836 - RNA, 17 nt, Salmonella enterica enterica serovar Typhi
ggcgcgaaaacagcugg

SEQ ID NO: 1678837 - RNA, 15 nt, Salmonella enterica enterica serovar Typhi
ggcgccggggcagca

SEQ ID NO: 1678838 - RNA, 16 nt, Salmonella enterica enterica serovar Typhi
ggcgccggggcagcaa

SEQ ID NO: 1678839 - RNA, 17 nt, Salmonella enterica enterica serovar Typhi
ggcgccggggcagcaau

SEQ ID NO: 1678840 - RNA, 17 nt, Salmonella enterica enterica serovar Typhi
ggcgccaucgccuccag

SEQ ID NO: 1678841 - RNA, 11 nt, Salmonella enterica enterica serovar Typhi
ggcgccaguac

SEQ ID NO: 1678842 - RNA, 18 nt, Salmonella enterica enterica serovar Typhi
ggcgccagcgacaacgcu

SEQ ID NO: 1678843 - RNA, 15 nt, Salmonella enterica enterica serovar Typhi
aaauaccgcacauca

SEQ ID NO: 1678844 - RNA, 12 nt, Salmonella enterica enterica serovar Typhi
aaauaccuaacu

SEQ ID NO: 1678845 - RNA, 23 nt, Salmonella enterica enterica serovar Typhi
aaauaccggcagcggucaucaau

SEQ ID NO: 1678846 - RNA, 22 nt, Salmonella enterica enterica serovar Typhi
aaauacggcuuccacugcggca

SEQ ID NO: 1678847 - RNA, 15 nt, Salmonella enterica enterica serovar Typhi
aaauacgccagauaa

SEQ ID NO: 1678848 - RNA, 16 nt, Salmonella enterica enterica serovar Typhi
aaauacgcucaauaua

SEQ ID NO: 1678849 - RNA, 15 nt, Salmonella enterica enterica serovar Typhi
ggcgcgcguggcuuc

SEQ ID NO: 1678850 - RNA, 17 nt, Salmonella enterica enterica serovar Typhi
aaauagaaauugcaggg

SEQ ID NO: 1678851 - RNA, 23 nt, Salmonella enterica enterica serovar Typhi
ggcggaaguagccuccggcggug

SEQ ID NO: 1678852 - RNA, 20 nt, Salmonella enterica enterica serovar Typhi
ggcggacaacgcuccagcag

SEQ ID NO: 1678853 - RNA, 13 nt, Salmonella enterica enterica serovar Typhi
ggcggacagcggc

SEQ ID NO: 1678854 - RNA, 15 nt, Salmonella enterica enterica serovar Typhi
ggcgcugcgcgcauc

SEQ ID NO: 1678855 - RNA, 14 nt, Salmonella enterica enterica serovar Typhi
ggcgcugcgcggcg

SEQ ID NO: 1678856 - RNA, 17 nt, Salmonella enterica enterica serovar Typhi
ggcggcauaaaugccuu

SEQ ID NO: 1678857 - RNA, 13 nt, Salmonella enterica enterica serovar Typhi
ggcggccagcauu

SEQ ID NO: 1678858 - RNA, 15 nt, Salmonella enterica enterica serovar Typhi
ggcggauaaggcgcu

SEQ ID NO: 1678859 - RNA, 13 nt, Salmonella enterica enterica serovar Typhi
ggcggcaaagaaa

SEQ ID NO: 1678860 - RNA, 14 nt, Salmonella enterica enterica serovar Typhi
ggcgggcagcagca

SEQ ID NO: 1678861 - RNA, 17 nt, Salmonella enterica enterica serovar Typhi
ggcgggcagcagcaggc

SEQ ID NO: 1678862 - RNA, 20 nt, Salmonella enterica enterica serovar Typhi
ggcgggcagcagcaggcugg

SEQ ID NO: 1678863 - RNA, 14 nt, Salmonella enterica enterica serovar Typhi
ggcggcgcgcugcc

SEQ ID NO: 1678864 - RNA, 15 nt, Salmonella enterica enterica serovar Typhi
ggcgggugccgggaa

SEQ ID NO: 1678865 - RNA, 17 nt, Salmonella enterica enterica serovar Typhi
ggcgguaaucgcgcugu

SEQ ID NO: 1678866 - RNA, 20 nt, Salmonella enterica enterica serovar Typhi
ggcgguuaacagacccgcuu

SEQ ID NO: 1678867 - RNA, 18 nt, Salmonella enterica enterica serovar Typhi
ggcgguuauccgccagcg

SEQ ID NO: 1678868 - RNA, 22 nt, Salmonella enterica enterica serovar Typhi
ggcgguucccgggcgcucgcuu

SEQ ID NO: 1678869 - RNA, 14 nt, Salmonella enterica enterica serovar Typhi
ggcgguaugaaagc

SEQ ID NO: 1678870 - RNA, 19 nt, Salmonella enterica enterica serovar Typhi
aaauacccgaccccgccgu

SEQ ID NO: 1678871 - RNA, 12 nt, Salmonella enterica enterica serovar Typhi
aaauaccacauc

SEQ ID NO: 1678872 - RNA, 16 nt, Salmonella enterica enterica serovar Typhi
aaauaccagcaccuga

SEQ ID NO: 1678873 - RNA, 9 nt, Salmonella enterica enterica serovar Typhi
aaauaccag

SEQ ID NO: 1678874 - RNA, 13 nt, Salmonella enterica enterica serovar Typhi
aaauaccacauca

SEQ ID NO: 1678875 - RNA, 12 nt, Salmonella enterica enterica serovar Typhi
aaauaccagcac

SEQ ID NO: 1678876 - RNA, 13 nt, Salmonella enterica enterica serovar Typhi
aaauacaucgcca

SEQ ID NO: 1678877 - RNA, 14 nt, Salmonella enterica enterica serovar Typhi
ggcgcagcgcggga

SEQ ID NO: 1678878 - RNA, 11 nt, Salmonella enterica enterica serovar Typhi
ggcgcaggcaa

SEQ ID NO: 1678879 - RNA, 21 nt, Salmonella enterica enterica serovar Typhi
ggcgcaaagcaauguaaaacu

SEQ ID NO: 1678880 - RNA, 18 nt, Salmonella enterica enterica serovar Typhi
ggcgauuuucauagcugg

SEQ ID NO: 1678881 - RNA, 21 nt, Salmonella enterica enterica serovar Typhi
ggcgauuuccagcgccgcgcg

SEQ ID NO: 1678882 - RNA, 18 nt, Salmonella enterica enterica serovar Typhi
ggcgcaccaaagugcgcc

SEQ ID NO: 1678883 - RNA, 17 nt, Salmonella enterica enterica serovar Typhi
ggcgcaaauggcugcga

SEQ ID NO: 1678884 - RNA, 21 nt, Salmonella enterica enterica serovar Typhi
ggcgcacgcgucaucggcgcg

SEQ ID NO: 1678885 - RNA, 15 nt, Salmonella enterica enterica serovar Typhi
ggcgauguuggcgcc

SEQ ID NO: 1678886 - RNA, 15 nt, Salmonella enterica enterica serovar Typhi
ggcgauuaauacauc

SEQ ID NO: 1678887 - RNA, 17 nt, Salmonella enterica enterica serovar Typhi
ggcgaucagcgccacca

SEQ ID NO: 1678888 - RNA, 17 nt, Salmonella enterica enterica serovar Typhi
ggcgauagccccaguaa

SEQ ID NO: 1678889 - RNA, 17 nt, Salmonella enterica enterica serovar Typhi
ggcgauacucugcccgc

SEQ ID NO: 1678890 - RNA, 13 nt, Salmonella enterica enterica serovar Typhi
aaauaauugauaa

SEQ ID NO: 1678891 - RNA, 14 nt, Salmonella enterica enterica serovar Typhi
aaauaauucauauu

SEQ ID NO: 1678892 - RNA, 14 nt, Salmonella enterica enterica serovar Typhi
aaauaauuguguaa

SEQ ID NO: 1678893 - RNA, 12 nt, Salmonella enterica enterica serovar Typhi
ggcgauaaucuc

SEQ ID NO: 1678894 - RNA, 21 nt, Salmonella enterica enterica serovar Typhi
ggcgauaaggucgcuauccag

SEQ ID NO: 1678895 - RNA, 22 nt, Salmonella enterica enterica serovar Typhi
aaauaaggcugcgcguuuucau

SEQ ID NO: 1678896 - RNA, 12 nt, Salmonella enterica enterica serovar Typhi
aaauaauaccac

SEQ ID NO: 1678897 - RNA, 22 nt, Salmonella enterica enterica serovar Typhi
aaauaauagguacggggcaucu

SEQ ID NO: 1678898 - RNA, 22 nt, Salmonella enterica enterica serovar Typhi
aaauaauccgcugcaacucccg

SEQ ID NO: 1678899 - RNA, 13 nt, Salmonella enterica enterica serovar Typhi
aaauaauauuauu

SEQ ID NO: 1678900 - RNA, 20 nt, Salmonella enterica enterica serovar Typhi
ggcgacagggauauuccaua

SEQ ID NO: 1678901 - RNA, 14 nt, Salmonella enterica enterica serovar Typhi
ggcgacagccgcgu

SEQ ID NO: 1678902 - RNA, 14 nt, Salmonella enterica enterica serovar Typhi
ggcgaacaggcuca

SEQ ID NO: 1678903 - RNA, 15 nt, Salmonella enterica enterica serovar Typhi
ggcgaacaggcucag

SEQ ID NO: 1678904 - RNA, 12 nt, Salmonella enterica enterica serovar Typhi
ggcgaaaaaccg

SEQ ID NO: 1678905 - RNA, 13 nt, Salmonella enterica enterica serovar Typhi
ggcgaaagaaaau

SEQ ID NO: 1678906 - RNA, 15 nt, Salmonella enterica enterica serovar Typhi
ggccgacacaacaug

SEQ ID NO: 1678907 - RNA, 14 nt, Salmonella enterica enterica serovar Typhi
ggccgacaaaaauu

SEQ ID NO: 1678908 - RNA, 15 nt, Salmonella enterica enterica serovar Typhi
ggccgacaggcggcc

SEQ ID NO: 1678909 - RNA, 22 nt, Salmonella enterica enterica serovar Typhi
ggcgacgguacaaaccccaccc

SEQ ID NO: 1678910 - RNA, 17 nt, Salmonella enterica enterica serovar Typhi
ggcgacgucagacgagg

SEQ ID NO: 1678911 - RNA, 20 nt, Salmonella enterica enterica serovar Typhi
aaauaacuuuuaauuuuuau

SEQ ID NO: 1678912 - RNA, 21 nt, Salmonella enterica enterica serovar Typhi
aaauaacuuuuaauuuuuaug

SEQ ID NO: 1678913 - RNA, 12 nt, Salmonella enterica enterica serovar Typhi
aaauaagaguca

SEQ ID NO: 1678914 - RNA, 23 nt, Salmonella enterica enterica serovar Typhi
ggcgagcggcaccggacauccca

SEQ ID NO: 1678915 - RNA, 16 nt, Salmonella enterica enterica serovar Typhi
ggcgacgcuuucaccu

SEQ ID NO: 1678916 - RNA, 18 nt, Salmonella enterica enterica serovar Typhi
ggcgacggcggucgccgc

SEQ ID NO: 1678917 - RNA, 19 nt, Salmonella enterica enterica serovar Typhi
aaauaacuuuuaauuuuua

SEQ ID NO: 1678918 - RNA, 13 nt, Salmonella enterica enterica serovar Typhi
aaauaacuuuuaa

SEQ ID NO: 1678919 - RNA, 18 nt, Salmonella enterica enterica serovar Typhi
aaauaacucuggaucagu

SEQ ID NO: 1678920 - RNA, 21 nt, Salmonella enterica enterica serovar Typhi
aaauaacaauauuaaauaaau

SEQ ID NO: 1678921 - RNA, 20 nt, Salmonella enterica enterica serovar Typhi
ggcugccgucgaugucgccg

SEQ ID NO: 1678922 - RNA, 14 nt, Salmonella enterica enterica serovar Typhi
ggcugcggcaaacu

SEQ ID NO: 1678923 - RNA, 17 nt, Salmonella enterica enterica serovar Typhi
ggcugcgcugccagcug

SEQ ID NO: 1678924 - RNA, 16 nt, Salmonella enterica enterica serovar Typhi
ggcugccccagacgcc

SEQ ID NO: 1678925 - RNA, 19 nt, Salmonella enterica enterica serovar Typhi
ggcugccgacaacgccucc

SEQ ID NO: 1678926 - RNA, 21 nt, Salmonella enterica enterica serovar Typhi
ggcugcacccggagagaaaca

SEQ ID NO: 1678927 - RNA, 16 nt, Salmonella enterica enterica serovar Typhi
ggcugauaggccugga

SEQ ID NO: 1678928 - RNA, 11 nt, Salmonella enterica enterica serovar Typhi
ggcugaagcgg

SEQ ID NO: 1678929 - RNA, 12 nt, Salmonella enterica enterica serovar Typhi
ggcugaagcccc

SEQ ID NO: 1678930 - RNA, 20 nt, Salmonella enterica enterica serovar Typhi
ggcguauucgcccggcagga

SEQ ID NO: 1678931 - RNA, 16 nt, Salmonella enterica enterica serovar Typhi
ggcucaucagcgccau

SEQ ID NO: 1678932 - RNA, 15 nt, Salmonella enterica enterica serovar Typhi
ggcuccuuuuuugua

SEQ ID NO: 1678933 - RNA, 20 nt, Salmonella enterica enterica serovar Typhi
ggcuccuggugagguuucag

SEQ ID NO: 1678934 - RNA, 16 nt, Salmonella enterica enterica serovar Typhi
ggcucccacucuucca

SEQ ID NO: 1678935 - RNA, 23 nt, Salmonella enterica enterica serovar Typhi
ggcucauuuuauccaacagcgca

SEQ ID NO: 1678936 - RNA, 14 nt, Salmonella enterica enterica serovar Typhi
ggcuccagcgccag

SEQ ID NO: 1678937 - RNA, 19 nt, Salmonella enterica enterica serovar Typhi
ggcucuaaauuagcucccg

SEQ ID NO: 1678938 - RNA, 13 nt, Salmonella enterica enterica serovar Typhi
ggcucguuuuugu

SEQ ID NO: 1678939 - RNA, 22 nt, Salmonella enterica enterica serovar Typhi
ggcucgucguugaaaucgucag

SEQ ID NO: 1678940 - RNA, 22 nt, Salmonella enterica enterica serovar Typhi
ggcuugaucgcgcagcaaauca

SEQ ID NO: 1678941 - RNA, 17 nt, Salmonella enterica enterica serovar Typhi
ggcuugccagauagaca

SEQ ID NO: 1678942 - RNA, 14 nt, Salmonella enterica enterica serovar Typhi
ggcuugccagcaga

SEQ ID NO: 1678943 - RNA, 22 nt, Salmonella enterica enterica serovar Typhi
ggcuucguuaagcgguuuucaa

SEQ ID NO: 1678944 - RNA, 17 nt, Salmonella enterica enterica serovar Typhi
ggcuugaucgcgcagca

SEQ ID NO: 1678945 - RNA, 20 nt, Salmonella enterica enterica serovar Typhi
ggcuugaguuuuucucgcaa

SEQ ID NO: 1678946 - RNA, 22 nt, Salmonella enterica enterica serovar Typhi
ggcuucugcugugcauaaauaa

SEQ ID NO: 1678947 - RNA, 23 nt, Salmonella enterica enterica serovar Typhi
ggcuuccauugcagaauauguuc

SEQ ID NO: 1678948 - RNA, 22 nt, Salmonella enterica enterica serovar Typhi
ggcuuccaguugaaaaccacaa

SEQ ID NO: 1678949 - RNA, 23 nt, Salmonella enterica enterica serovar Typhi
ggcuucggcaauuuccggcgacg

SEQ ID NO: 1678950 - RNA, 16 nt, Salmonella enterica enterica serovar Typhi
ggcuguuaguaagcug

SEQ ID NO: 1678951 - RNA, 20 nt, Salmonella enterica enterica serovar Typhi
ggcuguucacguaccaggca

SEQ ID NO: 1678952 - RNA, 21 nt, Salmonella enterica enterica serovar Typhi
ggcuuacuuuccaaaauccag

SEQ ID NO: 1678953 - RNA, 13 nt, Salmonella enterica enterica serovar Typhi
ggcugucccagag

SEQ ID NO: 1678954 - RNA, 23 nt, Salmonella enterica enterica serovar Typhi
ggcugucaggagccaccggcagg

SEQ ID NO: 1678955 - RNA, 11 nt, Salmonella enterica enterica serovar Typhi
ggcuguauaca

SEQ ID NO: 1678956 - RNA, 16 nt, Salmonella enterica enterica serovar Typhi
ggcugucgcggcggca

SEQ ID NO: 1678957 - RNA, 13 nt, Salmonella enterica enterica serovar Typhi
ggcugucgauccc

SEQ ID NO: 1678958 - RNA, 18 nt, Salmonella enterica enterica serovar Typhi
ggcugugcgugacccaca

SEQ ID NO: 1678959 - RNA, 20 nt, Salmonella enterica enterica serovar Typhi
ggcuggcaaugcgcuguauu

SEQ ID NO: 1678960 - RNA, 19 nt, Salmonella enterica enterica serovar Typhi
ggcuggauaaccguacggc

SEQ ID NO: 1678961 - RNA, 14 nt, Salmonella enterica enterica serovar Typhi
ggcuggaugacggu

SEQ ID NO: 1678962 - RNA, 14 nt, Salmonella enterica enterica serovar Typhi
ggcuggcgcaacug

SEQ ID NO: 1678963 - RNA, 12 nt, Salmonella enterica enterica serovar Typhi
gggcaggcgugu

SEQ ID NO: 1678964 - RNA, 18 nt, Salmonella enterica enterica serovar Typhi
gggcaggcgucaaaacag

SEQ ID NO: 1678965 - RNA, 15 nt, Salmonella enterica enterica serovar Typhi
gggcagugcucgcca

SEQ ID NO: 1678966 - RNA, 16 nt, Salmonella enterica enterica serovar Typhi
gggcauaaaugguacu

SEQ ID NO: 1678967 - RNA, 11 nt, Salmonella enterica enterica serovar Typhi
gggcagcaucu

SEQ ID NO: 1678968 - RNA, 12 nt, Salmonella enterica enterica serovar Typhi
gggcagaaacgu

SEQ ID NO: 1678969 - RNA, 12 nt, Salmonella enterica enterica serovar Typhi
gggcagaaaaau

SEQ ID NO: 1678970 - RNA, 14 nt, Salmonella enterica enterica serovar Typhi
gggcaauccauuaa

SEQ ID NO: 1678971 - RNA, 13 nt, Salmonella enterica enterica serovar Typhi
gggcaagcucagc

SEQ ID NO: 1678972 - RNA, 15 nt, Salmonella enterica enterica serovar Typhi
gggauuuccuggcag

SEQ ID NO: 1678973 - RNA, 21 nt, Salmonella enterica enterica serovar Typhi
gggaucguucugcugauaaua

SEQ ID NO: 1678974 - RNA, 20 nt, Salmonella enterica enterica serovar Typhi
gggaguacauuuacaauaau

SEQ ID NO: 1678975 - RNA, 23 nt, Salmonella enterica enterica serovar Typhi
gggaguaguguaauaccacugcc

SEQ ID NO: 1678976 - RNA, 21 nt, Salmonella enterica enterica serovar Typhi
gggaguaugcggucaaaagcu

SEQ ID NO: 1678977 - RNA, 13 nt, Salmonella enterica enterica serovar Typhi
gggaggggcuuuc

SEQ ID NO: 1678978 - RNA, 12 nt, Salmonella enterica enterica serovar Typhi
gggaaagggggg

SEQ ID NO: 1678979 - RNA, 17 nt, Salmonella enterica enterica serovar Typhi
gggaaaugagaaaagga

SEQ ID NO: 1678980 - RNA, 13 nt, Salmonella enterica enterica serovar Typhi
gggaacacucuaa

SEQ ID NO: 1678981 - RNA, 14 nt, Salmonella enterica enterica serovar Typhi
gggaacacucuaaa

SEQ ID NO: 1678982 - RNA, 13 nt, Salmonella enterica enterica serovar Typhi
gggaagcuacgau

SEQ ID NO: 1678983 - RNA, 22 nt, Salmonella enterica enterica serovar Typhi
gggaagaugugccacuccgcca

SEQ ID NO: 1678984 - RNA, 16 nt, Salmonella enterica enterica serovar Typhi
gggaagaugugccacu

SEQ ID NO: 1678985 - RNA, 22 nt, Salmonella enterica enterica serovar Typhi
ggcuuucccguuucagccccuu

SEQ ID NO: 1678986 - RNA, 13 nt, Salmonella enterica enterica serovar Typhi
ggcuuuaaugcuu

SEQ ID NO: 1678987 - RNA, 15 nt, Salmonella enterica enterica serovar Typhi
ggcuuucauccaaua

SEQ ID NO: 1678988 - RNA, 12 nt, Salmonella enterica enterica serovar Typhi
ggcuuuuuucuc

SEQ ID NO: 1678989 - RNA, 20 nt, Salmonella enterica enterica serovar Typhi
ggcuuuuuuuuaugccucuu

SEQ ID NO: 1678990 - RNA, 16 nt, Salmonella enterica enterica serovar Typhi
ggcuuuuugccgggcg

SEQ ID NO: 1678991 - RNA, 14 nt, Salmonella enterica enterica serovar Typhi
ggcuuuuaucgaca

SEQ ID NO: 1678992 - RNA, 16 nt, Salmonella enterica enterica serovar Typhi
gggaaguaaggcauga

SEQ ID NO: 1678993 - RNA, 12 nt, Salmonella enterica enterica serovar Typhi
gggacacucaag

SEQ ID NO: 1678994 - RNA, 22 nt, Salmonella enterica enterica serovar Typhi
gggagacuucuucagucagggc

SEQ ID NO: 1678995 - RNA, 13 nt, Salmonella enterica enterica serovar Typhi
gggacgcugcuga

SEQ ID NO: 1678996 - RNA, 23 nt, Salmonella enterica enterica serovar Typhi
gggacuaucgaaagagcaaauac

SEQ ID NO: 1678997 - RNA, 15 nt, Salmonella enterica enterica serovar Typhi
gggacucaccguuac

SEQ ID NO: 1678998 - RNA, 19 nt, Salmonella enterica enterica serovar Typhi
gggggauagcgacggggcg

SEQ ID NO: 1678999 - RNA, 20 nt, Salmonella enterica enterica serovar Typhi
gggggccugauggcgcugcg

SEQ ID NO: 1679000 - RNA, 18 nt, Salmonella enterica enterica serovar Typhi
ggggcuuugugccgcaca

SEQ ID NO: 1679001 - RNA, 17 nt, Salmonella enterica enterica serovar Typhi
ggggcgacaaacagcgc

SEQ ID NO: 1679002 - RNA, 14 nt, Salmonella enterica enterica serovar Typhi
ggggcgacagcccc

SEQ ID NO: 1679003 - RNA, 13 nt, Salmonella enterica enterica serovar Typhi
ggggcgaccggcu

SEQ ID NO: 1679004 - RNA, 18 nt, Salmonella enterica enterica serovar Typhi
ggggccacaggcggcaug

SEQ ID NO: 1679005 - RNA, 15 nt, Salmonella enterica enterica serovar Typhi
ggggaucgguuuauc

SEQ ID NO: 1679006 - RNA, 16 nt, Salmonella enterica enterica serovar Typhi
ggggauaaccagaaaa

SEQ ID NO: 1679007 - RNA, 18 nt, Salmonella enterica enterica serovar Typhi
ggggaugauuuucaggca

SEQ ID NO: 1679008 - RNA, 22 nt, Salmonella enterica enterica serovar Typhi
ggggaacggcagacagccgcgg

SEQ ID NO: 1679009 - RNA, 23 nt, Salmonella enterica enterica serovar Typhi
gggcuuuugagucgcauccagug

SEQ ID NO: 1679010 - RNA, 22 nt, Salmonella enterica enterica serovar Typhi
ggggaaaauauuagcggcggca

SEQ ID NO: 1679011 - RNA, 16 nt, Salmonella enterica enterica serovar Typhi
gggcuucagauguuug

SEQ ID NO: 1679012 - RNA, 19 nt, Salmonella enterica enterica serovar Typhi
gggcuuauccccauucugc

SEQ ID NO: 1679013 - RNA, 22 nt, Salmonella enterica enterica serovar Typhi
ggguaaugaucagcaaaauagu

SEQ ID NO: 1679014 - RNA, 12 nt, Salmonella enterica enterica serovar Typhi
ggguaauaacgg

SEQ ID NO: 1679015 - RNA, 11 nt, Salmonella enterica enterica serovar Typhi
ggguaauacug

SEQ ID NO: 1679016 - RNA, 19 nt, Salmonella enterica enterica serovar Typhi
ggguaaaaauauggcgggc

SEQ ID NO: 1679017 - RNA, 16 nt, Salmonella enterica enterica serovar Typhi
gggguuuuggccggac

SEQ ID NO: 1679018 - RNA, 11 nt, Salmonella enterica enterica serovar Typhi
ggguaguuuug

SEQ ID NO: 1679019 - RNA, 14 nt, Salmonella enterica enterica serovar Typhi
ggguagaaaaaggu

SEQ ID NO: 1679020 - RNA, 22 nt, Salmonella enterica enterica serovar Typhi
gggguucaauagcacaucagcc

SEQ ID NO: 1679021 - RNA, 16 nt, Salmonella enterica enterica serovar Typhi
gggguucagaccagaa

SEQ ID NO: 1679022 - RNA, 12 nt, Salmonella enterica enterica serovar Typhi
ggggugaaacag

SEQ ID NO: 1679023 - RNA, 20 nt, Salmonella enterica enterica serovar Typhi
ggggucucuacgcggcgggc

SEQ ID NO: 1679024 - RNA, 24 nt, Salmonella enterica enterica serovar Typhi
gggucacauccagacagccgacgg

SEQ ID NO: 1679025 - RNA, 14 nt, Salmonella enterica enterica serovar Typhi
gggucaaaugcgaa

SEQ ID NO: 1679026 - RNA, 16 nt, Salmonella enterica enterica serovar Typhi
ggguauugacgagcga

SEQ ID NO: 1679027 - RNA, 21 nt, Salmonella enterica enterica serovar Typhi
ggguaucuaacccgcucagac

SEQ ID NO: 1679028 - RNA, 17 nt, Salmonella enterica enterica serovar Typhi
gggucaguacgcgcgua

SEQ ID NO: 1679029 - RNA, 22 nt, Salmonella enterica enterica serovar Typhi
gggucagcgggguucagaccag

SEQ ID NO: 1679030 - RNA, 21 nt, Salmonella enterica enterica serovar Typhi
gggugaauauuuguuggaaau

SEQ ID NO: 1679031 - RNA, 22 nt, Salmonella enterica enterica serovar Typhi
gggucuuauuucuccugcgcca

SEQ ID NO: 1679032 - RNA, 12 nt, Salmonella enterica enterica serovar Typhi
gggcauccgccg

SEQ ID NO: 1679033 - RNA, 18 nt, Salmonella enterica enterica serovar Typhi
gggcaucccgucccacca

SEQ ID NO: 1679034 - RNA, 15 nt, Salmonella enterica enterica serovar Typhi
gggccagauucuuag

SEQ ID NO: 1679035 - RNA, 24 nt, Salmonella enterica enterica serovar Typhi
gggccaguuuccugacccgcucgu

SEQ ID NO: 1679036 - RNA, 17 nt, Salmonella enterica enterica serovar Typhi
gggccgcuagcugcagc

SEQ ID NO: 1679037 - RNA, 14 nt, Salmonella enterica enterica serovar Typhi
gggccgccgcagca

SEQ ID NO: 1679038 - RNA, 14 nt, Salmonella enterica enterica serovar Typhi
gggccgacaggcgg

SEQ ID NO: 1679039 - RNA, 17 nt, Salmonella enterica enterica serovar Typhi
gggcccguggcccaggc

SEQ ID NO: 1679040 - RNA, 23 nt, Salmonella enterica enterica serovar Typhi
gggccuacgagauaaaaacgggu

SEQ ID NO: 1679041 - RNA, 21 nt, Salmonella enterica enterica serovar Typhi
gggccuacggauucgcugcug

SEQ ID NO: 1679042 - RNA, 21 nt, Salmonella enterica enterica serovar Typhi
gggcgaacccaucagggaaaa

SEQ ID NO: 1679043 - RNA, 23 nt, Salmonella enterica enterica serovar Typhi
gggcgagauguuuuaccaguaca

SEQ ID NO: 1679044 - RNA, 15 nt, Salmonella enterica enterica serovar Typhi
gggcgcacagcgcca

SEQ ID NO: 1679045 - RNA, 13 nt, Salmonella enterica enterica serovar Typhi
gggcgaugcgcga

SEQ ID NO: 1679046 - RNA, 14 nt, Salmonella enterica enterica serovar Typhi
gggcgcagaagcua

SEQ ID NO: 1679047 - RNA, 15 nt, Salmonella enterica enterica serovar Typhi
gggcgcaugaggccu

SEQ ID NO: 1679048 - RNA, 21 nt, Salmonella enterica enterica serovar Typhi
gggcgugucgccggggcgcug

SEQ ID NO: 1679049 - RNA, 13 nt, Salmonella enterica enterica serovar Typhi
gggcgugucccug

SEQ ID NO: 1679050 - RNA, 19 nt, Salmonella enterica enterica serovar Typhi
gggcuaaaugcccacggcg

SEQ ID NO: 1679051 - RNA, 22 nt, Salmonella enterica enterica serovar Typhi
gggcucauuuuauccaacagcg

SEQ ID NO: 1679052 - RNA, 13 nt, Salmonella enterica enterica serovar Typhi
gggcuaugaagag

SEQ ID NO: 1679053 - RNA, 21 nt, Salmonella enterica enterica serovar Typhi
gggcuaaucgcaaacugcgcg

SEQ ID NO: 1679054 - RNA, 18 nt, Salmonella enterica enterica serovar Typhi
gguaacaucgcccgcacc

SEQ ID NO: 1679055 - RNA, 22 nt, Salmonella enterica enterica serovar Typhi
gguaacgcucuuaccgcuaaaa

SEQ ID NO: 1679056 - RNA, 15 nt, Salmonella enterica enterica serovar Typhi
gguaacgaacgcugu

SEQ ID NO: 1679057 - RNA, 16 nt, Salmonella enterica enterica serovar Typhi
gguaacgauaaaaugc

SEQ ID NO: 1679058 - RNA, 22 nt, Salmonella enterica enterica serovar Typhi
gguaaagaaaccagaguccggc

SEQ ID NO: 1679059 - RNA, 14 nt, Salmonella enterica enterica serovar Typhi
gguaaauaacuuuu

SEQ ID NO: 1679060 - RNA, 20 nt, Salmonella enterica enterica serovar Typhi
gguaaauuuaugguuccuga

SEQ ID NO: 1679061 - RNA, 13 nt, Salmonella enterica enterica serovar Typhi
gguaaaacgcugg

SEQ ID NO: 1679062 - RNA, 15 nt, Salmonella enterica enterica serovar Typhi
gguaaaccaggccag

SEQ ID NO: 1679063 - RNA, 22 nt, Salmonella enterica enterica serovar Typhi
gguaaaauggacuuccgcacgc

SEQ ID NO: 1679064 - RNA, 12 nt, Salmonella enterica enterica serovar Typhi
gguaaaauccuu

SEQ ID NO: 1679065 - RNA, 21 nt, Salmonella enterica enterica serovar Typhi
gguaacguuacuugauggaaa

SEQ ID NO: 1679066 - RNA, 16 nt, Salmonella enterica enterica serovar Typhi
gguaagcgccugcugc

SEQ ID NO: 1679067 - RNA, 23 nt, Salmonella enterica enterica serovar Typhi
gguaagcccauggcaggcagcac

SEQ ID NO: 1679068 - RNA, 17 nt, Salmonella enterica enterica serovar Typhi
gguaaguuuuucucuua

SEQ ID NO: 1679069 - RNA, 15 nt, Salmonella enterica enterica serovar Typhi
gguaauggucagcau

SEQ ID NO: 1679070 - RNA, 15 nt, Salmonella enterica enterica serovar Typhi
gguaaugcgugagca

SEQ ID NO: 1679071 - RNA, 14 nt, Salmonella enterica enterica serovar Typhi
ggguuaauggcagc

SEQ ID NO: 1679072 - RNA, 14 nt, Salmonella enterica enterica serovar Typhi
ggguuaaagcccug

SEQ ID NO: 1679073 - RNA, 15 nt, Salmonella enterica enterica serovar Typhi
ggguuaaagcccuga

SEQ ID NO: 1679074 - RNA, 23 nt, Salmonella enterica enterica serovar Typhi
ggguuacucuguuucgccgcagg

SEQ ID NO: 1679075 - RNA, 17 nt, Salmonella enterica enterica serovar Typhi
ggguucaaguccccccc

SEQ ID NO: 1679076 - RNA, 15 nt, Salmonella enterica enterica serovar Typhi
ggguucguaauaagg

SEQ ID NO: 1679077 - RNA, 14 nt, Salmonella enterica enterica serovar Typhi
ggguucgcccggca

SEQ ID NO: 1679078 - RNA, 21 nt, Salmonella enterica enterica serovar Typhi
ggguugagcgagucagacacc

SEQ ID NO: 1679079 - RNA, 14 nt, Salmonella enterica enterica serovar Typhi
gggugcgcagcccc

SEQ ID NO: 1679080 - RNA, 14 nt, Salmonella enterica enterica serovar Typhi
gggugcgcccagac

SEQ ID NO: 1679081 - RNA, 18 nt, Salmonella enterica enterica serovar Typhi
gguagcccggcaggcugg

SEQ ID NO: 1679082 - RNA, 22 nt, Salmonella enterica enterica serovar Typhi
gguagcccggacaaggcgcgcc

SEQ ID NO: 1679083 - RNA, 21 nt, Salmonella enterica enterica serovar Typhi
gguagcgcuuguuaucuggca

SEQ ID NO: 1679084 - RNA, 21 nt, Salmonella enterica enterica serovar Typhi
gguagcgucagguagcccggc

SEQ ID NO: 1679085 - RNA, 24 nt, Salmonella enterica enterica serovar Typhi
gguagcuccagacaggacgccagc

SEQ ID NO: 1679086 - RNA, 13 nt, Salmonella enterica enterica serovar Typhi
gguagccacagau

SEQ ID NO: 1679087 - RNA, 15 nt, Salmonella enterica enterica serovar Typhi
gguagacgcaccaga

SEQ ID NO: 1679088 - RNA, 20 nt, Salmonella enterica enterica serovar Typhi
gguagacccggcauugaaac

SEQ ID NO: 1679089 - RNA, 22 nt, Salmonella enterica enterica serovar Typhi
gguacuuuucauccacagcgcc

SEQ ID NO: 1679090 - RNA, 23 nt, Salmonella enterica enterica serovar Typhi
gguacuugacgucgccauaucca

SEQ ID NO: 1679091 - RNA, 16 nt, Salmonella enterica enterica serovar Typhi
gguacucuuccagcug

SEQ ID NO: 1679092 - RNA, 23 nt, Salmonella enterica enterica serovar Typhi
gguacucuuccagcugcucuccu

SEQ ID NO: 1679093 - RNA, 15 nt, Salmonella enterica enterica serovar Typhi
gguacggccagcgcg

SEQ ID NO: 1679094 - RNA, 15 nt, Salmonella enterica enterica serovar Typhi
gguacgacgcggcuc

SEQ ID NO: 1679095 - RNA, 14 nt, Salmonella enterica enterica serovar Typhi
gguacaggccgccg

SEQ ID NO: 1679096 - RNA, 21 nt, Salmonella enterica enterica serovar Typhi
gguaauuuucaccuccgggug

SEQ ID NO: 1679097 - RNA, 15 nt, Salmonella enterica enterica serovar Typhi
gguacagaugcugua

SEQ ID NO: 1679098 - RNA, 14 nt, Salmonella enterica enterica serovar Typhi
gguauccugaacca

SEQ ID NO: 1679099 - RNA, 14 nt, Salmonella enterica enterica serovar Typhi
gguauccagcagaa

SEQ ID NO: 1679100 - RNA, 14 nt, Salmonella enterica enterica serovar Typhi
gguauccuccugcc

SEQ ID NO: 1679101 - RNA, 14 nt, Salmonella enterica enterica serovar Typhi
gguaucagcgcguu

SEQ ID NO: 1679102 - RNA, 21 nt, Salmonella enterica enterica serovar Typhi
gguauauaaaucaaaagugca

SEQ ID NO: 1679103 - RNA, 15 nt, Salmonella enterica enterica serovar Typhi
gguauaggccaggcu

SEQ ID NO: 1679104 - RNA, 22 nt, Salmonella enterica enterica serovar Typhi
gguaggguugccagaggcagca

SEQ ID NO: 1679105 - RNA, 18 nt, Salmonella enterica enterica serovar Typhi
gguauucaccaaaaggca

SEQ ID NO: 1679106 - RNA, 19 nt, Salmonella enterica enterica serovar Typhi
gguauucgcggccagauaa

SEQ ID NO: 1679107 - RNA, 17 nt, Salmonella enterica enterica serovar Typhi
gguauuuauccagcagg

SEQ ID NO: 1679108 - RNA, 18 nt, Salmonella enterica enterica serovar Typhi
ggucaaacaccugaacca

SEQ ID NO: 1679109 - RNA, 21 nt, Salmonella enterica enterica serovar Typhi
ggucaaacaccugaaccagcg

SEQ ID NO: 1679110 - RNA, 20 nt, Salmonella enterica enterica serovar Typhi
ggucaaaaaagcgacgcugu

SEQ ID NO: 1679111 - RNA, 21 nt, Salmonella enterica enterica serovar Typhi
gguauuagcaccguuucugaa

SEQ ID NO: 1679112 - RNA, 23 nt, Salmonella enterica enterica serovar Typhi
gguauucaacgccaucuuccuca

SEQ ID NO: 1679113 - RNA, 18 nt, Salmonella enterica enterica serovar Typhi
gguauguuccuggauaga

SEQ ID NO: 1679114 - RNA, 18 nt, Salmonella enterica enterica serovar Typhi
gguaucuaacccgcucag

SEQ ID NO: 1679115 - RNA, 22 nt, Salmonella enterica enterica serovar Typhi
gguaucugggcggcaaaauuga

SEQ ID NO: 1679116 - RNA, 16 nt, Salmonella enterica enterica serovar Typhi
gguaugaaacauauau

SEQ ID NO: 1679117 - RNA, 19 nt, Salmonella enterica enterica serovar Typhi
ggucacaaaggccagcagc

SEQ ID NO: 1679118 - RNA, 22 nt, Salmonella enterica enterica serovar Typhi
ggucacaaaggccagcagcagc

SEQ ID NO: 1679119 - RNA, 19 nt, Salmonella enterica enterica serovar Typhi
ggucaauaagauauccugc

SEQ ID NO: 1679120 - RNA, 12 nt, Salmonella enterica enterica serovar Typhi
ggucagauccuu

SEQ ID NO: 1679121 - RNA, 20 nt, Salmonella enterica enterica serovar Typhi
ggucagccgguuuauccgca

SEQ ID NO: 1679122 - RNA, 14 nt, Salmonella enterica enterica serovar Typhi
ggucagcggcgcgc

SEQ ID NO: 1679123 - RNA, 21 nt, Salmonella enterica enterica serovar Typhi
ggucagcauuucauccauuaa

SEQ ID NO: 1679124 - RNA, 13 nt, Salmonella enterica enterica serovar Typhi
ggucaggcuaaau

SEQ ID NO: 1679125 - RNA, 21 nt, Salmonella enterica enterica serovar Typhi
ggucaggcucaggaaaacaaa

SEQ ID NO: 1679126 - RNA, 23 nt, Salmonella enterica enterica serovar Typhi
gguccucugauaagucccggacc

SEQ ID NO: 1679127 - RNA, 19 nt, Salmonella enterica enterica serovar Typhi
ggucauucauugucuuuuu

SEQ ID NO: 1679128 - RNA, 13 nt, Salmonella enterica enterica serovar Typhi
ggucauacugugc

SEQ ID NO: 1679129 - RNA, 23 nt, Salmonella enterica enterica serovar Typhi
ggucaguaggcgaacuucaucca

SEQ ID NO: 1679130 - RNA, 16 nt, Salmonella enterica enterica serovar Typhi
ggucgggcaggcuucc

SEQ ID NO: 1679131 - RNA, 16 nt, Salmonella enterica enterica serovar Typhi
ggucggcuccugguga

SEQ ID NO: 1679132 - RNA, 13 nt, Salmonella enterica enterica serovar Typhi
ggucgucagccgu

SEQ ID NO: 1679133 - RNA, 17 nt, Salmonella enterica enterica serovar Typhi
ggucguaaugagcacuu

SEQ ID NO: 1679134 - RNA, 19 nt, Salmonella enterica enterica serovar Typhi
ggucguacuaaagagcgcc

SEQ ID NO: 1679135 - RNA, 20 nt, Salmonella enterica enterica serovar Typhi
ggucguacuaaagagcgccu

SEQ ID NO: 1679136 - RNA, 19 nt, Salmonella enterica enterica serovar Typhi
ggucuaaguugaccacauc

SEQ ID NO: 1679137 - RNA, 16 nt, Salmonella enterica enterica serovar Typhi
ggucucuuaaugccag

SEQ ID NO: 1679138 - RNA, 17 nt, Salmonella enterica enterica serovar Typhi
ggucucuuaaugccagc

SEQ ID NO: 1679139 - RNA, 20 nt, Salmonella enterica enterica serovar Typhi
ggucucuuaaugccagcggc

SEQ ID NO: 1679140 - RNA, 20 nt, Salmonella enterica enterica serovar Typhi
ggucucuucaugcauaaccg

SEQ ID NO: 1679141 - RNA, 19 nt, Salmonella enterica enterica serovar Typhi
ggugaaaaaucauuaucac

SEQ ID NO: 1679142 - RNA, 20 nt, Salmonella enterica enterica serovar Typhi
ggucugcuucagccacuggc

SEQ ID NO: 1679143 - RNA, 19 nt, Salmonella enterica enterica serovar Typhi
ggucgcuaacccaggccgg

SEQ ID NO: 1679144 - RNA, 22 nt, Salmonella enterica enterica serovar Typhi
ggucgcgccaaaagaggcagca

SEQ ID NO: 1679145 - RNA, 18 nt, Salmonella enterica enterica serovar Typhi
ggucgcgacggccagcau

SEQ ID NO: 1679146 - RNA, 13 nt, Salmonella enterica enterica serovar Typhi
ggucgccagcgcc

SEQ ID NO: 1679147 - RNA, 17 nt, Salmonella enterica enterica serovar Typhi
ggucgaccaccugcugu

SEQ ID NO: 1679148 - RNA, 14 nt, Salmonella enterica enterica serovar Typhi
ggaacaccagcgcc

SEQ ID NO: 1679149 - RNA, 23 nt, Salmonella enterica enterica serovar Typhi
ggaacaaaccgacuuucaaaucg

SEQ ID NO: 1679150 - RNA, 17 nt, Salmonella enterica enterica serovar Typhi
ggaacaagcaaaccuau

SEQ ID NO: 1679151 - RNA, 14 nt, Salmonella enterica enterica serovar Typhi
gcuuuccgggguga

SEQ ID NO: 1679152 - RNA, 19 nt, Salmonella enterica enterica serovar Typhi
gcuuuccguuaccucaaaa

SEQ ID NO: 1679153 - RNA, 13 nt, Salmonella enterica enterica serovar Typhi
ggaacaaaacgga

SEQ ID NO: 1679154 - RNA, 19 nt, Salmonella enterica enterica serovar Typhi
ggaacagcggagcgaagaa

SEQ ID NO: 1679155 - RNA, 16 nt, Salmonella enterica enterica serovar Typhi
ggaacaggccaaaccc

SEQ ID NO: 1679156 - RNA, 16 nt, Salmonella enterica enterica serovar Typhi
ggaacaucagccagca

SEQ ID NO: 1679157 - RNA, 14 nt, Salmonella enterica enterica serovar Typhi
ggaacaucagccag

SEQ ID NO: 1679158 - RNA, 13 nt, Salmonella enterica enterica serovar Typhi
ggaaccaggcgcg

SEQ ID NO: 1679159 - RNA, 16 nt, Salmonella enterica enterica serovar Typhi
ggaaccaaaugcccag

SEQ ID NO: 1679160 - RNA, 13 nt, Salmonella enterica enterica serovar Typhi
ggaacaucuuuua

SEQ ID NO: 1679161 - RNA, 19 nt, Salmonella enterica enterica serovar Typhi
ggaacaucuuuuaccugug

SEQ ID NO: 1679162 - RNA, 17 nt, Salmonella enterica enterica serovar Typhi
ggaagcgauguuuacug

SEQ ID NO: 1679163 - RNA, 22 nt, Salmonella enterica enterica serovar Typhi
ggaagcugcgcagcacuucaga

SEQ ID NO: 1679164 - RNA, 23 nt, Salmonella enterica enterica serovar Typhi
ggaaggucgcauccgcguuagca

SEQ ID NO: 1679165 - RNA, 16 nt, Salmonella enterica enterica serovar Typhi
ggacacauuucuuuug

SEQ ID NO: 1679166 - RNA, 14 nt, Salmonella enterica enterica serovar Typhi
ggacacccgcagcc

SEQ ID NO: 1679167 - RNA, 16 nt, Salmonella enterica enterica serovar Typhi
ggacaacgcuccagca

SEQ ID NO: 1679168 - RNA, 17 nt, Salmonella enterica enterica serovar Typhi
ggaauugguagacacgc

SEQ ID NO: 1679169 - RNA, 18 nt, Salmonella enterica enterica serovar Typhi
ggaagucagcuuccugca

SEQ ID NO: 1679170 - RNA, 21 nt, Salmonella enterica enterica serovar Typhi
ggaauaacaucguaaaucaaa

SEQ ID NO: 1679171 - RNA, 15 nt, Salmonella enterica enterica serovar Typhi
ggaauaacuccagug

SEQ ID NO: 1679172 - RNA, 19 nt, Salmonella enterica enterica serovar Typhi
ggaauaaaaauaaauaaaa

SEQ ID NO: 1679173 - RNA, 23 nt, Salmonella enterica enterica serovar Typhi
ggaauguuccccguugagaaugg

SEQ ID NO: 1679174 - RNA, 15 nt, Salmonella enterica enterica serovar Typhi
ggaauggcgggcgca

SEQ ID NO: 1679175 - RNA, 12 nt, Salmonella enterica enterica serovar Typhi
ggaaugcccagc

SEQ ID NO: 1679176 - RNA, 20 nt, Salmonella enterica enterica serovar Typhi
ggacagcgacacuccgcgca

SEQ ID NO: 1679177 - RNA, 16 nt, Salmonella enterica enterica serovar Typhi
ggacaggcgaaauaag

SEQ ID NO: 1679178 - RNA, 17 nt, Salmonella enterica enterica serovar Typhi
ggaccggcaaucgccug

SEQ ID NO: 1679179 - RNA, 20 nt, Salmonella enterica enterica serovar Typhi
ggaccggcaaucgccugcaa

SEQ ID NO: 1679180 - RNA, 19 nt, Salmonella enterica enterica serovar Typhi
ggaccguguucaugcagcc

SEQ ID NO: 1679181 - RNA, 15 nt, Salmonella enterica enterica serovar Typhi
aaaggcuuguuuagc

SEQ ID NO: 1679182 - RNA, 16 nt, Salmonella enterica enterica serovar Typhi
aaaggcuuuaaagcag

SEQ ID NO: 1679183 - RNA, 23 nt, Salmonella enterica enterica serovar Typhi
ggaccuguguauucugcgccagc

SEQ ID NO: 1679184 - RNA, 22 nt, Salmonella enterica enterica serovar Typhi
ggacgaacaacaucagacagua

SEQ ID NO: 1679185 - RNA, 21 nt, Salmonella enterica enterica serovar Typhi
ggacgaaugcgaaaaguaaag

SEQ ID NO: 1679186 - RNA, 20 nt, Salmonella enterica enterica serovar Typhi
aaaggguaacgggacacugc

SEQ ID NO: 1679187 - RNA, 19 nt, Salmonella enterica enterica serovar Typhi
aaaggggggcuagcugugg

SEQ ID NO: 1679188 - RNA, 22 nt, Salmonella enterica enterica serovar Typhi
aaaggggccugcacaauaccaa

SEQ ID NO: 1679189 - RNA, 18 nt, Salmonella enterica enterica serovar Typhi
ggacgcugacgccaggcc

SEQ ID NO: 1679190 - RNA, 20 nt, Salmonella enterica enterica serovar Typhi
ggacgagcgcgucagcgccu

SEQ ID NO: 1679191 - RNA, 17 nt, Salmonella enterica enterica serovar Typhi
ggagaaaacgcggccug

SEQ ID NO: 1679192 - RNA, 14 nt, Salmonella enterica enterica serovar Typhi
ggagaaaacgcggc

SEQ ID NO: 1679193 - RNA, 18 nt, Salmonella enterica enterica serovar Typhi
ggagaccccacacuacca

SEQ ID NO: 1679194 - RNA, 17 nt, Salmonella enterica enterica serovar Typhi
ggagauuaacagcgcga

SEQ ID NO: 1679195 - RNA, 20 nt, Salmonella enterica enterica serovar Typhi
ggagcacgcggugccgaugg

SEQ ID NO: 1679196 - RNA, 21 nt, Salmonella enterica enterica serovar Typhi
ggagcagugauuaugcucccg

SEQ ID NO: 1679197 - RNA, 15 nt, Salmonella enterica enterica serovar Typhi
ggacuguacaagaag

SEQ ID NO: 1679198 - RNA, 21 nt, Salmonella enterica enterica serovar Typhi
ggacuggagguacauugccag

SEQ ID NO: 1679199 - RNA, 23 nt, Salmonella enterica enterica serovar Typhi
ggacugacugagccacugcugaa

SEQ ID NO: 1679200 - RNA, 23 nt, Salmonella enterica enterica serovar Typhi
ggacugauacagccaaaucagca

SEQ ID NO: 1679201 - RNA, 22 nt, Salmonella enterica enterica serovar Typhi
ggacugaucccacuuaggcagc

SEQ ID NO: 1679202 - RNA, 18 nt, Salmonella enterica enterica serovar Typhi
aaaggucaaacaccugaa

SEQ ID NO: 1679203 - RNA, 15 nt, Salmonella enterica enterica serovar Typhi
aaaggucgacauuua

SEQ ID NO: 1679204 - RNA, 17 nt, Salmonella enterica enterica serovar Typhi
ggaucaagcaaugccag

SEQ ID NO: 1679205 - RNA, 17 nt, Salmonella enterica enterica serovar Typhi
ggauauucaucaguuua

SEQ ID NO: 1679206 - RNA, 21 nt, Salmonella enterica enterica serovar Typhi
ggaucaaaaaggugagcauug

SEQ ID NO: 1679207 - RNA, 19 nt, Salmonella enterica enterica serovar Typhi
ggauaugcgacgaaagcgg

SEQ ID NO: 1679208 - RNA, 13 nt, Salmonella enterica enterica serovar Typhi
ggauauggcaaaa

SEQ ID NO: 1679209 - RNA, 16 nt, Salmonella enterica enterica serovar Typhi
ggauauguuugacaag

SEQ ID NO: 1679210 - RNA, 17 nt, Salmonella enterica enterica serovar Typhi
ggauauguuugacaagc

SEQ ID NO: 1679211 - RNA, 17 nt, Salmonella enterica enterica serovar Typhi
ggauagagaucuuccgc

SEQ ID NO: 1679212 - RNA, 15 nt, Salmonella enterica enterica serovar Typhi
ggauacguucauccu

SEQ ID NO: 1679213 - RNA, 18 nt, Salmonella enterica enterica serovar Typhi
ggauacguucauccuccu

SEQ ID NO: 1679214 - RNA, 15 nt, Salmonella enterica enterica serovar Typhi
ggauacgauguaaaa

SEQ ID NO: 1679215 - RNA, 19 nt, Salmonella enterica enterica serovar Typhi
ggauacgauguaaaaaugc

SEQ ID NO: 1679216 - RNA, 21 nt, Salmonella enterica enterica serovar Typhi
ggauaagcgaugcgcggaugc

SEQ ID NO: 1679217 - RNA, 17 nt, Salmonella enterica enterica serovar Typhi
ggauaacguucuuuuga

SEQ ID NO: 1679218 - RNA, 20 nt, Salmonella enterica enterica serovar Typhi
ggauaacgcagaagacagaa

SEQ ID NO: 1679219 - RNA, 14 nt, Salmonella enterica enterica serovar Typhi
ggauaaagaccggc

SEQ ID NO: 1679220 - RNA, 12 nt, Salmonella enterica enterica serovar Typhi
ggauaaaacaga

SEQ ID NO: 1679221 - RNA, 20 nt, Salmonella enterica enterica serovar Typhi
ggauaacauguggcuggggc

SEQ ID NO: 1679222 - RNA, 13 nt, Salmonella enterica enterica serovar Typhi
ggagcccaguagc

SEQ ID NO: 1679223 - RNA, 13 nt, Salmonella enterica enterica serovar Typhi
ggaucaucuuuua

SEQ ID NO: 1679224 - RNA, 16 nt, Salmonella enterica enterica serovar Typhi
ggaucaugguugaaaa

SEQ ID NO: 1679225 - RNA, 15 nt, Salmonella enterica enterica serovar Typhi
ggaucaauaugccag

SEQ ID NO: 1679226 - RNA, 16 nt, Salmonella enterica enterica serovar Typhi
ggaucggccauaucca

SEQ ID NO: 1679227 - RNA, 14 nt, Salmonella enterica enterica serovar Typhi
ggaucgguuuaucc

SEQ ID NO: 1679228 - RNA, 22 nt, Salmonella enterica enterica serovar Typhi
ggaugaacucuaugcaaaagaa

SEQ ID NO: 1679229 - RNA, 22 nt, Salmonella enterica enterica serovar Typhi
ggaugacgaauaccugaaagag

SEQ ID NO: 1679230 - RNA, 23 nt, Salmonella enterica enterica serovar Typhi
ggaucugcuuaugaucgcccagc

SEQ ID NO: 1679231 - RNA, 20 nt, Salmonella enterica enterica serovar Typhi
ggaucugauacggaaauagc

SEQ ID NO: 1679232 - RNA, 11 nt, Salmonella enterica enterica serovar Typhi
ggauggugguc

SEQ ID NO: 1679233 - RNA, 20 nt, Salmonella enterica enterica serovar Typhi
ggauggcuggggaaguuaug

SEQ ID NO: 1679234 - RNA, 21 nt, Salmonella enterica enterica serovar Typhi
ggauggcgucgcuacgggcgc

SEQ ID NO: 1679235 - RNA, 12 nt, Salmonella enterica enterica serovar Typhi
ggauggcggcgc

SEQ ID NO: 1679236 - RNA, 12 nt, Salmonella enterica enterica serovar Typhi
ggaugucggcgu

SEQ ID NO: 1679237 - RNA, 23 nt, Salmonella enterica enterica serovar Typhi
aaaguaccagcgcgaacauuaca

SEQ ID NO: 1679238 - RNA, 13 nt, Salmonella enterica enterica serovar Typhi
ggaugugcauuga

SEQ ID NO: 1679239 - RNA, 21 nt, Salmonella enterica enterica serovar Typhi
ggaugugaccuuugugcagga

SEQ ID NO: 1679240 - RNA, 15 nt, Salmonella enterica enterica serovar Typhi
ggaugccaaccaccg

SEQ ID NO: 1679241 - RNA, 13 nt, Salmonella enterica enterica serovar Typhi
ggaugcagucugg

SEQ ID NO: 1679242 - RNA, 13 nt, Salmonella enterica enterica serovar Typhi
ggauggcaaaaac

SEQ ID NO: 1679243 - RNA, 15 nt, Salmonella enterica enterica serovar Typhi
ggauggccugcucaa

SEQ ID NO: 1679244 - RNA, 17 nt, Salmonella enterica enterica serovar Typhi
ggauggcaguacagggc

SEQ ID NO: 1679245 - RNA, 19 nt, Salmonella enterica enterica serovar Typhi
ggauuacgcgccugccuga

SEQ ID NO: 1679246 - RNA, 15 nt, Salmonella enterica enterica serovar Typhi
ggauguugccacagg

SEQ ID NO: 1679247 - RNA, 17 nt, Salmonella enterica enterica serovar Typhi
ggauguugccacaggcu

SEQ ID NO: 1679248 - RNA, 16 nt, Salmonella enterica enterica serovar Typhi
ggauguggugcggcuu

SEQ ID NO: 1679249 - RNA, 15 nt, Salmonella enterica enterica serovar Typhi
ggauuacgacccaca

SEQ ID NO: 1679250 - RNA, 16 nt, Salmonella enterica enterica serovar Typhi
ggauuaucgaaauagc

SEQ ID NO: 1679251 - RNA, 22 nt, Salmonella enterica enterica serovar Typhi
ggauuaucaggaugaauaugaa

SEQ ID NO: 1679252 - RNA, 19 nt, Salmonella enterica enterica serovar Typhi
ggauucgacggccagcgcg

SEQ ID NO: 1679253 - RNA, 20 nt, Salmonella enterica enterica serovar Typhi
ggauuccgccgcggccagca

SEQ ID NO: 1679254 - RNA, 16 nt, Salmonella enterica enterica serovar Typhi
ggauucugccaucgac

SEQ ID NO: 1679255 - RNA, 11 nt, Salmonella enterica enterica serovar Typhi
ggauuuuaaau

SEQ ID NO: 1679256 - RNA, 17 nt, Salmonella enterica enterica serovar Typhi
ggauuuuaaauugguua

SEQ ID NO: 1679257 - RNA, 16 nt, Salmonella enterica enterica serovar Typhi
ggcaaccaccagcagu

SEQ ID NO: 1679258 - RNA, 13 nt, Salmonella enterica enterica serovar Typhi
ggcaagccagcau

SEQ ID NO: 1679259 - RNA, 23 nt, Salmonella enterica enterica serovar Typhi
ggcaagagauucaggccgccagc

SEQ ID NO: 1679260 - RNA, 17 nt, Salmonella enterica enterica serovar Typhi
ggccaguuguucuuuca

SEQ ID NO: 1679261 - RNA, 18 nt, Salmonella enterica enterica serovar Typhi
ggccaguuguucuuucac

SEQ ID NO: 1679262 - RNA, 14 nt, Salmonella enterica enterica serovar Typhi
ggccaguuuccuga

SEQ ID NO: 1679263 - RNA, 19 nt, Salmonella enterica enterica serovar Typhi
ggccaguuuccugacccgc

SEQ ID NO: 1679264 - RNA, 12 nt, Salmonella enterica enterica serovar Typhi
ggccaucaacuu

SEQ ID NO: 1679265 - RNA, 21 nt, Salmonella enterica enterica serovar Typhi
ggccaucaacuucucgcaggc

SEQ ID NO: 1679266 - RNA, 21 nt, Salmonella enterica enterica serovar Typhi
ggccaucuuccagcaucagca

SEQ ID NO: 1679267 - RNA, 14 nt, Salmonella enterica enterica serovar Typhi
ggccagauucuuag

SEQ ID NO: 1679268 - RNA, 15 nt, Salmonella enterica enterica serovar Typhi
ggccagauggcaaac

SEQ ID NO: 1679269 - RNA, 21 nt, Salmonella enterica enterica serovar Typhi
ggcccagcuuaguaaccccag

SEQ ID NO: 1679270 - RNA, 17 nt, Salmonella enterica enterica serovar Typhi
ggcccagcgcgguggcg

SEQ ID NO: 1679271 - RNA, 18 nt, Salmonella enterica enterica serovar Typhi
ggcccgccgcuggcuggc

SEQ ID NO: 1679272 - RNA, 22 nt, Salmonella enterica enterica serovar Typhi
aaagucggggcguaaaaauuuu

SEQ ID NO: 1679273 - RNA, 18 nt, Salmonella enterica enterica serovar Typhi
aaagugaaggccagacuu

SEQ ID NO: 1679274 - RNA, 21 nt, Salmonella enterica enterica serovar Typhi
aaagugauuauaaaucaauag

SEQ ID NO: 1679275 - RNA, 17 nt, Salmonella enterica enterica serovar Typhi
ggcccguggcccaggcc

SEQ ID NO: 1679276 - RNA, 16 nt, Salmonella enterica enterica serovar Typhi
ggcccguugucuucac

SEQ ID NO: 1679277 - RNA, 20 nt, Salmonella enterica enterica serovar Typhi
ggcccgguggcguggcgcca

SEQ ID NO: 1679278 - RNA, 15 nt, Salmonella enterica enterica serovar Typhi
ggcccgguggcgcca

SEQ ID NO: 1679279 - RNA, 17 nt, Salmonella enterica enterica serovar Typhi
ggcccgguaagcgcagc

SEQ ID NO: 1679280 - RNA, 18 nt, Salmonella enterica enterica serovar Typhi
ggcccgguaagcgcagcg

SEQ ID NO: 1679281 - RNA, 20 nt, Salmonella enterica enterica serovar Typhi
ggcccgguaagcgcagcgcc

SEQ ID NO: 1679282 - RNA, 22 nt, Salmonella enterica enterica serovar Typhi
ggcccgguaagcacaacgcauu

SEQ ID NO: 1679283 - RNA, 22 nt, Salmonella enterica enterica serovar Typhi
ggcagccggauuuuaaauuggu

SEQ ID NO: 1679284 - RNA, 15 nt, Salmonella enterica enterica serovar Typhi
ggcagccgacagcgu

SEQ ID NO: 1679285 - RNA, 16 nt, Salmonella enterica enterica serovar Typhi
ggcagccgccaccaca

SEQ ID NO: 1679286 - RNA, 16 nt, Salmonella enterica enterica serovar Typhi
ggcagaucgcgcuccc

SEQ ID NO: 1679287 - RNA, 13 nt, Salmonella enterica enterica serovar Typhi
ggcagauucuucu

SEQ ID NO: 1679288 - RNA, 19 nt, Salmonella enterica enterica serovar Typhi
ggcaagccgaucagcgugu

SEQ ID NO: 1679289 - RNA, 15 nt, Salmonella enterica enterica serovar Typhi
ggcaagcgaagcgcu

SEQ ID NO: 1679290 - RNA, 10 nt, Salmonella enterica enterica serovar Typhi
ggcagaaccu

SEQ ID NO: 1679291 - RNA, 14 nt, Salmonella enterica enterica serovar Typhi
ggcagagcgcgcuc

SEQ ID NO: 1679292 - RNA, 19 nt, Salmonella enterica enterica serovar Typhi
ggcagagcgcgcucugccu

SEQ ID NO: 1679293 - RNA, 15 nt, Salmonella enterica enterica serovar Typhi
ggcagcgccagcggu

SEQ ID NO: 1679294 - RNA, 12 nt, Salmonella enterica enterica serovar Typhi
aaaguagccaau

SEQ ID NO: 1679295 - RNA, 20 nt, Salmonella enterica enterica serovar Typhi
ggcagcuuccagcaaaccuu

SEQ ID NO: 1679296 - RNA, 15 nt, Salmonella enterica enterica serovar Typhi
ggcaggcagcgccag

SEQ ID NO: 1679297 - RNA, 16 nt, Salmonella enterica enterica serovar Typhi
ggcaggcauggccaau

SEQ ID NO: 1679298 - RNA, 15 nt, Salmonella enterica enterica serovar Typhi
ggcaggccuaacaca

SEQ ID NO: 1679299 - RNA, 11 nt, Salmonella enterica enterica serovar Typhi
ggcaggcuggu

SEQ ID NO: 1679300 - RNA, 17 nt, Salmonella enterica enterica serovar Typhi
ggcaucagacgguggcc

SEQ ID NO: 1679301 - RNA, 19 nt, Salmonella enterica enterica serovar Typhi
ggcauccagcgcucaauca

SEQ ID NO: 1679302 - RNA, 17 nt, Salmonella enterica enterica serovar Typhi
ggcagguaucgauacag

SEQ ID NO: 1679303 - RNA, 19 nt, Salmonella enterica enterica serovar Typhi
ggcaucucaucuugcagga

SEQ ID NO: 1679304 - RNA, 21 nt, Salmonella enterica enterica serovar Typhi
ggcaucgggauuuacaaccgc

SEQ ID NO: 1679305 - RNA, 18 nt, Salmonella enterica enterica serovar Typhi
ggcaucggaaccggggcg

SEQ ID NO: 1679306 - RNA, 14 nt, Salmonella enterica enterica serovar Typhi
ggcaucgucggcga

SEQ ID NO: 1679307 - RNA, 11 nt, Salmonella enterica enterica serovar Typhi
ggcaucucaag

SEQ ID NO: 1679308 - RNA, 19 nt, Salmonella enterica enterica serovar Typhi
ggcauucgaauccuccugu

SEQ ID NO: 1679309 - RNA, 15 nt, Salmonella enterica enterica serovar Typhi
ggcauggcagcaggg

SEQ ID NO: 1679310 - RNA, 20 nt, Salmonella enterica enterica serovar Typhi
ggcauggaugcaugagcacg

SEQ ID NO: 1679311 - RNA, 17 nt, Salmonella enterica enterica serovar Typhi
ggcauuccgcuggugcg

SEQ ID NO: 1679312 - RNA, 14 nt, Salmonella enterica enterica serovar Typhi
ggcauuauguuuug

SEQ ID NO: 1679313 - RNA, 13 nt, Salmonella enterica enterica serovar Typhi
ggccaauccugca

SEQ ID NO: 1679314 - RNA, 13 nt, Salmonella enterica enterica serovar Typhi
ggccaagcgccug

SEQ ID NO: 1679315 - RNA, 17 nt, Salmonella enterica enterica serovar Typhi
ggccaagcgccuguuca

SEQ ID NO: 1679316 - RNA, 20 nt, Salmonella enterica enterica serovar Typhi
ggccaauguacguaaaacca

SEQ ID NO: 1679317 - RNA, 20 nt, Salmonella enterica enterica serovar Typhi
ggccacugcccuggaagaac

SEQ ID NO: 1679318 - RNA, 20 nt, Salmonella enterica enterica serovar Typhi
ggccagauaaguuugcagau

SEQ ID NO: 1679319 - RNA, 18 nt, Salmonella enterica enterica serovar Typhi
ggccagauaguggcugag

SEQ ID NO: 1679320 - RNA, 18 nt, Salmonella enterica enterica serovar Typhi
gcuggcaaaacgcaucca

SEQ ID NO: 1679321 - RNA, 15 nt, Salmonella enterica enterica serovar Typhi
gcuggcacguucucg

SEQ ID NO: 1679322 - RNA, 16 nt, Salmonella enterica enterica serovar Typhi
gcuggucgccagcgcc

SEQ ID NO: 1679323 - RNA, 19 nt, Salmonella enterica enterica serovar Typhi
gcuggucgccgcccaucgg

SEQ ID NO: 1679324 - RNA, 15 nt, Salmonella enterica enterica serovar Typhi
gcuggugaucuggcc

SEQ ID NO: 1679325 - RNA, 15 nt, Salmonella enterica enterica serovar Typhi
gcuggugaagacgcu

SEQ ID NO: 1679326 - RNA, 19 nt, Salmonella enterica enterica serovar Typhi
gcuggugccaaucuccagc

SEQ ID NO: 1679327 - RNA, 13 nt, Salmonella enterica enterica serovar Typhi
gcuggugcagccc

SEQ ID NO: 1679328 - RNA, 14 nt, Salmonella enterica enterica serovar Typhi
gcuguaucacgacu

SEQ ID NO: 1679329 - RNA, 22 nt, Salmonella enterica enterica serovar Typhi
gcuguagcguuucacgcgcgcc

SEQ ID NO: 1679330 - RNA, 14 nt, Salmonella enterica enterica serovar Typhi
gcuguacuuuugcu

SEQ ID NO: 1679331 - RNA, 23 nt, Salmonella enterica enterica serovar Typhi
gcuguuuuucaucaucauccaga

SEQ ID NO: 1679332 - RNA, 15 nt, Salmonella enterica enterica serovar Typhi
gcuuaaaaaauccug

SEQ ID NO: 1679333 - RNA, 13 nt, Salmonella enterica enterica serovar Typhi
gcuguuuuuuguu

SEQ ID NO: 1679334 - RNA, 18 nt, Salmonella enterica enterica serovar Typhi
gcuguugucgauauuaaa

SEQ ID NO: 1679335 - RNA, 15 nt, Salmonella enterica enterica serovar Typhi
gcuguuguuccagau

SEQ ID NO: 1679336 - RNA, 18 nt, Salmonella enterica enterica serovar Typhi
gcuguuuauccacaggcg

SEQ ID NO: 1679337 - RNA, 15 nt, Salmonella enterica enterica serovar Typhi
gcuuacaauuuaucu

SEQ ID NO: 1679338 - RNA, 18 nt, Salmonella enterica enterica serovar Typhi
gcuuacaauuuaucugcg

SEQ ID NO: 1679339 - RNA, 21 nt, Salmonella enterica enterica serovar Typhi
gcuuaauacgcagaucuuuuu

SEQ ID NO: 1679340 - RNA, 16 nt, Salmonella enterica enterica serovar Typhi
gcuuaaugcucugcug

SEQ ID NO: 1679341 - RNA, 19 nt, Salmonella enterica enterica serovar Typhi
gcuuaagcuuugcaccacu

SEQ ID NO: 1679342 - RNA, 23 nt, Salmonella enterica enterica serovar Typhi
gcuuaacccugccguuugcgcca

SEQ ID NO: 1679343 - RNA, 16 nt, Salmonella enterica enterica serovar Typhi
gcuuaacuucugcagg

SEQ ID NO: 1679344 - RNA, 20 nt, Salmonella enterica enterica serovar Typhi
gcuuaaacauauacugcugu

SEQ ID NO: 1679345 - RNA, 22 nt, Salmonella enterica enterica serovar Typhi
gcuguccagauagggccaggcg

SEQ ID NO: 1679346 - RNA, 14 nt, Salmonella enterica enterica serovar Typhi
gcuguccagccgcc

SEQ ID NO: 1679347 - RNA, 15 nt, Salmonella enterica enterica serovar Typhi
gcugucccaguguca

SEQ ID NO: 1679348 - RNA, 14 nt, Salmonella enterica enterica serovar Typhi
gcuguccagucaaa

SEQ ID NO: 1679349 - RNA, 12 nt, Salmonella enterica enterica serovar Typhi
gcugucccagag

SEQ ID NO: 1679350 - RNA, 15 nt, Salmonella enterica enterica serovar Typhi
gcuguguucauccca

SEQ ID NO: 1679351 - RNA, 16 nt, Salmonella enterica enterica serovar Typhi
gcuguguccaggucau

SEQ ID NO: 1679352 - RNA, 15 nt, Salmonella enterica enterica serovar Typhi
gcuguguccgccaug

SEQ ID NO: 1679353 - RNA, 19 nt, Salmonella enterica enterica serovar Typhi
gcuguuaaaaccggcugcc

SEQ ID NO: 1679354 - RNA, 17 nt, Salmonella enterica enterica serovar Typhi
gcuguuaaucucauaaa

SEQ ID NO: 1679355 - RNA, 15 nt, Salmonella enterica enterica serovar Typhi
gcuguggucgucugg

SEQ ID NO: 1679356 - RNA, 15 nt, Salmonella enterica enterica serovar Typhi
gcuguucagcagaau

SEQ ID NO: 1679357 - RNA, 19 nt, Salmonella enterica enterica serovar Typhi
gcuguuccuucagaaaauu

SEQ ID NO: 1679358 - RNA, 18 nt, Salmonella enterica enterica serovar Typhi
gcuguugaggaaauucug

SEQ ID NO: 1679359 - RNA, 17 nt, Salmonella enterica enterica serovar Typhi
gcuguuaguaagcuggg

SEQ ID NO: 1679360 - RNA, 17 nt, Salmonella enterica enterica serovar Typhi
gcuguuaaccuugcgcc

SEQ ID NO: 1679361 - RNA, 23 nt, Salmonella enterica enterica serovar Typhi
gcuguuaccaaugccaaaaaaac

SEQ ID NO: 1679362 - RNA, 13 nt, Salmonella enterica enterica serovar Typhi
gcuguuccacggg

SEQ ID NO: 1679363 - RNA, 22 nt, Salmonella enterica enterica serovar Typhi
gcuguucaaucacugaugccac

SEQ ID NO: 1679364 - RNA, 14 nt, Salmonella enterica enterica serovar Typhi
gcuucaccgccaga

SEQ ID NO: 1679365 - RNA, 16 nt, Salmonella enterica enterica serovar Typhi
gcuucaccgccagagc

SEQ ID NO: 1679366 - RNA, 18 nt, Salmonella enterica enterica serovar Typhi
gcuucaccgauuuaaaau

SEQ ID NO: 1679367 - RNA, 19 nt, Salmonella enterica enterica serovar Typhi
gcuucacgaagcggguuuu

SEQ ID NO: 1679368 - RNA, 21 nt, Salmonella enterica enterica serovar Typhi
gcuucagaaagcagguuuuga

SEQ ID NO: 1679369 - RNA, 19 nt, Salmonella enterica enterica serovar Typhi
gcuucagacaacgccgccu

SEQ ID NO: 1679370 - RNA, 16 nt, Salmonella enterica enterica serovar Typhi
gcuucacgucagcgac

SEQ ID NO: 1679371 - RNA, 17 nt, Salmonella enterica enterica serovar Typhi
gcuucacuaacugguac

SEQ ID NO: 1679372 - RNA, 17 nt, Salmonella enterica enterica serovar Typhi
gcuucagcaucaucucc

SEQ ID NO: 1679373 - RNA, 18 nt, Salmonella enterica enterica serovar Typhi
gcuucacguuuuccaggu

SEQ ID NO: 1679374 - RNA, 22 nt, Salmonella enterica enterica serovar Typhi
gcuucacgcgcuguaacuucac

SEQ ID NO: 1679375 - RNA, 17 nt, Salmonella enterica enterica serovar Typhi
gcuucacgagcggucag

SEQ ID NO: 1679376 - RNA, 18 nt, Salmonella enterica enterica serovar Typhi
gcuucaacagcggcggca

SEQ ID NO: 1679377 - RNA, 19 nt, Salmonella enterica enterica serovar Typhi
gcuucaaccguuucuuuuu

SEQ ID NO: 1679378 - RNA, 14 nt, Salmonella enterica enterica serovar Typhi
gcuucaaccuccug

SEQ ID NO: 1679379 - RNA, 17 nt, Salmonella enterica enterica serovar Typhi
gcuucaacagcggcggc

SEQ ID NO: 1679380 - RNA, 14 nt, Salmonella enterica enterica serovar Typhi
gcuuaucugaccau

SEQ ID NO: 1679381 - RNA, 21 nt, Salmonella enterica enterica serovar Typhi
gcuuaucugcugcuggguuga

SEQ ID NO: 1679382 - RNA, 16 nt, Salmonella enterica enterica serovar Typhi
gcuuaguaaccccagg

SEQ ID NO: 1679383 - RNA, 17 nt, Salmonella enterica enterica serovar Typhi
gcuuauccggccugcac

SEQ ID NO: 1679384 - RNA, 23 nt, Salmonella enterica enterica serovar Typhi
gcuuaucgauaucugccugcaga

SEQ ID NO: 1679385 - RNA, 22 nt, Salmonella enterica enterica serovar Typhi
gcuuaucaggccuacauuuuua

SEQ ID NO: 1679386 - RNA, 18 nt, Salmonella enterica enterica serovar Typhi
gcuuaucaggccuaccag

SEQ ID NO: 1679387 - RNA, 14 nt, Salmonella enterica enterica serovar Typhi
gcuuacauuucagg

SEQ ID NO: 1679388 - RNA, 22 nt, Salmonella enterica enterica serovar Typhi
gcuuacauuucaggcaaaaaaa

SEQ ID NO: 1679389 - RNA, 17 nt, Salmonella enterica enterica serovar Typhi
gcuuacgcggcgcgcuc

SEQ ID NO: 1679390 - RNA, 23 nt, Salmonella enterica enterica serovar Typhi
gcuuacggccauggaacauccuc

SEQ ID NO: 1679391 - RNA, 18 nt, Salmonella enterica enterica serovar Typhi
gcuuaccuuguucuucca

SEQ ID NO: 1679392 - RNA, 22 nt, Salmonella enterica enterica serovar Typhi
gcuuagaacucacgcucaagau

SEQ ID NO: 1679393 - RNA, 21 nt, Salmonella enterica enterica serovar Typhi
gcuuacuuuccaaaauccagg

SEQ ID NO: 1679394 - RNA, 17 nt, Salmonella enterica enterica serovar Typhi
gcuuccggcacuuucag

SEQ ID NO: 1679395 - RNA, 14 nt, Salmonella enterica enterica serovar Typhi
gcuuccgccgggaa

SEQ ID NO: 1679396 - RNA, 15 nt, Salmonella enterica enterica serovar Typhi
gcuuccguccccagc

SEQ ID NO: 1679397 - RNA, 13 nt, Salmonella enterica enterica serovar Typhi
gcuuccuggaugu

SEQ ID NO: 1679398 - RNA, 16 nt, Salmonella enterica enterica serovar Typhi
gcuucccgaugccagc

SEQ ID NO: 1679399 - RNA, 18 nt, Salmonella enterica enterica serovar Typhi
gcuucccgaugccagcaa

SEQ ID NO: 1679400 - RNA, 16 nt, Salmonella enterica enterica serovar Typhi
gcuucccgaaaggaag

SEQ ID NO: 1679401 - RNA, 19 nt, Salmonella enterica enterica serovar Typhi
gcuucccacagucggcgaa

SEQ ID NO: 1679402 - RNA, 17 nt, Salmonella enterica enterica serovar Typhi
gcuuccaccucuucugc

SEQ ID NO: 1679403 - RNA, 20 nt, Salmonella enterica enterica serovar Typhi
gcuuccacgcacgccggccc

SEQ ID NO: 1679404 - RNA, 22 nt, Salmonella enterica enterica serovar Typhi
gcuuccagcaaaccuuccgcca

SEQ ID NO: 1679405 - RNA, 19 nt, Salmonella enterica enterica serovar Typhi
gcuucauugguuaauucaa

SEQ ID NO: 1679406 - RNA, 19 nt, Salmonella enterica enterica serovar Typhi
gcuucagccugugcaacca

SEQ ID NO: 1679407 - RNA, 16 nt, Salmonella enterica enterica serovar Typhi
gcuucagcggcgcguu

SEQ ID NO: 1679408 - RNA, 22 nt, Salmonella enterica enterica serovar Typhi
gcuucgucccugcauuauccac

SEQ ID NO: 1679409 - RNA, 19 nt, Salmonella enterica enterica serovar Typhi
gcuucgucaggcggcugcg

SEQ ID NO: 1679410 - RNA, 17 nt, Salmonella enterica enterica serovar Typhi
gcuucgucaggcggcug

SEQ ID NO: 1679411 - RNA, 18 nt, Salmonella enterica enterica serovar Typhi
gcuucgucaggcggcugc

SEQ ID NO: 1679412 - RNA, 17 nt, Salmonella enterica enterica serovar Typhi
gcuucgcucucgugcca

SEQ ID NO: 1679413 - RNA, 24 nt, Salmonella enterica enterica serovar Typhi
gcuucgcgaacugcacucggaugu

SEQ ID NO: 1679414 - RNA, 13 nt, Salmonella enterica enterica serovar Typhi
gcuucgccaauaa

SEQ ID NO: 1679415 - RNA, 15 nt, Salmonella enterica enterica serovar Typhi
gcuucuggcguaaug

SEQ ID NO: 1679416 - RNA, 16 nt, Salmonella enterica enterica serovar Typhi
gcuucugucagccuug

SEQ ID NO: 1679417 - RNA, 16 nt, Salmonella enterica enterica serovar Typhi
gcuucugucugcguga

SEQ ID NO: 1679418 - RNA, 20 nt, Salmonella enterica enterica serovar Typhi
gcuucguuaccgccuuuuuu

SEQ ID NO: 1679419 - RNA, 22 nt, Salmonella enterica enterica serovar Typhi
gcuucguuccgcgauuuccugu

SEQ ID NO: 1679420 - RNA, 20 nt, Salmonella enterica enterica serovar Typhi
gcuucuccaccauaucgcag

SEQ ID NO: 1679421 - RNA, 22 nt, Salmonella enterica enterica serovar Typhi
gcuugccgucacaggcggccag

SEQ ID NO: 1679422 - RNA, 14 nt, Salmonella enterica enterica serovar Typhi
gcuugcggguuuug

SEQ ID NO: 1679423 - RNA, 21 nt, Salmonella enterica enterica serovar Typhi
gcuugcccggccuacauucau

SEQ ID NO: 1679424 - RNA, 14 nt, Salmonella enterica enterica serovar Typhi
gcuugcccggccgu

SEQ ID NO: 1679425 - RNA, 16 nt, Salmonella enterica enterica serovar Typhi
gcuugcccagcauauu

SEQ ID NO: 1679426 - RNA, 23 nt, Salmonella enterica enterica serovar Typhi
gcuugcagcguaauagucugcuc

SEQ ID NO: 1679427 - RNA, 20 nt, Salmonella enterica enterica serovar Typhi
gcuugaucucucccuggcag

SEQ ID NO: 1679428 - RNA, 19 nt, Salmonella enterica enterica serovar Typhi
gcuugaguuuuccgccauu

SEQ ID NO: 1679429 - RNA, 12 nt, Salmonella enterica enterica serovar Typhi
gcuugauaaaua

SEQ ID NO: 1679430 - RNA, 15 nt, Salmonella enterica enterica serovar Typhi
gcuugacucugaagc

SEQ ID NO: 1679431 - RNA, 17 nt, Salmonella enterica enterica serovar Typhi
gcuugagacagaccaca

SEQ ID NO: 1679432 - RNA, 17 nt, Salmonella enterica enterica serovar Typhi
gcuugaauaacauaaag

SEQ ID NO: 1679433 - RNA, 13 nt, Salmonella enterica enterica serovar Typhi
aaaggccagcagc

SEQ ID NO: 1679434 - RNA, 13 nt, Salmonella enterica enterica serovar Typhi
aaaggcagaagaa

SEQ ID NO: 1679435 - RNA, 19 nt, Salmonella enterica enterica serovar Typhi
gcuugcuuuucaucaccau

SEQ ID NO: 1679436 - RNA, 17 nt, Salmonella enterica enterica serovar Typhi
gcuuggcggcuuccugu

SEQ ID NO: 1679437 - RNA, 14 nt, Salmonella enterica enterica serovar Typhi
gcuugucacgaagc

SEQ ID NO: 1679438 - RNA, 17 nt, Salmonella enterica enterica serovar Typhi
gcuugucgccaugcacc

SEQ ID NO: 1679439 - RNA, 19 nt, Salmonella enterica enterica serovar Typhi
gcuugucgcgagcuuccag

SEQ ID NO: 1679440 - RNA, 20 nt, Salmonella enterica enterica serovar Typhi
aaaggcgccgcuucccccgg

SEQ ID NO: 1679441 - RNA, 16 nt, Salmonella enterica enterica serovar Typhi
aaaggccuggcugaga

SEQ ID NO: 1679442 - RNA, 22 nt, Salmonella enterica enterica serovar Typhi
aaaggcguguguuuagauaaca

SEQ ID NO: 1679443 - RNA, 14 nt, Salmonella enterica enterica serovar Typhi
aaaggcuaccgguu

SEQ ID NO: 1679444 - RNA, 14 nt, Salmonella enterica enterica serovar Typhi
gcuuggugacguag

SEQ ID NO: 1679445 - RNA, 18 nt, Salmonella enterica enterica serovar Typhi
gcuuucacgccauuggca

SEQ ID NO: 1679446 - RNA, 13 nt, Salmonella enterica enterica serovar Typhi
gcuuuaugcacgc

SEQ ID NO: 1679447 - RNA, 20 nt, Salmonella enterica enterica serovar Typhi
gcuuucaguaauaauauaaa

SEQ ID NO: 1679448 - RNA, 19 nt, Salmonella enterica enterica serovar Typhi
gcuuucaguaauaauauaa

SEQ ID NO: 1679449 - RNA, 12 nt, Salmonella enterica enterica serovar Typhi
gcuuuccagcuc

SEQ ID NO: 1679450 - RNA, 14 nt, Salmonella enterica enterica serovar Typhi
gcuuuccgccgccg

SEQ ID NO: 1679451 - RNA, 16 nt, Salmonella enterica enterica serovar Typhi
gcuuuccgccaugaaa

SEQ ID NO: 1679452 - RNA, 20 nt, Salmonella enterica enterica serovar Typhi
gcuuuccgccaugaaaaaaa

SEQ ID NO: 1679453 - RNA, 21 nt, Salmonella enterica enterica serovar Typhi
gcuuuccgccaugaaaaaaac

SEQ ID NO: 1679454 - RNA, 15 nt, Salmonella enterica enterica serovar Typhi
gcuuucccuucagau

SEQ ID NO: 1679455 - RNA, 22 nt, Salmonella enterica enterica serovar Typhi
gcuuucccguuucagccccuug

SEQ ID NO: 1679456 - RNA, 15 nt, Salmonella enterica enterica serovar Typhi
gcuuguuaucuggca

SEQ ID NO: 1679457 - RNA, 18 nt, Salmonella enterica enterica serovar Typhi
gcuuguuucacuguagcu

SEQ ID NO: 1679458 - RNA, 16 nt, Salmonella enterica enterica serovar Typhi
gcuuuaaauucagcac

SEQ ID NO: 1679459 - RNA, 13 nt, Salmonella enterica enterica serovar Typhi
gcuuuaaguuuuu

SEQ ID NO: 1679460 - RNA, 17 nt, Salmonella enterica enterica serovar Typhi
gcuuuaacgcugcaaag

SEQ ID NO: 1679461 - RNA, 14 nt, Salmonella enterica enterica serovar Typhi
gcuuuaauauucau

SEQ ID NO: 1679462 - RNA, 18 nt, Salmonella enterica enterica serovar Typhi
gcuuuaauauucauucug

SEQ ID NO: 1679463 - RNA, 15 nt, Salmonella enterica enterica serovar Typhi
gcuuuaaucaccaug

SEQ ID NO: 1679464 - RNA, 23 nt, Salmonella enterica enterica serovar Typhi
gcuuuaaucacccgcgccagcag

SEQ ID NO: 1679465 - RNA, 20 nt, Salmonella enterica enterica serovar Typhi
gcuuuaaucaguucauagcc

SEQ ID NO: 1679466 - RNA, 22 nt, Salmonella enterica enterica serovar Typhi
gcuuuacccgggccaucuuuuu

SEQ ID NO: 1679467 - RNA, 20 nt, Salmonella enterica enterica serovar Typhi
gcuuuaggguaucauuucca

SEQ ID NO: 1679468 - RNA, 16 nt, Salmonella enterica enterica serovar Typhi
gcuuuagcuuuacucu

SEQ ID NO: 1679469 - RNA, 15 nt, Salmonella enterica enterica serovar Typhi
gcuuuagggcuuccu

SEQ ID NO: 1679470 - RNA, 20 nt, Salmonella enterica enterica serovar Typhi
gcuccaugcugucgucgaca

SEQ ID NO: 1679471 - RNA, 18 nt, Salmonella enterica enterica serovar Typhi
gcuccauccaccagcccc

SEQ ID NO: 1679472 - RNA, 16 nt, Salmonella enterica enterica serovar Typhi
gcuccaguuguuccag

SEQ ID NO: 1679473 - RNA, 15 nt, Salmonella enterica enterica serovar Typhi
gcuccauccaccagc

SEQ ID NO: 1679474 - RNA, 22 nt, Salmonella enterica enterica serovar Typhi
gcuccaucacgguaaaccuguu

SEQ ID NO: 1679475 - RNA, 20 nt, Salmonella enterica enterica serovar Typhi
gcuccaguuguuccagcagc

SEQ ID NO: 1679476 - RNA, 19 nt, Salmonella enterica enterica serovar Typhi
gcuccauagaaaucagcag

SEQ ID NO: 1679477 - RNA, 15 nt, Salmonella enterica enterica serovar Typhi
gcuccgccagcaaug

SEQ ID NO: 1679478 - RNA, 22 nt, Salmonella enterica enterica serovar Typhi
gcuccgagacucaaagaaaaca

SEQ ID NO: 1679479 - RNA, 19 nt, Salmonella enterica enterica serovar Typhi
gcuccgaauaauccuuccc

SEQ ID NO: 1679480 - RNA, 23 nt, Salmonella enterica enterica serovar Typhi
gcuccgaauaauccuucccgcua

SEQ ID NO: 1679481 - RNA, 21 nt, Salmonella enterica enterica serovar Typhi
gcucccuucccccagaaugcc

SEQ ID NO: 1679482 - RNA, 21 nt, Salmonella enterica enterica serovar Typhi
gcucccuuauacaggcgcagg

SEQ ID NO: 1679483 - RNA, 20 nt, Salmonella enterica enterica serovar Typhi
gcuccguucccucgacaauu

SEQ ID NO: 1679484 - RNA, 19 nt, Salmonella enterica enterica serovar Typhi
gcuccgcgccgaaauuuuc

SEQ ID NO: 1679485 - RNA, 16 nt, Salmonella enterica enterica serovar Typhi
gcuccgggccaugauc

SEQ ID NO: 1679486 - RNA, 15 nt, Salmonella enterica enterica serovar Typhi
gcuccagcccgccgc

SEQ ID NO: 1679487 - RNA, 13 nt, Salmonella enterica enterica serovar Typhi
gcuccaauaaaua

SEQ ID NO: 1679488 - RNA, 17 nt, Salmonella enterica enterica serovar Typhi
gcucaugauagggcagc

SEQ ID NO: 1679489 - RNA, 19 nt, Salmonella enterica enterica serovar Typhi
gcucaugauagggcagcag

SEQ ID NO: 1679490 - RNA, 17 nt, Salmonella enterica enterica serovar Typhi
gcucauuuuauccaaca

SEQ ID NO: 1679491 - RNA, 22 nt, Salmonella enterica enterica serovar Typhi
gcucauuugcggcgucgccugg

SEQ ID NO: 1679492 - RNA, 24 nt, Salmonella enterica enterica serovar Typhi
gcucaugacaucgcccugggucac

SEQ ID NO: 1679493 - RNA, 13 nt, Salmonella enterica enterica serovar Typhi
gcucaucucaagc

SEQ ID NO: 1679494 - RNA, 22 nt, Salmonella enterica enterica serovar Typhi
gcucaucaaacagcggcacuuc

SEQ ID NO: 1679495 - RNA, 13 nt, Salmonella enterica enterica serovar Typhi
gcucauccagcaa

SEQ ID NO: 1679496 - RNA, 17 nt, Salmonella enterica enterica serovar Typhi
gcucaucaggcgugccc

SEQ ID NO: 1679497 - RNA, 13 nt, Salmonella enterica enterica serovar Typhi
gcgguaucaaugc

SEQ ID NO: 1679498 - RNA, 18 nt, Salmonella enterica enterica serovar Typhi
gcgguaauaacugacaga

SEQ ID NO: 1679499 - RNA, 12 nt, Salmonella enterica enterica serovar Typhi
gcuccuggaacc

SEQ ID NO: 1679500 - RNA, 15 nt, Salmonella enterica enterica serovar Typhi
gcuccugcgggcuua

SEQ ID NO: 1679501 - RNA, 15 nt, Salmonella enterica enterica serovar Typhi
gcuccugccagauuu

SEQ ID NO: 1679502 - RNA, 18 nt, Salmonella enterica enterica serovar Typhi
gcuccuugauugcaagaa

SEQ ID NO: 1679503 - RNA, 16 nt, Salmonella enterica enterica serovar Typhi
gcucgaguucuucacg

SEQ ID NO: 1679504 - RNA, 20 nt, Salmonella enterica enterica serovar Typhi
gcucgacguccagcgcguga

SEQ ID NO: 1679505 - RNA, 19 nt, Salmonella enterica enterica serovar Typhi
gcucgaucccgacccauac

SEQ ID NO: 1679506 - RNA, 20 nt, Salmonella enterica enterica serovar Typhi
gcucgccagcauacgucugc

SEQ ID NO: 1679507 - RNA, 22 nt, Salmonella enterica enterica serovar Typhi
gcucgccagcgcugucagugaa

SEQ ID NO: 1679508 - RNA, 13 nt, Salmonella enterica enterica serovar Typhi
gcucgccagcgcu

SEQ ID NO: 1679509 - RNA, 14 nt, Salmonella enterica enterica serovar Typhi
gcucgcccgccgca

SEQ ID NO: 1679510 - RNA, 20 nt, Salmonella enterica enterica serovar Typhi
gcucgccgaccggcgcgccg

SEQ ID NO: 1679511 - RNA, 18 nt, Salmonella enterica enterica serovar Typhi
gcucgccgccucccccuc

SEQ ID NO: 1679512 - RNA, 19 nt, Salmonella enterica enterica serovar Typhi
gcucgccgaccggcgcgcc

SEQ ID NO: 1679513 - RNA, 19 nt, Salmonella enterica enterica serovar Typhi
gcucgccguuuuuuaaccg

SEQ ID NO: 1679514 - RNA, 18 nt, Salmonella enterica enterica serovar Typhi
gcucgcuaccuuuuuuca

SEQ ID NO: 1679515 - RNA, 22 nt, Salmonella enterica enterica serovar Typhi
gcucgcuaugaaaacgcagccc

SEQ ID NO: 1679516 - RNA, 19 nt, Salmonella enterica enterica serovar Typhi
gcucgcuuacgcggcgcgc

SEQ ID NO: 1679517 - RNA, 11 nt, Salmonella enterica enterica serovar Typhi
gcucgcuggug

SEQ ID NO: 1679518 - RNA, 15 nt, Salmonella enterica enterica serovar Typhi
gcucgguaaaaaguu

SEQ ID NO: 1679519 - RNA, 15 nt, Salmonella enterica enterica serovar Typhi
gcucgcuuugccgcc

SEQ ID NO: 1679520 - RNA, 22 nt, Salmonella enterica enterica serovar Typhi
gcucuccuccaaagguauggag

SEQ ID NO: 1679521 - RNA, 13 nt, Salmonella enterica enterica serovar Typhi
gcucuccuggcau

SEQ ID NO: 1679522 - RNA, 22 nt, Salmonella enterica enterica serovar Typhi
gcucuccggcacauucaccacg

SEQ ID NO: 1679523 - RNA, 20 nt, Salmonella enterica enterica serovar Typhi
gcucuaucgccgcccgcaug

SEQ ID NO: 1679524 - RNA, 14 nt, Salmonella enterica enterica serovar Typhi
gcugcgccagcgca

SEQ ID NO: 1679525 - RNA, 13 nt, Salmonella enterica enterica serovar Typhi
gcugcgcauccgc

SEQ ID NO: 1679526 - RNA, 13 nt, Salmonella enterica enterica serovar Typhi
gcugcgacaacaa

SEQ ID NO: 1679527 - RNA, 15 nt, Salmonella enterica enterica serovar Typhi
gcugcgacagcgaac

SEQ ID NO: 1679528 - RNA, 19 nt, Salmonella enterica enterica serovar Typhi
gcugccggaaagggaagag

SEQ ID NO: 1679529 - RNA, 15 nt, Salmonella enterica enterica serovar Typhi
gcugccgcccuuucc

SEQ ID NO: 1679530 - RNA, 21 nt, Salmonella enterica enterica serovar Typhi
gcugccgccauuugcgcggcu

SEQ ID NO: 1679531 - RNA, 19 nt, Salmonella enterica enterica serovar Typhi
gcugccgauacuccauugu

SEQ ID NO: 1679532 - RNA, 9 nt, Salmonella enterica enterica serovar Typhi
gcugccgca

SEQ ID NO: 1679533 - RNA, 16 nt, Salmonella enterica enterica serovar Typhi
gcugccgaucagauug

SEQ ID NO: 1679534 - RNA, 22 nt, Salmonella enterica enterica serovar Typhi
gcugccgacaacgccuccugcc

SEQ ID NO: 1679535 - RNA, 13 nt, Salmonella enterica enterica serovar Typhi
gcugccagcugcg

SEQ ID NO: 1679536 - RNA, 22 nt, Salmonella enterica enterica serovar Typhi
gcugcgccugaaaggcacgcuc

SEQ ID NO: 1679537 - RNA, 12 nt, Salmonella enterica enterica serovar Typhi
gcugcgccgcgc

SEQ ID NO: 1679538 - RNA, 13 nt, Salmonella enterica enterica serovar Typhi
gcugcgccguucc

SEQ ID NO: 1679539 - RNA, 17 nt, Salmonella enterica enterica serovar Typhi
gcugcgcuuaccgggcc

SEQ ID NO: 1679540 - RNA, 13 nt, Salmonella enterica enterica serovar Typhi
gcugcgcucagaa

SEQ ID NO: 1679541 - RNA, 21 nt, Salmonella enterica enterica serovar Typhi
gcugcucauuuaugcgcuggg

SEQ ID NO: 1679542 - RNA, 18 nt, Salmonella enterica enterica serovar Typhi
gcugcuauuucaguggcu

SEQ ID NO: 1679543 - RNA, 17 nt, Salmonella enterica enterica serovar Typhi
gcugcuauuuugcgcuu

SEQ ID NO: 1679544 - RNA, 18 nt, Salmonella enterica enterica serovar Typhi
gcugcguucggaagacug

SEQ ID NO: 1679545 - RNA, 21 nt, Salmonella enterica enterica serovar Typhi
gcugcguucggaagacugcuc

SEQ ID NO: 1679546 - RNA, 19 nt, Salmonella enterica enterica serovar Typhi
gcugcggaacaccagcgcc

SEQ ID NO: 1679547 - RNA, 14 nt, Salmonella enterica enterica serovar Typhi
gcugcgcugccagc

SEQ ID NO: 1679548 - RNA, 14 nt, Salmonella enterica enterica serovar Typhi
gcuggaugaggcgc

SEQ ID NO: 1679549 - RNA, 17 nt, Salmonella enterica enterica serovar Typhi
gcuggaaugcccacucc

SEQ ID NO: 1679550 - RNA, 19 nt, Salmonella enterica enterica serovar Typhi
gcugcuggccuuccagaua

SEQ ID NO: 1679551 - RNA, 21 nt, Salmonella enterica enterica serovar Typhi
gcugcuggcgagcaggaaaag

SEQ ID NO: 1679552 - RNA, 15 nt, Salmonella enterica enterica serovar Typhi
gcugaaauagccccg

SEQ ID NO: 1679553 - RNA, 14 nt, Salmonella enterica enterica serovar Typhi
gcugaaagaagacg

SEQ ID NO: 1679554 - RNA, 16 nt, Salmonella enterica enterica serovar Typhi
gcucuccuggcauggc

SEQ ID NO: 1679555 - RNA, 15 nt, Salmonella enterica enterica serovar Typhi
gcugaagugcggaua

SEQ ID NO: 1679556 - RNA, 11 nt, Salmonella enterica enterica serovar Typhi
gcugaaccacc

SEQ ID NO: 1679557 - RNA, 22 nt, Salmonella enterica enterica serovar Typhi
gcugaaccacccugaaaaguua

SEQ ID NO: 1679558 - RNA, 19 nt, Salmonella enterica enterica serovar Typhi
gcugaauaaugccuuccug

SEQ ID NO: 1679559 - RNA, 18 nt, Salmonella enterica enterica serovar Typhi
gcugacacccucugcgcc

SEQ ID NO: 1679560 - RNA, 15 nt, Salmonella enterica enterica serovar Typhi
gcugacaaucugcug

SEQ ID NO: 1679561 - RNA, 17 nt, Salmonella enterica enterica serovar Typhi
gcugacacucauccaga

SEQ ID NO: 1679562 - RNA, 17 nt, Salmonella enterica enterica serovar Typhi
gcugacauccaucaucu

SEQ ID NO: 1679563 - RNA, 22 nt, Salmonella enterica enterica serovar Typhi
gcugacaggauacccggcucgc

SEQ ID NO: 1679564 - RNA, 15 nt, Salmonella enterica enterica serovar Typhi
gcugacgacauucag

SEQ ID NO: 1679565 - RNA, 16 nt, Salmonella enterica enterica serovar Typhi
gcugacgcccaucagc

SEQ ID NO: 1679566 - RNA, 13 nt, Salmonella enterica enterica serovar Typhi
gcugagaaaaaua

SEQ ID NO: 1679567 - RNA, 15 nt, Salmonella enterica enterica serovar Typhi
gcugacgacgccagc

SEQ ID NO: 1679568 - RNA, 16 nt, Salmonella enterica enterica serovar Typhi
gcugacgcagcaguuc

SEQ ID NO: 1679569 - RNA, 20 nt, Salmonella enterica enterica serovar Typhi
gcugauuuguuaucuacagu

SEQ ID NO: 1679570 - RNA, 15 nt, Salmonella enterica enterica serovar Typhi
gcugauuuguuaucu

SEQ ID NO: 1679571 - RNA, 21 nt, Salmonella enterica enterica serovar Typhi
gcugcagcuuaggauucgcca

SEQ ID NO: 1679572 - RNA, 14 nt, Salmonella enterica enterica serovar Typhi
gcugccacacucuc

SEQ ID NO: 1679573 - RNA, 19 nt, Salmonella enterica enterica serovar Typhi
gcugccacacucucuccag

SEQ ID NO: 1679574 - RNA, 19 nt, Salmonella enterica enterica serovar Typhi
gcugauuccggcgcaucca

SEQ ID NO: 1679575 - RNA, 18 nt, Salmonella enterica enterica serovar Typhi
gcugauguuugcgcucuu

SEQ ID NO: 1679576 - RNA, 16 nt, Salmonella enterica enterica serovar Typhi
gcugauguccgcagcc

SEQ ID NO: 1679577 - RNA, 16 nt, Salmonella enterica enterica serovar Typhi
gcugaugugcggccug

SEQ ID NO: 1679578 - RNA, 21 nt, Salmonella enterica enterica serovar Typhi
gcugaucgugauaggccagac

SEQ ID NO: 1679579 - RNA, 16 nt, Salmonella enterica enterica serovar Typhi
gcugauaggccuggau

SEQ ID NO: 1679580 - RNA, 16 nt, Salmonella enterica enterica serovar Typhi
gcugaucccgcgcgcc

SEQ ID NO: 1679581 - RNA, 16 nt, Salmonella enterica enterica serovar Typhi
uaaacuguuuccaguu

SEQ ID NO: 1679582 - RNA, 22 nt, Salmonella enterica enterica serovar Typhi
uaaacuucacgucgcucacauu

SEQ ID NO: 1679583 - RNA, 11 nt, Salmonella enterica enterica serovar Typhi
uaaacugccuu

SEQ ID NO: 1679584 - RNA, 15 nt, Salmonella enterica enterica serovar Typhi
uaaagaccggcacaa

SEQ ID NO: 1679585 - RNA, 19 nt, Salmonella enterica enterica serovar Typhi
uaaagaaugaaaaaaaaau

SEQ ID NO: 1679586 - RNA, 22 nt, Salmonella enterica enterica serovar Typhi
uaaacggcagccgccaccacaa

SEQ ID NO: 1679587 - RNA, 17 nt, Salmonella enterica enterica serovar Typhi
uaaacucaaucaggcua

SEQ ID NO: 1679588 - RNA, 18 nt, Salmonella enterica enterica serovar Typhi
uaaacucaucuuuauuca

SEQ ID NO: 1679589 - RNA, 17 nt, Salmonella enterica enterica serovar Typhi
uaaacuccauuaaauua

SEQ ID NO: 1679590 - RNA, 14 nt, Salmonella enterica enterica serovar Typhi
uaaacgccccuucg

SEQ ID NO: 1679591 - RNA, 13 nt, Salmonella enterica enterica serovar Typhi
uaaacgccugcac

SEQ ID NO: 1679592 - RNA, 15 nt, Salmonella enterica enterica serovar Typhi
uaaacgccugcacca

SEQ ID NO: 1679593 - RNA, 15 nt, Salmonella enterica enterica serovar Typhi
uaaacgcucaagcaa

SEQ ID NO: 1679594 - RNA, 19 nt, Salmonella enterica enterica serovar Typhi
uaaacgcgccaaguaaauu

SEQ ID NO: 1679595 - RNA, 19 nt, Salmonella enterica enterica serovar Typhi
uaaaccgucauuuaccagu

SEQ ID NO: 1679596 - RNA, 15 nt, Salmonella enterica enterica serovar Typhi
uaaaccguuaugaau

SEQ ID NO: 1679597 - RNA, 17 nt, Salmonella enterica enterica serovar Typhi
uaaaccaaacuuaucuc

SEQ ID NO: 1679598 - RNA, 21 nt, Salmonella enterica enterica serovar Typhi
uaaaccacaugaccagcgccg

SEQ ID NO: 1679599 - RNA, 16 nt, Salmonella enterica enterica serovar Typhi
uaaacagcuccgcaaa

SEQ ID NO: 1679600 - RNA, 12 nt, Salmonella enterica enterica serovar Typhi
uaaacagcagcg

SEQ ID NO: 1679601 - RNA, 15 nt, Salmonella enterica enterica serovar Typhi
uaaacacguuaucug

SEQ ID NO: 1679602 - RNA, 17 nt, Salmonella enterica enterica serovar Typhi
uaaacacguuaucugac

SEQ ID NO: 1679603 - RNA, 15 nt, Salmonella enterica enterica serovar Typhi
uaaacacuaaaucau

SEQ ID NO: 1679604 - RNA, 19 nt, Salmonella enterica enterica serovar Typhi
uaaacacucuccaccaaau

SEQ ID NO: 1679605 - RNA, 21 nt, Salmonella enterica enterica serovar Typhi
uaaacacucuccaccaaaucc

SEQ ID NO: 1679606 - RNA, 18 nt, Salmonella enterica enterica serovar Typhi
guuuuggguaaauaccag

SEQ ID NO: 1679607 - RNA, 20 nt, Salmonella enterica enterica serovar Typhi
guuuugguaucuucugacgg

SEQ ID NO: 1679608 - RNA, 16 nt, Salmonella enterica enterica serovar Typhi
guuuugcugucugggu

SEQ ID NO: 1679609 - RNA, 15 nt, Salmonella enterica enterica serovar Typhi
guuuuuaucuuucuu

SEQ ID NO: 1679610 - RNA, 13 nt, Salmonella enterica enterica serovar Typhi
guuuuucccggau

SEQ ID NO: 1679611 - RNA, 17 nt, Salmonella enterica enterica serovar Typhi
uaaacaacgccauaaua

SEQ ID NO: 1679612 - RNA, 14 nt, Salmonella enterica enterica serovar Typhi
uaaagcccugacag

SEQ ID NO: 1679613 - RNA, 15 nt, Salmonella enterica enterica serovar Typhi
uaaagcccugacaga

SEQ ID NO: 1679614 - RNA, 21 nt, Salmonella enterica enterica serovar Typhi
uaaagccgccauccggcauuu

SEQ ID NO: 1679615 - RNA, 19 nt, Salmonella enterica enterica serovar Typhi
uaaagccgccgugcucacu

SEQ ID NO: 1679616 - RNA, 13 nt, Salmonella enterica enterica serovar Typhi
uaaagaucugaug

SEQ ID NO: 1679617 - RNA, 18 nt, Salmonella enterica enterica serovar Typhi
uaaagauuggcaucugca

SEQ ID NO: 1679618 - RNA, 15 nt, Salmonella enterica enterica serovar Typhi
uaaagccaauccaga

SEQ ID NO: 1679619 - RNA, 17 nt, Salmonella enterica enterica serovar Typhi
uaaagcccagcacggca

SEQ ID NO: 1679620 - RNA, 19 nt, Salmonella enterica enterica serovar Typhi
uaaagcauagcgucaucaa

SEQ ID NO: 1679621 - RNA, 23 nt, Salmonella enterica enterica serovar Typhi
uaaagcauagcgucaucaacaua

SEQ ID NO: 1679622 - RNA, 13 nt, Salmonella enterica enterica serovar Typhi
uaaagucagcaag

SEQ ID NO: 1679623 - RNA, 21 nt, Salmonella enterica enterica serovar Typhi
uaaaguacggcgcgccaauaa

SEQ ID NO: 1679624 - RNA, 14 nt, Salmonella enterica enterica serovar Typhi
uaaagugaguguua

SEQ ID NO: 1679625 - RNA, 19 nt, Salmonella enterica enterica serovar Typhi
uaaagugaguguuacucuu

SEQ ID NO: 1679626 - RNA, 16 nt, Salmonella enterica enterica serovar Typhi
uaaauauaagaucuau

SEQ ID NO: 1679627 - RNA, 15 nt, Salmonella enterica enterica serovar Typhi
uaaauaaaaauuccc

SEQ ID NO: 1679628 - RNA, 14 nt, Salmonella enterica enterica serovar Typhi
uaaauaacaggaau

SEQ ID NO: 1679629 - RNA, 21 nt, Salmonella enterica enterica serovar Typhi
uaaauaagaagguuaauauac

SEQ ID NO: 1679630 - RNA, 17 nt, Salmonella enterica enterica serovar Typhi
uaaauaaccgguaacug

SEQ ID NO: 1679631 - RNA, 15 nt, Salmonella enterica enterica serovar Typhi
uaaaucagauaacaa

SEQ ID NO: 1679632 - RNA, 16 nt, Salmonella enterica enterica serovar Typhi
uaaauaugaaagagaa

SEQ ID NO: 1679633 - RNA, 22 nt, Salmonella enterica enterica serovar Typhi
uaaauaugaaagagaaaucuca

SEQ ID NO: 1679634 - RNA, 14 nt, Salmonella enterica enterica serovar Typhi
uaaaucaucauaau

SEQ ID NO: 1679635 - RNA, 21 nt, Salmonella enterica enterica serovar Typhi
uaaaucauuuguacaaaaaau

SEQ ID NO: 1679636 - RNA, 15 nt, Salmonella enterica enterica serovar Typhi
uaaaucauuacuuau

SEQ ID NO: 1679637 - RNA, 21 nt, Salmonella enterica enterica serovar Typhi
uaaaucauuacuuauauuuau

SEQ ID NO: 1679638 - RNA, 12 nt, Salmonella enterica enterica serovar Typhi
uaaaucagcgau

SEQ ID NO: 1679639 - RNA, 18 nt, Salmonella enterica enterica serovar Typhi
uaaaucagcgauaaccag

SEQ ID NO: 1679640 - RNA, 17 nt, Salmonella enterica enterica serovar Typhi
uaaaucagcacacgcca

SEQ ID NO: 1679641 - RNA, 20 nt, Salmonella enterica enterica serovar Typhi
uaaaucagcgcggcaaggau

SEQ ID NO: 1679642 - RNA, 23 nt, Salmonella enterica enterica serovar Typhi
uaaaucagcuuugcggccagcau

SEQ ID NO: 1679643 - RNA, 13 nt, Salmonella enterica enterica serovar Typhi
uaaaucauaauuu

SEQ ID NO: 1679644 - RNA, 13 nt, Salmonella enterica enterica serovar Typhi
uaacacuaacuaa

SEQ ID NO: 1679645 - RNA, 13 nt, Salmonella enterica enterica serovar Typhi
uaacacugccgaa

SEQ ID NO: 1679646 - RNA, 18 nt, Salmonella enterica enterica serovar Typhi
uaacagagagggaaaaaa

SEQ ID NO: 1679647 - RNA, 20 nt, Salmonella enterica enterica serovar Typhi
uaacagagagggaaaaaaau

SEQ ID NO: 1679648 - RNA, 19 nt, Salmonella enterica enterica serovar Typhi
uaacagacgcaucuuuuuc

SEQ ID NO: 1679649 - RNA, 22 nt, Salmonella enterica enterica serovar Typhi
uaacagacgcaucuuuuucccg

SEQ ID NO: 1679650 - RNA, 21 nt, Salmonella enterica enterica serovar Typhi
uaacacuuugaacgagucuua

SEQ ID NO: 1679651 - RNA, 19 nt, Salmonella enterica enterica serovar Typhi
uaacaugcuggauucaguu

SEQ ID NO: 1679652 - RNA, 14 nt, Salmonella enterica enterica serovar Typhi
uaaccacagccuua

SEQ ID NO: 1679653 - RNA, 21 nt, Salmonella enterica enterica serovar Typhi
uaacaucaccuuucauuuuau

SEQ ID NO: 1679654 - RNA, 21 nt, Salmonella enterica enterica serovar Typhi
uaaccagggaggacgcaagag

SEQ ID NO: 1679655 - RNA, 18 nt, Salmonella enterica enterica serovar Typhi
uaaccagcgcgccgccaa

SEQ ID NO: 1679656 - RNA, 12 nt, Salmonella enterica enterica serovar Typhi
uaaccagcaguc

SEQ ID NO: 1679657 - RNA, 22 nt, Salmonella enterica enterica serovar Typhi
uaaccacgaaaauuauuuucga

SEQ ID NO: 1679658 - RNA, 17 nt, Salmonella enterica enterica serovar Typhi
uaaccacgaaaauuauu

SEQ ID NO: 1679659 - RNA, 17 nt, Salmonella enterica enterica serovar Typhi
uaaccagauaagccugu

SEQ ID NO: 1679660 - RNA, 16 nt, Salmonella enterica enterica serovar Typhi
uaacccgauacccuga

SEQ ID NO: 1679661 - RNA, 18 nt, Salmonella enterica enterica serovar Typhi
uaaccccugcgcggccug

SEQ ID NO: 1679662 - RNA, 22 nt, Salmonella enterica enterica serovar Typhi
uaacccgcuuacaauuuaucug

SEQ ID NO: 1679663 - RNA, 22 nt, Salmonella enterica enterica serovar Typhi
uaacggcugacgcccaucagca

SEQ ID NO: 1679664 - RNA, 14 nt, Salmonella enterica enterica serovar Typhi
uaacgggacacugc

SEQ ID NO: 1679665 - RNA, 16 nt, Salmonella enterica enterica serovar Typhi
uaacgguaacggacau

SEQ ID NO: 1679666 - RNA, 16 nt, Salmonella enterica enterica serovar Typhi
uaacggacucaggccu

SEQ ID NO: 1679667 - RNA, 23 nt, Salmonella enterica enterica serovar Typhi
uaacgcgccaucuuucacccauu

SEQ ID NO: 1679668 - RNA, 15 nt, Salmonella enterica enterica serovar Typhi
uaacgcgagaagaag

SEQ ID NO: 1679669 - RNA, 21 nt, Salmonella enterica enterica serovar Typhi
uaacgcgagugucauccugcg

SEQ ID NO: 1679670 - RNA, 16 nt, Salmonella enterica enterica serovar Typhi
uaacgcgccaucuuuc

SEQ ID NO: 1679671 - RNA, 15 nt, Salmonella enterica enterica serovar Typhi
uaacgccgauuaaug

SEQ ID NO: 1679672 - RNA, 17 nt, Salmonella enterica enterica serovar Typhi
uaacgcugcaaaguuau

SEQ ID NO: 1679673 - RNA, 23 nt, Salmonella enterica enterica serovar Typhi
uaacgcguccaacuggcuuucau

SEQ ID NO: 1679674 - RNA, 23 nt, Salmonella enterica enterica serovar Typhi
uaacgcguguucuuuuucgccuu

SEQ ID NO: 1679675 - RNA, 16 nt, Salmonella enterica enterica serovar Typhi
uaacgcgaaaaaagau

SEQ ID NO: 1679676 - RNA, 22 nt, Salmonella enterica enterica serovar Typhi
uaacgccgaacacgcauaauug

SEQ ID NO: 1679677 - RNA, 17 nt, Salmonella enterica enterica serovar Typhi
uaacgcagcaucgccau

SEQ ID NO: 1679678 - RNA, 17 nt, Salmonella enterica enterica serovar Typhi
uaacgcacuuuuccagc

SEQ ID NO: 1679679 - RNA, 22 nt, Salmonella enterica enterica serovar Typhi
uaacgcagaauauuuuucucag

SEQ ID NO: 1679680 - RNA, 22 nt, Salmonella enterica enterica serovar Typhi
uaacgcaacggaaggaaauaac

SEQ ID NO: 1679681 - RNA, 23 nt, Salmonella enterica enterica serovar Typhi
uaacgcacuggucgggcaggcuu

SEQ ID NO: 1679682 - RNA, 16 nt, Salmonella enterica enterica serovar Typhi
uaacgcacuuuuccag

SEQ ID NO: 1679683 - RNA, 18 nt, Salmonella enterica enterica serovar Typhi
uaaccgauaacgcggccc

SEQ ID NO: 1679684 - RNA, 19 nt, Salmonella enterica enterica serovar Typhi
uaaccgauaacgcggcccg

SEQ ID NO: 1679685 - RNA, 17 nt, Salmonella enterica enterica serovar Typhi
uaaccguggcggcagug

SEQ ID NO: 1679686 - RNA, 16 nt, Salmonella enterica enterica serovar Typhi
uaaccguucuuccugg

SEQ ID NO: 1679687 - RNA, 15 nt, Salmonella enterica enterica serovar Typhi
uaacgauuuccccug

SEQ ID NO: 1679688 - RNA, 14 nt, Salmonella enterica enterica serovar Typhi
uaacaaaaaacaua

SEQ ID NO: 1679689 - RNA, 15 nt, Salmonella enterica enterica serovar Typhi
uaaauuuuuuaacag

SEQ ID NO: 1679690 - RNA, 19 nt, Salmonella enterica enterica serovar Typhi
uaacaccgcauggcuggca

SEQ ID NO: 1679691 - RNA, 23 nt, Salmonella enterica enterica serovar Typhi
uaacaccgcauggcuggcauauu

SEQ ID NO: 1679692 - RNA, 19 nt, Salmonella enterica enterica serovar Typhi
uaacacacaguugccuucg

SEQ ID NO: 1679693 - RNA, 15 nt, Salmonella enterica enterica serovar Typhi
uaacaauuuaucaga

SEQ ID NO: 1679694 - RNA, 14 nt, Salmonella enterica enterica serovar Typhi
uaacaauuuaucag

SEQ ID NO: 1679695 - RNA, 18 nt, Salmonella enterica enterica serovar Typhi
uaacaauuuaucagacaa

SEQ ID NO: 1679696 - RNA, 21 nt, Salmonella enterica enterica serovar Typhi
uaaauccguuaagcccugaau

SEQ ID NO: 1679697 - RNA, 16 nt, Salmonella enterica enterica serovar Typhi
uaaaucgcgcaaauau

SEQ ID NO: 1679698 - RNA, 17 nt, Salmonella enterica enterica serovar Typhi
uaaaucgcgcaaauauu

SEQ ID NO: 1679699 - RNA, 19 nt, Salmonella enterica enterica serovar Typhi
uaaaucccggcgauuaaua

SEQ ID NO: 1679700 - RNA, 14 nt, Salmonella enterica enterica serovar Typhi
uaaauccauauucu

SEQ ID NO: 1679701 - RNA, 17 nt, Salmonella enterica enterica serovar Typhi
uaaauccacauuccaga

SEQ ID NO: 1679702 - RNA, 16 nt, Salmonella enterica enterica serovar Typhi
uaaauccagccucucc

SEQ ID NO: 1679703 - RNA, 14 nt, Salmonella enterica enterica serovar Typhi
uaaauucucuauac

SEQ ID NO: 1679704 - RNA, 19 nt, Salmonella enterica enterica serovar Typhi
uaaauucauauuuaaauau

SEQ ID NO: 1679705 - RNA, 20 nt, Salmonella enterica enterica serovar Typhi
uaaauuaaacagcuguaaau

SEQ ID NO: 1679706 - RNA, 13 nt, Salmonella enterica enterica serovar Typhi
uaauaaaauaacu

SEQ ID NO: 1679707 - RNA, 14 nt, Salmonella enterica enterica serovar Typhi
uaauaaaauucacu

SEQ ID NO: 1679708 - RNA, 18 nt, Salmonella enterica enterica serovar Typhi
uaauaaaaucuaagagcc

SEQ ID NO: 1679709 - RNA, 11 nt, Salmonella enterica enterica serovar Typhi
uaauaaauauu

SEQ ID NO: 1679710 - RNA, 16 nt, Salmonella enterica enterica serovar Typhi
uaaguugaaaggaaag

SEQ ID NO: 1679711 - RNA, 15 nt, Salmonella enterica enterica serovar Typhi
uaaguugaccacauc

SEQ ID NO: 1679712 - RNA, 22 nt, Salmonella enterica enterica serovar Typhi
uaaguccgcgggcaaaagggcc

SEQ ID NO: 1679713 - RNA, 19 nt, Salmonella enterica enterica serovar Typhi
uaagucgccgcagcuccau

SEQ ID NO: 1679714 - RNA, 21 nt, Salmonella enterica enterica serovar Typhi
uaaguacaagagccgccgcca

SEQ ID NO: 1679715 - RNA, 21 nt, Salmonella enterica enterica serovar Typhi
uaagguucuggcauuggcauc

SEQ ID NO: 1679716 - RNA, 14 nt, Salmonella enterica enterica serovar Typhi
uaaguaaguugauc

SEQ ID NO: 1679717 - RNA, 14 nt, Salmonella enterica enterica serovar Typhi
uaagggccuucauu

SEQ ID NO: 1679718 - RNA, 16 nt, Salmonella enterica enterica serovar Typhi
uaagguccagggaaaa

SEQ ID NO: 1679719 - RNA, 21 nt, Salmonella enterica enterica serovar Typhi
uaaggucgcuauccagcagua

SEQ ID NO: 1679720 - RNA, 19 nt, Salmonella enterica enterica serovar Typhi
uaagguauccuaaugccac

SEQ ID NO: 1679721 - RNA, 19 nt, Salmonella enterica enterica serovar Typhi
uaagccaugugacggcaug

SEQ ID NO: 1679722 - RNA, 21 nt, Salmonella enterica enterica serovar Typhi
uaagccaguccugccaccagc

SEQ ID NO: 1679723 - RNA, 23 nt, Salmonella enterica enterica serovar Typhi
uaagcauuagcgccauccggcac

SEQ ID NO: 1679724 - RNA, 15 nt, Salmonella enterica enterica serovar Typhi
uaagcauccaggaag

SEQ ID NO: 1679725 - RNA, 18 nt, Salmonella enterica enterica serovar Typhi
uaagcgcaaacuuccaca

SEQ ID NO: 1679726 - RNA, 14 nt, Salmonella enterica enterica serovar Typhi
uaagcgcagcgcca

SEQ ID NO: 1679727 - RNA, 17 nt, Salmonella enterica enterica serovar Typhi
uaagccgguaaucacug

SEQ ID NO: 1679728 - RNA, 21 nt, Salmonella enterica enterica serovar Typhi
uaagcaauccauuuuaaauac

SEQ ID NO: 1679729 - RNA, 22 nt, Salmonella enterica enterica serovar Typhi
uaagcaauccauuuuaaauaca

SEQ ID NO: 1679730 - RNA, 23 nt, Salmonella enterica enterica serovar Typhi
uaagcaauccauuuuaaauacac

SEQ ID NO: 1679731 - RNA, 14 nt, Salmonella enterica enterica serovar Typhi
uaagcaagcgccau

SEQ ID NO: 1679732 - RNA, 20 nt, Salmonella enterica enterica serovar Typhi
uaagcaacuugaaguaugaa

SEQ ID NO: 1679733 - RNA, 12 nt, Salmonella enterica enterica serovar Typhi
uaagcaauuaau

SEQ ID NO: 1679734 - RNA, 14 nt, Salmonella enterica enterica serovar Typhi
uaagcaauuaauau

SEQ ID NO: 1679735 - RNA, 15 nt, Salmonella enterica enterica serovar Typhi
uaagauuuaaaacaa

SEQ ID NO: 1679736 - RNA, 14 nt, Salmonella enterica enterica serovar Typhi
uaagcacaggccau

SEQ ID NO: 1679737 - RNA, 20 nt, Salmonella enterica enterica serovar Typhi
uaagcacgggcuugaauaac

SEQ ID NO: 1679738 - RNA, 21 nt, Salmonella enterica enterica serovar Typhi
uaagcauccaggaaguaaauu

SEQ ID NO: 1679739 - RNA, 23 nt, Salmonella enterica enterica serovar Typhi
uaaggaucggaagacuggcgcag

SEQ ID NO: 1679740 - RNA, 22 nt, Salmonella enterica enterica serovar Typhi
uaaggauaucuugaugauucac

SEQ ID NO: 1679741 - RNA, 17 nt, Salmonella enterica enterica serovar Typhi
uaagcuuugcaccacuu

SEQ ID NO: 1679742 - RNA, 20 nt, Salmonella enterica enterica serovar Typhi
uaaggacuuuaucuuuacca

SEQ ID NO: 1679743 - RNA, 21 nt, Salmonella enterica enterica serovar Typhi
uaaggcaaguucuuguuucau

SEQ ID NO: 1679744 - RNA, 19 nt, Salmonella enterica enterica serovar Typhi
uaaggccugccguccugau

SEQ ID NO: 1679745 - RNA, 19 nt, Salmonella enterica enterica serovar Typhi
uaaggcgcuugcgccgcca

SEQ ID NO: 1679746 - RNA, 20 nt, Salmonella enterica enterica serovar Typhi
uaaggcgauucaacagggca

SEQ ID NO: 1679747 - RNA, 21 nt, Salmonella enterica enterica serovar Typhi
uaaggcgauucaacagggcaa

SEQ ID NO: 1679748 - RNA, 16 nt, Salmonella enterica enterica serovar Typhi
uaaggcuggcacguuc

SEQ ID NO: 1679749 - RNA, 12 nt, Salmonella enterica enterica serovar Typhi
uaaggcguucac

SEQ ID NO: 1679750 - RNA, 18 nt, Salmonella enterica enterica serovar Typhi
uaaggcucucuuaccagc

SEQ ID NO: 1679751 - RNA, 20 nt, Salmonella enterica enterica serovar Typhi
uaagcuuccgccaugguugg

SEQ ID NO: 1679752 - RNA, 18 nt, Salmonella enterica enterica serovar Typhi
uaagcugagccuucaccg

SEQ ID NO: 1679753 - RNA, 19 nt, Salmonella enterica enterica serovar Typhi
uaagcuggaccgcagcuua

SEQ ID NO: 1679754 - RNA, 14 nt, Salmonella enterica enterica serovar Typhi
uaagcgcucaggca

SEQ ID NO: 1679755 - RNA, 14 nt, Salmonella enterica enterica serovar Typhi
uaagcgcuagcgcc

SEQ ID NO: 1679756 - RNA, 19 nt, Salmonella enterica enterica serovar Typhi
uaagcggcggaccagcgug

SEQ ID NO: 1679757 - RNA, 21 nt, Salmonella enterica enterica serovar Typhi
uaagcgucacccggcaauuca

SEQ ID NO: 1679758 - RNA, 16 nt, Salmonella enterica enterica serovar Typhi
uaagcuauguuuuuau

SEQ ID NO: 1679759 - RNA, 19 nt, Salmonella enterica enterica serovar Typhi
uaagcuauuccuguauaau

SEQ ID NO: 1679760 - RNA, 12 nt, Salmonella enterica enterica serovar Typhi
uaagaagaacca

SEQ ID NO: 1679761 - RNA, 18 nt, Salmonella enterica enterica serovar Typhi
uaagaacuccaaauaccg

SEQ ID NO: 1679762 - RNA, 21 nt, Salmonella enterica enterica serovar Typhi
uaagaaacugcuguagcacau

SEQ ID NO: 1679763 - RNA, 15 nt, Salmonella enterica enterica serovar Typhi
uaagaaguaaacaga

SEQ ID NO: 1679764 - RNA, 14 nt, Salmonella enterica enterica serovar Typhi
uaagaaaaaacugg

SEQ ID NO: 1679765 - RNA, 22 nt, Salmonella enterica enterica serovar Typhi
uaacuuucccgcuauccaucau

SEQ ID NO: 1679766 - RNA, 23 nt, Salmonella enterica enterica serovar Typhi
uaacuucuugguaccaaacagca

SEQ ID NO: 1679767 - RNA, 21 nt, Salmonella enterica enterica serovar Typhi
uaacuugacuuugcucuccuu

SEQ ID NO: 1679768 - RNA, 14 nt, Salmonella enterica enterica serovar Typhi
uaagagacugacaa

SEQ ID NO: 1679769 - RNA, 17 nt, Salmonella enterica enterica serovar Typhi
uaagagccugucccacc

SEQ ID NO: 1679770 - RNA, 16 nt, Salmonella enterica enterica serovar Typhi
uaagaggcauaaaaaa

SEQ ID NO: 1679771 - RNA, 14 nt, Salmonella enterica enterica serovar Typhi
uaagagcuggccgg

SEQ ID NO: 1679772 - RNA, 14 nt, Salmonella enterica enterica serovar Typhi
uaagaccagcauca

SEQ ID NO: 1679773 - RNA, 22 nt, Salmonella enterica enterica serovar Typhi
uaagaccauacuuugcauugcc

SEQ ID NO: 1679774 - RNA, 20 nt, Salmonella enterica enterica serovar Typhi
uaagauauuuuguuuuaaau

SEQ ID NO: 1679775 - RNA, 18 nt, Salmonella enterica enterica serovar Typhi
uaagauauccugcuugcc

SEQ ID NO: 1679776 - RNA, 17 nt, Salmonella enterica enterica serovar Typhi
uaacugacaauuuccag

SEQ ID NO: 1679777 - RNA, 20 nt, Salmonella enterica enterica serovar Typhi
uaacucuuuuucagcaaaua

SEQ ID NO: 1679778 - RNA, 17 nt, Salmonella enterica enterica serovar Typhi
uaacugaagguuuuucc

SEQ ID NO: 1679779 - RNA, 18 nt, Salmonella enterica enterica serovar Typhi
uaacugaagguuuuuccc

SEQ ID NO: 1679780 - RNA, 12 nt, Salmonella enterica enterica serovar Typhi
uaacugacagac

SEQ ID NO: 1679781 - RNA, 20 nt, Salmonella enterica enterica serovar Typhi
aaauccccaccugacuauac

SEQ ID NO: 1679782 - RNA, 19 nt, Salmonella enterica enterica serovar Typhi
aaauccaugagaagaaaaa

SEQ ID NO: 1679783 - RNA, 21 nt, Salmonella enterica enterica serovar Typhi
aaauccaucucaggccgacaa

SEQ ID NO: 1679784 - RNA, 23 nt, Salmonella enterica enterica serovar Typhi
uaacugcaccuuuuuuuccagcg

SEQ ID NO: 1679785 - RNA, 16 nt, Salmonella enterica enterica serovar Typhi
uaacugccagaacgcu

SEQ ID NO: 1679786 - RNA, 17 nt, Salmonella enterica enterica serovar Typhi
aaauccggaucaucuuu

SEQ ID NO: 1679787 - RNA, 21 nt, Salmonella enterica enterica serovar Typhi
aaauccggcaggcagccggau

SEQ ID NO: 1679788 - RNA, 11 nt, Salmonella enterica enterica serovar Typhi
uaacugcggua

SEQ ID NO: 1679789 - RNA, 19 nt, Salmonella enterica enterica serovar Typhi
uaacugccuuauccggccu

SEQ ID NO: 1679790 - RNA, 18 nt, Salmonella enterica enterica serovar Typhi
uaacugcccguuacgcau

SEQ ID NO: 1679791 - RNA, 21 nt, Salmonella enterica enterica serovar Typhi
uaacugcccguuacgcauuuc

SEQ ID NO: 1679792 - RNA, 12 nt, Salmonella enterica enterica serovar Typhi
uaacugcccguc

SEQ ID NO: 1679793 - RNA, 17 nt, Salmonella enterica enterica serovar Typhi
aaaucccggcgauuaau

SEQ ID NO: 1679794 - RNA, 19 nt, Salmonella enterica enterica serovar Typhi
aaaucccggcgauuaauaa

SEQ ID NO: 1679795 - RNA, 14 nt, Salmonella enterica enterica serovar Typhi
aaaucccggcuggg

SEQ ID NO: 1679796 - RNA, 22 nt, Salmonella enterica enterica serovar Typhi
aaauccgcgcucggucacuuca

SEQ ID NO: 1679797 - RNA, 13 nt, Salmonella enterica enterica serovar Typhi
uaacuggaaaaag

SEQ ID NO: 1679798 - RNA, 13 nt, Salmonella enterica enterica serovar Typhi
uaacuuauccacu

SEQ ID NO: 1679799 - RNA, 16 nt, Salmonella enterica enterica serovar Typhi
uaacuuauugauuuuc

SEQ ID NO: 1679800 - RNA, 23 nt, Salmonella enterica enterica serovar Typhi
uaacuuccuuugccuuucuuauu

SEQ ID NO: 1679801 - RNA, 21 nt, Salmonella enterica enterica serovar Typhi
uaacuucggcaaauucuuuuc

SEQ ID NO: 1679802 - RNA, 22 nt, Salmonella enterica enterica serovar Typhi
uaacuucggcaaauucuuuuca

SEQ ID NO: 1679803 - RNA, 19 nt, Salmonella enterica enterica serovar Typhi
uaacgucguaaauuccugc

SEQ ID NO: 1679804 - RNA, 22 nt, Salmonella enterica enterica serovar Typhi
uaacuaauuguuuguagaaagu

SEQ ID NO: 1679805 - RNA, 13 nt, Salmonella enterica enterica serovar Typhi
uaacguuuaaacu

SEQ ID NO: 1679806 - RNA, 22 nt, Salmonella enterica enterica serovar Typhi
uaacguuuggcaucaaaguuau

SEQ ID NO: 1679807 - RNA, 19 nt, Salmonella enterica enterica serovar Typhi
uaacucuuccgcaaucaca

SEQ ID NO: 1679808 - RNA, 13 nt, Salmonella enterica enterica serovar Typhi
uaacucuucaucg

SEQ ID NO: 1679809 - RNA, 19 nt, Salmonella enterica enterica serovar Typhi
uaacuccuucuaauuccag

SEQ ID NO: 1679810 - RNA, 18 nt, Salmonella enterica enterica serovar Typhi
uaacuccaugcccacaca

SEQ ID NO: 1679811 - RNA, 23 nt, Salmonella enterica enterica serovar Typhi
uaacuccagugcagaaaguguga

SEQ ID NO: 1679812 - RNA, 13 nt, Salmonella enterica enterica serovar Typhi
uaacuauuucuau

SEQ ID NO: 1679813 - RNA, 20 nt, Salmonella enterica enterica serovar Typhi
uaacuauaauugcuuuuuuc

SEQ ID NO: 1679814 - RNA, 19 nt, Salmonella enterica enterica serovar Typhi
uaauacguuuauucuuuuc

SEQ ID NO: 1679815 - RNA, 22 nt, Salmonella enterica enterica serovar Typhi
uaauacgcgaugagauaauaaa

SEQ ID NO: 1679816 - RNA, 18 nt, Salmonella enterica enterica serovar Typhi
uaauacggagcaaaaaau

SEQ ID NO: 1679817 - RNA, 21 nt, Salmonella enterica enterica serovar Typhi
uaauagagauccuggcgaaag

SEQ ID NO: 1679818 - RNA, 16 nt, Salmonella enterica enterica serovar Typhi
uaauagaugcgucgca

SEQ ID NO: 1679819 - RNA, 20 nt, Salmonella enterica enterica serovar Typhi
uaauaguuucgacuuucauu

SEQ ID NO: 1679820 - RNA, 15 nt, Salmonella enterica enterica serovar Typhi
uaauauacauucauu

SEQ ID NO: 1679821 - RNA, 19 nt, Salmonella enterica enterica serovar Typhi
uaauagccucauccccagc

SEQ ID NO: 1679822 - RNA, 23 nt, Salmonella enterica enterica serovar Typhi
uaauagguacggggcaucuauuu

SEQ ID NO: 1679823 - RNA, 19 nt, Salmonella enterica enterica serovar Typhi
uaauaauuagcauccagca

SEQ ID NO: 1679824 - RNA, 22 nt, Salmonella enterica enterica serovar Typhi
uaauaauugagcgcaaaacgcu

SEQ ID NO: 1679825 - RNA, 12 nt, Salmonella enterica enterica serovar Typhi
uaauacaggcca

SEQ ID NO: 1679826 - RNA, 16 nt, Salmonella enterica enterica serovar Typhi
uaauacaggccagcau

SEQ ID NO: 1679827 - RNA, 21 nt, Salmonella enterica enterica serovar Typhi
uaauaaguccgcgggcaaaag

SEQ ID NO: 1679828 - RNA, 23 nt, Salmonella enterica enterica serovar Typhi
uaauaagcggccuauauuagugu

SEQ ID NO: 1679829 - RNA, 19 nt, Salmonella enterica enterica serovar Typhi
uaaucaucacgcuauggcc

SEQ ID NO: 1679830 - RNA, 16 nt, Salmonella enterica enterica serovar Typhi
uaaucauauaagaaau

SEQ ID NO: 1679831 - RNA, 19 nt, Salmonella enterica enterica serovar Typhi
uaaucagcacauucagcag

SEQ ID NO: 1679832 - RNA, 16 nt, Salmonella enterica enterica serovar Typhi
uaaucaggagggcugc

SEQ ID NO: 1679833 - RNA, 12 nt, Salmonella enterica enterica serovar Typhi
uaaucagcagcg

SEQ ID NO: 1679834 - RNA, 14 nt, Salmonella enterica enterica serovar Typhi
uaaucacugcaccu

SEQ ID NO: 1679835 - RNA, 12 nt, Salmonella enterica enterica serovar Typhi
uaaucaccagcg

SEQ ID NO: 1679836 - RNA, 15 nt, Salmonella enterica enterica serovar Typhi
uaaucaccagcgcau

SEQ ID NO: 1679837 - RNA, 12 nt, Salmonella enterica enterica serovar Typhi
uaaucaauaagu

SEQ ID NO: 1679838 - RNA, 13 nt, Salmonella enterica enterica serovar Typhi
uaaucaauaaguu

SEQ ID NO: 1679839 - RNA, 16 nt, Salmonella enterica enterica serovar Typhi
uaaucacaucauuaaa

SEQ ID NO: 1679840 - RNA, 19 nt, Salmonella enterica enterica serovar Typhi
uaauccaggaauuuuccca

SEQ ID NO: 1679841 - RNA, 17 nt, Salmonella enterica enterica serovar Typhi
uaaucgaaucgccucaa

SEQ ID NO: 1679842 - RNA, 18 nt, Salmonella enterica enterica serovar Typhi
uaaucccuucuuuuacug

SEQ ID NO: 1679843 - RNA, 11 nt, Salmonella enterica enterica serovar Typhi
uaaucccuugc

SEQ ID NO: 1679844 - RNA, 18 nt, Salmonella enterica enterica serovar Typhi
uaaucccgaaucacuuac

SEQ ID NO: 1679845 - RNA, 18 nt, Salmonella enterica enterica serovar Typhi
uaauccaacauuaucaaa

SEQ ID NO: 1679846 - RNA, 13 nt, Salmonella enterica enterica serovar Typhi
uaaucaucaugcu

SEQ ID NO: 1679847 - RNA, 16 nt, Salmonella enterica enterica serovar Typhi
uaaucaaacccuuccg

SEQ ID NO: 1679848 - RNA, 15 nt, Salmonella enterica enterica serovar Typhi
uaaucaacucuccuu

SEQ ID NO: 1679849 - RNA, 21 nt, Salmonella enterica enterica serovar Typhi
uaaucaacugcgccacaucau

SEQ ID NO: 1679850 - RNA, 20 nt, Salmonella enterica enterica serovar Typhi
uaauauuaagcagcuuaucg

SEQ ID NO: 1679851 - RNA, 22 nt, Salmonella enterica enterica serovar Typhi
uaauauuauccuuuaauuaauc

SEQ ID NO: 1679852 - RNA, 16 nt, Salmonella enterica enterica serovar Typhi
uaauauuuaacacauu

SEQ ID NO: 1679853 - RNA, 13 nt, Salmonella enterica enterica serovar Typhi
uaauauuuauuau

SEQ ID NO: 1679854 - RNA, 21 nt, Salmonella enterica enterica serovar Typhi
uaauauaugaaccaagauaag

SEQ ID NO: 1679855 - RNA, 16 nt, Salmonella enterica enterica serovar Typhi
uaauauagaguuguga

SEQ ID NO: 1679856 - RNA, 15 nt, Salmonella enterica enterica serovar Typhi
uaauauccaggagca

SEQ ID NO: 1679857 - RNA, 20 nt, Salmonella enterica enterica serovar Typhi
uaauaucgcgcucuuccgcc

SEQ ID NO: 1679858 - RNA, 23 nt, Salmonella enterica enterica serovar Typhi
uaauaucguuaagccuucaauuu

SEQ ID NO: 1679859 - RNA, 19 nt, Salmonella enterica enterica serovar Typhi
uaaugagcgucgccagacc

SEQ ID NO: 1679860 - RNA, 22 nt, Salmonella enterica enterica serovar Typhi
uaaugagcacuuuccacaucgg

SEQ ID NO: 1679861 - RNA, 23 nt, Salmonella enterica enterica serovar Typhi
uaaugagccagauggauaaccug

SEQ ID NO: 1679862 - RNA, 19 nt, Salmonella enterica enterica serovar Typhi
uaaucgacaacgcguuuau

SEQ ID NO: 1679863 - RNA, 21 nt, Salmonella enterica enterica serovar Typhi
uaaucgagacuguuugacacu

SEQ ID NO: 1679864 - RNA, 16 nt, Salmonella enterica enterica serovar Typhi
uaaucgauaagccagc

SEQ ID NO: 1679865 - RNA, 22 nt, Salmonella enterica enterica serovar Typhi
uaaucgagcccagacuuuccag

SEQ ID NO: 1679866 - RNA, 17 nt, Salmonella enterica enterica serovar Typhi
uaaucgauauaauuuua

SEQ ID NO: 1679867 - RNA, 23 nt, Salmonella enterica enterica serovar Typhi
uaaugauuaucuuuuuuagucuc

SEQ ID NO: 1679868 - RNA, 16 nt, Salmonella enterica enterica serovar Typhi
uaaugauuaaaauaaa

SEQ ID NO: 1679869 - RNA, 22 nt, Salmonella enterica enterica serovar Typhi
uaaugauucuguguuuuuucgu

SEQ ID NO: 1679870 - RNA, 19 nt, Salmonella enterica enterica serovar Typhi
uaaugaguagaacguauua

SEQ ID NO: 1679871 - RNA, 21 nt, Salmonella enterica enterica serovar Typhi
uaaugaucagcaaaauagugu

SEQ ID NO: 1679872 - RNA, 16 nt, Salmonella enterica enterica serovar Typhi
uaaugcuaucccaggc

SEQ ID NO: 1679873 - RNA, 18 nt, Salmonella enterica enterica serovar Typhi
uaaugcgccaggcagcac

SEQ ID NO: 1679874 - RNA, 16 nt, Salmonella enterica enterica serovar Typhi
uaaugcgaugccgcac

SEQ ID NO: 1679875 - RNA, 13 nt, Salmonella enterica enterica serovar Typhi
uaaugugaaaaac

SEQ ID NO: 1679876 - RNA, 16 nt, Salmonella enterica enterica serovar Typhi
uaaugugauccgcccc

SEQ ID NO: 1679877 - RNA, 19 nt, Salmonella enterica enterica serovar Typhi
uaauguaaaggugagcucu

SEQ ID NO: 1679878 - RNA, 18 nt, Salmonella enterica enterica serovar Typhi
uaauguuucacguagcaa

SEQ ID NO: 1679879 - RNA, 17 nt, Salmonella enterica enterica serovar Typhi
uaauguuaggaguaaau

SEQ ID NO: 1679880 - RNA, 18 nt, Salmonella enterica enterica serovar Typhi
uaauguucaguuuuucca

SEQ ID NO: 1679881 - RNA, 19 nt, Salmonella enterica enterica serovar Typhi
uaauuauuuuucaaaugau

SEQ ID NO: 1679882 - RNA, 16 nt, Salmonella enterica enterica serovar Typhi
uaauuauuacagacag

SEQ ID NO: 1679883 - RNA, 22 nt, Salmonella enterica enterica serovar Typhi
uaauuauuacuggaucauacau

SEQ ID NO: 1679884 - RNA, 18 nt, Salmonella enterica enterica serovar Typhi
uaauuacuccguuuuaau

SEQ ID NO: 1679885 - RNA, 19 nt, Salmonella enterica enterica serovar Typhi
uaauuaucugccagccgau

SEQ ID NO: 1679886 - RNA, 16 nt, Salmonella enterica enterica serovar Typhi
uacaagcaguuaauac

SEQ ID NO: 1679887 - RNA, 23 nt, Salmonella enterica enterica serovar Typhi
uacaagcguuuaauuccaucggc

SEQ ID NO: 1679888 - RNA, 16 nt, Salmonella enterica enterica serovar Typhi
uacaaggaaagaaaau

SEQ ID NO: 1679889 - RNA, 19 nt, Salmonella enterica enterica serovar Typhi
uacaagaaaguaccugcac

SEQ ID NO: 1679890 - RNA, 20 nt, Salmonella enterica enterica serovar Typhi
uacaagaaaguaccugcacc

SEQ ID NO: 1679891 - RNA, 22 nt, Salmonella enterica enterica serovar Typhi
uacaacuacucguaaucuaaaa

SEQ ID NO: 1679892 - RNA, 16 nt, Salmonella enterica enterica serovar Typhi
uacaacucauccaccu

SEQ ID NO: 1679893 - RNA, 17 nt, Salmonella enterica enterica serovar Typhi
uacaaaucucagggugu

SEQ ID NO: 1679894 - RNA, 16 nt, Salmonella enterica enterica serovar Typhi
uacaaauuuaaacaug

SEQ ID NO: 1679895 - RNA, 15 nt, Salmonella enterica enterica serovar Typhi
uacaaauuuaaacau

SEQ ID NO: 1679896 - RNA, 13 nt, Salmonella enterica enterica serovar Typhi
uacaaaucacugg

SEQ ID NO: 1679897 - RNA, 23 nt, Salmonella enterica enterica serovar Typhi
uacaaaauaugggauuugaugcc

SEQ ID NO: 1679898 - RNA, 13 nt, Salmonella enterica enterica serovar Typhi
uacaaacaaauaa

SEQ ID NO: 1679899 - RNA, 23 nt, Salmonella enterica enterica serovar Typhi
uacaaacaguuuuuccuuucugc

SEQ ID NO: 1679900 - RNA, 17 nt, Salmonella enterica enterica serovar Typhi
uacaaaccaccaccaug

SEQ ID NO: 1679901 - RNA, 19 nt, Salmonella enterica enterica serovar Typhi
uacaaaccccacccacuga

SEQ ID NO: 1679902 - RNA, 19 nt, Salmonella enterica enterica serovar Typhi
uaauuuuguuaaagugagu

SEQ ID NO: 1679903 - RNA, 19 nt, Salmonella enterica enterica serovar Typhi
uaauuuucccaguucaucc

SEQ ID NO: 1679904 - RNA, 15 nt, Salmonella enterica enterica serovar Typhi
uacaaaaaagauaac

SEQ ID NO: 1679905 - RNA, 22 nt, Salmonella enterica enterica serovar Typhi
uaauuuuuccagcauuucuuca

SEQ ID NO: 1679906 - RNA, 20 nt, Salmonella enterica enterica serovar Typhi
uaauuuuuaugucauuuauu

SEQ ID NO: 1679907 - RNA, 12 nt, Salmonella enterica enterica serovar Typhi
uaauuucaauuu

SEQ ID NO: 1679908 - RNA, 17 nt, Salmonella enterica enterica serovar Typhi
uaauuucaauuuugccg

SEQ ID NO: 1679909 - RNA, 23 nt, Salmonella enterica enterica serovar Typhi
uaauuugcaaaccaugauaauaa

SEQ ID NO: 1679910 - RNA, 22 nt, Salmonella enterica enterica serovar Typhi
uacacaaagacgaauaaggaau

SEQ ID NO: 1679911 - RNA, 20 nt, Salmonella enterica enterica serovar Typhi
uacaaggaaagaaaaugcca

SEQ ID NO: 1679912 - RNA, 14 nt, Salmonella enterica enterica serovar Typhi
uacaaguaauaaaa

SEQ ID NO: 1679913 - RNA, 19 nt, Salmonella enterica enterica serovar Typhi
uacaaguaauaaaauaaua

SEQ ID NO: 1679914 - RNA, 15 nt, Salmonella enterica enterica serovar Typhi
uacaauuuaucugcg

SEQ ID NO: 1679915 - RNA, 16 nt, Salmonella enterica enterica serovar Typhi
uacauagaaaauauau

SEQ ID NO: 1679916 - RNA, 16 nt, Salmonella enterica enterica serovar Typhi
uacauccaugccaucc

SEQ ID NO: 1679917 - RNA, 19 nt, Salmonella enterica enterica serovar Typhi
uaccaaccgccagucaccc

SEQ ID NO: 1679918 - RNA, 20 nt, Salmonella enterica enterica serovar Typhi
uaccaaccgccagucacccu

SEQ ID NO: 1679919 - RNA, 14 nt, Salmonella enterica enterica serovar Typhi
uaccaacugagcua

SEQ ID NO: 1679920 - RNA, 21 nt, Salmonella enterica enterica serovar Typhi
uaccaaauauuucuuugucgc

SEQ ID NO: 1679921 - RNA, 13 nt, Salmonella enterica enterica serovar Typhi
uacauugccaguc

SEQ ID NO: 1679922 - RNA, 17 nt, Salmonella enterica enterica serovar Typhi
uacauuauugcacauaa

SEQ ID NO: 1679923 - RNA, 18 nt, Salmonella enterica enterica serovar Typhi
uacauucuguuugucuuu

SEQ ID NO: 1679924 - RNA, 14 nt, Salmonella enterica enterica serovar Typhi
uacaucuacuucag

SEQ ID NO: 1679925 - RNA, 21 nt, Salmonella enterica enterica serovar Typhi
uaccagacgcgccugcauacu

SEQ ID NO: 1679926 - RNA, 20 nt, Salmonella enterica enterica serovar Typhi
uaccacuucggcagaaaaag

SEQ ID NO: 1679927 - RNA, 11 nt, Salmonella enterica enterica serovar Typhi
uaccacaucag

SEQ ID NO: 1679928 - RNA, 11 nt, Salmonella enterica enterica serovar Typhi
uaccagcaccu

SEQ ID NO: 1679929 - RNA, 20 nt, Salmonella enterica enterica serovar Typhi
uaccagccgcgcccuaacag

SEQ ID NO: 1679930 - RNA, 17 nt, Salmonella enterica enterica serovar Typhi
uaccagauuaauaauag

SEQ ID NO: 1679931 - RNA, 20 nt, Salmonella enterica enterica serovar Typhi
uaccagcggcagcuucagcc

SEQ ID NO: 1679932 - RNA, 17 nt, Salmonella enterica enterica serovar Typhi
uaccagcgucaucggau

SEQ ID NO: 1679933 - RNA, 19 nt, Salmonella enterica enterica serovar Typhi
uaccagcgcgaacauuaca

SEQ ID NO: 1679934 - RNA, 15 nt, Salmonella enterica enterica serovar Typhi
uaccagcgcggcgcc

SEQ ID NO: 1679935 - RNA, 23 nt, Salmonella enterica enterica serovar Typhi
uaccagccuucggacugcuggua

SEQ ID NO: 1679936 - RNA, 13 nt, Salmonella enterica enterica serovar Typhi
uacccaaauuaau

SEQ ID NO: 1679937 - RNA, 21 nt, Salmonella enterica enterica serovar Typhi
uacccaaauuaauuuauugac

SEQ ID NO: 1679938 - RNA, 21 nt, Salmonella enterica enterica serovar Typhi
uacccagcgccaacgccacug

SEQ ID NO: 1679939 - RNA, 18 nt, Salmonella enterica enterica serovar Typhi
uacccagcgaaugcugca

SEQ ID NO: 1679940 - RNA, 16 nt, Salmonella enterica enterica serovar Typhi
uacccaacgcaaugcg

SEQ ID NO: 1679941 - RNA, 19 nt, Salmonella enterica enterica serovar Typhi
uacccaauugaauuuaaau

SEQ ID NO: 1679942 - RNA, 17 nt, Salmonella enterica enterica serovar Typhi
uaccccacgccauaaug

SEQ ID NO: 1679943 - RNA, 16 nt, Salmonella enterica enterica serovar Typhi
uaccccgccaccgccg

SEQ ID NO: 1679944 - RNA, 15 nt, Salmonella enterica enterica serovar Typhi
uaccccggcgcggcg

SEQ ID NO: 1679945 - RNA, 18 nt, Salmonella enterica enterica serovar Typhi
uacccaguaccauaccgg

SEQ ID NO: 1679946 - RNA, 14 nt, Salmonella enterica enterica serovar Typhi
uaccauucagcuua

SEQ ID NO: 1679947 - RNA, 13 nt, Salmonella enterica enterica serovar Typhi
uaccauucagcuu

SEQ ID NO: 1679948 - RNA, 14 nt, Salmonella enterica enterica serovar Typhi
uaccauuccucacg

SEQ ID NO: 1679949 - RNA, 19 nt, Salmonella enterica enterica serovar Typhi
uaccaggcggcuuuuucau

SEQ ID NO: 1679950 - RNA, 10 nt, Salmonella enterica enterica serovar Typhi
uaccaggcac

SEQ ID NO: 1679951 - RNA, 15 nt, Salmonella enterica enterica serovar Typhi
uaccaggcagcgcgc

SEQ ID NO: 1679952 - RNA, 22 nt, Salmonella enterica enterica serovar Typhi
uaccagggaauaugauuuaaaa

SEQ ID NO: 1679953 - RNA, 22 nt, Salmonella enterica enterica serovar Typhi
uaccauaccggugcgccccagc

SEQ ID NO: 1679954 - RNA, 16 nt, Salmonella enterica enterica serovar Typhi
uacccgcugcuucacg

SEQ ID NO: 1679955 - RNA, 19 nt, Salmonella enterica enterica serovar Typhi
uacccgcgcaucccacacc

SEQ ID NO: 1679956 - RNA, 20 nt, Salmonella enterica enterica serovar Typhi
uacccggcgcaaacuucaca

SEQ ID NO: 1679957 - RNA, 15 nt, Salmonella enterica enterica serovar Typhi
uacccgguaauacuu

SEQ ID NO: 1679958 - RNA, 21 nt, Salmonella enterica enterica serovar Typhi
uaccccuuuuucaauuuccag

SEQ ID NO: 1679959 - RNA, 14 nt, Salmonella enterica enterica serovar Typhi
uaccccgugguggg

SEQ ID NO: 1679960 - RNA, 21 nt, Salmonella enterica enterica serovar Typhi
uacccuuccccggcagccuca

SEQ ID NO: 1679961 - RNA, 19 nt, Salmonella enterica enterica serovar Typhi
uacccugauuuucaaauuu

SEQ ID NO: 1679962 - RNA, 15 nt, Salmonella enterica enterica serovar Typhi
uaccgaacagccagg

SEQ ID NO: 1679963 - RNA, 19 nt, Salmonella enterica enterica serovar Typhi
uaccgaaauaguaccuccg

SEQ ID NO: 1679964 - RNA, 13 nt, Salmonella enterica enterica serovar Typhi
uacccucugcguc

SEQ ID NO: 1679965 - RNA, 12 nt, Salmonella enterica enterica serovar Typhi
uacccucugcac

SEQ ID NO: 1679966 - RNA, 20 nt, Salmonella enterica enterica serovar Typhi
uacccuauuuacagagcaau

SEQ ID NO: 1679967 - RNA, 19 nt, Salmonella enterica enterica serovar Typhi
uacccgugagcuacagcgu

SEQ ID NO: 1679968 - RNA, 17 nt, Salmonella enterica enterica serovar Typhi
uaccgacgaccauaauu

SEQ ID NO: 1679969 - RNA, 14 nt, Salmonella enterica enterica serovar Typhi
uaccgaagaacaua

SEQ ID NO: 1679970 - RNA, 20 nt, Salmonella enterica enterica serovar Typhi
uaccgacaaaucaaacucac

SEQ ID NO: 1679971 - RNA, 17 nt, Salmonella enterica enterica serovar Typhi
uaccgaacagccaggcu

SEQ ID NO: 1679972 - RNA, 22 nt, Salmonella enterica enterica serovar Typhi
uaccggacgacuguagauaccu

SEQ ID NO: 1679973 - RNA, 20 nt, Salmonella enterica enterica serovar Typhi
uaccggaaucgccugcgucg

SEQ ID NO: 1679974 - RNA, 17 nt, Salmonella enterica enterica serovar Typhi
uaccgcuuugccgcgcu

SEQ ID NO: 1679975 - RNA, 15 nt, Salmonella enterica enterica serovar Typhi
uacuggcgauuuuca

SEQ ID NO: 1679976 - RNA, 17 nt, Salmonella enterica enterica serovar Typhi
uacuggcgauuuucaua

SEQ ID NO: 1679977 - RNA, 22 nt, Salmonella enterica enterica serovar Typhi
uacuggcgauuuucauagcugg

SEQ ID NO: 1679978 - RNA, 21 nt, Salmonella enterica enterica serovar Typhi
uacugucgcgcggcgucccua

SEQ ID NO: 1679979 - RNA, 19 nt, Salmonella enterica enterica serovar Typhi
uacuggauaaccgcuucga

SEQ ID NO: 1679980 - RNA, 17 nt, Salmonella enterica enterica serovar Typhi
uacuggaucgcuccauu

SEQ ID NO: 1679981 - RNA, 16 nt, Salmonella enterica enterica serovar Typhi
uacugugcccagagcg

SEQ ID NO: 1679982 - RNA, 19 nt, Salmonella enterica enterica serovar Typhi
uacugucuuguggaacacc

SEQ ID NO: 1679983 - RNA, 21 nt, Salmonella enterica enterica serovar Typhi
uacugcggguguccguuccug

SEQ ID NO: 1679984 - RNA, 13 nt, Salmonella enterica enterica serovar Typhi
uacugcuauuagc

SEQ ID NO: 1679985 - RNA, 22 nt, Salmonella enterica enterica serovar Typhi
uacugccgcccaucgccacagc

SEQ ID NO: 1679986 - RNA, 18 nt, Salmonella enterica enterica serovar Typhi
uacugcuguccgccagca

SEQ ID NO: 1679987 - RNA, 16 nt, Salmonella enterica enterica serovar Typhi
uacuucugacagugac

SEQ ID NO: 1679988 - RNA, 20 nt, Salmonella enterica enterica serovar Typhi
uacuguuuuugcuuuaauau

SEQ ID NO: 1679989 - RNA, 14 nt, Salmonella enterica enterica serovar Typhi
uacuuaaaauugaa

SEQ ID NO: 1679990 - RNA, 16 nt, Salmonella enterica enterica serovar Typhi
uacuuaaaauugaauu

SEQ ID NO: 1679991 - RNA, 14 nt, Salmonella enterica enterica serovar Typhi
uacuuauauuuauu

SEQ ID NO: 1679992 - RNA, 15 nt, Salmonella enterica enterica serovar Typhi
uacuuauauuuauuu

SEQ ID NO: 1679993 - RNA, 22 nt, Salmonella enterica enterica serovar Typhi
uacuucacaauaagaaauuuag

SEQ ID NO: 1679994 - RNA, 22 nt, Salmonella enterica enterica serovar Typhi
uacucgggccagcucuuuucug

SEQ ID NO: 1679995 - RNA, 16 nt, Salmonella enterica enterica serovar Typhi
uacucugcggagcaag

SEQ ID NO: 1679996 - RNA, 21 nt, Salmonella enterica enterica serovar Typhi
uacucuuggagagcaucaucu

SEQ ID NO: 1679997 - RNA, 13 nt, Salmonella enterica enterica serovar Typhi
uacucuucacccu

SEQ ID NO: 1679998 - RNA, 13 nt, Salmonella enterica enterica serovar Typhi
uacucuuccacca

SEQ ID NO: 1679999 - RNA, 13 nt, Salmonella enterica enterica serovar Typhi
uacucugcuuuuu

SEQ ID NO: 1680000 - RNA, 20 nt, Salmonella enterica enterica serovar Typhi
uacugcaacgccagaugcgu

SEQ ID NO: 1680001 - RNA, 15 nt, Salmonella enterica enterica serovar Typhi
uacugcauuuucaau

SEQ ID NO: 1680002 - RNA, 18 nt, Salmonella enterica enterica serovar Typhi
uacugauaaaggauaaua

SEQ ID NO: 1680003 - RNA, 21 nt, Salmonella enterica enterica serovar Typhi
uacugauagcauuguauccag

SEQ ID NO: 1680004 - RNA, 13 nt, Salmonella enterica enterica serovar Typhi
uacugauuccugc

SEQ ID NO: 1680005 - RNA, 17 nt, Salmonella enterica enterica serovar Typhi
uacugaccagacagccc

SEQ ID NO: 1680006 - RNA, 19 nt, Salmonella enterica enterica serovar Typhi
uacugaauaacagcaccau

SEQ ID NO: 1680007 - RNA, 23 nt, Salmonella enterica enterica serovar Typhi
uacucuuucccggcaauuaccgc

SEQ ID NO: 1680008 - RNA, 19 nt, Salmonella enterica enterica serovar Typhi
uacgucgcauacuuccuca

SEQ ID NO: 1680009 - RNA, 19 nt, Salmonella enterica enterica serovar Typhi
uacgucucgaguaaucacu

SEQ ID NO: 1680010 - RNA, 15 nt, Salmonella enterica enterica serovar Typhi
uacuacagaaagcca

SEQ ID NO: 1680011 - RNA, 13 nt, Salmonella enterica enterica serovar Typhi
uacuacaacuguc

SEQ ID NO: 1680012 - RNA, 21 nt, Salmonella enterica enterica serovar Typhi
uacuaaucucacccauagaua

SEQ ID NO: 1680013 - RNA, 17 nt, Salmonella enterica enterica serovar Typhi
uacuaaugaauuuaaua

SEQ ID NO: 1680014 - RNA, 20 nt, Salmonella enterica enterica serovar Typhi
uacuaaugaauuuaauauuu

SEQ ID NO: 1680015 - RNA, 13 nt, Salmonella enterica enterica serovar Typhi
uacuaauaaaauu

SEQ ID NO: 1680016 - RNA, 20 nt, Salmonella enterica enterica serovar Typhi
uacggcuuucacaccguuau

SEQ ID NO: 1680017 - RNA, 13 nt, Salmonella enterica enterica serovar Typhi
uacggcuuccacu

SEQ ID NO: 1680018 - RNA, 21 nt, Salmonella enterica enterica serovar Typhi
uacgggagagcguauccagca

SEQ ID NO: 1680019 - RNA, 23 nt, Salmonella enterica enterica serovar Typhi
uacggcugaaaaauccccccucc

SEQ ID NO: 1680020 - RNA, 18 nt, Salmonella enterica enterica serovar Typhi
uacgggcaugaagaaaau

SEQ ID NO: 1680021 - RNA, 15 nt, Salmonella enterica enterica serovar Typhi
uacguaacaugaccu

SEQ ID NO: 1680022 - RNA, 17 nt, Salmonella enterica enterica serovar Typhi
uacgcuauaaaguuccc

SEQ ID NO: 1680023 - RNA, 14 nt, Salmonella enterica enterica serovar Typhi
uacgcgucaauuac

SEQ ID NO: 1680024 - RNA, 23 nt, Salmonella enterica enterica serovar Typhi
uacgcgauaaaaacccaccagcg

SEQ ID NO: 1680025 - RNA, 18 nt, Salmonella enterica enterica serovar Typhi
uacgcgccacgccauugc

SEQ ID NO: 1680026 - RNA, 17 nt, Salmonella enterica enterica serovar Typhi
uacgcgcugcaaauacu

SEQ ID NO: 1680027 - RNA, 20 nt, Salmonella enterica enterica serovar Typhi
uacgcggcgcgccguaaaca

SEQ ID NO: 1680028 - RNA, 22 nt, Salmonella enterica enterica serovar Typhi
uacgcggcgcgccguaaacaau

SEQ ID NO: 1680029 - RNA, 18 nt, Salmonella enterica enterica serovar Typhi
uaccguaggccggauaag

SEQ ID NO: 1680030 - RNA, 19 nt, Salmonella enterica enterica serovar Typhi
uaccguaagcuuucugaau

SEQ ID NO: 1680031 - RNA, 23 nt, Salmonella enterica enterica serovar Typhi
uaccggcaggugauggcggcuug

SEQ ID NO: 1680032 - RNA, 14 nt, Salmonella enterica enterica serovar Typhi
uaccggcaccagca

SEQ ID NO: 1680033 - RNA, 17 nt, Salmonella enterica enterica serovar Typhi
uaccggcaccagcaaug

SEQ ID NO: 1680034 - RNA, 22 nt, Salmonella enterica enterica serovar Typhi
uaccguuucaacugccccuugu

SEQ ID NO: 1680035 - RNA, 19 nt, Salmonella enterica enterica serovar Typhi
uacgacacccgauacacgc

SEQ ID NO: 1680036 - RNA, 17 nt, Salmonella enterica enterica serovar Typhi
uacgaccggucagccgg

SEQ ID NO: 1680037 - RNA, 14 nt, Salmonella enterica enterica serovar Typhi
uacgaccgccgaca

SEQ ID NO: 1680038 - RNA, 18 nt, Salmonella enterica enterica serovar Typhi
uacgagaaccaacugcca

SEQ ID NO: 1680039 - RNA, 19 nt, Salmonella enterica enterica serovar Typhi
uacgagcauccagaucggc

SEQ ID NO: 1680040 - RNA, 16 nt, Salmonella enterica enterica serovar Typhi
uacgcaaaaaaagcca

SEQ ID NO: 1680041 - RNA, 12 nt, Salmonella enterica enterica serovar Typhi
uacgcaaaucac

SEQ ID NO: 1680042 - RNA, 14 nt, Salmonella enterica enterica serovar Typhi
uacgagauaaaaac

SEQ ID NO: 1680043 - RNA, 13 nt, Salmonella enterica enterica serovar Typhi
uacgcaucaccag

SEQ ID NO: 1680044 - RNA, 14 nt, Salmonella enterica enterica serovar Typhi
uacgccaagcugca

SEQ ID NO: 1680045 - RNA, 16 nt, Salmonella enterica enterica serovar Typhi
uacgccagcagacagg

SEQ ID NO: 1680046 - RNA, 19 nt, Salmonella enterica enterica serovar Typhi
uacgccagcagacagguga

SEQ ID NO: 1680047 - RNA, 19 nt, Salmonella enterica enterica serovar Typhi
uacgccagccgucaugaug

SEQ ID NO: 1680048 - RNA, 20 nt, Salmonella enterica enterica serovar Typhi
uacgccacggcaauuuacaa

SEQ ID NO: 1680049 - RNA, 15 nt, Salmonella enterica enterica serovar Typhi
uacgccagccuaucg

SEQ ID NO: 1680050 - RNA, 16 nt, Salmonella enterica enterica serovar Typhi
uacgcagcaggcagac

SEQ ID NO: 1680051 - RNA, 18 nt, Salmonella enterica enterica serovar Typhi
uacgcagaucguauccag

SEQ ID NO: 1680052 - RNA, 16 nt, Salmonella enterica enterica serovar Typhi
uacgcagccccauuug

SEQ ID NO: 1680053 - RNA, 14 nt, Salmonella enterica enterica serovar Typhi
uacgccccugcugg

SEQ ID NO: 1680054 - RNA, 18 nt, Salmonella enterica enterica serovar Typhi
uacgcccgugacgccagg

SEQ ID NO: 1680055 - RNA, 17 nt, Salmonella enterica enterica serovar Typhi
uacgcccuauccggccg

SEQ ID NO: 1680056 - RNA, 15 nt, Salmonella enterica enterica serovar Typhi
uacgccccacuuuca

SEQ ID NO: 1680057 - RNA, 24 nt, Salmonella enterica enterica serovar Typhi
uacgccuaaauuuaacucguccug

SEQ ID NO: 1680058 - RNA, 12 nt, Salmonella enterica enterica serovar Typhi
uacgccuuaucc

SEQ ID NO: 1680059 - RNA, 13 nt, Salmonella enterica enterica serovar Typhi
uacgccgccgccc

SEQ ID NO: 1680060 - RNA, 21 nt, Salmonella enterica enterica serovar Typhi
guccaugaugaagauauucac

SEQ ID NO: 1680061 - RNA, 21 nt, Salmonella enterica enterica serovar Typhi
guccaucaggcuuugcgccau

SEQ ID NO: 1680062 - RNA, 15 nt, Salmonella enterica enterica serovar Typhi
guccaucagauucaa

SEQ ID NO: 1680063 - RNA, 12 nt, Salmonella enterica enterica serovar Typhi
gucccagccuuc

SEQ ID NO: 1680064 - RNA, 15 nt, Salmonella enterica enterica serovar Typhi
gucccagccuuccug

SEQ ID NO: 1680065 - RNA, 22 nt, Salmonella enterica enterica serovar Typhi
guccaggccugauaagcacagg

SEQ ID NO: 1680066 - RNA, 14 nt, Salmonella enterica enterica serovar Typhi
guccauauucaguu

SEQ ID NO: 1680067 - RNA, 19 nt, Salmonella enterica enterica serovar Typhi
guccauauucaguuuuacg

SEQ ID NO: 1680068 - RNA, 24 nt, Salmonella enterica enterica serovar Typhi
guccacauccagcgccagcgccac

SEQ ID NO: 1680069 - RNA, 16 nt, Salmonella enterica enterica serovar Typhi
guccacauccagcgcc

SEQ ID NO: 1680070 - RNA, 14 nt, Salmonella enterica enterica serovar Typhi
guccagcggcagcu

SEQ ID NO: 1680071 - RNA, 17 nt, Salmonella enterica enterica serovar Typhi
gucauggguagccguuu

SEQ ID NO: 1680072 - RNA, 16 nt, Salmonella enterica enterica serovar Typhi
gucauggguagccguu

SEQ ID NO: 1680073 - RNA, 22 nt, Salmonella enterica enterica serovar Typhi
gucaugaaaagcuauauuuaua

SEQ ID NO: 1680074 - RNA, 20 nt, Salmonella enterica enterica serovar Typhi
gucaucggcacguaguaaug

SEQ ID NO: 1680075 - RNA, 18 nt, Salmonella enterica enterica serovar Typhi
gucaucggcuuuuuucaa

SEQ ID NO: 1680076 - RNA, 24 nt, Salmonella enterica enterica serovar Typhi
gucaucgcuucuauuaccgcagcg

SEQ ID NO: 1680077 - RNA, 20 nt, Salmonella enterica enterica serovar Typhi
gucauuaauucccgcagcca

SEQ ID NO: 1680078 - RNA, 13 nt, Salmonella enterica enterica serovar Typhi
gucaugguaaaac

SEQ ID NO: 1680079 - RNA, 23 nt, Salmonella enterica enterica serovar Typhi
guccaacaaggauauccgccagu

SEQ ID NO: 1680080 - RNA, 13 nt, Salmonella enterica enterica serovar Typhi
gucauuuuuucaa

SEQ ID NO: 1680081 - RNA, 22 nt, Salmonella enterica enterica serovar Typhi
gucaucaaauuaucuguugaua

SEQ ID NO: 1680082 - RNA, 20 nt, Salmonella enterica enterica serovar Typhi
gucaggugggaccaccgcgc

SEQ ID NO: 1680083 - RNA, 22 nt, Salmonella enterica enterica serovar Typhi
gucaucccgguuucccgcguga

SEQ ID NO: 1680084 - RNA, 16 nt, Salmonella enterica enterica serovar Typhi
gucauccggcaaucag

SEQ ID NO: 1680085 - RNA, 18 nt, Salmonella enterica enterica serovar Typhi
gucauccugcaggcggca

SEQ ID NO: 1680086 - RNA, 16 nt, Salmonella enterica enterica serovar Typhi
gucauccgguucaccc

SEQ ID NO: 1680087 - RNA, 21 nt, Salmonella enterica enterica serovar Typhi
gucaucgaaggcaucuucaga

SEQ ID NO: 1680088 - RNA, 16 nt, Salmonella enterica enterica serovar Typhi
gucauccggcauaaga

SEQ ID NO: 1680089 - RNA, 12 nt, Salmonella enterica enterica serovar Typhi
gucagccuugac

SEQ ID NO: 1680090 - RNA, 23 nt, Salmonella enterica enterica serovar Typhi
gucagcgcauaccggccacgagc

SEQ ID NO: 1680091 - RNA, 15 nt, Salmonella enterica enterica serovar Typhi
gucagcgcggcuucc

SEQ ID NO: 1680092 - RNA, 19 nt, Salmonella enterica enterica serovar Typhi
gucaggccgccgcacaggc

SEQ ID NO: 1680093 - RNA, 19 nt, Salmonella enterica enterica serovar Typhi
gucaggccacugcccugga

SEQ ID NO: 1680094 - RNA, 23 nt, Salmonella enterica enterica serovar Typhi
gucagggcgcggcgcaacuuuuu

SEQ ID NO: 1680095 - RNA, 23 nt, Salmonella enterica enterica serovar Typhi
gucagggucuuauuucuccugcg

SEQ ID NO: 1680096 - RNA, 19 nt, Salmonella enterica enterica serovar Typhi
gucagggugaauaccagcg

SEQ ID NO: 1680097 - RNA, 21 nt, Salmonella enterica enterica serovar Typhi
gucagggugaauaccagcggc

SEQ ID NO: 1680098 - RNA, 19 nt, Salmonella enterica enterica serovar Typhi
gucagguaagcuauuacaa

SEQ ID NO: 1680099 - RNA, 13 nt, Salmonella enterica enterica serovar Typhi
gucaggcggcugc

SEQ ID NO: 1680100 - RNA, 14 nt, Salmonella enterica enterica serovar Typhi
gucagggcaaggcg

SEQ ID NO: 1680101 - RNA, 15 nt, Salmonella enterica enterica serovar Typhi
gucagggcgcggcgc

SEQ ID NO: 1680102 - RNA, 16 nt, Salmonella enterica enterica serovar Typhi
gucagggcgcggcgca

SEQ ID NO: 1680103 - RNA, 15 nt, Salmonella enterica enterica serovar Typhi
gucaggcucuaauaa

SEQ ID NO: 1680104 - RNA, 19 nt, Salmonella enterica enterica serovar Typhi
gucagcauaauauccugca

SEQ ID NO: 1680105 - RNA, 15 nt, Salmonella enterica enterica serovar Typhi
gucagcaguuuuauc

SEQ ID NO: 1680106 - RNA, 11 nt, Salmonella enterica enterica serovar Typhi
gucagcaucaa

SEQ ID NO: 1680107 - RNA, 16 nt, Salmonella enterica enterica serovar Typhi
gucaaucgccugcugu

SEQ ID NO: 1680108 - RNA, 19 nt, Salmonella enterica enterica serovar Typhi
gucaacucuuucaggcgag

SEQ ID NO: 1680109 - RNA, 21 nt, Salmonella enterica enterica serovar Typhi
gucaagaucgcgcagcaggcc

SEQ ID NO: 1680110 - RNA, 20 nt, Salmonella enterica enterica serovar Typhi
ggugaaggcaaaacaccaua

SEQ ID NO: 1680111 - RNA, 18 nt, Salmonella enterica enterica serovar Typhi
gucaacguuaacugcugc

SEQ ID NO: 1680112 - RNA, 21 nt, Salmonella enterica enterica serovar Typhi
gucaacguccaguucguucug

SEQ ID NO: 1680113 - RNA, 15 nt, Salmonella enterica enterica serovar Typhi
ggugaagaaaaagaa

SEQ ID NO: 1680114 - RNA, 17 nt, Salmonella enterica enterica serovar Typhi
gucaaugugaauccagg

SEQ ID NO: 1680115 - RNA, 15 nt, Salmonella enterica enterica serovar Typhi
gucaauggcgcuguc

SEQ ID NO: 1680116 - RNA, 15 nt, Salmonella enterica enterica serovar Typhi
gucaaugaucaguuu

SEQ ID NO: 1680117 - RNA, 19 nt, Salmonella enterica enterica serovar Typhi
gucaaugaucaguuugucg

SEQ ID NO: 1680118 - RNA, 22 nt, Salmonella enterica enterica serovar Typhi
gucacccgcuuuuccuguucug

SEQ ID NO: 1680119 - RNA, 18 nt, Salmonella enterica enterica serovar Typhi
gucaccgacacgcauaug

SEQ ID NO: 1680120 - RNA, 17 nt, Salmonella enterica enterica serovar Typhi
gucacccgcguaucauu

SEQ ID NO: 1680121 - RNA, 18 nt, Salmonella enterica enterica serovar Typhi
gucacgcgcaaagcugcg

SEQ ID NO: 1680122 - RNA, 20 nt, Salmonella enterica enterica serovar Typhi
gucacgccggguacauauac

SEQ ID NO: 1680123 - RNA, 22 nt, Salmonella enterica enterica serovar Typhi
gucacgcaugucguauccccag

SEQ ID NO: 1680124 - RNA, 15 nt, Salmonella enterica enterica serovar Typhi
guccccuuuucaccc

SEQ ID NO: 1680125 - RNA, 16 nt, Salmonella enterica enterica serovar Typhi
gucccaggccagaugc

SEQ ID NO: 1680126 - RNA, 22 nt, Salmonella enterica enterica serovar Typhi
guccccucaaacaggcugucug

SEQ ID NO: 1680127 - RNA, 15 nt, Salmonella enterica enterica serovar Typhi
guccccguucugacc

SEQ ID NO: 1680128 - RNA, 17 nt, Salmonella enterica enterica serovar Typhi
guccggccccaaacugg

SEQ ID NO: 1680129 - RNA, 16 nt, Salmonella enterica enterica serovar Typhi
guccugaucggcggcc

SEQ ID NO: 1680130 - RNA, 20 nt, Salmonella enterica enterica serovar Typhi
guccugcgggaacaugcaua

SEQ ID NO: 1680131 - RNA, 14 nt, Salmonella enterica enterica serovar Typhi
guccuccauggcuu

SEQ ID NO: 1680132 - RNA, 15 nt, Salmonella enterica enterica serovar Typhi
guccgggaaggacgc

SEQ ID NO: 1680133 - RNA, 17 nt, Salmonella enterica enterica serovar Typhi
guccggcgcuaaccagc

SEQ ID NO: 1680134 - RNA, 20 nt, Salmonella enterica enterica serovar Typhi
guccucacacugauggcaga

SEQ ID NO: 1680135 - RNA, 20 nt, Salmonella enterica enterica serovar Typhi
gucgagcaucuccagcgcau

SEQ ID NO: 1680136 - RNA, 17 nt, Salmonella enterica enterica serovar Typhi
gucgacgccuuccacuu

SEQ ID NO: 1680137 - RNA, 16 nt, Salmonella enterica enterica serovar Typhi
gucgacgucuuucuua

SEQ ID NO: 1680138 - RNA, 23 nt, Salmonella enterica enterica serovar Typhi
gucgauacucacgacuuucacca

SEQ ID NO: 1680139 - RNA, 13 nt, Salmonella enterica enterica serovar Typhi
guccuucuccuuc

SEQ ID NO: 1680140 - RNA, 21 nt, Salmonella enterica enterica serovar Typhi
guccuuuaucugcccuuucuu

SEQ ID NO: 1680141 - RNA, 21 nt, Salmonella enterica enterica serovar Typhi
gucgacauaauuuccggccag

SEQ ID NO: 1680142 - RNA, 22 nt, Salmonella enterica enterica serovar Typhi
gucgacauaauuuccggccagu

SEQ ID NO: 1680143 - RNA, 14 nt, Salmonella enterica enterica serovar Typhi
gucgaccagcggcu

SEQ ID NO: 1680144 - RNA, 19 nt, Salmonella enterica enterica serovar Typhi
gucgaccgcagaccggaug

SEQ ID NO: 1680145 - RNA, 17 nt, Salmonella enterica enterica serovar Typhi
gucgcaagacgaaaaau

SEQ ID NO: 1680146 - RNA, 16 nt, Salmonella enterica enterica serovar Typhi
gucgauuuugccuuca

SEQ ID NO: 1680147 - RNA, 20 nt, Salmonella enterica enterica serovar Typhi
gucgcagcggcggucugcgc

SEQ ID NO: 1680148 - RNA, 23 nt, Salmonella enterica enterica serovar Typhi
gucgcccgcuaacggcaccagca

SEQ ID NO: 1680149 - RNA, 15 nt, Salmonella enterica enterica serovar Typhi
gucgccgcgcccagc

SEQ ID NO: 1680150 - RNA, 22 nt, Salmonella enterica enterica serovar Typhi
gucgccgcgcccagcagcagaa

SEQ ID NO: 1680151 - RNA, 14 nt, Salmonella enterica enterica serovar Typhi
gucgcggcuuucag

SEQ ID NO: 1680152 - RNA, 15 nt, Salmonella enterica enterica serovar Typhi
gucgcggcuuucagc

SEQ ID NO: 1680153 - RNA, 14 nt, Salmonella enterica enterica serovar Typhi
gucgcggccaccgc

SEQ ID NO: 1680154 - RNA, 14 nt, Salmonella enterica enterica serovar Typhi
gucgccuuccagcg

SEQ ID NO: 1680155 - RNA, 18 nt, Salmonella enterica enterica serovar Typhi
gucgccuuccugcaggcg

SEQ ID NO: 1680156 - RNA, 15 nt, Salmonella enterica enterica serovar Typhi
gucgccggggcgcug

SEQ ID NO: 1680157 - RNA, 18 nt, Salmonella enterica enterica serovar Typhi
gucgccggggcgcuggcg

SEQ ID NO: 1680158 - RNA, 17 nt, Salmonella enterica enterica serovar Typhi
gucguaaaacugcacca

SEQ ID NO: 1680159 - RNA, 19 nt, Salmonella enterica enterica serovar Typhi
gucggcaccgaauguuccg

SEQ ID NO: 1680160 - RNA, 23 nt, Salmonella enterica enterica serovar Typhi
gucggaaaucuguuccagcgagc

SEQ ID NO: 1680161 - RNA, 20 nt, Salmonella enterica enterica serovar Typhi
gucggcaucgugaaacucac

SEQ ID NO: 1680162 - RNA, 13 nt, Salmonella enterica enterica serovar Typhi
gucggcagacugg

SEQ ID NO: 1680163 - RNA, 15 nt, Salmonella enterica enterica serovar Typhi
gucggcagcaccgga

SEQ ID NO: 1680164 - RNA, 15 nt, Salmonella enterica enterica serovar Typhi
gucggcuuuuguucc

SEQ ID NO: 1680165 - RNA, 15 nt, Salmonella enterica enterica serovar Typhi
gucgggaacgcuguc

SEQ ID NO: 1680166 - RNA, 20 nt, Salmonella enterica enterica serovar Typhi
gucgggaaagggcggcagcg

SEQ ID NO: 1680167 - RNA, 23 nt, Salmonella enterica enterica serovar Typhi
gucugcugggcgauuucacgaau

SEQ ID NO: 1680168 - RNA, 15 nt, Salmonella enterica enterica serovar Typhi
gucugcuucgucugg

SEQ ID NO: 1680169 - RNA, 12 nt, Salmonella enterica enterica serovar Typhi
gucugcucagaa

SEQ ID NO: 1680170 - RNA, 15 nt, Salmonella enterica enterica serovar Typhi
gucugcgcugggccg

SEQ ID NO: 1680171 - RNA, 22 nt, Salmonella enterica enterica serovar Typhi
gucugcgcugggccgggccuga

SEQ ID NO: 1680172 - RNA, 15 nt, Salmonella enterica enterica serovar Typhi
gucuggugauccagc

SEQ ID NO: 1680173 - RNA, 11 nt, Salmonella enterica enterica serovar Typhi
gucuggucagc

SEQ ID NO: 1680174 - RNA, 20 nt, Salmonella enterica enterica serovar Typhi
gucugguacggccaccaggc

SEQ ID NO: 1680175 - RNA, 20 nt, Salmonella enterica enterica serovar Typhi
gucugguaucugucaugcgg

SEQ ID NO: 1680176 - RNA, 20 nt, Salmonella enterica enterica serovar Typhi
gucuggcagcggcaguaaau

SEQ ID NO: 1680177 - RNA, 19 nt, Salmonella enterica enterica serovar Typhi
gucuggcgugccgggcugg

SEQ ID NO: 1680178 - RNA, 23 nt, Salmonella enterica enterica serovar Typhi
gucuggccauuaucgaucugagc

SEQ ID NO: 1680179 - RNA, 13 nt, Salmonella enterica enterica serovar Typhi
gucuggggaacaa

SEQ ID NO: 1680180 - RNA, 20 nt, Salmonella enterica enterica serovar Typhi
gucuggcgugccgggcuggc

SEQ ID NO: 1680181 - RNA, 15 nt, Salmonella enterica enterica serovar Typhi
gucugaaucugcucc

SEQ ID NO: 1680182 - RNA, 20 nt, Salmonella enterica enterica serovar Typhi
gucugacaacuauugcugcc

SEQ ID NO: 1680183 - RNA, 13 nt, Salmonella enterica enterica serovar Typhi
gucugaccgggcg

SEQ ID NO: 1680184 - RNA, 16 nt, Salmonella enterica enterica serovar Typhi
gucugagcgcaaacau

SEQ ID NO: 1680185 - RNA, 14 nt, Salmonella enterica enterica serovar Typhi
gucugauaaacgca

SEQ ID NO: 1680186 - RNA, 14 nt, Salmonella enterica enterica serovar Typhi
gucugaaucugcuc

SEQ ID NO: 1680187 - RNA, 23 nt, Salmonella enterica enterica serovar Typhi
gucugaaucagugcaucuucacu

SEQ ID NO: 1680188 - RNA, 19 nt, Salmonella enterica enterica serovar Typhi
gucugaagaaguucuucug

SEQ ID NO: 1680189 - RNA, 20 nt, Salmonella enterica enterica serovar Typhi
gucugaaggcguaugaauga

SEQ ID NO: 1680190 - RNA, 22 nt, Salmonella enterica enterica serovar Typhi
gucugcaaaauuuguggugguc

SEQ ID NO: 1680191 - RNA, 15 nt, Salmonella enterica enterica serovar Typhi
gucugcaagagaaau

SEQ ID NO: 1680192 - RNA, 23 nt, Salmonella enterica enterica serovar Typhi
gucugauugccggaugacgcuuc

SEQ ID NO: 1680193 - RNA, 17 nt, Salmonella enterica enterica serovar Typhi
gucucugagaucaaaca

SEQ ID NO: 1680194 - RNA, 16 nt, Salmonella enterica enterica serovar Typhi
gucucuuuauugaaaa

SEQ ID NO: 1680195 - RNA, 13 nt, Salmonella enterica enterica serovar Typhi
gucugaaaauaau

SEQ ID NO: 1680196 - RNA, 19 nt, Salmonella enterica enterica serovar Typhi
gucucucgugcaggccgga

SEQ ID NO: 1680197 - RNA, 18 nt, Salmonella enterica enterica serovar Typhi
gucucucccgaucuucug

SEQ ID NO: 1680198 - RNA, 13 nt, Salmonella enterica enterica serovar Typhi
gucucucccucaa

SEQ ID NO: 1680199 - RNA, 14 nt, Salmonella enterica enterica serovar Typhi
gucucggccuggcc

SEQ ID NO: 1680200 - RNA, 18 nt, Salmonella enterica enterica serovar Typhi
gucuccggcgcgccgcug

SEQ ID NO: 1680201 - RNA, 18 nt, Salmonella enterica enterica serovar Typhi
gucuccucgccagcuacc

SEQ ID NO: 1680202 - RNA, 19 nt, Salmonella enterica enterica serovar Typhi
gucuccugccaaugaaaua

SEQ ID NO: 1680203 - RNA, 18 nt, Salmonella enterica enterica serovar Typhi
gucucauuauuaaauuaa

SEQ ID NO: 1680204 - RNA, 21 nt, Salmonella enterica enterica serovar Typhi
gucucauuguguacauccaga

SEQ ID NO: 1680205 - RNA, 15 nt, Salmonella enterica enterica serovar Typhi
gucucagguucgaau

SEQ ID NO: 1680206 - RNA, 19 nt, Salmonella enterica enterica serovar Typhi
gucucaucggucgcaucca

SEQ ID NO: 1680207 - RNA, 19 nt, Salmonella enterica enterica serovar Typhi
gucucagauggaaaaaaag

SEQ ID NO: 1680208 - RNA, 20 nt, Salmonella enterica enterica serovar Typhi
gucucagauggaaaaaaaga

SEQ ID NO: 1680209 - RNA, 15 nt, Salmonella enterica enterica serovar Typhi
gucguuaccgggcug

SEQ ID NO: 1680210 - RNA, 15 nt, Salmonella enterica enterica serovar Typhi
gucguggguucgaau

SEQ ID NO: 1680211 - RNA, 15 nt, Salmonella enterica enterica serovar Typhi
gucuucccagguuuc

SEQ ID NO: 1680212 - RNA, 15 nt, Salmonella enterica enterica serovar Typhi
gucuuccgacacuga

SEQ ID NO: 1680213 - RNA, 16 nt, Salmonella enterica enterica serovar Typhi
gucuuccuucguuacu

SEQ ID NO: 1680214 - RNA, 15 nt, Salmonella enterica enterica serovar Typhi
gucuucugccagcaa

SEQ ID NO: 1680215 - RNA, 23 nt, Salmonella enterica enterica serovar Typhi
gucuucuucuucgcgcauuucug

SEQ ID NO: 1680216 - RNA, 14 nt, Salmonella enterica enterica serovar Typhi
gucuuauuauuauu

SEQ ID NO: 1680217 - RNA, 19 nt, Salmonella enterica enterica serovar Typhi
gucuucaacguuccuucag

SEQ ID NO: 1680218 - RNA, 17 nt, Salmonella enterica enterica serovar Typhi
gucuuauuucuccugcg

SEQ ID NO: 1680219 - RNA, 12 nt, Salmonella enterica enterica serovar Typhi
gucuucaucuau

SEQ ID NO: 1680220 - RNA, 14 nt, Salmonella enterica enterica serovar Typhi
gucuucaucagcca

SEQ ID NO: 1680221 - RNA, 16 nt, Salmonella enterica enterica serovar Typhi
gucuucaucagccagc

SEQ ID NO: 1680222 - RNA, 19 nt, Salmonella enterica enterica serovar Typhi
gucuucaucagccagcauc

SEQ ID NO: 1680223 - RNA, 20 nt, Salmonella enterica enterica serovar Typhi
gucuucaucagccagcaucg

SEQ ID NO: 1680224 - RNA, 19 nt, Salmonella enterica enterica serovar Typhi
gucuuauccggccuccaaa

SEQ ID NO: 1680225 - RNA, 17 nt, Salmonella enterica enterica serovar Typhi
gucuuacacuuagcaca

SEQ ID NO: 1680226 - RNA, 21 nt, Salmonella enterica enterica serovar Typhi
gucuguucguagcccauagca

SEQ ID NO: 1680227 - RNA, 22 nt, Salmonella enterica enterica serovar Typhi
gucuguuuugccuugccacgca

SEQ ID NO: 1680228 - RNA, 14 nt, Salmonella enterica enterica serovar Typhi
gucuguguugaaua

SEQ ID NO: 1680229 - RNA, 13 nt, Salmonella enterica enterica serovar Typhi
gucugucaggacu

SEQ ID NO: 1680230 - RNA, 15 nt, Salmonella enterica enterica serovar Typhi
gucugucgguaaaga

SEQ ID NO: 1680231 - RNA, 20 nt, Salmonella enterica enterica serovar Typhi
gucugucggacucaggguga

SEQ ID NO: 1680232 - RNA, 22 nt, Salmonella enterica enterica serovar Typhi
gucuugucaggcucuaauaacu

SEQ ID NO: 1680233 - RNA, 23 nt, Salmonella enterica enterica serovar Typhi
gucuuuccgacccuuaugucauu

SEQ ID NO: 1680234 - RNA, 18 nt, Salmonella enterica enterica serovar Typhi
gucuuuauucaucaucuu

SEQ ID NO: 1680235 - RNA, 15 nt, Salmonella enterica enterica serovar Typhi
gucuuucuucgcugc

SEQ ID NO: 1680236 - RNA, 15 nt, Salmonella enterica enterica serovar Typhi
gucuuuuucaucuuu

SEQ ID NO: 1680237 - RNA, 13 nt, Salmonella enterica enterica serovar Typhi
gucuuuucugucg

SEQ ID NO: 1680238 - RNA, 12 nt, Salmonella enterica enterica serovar Typhi
gucuuuuauccc

SEQ ID NO: 1680239 - RNA, 21 nt, Salmonella enterica enterica serovar Typhi
gugaaauaaacguaccgauga

SEQ ID NO: 1680240 - RNA, 17 nt, Salmonella enterica enterica serovar Typhi
gugaaagcgcuugauaa

SEQ ID NO: 1680241 - RNA, 14 nt, Salmonella enterica enterica serovar Typhi
gugaaaagcuuaga

SEQ ID NO: 1680242 - RNA, 17 nt, Salmonella enterica enterica serovar Typhi
gugaaaagggaugcuga

SEQ ID NO: 1680243 - RNA, 21 nt, Salmonella enterica enterica serovar Typhi
gugaacauggguuucuugccg

SEQ ID NO: 1680244 - RNA, 16 nt, Salmonella enterica enterica serovar Typhi
gugaacaccacugaaa

SEQ ID NO: 1680245 - RNA, 18 nt, Salmonella enterica enterica serovar Typhi
gugaaauuauuccuuauc

SEQ ID NO: 1680246 - RNA, 17 nt, Salmonella enterica enterica serovar Typhi
aaauagccagaaugcca

SEQ ID NO: 1680247 - RNA, 21 nt, Salmonella enterica enterica serovar Typhi
gugaaccagcaucccacgaau

SEQ ID NO: 1680248 - RNA, 18 nt, Salmonella enterica enterica serovar Typhi
aaauagcaagagaugagc

SEQ ID NO: 1680249 - RNA, 20 nt, Salmonella enterica enterica serovar Typhi
gugcaggauuuguaucacaa

SEQ ID NO: 1680250 - RNA, 16 nt, Salmonella enterica enterica serovar Typhi
gugcaggaucaaccgg

SEQ ID NO: 1680251 - RNA, 14 nt, Salmonella enterica enterica serovar Typhi
gugcagcaaauaau

SEQ ID NO: 1680252 - RNA, 16 nt, Salmonella enterica enterica serovar Typhi
gugcagcaagcggcug

SEQ ID NO: 1680253 - RNA, 14 nt, Salmonella enterica enterica serovar Typhi
gugcagcgugccgg

SEQ ID NO: 1680254 - RNA, 23 nt, Salmonella enterica enterica serovar Typhi
gugcaaucccggaacagcggagc

SEQ ID NO: 1680255 - RNA, 24 nt, Salmonella enterica enterica serovar Typhi
gugcaaucccggaacagcggagcg

SEQ ID NO: 1680256 - RNA, 20 nt, Salmonella enterica enterica serovar Typhi
gugcaaugucaugacugguu

SEQ ID NO: 1680257 - RNA, 23 nt, Salmonella enterica enterica serovar Typhi
gugcaauccugucgucaccagca

SEQ ID NO: 1680258 - RNA, 17 nt, Salmonella enterica enterica serovar Typhi
gugauccaccaccagca

SEQ ID NO: 1680259 - RNA, 18 nt, Salmonella enterica enterica serovar Typhi
gugaucggagaaauagac

SEQ ID NO: 1680260 - RNA, 12 nt, Salmonella enterica enterica serovar Typhi
gugcaagcaccu

SEQ ID NO: 1680261 - RNA, 22 nt, Salmonella enterica enterica serovar Typhi
gugauuggcuggacauguuccg

SEQ ID NO: 1680262 - RNA, 18 nt, Salmonella enterica enterica serovar Typhi
gugauuuacuccaaaaau

SEQ ID NO: 1680263 - RNA, 18 nt, Salmonella enterica enterica serovar Typhi
gugacuaauagccaaaag

SEQ ID NO: 1680264 - RNA, 17 nt, Salmonella enterica enterica serovar Typhi
gugacuaauagccaaaa

SEQ ID NO: 1680265 - RNA, 15 nt, Salmonella enterica enterica serovar Typhi
gugacuuugcccuuu

SEQ ID NO: 1680266 - RNA, 14 nt, Salmonella enterica enterica serovar Typhi
gugagcgaacaggu

SEQ ID NO: 1680267 - RNA, 15 nt, Salmonella enterica enterica serovar Typhi
gugagcccuccucca

SEQ ID NO: 1680268 - RNA, 23 nt, Salmonella enterica enterica serovar Typhi
gugagcccuccuccagcgcgucc

SEQ ID NO: 1680269 - RNA, 23 nt, Salmonella enterica enterica serovar Typhi
gugagaucguuauuaaacagaca

SEQ ID NO: 1680270 - RNA, 21 nt, Salmonella enterica enterica serovar Typhi
gugaggcaucgcccuguaaga

SEQ ID NO: 1680271 - RNA, 16 nt, Salmonella enterica enterica serovar Typhi
gugaggagcuuuagcu

SEQ ID NO: 1680272 - RNA, 18 nt, Salmonella enterica enterica serovar Typhi
gugaguaauaacaaaaaa

SEQ ID NO: 1680273 - RNA, 15 nt, Salmonella enterica enterica serovar Typhi
gugaguacgcaggag

SEQ ID NO: 1680274 - RNA, 20 nt, Salmonella enterica enterica serovar Typhi
gugaguggcggcgcgcaggc

SEQ ID NO: 1680275 - RNA, 19 nt, Salmonella enterica enterica serovar Typhi
gugaguguuacucuuccuc

SEQ ID NO: 1680276 - RNA, 16 nt, Salmonella enterica enterica serovar Typhi
gugaguuucgcaucag

SEQ ID NO: 1680277 - RNA, 16 nt, Salmonella enterica enterica serovar Typhi
gugauaaagcagacca

SEQ ID NO: 1680278 - RNA, 14 nt, Salmonella enterica enterica serovar Typhi
gugauaaagcccgu

SEQ ID NO: 1680279 - RNA, 20 nt, Salmonella enterica enterica serovar Typhi
aaauaggcgaggaaaacauu

SEQ ID NO: 1680280 - RNA, 18 nt, Salmonella enterica enterica serovar Typhi
aaauaguaaauagaaaau

SEQ ID NO: 1680281 - RNA, 21 nt, Salmonella enterica enterica serovar Typhi
aaauaguauaacgaugauuau

SEQ ID NO: 1680282 - RNA, 22 nt, Salmonella enterica enterica serovar Typhi
aaauaguucaucgugaaauuau

SEQ ID NO: 1680283 - RNA, 21 nt, Salmonella enterica enterica serovar Typhi
gugacggaggcgggcgcgcag

SEQ ID NO: 1680284 - RNA, 23 nt, Salmonella enterica enterica serovar Typhi
gugacgucaagaucgcgcagcag

SEQ ID NO: 1680285 - RNA, 21 nt, Salmonella enterica enterica serovar Typhi
gugaccgguaagcccauggca

SEQ ID NO: 1680286 - RNA, 12 nt, Salmonella enterica enterica serovar Typhi
gugaccugcuga

SEQ ID NO: 1680287 - RNA, 14 nt, Salmonella enterica enterica serovar Typhi
gugaccugcugacu

SEQ ID NO: 1680288 - RNA, 15 nt, Salmonella enterica enterica serovar Typhi
gugaccgauaaaaaa

SEQ ID NO: 1680289 - RNA, 20 nt, Salmonella enterica enterica serovar Typhi
gugaccccggccucgcccgc

SEQ ID NO: 1680290 - RNA, 12 nt, Salmonella enterica enterica serovar Typhi
gugacccgccgc

SEQ ID NO: 1680291 - RNA, 16 nt, Salmonella enterica enterica serovar Typhi
gugacccgccgccagc

SEQ ID NO: 1680292 - RNA, 18 nt, Salmonella enterica enterica serovar Typhi
gugacccgccgccagcac

SEQ ID NO: 1680293 - RNA, 19 nt, Salmonella enterica enterica serovar Typhi
gugacccgccgccagcacc

SEQ ID NO: 1680294 - RNA, 19 nt, Salmonella enterica enterica serovar Typhi
gugaaucgacggcaauauu

SEQ ID NO: 1680295 - RNA, 13 nt, Salmonella enterica enterica serovar Typhi
gugaauuucugcu

SEQ ID NO: 1680296 - RNA, 14 nt, Salmonella enterica enterica serovar Typhi
gugaagccaucaaa

SEQ ID NO: 1680297 - RNA, 21 nt, Salmonella enterica enterica serovar Typhi
gugaaggcaaaacaccauauu

SEQ ID NO: 1680298 - RNA, 12 nt, Salmonella enterica enterica serovar Typhi
gugaaggcaaaa

SEQ ID NO: 1680299 - RNA, 13 nt, Salmonella enterica enterica serovar Typhi
gugaauaaauccu

SEQ ID NO: 1680300 - RNA, 16 nt, Salmonella enterica enterica serovar Typhi
gugaauaccaaagccc

SEQ ID NO: 1680301 - RNA, 18 nt, Salmonella enterica enterica serovar Typhi
gugaauaugaucugcaca

SEQ ID NO: 1680302 - RNA, 20 nt, Salmonella enterica enterica serovar Typhi
gugaaccauggcaacaugga

SEQ ID NO: 1680303 - RNA, 12 nt, Salmonella enterica enterica serovar Typhi
gugaaccauggc

SEQ ID NO: 1680304 - RNA, 19 nt, Salmonella enterica enterica serovar Typhi
gugaacgcacgcagccaac

SEQ ID NO: 1680305 - RNA, 14 nt, Salmonella enterica enterica serovar Typhi
gugaaccgguaaag

SEQ ID NO: 1680306 - RNA, 14 nt, Salmonella enterica enterica serovar Typhi
aaauagcuggcugu

SEQ ID NO: 1680307 - RNA, 18 nt, Salmonella enterica enterica serovar Typhi
aaauagccguuaccgccg

SEQ ID NO: 1680308 - RNA, 20 nt, Salmonella enterica enterica serovar Typhi
aaauagccgaaacuuauacu

SEQ ID NO: 1680309 - RNA, 16 nt, Salmonella enterica enterica serovar Typhi
gugaagaaucccccau

SEQ ID NO: 1680310 - RNA, 17 nt, Salmonella enterica enterica serovar Typhi
gugaacgccuccauuuu

SEQ ID NO: 1680311 - RNA, 18 nt, Salmonella enterica enterica serovar Typhi
gugaacgccaaauacguc

SEQ ID NO: 1680312 - RNA, 22 nt, Salmonella enterica enterica serovar Typhi
guuuccacugagcuucaccgcc

SEQ ID NO: 1680313 - RNA, 17 nt, Salmonella enterica enterica serovar Typhi
guuuccacugagcuuca

SEQ ID NO: 1680314 - RNA, 21 nt, Salmonella enterica enterica serovar Typhi
guuuccagcaucgaccaggau

SEQ ID NO: 1680315 - RNA, 21 nt, Salmonella enterica enterica serovar Typhi
aaauauuggcggcaaagaaaa

SEQ ID NO: 1680316 - RNA, 16 nt, Salmonella enterica enterica serovar Typhi
guuucccucauauuug

SEQ ID NO: 1680317 - RNA, 12 nt, Salmonella enterica enterica serovar Typhi
guuucccugacc

SEQ ID NO: 1680318 - RNA, 21 nt, Salmonella enterica enterica serovar Typhi
guuucccccuccauacccuau

SEQ ID NO: 1680319 - RNA, 13 nt, Salmonella enterica enterica serovar Typhi
guuucccagguuu

SEQ ID NO: 1680320 - RNA, 22 nt, Salmonella enterica enterica serovar Typhi
guuucccauugggccagcagcg

SEQ ID NO: 1680321 - RNA, 21 nt, Salmonella enterica enterica serovar Typhi
guuucccaacaaugccacgcc

SEQ ID NO: 1680322 - RNA, 19 nt, Salmonella enterica enterica serovar Typhi
guuuccggcauccagcgcu

SEQ ID NO: 1680323 - RNA, 22 nt, Salmonella enterica enterica serovar Typhi
guuuccguuuguaacauauuuu

SEQ ID NO: 1680324 - RNA, 14 nt, Salmonella enterica enterica serovar Typhi
guuuccggcgggag

SEQ ID NO: 1680325 - RNA, 19 nt, Salmonella enterica enterica serovar Typhi
guuuccgcuagggcaucag

SEQ ID NO: 1680326 - RNA, 18 nt, Salmonella enterica enterica serovar Typhi
aaaucaaagaccuccgcc

SEQ ID NO: 1680327 - RNA, 22 nt, Salmonella enterica enterica serovar Typhi
aaaucaacgaaaucagagacaa

SEQ ID NO: 1680328 - RNA, 19 nt, Salmonella enterica enterica serovar Typhi
guuucucccgccagaugca

SEQ ID NO: 1680329 - RNA, 18 nt, Salmonella enterica enterica serovar Typhi
guuucuagaugaugauuu

SEQ ID NO: 1680330 - RNA, 14 nt, Salmonella enterica enterica serovar Typhi
guuucuacggccac

SEQ ID NO: 1680331 - RNA, 20 nt, Salmonella enterica enterica serovar Typhi
aaaucacuaagaccagcauc

SEQ ID NO: 1680332 - RNA, 16 nt, Salmonella enterica enterica serovar Typhi
aaaucacaucgccgga

SEQ ID NO: 1680333 - RNA, 18 nt, Salmonella enterica enterica serovar Typhi
guuucguuuagcgccugc

SEQ ID NO: 1680334 - RNA, 22 nt, Salmonella enterica enterica serovar Typhi
aaaucaacgcucagaccgaucu

SEQ ID NO: 1680335 - RNA, 18 nt, Salmonella enterica enterica serovar Typhi
guuucgacaguuucuucu

SEQ ID NO: 1680336 - RNA, 15 nt, Salmonella enterica enterica serovar Typhi
guuucgccgcagggu

SEQ ID NO: 1680337 - RNA, 16 nt, Salmonella enterica enterica serovar Typhi
guuucgauagcaggca

SEQ ID NO: 1680338 - RNA, 14 nt, Salmonella enterica enterica serovar Typhi
guuucgccagcgcg

SEQ ID NO: 1680339 - RNA, 14 nt, Salmonella enterica enterica serovar Typhi
guuucggcauccca

SEQ ID NO: 1680340 - RNA, 18 nt, Salmonella enterica enterica serovar Typhi
guuugcucgccauaaauc

SEQ ID NO: 1680341 - RNA, 18 nt, Salmonella enterica enterica serovar Typhi
guuugcugacaaucugcu

SEQ ID NO: 1680342 - RNA, 15 nt, Salmonella enterica enterica serovar Typhi
guuugcgauccagua

SEQ ID NO: 1680343 - RNA, 18 nt, Salmonella enterica enterica serovar Typhi
guuugcggauuggauaaa

SEQ ID NO: 1680344 - RNA, 19 nt, Salmonella enterica enterica serovar Typhi
guuuuacgaugguugugug

SEQ ID NO: 1680345 - RNA, 22 nt, Salmonella enterica enterica serovar Typhi
guuuuacuuuuuuaaauguuuu

SEQ ID NO: 1680346 - RNA, 18 nt, Salmonella enterica enterica serovar Typhi
guuugugguugguagccc

SEQ ID NO: 1680347 - RNA, 22 nt, Salmonella enterica enterica serovar Typhi
guuugaggaaaccuuucuucuc

SEQ ID NO: 1680348 - RNA, 23 nt, Salmonella enterica enterica serovar Typhi
guuugaggaaaccuuucuucucu

SEQ ID NO: 1680349 - RNA, 19 nt, Salmonella enterica enterica serovar Typhi
guuugagaaaaacaucaug

SEQ ID NO: 1680350 - RNA, 15 nt, Salmonella enterica enterica serovar Typhi
guuugaucauggcuc

SEQ ID NO: 1680351 - RNA, 19 nt, Salmonella enterica enterica serovar Typhi
guuugaggcuugcagcauu

SEQ ID NO: 1680352 - RNA, 23 nt, Salmonella enterica enterica serovar Typhi
guuucugccgguucggcaucgcc

SEQ ID NO: 1680353 - RNA, 19 nt, Salmonella enterica enterica serovar Typhi
guuucucuugugcuuccag

SEQ ID NO: 1680354 - RNA, 15 nt, Salmonella enterica enterica serovar Typhi
guuuugcuggaauuu

SEQ ID NO: 1680355 - RNA, 18 nt, Salmonella enterica enterica serovar Typhi
guuuugccaguuucucaa

SEQ ID NO: 1680356 - RNA, 22 nt, Salmonella enterica enterica serovar Typhi
guuuucaggccgcguaauuuuu

SEQ ID NO: 1680357 - RNA, 14 nt, Salmonella enterica enterica serovar Typhi
guuuucaggucaua

SEQ ID NO: 1680358 - RNA, 22 nt, Salmonella enterica enterica serovar Typhi
aaaucauuuguacaaaaaaugu

SEQ ID NO: 1680359 - RNA, 22 nt, Salmonella enterica enterica serovar Typhi
aaaucauuacuuauauuuauuu

SEQ ID NO: 1680360 - RNA, 24 nt, Salmonella enterica enterica serovar Typhi
aaaucaucaaucgcuaucugacag

SEQ ID NO: 1680361 - RNA, 13 nt, Salmonella enterica enterica serovar Typhi
aaaucaucaaugg

SEQ ID NO: 1680362 - RNA, 12 nt, Salmonella enterica enterica serovar Typhi
aaaucagacuaa

SEQ ID NO: 1680363 - RNA, 15 nt, Salmonella enterica enterica serovar Typhi
aaaucauaccagcga

SEQ ID NO: 1680364 - RNA, 17 nt, Salmonella enterica enterica serovar Typhi
guuucaugccauacucc

SEQ ID NO: 1680365 - RNA, 19 nt, Salmonella enterica enterica serovar Typhi
guuucauggagauccagua

SEQ ID NO: 1680366 - RNA, 14 nt, Salmonella enterica enterica serovar Typhi
guuucaucucuccg

SEQ ID NO: 1680367 - RNA, 19 nt, Salmonella enterica enterica serovar Typhi
guuucaccguuuucgucaa

SEQ ID NO: 1680368 - RNA, 12 nt, Salmonella enterica enterica serovar Typhi
guuucaccuucu

SEQ ID NO: 1680369 - RNA, 13 nt, Salmonella enterica enterica serovar Typhi
guuucaccagcac

SEQ ID NO: 1680370 - RNA, 22 nt, Salmonella enterica enterica serovar Typhi
guuucaggacggcauaagccag

SEQ ID NO: 1680371 - RNA, 17 nt, Salmonella enterica enterica serovar Typhi
aaauaucucucccuccc

SEQ ID NO: 1680372 - RNA, 17 nt, Salmonella enterica enterica serovar Typhi
aaauaugcggagccucu

SEQ ID NO: 1680373 - RNA, 19 nt, Salmonella enterica enterica serovar Typhi
aaauaugagguugucuuug

SEQ ID NO: 1680374 - RNA, 22 nt, Salmonella enterica enterica serovar Typhi
aaauaugagguugucuuugcug

SEQ ID NO: 1680375 - RNA, 16 nt, Salmonella enterica enterica serovar Typhi
aaauaugaaagagaaa

SEQ ID NO: 1680376 - RNA, 19 nt, Salmonella enterica enterica serovar Typhi
guuucaaugcccaggcgcc

SEQ ID NO: 1680377 - RNA, 15 nt, Salmonella enterica enterica serovar Typhi
guuucaauccaugua

SEQ ID NO: 1680378 - RNA, 23 nt, Salmonella enterica enterica serovar Typhi
guuucaauauagccguggcuggc

SEQ ID NO: 1680379 - RNA, 21 nt, Salmonella enterica enterica serovar Typhi
guuucaacccccucagcaaug

SEQ ID NO: 1680380 - RNA, 17 nt, Salmonella enterica enterica serovar Typhi
guuuauauaaaaauagc

SEQ ID NO: 1680381 - RNA, 18 nt, Salmonella enterica enterica serovar Typhi
guuuagaaaaaauuaaaa

SEQ ID NO: 1680382 - RNA, 22 nt, Salmonella enterica enterica serovar Typhi
guuuauaugcguguagcagaua

SEQ ID NO: 1680383 - RNA, 17 nt, Salmonella enterica enterica serovar Typhi
guugucggggcuuuaau

SEQ ID NO: 1680384 - RNA, 22 nt, Salmonella enterica enterica serovar Typhi
guuuaacguuucauggaaauca

SEQ ID NO: 1680385 - RNA, 23 nt, Salmonella enterica enterica serovar Typhi
guuguccccucaugacuuuuuuc

SEQ ID NO: 1680386 - RNA, 23 nt, Salmonella enterica enterica serovar Typhi
guuuaaucucuucaucuguggca

SEQ ID NO: 1680387 - RNA, 19 nt, Salmonella enterica enterica serovar Typhi
guuuaaugcuuucaauacu

SEQ ID NO: 1680388 - RNA, 15 nt, Salmonella enterica enterica serovar Typhi
guuuacgccgccauc

SEQ ID NO: 1680389 - RNA, 13 nt, Salmonella enterica enterica serovar Typhi
guuuaagcggaua

SEQ ID NO: 1680390 - RNA, 14 nt, Salmonella enterica enterica serovar Typhi
guuuacgcugcucc

SEQ ID NO: 1680391 - RNA, 23 nt, Salmonella enterica enterica serovar Typhi
guuuacguagcaaauagauaaag

SEQ ID NO: 1680392 - RNA, 18 nt, Salmonella enterica enterica serovar Typhi
guuuacgcccucaucggc

SEQ ID NO: 1680393 - RNA, 18 nt, Salmonella enterica enterica serovar Typhi
guuuacuaaaacgguuuu

SEQ ID NO: 1680394 - RNA, 13 nt, Salmonella enterica enterica serovar Typhi
guuuacuccauuc

SEQ ID NO: 1680395 - RNA, 19 nt, Salmonella enterica enterica serovar Typhi
guuuacuccauucccagcu

SEQ ID NO: 1680396 - RNA, 20 nt, Salmonella enterica enterica serovar Typhi
guuuacuccauucccagcuc

SEQ ID NO: 1680397 - RNA, 13 nt, Salmonella enterica enterica serovar Typhi
guugcuaaaucca

SEQ ID NO: 1680398 - RNA, 20 nt, Salmonella enterica enterica serovar Typhi
guugcguucccuacgcccag

SEQ ID NO: 1680399 - RNA, 14 nt, Salmonella enterica enterica serovar Typhi
guugcuccagcauc

SEQ ID NO: 1680400 - RNA, 14 nt, Salmonella enterica enterica serovar Typhi
guugcugcaaaaga

SEQ ID NO: 1680401 - RNA, 21 nt, Salmonella enterica enterica serovar Typhi
guugcuuaccuuguucuucca

SEQ ID NO: 1680402 - RNA, 14 nt, Salmonella enterica enterica serovar Typhi
guugcgcccaucau

SEQ ID NO: 1680403 - RNA, 15 nt, Salmonella enterica enterica serovar Typhi
guugcggauaaccga

SEQ ID NO: 1680404 - RNA, 14 nt, Salmonella enterica enterica serovar Typhi
guugcgcugguugg

SEQ ID NO: 1680405 - RNA, 15 nt, Salmonella enterica enterica serovar Typhi
guugucaaaaaauca

SEQ ID NO: 1680406 - RNA, 21 nt, Salmonella enterica enterica serovar Typhi
guuggucacaaaggccagcag

SEQ ID NO: 1680407 - RNA, 17 nt, Salmonella enterica enterica serovar Typhi
guuggcguaccaucagc

SEQ ID NO: 1680408 - RNA, 23 nt, Salmonella enterica enterica serovar Typhi
guugguauugcgaaacggcagcg

SEQ ID NO: 1680409 - RNA, 21 nt, Salmonella enterica enterica serovar Typhi
guugcuucuguccuuucugcu

SEQ ID NO: 1680410 - RNA, 15 nt, Salmonella enterica enterica serovar Typhi
guuggcgauuuccag

SEQ ID NO: 1680411 - RNA, 18 nt, Salmonella enterica enterica serovar Typhi
guuggcgaaggcggcggc

SEQ ID NO: 1680412 - RNA, 18 nt, Salmonella enterica enterica serovar Typhi
guuggcguaaaucaggcc

SEQ ID NO: 1680413 - RNA, 21 nt, Salmonella enterica enterica serovar Typhi
guugcgacuguucaucaaaga

SEQ ID NO: 1680414 - RNA, 21 nt, Salmonella enterica enterica serovar Typhi
guugcgcagcguuuccagacu

SEQ ID NO: 1680415 - RNA, 22 nt, Salmonella enterica enterica serovar Typhi
guugccggaaacgaaucuuuua

SEQ ID NO: 1680416 - RNA, 23 nt, Salmonella enterica enterica serovar Typhi
guugauacagaaaaccggcaaau

SEQ ID NO: 1680417 - RNA, 19 nt, Salmonella enterica enterica serovar Typhi
guugauacaggaauaacca

SEQ ID NO: 1680418 - RNA, 14 nt, Salmonella enterica enterica serovar Typhi
guugauaccggagg

SEQ ID NO: 1680419 - RNA, 19 nt, Salmonella enterica enterica serovar Typhi
guucuaaacguucaucuuc

SEQ ID NO: 1680420 - RNA, 14 nt, Salmonella enterica enterica serovar Typhi
guucuaucuuucag

SEQ ID NO: 1680421 - RNA, 21 nt, Salmonella enterica enterica serovar Typhi
guucucgcgccgccugcacgg

SEQ ID NO: 1680422 - RNA, 17 nt, Salmonella enterica enterica serovar Typhi
guucucgcucuuccagu

SEQ ID NO: 1680423 - RNA, 19 nt, Salmonella enterica enterica serovar Typhi
guugagccauuccagcgua

SEQ ID NO: 1680424 - RNA, 11 nt, Salmonella enterica enterica serovar Typhi
guuaauuucuu

SEQ ID NO: 1680425 - RNA, 21 nt, Salmonella enterica enterica serovar Typhi
guuaaggcaucaauaccuguc

SEQ ID NO: 1680426 - RNA, 23 nt, Salmonella enterica enterica serovar Typhi
guuaaggccgcaaacagcacgcc

SEQ ID NO: 1680427 - RNA, 20 nt, Salmonella enterica enterica serovar Typhi
guuaaugcuguccugcaaaa

SEQ ID NO: 1680428 - RNA, 21 nt, Salmonella enterica enterica serovar Typhi
guuaaugguaccaauagccuu

SEQ ID NO: 1680429 - RNA, 18 nt, Salmonella enterica enterica serovar Typhi
guuaacgcggccguaaua

SEQ ID NO: 1680430 - RNA, 22 nt, Salmonella enterica enterica serovar Typhi
guuaacgacccaucaauaacga

SEQ ID NO: 1680431 - RNA, 14 nt, Salmonella enterica enterica serovar Typhi
guuaacccaaaaac

SEQ ID NO: 1680432 - RNA, 16 nt, Salmonella enterica enterica serovar Typhi
guuaagaagucuguga

SEQ ID NO: 1680433 - RNA, 21 nt, Salmonella enterica enterica serovar Typhi
guuaacuggauauuccaguua

SEQ ID NO: 1680434 - RNA, 13 nt, Salmonella enterica enterica serovar Typhi
guuaacugcugcu

SEQ ID NO: 1680435 - RNA, 15 nt, Salmonella enterica enterica serovar Typhi
guuaacagaaugcug

SEQ ID NO: 1680436 - RNA, 17 nt, Salmonella enterica enterica serovar Typhi
guuaacaauauugcgcu

SEQ ID NO: 1680437 - RNA, 20 nt, Salmonella enterica enterica serovar Typhi
guuaaaccaggcgaacccca

SEQ ID NO: 1680438 - RNA, 21 nt, Salmonella enterica enterica serovar Typhi
guuaaaaaucgcuauauugcu

SEQ ID NO: 1680439 - RNA, 14 nt, Salmonella enterica enterica serovar Typhi
guguugauugaaac

SEQ ID NO: 1680440 - RNA, 22 nt, Salmonella enterica enterica serovar Typhi
guguuggaugaaccauaucaaa

SEQ ID NO: 1680441 - RNA, 19 nt, Salmonella enterica enterica serovar Typhi
guguuuuuuaauauauuca

SEQ ID NO: 1680442 - RNA, 15 nt, Salmonella enterica enterica serovar Typhi
guuaucugaccuaca

SEQ ID NO: 1680443 - RNA, 11 nt, Salmonella enterica enterica serovar Typhi
guuaugccauc

SEQ ID NO: 1680444 - RNA, 21 nt, Salmonella enterica enterica serovar Typhi
guuaugccaucuaacacaaau

SEQ ID NO: 1680445 - RNA, 12 nt, Salmonella enterica enterica serovar Typhi
guuaugcaucug

SEQ ID NO: 1680446 - RNA, 15 nt, Salmonella enterica enterica serovar Typhi
guuauggcaggcgaa

SEQ ID NO: 1680447 - RNA, 16 nt, Salmonella enterica enterica serovar Typhi
guuaggguagaaaaag

SEQ ID NO: 1680448 - RNA, 19 nt, Salmonella enterica enterica serovar Typhi
guuaggguagaaaaaggua

SEQ ID NO: 1680449 - RNA, 21 nt, Salmonella enterica enterica serovar Typhi
guuagggcgcggcugguaaga

SEQ ID NO: 1680450 - RNA, 22 nt, Salmonella enterica enterica serovar Typhi
guuagugacguuaucugucagc

SEQ ID NO: 1680451 - RNA, 15 nt, Salmonella enterica enterica serovar Typhi
guuauauuacuggcu

SEQ ID NO: 1680452 - RNA, 21 nt, Salmonella enterica enterica serovar Typhi
guuauauauuuuucagcuucu

SEQ ID NO: 1680453 - RNA, 16 nt, Salmonella enterica enterica serovar Typhi
guuacucuuccaccau

SEQ ID NO: 1680454 - RNA, 14 nt, Salmonella enterica enterica serovar Typhi
guuacucuuccucc

SEQ ID NO: 1680455 - RNA, 20 nt, Salmonella enterica enterica serovar Typhi
guuacucuuccuccccaggc

SEQ ID NO: 1680456 - RNA, 22 nt, Salmonella enterica enterica serovar Typhi
guuacucuuccuccccaggcgc

SEQ ID NO: 1680457 - RNA, 23 nt, Salmonella enterica enterica serovar Typhi
guuaccucaaaaaccaguugcca

SEQ ID NO: 1680458 - RNA, 23 nt, Salmonella enterica enterica serovar Typhi
guuacccaugagcgaaacuccag

SEQ ID NO: 1680459 - RNA, 23 nt, Salmonella enterica enterica serovar Typhi
guuaccccgaagcgcccaugaau

SEQ ID NO: 1680460 - RNA, 23 nt, Salmonella enterica enterica serovar Typhi
guuaccccuuuuucaauuuccag

SEQ ID NO: 1680461 - RNA, 21 nt, Salmonella enterica enterica serovar Typhi
guuaccgccggcuucgucuuu

SEQ ID NO: 1680462 - RNA, 17 nt, Salmonella enterica enterica serovar Typhi
guuagggcgcggcuggu

SEQ ID NO: 1680463 - RNA, 20 nt, Salmonella enterica enterica serovar Typhi
guuaggcaagcugguaaaug

SEQ ID NO: 1680464 - RNA, 13 nt, Salmonella enterica enterica serovar Typhi
guuaggaaagcag

SEQ ID NO: 1680465 - RNA, 21 nt, Salmonella enterica enterica serovar Typhi
guuagaaaauacugcuagaac

SEQ ID NO: 1680466 - RNA, 18 nt, Salmonella enterica enterica serovar Typhi
guuccauuccagaacgaa

SEQ ID NO: 1680467 - RNA, 17 nt, Salmonella enterica enterica serovar Typhi
guuccaucacuuccugu

SEQ ID NO: 1680468 - RNA, 20 nt, Salmonella enterica enterica serovar Typhi
guuccgcuuuucuggcuuca

SEQ ID NO: 1680469 - RNA, 13 nt, Salmonella enterica enterica serovar Typhi
guuccgcuaccug

SEQ ID NO: 1680470 - RNA, 18 nt, Salmonella enterica enterica serovar Typhi
guuccgcuaccugcgagc

SEQ ID NO: 1680471 - RNA, 18 nt, Salmonella enterica enterica serovar Typhi
guuccgcuuuucuggcuu

SEQ ID NO: 1680472 - RNA, 22 nt, Salmonella enterica enterica serovar Typhi
guuccugcgggaacagauaaau

SEQ ID NO: 1680473 - RNA, 19 nt, Salmonella enterica enterica serovar Typhi
guuccugcacccgaauaaa

SEQ ID NO: 1680474 - RNA, 18 nt, Salmonella enterica enterica serovar Typhi
guucgguaucgcgccagg

SEQ ID NO: 1680475 - RNA, 16 nt, Salmonella enterica enterica serovar Typhi
guucggguuuuccugc

SEQ ID NO: 1680476 - RNA, 22 nt, Salmonella enterica enterica serovar Typhi
guuccuuuacuucuuugcgauu

SEQ ID NO: 1680477 - RNA, 20 nt, Salmonella enterica enterica serovar Typhi
guucgaauccagguacccca

SEQ ID NO: 1680478 - RNA, 18 nt, Salmonella enterica enterica serovar Typhi
guucgcgcaauucuucua

SEQ ID NO: 1680479 - RNA, 17 nt, Salmonella enterica enterica serovar Typhi
guucgcgcaguucaucc

SEQ ID NO: 1680480 - RNA, 13 nt, Salmonella enterica enterica serovar Typhi
guucgcgacugau

SEQ ID NO: 1680481 - RNA, 19 nt, Salmonella enterica enterica serovar Typhi
guucgccuucguuauaagg

SEQ ID NO: 1680482 - RNA, 19 nt, Salmonella enterica enterica serovar Typhi
guucgcgaauuucacgcag

SEQ ID NO: 1680483 - RNA, 23 nt, Salmonella enterica enterica serovar Typhi
guucgcccggcaugacaucagaa

SEQ ID NO: 1680484 - RNA, 22 nt, Salmonella enterica enterica serovar Typhi
guucaccaccacccagugccac

SEQ ID NO: 1680485 - RNA, 22 nt, Salmonella enterica enterica serovar Typhi
guuauuuuccugaaaaaauucc

SEQ ID NO: 1680486 - RNA, 22 nt, Salmonella enterica enterica serovar Typhi
guuauugugguguuccauugcu

SEQ ID NO: 1680487 - RNA, 21 nt, Salmonella enterica enterica serovar Typhi
guuauugucaugcuaaaacag

SEQ ID NO: 1680488 - RNA, 18 nt, Salmonella enterica enterica serovar Typhi
guuauuugccucuggcca

SEQ ID NO: 1680489 - RNA, 14 nt, Salmonella enterica enterica serovar Typhi
guucagccgccagu

SEQ ID NO: 1680490 - RNA, 12 nt, Salmonella enterica enterica serovar Typhi
guucagccagca

SEQ ID NO: 1680491 - RNA, 16 nt, Salmonella enterica enterica serovar Typhi
guucagcgccugaaug

SEQ ID NO: 1680492 - RNA, 20 nt, Salmonella enterica enterica serovar Typhi
guucacgccaaauaauguaa

SEQ ID NO: 1680493 - RNA, 15 nt, Salmonella enterica enterica serovar Typhi
guucacguaaucgcc

SEQ ID NO: 1680494 - RNA, 17 nt, Salmonella enterica enterica serovar Typhi
guucacgcgacggccca

SEQ ID NO: 1680495 - RNA, 18 nt, Salmonella enterica enterica serovar Typhi
guuccacacguccauccg

SEQ ID NO: 1680496 - RNA, 22 nt, Salmonella enterica enterica serovar Typhi
guuccacaaucaaauggcuggc

SEQ ID NO: 1680497 - RNA, 20 nt, Salmonella enterica enterica serovar Typhi
guuccaccgccaauaaaaac

SEQ ID NO: 1680498 - RNA, 19 nt, Salmonella enterica enterica serovar Typhi
guucaggcacgugcauaaa

SEQ ID NO: 1680499 - RNA, 19 nt, Salmonella enterica enterica serovar Typhi
guucaucaggccugcaaac

SEQ ID NO: 1680500 - RNA, 17 nt, Salmonella enterica enterica serovar Typhi
guucaucauccugcagg

SEQ ID NO: 1680501 - RNA, 21 nt, Salmonella enterica enterica serovar Typhi
guucaucaggccugcaaaccu

SEQ ID NO: 1680502 - RNA, 16 nt, Salmonella enterica enterica serovar Typhi
guucauccugcgccau

SEQ ID NO: 1680503 - RNA, 22 nt, Salmonella enterica enterica serovar Typhi
guucaugcaauuccgcuuucuu

SEQ ID NO: 1680504 - RNA, 19 nt, Salmonella enterica enterica serovar Typhi
guucaugaaccacgccaac

SEQ ID NO: 1680505 - RNA, 13 nt, Salmonella enterica enterica serovar Typhi
guucaucucuucc

SEQ ID NO: 1680506 - RNA, 15 nt, Salmonella enterica enterica serovar Typhi
guucaucucuucccg

SEQ ID NO: 1680507 - RNA, 19 nt, Salmonella enterica enterica serovar Typhi
gugucaugcgguuaaacca

SEQ ID NO: 1680508 - RNA, 19 nt, Salmonella enterica enterica serovar Typhi
gugucuuuuucaucuuuua

SEQ ID NO: 1680509 - RNA, 19 nt, Salmonella enterica enterica serovar Typhi
gugucaucauuacaggcga

SEQ ID NO: 1680510 - RNA, 13 nt, Salmonella enterica enterica serovar Typhi
gugucccgcugug

SEQ ID NO: 1680511 - RNA, 21 nt, Salmonella enterica enterica serovar Typhi
guguccaggucaucaccucca

SEQ ID NO: 1680512 - RNA, 14 nt, Salmonella enterica enterica serovar Typhi
gugucguaguggca

SEQ ID NO: 1680513 - RNA, 22 nt, Salmonella enterica enterica serovar Typhi
guggggaauguauuucagacuu

SEQ ID NO: 1680514 - RNA, 21 nt, Salmonella enterica enterica serovar Typhi
guggugucucgucgccagggc

SEQ ID NO: 1680515 - RNA, 13 nt, Salmonella enterica enterica serovar Typhi
guguaccagcagc

SEQ ID NO: 1680516 - RNA, 15 nt, Salmonella enterica enterica serovar Typhi
guguagagauucugc

SEQ ID NO: 1680517 - RNA, 17 nt, Salmonella enterica enterica serovar Typhi
gugguuaacagcgcagg

SEQ ID NO: 1680518 - RNA, 13 nt, Salmonella enterica enterica serovar Typhi
aaauauaugacaa

SEQ ID NO: 1680519 - RNA, 21 nt, Salmonella enterica enterica serovar Typhi
aaauaucauucgcgucauacu

SEQ ID NO: 1680520 - RNA, 17 nt, Salmonella enterica enterica serovar Typhi
gugugguuucaagcggc

SEQ ID NO: 1680521 - RNA, 18 nt, Salmonella enterica enterica serovar Typhi
guguggucgcggcucacc

SEQ ID NO: 1680522 - RNA, 13 nt, Salmonella enterica enterica serovar Typhi
guguucucccugc

SEQ ID NO: 1680523 - RNA, 17 nt, Salmonella enterica enterica serovar Typhi
guguucucccugcucgg

SEQ ID NO: 1680524 - RNA, 15 nt, Salmonella enterica enterica serovar Typhi
guguuccauugcugc

SEQ ID NO: 1680525 - RNA, 21 nt, Salmonella enterica enterica serovar Typhi
guguuauuuucaaaaacaagg

SEQ ID NO: 1680526 - RNA, 15 nt, Salmonella enterica enterica serovar Typhi
guguuaaucauuuuc

SEQ ID NO: 1680527 - RNA, 18 nt, Salmonella enterica enterica serovar Typhi
guguucaugcgcggcgga

SEQ ID NO: 1680528 - RNA, 15 nt, Salmonella enterica enterica serovar Typhi
guguucacaauugug

SEQ ID NO: 1680529 - RNA, 20 nt, Salmonella enterica enterica serovar Typhi
guggaaaacagcauaauaaa

SEQ ID NO: 1680530 - RNA, 19 nt, Salmonella enterica enterica serovar Typhi
guggaaaguaccaaaacag

SEQ ID NO: 1680531 - RNA, 14 nt, Salmonella enterica enterica serovar Typhi
gugcuggugguggg

SEQ ID NO: 1680532 - RNA, 14 nt, Salmonella enterica enterica serovar Typhi
gugcuggcggccgu

SEQ ID NO: 1680533 - RNA, 23 nt, Salmonella enterica enterica serovar Typhi
gugcuggcggaaguagccuccgg

SEQ ID NO: 1680534 - RNA, 22 nt, Salmonella enterica enterica serovar Typhi
guggaacuuuaucgcgcggcga

SEQ ID NO: 1680535 - RNA, 14 nt, Salmonella enterica enterica serovar Typhi
guggcaaucagcaa

SEQ ID NO: 1680536 - RNA, 14 nt, Salmonella enterica enterica serovar Typhi
guggcaaaauccaa

SEQ ID NO: 1680537 - RNA, 11 nt, Salmonella enterica enterica serovar Typhi
guggcaaauac

SEQ ID NO: 1680538 - RNA, 15 nt, Salmonella enterica enterica serovar Typhi
guggcaaaauccaac

SEQ ID NO: 1680539 - RNA, 19 nt, Salmonella enterica enterica serovar Typhi
guggaucucgucgccggug

SEQ ID NO: 1680540 - RNA, 22 nt, Salmonella enterica enterica serovar Typhi
guggcgaacaggcucagcgcca

SEQ ID NO: 1680541 - RNA, 14 nt, Salmonella enterica enterica serovar Typhi
guggcgaccagcag

SEQ ID NO: 1680542 - RNA, 18 nt, Salmonella enterica enterica serovar Typhi
guggccagcaugcccgcc

SEQ ID NO: 1680543 - RNA, 16 nt, Salmonella enterica enterica serovar Typhi
guggccaucuuccagc

SEQ ID NO: 1680544 - RNA, 15 nt, Salmonella enterica enterica serovar Typhi
guggcguuuucauua

SEQ ID NO: 1680545 - RNA, 22 nt, Salmonella enterica enterica serovar Typhi
guggcgaucaguggcgccgcaa

SEQ ID NO: 1680546 - RNA, 18 nt, Salmonella enterica enterica serovar Typhi
ucagccaaacuccucacu

SEQ ID NO: 1680547 - RNA, 16 nt, Salmonella enterica enterica serovar Typhi
ucagccacgacgcuca

SEQ ID NO: 1680548 - RNA, 21 nt, Salmonella enterica enterica serovar Typhi
ucagcccuaucgcugcgcugc

SEQ ID NO: 1680549 - RNA, 15 nt, Salmonella enterica enterica serovar Typhi
ucagcccuacaaagg

SEQ ID NO: 1680550 - RNA, 16 nt, Salmonella enterica enterica serovar Typhi
ucagcgauucaaacuc

SEQ ID NO: 1680551 - RNA, 19 nt, Salmonella enterica enterica serovar Typhi
ucagccgauaagaacucca

SEQ ID NO: 1680552 - RNA, 18 nt, Salmonella enterica enterica serovar Typhi
ucagcgccauugcuagga

SEQ ID NO: 1680553 - RNA, 22 nt, Salmonella enterica enterica serovar Typhi
ucagcgcguccuccaacgugca

SEQ ID NO: 1680554 - RNA, 18 nt, Salmonella enterica enterica serovar Typhi
ucagcgcuaccagcgcgg

SEQ ID NO: 1680555 - RNA, 22 nt, Salmonella enterica enterica serovar Typhi
ucagcgccacgcccaacauaaa

SEQ ID NO: 1680556 - RNA, 17 nt, Salmonella enterica enterica serovar Typhi
ucagcgccaccacaaac

SEQ ID NO: 1680557 - RNA, 15 nt, Salmonella enterica enterica serovar Typhi
ucagcgccaccacaa

SEQ ID NO: 1680558 - RNA, 21 nt, Salmonella enterica enterica serovar Typhi
ucagcuccuuauuacauaccc

SEQ ID NO: 1680559 - RNA, 13 nt, Salmonella enterica enterica serovar Typhi
ucagcucgcugcc

SEQ ID NO: 1680560 - RNA, 14 nt, Salmonella enterica enterica serovar Typhi
ucagcgucuuucuu

SEQ ID NO: 1680561 - RNA, 15 nt, Salmonella enterica enterica serovar Typhi
ucagcgucuauagau

SEQ ID NO: 1680562 - RNA, 13 nt, Salmonella enterica enterica serovar Typhi
ucagcgguuguuc

SEQ ID NO: 1680563 - RNA, 15 nt, Salmonella enterica enterica serovar Typhi
ucagcggccagggca

SEQ ID NO: 1680564 - RNA, 18 nt, Salmonella enterica enterica serovar Typhi
ucagcggcgcaggggcau

SEQ ID NO: 1680565 - RNA, 14 nt, Salmonella enterica enterica serovar Typhi
ucagcggccagggc

SEQ ID NO: 1680566 - RNA, 15 nt, Salmonella enterica enterica serovar Typhi
ucagcggcagcucug

SEQ ID NO: 1680567 - RNA, 16 nt, Salmonella enterica enterica serovar Typhi
ucagcggcagcucugc

SEQ ID NO: 1680568 - RNA, 14 nt, Salmonella enterica enterica serovar Typhi
ucagcggcaauagc

SEQ ID NO: 1680569 - RNA, 16 nt, Salmonella enterica enterica serovar Typhi
ucagcaagaaguuccg

SEQ ID NO: 1680570 - RNA, 15 nt, Salmonella enterica enterica serovar Typhi
ucagcaauauuuugu

SEQ ID NO: 1680571 - RNA, 16 nt, Salmonella enterica enterica serovar Typhi
ucagcacacuacacag

SEQ ID NO: 1680572 - RNA, 21 nt, Salmonella enterica enterica serovar Typhi
ucagcacaaaaucccacauac

SEQ ID NO: 1680573 - RNA, 17 nt, Salmonella enterica enterica serovar Typhi
ucagcaauuaacaaaua

SEQ ID NO: 1680574 - RNA, 15 nt, Salmonella enterica enterica serovar Typhi
ucagcaaugauuuuu

SEQ ID NO: 1680575 - RNA, 18 nt, Salmonella enterica enterica serovar Typhi
ucagcaauuaacaaauaa

SEQ ID NO: 1680576 - RNA, 20 nt, Salmonella enterica enterica serovar Typhi
ucagcaauuucucgcccgcc

SEQ ID NO: 1680577 - RNA, 20 nt, Salmonella enterica enterica serovar Typhi
ucagcaccucuuugcggccu

SEQ ID NO: 1680578 - RNA, 14 nt, Salmonella enterica enterica serovar Typhi
ucagcagcaccacu

SEQ ID NO: 1680579 - RNA, 19 nt, Salmonella enterica enterica serovar Typhi
ucagcauguuucuccugcc

SEQ ID NO: 1680580 - RNA, 21 nt, Salmonella enterica enterica serovar Typhi
ucagcauguaccauugucaaa

SEQ ID NO: 1680581 - RNA, 12 nt, Salmonella enterica enterica serovar Typhi
ucagcaguucau

SEQ ID NO: 1680582 - RNA, 19 nt, Salmonella enterica enterica serovar Typhi
ucagcauccgcaagacacg

SEQ ID NO: 1680583 - RNA, 21 nt, Salmonella enterica enterica serovar Typhi
ucagcagcaccgguuuuuccg

SEQ ID NO: 1680584 - RNA, 11 nt, Salmonella enterica enterica serovar Typhi
ucagcaggagc

SEQ ID NO: 1680585 - RNA, 14 nt, Salmonella enterica enterica serovar Typhi
ucagcaggcgggcu

SEQ ID NO: 1680586 - RNA, 17 nt, Salmonella enterica enterica serovar Typhi
ucagcauaaagccucuc

SEQ ID NO: 1680587 - RNA, 21 nt, Salmonella enterica enterica serovar Typhi
ucagcauaauauccugcaccg

SEQ ID NO: 1680588 - RNA, 18 nt, Salmonella enterica enterica serovar Typhi
ucaggccgccgcacaggc

SEQ ID NO: 1680589 - RNA, 12 nt, Salmonella enterica enterica serovar Typhi
ucaggccgccag

SEQ ID NO: 1680590 - RNA, 16 nt, Salmonella enterica enterica serovar Typhi
ucaggcgaucccggcc

SEQ ID NO: 1680591 - RNA, 16 nt, Salmonella enterica enterica serovar Typhi
ucaggcgcauaucgcc

SEQ ID NO: 1680592 - RNA, 17 nt, Salmonella enterica enterica serovar Typhi
ucaggccuauagacacc

SEQ ID NO: 1680593 - RNA, 22 nt, Salmonella enterica enterica serovar Typhi
ucaggccuauagacaccuuaua

SEQ ID NO: 1680594 - RNA, 19 nt, Salmonella enterica enterica serovar Typhi
ucaggccuacacucugcgc

SEQ ID NO: 1680595 - RNA, 14 nt, Salmonella enterica enterica serovar Typhi
ucaggcauccugcc

SEQ ID NO: 1680596 - RNA, 16 nt, Salmonella enterica enterica serovar Typhi
ucaggcaucugaaaug

SEQ ID NO: 1680597 - RNA, 18 nt, Salmonella enterica enterica serovar Typhi
ucaggcaucugaaaugcu

SEQ ID NO: 1680598 - RNA, 21 nt, Salmonella enterica enterica serovar Typhi
ucaggcauguugcgcaaucac

SEQ ID NO: 1680599 - RNA, 15 nt, Salmonella enterica enterica serovar Typhi
ucaggcacuggcuua

SEQ ID NO: 1680600 - RNA, 13 nt, Salmonella enterica enterica serovar Typhi
ucaggcaguagcc

SEQ ID NO: 1680601 - RNA, 16 nt, Salmonella enterica enterica serovar Typhi
ucaggcacgugcauaa

SEQ ID NO: 1680602 - RNA, 14 nt, Salmonella enterica enterica serovar Typhi
ucaggcaaugucug

SEQ ID NO: 1680603 - RNA, 13 nt, Salmonella enterica enterica serovar Typhi
ucaggacaucaaa

SEQ ID NO: 1680604 - RNA, 22 nt, Salmonella enterica enterica serovar Typhi
ucaggaauuuaucaacaaauuc

SEQ ID NO: 1680605 - RNA, 19 nt, Salmonella enterica enterica serovar Typhi
ucagcugaacagucccacc

SEQ ID NO: 1680606 - RNA, 18 nt, Salmonella enterica enterica serovar Typhi
ucagcugacaaugugccg

SEQ ID NO: 1680607 - RNA, 21 nt, Salmonella enterica enterica serovar Typhi
ucaggaguaaauaacaaaagc

SEQ ID NO: 1680608 - RNA, 15 nt, Salmonella enterica enterica serovar Typhi
ucaggaggccugaau

SEQ ID NO: 1680609 - RNA, 16 nt, Salmonella enterica enterica serovar Typhi
ucaggaggccugaaua

SEQ ID NO: 1680610 - RNA, 14 nt, Salmonella enterica enterica serovar Typhi
ucaggcuaaauggc

SEQ ID NO: 1680611 - RNA, 18 nt, Salmonella enterica enterica serovar Typhi
ucaggcuguuguucuuuu

SEQ ID NO: 1680612 - RNA, 12 nt, Salmonella enterica enterica serovar Typhi
ucaggcuuucca

SEQ ID NO: 1680613 - RNA, 17 nt, Salmonella enterica enterica serovar Typhi
ucaggucgcuaaaaccc

SEQ ID NO: 1680614 - RNA, 16 nt, Salmonella enterica enterica serovar Typhi
ucaggucuauugccua

SEQ ID NO: 1680615 - RNA, 19 nt, Salmonella enterica enterica serovar Typhi
ucaguacgcuuuggcaggc

SEQ ID NO: 1680616 - RNA, 20 nt, Salmonella enterica enterica serovar Typhi
ucaguagccgccgcaggaca

SEQ ID NO: 1680617 - RNA, 21 nt, Salmonella enterica enterica serovar Typhi
ucaguacgcuuuggcaggccu

SEQ ID NO: 1680618 - RNA, 15 nt, Salmonella enterica enterica serovar Typhi
ucaggucauacggca

SEQ ID NO: 1680619 - RNA, 16 nt, Salmonella enterica enterica serovar Typhi
ucagguauuuccugcu

SEQ ID NO: 1680620 - RNA, 19 nt, Salmonella enterica enterica serovar Typhi
ucagguaucccgccagcgg

SEQ ID NO: 1680621 - RNA, 14 nt, Salmonella enterica enterica serovar Typhi
ucaggcuugucgcg

SEQ ID NO: 1680622 - RNA, 20 nt, Salmonella enterica enterica serovar Typhi
ucagugaaaagcuggaggug

SEQ ID NO: 1680623 - RNA, 14 nt, Salmonella enterica enterica serovar Typhi
ucagugaacacccu

SEQ ID NO: 1680624 - RNA, 17 nt, Salmonella enterica enterica serovar Typhi
ucagugaacacccugcc

SEQ ID NO: 1680625 - RNA, 23 nt, Salmonella enterica enterica serovar Typhi
ucaguagcuuuuccgcuggaaua

SEQ ID NO: 1680626 - RNA, 17 nt, Salmonella enterica enterica serovar Typhi
ucaguacgucgcauacu

SEQ ID NO: 1680627 - RNA, 19 nt, Salmonella enterica enterica serovar Typhi
ucaggugacaguccgggcc

SEQ ID NO: 1680628 - RNA, 21 nt, Salmonella enterica enterica serovar Typhi
ucaguagccgccgcaggacag

SEQ ID NO: 1680629 - RNA, 16 nt, Salmonella enterica enterica serovar Typhi
ucaguaugaugaccug

SEQ ID NO: 1680630 - RNA, 21 nt, Salmonella enterica enterica serovar Typhi
ucagugugguuucaagcggca

SEQ ID NO: 1680631 - RNA, 14 nt, Salmonella enterica enterica serovar Typhi
ucaguggaaaacag

SEQ ID NO: 1680632 - RNA, 15 nt, Salmonella enterica enterica serovar Typhi
ucaguggaaaacagc

SEQ ID NO: 1680633 - RNA, 15 nt, Salmonella enterica enterica serovar Typhi
ucagcaacugcugcg

SEQ ID NO: 1680634 - RNA, 18 nt, Salmonella enterica enterica serovar Typhi
ucagcaacggaagcugac

SEQ ID NO: 1680635 - RNA, 19 nt, Salmonella enterica enterica serovar Typhi
ucagcaacggaagcugacc

SEQ ID NO: 1680636 - RNA, 18 nt, Salmonella enterica enterica serovar Typhi
ucagcaacccuuuuucaa

SEQ ID NO: 1680637 - RNA, 20 nt, Salmonella enterica enterica serovar Typhi
aaaucgguaacaucaaguac

SEQ ID NO: 1680638 - RNA, 22 nt, Salmonella enterica enterica serovar Typhi
aaaucggucauuaauccccggc

SEQ ID NO: 1680639 - RNA, 22 nt, Salmonella enterica enterica serovar Typhi
aaaucgguaaucaugucguaga

SEQ ID NO: 1680640 - RNA, 20 nt, Salmonella enterica enterica serovar Typhi
aaaucguuuucuaacgaggu

SEQ ID NO: 1680641 - RNA, 12 nt, Salmonella enterica enterica serovar Typhi
ucagauccuuuu

SEQ ID NO: 1680642 - RNA, 13 nt, Salmonella enterica enterica serovar Typhi
ucagauccuuuuu

SEQ ID NO: 1680643 - RNA, 15 nt, Salmonella enterica enterica serovar Typhi
ucagauaauucuaaa

SEQ ID NO: 1680644 - RNA, 23 nt, Salmonella enterica enterica serovar Typhi
ucagauaggcgcgaaaugucccg

SEQ ID NO: 1680645 - RNA, 22 nt, Salmonella enterica enterica serovar Typhi
ucagauaacgaaccaucauuaa

SEQ ID NO: 1680646 - RNA, 13 nt, Salmonella enterica enterica serovar Typhi
ucagauaaauaac

SEQ ID NO: 1680647 - RNA, 13 nt, Salmonella enterica enterica serovar Typhi
ucagauuacccuc

SEQ ID NO: 1680648 - RNA, 18 nt, Salmonella enterica enterica serovar Typhi
ucagauucagcauuggca

SEQ ID NO: 1680649 - RNA, 17 nt, Salmonella enterica enterica serovar Typhi
ucagauugccacaggac

SEQ ID NO: 1680650 - RNA, 16 nt, Salmonella enterica enterica serovar Typhi
ucagacgcgcagugug

SEQ ID NO: 1680651 - RNA, 14 nt, Salmonella enterica enterica serovar Typhi
ucagacgaggcgcg

SEQ ID NO: 1680652 - RNA, 23 nt, Salmonella enterica enterica serovar Typhi
ucagacgaccauccaccagaacc

SEQ ID NO: 1680653 - RNA, 16 nt, Salmonella enterica enterica serovar Typhi
ucagacggacaucaga

SEQ ID NO: 1680654 - RNA, 17 nt, Salmonella enterica enterica serovar Typhi
ucagacggacaucagag

SEQ ID NO: 1680655 - RNA, 15 nt, Salmonella enterica enterica serovar Typhi
ucagacgcugguugu

SEQ ID NO: 1680656 - RNA, 21 nt, Salmonella enterica enterica serovar Typhi
ucagaggccuuuugcagcagc

SEQ ID NO: 1680657 - RNA, 22 nt, Salmonella enterica enterica serovar Typhi
ucagacacaauauugcugugcu

SEQ ID NO: 1680658 - RNA, 20 nt, Salmonella enterica enterica serovar Typhi
ucagaauuuuuaaccaucac

SEQ ID NO: 1680659 - RNA, 19 nt, Salmonella enterica enterica serovar Typhi
ucagaaucguccagauuga

SEQ ID NO: 1680660 - RNA, 23 nt, Salmonella enterica enterica serovar Typhi
ucagaccagaaucccacggagaa

SEQ ID NO: 1680661 - RNA, 18 nt, Salmonella enterica enterica serovar Typhi
ucagaccgauaaauaccg

SEQ ID NO: 1680662 - RNA, 20 nt, Salmonella enterica enterica serovar Typhi
ucagacacauucugugaucc

SEQ ID NO: 1680663 - RNA, 19 nt, Salmonella enterica enterica serovar Typhi
ucagacaccagcccuggcu

SEQ ID NO: 1680664 - RNA, 12 nt, Salmonella enterica enterica serovar Typhi
ucagaauaaugc

SEQ ID NO: 1680665 - RNA, 19 nt, Salmonella enterica enterica serovar Typhi
ucagaauauccgguacacc

SEQ ID NO: 1680666 - RNA, 16 nt, Salmonella enterica enterica serovar Typhi
ucagaauaguuuugcc

SEQ ID NO: 1680667 - RNA, 16 nt, Salmonella enterica enterica serovar Typhi
ucagaauaugccaggg

SEQ ID NO: 1680668 - RNA, 15 nt, Salmonella enterica enterica serovar Typhi
ucagaagaagacaac

SEQ ID NO: 1680669 - RNA, 13 nt, Salmonella enterica enterica serovar Typhi
ucagaaauucgca

SEQ ID NO: 1680670 - RNA, 19 nt, Salmonella enterica enterica serovar Typhi
ucagaaauauucaguacug

SEQ ID NO: 1680671 - RNA, 15 nt, Salmonella enterica enterica serovar Typhi
ucacuuucaucagag

SEQ ID NO: 1680672 - RNA, 22 nt, Salmonella enterica enterica serovar Typhi
ucacuuucccggaaaaguauuc

SEQ ID NO: 1680673 - RNA, 20 nt, Salmonella enterica enterica serovar Typhi
ucacuuucagauuuuuaaug

SEQ ID NO: 1680674 - RNA, 18 nt, Salmonella enterica enterica serovar Typhi
ucacuuuucuuuccugca

SEQ ID NO: 1680675 - RNA, 16 nt, Salmonella enterica enterica serovar Typhi
ucagaaaaccuuugcu

SEQ ID NO: 1680676 - RNA, 15 nt, Salmonella enterica enterica serovar Typhi
ucacuucaucaucau

SEQ ID NO: 1680677 - RNA, 23 nt, Salmonella enterica enterica serovar Typhi
ucacuucugaguucggcaugggg

SEQ ID NO: 1680678 - RNA, 19 nt, Salmonella enterica enterica serovar Typhi
ucacuuucagauuuuuaau

SEQ ID NO: 1680679 - RNA, 19 nt, Salmonella enterica enterica serovar Typhi
ucacuggcggcaagcugcu

SEQ ID NO: 1680680 - RNA, 14 nt, Salmonella enterica enterica serovar Typhi
ucacuguaaaaggg

SEQ ID NO: 1680681 - RNA, 14 nt, Salmonella enterica enterica serovar Typhi
ucacgcuuaucgcc

SEQ ID NO: 1680682 - RNA, 21 nt, Salmonella enterica enterica serovar Typhi
ucacgccgugaauuucugcug

SEQ ID NO: 1680683 - RNA, 23 nt, Salmonella enterica enterica serovar Typhi
ucacgccgugaauuucugcugcc

SEQ ID NO: 1680684 - RNA, 22 nt, Salmonella enterica enterica serovar Typhi
ucacgcauggcguugcugcaaa

SEQ ID NO: 1680685 - RNA, 19 nt, Salmonella enterica enterica serovar Typhi
ucacgcauggcguugcugc

SEQ ID NO: 1680686 - RNA, 16 nt, Salmonella enterica enterica serovar Typhi
ucacccugaauuucaa

SEQ ID NO: 1680687 - RNA, 20 nt, Salmonella enterica enterica serovar Typhi
ucacccugaauuucaauaau

SEQ ID NO: 1680688 - RNA, 17 nt, Salmonella enterica enterica serovar Typhi
ucacccuauaagcugcc

SEQ ID NO: 1680689 - RNA, 23 nt, Salmonella enterica enterica serovar Typhi
ucacccguuauucauucacccaa

SEQ ID NO: 1680690 - RNA, 16 nt, Salmonella enterica enterica serovar Typhi
ucacccgcuuuuccug

SEQ ID NO: 1680691 - RNA, 19 nt, Salmonella enterica enterica serovar Typhi
ucacccggauacgcggcac

SEQ ID NO: 1680692 - RNA, 17 nt, Salmonella enterica enterica serovar Typhi
ucacccgcgccagcagg

SEQ ID NO: 1680693 - RNA, 18 nt, Salmonella enterica enterica serovar Typhi
ucacccgcgccagcaggu

SEQ ID NO: 1680694 - RNA, 19 nt, Salmonella enterica enterica serovar Typhi
ucacggcaucugcggcaug

SEQ ID NO: 1680695 - RNA, 17 nt, Salmonella enterica enterica serovar Typhi
ucacggcgaaucgccug

SEQ ID NO: 1680696 - RNA, 15 nt, Salmonella enterica enterica serovar Typhi
ucacguuccccagca

SEQ ID NO: 1680697 - RNA, 13 nt, Salmonella enterica enterica serovar Typhi
ucacguuccccag

SEQ ID NO: 1680698 - RNA, 20 nt, Salmonella enterica enterica serovar Typhi
ucacguuuugcagcgccauc

SEQ ID NO: 1680699 - RNA, 15 nt, Salmonella enterica enterica serovar Typhi
ucacuaucacacugg

SEQ ID NO: 1680700 - RNA, 19 nt, Salmonella enterica enterica serovar Typhi
ucaaagccacacugcaucg

SEQ ID NO: 1680701 - RNA, 15 nt, Salmonella enterica enterica serovar Typhi
ucaaacuuuuaaauu

SEQ ID NO: 1680702 - RNA, 14 nt, Salmonella enterica enterica serovar Typhi
ucaaauauauugaa

SEQ ID NO: 1680703 - RNA, 22 nt, Salmonella enterica enterica serovar Typhi
ucaaaucagacgcuucauuggu

SEQ ID NO: 1680704 - RNA, 14 nt, Salmonella enterica enterica serovar Typhi
ucaaauagagaaaa

SEQ ID NO: 1680705 - RNA, 15 nt, Salmonella enterica enterica serovar Typhi
ucaaauagagaaaau

SEQ ID NO: 1680706 - RNA, 16 nt, Salmonella enterica enterica serovar Typhi
ucaaauagagaaaaua

SEQ ID NO: 1680707 - RNA, 17 nt, Salmonella enterica enterica serovar Typhi
ucaaauagagaaaauaa

SEQ ID NO: 1680708 - RNA, 22 nt, Salmonella enterica enterica serovar Typhi
ucaaauagagaaaauaacaaua

SEQ ID NO: 1680709 - RNA, 14 nt, Salmonella enterica enterica serovar Typhi
ucaaauuucaauuu

SEQ ID NO: 1680710 - RNA, 12 nt, Salmonella enterica enterica serovar Typhi
ucaaaugggauc

SEQ ID NO: 1680711 - RNA, 21 nt, Salmonella enterica enterica serovar Typhi
ucaaaugggaucuucaaugaa

SEQ ID NO: 1680712 - RNA, 20 nt, Salmonella enterica enterica serovar Typhi
ucaaauguuguuugaaaagu

SEQ ID NO: 1680713 - RNA, 22 nt, Salmonella enterica enterica serovar Typhi
ucaaauguuguuugaaaaguga

SEQ ID NO: 1680714 - RNA, 14 nt, Salmonella enterica enterica serovar Typhi
ucaaaugcgaaaaa

SEQ ID NO: 1680715 - RNA, 14 nt, Salmonella enterica enterica serovar Typhi
ucaaaugagaauag

SEQ ID NO: 1680716 - RNA, 16 nt, Salmonella enterica enterica serovar Typhi
ucaaaccagcuuuuca

SEQ ID NO: 1680717 - RNA, 18 nt, Salmonella enterica enterica serovar Typhi
ucaaaccagcuuuucauu

SEQ ID NO: 1680718 - RNA, 14 nt, Salmonella enterica enterica serovar Typhi
ucaaacacuucuaa

SEQ ID NO: 1680719 - RNA, 21 nt, Salmonella enterica enterica serovar Typhi
ucaaacaccugaaccagcgcc

SEQ ID NO: 1680720 - RNA, 17 nt, Salmonella enterica enterica serovar Typhi
ucaaacacaaauuucga

SEQ ID NO: 1680721 - RNA, 16 nt, Salmonella enterica enterica serovar Typhi
ucaaaauggaaaauaa

SEQ ID NO: 1680722 - RNA, 18 nt, Salmonella enterica enterica serovar Typhi
ucaaaauggaaaauaaua

SEQ ID NO: 1680723 - RNA, 21 nt, Salmonella enterica enterica serovar Typhi
ucaaaauggaaaauaauaauc

SEQ ID NO: 1680724 - RNA, 17 nt, Salmonella enterica enterica serovar Typhi
ucaacccagcagcagau

SEQ ID NO: 1680725 - RNA, 18 nt, Salmonella enterica enterica serovar Typhi
ucaacccagcagcagaua

SEQ ID NO: 1680726 - RNA, 15 nt, Salmonella enterica enterica serovar Typhi
ucaacgccaucuucc

SEQ ID NO: 1680727 - RNA, 18 nt, Salmonella enterica enterica serovar Typhi
ucaacgcaucaaauaccu

SEQ ID NO: 1680728 - RNA, 20 nt, Salmonella enterica enterica serovar Typhi
ucaacgccgcgcuucuggaa

SEQ ID NO: 1680729 - RNA, 17 nt, Salmonella enterica enterica serovar Typhi
ucaacgccuccaggcua

SEQ ID NO: 1680730 - RNA, 20 nt, Salmonella enterica enterica serovar Typhi
ucaacgcccgcuuucaccau

SEQ ID NO: 1680731 - RNA, 16 nt, Salmonella enterica enterica serovar Typhi
ucaacgcccugcuccc

SEQ ID NO: 1680732 - RNA, 18 nt, Salmonella enterica enterica serovar Typhi
ucaacgaaugccugcaua

SEQ ID NO: 1680733 - RNA, 18 nt, Salmonella enterica enterica serovar Typhi
ucaacgaggugaauaaau

SEQ ID NO: 1680734 - RNA, 13 nt, Salmonella enterica enterica serovar Typhi
ucaacuauuaaag

SEQ ID NO: 1680735 - RNA, 18 nt, Salmonella enterica enterica serovar Typhi
ucaacuucucgcaggcca

SEQ ID NO: 1680736 - RNA, 23 nt, Salmonella enterica enterica serovar Typhi
ucaacgcgccgcucacaaccguc

SEQ ID NO: 1680737 - RNA, 18 nt, Salmonella enterica enterica serovar Typhi
ucaacgcgaccggauaac

SEQ ID NO: 1680738 - RNA, 14 nt, Salmonella enterica enterica serovar Typhi
ucaacgcgccgcca

SEQ ID NO: 1680739 - RNA, 14 nt, Salmonella enterica enterica serovar Typhi
ucaacaucaucgga

SEQ ID NO: 1680740 - RNA, 12 nt, Salmonella enterica enterica serovar Typhi
ucaacaucaucc

SEQ ID NO: 1680741 - RNA, 20 nt, Salmonella enterica enterica serovar Typhi
ucaaccacggauaagccagc

SEQ ID NO: 1680742 - RNA, 15 nt, Salmonella enterica enterica serovar Typhi
ucaaccaacggcgcu

SEQ ID NO: 1680743 - RNA, 18 nt, Salmonella enterica enterica serovar Typhi
ucaaccaucaaaaaaaau

SEQ ID NO: 1680744 - RNA, 16 nt, Salmonella enterica enterica serovar Typhi
ucaacauuauuaaaau

SEQ ID NO: 1680745 - RNA, 22 nt, Salmonella enterica enterica serovar Typhi
ucaacagcacccaggcacgggu

SEQ ID NO: 1680746 - RNA, 20 nt, Salmonella enterica enterica serovar Typhi
ucaacacgcagacccaggcg

SEQ ID NO: 1680747 - RNA, 21 nt, Salmonella enterica enterica serovar Typhi
ucaacacuuagaacgcggaag

SEQ ID NO: 1680748 - RNA, 18 nt, Salmonella enterica enterica serovar Typhi
ucaacaacuucaaaauag

SEQ ID NO: 1680749 - RNA, 14 nt, Salmonella enterica enterica serovar Typhi
ucaacaaugucgcc

SEQ ID NO: 1680750 - RNA, 22 nt, Salmonella enterica enterica serovar Typhi
ucacagcgguuacgcuauagcu

SEQ ID NO: 1680751 - RNA, 15 nt, Salmonella enterica enterica serovar Typhi
ucacaggcauacaga

SEQ ID NO: 1680752 - RNA, 14 nt, Salmonella enterica enterica serovar Typhi
ucacaggcuuauac

SEQ ID NO: 1680753 - RNA, 15 nt, Salmonella enterica enterica serovar Typhi
ucacaggcuucgaca

SEQ ID NO: 1680754 - RNA, 20 nt, Salmonella enterica enterica serovar Typhi
ucacaggcuucgacaaacag

SEQ ID NO: 1680755 - RNA, 19 nt, Salmonella enterica enterica serovar Typhi
ucacagccacacugcugug

SEQ ID NO: 1680756 - RNA, 15 nt, Salmonella enterica enterica serovar Typhi
ucaauuucauauuau

SEQ ID NO: 1680757 - RNA, 13 nt, Salmonella enterica enterica serovar Typhi
ucacaaaaucauu

SEQ ID NO: 1680758 - RNA, 15 nt, Salmonella enterica enterica serovar Typhi
ucacaaacaauuucc

SEQ ID NO: 1680759 - RNA, 22 nt, Salmonella enterica enterica serovar Typhi
ucacaaacaauuucccccacuu

SEQ ID NO: 1680760 - RNA, 17 nt, Salmonella enterica enterica serovar Typhi
ucacagggggaacauuu

SEQ ID NO: 1680761 - RNA, 21 nt, Salmonella enterica enterica serovar Typhi
ucacauaacaaaaccagcauc

SEQ ID NO: 1680762 - RNA, 16 nt, Salmonella enterica enterica serovar Typhi
aaaucgcgcaaauauu

SEQ ID NO: 1680763 - RNA, 19 nt, Salmonella enterica enterica serovar Typhi
aaaucgcgcaaauauuaca

SEQ ID NO: 1680764 - RNA, 16 nt, Salmonella enterica enterica serovar Typhi
aaaucgcccaggccug

SEQ ID NO: 1680765 - RNA, 19 nt, Salmonella enterica enterica serovar Typhi
aaaucgccucauucgggca

SEQ ID NO: 1680766 - RNA, 21 nt, Salmonella enterica enterica serovar Typhi
ucacauacaaagagaaaauga

SEQ ID NO: 1680767 - RNA, 21 nt, Salmonella enterica enterica serovar Typhi
aaaucggggucuuccagcaga

SEQ ID NO: 1680768 - RNA, 23 nt, Salmonella enterica enterica serovar Typhi
ucaccauaccgacgaccauaauu

SEQ ID NO: 1680769 - RNA, 15 nt, Salmonella enterica enterica serovar Typhi
ucaccauaaaucauu

SEQ ID NO: 1680770 - RNA, 15 nt, Salmonella enterica enterica serovar Typhi
ucaccaucccaugau

SEQ ID NO: 1680771 - RNA, 24 nt, Salmonella enterica enterica serovar Typhi
ucaccaucaguagcacaacgaguc

SEQ ID NO: 1680772 - RNA, 20 nt, Salmonella enterica enterica serovar Typhi
ucaccagcugacgcagcagu

SEQ ID NO: 1680773 - RNA, 12 nt, Salmonella enterica enterica serovar Typhi
ucaccagcgcgc

SEQ ID NO: 1680774 - RNA, 12 nt, Salmonella enterica enterica serovar Typhi
ucaccaggaugc

SEQ ID NO: 1680775 - RNA, 22 nt, Salmonella enterica enterica serovar Typhi
ucaccacgcgaauaccuaacag

SEQ ID NO: 1680776 - RNA, 22 nt, Salmonella enterica enterica serovar Typhi
ucaccacgccauagcgcuaugc

SEQ ID NO: 1680777 - RNA, 21 nt, Salmonella enterica enterica serovar Typhi
ucacauggcgaaaaucacuau

SEQ ID NO: 1680778 - RNA, 16 nt, Salmonella enterica enterica serovar Typhi
ucaccaccgccgcgag

SEQ ID NO: 1680779 - RNA, 18 nt, Salmonella enterica enterica serovar Typhi
ucaccaccgcaggcagcg

SEQ ID NO: 1680780 - RNA, 20 nt, Salmonella enterica enterica serovar Typhi
ucacaugcgggagcaaaaua

SEQ ID NO: 1680781 - RNA, 20 nt, Salmonella enterica enterica serovar Typhi
ucacauggcgaaaaucacua

SEQ ID NO: 1680782 - RNA, 13 nt, Salmonella enterica enterica serovar Typhi
ucacauccagccc

SEQ ID NO: 1680783 - RNA, 19 nt, Salmonella enterica enterica serovar Typhi
ucacaucgccggagaucag

SEQ ID NO: 1680784 - RNA, 22 nt, Salmonella enterica enterica serovar Typhi
ucacaucgccggagaucagcag

SEQ ID NO: 1680785 - RNA, 15 nt, Salmonella enterica enterica serovar Typhi
ucacaucgcgcagca

SEQ ID NO: 1680786 - RNA, 18 nt, Salmonella enterica enterica serovar Typhi
ucacauauucaauaauau

SEQ ID NO: 1680787 - RNA, 20 nt, Salmonella enterica enterica serovar Typhi
ucaaugggauagugccugcc

SEQ ID NO: 1680788 - RNA, 16 nt, Salmonella enterica enterica serovar Typhi
ucaauggguuaugggu

SEQ ID NO: 1680789 - RNA, 12 nt, Salmonella enterica enterica serovar Typhi
ucaaucaggcua

SEQ ID NO: 1680790 - RNA, 19 nt, Salmonella enterica enterica serovar Typhi
ucaauccaacgaaacucag

SEQ ID NO: 1680791 - RNA, 20 nt, Salmonella enterica enterica serovar Typhi
ucaauccaacgaaacucagc

SEQ ID NO: 1680792 - RNA, 16 nt, Salmonella enterica enterica serovar Typhi
ucaaucaucagaagaa

SEQ ID NO: 1680793 - RNA, 17 nt, Salmonella enterica enterica serovar Typhi
ucaaucaucauaucccg

SEQ ID NO: 1680794 - RNA, 19 nt, Salmonella enterica enterica serovar Typhi
ucaauguuagcauuauuuu

SEQ ID NO: 1680795 - RNA, 18 nt, Salmonella enterica enterica serovar Typhi
ucaauucuggaaucaauu

SEQ ID NO: 1680796 - RNA, 14 nt, Salmonella enterica enterica serovar Typhi
ucaauucuuuaauu

SEQ ID NO: 1680797 - RNA, 21 nt, Salmonella enterica enterica serovar Typhi
ucaauaauggcgcgaaaacag

SEQ ID NO: 1680798 - RNA, 15 nt, Salmonella enterica enterica serovar Typhi
ucaauaaucccuucu

SEQ ID NO: 1680799 - RNA, 13 nt, Salmonella enterica enterica serovar Typhi
ucaauaauauuau

SEQ ID NO: 1680800 - RNA, 15 nt, Salmonella enterica enterica serovar Typhi
ucaauaauauuauca

SEQ ID NO: 1680801 - RNA, 22 nt, Salmonella enterica enterica serovar Typhi
ucaauaagaaacugcuguagca

SEQ ID NO: 1680802 - RNA, 22 nt, Salmonella enterica enterica serovar Typhi
ucaaguuuagaaaaaauuaaaa

SEQ ID NO: 1680803 - RNA, 15 nt, Salmonella enterica enterica serovar Typhi
ucaaguuuagaaaaa

SEQ ID NO: 1680804 - RNA, 15 nt, Salmonella enterica enterica serovar Typhi
ucaauaguuaauuaa

SEQ ID NO: 1680805 - RNA, 16 nt, Salmonella enterica enterica serovar Typhi
ucaauaguuaauuaaa

SEQ ID NO: 1680806 - RNA, 15 nt, Salmonella enterica enterica serovar Typhi
ucaauagcacaucag

SEQ ID NO: 1680807 - RNA, 18 nt, Salmonella enterica enterica serovar Typhi
ucaauagagcgcagcaaa

SEQ ID NO: 1680808 - RNA, 22 nt, Salmonella enterica enterica serovar Typhi
ucaauacgagugacauuauuca

SEQ ID NO: 1680809 - RNA, 18 nt, Salmonella enterica enterica serovar Typhi
ucaauacagagauauuaa

SEQ ID NO: 1680810 - RNA, 18 nt, Salmonella enterica enterica serovar Typhi
uauuaacagcuucuucuu

SEQ ID NO: 1680811 - RNA, 12 nt, Salmonella enterica enterica serovar Typhi
uauuaaauaaau

SEQ ID NO: 1680812 - RNA, 14 nt, Salmonella enterica enterica serovar Typhi
uauuaaaucagaua

SEQ ID NO: 1680813 - RNA, 12 nt, Salmonella enterica enterica serovar Typhi
uauuacaaaaau

SEQ ID NO: 1680814 - RNA, 16 nt, Salmonella enterica enterica serovar Typhi
uauuacauagaaaaua

SEQ ID NO: 1680815 - RNA, 20 nt, Salmonella enterica enterica serovar Typhi
uauuacaaguaauaaaauaa

SEQ ID NO: 1680816 - RNA, 16 nt, Salmonella enterica enterica serovar Typhi
uauuacaacauguccu

SEQ ID NO: 1680817 - RNA, 23 nt, Salmonella enterica enterica serovar Typhi
uauuacagacagucuggauauaa

SEQ ID NO: 1680818 - RNA, 21 nt, Salmonella enterica enterica serovar Typhi
uauuacagaucuugugaguaa

SEQ ID NO: 1680819 - RNA, 18 nt, Salmonella enterica enterica serovar Typhi
uauuaucugauucaauua

SEQ ID NO: 1680820 - RNA, 11 nt, Salmonella enterica enterica serovar Typhi
uauuauaaaau

SEQ ID NO: 1680821 - RNA, 13 nt, Salmonella enterica enterica serovar Typhi
uauuauaaaauaa

SEQ ID NO: 1680822 - RNA, 14 nt, Salmonella enterica enterica serovar Typhi
uauguuauuuacaa

SEQ ID NO: 1680823 - RNA, 21 nt, Salmonella enterica enterica serovar Typhi
uauguuaacgccgauuaaugc

SEQ ID NO: 1680824 - RNA, 20 nt, Salmonella enterica enterica serovar Typhi
uaugugccgcccaggccuga

SEQ ID NO: 1680825 - RNA, 23 nt, Salmonella enterica enterica serovar Typhi
uaugugacaaucacucucuugua

SEQ ID NO: 1680826 - RNA, 19 nt, Salmonella enterica enterica serovar Typhi
uauguaauuugcaaaccau

SEQ ID NO: 1680827 - RNA, 17 nt, Salmonella enterica enterica serovar Typhi
uauggugaguaauaaca

SEQ ID NO: 1680828 - RNA, 21 nt, Salmonella enterica enterica serovar Typhi
uauguaaacgcauuaauauuu

SEQ ID NO: 1680829 - RNA, 15 nt, Salmonella enterica enterica serovar Typhi
uauuggcaggaugua

SEQ ID NO: 1680830 - RNA, 20 nt, Salmonella enterica enterica serovar Typhi
uauugcugugcuaugauaag

SEQ ID NO: 1680831 - RNA, 16 nt, Salmonella enterica enterica serovar Typhi
uauugcuucagccaga

SEQ ID NO: 1680832 - RNA, 18 nt, Salmonella enterica enterica serovar Typhi
uauugguaaguuuuucuc

SEQ ID NO: 1680833 - RNA, 18 nt, Salmonella enterica enterica serovar Typhi
uauugggcguaagaaaag

SEQ ID NO: 1680834 - RNA, 15 nt, Salmonella enterica enterica serovar Typhi
uauuguucaugcaau

SEQ ID NO: 1680835 - RNA, 13 nt, Salmonella enterica enterica serovar Typhi
uauuguuaaaaag

SEQ ID NO: 1680836 - RNA, 22 nt, Salmonella enterica enterica serovar Typhi
uauuuaacagagagggaaaaaa

SEQ ID NO: 1680837 - RNA, 12 nt, Salmonella enterica enterica serovar Typhi
uauuuaacccug

SEQ ID NO: 1680838 - RNA, 12 nt, Salmonella enterica enterica serovar Typhi
uauuguuuucua

SEQ ID NO: 1680839 - RNA, 21 nt, Salmonella enterica enterica serovar Typhi
uauuguuuaacguuucaugga

SEQ ID NO: 1680840 - RNA, 17 nt, Salmonella enterica enterica serovar Typhi
uauuguucaugcaauuc

SEQ ID NO: 1680841 - RNA, 20 nt, Salmonella enterica enterica serovar Typhi
uauugaacggcucaaaauaa

SEQ ID NO: 1680842 - RNA, 20 nt, Salmonella enterica enterica serovar Typhi
aaauccuccauaaauaacau

SEQ ID NO: 1680843 - RNA, 17 nt, Salmonella enterica enterica serovar Typhi
uauugccacaauaucau

SEQ ID NO: 1680844 - RNA, 16 nt, Salmonella enterica enterica serovar Typhi
uauugcaccauuuaca

SEQ ID NO: 1680845 - RNA, 15 nt, Salmonella enterica enterica serovar Typhi
uauugcaacuauuaa

SEQ ID NO: 1680846 - RNA, 19 nt, Salmonella enterica enterica serovar Typhi
uauugcaacuauuaauucu

SEQ ID NO: 1680847 - RNA, 11 nt, Salmonella enterica enterica serovar Typhi
uauugauuuuu

SEQ ID NO: 1680848 - RNA, 13 nt, Salmonella enterica enterica serovar Typhi
aaauccugcucca

SEQ ID NO: 1680849 - RNA, 23 nt, Salmonella enterica enterica serovar Typhi
aaauccuggauacguuccagcag

SEQ ID NO: 1680850 - RNA, 16 nt, Salmonella enterica enterica serovar Typhi
aaauccugcacuucca

SEQ ID NO: 1680851 - RNA, 17 nt, Salmonella enterica enterica serovar Typhi
uauucuuccccuucacu

SEQ ID NO: 1680852 - RNA, 20 nt, Salmonella enterica enterica serovar Typhi
uauuccgagucgaucucuuu

SEQ ID NO: 1680853 - RNA, 22 nt, Salmonella enterica enterica serovar Typhi
uauuccucggaggccagauuca

SEQ ID NO: 1680854 - RNA, 16 nt, Salmonella enterica enterica serovar Typhi
uauucccguuccagcu

SEQ ID NO: 1680855 - RNA, 20 nt, Salmonella enterica enterica serovar Typhi
uauuccccccggcagcuuua

SEQ ID NO: 1680856 - RNA, 16 nt, Salmonella enterica enterica serovar Typhi
uauucccaggcaaaug

SEQ ID NO: 1680857 - RNA, 22 nt, Salmonella enterica enterica serovar Typhi
uauuauuuugauacucaucaua

SEQ ID NO: 1680858 - RNA, 16 nt, Salmonella enterica enterica serovar Typhi
uauuauuuugggaaug

SEQ ID NO: 1680859 - RNA, 19 nt, Salmonella enterica enterica serovar Typhi
uauuaugcguuuuuaucuu

SEQ ID NO: 1680860 - RNA, 15 nt, Salmonella enterica enterica serovar Typhi
uauuaugcuggccug

SEQ ID NO: 1680861 - RNA, 20 nt, Salmonella enterica enterica serovar Typhi
uaucuuuuuuagucuccugc

SEQ ID NO: 1680862 - RNA, 17 nt, Salmonella enterica enterica serovar Typhi
uaucuuuaugucaguaa

SEQ ID NO: 1680863 - RNA, 22 nt, Salmonella enterica enterica serovar Typhi
uaucuuuauugaaaagcagcca

SEQ ID NO: 1680864 - RNA, 13 nt, Salmonella enterica enterica serovar Typhi
uaucuuucuuuuu

SEQ ID NO: 1680865 - RNA, 14 nt, Salmonella enterica enterica serovar Typhi
uaucuuucuuuuua

SEQ ID NO: 1680866 - RNA, 23 nt, Salmonella enterica enterica serovar Typhi
uaucuuugccuuuugacagcaca

SEQ ID NO: 1680867 - RNA, 20 nt, Salmonella enterica enterica serovar Typhi
uaugaaaccccaaaucagca

SEQ ID NO: 1680868 - RNA, 17 nt, Salmonella enterica enterica serovar Typhi
uaugaaagagaaaucuc

SEQ ID NO: 1680869 - RNA, 14 nt, Salmonella enterica enterica serovar Typhi
uaugaagcuggagc

SEQ ID NO: 1680870 - RNA, 14 nt, Salmonella enterica enterica serovar Typhi
uaugaacugcauca

SEQ ID NO: 1680871 - RNA, 20 nt, Salmonella enterica enterica serovar Typhi
uaugaacaggcagcguaaua

SEQ ID NO: 1680872 - RNA, 24 nt, Salmonella enterica enterica serovar Typhi
uaucuuuaccagggaauaugauuu

SEQ ID NO: 1680873 - RNA, 12 nt, Salmonella enterica enterica serovar Typhi
uaucuuccagcg

SEQ ID NO: 1680874 - RNA, 22 nt, Salmonella enterica enterica serovar Typhi
uaucuucggucgagcuuuugcu

SEQ ID NO: 1680875 - RNA, 19 nt, Salmonella enterica enterica serovar Typhi
uaucuucgauaaacucaau

SEQ ID NO: 1680876 - RNA, 21 nt, Salmonella enterica enterica serovar Typhi
uaucuguugauaaaacacucu

SEQ ID NO: 1680877 - RNA, 18 nt, Salmonella enterica enterica serovar Typhi
uaucuguaauuauaaaua

SEQ ID NO: 1680878 - RNA, 22 nt, Salmonella enterica enterica serovar Typhi
uaucuucaagguuaugcgcaca

SEQ ID NO: 1680879 - RNA, 15 nt, Salmonella enterica enterica serovar Typhi
uaucucucuggcgca

SEQ ID NO: 1680880 - RNA, 14 nt, Salmonella enterica enterica serovar Typhi
uaucucuauugcuu

SEQ ID NO: 1680881 - RNA, 22 nt, Salmonella enterica enterica serovar Typhi
uaucucuacuuuccugaaggua

SEQ ID NO: 1680882 - RNA, 17 nt, Salmonella enterica enterica serovar Typhi
uaucucacggaaugacu

SEQ ID NO: 1680883 - RNA, 17 nt, Salmonella enterica enterica serovar Typhi
uaucugaccaugccagc

SEQ ID NO: 1680884 - RNA, 21 nt, Salmonella enterica enterica serovar Typhi
uaucugacauauacaaaccac

SEQ ID NO: 1680885 - RNA, 21 nt, Salmonella enterica enterica serovar Typhi
uaucugccagccgauuuuucg

SEQ ID NO: 1680886 - RNA, 18 nt, Salmonella enterica enterica serovar Typhi
uaucugcccuuucuuaug

SEQ ID NO: 1680887 - RNA, 18 nt, Salmonella enterica enterica serovar Typhi
uaucuggauacccccuau

SEQ ID NO: 1680888 - RNA, 18 nt, Salmonella enterica enterica serovar Typhi
uaucguugcgcgcaauca

SEQ ID NO: 1680889 - RNA, 20 nt, Salmonella enterica enterica serovar Typhi
uaucuauuucuuagcgccag

SEQ ID NO: 1680890 - RNA, 22 nt, Salmonella enterica enterica serovar Typhi
uaugacguaagcggcgaaccag

SEQ ID NO: 1680891 - RNA, 16 nt, Salmonella enterica enterica serovar Typhi
uaugauuuucuuauua

SEQ ID NO: 1680892 - RNA, 14 nt, Salmonella enterica enterica serovar Typhi
uaugcaaaagaaaa

SEQ ID NO: 1680893 - RNA, 22 nt, Salmonella enterica enterica serovar Typhi
uaugcaaaagaaaaaacuuauu

SEQ ID NO: 1680894 - RNA, 15 nt, Salmonella enterica enterica serovar Typhi
uaugauuuucuuauu

SEQ ID NO: 1680895 - RNA, 13 nt, Salmonella enterica enterica serovar Typhi
uaugcauugcuga

SEQ ID NO: 1680896 - RNA, 12 nt, Salmonella enterica enterica serovar Typhi
uaugauuuaaaa

SEQ ID NO: 1680897 - RNA, 15 nt, Salmonella enterica enterica serovar Typhi
uaugauuuaaaaaag

SEQ ID NO: 1680898 - RNA, 22 nt, Salmonella enterica enterica serovar Typhi
uaugaucgguuuuuuuagaacc

SEQ ID NO: 1680899 - RNA, 16 nt, Salmonella enterica enterica serovar Typhi
uaugaucugcacaaca

SEQ ID NO: 1680900 - RNA, 13 nt, Salmonella enterica enterica serovar Typhi
uauggcaggcgaa

SEQ ID NO: 1680901 - RNA, 12 nt, Salmonella enterica enterica serovar Typhi
uauggcaaugcc

SEQ ID NO: 1680902 - RNA, 18 nt, Salmonella enterica enterica serovar Typhi
uauggagucaugaauguc

SEQ ID NO: 1680903 - RNA, 21 nt, Salmonella enterica enterica serovar Typhi
uauggguuuccuccaucagcg

SEQ ID NO: 1680904 - RNA, 16 nt, Salmonella enterica enterica serovar Typhi
uauggguguagcucau

SEQ ID NO: 1680905 - RNA, 17 nt, Salmonella enterica enterica serovar Typhi
uaugguauucgugcauc

SEQ ID NO: 1680906 - RNA, 23 nt, Salmonella enterica enterica serovar Typhi
uaugccacucuuuuaaggcccuc

SEQ ID NO: 1680907 - RNA, 19 nt, Salmonella enterica enterica serovar Typhi
uaugccggaggauauuuau

SEQ ID NO: 1680908 - RNA, 16 nt, Salmonella enterica enterica serovar Typhi
uaugccgcacaaaauu

SEQ ID NO: 1680909 - RNA, 23 nt, Salmonella enterica enterica serovar Typhi
uaugcccggaugauuaucaucua

SEQ ID NO: 1680910 - RNA, 21 nt, Salmonella enterica enterica serovar Typhi
uaugcgacugaaaaucaaaaa

SEQ ID NO: 1680911 - RNA, 19 nt, Salmonella enterica enterica serovar Typhi
uaugcgacugaaaaucaaa

SEQ ID NO: 1680912 - RNA, 19 nt, Salmonella enterica enterica serovar Typhi
uaugccuggggucgucagc

SEQ ID NO: 1680913 - RNA, 18 nt, Salmonella enterica enterica serovar Typhi
uaugccccgacaucagau

SEQ ID NO: 1680914 - RNA, 19 nt, Salmonella enterica enterica serovar Typhi
uaugccugcacuaaaccag

SEQ ID NO: 1680915 - RNA, 21 nt, Salmonella enterica enterica serovar Typhi
uaugccugccagcauuaaccc

SEQ ID NO: 1680916 - RNA, 20 nt, Salmonella enterica enterica serovar Typhi
uaugccggaggauauuuauu

SEQ ID NO: 1680917 - RNA, 20 nt, Salmonella enterica enterica serovar Typhi
uaugcucccggggauuucuu

SEQ ID NO: 1680918 - RNA, 14 nt, Salmonella enterica enterica serovar Typhi
uaugcgguucuccc

SEQ ID NO: 1680919 - RNA, 18 nt, Salmonella enterica enterica serovar Typhi
uaucagcgcguuuuccau

SEQ ID NO: 1680920 - RNA, 19 nt, Salmonella enterica enterica serovar Typhi
uaucagcguccggagcagc

SEQ ID NO: 1680921 - RNA, 14 nt, Salmonella enterica enterica serovar Typhi
uaucagcuugccgu

SEQ ID NO: 1680922 - RNA, 16 nt, Salmonella enterica enterica serovar Typhi
uaucauagugccggug

SEQ ID NO: 1680923 - RNA, 23 nt, Salmonella enterica enterica serovar Typhi
uauccagcagguaacguuucagu

SEQ ID NO: 1680924 - RNA, 12 nt, Salmonella enterica enterica serovar Typhi
uauccagcagcc

SEQ ID NO: 1680925 - RNA, 17 nt, Salmonella enterica enterica serovar Typhi
uauccagcggcaaaggc

SEQ ID NO: 1680926 - RNA, 19 nt, Salmonella enterica enterica serovar Typhi
uauccagcggcaaaggcau

SEQ ID NO: 1680927 - RNA, 18 nt, Salmonella enterica enterica serovar Typhi
uauccagcgcccgcuuca

SEQ ID NO: 1680928 - RNA, 19 nt, Salmonella enterica enterica serovar Typhi
uauccuaaugccacggcug

SEQ ID NO: 1680929 - RNA, 15 nt, Salmonella enterica enterica serovar Typhi
uauccuaaaucugcc

SEQ ID NO: 1680930 - RNA, 19 nt, Salmonella enterica enterica serovar Typhi
uauccuaaaucugccauca

SEQ ID NO: 1680931 - RNA, 19 nt, Salmonella enterica enterica serovar Typhi
uauccguuauuuaauucuu

SEQ ID NO: 1680932 - RNA, 21 nt, Salmonella enterica enterica serovar Typhi
uauccucgcauccuccaucca

SEQ ID NO: 1680933 - RNA, 21 nt, Salmonella enterica enterica serovar Typhi
uauccgugcgcaauuccagca

SEQ ID NO: 1680934 - RNA, 18 nt, Salmonella enterica enterica serovar Typhi
uauccccagucuuccugc

SEQ ID NO: 1680935 - RNA, 21 nt, Salmonella enterica enterica serovar Typhi
uaucccauacguuuuuauuau

SEQ ID NO: 1680936 - RNA, 15 nt, Salmonella enterica enterica serovar Typhi
uaucccauugcguuc

SEQ ID NO: 1680937 - RNA, 16 nt, Salmonella enterica enterica serovar Typhi
uaucccugcaaacuau

SEQ ID NO: 1680938 - RNA, 14 nt, Salmonella enterica enterica serovar Typhi
uaucccugcugagu

SEQ ID NO: 1680939 - RNA, 18 nt, Salmonella enterica enterica serovar Typhi
uauccggcaaaagaggcu

SEQ ID NO: 1680940 - RNA, 24 nt, Salmonella enterica enterica serovar Typhi
uauccccugacagagcucgucaaa

SEQ ID NO: 1680941 - RNA, 14 nt, Salmonella enterica enterica serovar Typhi
uauccccgcuggcg

SEQ ID NO: 1680942 - RNA, 15 nt, Salmonella enterica enterica serovar Typhi
uauccuuaaguacaa

SEQ ID NO: 1680943 - RNA, 18 nt, Salmonella enterica enterica serovar Typhi
uauccuuaucagacucag

SEQ ID NO: 1680944 - RNA, 18 nt, Salmonella enterica enterica serovar Typhi
uauccuguaacucaucug

SEQ ID NO: 1680945 - RNA, 14 nt, Salmonella enterica enterica serovar Typhi
uauccugcuugccu

SEQ ID NO: 1680946 - RNA, 18 nt, Salmonella enterica enterica serovar Typhi
uaucgacgcuauuuuuca

SEQ ID NO: 1680947 - RNA, 16 nt, Salmonella enterica enterica serovar Typhi
uaucgauaucugccug

SEQ ID NO: 1680948 - RNA, 21 nt, Salmonella enterica enterica serovar Typhi
uaucgauaaucaacaaugucg

SEQ ID NO: 1680949 - RNA, 22 nt, Salmonella enterica enterica serovar Typhi
uaucgcugcuaaacgagccguc

SEQ ID NO: 1680950 - RNA, 15 nt, Salmonella enterica enterica serovar Typhi
uaucgcgucaucaaa

SEQ ID NO: 1680951 - RNA, 23 nt, Salmonella enterica enterica serovar Typhi
uaucgcgccgccaauauccauuu

SEQ ID NO: 1680952 - RNA, 20 nt, Salmonella enterica enterica serovar Typhi
uaucgcgccggacagcagca

SEQ ID NO: 1680953 - RNA, 17 nt, Salmonella enterica enterica serovar Typhi
uaucgcgccagguauac

SEQ ID NO: 1680954 - RNA, 19 nt, Salmonella enterica enterica serovar Typhi
uaucgccgacaaacaguga

SEQ ID NO: 1680955 - RNA, 14 nt, Salmonella enterica enterica serovar Typhi
uaucgccgaucaca

SEQ ID NO: 1680956 - RNA, 20 nt, Salmonella enterica enterica serovar Typhi
uaucggcaauauugccgcac

SEQ ID NO: 1680957 - RNA, 13 nt, Salmonella enterica enterica serovar Typhi
uaucggccagcgc

SEQ ID NO: 1680958 - RNA, 12 nt, Salmonella enterica enterica serovar Typhi
uaucaagccuac

SEQ ID NO: 1680959 - RNA, 15 nt, Salmonella enterica enterica serovar Typhi
uaucaagccuacacc

SEQ ID NO: 1680960 - RNA, 14 nt, Salmonella enterica enterica serovar Typhi
uaucaagauaaaaa

SEQ ID NO: 1680961 - RNA, 15 nt, Salmonella enterica enterica serovar Typhi
uaucaauuucauauu

SEQ ID NO: 1680962 - RNA, 13 nt, Salmonella enterica enterica serovar Typhi
uaucagacucagg

SEQ ID NO: 1680963 - RNA, 12 nt, Salmonella enterica enterica serovar Typhi
uaucaccaucuu

SEQ ID NO: 1680964 - RNA, 19 nt, Salmonella enterica enterica serovar Typhi
uaucaccgcugacugaacu

SEQ ID NO: 1680965 - RNA, 20 nt, Salmonella enterica enterica serovar Typhi
uaucaccaucuuuuugcuca

SEQ ID NO: 1680966 - RNA, 19 nt, Salmonella enterica enterica serovar Typhi
uaucaauuucauauuauua

SEQ ID NO: 1680967 - RNA, 21 nt, Salmonella enterica enterica serovar Typhi
uauauguccuuuacugcgcca

SEQ ID NO: 1680968 - RNA, 14 nt, Salmonella enterica enterica serovar Typhi
uauauguugaauau

SEQ ID NO: 1680969 - RNA, 20 nt, Salmonella enterica enterica serovar Typhi
uauaugcgacagaaauugaa

SEQ ID NO: 1680970 - RNA, 19 nt, Salmonella enterica enterica serovar Typhi
uauaugcaggcauaaaaaa

SEQ ID NO: 1680971 - RNA, 23 nt, Salmonella enterica enterica serovar Typhi
uauaugagcgggccgucaggccc

SEQ ID NO: 1680972 - RNA, 16 nt, Salmonella enterica enterica serovar Typhi
uauaugacaacacuca

SEQ ID NO: 1680973 - RNA, 13 nt, Salmonella enterica enterica serovar Typhi
uauauuuaaaauu

SEQ ID NO: 1680974 - RNA, 21 nt, Salmonella enterica enterica serovar Typhi
uauauuuacugaauaaauagu

SEQ ID NO: 1680975 - RNA, 21 nt, Salmonella enterica enterica serovar Typhi
uauaugaaaucgccuguuaau

SEQ ID NO: 1680976 - RNA, 16 nt, Salmonella enterica enterica serovar Typhi
uauaucgcgauaaacu

SEQ ID NO: 1680977 - RNA, 20 nt, Salmonella enterica enterica serovar Typhi
uauaucgcgauaaacugaca

SEQ ID NO: 1680978 - RNA, 20 nt, Salmonella enterica enterica serovar Typhi
uauaucggcugcuguaacag

SEQ ID NO: 1680979 - RNA, 13 nt, Salmonella enterica enterica serovar Typhi
uauaguaaauuga

SEQ ID NO: 1680980 - RNA, 23 nt, Salmonella enterica enterica serovar Typhi
uauagguguaaaccguuuuuccg

SEQ ID NO: 1680981 - RNA, 12 nt, Salmonella enterica enterica serovar Typhi
uauaggccaggc

SEQ ID NO: 1680982 - RNA, 14 nt, Salmonella enterica enterica serovar Typhi
uauaggggccaagc

SEQ ID NO: 1680983 - RNA, 14 nt, Salmonella enterica enterica serovar Typhi
uauacacucaacca

SEQ ID NO: 1680984 - RNA, 20 nt, Salmonella enterica enterica serovar Typhi
uauacaaaacccauaucccc

SEQ ID NO: 1680985 - RNA, 18 nt, Salmonella enterica enterica serovar Typhi
uauaauuuuauuauauuu

SEQ ID NO: 1680986 - RNA, 17 nt, Salmonella enterica enterica serovar Typhi
uauaagcugccucuuug

SEQ ID NO: 1680987 - RNA, 16 nt, Salmonella enterica enterica serovar Typhi
uauaaucacagggguc

SEQ ID NO: 1680988 - RNA, 20 nt, Salmonella enterica enterica serovar Typhi
uauaauuaacauuuaagaaa

SEQ ID NO: 1680989 - RNA, 18 nt, Salmonella enterica enterica serovar Typhi
uauaauuaagaccauacu

SEQ ID NO: 1680990 - RNA, 19 nt, Salmonella enterica enterica serovar Typhi
uauaauucgucaauaccua

SEQ ID NO: 1680991 - RNA, 14 nt, Salmonella enterica enterica serovar Typhi
uauaaauaucauug

SEQ ID NO: 1680992 - RNA, 19 nt, Salmonella enterica enterica serovar Typhi
uauaaauauuaaugaauaa

SEQ ID NO: 1680993 - RNA, 21 nt, Salmonella enterica enterica serovar Typhi
uauaaauauuaaugaauaaau

SEQ ID NO: 1680994 - RNA, 11 nt, Salmonella enterica enterica serovar Typhi
uauaaauauag

SEQ ID NO: 1680995 - RNA, 18 nt, Salmonella enterica enterica serovar Typhi
uauaacagaauaagccag

SEQ ID NO: 1680996 - RNA, 20 nt, Salmonella enterica enterica serovar Typhi
uauaaauaaccgguaacugu

SEQ ID NO: 1680997 - RNA, 21 nt, Salmonella enterica enterica serovar Typhi
uauaagaaccaucuaccauau

SEQ ID NO: 1680998 - RNA, 22 nt, Salmonella enterica enterica serovar Typhi
uaguugacgccccauguggcca

SEQ ID NO: 1680999 - RNA, 17 nt, Salmonella enterica enterica serovar Typhi
uaguugaauaaccucaa

SEQ ID NO: 1681000 - RNA, 17 nt, Salmonella enterica enterica serovar Typhi
uauaaaguucccaugcu

SEQ ID NO: 1681001 - RNA, 22 nt, Salmonella enterica enterica serovar Typhi
uaguacccucugcaccagaacu

SEQ ID NO: 1681002 - RNA, 13 nt, Salmonella enterica enterica serovar Typhi
uaguaccgacacc

SEQ ID NO: 1681003 - RNA, 16 nt, Salmonella enterica enterica serovar Typhi
uagucauaauuaaaaa

SEQ ID NO: 1681004 - RNA, 22 nt, Salmonella enterica enterica serovar Typhi
uaguccucgcgcgggaaaucgu

SEQ ID NO: 1681005 - RNA, 19 nt, Salmonella enterica enterica serovar Typhi
uagucaucgccuucauccg

SEQ ID NO: 1681006 - RNA, 13 nt, Salmonella enterica enterica serovar Typhi
uaguaacuuacaa

SEQ ID NO: 1681007 - RNA, 18 nt, Salmonella enterica enterica serovar Typhi
uagguucugcgaggugau

SEQ ID NO: 1681008 - RNA, 23 nt, Salmonella enterica enterica serovar Typhi
uagguuaaauagcaggcaaugau

SEQ ID NO: 1681009 - RNA, 19 nt, Salmonella enterica enterica serovar Typhi
uacuuucagauaauucuaa

SEQ ID NO: 1681010 - RNA, 12 nt, Salmonella enterica enterica serovar Typhi
uacuuucaaaau

SEQ ID NO: 1681011 - RNA, 15 nt, Salmonella enterica enterica serovar Typhi
uacuuucaaaauacu

SEQ ID NO: 1681012 - RNA, 21 nt, Salmonella enterica enterica serovar Typhi
uaguuaucacguuccuuuacu

SEQ ID NO: 1681013 - RNA, 20 nt, Salmonella enterica enterica serovar Typhi
uaguuauacauuuuuuucuu

SEQ ID NO: 1681014 - RNA, 15 nt, Salmonella enterica enterica serovar Typhi
uaguuauaaauuuau

SEQ ID NO: 1681015 - RNA, 14 nt, Salmonella enterica enterica serovar Typhi
uaguggauggccca

SEQ ID NO: 1681016 - RNA, 14 nt, Salmonella enterica enterica serovar Typhi
uaguggcgaucuga

SEQ ID NO: 1681017 - RNA, 15 nt, Salmonella enterica enterica serovar Typhi
uaguggaucagcaga

SEQ ID NO: 1681018 - RNA, 23 nt, Salmonella enterica enterica serovar Typhi
uagucgauggucucguugccauu

SEQ ID NO: 1681019 - RNA, 22 nt, Salmonella enterica enterica serovar Typhi
uagucuccugccaaugaaauaa

SEQ ID NO: 1681020 - RNA, 12 nt, Salmonella enterica enterica serovar Typhi
uagucucccucc

SEQ ID NO: 1681021 - RNA, 12 nt, Salmonella enterica enterica serovar Typhi
uagucuccgcca

SEQ ID NO: 1681022 - RNA, 23 nt, Salmonella enterica enterica serovar Typhi
uagucuuguuacucaauaaaagu

SEQ ID NO: 1681023 - RNA, 17 nt, Salmonella enterica enterica serovar Typhi
uccuucggugccauauu

SEQ ID NO: 1681024 - RNA, 17 nt, Salmonella enterica enterica serovar Typhi
uccuucguuacuuucau

SEQ ID NO: 1681025 - RNA, 15 nt, Salmonella enterica enterica serovar Typhi
uccuucccccaccac

SEQ ID NO: 1681026 - RNA, 14 nt, Salmonella enterica enterica serovar Typhi
uccuucuucccccu

SEQ ID NO: 1681027 - RNA, 19 nt, Salmonella enterica enterica serovar Typhi
uccuugcacgccaaaaagu

SEQ ID NO: 1681028 - RNA, 18 nt, Salmonella enterica enterica serovar Typhi
uccuuuaaucgccgugcc

SEQ ID NO: 1681029 - RNA, 15 nt, Salmonella enterica enterica serovar Typhi
uccuuuaucugcccu

SEQ ID NO: 1681030 - RNA, 21 nt, Salmonella enterica enterica serovar Typhi
uccuuuacugcgccagccugc

SEQ ID NO: 1681031 - RNA, 20 nt, Salmonella enterica enterica serovar Typhi
uccuugccagugaaaaaaag

SEQ ID NO: 1681032 - RNA, 14 nt, Salmonella enterica enterica serovar Typhi
uccuugcagccaga

SEQ ID NO: 1681033 - RNA, 22 nt, Salmonella enterica enterica serovar Typhi
uccuugcagccagaacucaucu

SEQ ID NO: 1681034 - RNA, 23 nt, Salmonella enterica enterica serovar Typhi
uccuugcagccagaacucaucuu

SEQ ID NO: 1681035 - RNA, 23 nt, Salmonella enterica enterica serovar Typhi
uccuugcccuguuucgcaggccg

SEQ ID NO: 1681036 - RNA, 13 nt, Salmonella enterica enterica serovar Typhi
uccuuuuucaggc

SEQ ID NO: 1681037 - RNA, 15 nt, Salmonella enterica enterica serovar Typhi
uccuuuuucaggcac

SEQ ID NO: 1681038 - RNA, 19 nt, Salmonella enterica enterica serovar Typhi
uccuuuuaauaaagaaagc

SEQ ID NO: 1681039 - RNA, 21 nt, Salmonella enterica enterica serovar Typhi
uccuuuuaccggcgaagucgc

SEQ ID NO: 1681040 - RNA, 23 nt, Salmonella enterica enterica serovar Typhi
uccuuuguuugccgcgaccacgc

SEQ ID NO: 1681041 - RNA, 19 nt, Salmonella enterica enterica serovar Typhi
uccuuucggacuuccugua

SEQ ID NO: 1681042 - RNA, 22 nt, Salmonella enterica enterica serovar Typhi
uccuuuccugugcucgauauau

SEQ ID NO: 1681043 - RNA, 14 nt, Salmonella enterica enterica serovar Typhi
ucgaacaucugcgu

SEQ ID NO: 1681044 - RNA, 18 nt, Salmonella enterica enterica serovar Typhi
ucgaaacaggaaaaacau

SEQ ID NO: 1681045 - RNA, 20 nt, Salmonella enterica enterica serovar Typhi
ucgaaaugccuuaccuggca

SEQ ID NO: 1681046 - RNA, 19 nt, Salmonella enterica enterica serovar Typhi
ucgaagccgaccaccaucc

SEQ ID NO: 1681047 - RNA, 16 nt, Salmonella enterica enterica serovar Typhi
ucgaagagcacuuugg

SEQ ID NO: 1681048 - RNA, 19 nt, Salmonella enterica enterica serovar Typhi
ucgaacgcuuccgggcuca

SEQ ID NO: 1681049 - RNA, 17 nt, Salmonella enterica enterica serovar Typhi
ucgaacgguaacaggaa

SEQ ID NO: 1681050 - RNA, 14 nt, Salmonella enterica enterica serovar Typhi
ucgacaaaggcaag

SEQ ID NO: 1681051 - RNA, 13 nt, Salmonella enterica enterica serovar Typhi
ucgacaauuucac

SEQ ID NO: 1681052 - RNA, 16 nt, Salmonella enterica enterica serovar Typhi
ucgacaagcuaauccc

SEQ ID NO: 1681053 - RNA, 17 nt, Salmonella enterica enterica serovar Typhi
ucgaaucgccucaacca

SEQ ID NO: 1681054 - RNA, 20 nt, Salmonella enterica enterica serovar Typhi
ucgacagccagcauuuccag

SEQ ID NO: 1681055 - RNA, 21 nt, Salmonella enterica enterica serovar Typhi
ucgacagccagcauuuccagc

SEQ ID NO: 1681056 - RNA, 17 nt, Salmonella enterica enterica serovar Typhi
ucgacaugcagaucgcg

SEQ ID NO: 1681057 - RNA, 15 nt, Salmonella enterica enterica serovar Typhi
ucgacaugggcggga

SEQ ID NO: 1681058 - RNA, 20 nt, Salmonella enterica enterica serovar Typhi
ucgaccucuucguucauccg

SEQ ID NO: 1681059 - RNA, 21 nt, Salmonella enterica enterica serovar Typhi
ucgaccugcguuaacggcuuc

SEQ ID NO: 1681060 - RNA, 17 nt, Salmonella enterica enterica serovar Typhi
ucgaccuucaucucuuu

SEQ ID NO: 1681061 - RNA, 13 nt, Salmonella enterica enterica serovar Typhi
ucgacgaaauggu

SEQ ID NO: 1681062 - RNA, 13 nt, Salmonella enterica enterica serovar Typhi
ucgacggcaaccu

SEQ ID NO: 1681063 - RNA, 16 nt, Salmonella enterica enterica serovar Typhi
ucgacggccagcgcgc

SEQ ID NO: 1681064 - RNA, 14 nt, Salmonella enterica enterica serovar Typhi
ucgacgcgcaucac

SEQ ID NO: 1681065 - RNA, 17 nt, Salmonella enterica enterica serovar Typhi
ucgacguuuuccaucac

SEQ ID NO: 1681066 - RNA, 12 nt, Salmonella enterica enterica serovar Typhi
ucgacuuucauu

SEQ ID NO: 1681067 - RNA, 15 nt, Salmonella enterica enterica serovar Typhi
ucgaggacggccuga

SEQ ID NO: 1681068 - RNA, 15 nt, Salmonella enterica enterica serovar Typhi
ucgaggccauauuua

SEQ ID NO: 1681069 - RNA, 18 nt, Salmonella enterica enterica serovar Typhi
ucgagcguaauuccggcc

SEQ ID NO: 1681070 - RNA, 11 nt, Salmonella enterica enterica serovar Typhi
ucgagcgcgga

SEQ ID NO: 1681071 - RNA, 19 nt, Salmonella enterica enterica serovar Typhi
ucgagcaucuccagcgcau

SEQ ID NO: 1681072 - RNA, 22 nt, Salmonella enterica enterica serovar Typhi
ucgagggugggcgcacaggccu

SEQ ID NO: 1681073 - RNA, 22 nt, Salmonella enterica enterica serovar Typhi
ucgaguucuugcgacaucgcau

SEQ ID NO: 1681074 - RNA, 16 nt, Salmonella enterica enterica serovar Typhi
ucgauaaucgcgcgcu

SEQ ID NO: 1681075 - RNA, 16 nt, Salmonella enterica enterica serovar Typhi
ucgauaaccaccagcg

SEQ ID NO: 1681076 - RNA, 22 nt, Salmonella enterica enterica serovar Typhi
ucgauccccucuuccaucagcc

SEQ ID NO: 1681077 - RNA, 17 nt, Salmonella enterica enterica serovar Typhi
ucgauccacuucccauu

SEQ ID NO: 1681078 - RNA, 15 nt, Salmonella enterica enterica serovar Typhi
ucgaucagcuggcuu

SEQ ID NO: 1681079 - RNA, 19 nt, Salmonella enterica enterica serovar Typhi
ucgauagcguuuuccagcu

SEQ ID NO: 1681080 - RNA, 18 nt, Salmonella enterica enterica serovar Typhi
ucgauacgcugaagcuug

SEQ ID NO: 1681081 - RNA, 22 nt, Salmonella enterica enterica serovar Typhi
ucgauacgauugcgcguguuac

SEQ ID NO: 1681082 - RNA, 18 nt, Salmonella enterica enterica serovar Typhi
ucgauaauugcucaccca

SEQ ID NO: 1681083 - RNA, 16 nt, Salmonella enterica enterica serovar Typhi
ucgauauaauuuuauu

SEQ ID NO: 1681084 - RNA, 15 nt, Salmonella enterica enterica serovar Typhi
ucgauaucugccugc

SEQ ID NO: 1681085 - RNA, 19 nt, Salmonella enterica enterica serovar Typhi
ucgauaucgauaaucaaca

SEQ ID NO: 1681086 - RNA, 18 nt, Salmonella enterica enterica serovar Typhi
ucgaugcccguugucaca

SEQ ID NO: 1681087 - RNA, 21 nt, Salmonella enterica enterica serovar Typhi
ucgaugagcucguuauaagcu

SEQ ID NO: 1681088 - RNA, 22 nt, Salmonella enterica enterica serovar Typhi
ucgaucucgauauucacacgcu

SEQ ID NO: 1681089 - RNA, 15 nt, Salmonella enterica enterica serovar Typhi
ucgaugaaaaagagg

SEQ ID NO: 1681090 - RNA, 14 nt, Salmonella enterica enterica serovar Typhi
ucgaugaaaaagag

SEQ ID NO: 1681091 - RNA, 14 nt, Salmonella enterica enterica serovar Typhi
ucgaucccggcaaa

SEQ ID NO: 1681092 - RNA, 13 nt, Salmonella enterica enterica serovar Typhi
ucgauuuuuucga

SEQ ID NO: 1681093 - RNA, 22 nt, Salmonella enterica enterica serovar Typhi
ucgauuuucugcucaauauuau

SEQ ID NO: 1681094 - RNA, 17 nt, Salmonella enterica enterica serovar Typhi
ucgauuaaacgccuggg

SEQ ID NO: 1681095 - RNA, 23 nt, Salmonella enterica enterica serovar Typhi
ucgauuagaccguaaauccuaac

SEQ ID NO: 1681096 - RNA, 13 nt, Salmonella enterica enterica serovar Typhi
ucgauggccucau

SEQ ID NO: 1681097 - RNA, 17 nt, Salmonella enterica enterica serovar Typhi
ucgcaccauagcagcca

SEQ ID NO: 1681098 - RNA, 23 nt, Salmonella enterica enterica serovar Typhi
ucgcacaucaugaugaucuucag

SEQ ID NO: 1681099 - RNA, 20 nt, Salmonella enterica enterica serovar Typhi
ucgcaaggcgcgauccgccc

SEQ ID NO: 1681100 - RNA, 20 nt, Salmonella enterica enterica serovar Typhi
ucgcaacgccccgucaccag

SEQ ID NO: 1681101 - RNA, 21 nt, Salmonella enterica enterica serovar Typhi
ucgcaacgccgccgacaugac

SEQ ID NO: 1681102 - RNA, 20 nt, Salmonella enterica enterica serovar Typhi
ucgcaacgccggugccugcc

SEQ ID NO: 1681103 - RNA, 20 nt, Salmonella enterica enterica serovar Typhi
ucgcaagacgaaaaaugaau

SEQ ID NO: 1681104 - RNA, 15 nt, Salmonella enterica enterica serovar Typhi
ucgcagaccauccau

SEQ ID NO: 1681105 - RNA, 21 nt, Salmonella enterica enterica serovar Typhi
ucgcacgucgucguuuguagg

SEQ ID NO: 1681106 - RNA, 15 nt, Salmonella enterica enterica serovar Typhi
ucgcagacauggcaa

SEQ ID NO: 1681107 - RNA, 13 nt, Salmonella enterica enterica serovar Typhi
ucgcauaacuucg

SEQ ID NO: 1681108 - RNA, 21 nt, Salmonella enterica enterica serovar Typhi
ucgcaguuaugcgcaucaccg

SEQ ID NO: 1681109 - RNA, 24 nt, Salmonella enterica enterica serovar Typhi
ucgcagcgcuuugccgcugcugcc

SEQ ID NO: 1681110 - RNA, 21 nt, Salmonella enterica enterica serovar Typhi
ucgcaggccaaacagcggcuc

SEQ ID NO: 1681111 - RNA, 16 nt, Salmonella enterica enterica serovar Typhi
ucgcagccuuuggcaa

SEQ ID NO: 1681112 - RNA, 12 nt, Salmonella enterica enterica serovar Typhi
ucgcagcggcug

SEQ ID NO: 1681113 - RNA, 18 nt, Salmonella enterica enterica serovar Typhi
uccggcuacgguuuuaau

SEQ ID NO: 1681114 - RNA, 16 nt, Salmonella enterica enterica serovar Typhi
uccggcuaugccggag

SEQ ID NO: 1681115 - RNA, 18 nt, Salmonella enterica enterica serovar Typhi
uccggcugcaccagcguu

SEQ ID NO: 1681116 - RNA, 11 nt, Salmonella enterica enterica serovar Typhi
uccggcugccu

SEQ ID NO: 1681117 - RNA, 15 nt, Salmonella enterica enterica serovar Typhi
uccggcggugaagca

SEQ ID NO: 1681118 - RNA, 21 nt, Salmonella enterica enterica serovar Typhi
uccggcgugucagggcggaac

SEQ ID NO: 1681119 - RNA, 21 nt, Salmonella enterica enterica serovar Typhi
uccggcgcugaugacgcgccg

SEQ ID NO: 1681120 - RNA, 13 nt, Salmonella enterica enterica serovar Typhi
uccggccugcaug

SEQ ID NO: 1681121 - RNA, 14 nt, Salmonella enterica enterica serovar Typhi
uccggcgcaauaag

SEQ ID NO: 1681122 - RNA, 17 nt, Salmonella enterica enterica serovar Typhi
uccggccuacagacugu

SEQ ID NO: 1681123 - RNA, 20 nt, Salmonella enterica enterica serovar Typhi
uccggccuacgcgucaauua

SEQ ID NO: 1681124 - RNA, 14 nt, Salmonella enterica enterica serovar Typhi
uccggccugcaggc

SEQ ID NO: 1681125 - RNA, 16 nt, Salmonella enterica enterica serovar Typhi
uccggccugcagggaa

SEQ ID NO: 1681126 - RNA, 16 nt, Salmonella enterica enterica serovar Typhi
uccgguagagaacgaa

SEQ ID NO: 1681127 - RNA, 15 nt, Salmonella enterica enterica serovar Typhi
uccgguacgccuaaa

SEQ ID NO: 1681128 - RNA, 19 nt, Salmonella enterica enterica serovar Typhi
uccgggcgcaccaguuccc

SEQ ID NO: 1681129 - RNA, 18 nt, Salmonella enterica enterica serovar Typhi
uccgcuuucuucccggca

SEQ ID NO: 1681130 - RNA, 16 nt, Salmonella enterica enterica serovar Typhi
uccgcuuuucuggcuu

SEQ ID NO: 1681131 - RNA, 16 nt, Salmonella enterica enterica serovar Typhi
uccgcuuuugguuuuu

SEQ ID NO: 1681132 - RNA, 14 nt, Salmonella enterica enterica serovar Typhi
uccggcaaacucag

SEQ ID NO: 1681133 - RNA, 21 nt, Salmonella enterica enterica serovar Typhi
uccggcaacggguuagacuca

SEQ ID NO: 1681134 - RNA, 20 nt, Salmonella enterica enterica serovar Typhi
uccgcuuuuuuauuguuucu

SEQ ID NO: 1681135 - RNA, 14 nt, Salmonella enterica enterica serovar Typhi
uccggagccugugu

SEQ ID NO: 1681136 - RNA, 15 nt, Salmonella enterica enterica serovar Typhi
uccggaucaucuuuu

SEQ ID NO: 1681137 - RNA, 18 nt, Salmonella enterica enterica serovar Typhi
uccggacguacccaggcg

SEQ ID NO: 1681138 - RNA, 16 nt, Salmonella enterica enterica serovar Typhi
uccggcauccagcgcu

SEQ ID NO: 1681139 - RNA, 12 nt, Salmonella enterica enterica serovar Typhi
uccggccagcgc

SEQ ID NO: 1681140 - RNA, 13 nt, Salmonella enterica enterica serovar Typhi
uccggcacacagc

SEQ ID NO: 1681141 - RNA, 15 nt, Salmonella enterica enterica serovar Typhi
uccggcacacagcgc

SEQ ID NO: 1681142 - RNA, 19 nt, Salmonella enterica enterica serovar Typhi
uccggcaaacucagcggcu

SEQ ID NO: 1681143 - RNA, 13 nt, Salmonella enterica enterica serovar Typhi
uccggcaaugauu

SEQ ID NO: 1681144 - RNA, 14 nt, Salmonella enterica enterica serovar Typhi
uccggcagaaauga

SEQ ID NO: 1681145 - RNA, 17 nt, Salmonella enterica enterica serovar Typhi
uccggcagacggcuggg

SEQ ID NO: 1681146 - RNA, 18 nt, Salmonella enterica enterica serovar Typhi
uccgucgugccuuucagg

SEQ ID NO: 1681147 - RNA, 16 nt, Salmonella enterica enterica serovar Typhi
uccgucuccggacguu

SEQ ID NO: 1681148 - RNA, 19 nt, Salmonella enterica enterica serovar Typhi
uccgucggcuggaagccuu

SEQ ID NO: 1681149 - RNA, 15 nt, Salmonella enterica enterica serovar Typhi
uccgucguguagccu

SEQ ID NO: 1681150 - RNA, 13 nt, Salmonella enterica enterica serovar Typhi
uccgugaccugcu

SEQ ID NO: 1681151 - RNA, 18 nt, Salmonella enterica enterica serovar Typhi
uccguucaucggcauaca

SEQ ID NO: 1681152 - RNA, 17 nt, Salmonella enterica enterica serovar Typhi
uccguuauuucacagca

SEQ ID NO: 1681153 - RNA, 17 nt, Salmonella enterica enterica serovar Typhi
uccguuagcucuuucau

SEQ ID NO: 1681154 - RNA, 21 nt, Salmonella enterica enterica serovar Typhi
uccgugaaugccaagcgcaua

SEQ ID NO: 1681155 - RNA, 18 nt, Salmonella enterica enterica serovar Typhi
uccguuuguaacauauuu

SEQ ID NO: 1681156 - RNA, 23 nt, Salmonella enterica enterica serovar Typhi
uccguuuucgacaugguuggcca

SEQ ID NO: 1681157 - RNA, 19 nt, Salmonella enterica enterica serovar Typhi
uccguauuauccacccccg

SEQ ID NO: 1681158 - RNA, 16 nt, Salmonella enterica enterica serovar Typhi
uccguauugcaaugcg

SEQ ID NO: 1681159 - RNA, 16 nt, Salmonella enterica enterica serovar Typhi
uccguagcgauaauga

SEQ ID NO: 1681160 - RNA, 22 nt, Salmonella enterica enterica serovar Typhi
uccgucauguagcaaauuucau

SEQ ID NO: 1681161 - RNA, 13 nt, Salmonella enterica enterica serovar Typhi
uccguccucuuuc

SEQ ID NO: 1681162 - RNA, 15 nt, Salmonella enterica enterica serovar Typhi
uccggucuacaagug

SEQ ID NO: 1681163 - RNA, 14 nt, Salmonella enterica enterica serovar Typhi
uccgguuccagcgg

SEQ ID NO: 1681164 - RNA, 16 nt, Salmonella enterica enterica serovar Typhi
uccgguugaccgcaua

SEQ ID NO: 1681165 - RNA, 11 nt, Salmonella enterica enterica serovar Typhi
uccgguuuuug

SEQ ID NO: 1681166 - RNA, 20 nt, Salmonella enterica enterica serovar Typhi
uccucaauauugucuucguc

SEQ ID NO: 1681167 - RNA, 15 nt, Salmonella enterica enterica serovar Typhi
uccucaauguuaacu

SEQ ID NO: 1681168 - RNA, 19 nt, Salmonella enterica enterica serovar Typhi
uccucacaaacggcaucga

SEQ ID NO: 1681169 - RNA, 22 nt, Salmonella enterica enterica serovar Typhi
uccucaccguagcuccagaccu

SEQ ID NO: 1681170 - RNA, 16 nt, Salmonella enterica enterica serovar Typhi
uccucaacucguuccc

SEQ ID NO: 1681171 - RNA, 16 nt, Salmonella enterica enterica serovar Typhi
uccuaauuuuuaaaga

SEQ ID NO: 1681172 - RNA, 23 nt, Salmonella enterica enterica serovar Typhi
uccuaccacgccgcuacugccgc

SEQ ID NO: 1681173 - RNA, 20 nt, Salmonella enterica enterica serovar Typhi
uccugauuaaguuuuuuuaa

SEQ ID NO: 1681174 - RNA, 15 nt, Salmonella enterica enterica serovar Typhi
uccugcaaaauaccg

SEQ ID NO: 1681175 - RNA, 14 nt, Salmonella enterica enterica serovar Typhi
uccugauuuuacug

SEQ ID NO: 1681176 - RNA, 19 nt, Salmonella enterica enterica serovar Typhi
uccugcaacagcaccagca

SEQ ID NO: 1681177 - RNA, 19 nt, Salmonella enterica enterica serovar Typhi
uccugauagcaaucauccu

SEQ ID NO: 1681178 - RNA, 22 nt, Salmonella enterica enterica serovar Typhi
uccugauauucccguuccagcu

SEQ ID NO: 1681179 - RNA, 17 nt, Salmonella enterica enterica serovar Typhi
uccugaucuucaaccuc

SEQ ID NO: 1681180 - RNA, 13 nt, Salmonella enterica enterica serovar Typhi
uccugauccggcu

SEQ ID NO: 1681181 - RNA, 17 nt, Salmonella enterica enterica serovar Typhi
uccugaugauggaaaac

SEQ ID NO: 1681182 - RNA, 12 nt, Salmonella enterica enterica serovar Typhi
uccugacgcuga

SEQ ID NO: 1681183 - RNA, 22 nt, Salmonella enterica enterica serovar Typhi
uccugaguaaagccugcccugc

SEQ ID NO: 1681184 - RNA, 13 nt, Salmonella enterica enterica serovar Typhi
uccugagcgaaug

SEQ ID NO: 1681185 - RNA, 13 nt, Salmonella enterica enterica serovar Typhi
uccucuuucccuu

SEQ ID NO: 1681186 - RNA, 14 nt, Salmonella enterica enterica serovar Typhi
uccucuuucaaccu

SEQ ID NO: 1681187 - RNA, 16 nt, Salmonella enterica enterica serovar Typhi
uccucuugucaggcag

SEQ ID NO: 1681188 - RNA, 14 nt, Salmonella enterica enterica serovar Typhi
uccugaaccagcgg

SEQ ID NO: 1681189 - RNA, 21 nt, Salmonella enterica enterica serovar Typhi
uccugaaccagcggcaccagc

SEQ ID NO: 1681190 - RNA, 19 nt, Salmonella enterica enterica serovar Typhi
uccugaaggacaagcugcg

SEQ ID NO: 1681191 - RNA, 22 nt, Salmonella enterica enterica serovar Typhi
uccugaagaugggucagugcau

SEQ ID NO: 1681192 - RNA, 21 nt, Salmonella enterica enterica serovar Typhi
uccugaaacccauaauaauga

SEQ ID NO: 1681193 - RNA, 15 nt, Salmonella enterica enterica serovar Typhi
uccucuuucccuuuu

SEQ ID NO: 1681194 - RNA, 16 nt, Salmonella enterica enterica serovar Typhi
uccugaaaaaauuccc

SEQ ID NO: 1681195 - RNA, 21 nt, Salmonella enterica enterica serovar Typhi
uccucuuuucgaacgccgaca

SEQ ID NO: 1681196 - RNA, 14 nt, Salmonella enterica enterica serovar Typhi
uccucgcauccucc

SEQ ID NO: 1681197 - RNA, 19 nt, Salmonella enterica enterica serovar Typhi
uccucgucgcgcgccgccu

SEQ ID NO: 1681198 - RNA, 19 nt, Salmonella enterica enterica serovar Typhi
uccuccggcguaaaggcuu

SEQ ID NO: 1681199 - RNA, 23 nt, Salmonella enterica enterica serovar Typhi
uccuccggcguaaaggcuuguuu

SEQ ID NO: 1681200 - RNA, 15 nt, Salmonella enterica enterica serovar Typhi
uccuccucauucagc

SEQ ID NO: 1681201 - RNA, 16 nt, Salmonella enterica enterica serovar Typhi
uccuccgguuucaacu

SEQ ID NO: 1681202 - RNA, 14 nt, Salmonella enterica enterica serovar Typhi
uccucauucagcgg

SEQ ID NO: 1681203 - RNA, 19 nt, Salmonella enterica enterica serovar Typhi
uccucauuuuguugcucca

SEQ ID NO: 1681204 - RNA, 16 nt, Salmonella enterica enterica serovar Typhi
uccucauacagcccgc

SEQ ID NO: 1681205 - RNA, 17 nt, Salmonella enterica enterica serovar Typhi
uccugcaccgccugcgg

SEQ ID NO: 1681206 - RNA, 18 nt, Salmonella enterica enterica serovar Typhi
uccugcagcgccagaaag

SEQ ID NO: 1681207 - RNA, 20 nt, Salmonella enterica enterica serovar Typhi
uccugcaggcgagugcuacc

SEQ ID NO: 1681208 - RNA, 23 nt, Salmonella enterica enterica serovar Typhi
uccugcaggguaauuagccccug

SEQ ID NO: 1681209 - RNA, 21 nt, Salmonella enterica enterica serovar Typhi
uccugccgcaaacgccugcuc

SEQ ID NO: 1681210 - RNA, 22 nt, Salmonella enterica enterica serovar Typhi
uccugccgacaggcagguugcc

SEQ ID NO: 1681211 - RNA, 17 nt, Salmonella enterica enterica serovar Typhi
uccugcaggcggcaaaa

SEQ ID NO: 1681212 - RNA, 15 nt, Salmonella enterica enterica serovar Typhi
uccugccagacccca

SEQ ID NO: 1681213 - RNA, 21 nt, Salmonella enterica enterica serovar Typhi
uccugccagauuuucuuuaau

SEQ ID NO: 1681214 - RNA, 12 nt, Salmonella enterica enterica serovar Typhi
uccugcuguggu

SEQ ID NO: 1681215 - RNA, 22 nt, Salmonella enterica enterica serovar Typhi
uccuggcugucggcagaaccug

SEQ ID NO: 1681216 - RNA, 16 nt, Salmonella enterica enterica serovar Typhi
uccuggcuugccagau

SEQ ID NO: 1681217 - RNA, 20 nt, Salmonella enterica enterica serovar Typhi
uccuggcguaugcuuucagc

SEQ ID NO: 1681218 - RNA, 20 nt, Salmonella enterica enterica serovar Typhi
uccuggcguuaucaucguaa

SEQ ID NO: 1681219 - RNA, 17 nt, Salmonella enterica enterica serovar Typhi
uccuucacaaacuucuc

SEQ ID NO: 1681220 - RNA, 22 nt, Salmonella enterica enterica serovar Typhi
uccuuaugggucacauccagac

SEQ ID NO: 1681221 - RNA, 16 nt, Salmonella enterica enterica serovar Typhi
uccuuaugaccgaguc

SEQ ID NO: 1681222 - RNA, 19 nt, Salmonella enterica enterica serovar Typhi
uccuguuuuuucagcgcgc

SEQ ID NO: 1681223 - RNA, 13 nt, Salmonella enterica enterica serovar Typhi
uccuuaaucagcu

SEQ ID NO: 1681224 - RNA, 15 nt, Salmonella enterica enterica serovar Typhi
uccuuaucacauuuu

SEQ ID NO: 1681225 - RNA, 13 nt, Salmonella enterica enterica serovar Typhi
uccuuaucagacu

SEQ ID NO: 1681226 - RNA, 22 nt, Salmonella enterica enterica serovar Typhi
uccugggcaaaauagcccggcu

SEQ ID NO: 1681227 - RNA, 20 nt, Salmonella enterica enterica serovar Typhi
uccugguaacggcacugcuu

SEQ ID NO: 1681228 - RNA, 18 nt, Salmonella enterica enterica serovar Typhi
uccugguccggcagguag

SEQ ID NO: 1681229 - RNA, 19 nt, Salmonella enterica enterica serovar Typhi
uccuguaaaaaauccagcg

SEQ ID NO: 1681230 - RNA, 13 nt, Salmonella enterica enterica serovar Typhi
uccugucccugcc

SEQ ID NO: 1681231 - RNA, 16 nt, Salmonella enterica enterica serovar Typhi
uccugugaaguaaaaa

SEQ ID NO: 1681232 - RNA, 14 nt, Salmonella enterica enterica serovar Typhi
uccugugucggcag

SEQ ID NO: 1681233 - RNA, 22 nt, Salmonella enterica enterica serovar Typhi
uccuguugaugauggcuccugu

SEQ ID NO: 1681234 - RNA, 20 nt, Salmonella enterica enterica serovar Typhi
uccuguuuaagcccggccuu

SEQ ID NO: 1681235 - RNA, 20 nt, Salmonella enterica enterica serovar Typhi
ucccacucuucaaccggcag

SEQ ID NO: 1681236 - RNA, 14 nt, Salmonella enterica enterica serovar Typhi
ucccacucuuccag

SEQ ID NO: 1681237 - RNA, 12 nt, Salmonella enterica enterica serovar Typhi
ucccagaagaaa

SEQ ID NO: 1681238 - RNA, 13 nt, Salmonella enterica enterica serovar Typhi
ucccagaaaauga

SEQ ID NO: 1681239 - RNA, 16 nt, Salmonella enterica enterica serovar Typhi
ucccacuuugcucacc

SEQ ID NO: 1681240 - RNA, 19 nt, Salmonella enterica enterica serovar Typhi
ucccagccuuccuggucug

SEQ ID NO: 1681241 - RNA, 23 nt, Salmonella enterica enterica serovar Typhi
ucccagccgggcaggaaaagcug

SEQ ID NO: 1681242 - RNA, 19 nt, Salmonella enterica enterica serovar Typhi
ucccagauuaaaucauccu

SEQ ID NO: 1681243 - RNA, 13 nt, Salmonella enterica enterica serovar Typhi
ucccagacaaaau

SEQ ID NO: 1681244 - RNA, 14 nt, Salmonella enterica enterica serovar Typhi
ucccagcugagcua

SEQ ID NO: 1681245 - RNA, 20 nt, Salmonella enterica enterica serovar Typhi
ucccagcgcgcgcgcaaagc

SEQ ID NO: 1681246 - RNA, 18 nt, Salmonella enterica enterica serovar Typhi
ucccagucauccgguuca

SEQ ID NO: 1681247 - RNA, 16 nt, Salmonella enterica enterica serovar Typhi
ucccauacugcccagc

SEQ ID NO: 1681248 - RNA, 13 nt, Salmonella enterica enterica serovar Typhi
ucccagugucaac

SEQ ID NO: 1681249 - RNA, 14 nt, Salmonella enterica enterica serovar Typhi
ucccauccgggcca

SEQ ID NO: 1681250 - RNA, 16 nt, Salmonella enterica enterica serovar Typhi
uccccaucccaaucag

SEQ ID NO: 1681251 - RNA, 15 nt, Salmonella enterica enterica serovar Typhi
uccccaucccagacc

SEQ ID NO: 1681252 - RNA, 13 nt, Salmonella enterica enterica serovar Typhi
uccccauaucccg

SEQ ID NO: 1681253 - RNA, 21 nt, Salmonella enterica enterica serovar Typhi
uccccauaaucgaccguaucc

SEQ ID NO: 1681254 - RNA, 12 nt, Salmonella enterica enterica serovar Typhi
uccccagcaccg

SEQ ID NO: 1681255 - RNA, 16 nt, Salmonella enterica enterica serovar Typhi
uccccagcaucauguc

SEQ ID NO: 1681256 - RNA, 16 nt, Salmonella enterica enterica serovar Typhi
uccccagccagagauc

SEQ ID NO: 1681257 - RNA, 18 nt, Salmonella enterica enterica serovar Typhi
uccccagcguaccacgcc

SEQ ID NO: 1681258 - RNA, 12 nt, Salmonella enterica enterica serovar Typhi
ucccccacuucu

SEQ ID NO: 1681259 - RNA, 16 nt, Salmonella enterica enterica serovar Typhi
uccccauuuuuuucag

SEQ ID NO: 1681260 - RNA, 21 nt, Salmonella enterica enterica serovar Typhi
ucccauuccugcaagaagcgu

SEQ ID NO: 1681261 - RNA, 19 nt, Salmonella enterica enterica serovar Typhi
ucccauugggccagcagcg

SEQ ID NO: 1681262 - RNA, 16 nt, Salmonella enterica enterica serovar Typhi
uccccaacagcgacca

SEQ ID NO: 1681263 - RNA, 21 nt, Salmonella enterica enterica serovar Typhi
uccccacgccgaccaccagcu

SEQ ID NO: 1681264 - RNA, 18 nt, Salmonella enterica enterica serovar Typhi
uccccaccgcugauggcg

SEQ ID NO: 1681265 - RNA, 15 nt, Salmonella enterica enterica serovar Typhi
uccccaccaccgcca

SEQ ID NO: 1681266 - RNA, 17 nt, Salmonella enterica enterica serovar Typhi
uccccaccaccgccacu

SEQ ID NO: 1681267 - RNA, 14 nt, Salmonella enterica enterica serovar Typhi
uccccaccaggaau

SEQ ID NO: 1681268 - RNA, 17 nt, Salmonella enterica enterica serovar Typhi
uccccacaaucccgcca

SEQ ID NO: 1681269 - RNA, 21 nt, Salmonella enterica enterica serovar Typhi
uccccggggugcagaacauca

SEQ ID NO: 1681270 - RNA, 17 nt, Salmonella enterica enterica serovar Typhi
uccccggcgaaagaaaa

SEQ ID NO: 1681271 - RNA, 17 nt, Salmonella enterica enterica serovar Typhi
uccccguuugcaguccg

SEQ ID NO: 1681272 - RNA, 16 nt, Salmonella enterica enterica serovar Typhi
uccccguuccaccgcc

SEQ ID NO: 1681273 - RNA, 14 nt, Salmonella enterica enterica serovar Typhi
uccccgccgcggcg

SEQ ID NO: 1681274 - RNA, 19 nt, Salmonella enterica enterica serovar Typhi
uccccgauucgcaugaauu

SEQ ID NO: 1681275 - RNA, 19 nt, Salmonella enterica enterica serovar Typhi
uccccgacggccucuucac

SEQ ID NO: 1681276 - RNA, 19 nt, Salmonella enterica enterica serovar Typhi
ucccccucuugccccacau

SEQ ID NO: 1681277 - RNA, 13 nt, Salmonella enterica enterica serovar Typhi
ucccgaacaugcc

SEQ ID NO: 1681278 - RNA, 21 nt, Salmonella enterica enterica serovar Typhi
ucccgaacugucugaaucagu

SEQ ID NO: 1681279 - RNA, 17 nt, Salmonella enterica enterica serovar Typhi
ucccgauacgguugcgc

SEQ ID NO: 1681280 - RNA, 12 nt, Salmonella enterica enterica serovar Typhi
uccccugcuccu

SEQ ID NO: 1681281 - RNA, 16 nt, Salmonella enterica enterica serovar Typhi
uccccucuuccaucag

SEQ ID NO: 1681282 - RNA, 21 nt, Salmonella enterica enterica serovar Typhi
uccccucuuccaucagccagg

SEQ ID NO: 1681283 - RNA, 15 nt, Salmonella enterica enterica serovar Typhi
uccccuucugguagc

SEQ ID NO: 1681284 - RNA, 13 nt, Salmonella enterica enterica serovar Typhi
ucccguuucagug

SEQ ID NO: 1681285 - RNA, 16 nt, Salmonella enterica enterica serovar Typhi
ucccguaucuucaugu

SEQ ID NO: 1681286 - RNA, 20 nt, Salmonella enterica enterica serovar Typhi
ucccguagcgucaacacgag

SEQ ID NO: 1681287 - RNA, 22 nt, Salmonella enterica enterica serovar Typhi
ucccgguuuaugcgguucuccc

SEQ ID NO: 1681288 - RNA, 14 nt, Salmonella enterica enterica serovar Typhi
ucccguaaaagaag

SEQ ID NO: 1681289 - RNA, 15 nt, Salmonella enterica enterica serovar Typhi
ucccguaaaagaaga

SEQ ID NO: 1681290 - RNA, 17 nt, Salmonella enterica enterica serovar Typhi
ucccguaaaagaagaaa

SEQ ID NO: 1681291 - RNA, 14 nt, Salmonella enterica enterica serovar Typhi
ucccggcagugcau

SEQ ID NO: 1681292 - RNA, 14 nt, Salmonella enterica enterica serovar Typhi
ucccggcauuauaa

SEQ ID NO: 1681293 - RNA, 17 nt, Salmonella enterica enterica serovar Typhi
ucccggcgauuaauaaa

SEQ ID NO: 1681294 - RNA, 22 nt, Salmonella enterica enterica serovar Typhi
ucccggcuuaaauuuuuaauaa

SEQ ID NO: 1681295 - RNA, 16 nt, Salmonella enterica enterica serovar Typhi
ucccgggcgauaaacc

SEQ ID NO: 1681296 - RNA, 17 nt, Salmonella enterica enterica serovar Typhi
ucccgcuggcuggcguu

SEQ ID NO: 1681297 - RNA, 21 nt, Salmonella enterica enterica serovar Typhi
ucccggaacagcggagcgaag

SEQ ID NO: 1681298 - RNA, 21 nt, Salmonella enterica enterica serovar Typhi
ucccgcguucgcgcaguucau

SEQ ID NO: 1681299 - RNA, 13 nt, Salmonella enterica enterica serovar Typhi
ucccgcgcggucg

SEQ ID NO: 1681300 - RNA, 16 nt, Salmonella enterica enterica serovar Typhi
ucccgcgcuucauccg

SEQ ID NO: 1681301 - RNA, 13 nt, Salmonella enterica enterica serovar Typhi
ucccgccagcugc

SEQ ID NO: 1681302 - RNA, 22 nt, Salmonella enterica enterica serovar Typhi
ucccgcacgcuggcaucaauau

SEQ ID NO: 1681303 - RNA, 11 nt, Salmonella enterica enterica serovar Typhi
ucccgccgcca

SEQ ID NO: 1681304 - RNA, 21 nt, Salmonella enterica enterica serovar Typhi
ucccgccgguucaauaaauca

SEQ ID NO: 1681305 - RNA, 13 nt, Salmonella enterica enterica serovar Typhi
ucccuaauaaaau

SEQ ID NO: 1681306 - RNA, 14 nt, Salmonella enterica enterica serovar Typhi
ucccucaccucccc

SEQ ID NO: 1681307 - RNA, 17 nt, Salmonella enterica enterica serovar Typhi
ucccucacgcgucacaa

SEQ ID NO: 1681308 - RNA, 23 nt, Salmonella enterica enterica serovar Typhi
ucccuauguaaagaaugaaaaaa

SEQ ID NO: 1681309 - RNA, 12 nt, Salmonella enterica enterica serovar Typhi
ucccucgccccg

SEQ ID NO: 1681310 - RNA, 14 nt, Salmonella enterica enterica serovar Typhi
ucccucuccagggc

SEQ ID NO: 1681311 - RNA, 16 nt, Salmonella enterica enterica serovar Typhi
ucccucugaaacgcuu

SEQ ID NO: 1681312 - RNA, 13 nt, Salmonella enterica enterica serovar Typhi
ucccugaagaaaa

SEQ ID NO: 1681313 - RNA, 13 nt, Salmonella enterica enterica serovar Typhi
ucccugacgcgca

SEQ ID NO: 1681314 - RNA, 17 nt, Salmonella enterica enterica serovar Typhi
ucccuggcgugucauca

SEQ ID NO: 1681315 - RNA, 17 nt, Salmonella enterica enterica serovar Typhi
ucccuggauaaaauauc

SEQ ID NO: 1681316 - RNA, 10 nt, Salmonella enterica enterica serovar Typhi
ucccuggccg

SEQ ID NO: 1681317 - RNA, 19 nt, Salmonella enterica enterica serovar Typhi
ucccugagucuugccuguc

SEQ ID NO: 1681318 - RNA, 15 nt, Salmonella enterica enterica serovar Typhi
ucccugcauucuuuc

SEQ ID NO: 1681319 - RNA, 21 nt, Salmonella enterica enterica serovar Typhi
ucccuuccgccaccagguuca

SEQ ID NO: 1681320 - RNA, 12 nt, Salmonella enterica enterica serovar Typhi
ucccuguucaaa

SEQ ID NO: 1681321 - RNA, 16 nt, Salmonella enterica enterica serovar Typhi
uccgacacgcacaucc

SEQ ID NO: 1681322 - RNA, 19 nt, Salmonella enterica enterica serovar Typhi
uccgaccacggccacagcc

SEQ ID NO: 1681323 - RNA, 21 nt, Salmonella enterica enterica serovar Typhi
uccgaauacggacauuuauuu

SEQ ID NO: 1681324 - RNA, 17 nt, Salmonella enterica enterica serovar Typhi
uccgaaacaaucaccug

SEQ ID NO: 1681325 - RNA, 18 nt, Salmonella enterica enterica serovar Typhi
uccgacugaccagacaga

SEQ ID NO: 1681326 - RNA, 23 nt, Salmonella enterica enterica serovar Typhi
uccgaggaacgugaguccuucaa

SEQ ID NO: 1681327 - RNA, 21 nt, Salmonella enterica enterica serovar Typhi
uccgacguuugcguaaagcug

SEQ ID NO: 1681328 - RNA, 20 nt, Salmonella enterica enterica serovar Typhi
aaaucuggugauaaagcaga

SEQ ID NO: 1681329 - RNA, 20 nt, Salmonella enterica enterica serovar Typhi
aaaucugccgucaucgacuu

SEQ ID NO: 1681330 - RNA, 16 nt, Salmonella enterica enterica serovar Typhi
uccgccugcugugccg

SEQ ID NO: 1681331 - RNA, 17 nt, Salmonella enterica enterica serovar Typhi
uccgccuggaacccagg

SEQ ID NO: 1681332 - RNA, 22 nt, Salmonella enterica enterica serovar Typhi
uccgccuggaacccaggcaccu

SEQ ID NO: 1681333 - RNA, 19 nt, Salmonella enterica enterica serovar Typhi
uccgccuuaucaggccugu

SEQ ID NO: 1681334 - RNA, 18 nt, Salmonella enterica enterica serovar Typhi
uccgcccaagaacaugac

SEQ ID NO: 1681335 - RNA, 19 nt, Salmonella enterica enterica serovar Typhi
uccgcccaguaccagcacu

SEQ ID NO: 1681336 - RNA, 17 nt, Salmonella enterica enterica serovar Typhi
uccgcccaagaacauga

SEQ ID NO: 1681337 - RNA, 23 nt, Salmonella enterica enterica serovar Typhi
uccgcgauaucaaucaccucuuc

SEQ ID NO: 1681338 - RNA, 14 nt, Salmonella enterica enterica serovar Typhi
uccgcggcaaaccc

SEQ ID NO: 1681339 - RNA, 12 nt, Salmonella enterica enterica serovar Typhi
uccgcgccgccg

SEQ ID NO: 1681340 - RNA, 17 nt, Salmonella enterica enterica serovar Typhi
uccgcgccgagugcuug

SEQ ID NO: 1681341 - RNA, 15 nt, Salmonella enterica enterica serovar Typhi
uccgcuccacauccu

SEQ ID NO: 1681342 - RNA, 17 nt, Salmonella enterica enterica serovar Typhi
uccgcuagggcaucaga

SEQ ID NO: 1681343 - RNA, 19 nt, Salmonella enterica enterica serovar Typhi
uccgaggcguaucccagua

SEQ ID NO: 1681344 - RNA, 23 nt, Salmonella enterica enterica serovar Typhi
uccgaggcguaucccaguaaaua

SEQ ID NO: 1681345 - RNA, 19 nt, Salmonella enterica enterica serovar Typhi
uccgauuucaugcgcagca

SEQ ID NO: 1681346 - RNA, 11 nt, Salmonella enterica enterica serovar Typhi
uccgcaacaag

SEQ ID NO: 1681347 - RNA, 12 nt, Salmonella enterica enterica serovar Typhi
uccgcaaagugg

SEQ ID NO: 1681348 - RNA, 11 nt, Salmonella enterica enterica serovar Typhi
uccgcaauaag

SEQ ID NO: 1681349 - RNA, 13 nt, Salmonella enterica enterica serovar Typhi
uccgcaauaagug

SEQ ID NO: 1681350 - RNA, 19 nt, Salmonella enterica enterica serovar Typhi
uccgcaacugaaaccaggc

SEQ ID NO: 1681351 - RNA, 16 nt, Salmonella enterica enterica serovar Typhi
uccgcaauaagugcau

SEQ ID NO: 1681352 - RNA, 22 nt, Salmonella enterica enterica serovar Typhi
uccgcaaagacaacgaccagug

SEQ ID NO: 1681353 - RNA, 23 nt, Salmonella enterica enterica serovar Typhi
uccgcaaagcccaucagcgccag

SEQ ID NO: 1681354 - RNA, 15 nt, Salmonella enterica enterica serovar Typhi
uccgcaauccuggcu

SEQ ID NO: 1681355 - RNA, 21 nt, Salmonella enterica enterica serovar Typhi
uccgcaggcgacgugacggug

SEQ ID NO: 1681356 - RNA, 22 nt, Salmonella enterica enterica serovar Typhi
uccgcaggggauucugccaucg

SEQ ID NO: 1681357 - RNA, 20 nt, Salmonella enterica enterica serovar Typhi
uccgcagccagaaucagccg

SEQ ID NO: 1681358 - RNA, 21 nt, Salmonella enterica enterica serovar Typhi
uccgcacgccugcauaaagga

SEQ ID NO: 1681359 - RNA, 16 nt, Salmonella enterica enterica serovar Typhi
uccgcacgcgcgcccu

SEQ ID NO: 1681360 - RNA, 18 nt, Salmonella enterica enterica serovar Typhi
uccgccagcaaugccgcc

SEQ ID NO: 1681361 - RNA, 15 nt, Salmonella enterica enterica serovar Typhi
uccgccagcaacacu

SEQ ID NO: 1681362 - RNA, 19 nt, Salmonella enterica enterica serovar Typhi
uccgccagacucagccagg

SEQ ID NO: 1681363 - RNA, 12 nt, Salmonella enterica enterica serovar Typhi
uccgccacggcu

SEQ ID NO: 1681364 - RNA, 18 nt, Salmonella enterica enterica serovar Typhi
uccgccacggcuuucacg

SEQ ID NO: 1681365 - RNA, 13 nt, Salmonella enterica enterica serovar Typhi
uccgccagcgccu

SEQ ID NO: 1681366 - RNA, 20 nt, Salmonella enterica enterica serovar Typhi
uccgccauaacggcugucca

SEQ ID NO: 1681367 - RNA, 15 nt, Salmonella enterica enterica serovar Typhi
uccgccaugguuggg

SEQ ID NO: 1681368 - RNA, 19 nt, Salmonella enterica enterica serovar Typhi
uccaucgggcucggcgcuu

SEQ ID NO: 1681369 - RNA, 15 nt, Salmonella enterica enterica serovar Typhi
uccaucgguucucug

SEQ ID NO: 1681370 - RNA, 17 nt, Salmonella enterica enterica serovar Typhi
uccaucgguucucugcc

SEQ ID NO: 1681371 - RNA, 18 nt, Salmonella enterica enterica serovar Typhi
uccaucacgguaaaccug

SEQ ID NO: 1681372 - RNA, 19 nt, Salmonella enterica enterica serovar Typhi
uccaucacgguaaaccugu

SEQ ID NO: 1681373 - RNA, 13 nt, Salmonella enterica enterica serovar Typhi
uccaucacuccuu

SEQ ID NO: 1681374 - RNA, 14 nt, Salmonella enterica enterica serovar Typhi
uccaucagccaggc

SEQ ID NO: 1681375 - RNA, 13 nt, Salmonella enterica enterica serovar Typhi
uccaucagcgcgg

SEQ ID NO: 1681376 - RNA, 14 nt, Salmonella enterica enterica serovar Typhi
uccaucgaauaaag

SEQ ID NO: 1681377 - RNA, 16 nt, Salmonella enterica enterica serovar Typhi
uccaugucuugcuauc

SEQ ID NO: 1681378 - RNA, 20 nt, Salmonella enterica enterica serovar Typhi
uccauggucucuuuuuuagg

SEQ ID NO: 1681379 - RNA, 19 nt, Salmonella enterica enterica serovar Typhi
uccauuacucucauguuca

SEQ ID NO: 1681380 - RNA, 16 nt, Salmonella enterica enterica serovar Typhi
uccauuagcgccugau

SEQ ID NO: 1681381 - RNA, 20 nt, Salmonella enterica enterica serovar Typhi
uccauuaaauuacuuguuga

SEQ ID NO: 1681382 - RNA, 13 nt, Salmonella enterica enterica serovar Typhi
uccaugcuucgau

SEQ ID NO: 1681383 - RNA, 13 nt, Salmonella enterica enterica serovar Typhi
uccaugcccacac

SEQ ID NO: 1681384 - RNA, 13 nt, Salmonella enterica enterica serovar Typhi
uccaugccagcgc

SEQ ID NO: 1681385 - RNA, 15 nt, Salmonella enterica enterica serovar Typhi
uccaugagaagaaaa

SEQ ID NO: 1681386 - RNA, 17 nt, Salmonella enterica enterica serovar Typhi
uccaugagaagaaaaag

SEQ ID NO: 1681387 - RNA, 22 nt, Salmonella enterica enterica serovar Typhi
uccaugcgauacguaggccuga

SEQ ID NO: 1681388 - RNA, 13 nt, Salmonella enterica enterica serovar Typhi
uccauucccagcu

SEQ ID NO: 1681389 - RNA, 20 nt, Salmonella enterica enterica serovar Typhi
uccauucacacaauuuucuu

SEQ ID NO: 1681390 - RNA, 16 nt, Salmonella enterica enterica serovar Typhi
uccauuccagaacgaa

SEQ ID NO: 1681391 - RNA, 18 nt, Salmonella enterica enterica serovar Typhi
uccauugcgagaaaaaac

SEQ ID NO: 1681392 - RNA, 16 nt, Salmonella enterica enterica serovar Typhi
ucccaauaccggcgua

SEQ ID NO: 1681393 - RNA, 18 nt, Salmonella enterica enterica serovar Typhi
ucccaacaaugccacgcc

SEQ ID NO: 1681394 - RNA, 18 nt, Salmonella enterica enterica serovar Typhi
ucccaacccgaccaggac

SEQ ID NO: 1681395 - RNA, 13 nt, Salmonella enterica enterica serovar Typhi
ucccaauucgugu

SEQ ID NO: 1681396 - RNA, 14 nt, Salmonella enterica enterica serovar Typhi
ucccacgacauguu

SEQ ID NO: 1681397 - RNA, 21 nt, Salmonella enterica enterica serovar Typhi
ucccacauacggcugaaaaau

SEQ ID NO: 1681398 - RNA, 17 nt, Salmonella enterica enterica serovar Typhi
uccacuuucagcggcuu

SEQ ID NO: 1681399 - RNA, 17 nt, Salmonella enterica enterica serovar Typhi
uccacuuucucggcuuu

SEQ ID NO: 1681400 - RNA, 21 nt, Salmonella enterica enterica serovar Typhi
uccacuuucucggcuuuccag

SEQ ID NO: 1681401 - RNA, 23 nt, Salmonella enterica enterica serovar Typhi
uccacuuucucggcuuuccagcu

SEQ ID NO: 1681402 - RNA, 12 nt, Salmonella enterica enterica serovar Typhi
uccagaagaucu

SEQ ID NO: 1681403 - RNA, 24 nt, Salmonella enterica enterica serovar Typhi
uccagaacgaauuuacucgccaau

SEQ ID NO: 1681404 - RNA, 20 nt, Salmonella enterica enterica serovar Typhi
uccagcagguggaucugaau

SEQ ID NO: 1681405 - RNA, 17 nt, Salmonella enterica enterica serovar Typhi
uccagaauacgaauauu

SEQ ID NO: 1681406 - RNA, 12 nt, Salmonella enterica enterica serovar Typhi
uccagccaaagu

SEQ ID NO: 1681407 - RNA, 12 nt, Salmonella enterica enterica serovar Typhi
uccagcaguguc

SEQ ID NO: 1681408 - RNA, 22 nt, Salmonella enterica enterica serovar Typhi
uccagcgcauggaagaaaauau

SEQ ID NO: 1681409 - RNA, 16 nt, Salmonella enterica enterica serovar Typhi
uccagcgccagcucca

SEQ ID NO: 1681410 - RNA, 22 nt, Salmonella enterica enterica serovar Typhi
uccagcgccugcuguaaaauau

SEQ ID NO: 1681411 - RNA, 23 nt, Salmonella enterica enterica serovar Typhi
uccaggccaagcgccuguucaac

SEQ ID NO: 1681412 - RNA, 15 nt, Salmonella enterica enterica serovar Typhi
uccagcgucgggccg

SEQ ID NO: 1681413 - RNA, 16 nt, Salmonella enterica enterica serovar Typhi
uccagcgucgggccgc

SEQ ID NO: 1681414 - RNA, 20 nt, Salmonella enterica enterica serovar Typhi
uccagcggcaggauccccau

SEQ ID NO: 1681415 - RNA, 12 nt, Salmonella enterica enterica serovar Typhi
uccagcggcgcg

SEQ ID NO: 1681416 - RNA, 14 nt, Salmonella enterica enterica serovar Typhi
uccagucgcuccac

SEQ ID NO: 1681417 - RNA, 12 nt, Salmonella enterica enterica serovar Typhi
uccagucccuga

SEQ ID NO: 1681418 - RNA, 21 nt, Salmonella enterica enterica serovar Typhi
uccaguaaaaucggaccuccg

SEQ ID NO: 1681419 - RNA, 15 nt, Salmonella enterica enterica serovar Typhi
uccagugcagaaagu

SEQ ID NO: 1681420 - RNA, 17 nt, Salmonella enterica enterica serovar Typhi
uccagguaacauacaaa

SEQ ID NO: 1681421 - RNA, 21 nt, Salmonella enterica enterica serovar Typhi
uccaggccgucggcgccagcc

SEQ ID NO: 1681422 - RNA, 23 nt, Salmonella enterica enterica serovar Typhi
uccagguugugguuaaacacauc

SEQ ID NO: 1681423 - RNA, 20 nt, Salmonella enterica enterica serovar Typhi
uccagguucaucacuuucac

SEQ ID NO: 1681424 - RNA, 22 nt, Salmonella enterica enterica serovar Typhi
uccauauaaucaaacccuuccg

SEQ ID NO: 1681425 - RNA, 14 nt, Salmonella enterica enterica serovar Typhi
uccaguugcauaca

SEQ ID NO: 1681426 - RNA, 16 nt, Salmonella enterica enterica serovar Typhi
uccaguugcauacaua

SEQ ID NO: 1681427 - RNA, 17 nt, Salmonella enterica enterica serovar Typhi
uccaguugcccucuuua

SEQ ID NO: 1681428 - RNA, 16 nt, Salmonella enterica enterica serovar Typhi
uccaguugcuuaccuu

SEQ ID NO: 1681429 - RNA, 19 nt, Salmonella enterica enterica serovar Typhi
uccaguugcggcaucagau

SEQ ID NO: 1681430 - RNA, 13 nt, Salmonella enterica enterica serovar Typhi
uccaguucgagcc

SEQ ID NO: 1681431 - RNA, 21 nt, Salmonella enterica enterica serovar Typhi
uccaguucauaagucauccag

SEQ ID NO: 1681432 - RNA, 22 nt, Salmonella enterica enterica serovar Typhi
uccaguucaucuacacgcacuu

SEQ ID NO: 1681433 - RNA, 20 nt, Salmonella enterica enterica serovar Typhi
uccaauauuuauuuaauguu

SEQ ID NO: 1681434 - RNA, 20 nt, Salmonella enterica enterica serovar Typhi
uccaauagacuucacuuucc

SEQ ID NO: 1681435 - RNA, 20 nt, Salmonella enterica enterica serovar Typhi
uccaauagagcaguuaauaa

SEQ ID NO: 1681436 - RNA, 23 nt, Salmonella enterica enterica serovar Typhi
uccaauagagcaguuaauaauga

SEQ ID NO: 1681437 - RNA, 15 nt, Salmonella enterica enterica serovar Typhi
uccaauagacuucac

SEQ ID NO: 1681438 - RNA, 19 nt, Salmonella enterica enterica serovar Typhi
uccaauaacguaaccgcuu

SEQ ID NO: 1681439 - RNA, 18 nt, Salmonella enterica enterica serovar Typhi
uccaacuguuaucauaga

SEQ ID NO: 1681440 - RNA, 15 nt, Salmonella enterica enterica serovar Typhi
uccacagauagucgc

SEQ ID NO: 1681441 - RNA, 17 nt, Salmonella enterica enterica serovar Typhi
uccaccaggcaugcagc

SEQ ID NO: 1681442 - RNA, 16 nt, Salmonella enterica enterica serovar Typhi
uccaccagcuuaucug

SEQ ID NO: 1681443 - RNA, 18 nt, Salmonella enterica enterica serovar Typhi
uccaccagcuuaucugac

SEQ ID NO: 1681444 - RNA, 14 nt, Salmonella enterica enterica serovar Typhi
uccacccaguucau

SEQ ID NO: 1681445 - RNA, 20 nt, Salmonella enterica enterica serovar Typhi
uccacacguccauccgggua

SEQ ID NO: 1681446 - RNA, 14 nt, Salmonella enterica enterica serovar Typhi
uccacuucagcagc

SEQ ID NO: 1681447 - RNA, 16 nt, Salmonella enterica enterica serovar Typhi
uccacguuuuacuucc

SEQ ID NO: 1681448 - RNA, 17 nt, Salmonella enterica enterica serovar Typhi
uccacgucgcacgccau

SEQ ID NO: 1681449 - RNA, 22 nt, Salmonella enterica enterica serovar Typhi
uccacgguaaaacacgccucca

SEQ ID NO: 1681450 - RNA, 17 nt, Salmonella enterica enterica serovar Typhi
uccacgguucucaccgu

SEQ ID NO: 1681451 - RNA, 21 nt, Salmonella enterica enterica serovar Typhi
uccacggcgcuccugucaggc

SEQ ID NO: 1681452 - RNA, 17 nt, Salmonella enterica enterica serovar Typhi
ucauugccguaaauuga

SEQ ID NO: 1681453 - RNA, 18 nt, Salmonella enterica enterica serovar Typhi
ucauugcgaucuccuuua

SEQ ID NO: 1681454 - RNA, 19 nt, Salmonella enterica enterica serovar Typhi
ucauugucggaacgcugua

SEQ ID NO: 1681455 - RNA, 13 nt, Salmonella enterica enterica serovar Typhi
ucauuucugccug

SEQ ID NO: 1681456 - RNA, 13 nt, Salmonella enterica enterica serovar Typhi
ucauuucuuuaau

SEQ ID NO: 1681457 - RNA, 23 nt, Salmonella enterica enterica serovar Typhi
ucauuugcgagaaaaaguguccg

SEQ ID NO: 1681458 - RNA, 16 nt, Salmonella enterica enterica serovar Typhi
uccaacagaaggcuuc

SEQ ID NO: 1681459 - RNA, 20 nt, Salmonella enterica enterica serovar Typhi
ucauuuuguugcuccagcau

SEQ ID NO: 1681460 - RNA, 13 nt, Salmonella enterica enterica serovar Typhi
ucauuagcgcggu

SEQ ID NO: 1681461 - RNA, 17 nt, Salmonella enterica enterica serovar Typhi
ucauucagaucaaaaau

SEQ ID NO: 1681462 - RNA, 20 nt, Salmonella enterica enterica serovar Typhi
ucauugaggcgcgaaaaaua

SEQ ID NO: 1681463 - RNA, 18 nt, Salmonella enterica enterica serovar Typhi
ucauugaguuugcaaucc

SEQ ID NO: 1681464 - RNA, 14 nt, Salmonella enterica enterica serovar Typhi
ucauugaccggaaa

SEQ ID NO: 1681465 - RNA, 18 nt, Salmonella enterica enterica serovar Typhi
ucauugacccgaucgcua

SEQ ID NO: 1681466 - RNA, 20 nt, Salmonella enterica enterica serovar Typhi
ucauugacccucccugcgcu

SEQ ID NO: 1681467 - RNA, 24 nt, Salmonella enterica enterica serovar Typhi
ucauuccgaggguggacaugauaa

SEQ ID NO: 1681468 - RNA, 23 nt, Salmonella enterica enterica serovar Typhi
ucauguuauaagcgcgcagguag

SEQ ID NO: 1681469 - RNA, 19 nt, Salmonella enterica enterica serovar Typhi
ucauguugcggguuucuga

SEQ ID NO: 1681470 - RNA, 19 nt, Salmonella enterica enterica serovar Typhi
ucaugugcagcauccagcu

SEQ ID NO: 1681471 - RNA, 12 nt, Salmonella enterica enterica serovar Typhi
ucauuaaaaugc

SEQ ID NO: 1681472 - RNA, 14 nt, Salmonella enterica enterica serovar Typhi
ucauuaaaauugaa

SEQ ID NO: 1681473 - RNA, 13 nt, Salmonella enterica enterica serovar Typhi
ucauuaaaaaacc

SEQ ID NO: 1681474 - RNA, 21 nt, Salmonella enterica enterica serovar Typhi
ucaguguuuccauacauuuuu

SEQ ID NO: 1681475 - RNA, 14 nt, Salmonella enterica enterica serovar Typhi
ucaguugguuagaa

SEQ ID NO: 1681476 - RNA, 21 nt, Salmonella enterica enterica serovar Typhi
ugaugaugcguuuguuggaga

SEQ ID NO: 1681477 - RNA, 16 nt, Salmonella enterica enterica serovar Typhi
ugaugauggaacagac

SEQ ID NO: 1681478 - RNA, 20 nt, Salmonella enterica enterica serovar Typhi
ugaugauacccccagagauu

SEQ ID NO: 1681479 - RNA, 20 nt, Salmonella enterica enterica serovar Typhi
ugauuuaaaaaaggccgcuu

SEQ ID NO: 1681480 - RNA, 12 nt, Salmonella enterica enterica serovar Typhi
ugauuuaaaaaa

SEQ ID NO: 1681481 - RNA, 16 nt, Salmonella enterica enterica serovar Typhi
ugauuuuacuaaugaa

SEQ ID NO: 1681482 - RNA, 21 nt, Salmonella enterica enterica serovar Typhi
ugauuuuaacaucaccuuuca

SEQ ID NO: 1681483 - RNA, 14 nt, Salmonella enterica enterica serovar Typhi
ugauuuacuccaaa

SEQ ID NO: 1681484 - RNA, 23 nt, Salmonella enterica enterica serovar Typhi
ugauugccgccaucuuuacccug

SEQ ID NO: 1681485 - RNA, 22 nt, Salmonella enterica enterica serovar Typhi
ugauugcauaucgcuaaaccaa

SEQ ID NO: 1681486 - RNA, 13 nt, Salmonella enterica enterica serovar Typhi
ugcaaaagaaaaa

SEQ ID NO: 1681487 - RNA, 16 nt, Salmonella enterica enterica serovar Typhi
ugcaaaauuuguggug

SEQ ID NO: 1681488 - RNA, 16 nt, Salmonella enterica enterica serovar Typhi
ugcaaacgcggcgcca

SEQ ID NO: 1681489 - RNA, 20 nt, Salmonella enterica enterica serovar Typhi
ugcaaaccggguaacaacau

SEQ ID NO: 1681490 - RNA, 21 nt, Salmonella enterica enterica serovar Typhi
ugcaaaccggguaacaacauu

SEQ ID NO: 1681491 - RNA, 15 nt, Salmonella enterica enterica serovar Typhi
ugcaaauacugcuuu

SEQ ID NO: 1681492 - RNA, 14 nt, Salmonella enterica enterica serovar Typhi
ugcaaaucaccaca

SEQ ID NO: 1681493 - RNA, 11 nt, Salmonella enterica enterica serovar Typhi
ugcaaauacca

SEQ ID NO: 1681494 - RNA, 17 nt, Salmonella enterica enterica serovar Typhi
ugcaaagaagggcaggg

SEQ ID NO: 1681495 - RNA, 13 nt, Salmonella enterica enterica serovar Typhi
ugauuuucuuauu

SEQ ID NO: 1681496 - RNA, 11 nt, Salmonella enterica enterica serovar Typhi
ugauuuuauga

SEQ ID NO: 1681497 - RNA, 12 nt, Salmonella enterica enterica serovar Typhi
ugcaaucagauu

SEQ ID NO: 1681498 - RNA, 23 nt, Salmonella enterica enterica serovar Typhi
ugcaaucagcgaaggcaacugau

SEQ ID NO: 1681499 - RNA, 15 nt, Salmonella enterica enterica serovar Typhi
ugcaaucacacuaca

SEQ ID NO: 1681500 - RNA, 18 nt, Salmonella enterica enterica serovar Typhi
ugcaauaucccucgaagu

SEQ ID NO: 1681501 - RNA, 20 nt, Salmonella enterica enterica serovar Typhi
ugcaauaccgggauuguaua

SEQ ID NO: 1681502 - RNA, 17 nt, Salmonella enterica enterica serovar Typhi
ugcaauacuacgcaccg

SEQ ID NO: 1681503 - RNA, 17 nt, Salmonella enterica enterica serovar Typhi
ugcaauaccggcugcuu

SEQ ID NO: 1681504 - RNA, 19 nt, Salmonella enterica enterica serovar Typhi
ugcaaguugcaagucacca

SEQ ID NO: 1681505 - RNA, 22 nt, Salmonella enterica enterica serovar Typhi
ugcaauguucaauaucaaauug

SEQ ID NO: 1681506 - RNA, 15 nt, Salmonella enterica enterica serovar Typhi
ugcaauguucaauau

SEQ ID NO: 1681507 - RNA, 21 nt, Salmonella enterica enterica serovar Typhi
ugcaauguucaauaucaaauu

SEQ ID NO: 1681508 - RNA, 17 nt, Salmonella enterica enterica serovar Typhi
ugcaauuccggcgaaaa

SEQ ID NO: 1681509 - RNA, 19 nt, Salmonella enterica enterica serovar Typhi
ugcaauuccggcgaaaaac

SEQ ID NO: 1681510 - RNA, 15 nt, Salmonella enterica enterica serovar Typhi
ugcacaaaauacugu

SEQ ID NO: 1681511 - RNA, 13 nt, Salmonella enterica enterica serovar Typhi
ugcacaaaauacu

SEQ ID NO: 1681512 - RNA, 17 nt, Salmonella enterica enterica serovar Typhi
ugcaacgccagaugcgu

SEQ ID NO: 1681513 - RNA, 18 nt, Salmonella enterica enterica serovar Typhi
ugcaacgccgaugcuuuu

SEQ ID NO: 1681514 - RNA, 15 nt, Salmonella enterica enterica serovar Typhi
ugcaacuccacaaau

SEQ ID NO: 1681515 - RNA, 17 nt, Salmonella enterica enterica serovar Typhi
ugcaacuccugggcaaa

SEQ ID NO: 1681516 - RNA, 19 nt, Salmonella enterica enterica serovar Typhi
ugcaacuucaccuucggug

SEQ ID NO: 1681517 - RNA, 16 nt, Salmonella enterica enterica serovar Typhi
ugcaaaucugccguca

SEQ ID NO: 1681518 - RNA, 13 nt, Salmonella enterica enterica serovar Typhi
ugcaacagcacca

SEQ ID NO: 1681519 - RNA, 21 nt, Salmonella enterica enterica serovar Typhi
ugcaacagaagaguuaacuuc

SEQ ID NO: 1681520 - RNA, 22 nt, Salmonella enterica enterica serovar Typhi
ugcaacagaagaguuaacuucu

SEQ ID NO: 1681521 - RNA, 15 nt, Salmonella enterica enterica serovar Typhi
ugcaacagcaccagc

SEQ ID NO: 1681522 - RNA, 19 nt, Salmonella enterica enterica serovar Typhi
ugcaacagcaccagcaggu

SEQ ID NO: 1681523 - RNA, 17 nt, Salmonella enterica enterica serovar Typhi
ugcaaccgcucuuuugc

SEQ ID NO: 1681524 - RNA, 14 nt, Salmonella enterica enterica serovar Typhi
ugcaaccccuugcg

SEQ ID NO: 1681525 - RNA, 19 nt, Salmonella enterica enterica serovar Typhi
ugcaaccccuugcggugca

SEQ ID NO: 1681526 - RNA, 15 nt, Salmonella enterica enterica serovar Typhi
ugcaacauuccuugc

SEQ ID NO: 1681527 - RNA, 20 nt, Salmonella enterica enterica serovar Typhi
ugcaacauugcaggucugga

SEQ ID NO: 1681528 - RNA, 23 nt, Salmonella enterica enterica serovar Typhi
ugcagcaacugauucaaaaggug

SEQ ID NO: 1681529 - RNA, 24 nt, Salmonella enterica enterica serovar Typhi
ugcagcaagcggcugucaucaaug

SEQ ID NO: 1681530 - RNA, 14 nt, Salmonella enterica enterica serovar Typhi
ugcagcguuuccag

SEQ ID NO: 1681531 - RNA, 15 nt, Salmonella enterica enterica serovar Typhi
ugcagcguuuccagc

SEQ ID NO: 1681532 - RNA, 16 nt, Salmonella enterica enterica serovar Typhi
ugcagcguuuccagcc

SEQ ID NO: 1681533 - RNA, 21 nt, Salmonella enterica enterica serovar Typhi
ugcagcggcaguuccggcguu

SEQ ID NO: 1681534 - RNA, 17 nt, Salmonella enterica enterica serovar Typhi
ugcacugacuuacaggc

SEQ ID NO: 1681535 - RNA, 21 nt, Salmonella enterica enterica serovar Typhi
ugcacugcgcccauuauugau

SEQ ID NO: 1681536 - RNA, 15 nt, Salmonella enterica enterica serovar Typhi
ugcacugcugauagu

SEQ ID NO: 1681537 - RNA, 13 nt, Salmonella enterica enterica serovar Typhi
ugcacuuccugcg

SEQ ID NO: 1681538 - RNA, 14 nt, Salmonella enterica enterica serovar Typhi
ugcagaugcucagg

SEQ ID NO: 1681539 - RNA, 18 nt, Salmonella enterica enterica serovar Typhi
ugcagauuacugagcagu

SEQ ID NO: 1681540 - RNA, 13 nt, Salmonella enterica enterica serovar Typhi
ugcagauuuugcu

SEQ ID NO: 1681541 - RNA, 20 nt, Salmonella enterica enterica serovar Typhi
ugcagaucgcgggcaaucaa

SEQ ID NO: 1681542 - RNA, 20 nt, Salmonella enterica enterica serovar Typhi
ugcaccaggugaaugaggug

SEQ ID NO: 1681543 - RNA, 16 nt, Salmonella enterica enterica serovar Typhi
ugcaccaucucuuacu

SEQ ID NO: 1681544 - RNA, 17 nt, Salmonella enterica enterica serovar Typhi
ugcaccgcuaaaaaaca

SEQ ID NO: 1681545 - RNA, 12 nt, Salmonella enterica enterica serovar Typhi
ugcaccucuuua

SEQ ID NO: 1681546 - RNA, 18 nt, Salmonella enterica enterica serovar Typhi
ugcaccucagaccguuag

SEQ ID NO: 1681547 - RNA, 23 nt, Salmonella enterica enterica serovar Typhi
ugcacgucgcgcucgcucaucac

SEQ ID NO: 1681548 - RNA, 22 nt, Salmonella enterica enterica serovar Typhi
ugcacgucgagacgguguuuag

SEQ ID NO: 1681549 - RNA, 22 nt, Salmonella enterica enterica serovar Typhi
ugcacaagaaacauguuguguc

SEQ ID NO: 1681550 - RNA, 22 nt, Salmonella enterica enterica serovar Typhi
ugcacaacauuccgcuuccaga

SEQ ID NO: 1681551 - RNA, 16 nt, Salmonella enterica enterica serovar Typhi
ugcacaauaccaauaa

SEQ ID NO: 1681552 - RNA, 16 nt, Salmonella enterica enterica serovar Typhi
ugcacaaucgccagcc

SEQ ID NO: 1681553 - RNA, 17 nt, Salmonella enterica enterica serovar Typhi
ugcacauugcaggcuuu

SEQ ID NO: 1681554 - RNA, 19 nt, Salmonella enterica enterica serovar Typhi
ugcacauguuucagcaccu

SEQ ID NO: 1681555 - RNA, 19 nt, Salmonella enterica enterica serovar Typhi
ugcacauuagcaauugcca

SEQ ID NO: 1681556 - RNA, 19 nt, Salmonella enterica enterica serovar Typhi
ugcacauaacgugccaucu

SEQ ID NO: 1681557 - RNA, 13 nt, Salmonella enterica enterica serovar Typhi
ugcacagucugca

SEQ ID NO: 1681558 - RNA, 18 nt, Salmonella enterica enterica serovar Typhi
ugcacagucugcagaccu

SEQ ID NO: 1681559 - RNA, 13 nt, Salmonella enterica enterica serovar Typhi
ugcauaaaaaaac

SEQ ID NO: 1681560 - RNA, 14 nt, Salmonella enterica enterica serovar Typhi
ugcauaaaaaaacg

SEQ ID NO: 1681561 - RNA, 15 nt, Salmonella enterica enterica serovar Typhi
ugcaguucaaaaggu

SEQ ID NO: 1681562 - RNA, 19 nt, Salmonella enterica enterica serovar Typhi
ugcauaaagauuggcaucu

SEQ ID NO: 1681563 - RNA, 23 nt, Salmonella enterica enterica serovar Typhi
ugcauaaucgccgacuaauuauu

SEQ ID NO: 1681564 - RNA, 23 nt, Salmonella enterica enterica serovar Typhi
ugcaucagaacaaacuuauccca

SEQ ID NO: 1681565 - RNA, 15 nt, Salmonella enterica enterica serovar Typhi
ugcauagccccagcg

SEQ ID NO: 1681566 - RNA, 19 nt, Salmonella enterica enterica serovar Typhi
ugcauacucacauucauaa

SEQ ID NO: 1681567 - RNA, 22 nt, Salmonella enterica enterica serovar Typhi
ugcauacucacauucauaaaag

SEQ ID NO: 1681568 - RNA, 13 nt, Salmonella enterica enterica serovar Typhi
ugcauacauaaau

SEQ ID NO: 1681569 - RNA, 15 nt, Salmonella enterica enterica serovar Typhi
ugcauaauugcugac

SEQ ID NO: 1681570 - RNA, 15 nt, Salmonella enterica enterica serovar Typhi
ugcauacggaugaaa

SEQ ID NO: 1681571 - RNA, 17 nt, Salmonella enterica enterica serovar Typhi
ugcagugacagaggaau

SEQ ID NO: 1681572 - RNA, 19 nt, Salmonella enterica enterica serovar Typhi
ugcaguacaggcauuguca

SEQ ID NO: 1681573 - RNA, 17 nt, Salmonella enterica enterica serovar Typhi
ugcagucgguagcuuuu

SEQ ID NO: 1681574 - RNA, 19 nt, Salmonella enterica enterica serovar Typhi
ugcaguauugcaccaggaa

SEQ ID NO: 1681575 - RNA, 22 nt, Salmonella enterica enterica serovar Typhi
ugccacaaccgcccccaacuga

SEQ ID NO: 1681576 - RNA, 23 nt, Salmonella enterica enterica serovar Typhi
ugccaauggcgauaaaaauaucc

SEQ ID NO: 1681577 - RNA, 14 nt, Salmonella enterica enterica serovar Typhi
ugccaaugaaauaa

SEQ ID NO: 1681578 - RNA, 23 nt, Salmonella enterica enterica serovar Typhi
ugccacaacgccugaugcugcgc

SEQ ID NO: 1681579 - RNA, 14 nt, Salmonella enterica enterica serovar Typhi
ugccaccagcgcca

SEQ ID NO: 1681580 - RNA, 18 nt, Salmonella enterica enterica serovar Typhi
ugcauuguacuuuuaaau

SEQ ID NO: 1681581 - RNA, 17 nt, Salmonella enterica enterica serovar Typhi
ugcauuguccgcauucu

SEQ ID NO: 1681582 - RNA, 16 nt, Salmonella enterica enterica serovar Typhi
ugcauuuaucaaucug

SEQ ID NO: 1681583 - RNA, 20 nt, Salmonella enterica enterica serovar Typhi
ugcauuuaucaaucugcuuu

SEQ ID NO: 1681584 - RNA, 17 nt, Salmonella enterica enterica serovar Typhi
ugcauuuucaccuggau

SEQ ID NO: 1681585 - RNA, 13 nt, Salmonella enterica enterica serovar Typhi
ugccaaucuccag

SEQ ID NO: 1681586 - RNA, 19 nt, Salmonella enterica enterica serovar Typhi
ugcaucugggggaagauaa

SEQ ID NO: 1681587 - RNA, 13 nt, Salmonella enterica enterica serovar Typhi
ugcauucgcuccu

SEQ ID NO: 1681588 - RNA, 15 nt, Salmonella enterica enterica serovar Typhi
ugcauugauaggcug

SEQ ID NO: 1681589 - RNA, 13 nt, Salmonella enterica enterica serovar Typhi
ugcauuggccagc

SEQ ID NO: 1681590 - RNA, 15 nt, Salmonella enterica enterica serovar Typhi
ugcauugcuuuuagu

SEQ ID NO: 1681591 - RNA, 20 nt, Salmonella enterica enterica serovar Typhi
ugcauuauuuuagugaaaaa

SEQ ID NO: 1681592 - RNA, 20 nt, Salmonella enterica enterica serovar Typhi
ugcauucaggccucugcuuu

SEQ ID NO: 1681593 - RNA, 20 nt, Salmonella enterica enterica serovar Typhi
ugagcgcuugauccagcucg

SEQ ID NO: 1681594 - RNA, 19 nt, Salmonella enterica enterica serovar Typhi
ugagcggcucauccagcaa

SEQ ID NO: 1681595 - RNA, 18 nt, Salmonella enterica enterica serovar Typhi
ugagcggcucauccagca

SEQ ID NO: 1681596 - RNA, 20 nt, Salmonella enterica enterica serovar Typhi
ugagcguagaccgcccagga

SEQ ID NO: 1681597 - RNA, 18 nt, Salmonella enterica enterica serovar Typhi
ugagcguagaccgcccag

SEQ ID NO: 1681598 - RNA, 21 nt, Salmonella enterica enterica serovar Typhi
ugagauccgggcuggcaaaca

SEQ ID NO: 1681599 - RNA, 20 nt, Salmonella enterica enterica serovar Typhi
ugagauaauuuaugauuuua

SEQ ID NO: 1681600 - RNA, 13 nt, Salmonella enterica enterica serovar Typhi
ugagcucuuucug

SEQ ID NO: 1681601 - RNA, 19 nt, Salmonella enterica enterica serovar Typhi
ugagcucguuauaagcuuu

SEQ ID NO: 1681602 - RNA, 13 nt, Salmonella enterica enterica serovar Typhi
ugagcucauccag

SEQ ID NO: 1681603 - RNA, 14 nt, Salmonella enterica enterica serovar Typhi
ugagcucauccagc

SEQ ID NO: 1681604 - RNA, 17 nt, Salmonella enterica enterica serovar Typhi
ugagcucuuucugcgca

SEQ ID NO: 1681605 - RNA, 11 nt, Salmonella enterica enterica serovar Typhi
ugagcuaauca

SEQ ID NO: 1681606 - RNA, 18 nt, Salmonella enterica enterica serovar Typhi
ugagcuaaucacccacuu

SEQ ID NO: 1681607 - RNA, 18 nt, Salmonella enterica enterica serovar Typhi
ugagcguuacgggaacag

SEQ ID NO: 1681608 - RNA, 19 nt, Salmonella enterica enterica serovar Typhi
ugagcguuacgggaacaga

SEQ ID NO: 1681609 - RNA, 16 nt, Salmonella enterica enterica serovar Typhi
ugaggagcuggagcag

SEQ ID NO: 1681610 - RNA, 19 nt, Salmonella enterica enterica serovar Typhi
ugaggccuguuucuuacca

SEQ ID NO: 1681611 - RNA, 15 nt, Salmonella enterica enterica serovar Typhi
ugaggauauugguau

SEQ ID NO: 1681612 - RNA, 17 nt, Salmonella enterica enterica serovar Typhi
ugaggcguugcuccagc

SEQ ID NO: 1681613 - RNA, 12 nt, Salmonella enterica enterica serovar Typhi
ugaggcgcagcc

SEQ ID NO: 1681614 - RNA, 20 nt, Salmonella enterica enterica serovar Typhi
ugauaaaauaaacacuaaau

SEQ ID NO: 1681615 - RNA, 20 nt, Salmonella enterica enterica serovar Typhi
ugagguggccgagaggcuga

SEQ ID NO: 1681616 - RNA, 15 nt, Salmonella enterica enterica serovar Typhi
ugagucuugccuguc

SEQ ID NO: 1681617 - RNA, 21 nt, Salmonella enterica enterica serovar Typhi
ugagggcgauaauccgcucca

SEQ ID NO: 1681618 - RNA, 14 nt, Salmonella enterica enterica serovar Typhi
ugauacucaucaua

SEQ ID NO: 1681619 - RNA, 19 nt, Salmonella enterica enterica serovar Typhi
ugauacgcggcugaugcag

SEQ ID NO: 1681620 - RNA, 20 nt, Salmonella enterica enterica serovar Typhi
ugauaccuuuaaccucuuuu

SEQ ID NO: 1681621 - RNA, 16 nt, Salmonella enterica enterica serovar Typhi
ugauaccuauuuaaua

SEQ ID NO: 1681622 - RNA, 21 nt, Salmonella enterica enterica serovar Typhi
ugauaagcauagcgccaucag

SEQ ID NO: 1681623 - RNA, 21 nt, Salmonella enterica enterica serovar Typhi
ugauaagcguagcgccaucag

SEQ ID NO: 1681624 - RNA, 18 nt, Salmonella enterica enterica serovar Typhi
ugauaagcuaguaaagaa

SEQ ID NO: 1681625 - RNA, 18 nt, Salmonella enterica enterica serovar Typhi
ugauaagcgcagcgccau

SEQ ID NO: 1681626 - RNA, 16 nt, Salmonella enterica enterica serovar Typhi
ugauaccuaaacgcgu

SEQ ID NO: 1681627 - RNA, 14 nt, Salmonella enterica enterica serovar Typhi
ugauaccuauuuaa

SEQ ID NO: 1681628 - RNA, 12 nt, Salmonella enterica enterica serovar Typhi
ugauaauacugc

SEQ ID NO: 1681629 - RNA, 13 nt, Salmonella enterica enterica serovar Typhi
ugauaauaugcuc

SEQ ID NO: 1681630 - RNA, 20 nt, Salmonella enterica enterica serovar Typhi
ugauagcaggcacuguggug

SEQ ID NO: 1681631 - RNA, 23 nt, Salmonella enterica enterica serovar Typhi
ugauagcaaucauccugauuuua

SEQ ID NO: 1681632 - RNA, 15 nt, Salmonella enterica enterica serovar Typhi
ugauagcgaggcagc

SEQ ID NO: 1681633 - RNA, 18 nt, Salmonella enterica enterica serovar Typhi
ugauagccguucuccagc

SEQ ID NO: 1681634 - RNA, 20 nt, Salmonella enterica enterica serovar Typhi
ugauaggccagcuacaccug

SEQ ID NO: 1681635 - RNA, 21 nt, Salmonella enterica enterica serovar Typhi
ugauagguucaauaugccagg

SEQ ID NO: 1681636 - RNA, 13 nt, Salmonella enterica enterica serovar Typhi
ugauaguccauca

SEQ ID NO: 1681637 - RNA, 16 nt, Salmonella enterica enterica serovar Typhi
ugauaucgccccagaa

SEQ ID NO: 1681638 - RNA, 16 nt, Salmonella enterica enterica serovar Typhi
ugauaucgguaagcgc

SEQ ID NO: 1681639 - RNA, 22 nt, Salmonella enterica enterica serovar Typhi
ugaucugcgccggcugcgcugc

SEQ ID NO: 1681640 - RNA, 14 nt, Salmonella enterica enterica serovar Typhi
ugaucugcgccggc

SEQ ID NO: 1681641 - RNA, 19 nt, Salmonella enterica enterica serovar Typhi
ugaucuuaccucuccugaa

SEQ ID NO: 1681642 - RNA, 20 nt, Salmonella enterica enterica serovar Typhi
ugaucuggccaauuuuucac

SEQ ID NO: 1681643 - RNA, 12 nt, Salmonella enterica enterica serovar Typhi
ugaucggcuggc

SEQ ID NO: 1681644 - RNA, 20 nt, Salmonella enterica enterica serovar Typhi
ugaucgcgagaguaagccca

SEQ ID NO: 1681645 - RNA, 22 nt, Salmonella enterica enterica serovar Typhi
ugaucgaggucgccaaauuuag

SEQ ID NO: 1681646 - RNA, 15 nt, Salmonella enterica enterica serovar Typhi
ugaucauggcucaga

SEQ ID NO: 1681647 - RNA, 19 nt, Salmonella enterica enterica serovar Typhi
ugauccgcccccuccagua

SEQ ID NO: 1681648 - RNA, 22 nt, Salmonella enterica enterica serovar Typhi
ugauccugcaacagcaccagca

SEQ ID NO: 1681649 - RNA, 12 nt, Salmonella enterica enterica serovar Typhi
ugaucgaauuca

SEQ ID NO: 1681650 - RNA, 14 nt, Salmonella enterica enterica serovar Typhi
ugaucaggcuaaag

SEQ ID NO: 1681651 - RNA, 15 nt, Salmonella enterica enterica serovar Typhi
ugauaugcaguucau

SEQ ID NO: 1681652 - RNA, 20 nt, Salmonella enterica enterica serovar Typhi
ugauaugcaguucaucaucc

SEQ ID NO: 1681653 - RNA, 19 nt, Salmonella enterica enterica serovar Typhi
ugauaugcucgacaauaaa

SEQ ID NO: 1681654 - RNA, 18 nt, Salmonella enterica enterica serovar Typhi
ugacguuaacgcagcauc

SEQ ID NO: 1681655 - RNA, 15 nt, Salmonella enterica enterica serovar Typhi
ugacuaaaagacgcc

SEQ ID NO: 1681656 - RNA, 15 nt, Salmonella enterica enterica serovar Typhi
ugacuaaaucagcau

SEQ ID NO: 1681657 - RNA, 15 nt, Salmonella enterica enterica serovar Typhi
ugacuacgucagaug

SEQ ID NO: 1681658 - RNA, 11 nt, Salmonella enterica enterica serovar Typhi
ugacgcugccc

SEQ ID NO: 1681659 - RNA, 19 nt, Salmonella enterica enterica serovar Typhi
ugacggauucuuccucucg

SEQ ID NO: 1681660 - RNA, 19 nt, Salmonella enterica enterica serovar Typhi
ugacgcuugcaugaccauc

SEQ ID NO: 1681661 - RNA, 14 nt, Salmonella enterica enterica serovar Typhi
ugacggaaaccagc

SEQ ID NO: 1681662 - RNA, 23 nt, Salmonella enterica enterica serovar Typhi
ugacggcaacugaaaacaggccu

SEQ ID NO: 1681663 - RNA, 21 nt, Salmonella enterica enterica serovar Typhi
ugacggcaaagcccacgcccu

SEQ ID NO: 1681664 - RNA, 16 nt, Salmonella enterica enterica serovar Typhi
ugacggcgcugucacu

SEQ ID NO: 1681665 - RNA, 21 nt, Salmonella enterica enterica serovar Typhi
ugacggcggaagaggcgccug

SEQ ID NO: 1681666 - RNA, 20 nt, Salmonella enterica enterica serovar Typhi
ugacgggaaaucucccuggc

SEQ ID NO: 1681667 - RNA, 22 nt, Salmonella enterica enterica serovar Typhi
ugacgggaaaucucccuggcag

SEQ ID NO: 1681668 - RNA, 16 nt, Salmonella enterica enterica serovar Typhi
ugacggugauguuggc

SEQ ID NO: 1681669 - RNA, 19 nt, Salmonella enterica enterica serovar Typhi
ugacggggggaauguuugg

SEQ ID NO: 1681670 - RNA, 13 nt, Salmonella enterica enterica serovar Typhi
ugacguccaggcc

SEQ ID NO: 1681671 - RNA, 18 nt, Salmonella enterica enterica serovar Typhi
ugacguagauucugauug

SEQ ID NO: 1681672 - RNA, 19 nt, Salmonella enterica enterica serovar Typhi
ugacucauuaaaaaaacau

SEQ ID NO: 1681673 - RNA, 15 nt, Salmonella enterica enterica serovar Typhi
ugacucauuaaaaaa

SEQ ID NO: 1681674 - RNA, 12 nt, Salmonella enterica enterica serovar Typhi
ugacucugccuc

SEQ ID NO: 1681675 - RNA, 17 nt, Salmonella enterica enterica serovar Typhi
ugacugaauuuucagcc

SEQ ID NO: 1681676 - RNA, 14 nt, Salmonella enterica enterica serovar Typhi
ugacuuacaggcug

SEQ ID NO: 1681677 - RNA, 12 nt, Salmonella enterica enterica serovar Typhi
ugagaagaaaaa

SEQ ID NO: 1681678 - RNA, 18 nt, Salmonella enterica enterica serovar Typhi
ugagaaauuauuuuaaau

SEQ ID NO: 1681679 - RNA, 18 nt, Salmonella enterica enterica serovar Typhi
ugagacgcagccucucuu

SEQ ID NO: 1681680 - RNA, 21 nt, Salmonella enterica enterica serovar Typhi
ugacgaucaugccgcccaggc

SEQ ID NO: 1681681 - RNA, 18 nt, Salmonella enterica enterica serovar Typhi
ugacgcaaacugccaggc

SEQ ID NO: 1681682 - RNA, 13 nt, Salmonella enterica enterica serovar Typhi
ugacgcagcaguu

SEQ ID NO: 1681683 - RNA, 16 nt, Salmonella enterica enterica serovar Typhi
ugacgcagcaucucaa

SEQ ID NO: 1681684 - RNA, 14 nt, Salmonella enterica enterica serovar Typhi
ugacgcacaguguu

SEQ ID NO: 1681685 - RNA, 21 nt, Salmonella enterica enterica serovar Typhi
ugacgcaguaauacgccgccg

SEQ ID NO: 1681686 - RNA, 16 nt, Salmonella enterica enterica serovar Typhi
ugacgccaugcaaaaa

SEQ ID NO: 1681687 - RNA, 16 nt, Salmonella enterica enterica serovar Typhi
ugacgcucuccuccaa

SEQ ID NO: 1681688 - RNA, 19 nt, Salmonella enterica enterica serovar Typhi
ugacgccgcuguuuucacu

SEQ ID NO: 1681689 - RNA, 20 nt, Salmonella enterica enterica serovar Typhi
ugacgcgauauuacuccagc

SEQ ID NO: 1681690 - RNA, 21 nt, Salmonella enterica enterica serovar Typhi
ugacgccaguucccacagcuu

SEQ ID NO: 1681691 - RNA, 20 nt, Salmonella enterica enterica serovar Typhi
ugacgccccauguggccagc

SEQ ID NO: 1681692 - RNA, 11 nt, Salmonella enterica enterica serovar Typhi
ugacgccgcca

SEQ ID NO: 1681693 - RNA, 20 nt, Salmonella enterica enterica serovar Typhi
ugacgccgaccaccgcccug

SEQ ID NO: 1681694 - RNA, 18 nt, Salmonella enterica enterica serovar Typhi
ugaccgguaagcccaugg

SEQ ID NO: 1681695 - RNA, 19 nt, Salmonella enterica enterica serovar Typhi
ugaccgguaagcccauggc

SEQ ID NO: 1681696 - RNA, 15 nt, Salmonella enterica enterica serovar Typhi
ugaccgucagccccg

SEQ ID NO: 1681697 - RNA, 22 nt, Salmonella enterica enterica serovar Typhi
ugaccguuaguaaucggaucaa

SEQ ID NO: 1681698 - RNA, 17 nt, Salmonella enterica enterica serovar Typhi
ugaccgauauagccacu

SEQ ID NO: 1681699 - RNA, 14 nt, Salmonella enterica enterica serovar Typhi
ugaccgaggaaauc

SEQ ID NO: 1681700 - RNA, 20 nt, Salmonella enterica enterica serovar Typhi
ugaccgaaccgcuguagucu

SEQ ID NO: 1681701 - RNA, 17 nt, Salmonella enterica enterica serovar Typhi
ugacgagggaaggggau

SEQ ID NO: 1681702 - RNA, 18 nt, Salmonella enterica enterica serovar Typhi
ugacgaauaccugaaaga

SEQ ID NO: 1681703 - RNA, 16 nt, Salmonella enterica enterica serovar Typhi
ugacgaauagcgcgcu

SEQ ID NO: 1681704 - RNA, 14 nt, Salmonella enterica enterica serovar Typhi
ugacgaccacagcc

SEQ ID NO: 1681705 - RNA, 14 nt, Salmonella enterica enterica serovar Typhi
ugaccuacaggccg

SEQ ID NO: 1681706 - RNA, 13 nt, Salmonella enterica enterica serovar Typhi
ugaccucauccau

SEQ ID NO: 1681707 - RNA, 15 nt, Salmonella enterica enterica serovar Typhi
ugaccaccagcgcga

SEQ ID NO: 1681708 - RNA, 14 nt, Salmonella enterica enterica serovar Typhi
ugaccacgccgccg

SEQ ID NO: 1681709 - RNA, 19 nt, Salmonella enterica enterica serovar Typhi
ugacccgccgccagcaccg

SEQ ID NO: 1681710 - RNA, 14 nt, Salmonella enterica enterica serovar Typhi
ugacccgcagcaau

SEQ ID NO: 1681711 - RNA, 13 nt, Salmonella enterica enterica serovar Typhi
ugacccgcagcaa

SEQ ID NO: 1681712 - RNA, 20 nt, Salmonella enterica enterica serovar Typhi
ugacaugaaaauaugagguu

SEQ ID NO: 1681713 - RNA, 16 nt, Salmonella enterica enterica serovar Typhi
ugaauaaccauacuga

SEQ ID NO: 1681714 - RNA, 15 nt, Salmonella enterica enterica serovar Typhi
ugaauaacagcacca

SEQ ID NO: 1681715 - RNA, 19 nt, Salmonella enterica enterica serovar Typhi
ugaccaacaucauuauucc

SEQ ID NO: 1681716 - RNA, 18 nt, Salmonella enterica enterica serovar Typhi
ugaccaagcgucagcaug

SEQ ID NO: 1681717 - RNA, 21 nt, Salmonella enterica enterica serovar Typhi
ugaccaauguuaauaagcaga

SEQ ID NO: 1681718 - RNA, 19 nt, Salmonella enterica enterica serovar Typhi
ugacauucugacggcccuu

SEQ ID NO: 1681719 - RNA, 15 nt, Salmonella enterica enterica serovar Typhi
ugacauuauucaccu

SEQ ID NO: 1681720 - RNA, 21 nt, Salmonella enterica enterica serovar Typhi
ucugauagggacacauuucuu

SEQ ID NO: 1681721 - RNA, 22 nt, Salmonella enterica enterica serovar Typhi
ucugagccaauuuaugccggag

SEQ ID NO: 1681722 - RNA, 17 nt, Salmonella enterica enterica serovar Typhi
ucugacugcgugagugu

SEQ ID NO: 1681723 - RNA, 13 nt, Salmonella enterica enterica serovar Typhi
ucugacggccugu

SEQ ID NO: 1681724 - RNA, 22 nt, Salmonella enterica enterica serovar Typhi
ucugaauuuccugcgcuuuuug

SEQ ID NO: 1681725 - RNA, 22 nt, Salmonella enterica enterica serovar Typhi
ucugacggguaguaucgcucua

SEQ ID NO: 1681726 - RNA, 20 nt, Salmonella enterica enterica serovar Typhi
ucugacugaucgauccacuu

SEQ ID NO: 1681727 - RNA, 16 nt, Salmonella enterica enterica serovar Typhi
ucugaaucucuuccca

SEQ ID NO: 1681728 - RNA, 18 nt, Salmonella enterica enterica serovar Typhi
ucucuuuuugcagcagcg

SEQ ID NO: 1681729 - RNA, 14 nt, Salmonella enterica enterica serovar Typhi
ucucuuuuuuaggc

SEQ ID NO: 1681730 - RNA, 23 nt, Salmonella enterica enterica serovar Typhi
ucugaaaaaccgucggcaauaca

SEQ ID NO: 1681731 - RNA, 13 nt, Salmonella enterica enterica serovar Typhi
ucucuuuuaauuu

SEQ ID NO: 1681732 - RNA, 12 nt, Salmonella enterica enterica serovar Typhi
ucugaaaguuug

SEQ ID NO: 1681733 - RNA, 12 nt, Salmonella enterica enterica serovar Typhi
ucugaaaugcuc

SEQ ID NO: 1681734 - RNA, 16 nt, Salmonella enterica enterica serovar Typhi
ucugaagcguaaaaau

SEQ ID NO: 1681735 - RNA, 16 nt, Salmonella enterica enterica serovar Typhi
ucucuuccgccagcgc

SEQ ID NO: 1681736 - RNA, 19 nt, Salmonella enterica enterica serovar Typhi
aaaugcgucggcaccauuc

SEQ ID NO: 1681737 - RNA, 19 nt, Salmonella enterica enterica serovar Typhi
aaaugcguggcauuaacaa

SEQ ID NO: 1681738 - RNA, 20 nt, Salmonella enterica enterica serovar Typhi
aaaugcguggcauuaacaaa

SEQ ID NO: 1681739 - RNA, 15 nt, Salmonella enterica enterica serovar Typhi
aaaugcgguuuucuu

SEQ ID NO: 1681740 - RNA, 18 nt, Salmonella enterica enterica serovar Typhi
ucucugguuucccugccu

SEQ ID NO: 1681741 - RNA, 20 nt, Salmonella enterica enterica serovar Typhi
ucgcauguugacugcgcucc

SEQ ID NO: 1681742 - RNA, 22 nt, Salmonella enterica enterica serovar Typhi
ucgccaaagcagcggaaaauau

SEQ ID NO: 1681743 - RNA, 14 nt, Salmonella enterica enterica serovar Typhi
ucgccaaagcagcu

SEQ ID NO: 1681744 - RNA, 19 nt, Salmonella enterica enterica serovar Typhi
ucugcgugaugcaucagaa

SEQ ID NO: 1681745 - RNA, 22 nt, Salmonella enterica enterica serovar Typhi
ucugcgugagccggacacugcg

SEQ ID NO: 1681746 - RNA, 19 nt, Salmonella enterica enterica serovar Typhi
ucugcgucaguaccugaug

SEQ ID NO: 1681747 - RNA, 21 nt, Salmonella enterica enterica serovar Typhi
ucugcguccugcuuaugaaac

SEQ ID NO: 1681748 - RNA, 13 nt, Salmonella enterica enterica serovar Typhi
ucugcgugaagac

SEQ ID NO: 1681749 - RNA, 18 nt, Salmonella enterica enterica serovar Typhi
ucugcgggacgcaucauc

SEQ ID NO: 1681750 - RNA, 16 nt, Salmonella enterica enterica serovar Typhi
ucugcugaaaugccug

SEQ ID NO: 1681751 - RNA, 13 nt, Salmonella enterica enterica serovar Typhi
ucugcuccgccag

SEQ ID NO: 1681752 - RNA, 14 nt, Salmonella enterica enterica serovar Typhi
ucugcuccgccagc

SEQ ID NO: 1681753 - RNA, 22 nt, Salmonella enterica enterica serovar Typhi
ucugcuccgcgccgaaauuuuc

SEQ ID NO: 1681754 - RNA, 14 nt, Salmonella enterica enterica serovar Typhi
ucugcuccggcgua

SEQ ID NO: 1681755 - RNA, 21 nt, Salmonella enterica enterica serovar Typhi
ucugcugggcgauuucacgaa

SEQ ID NO: 1681756 - RNA, 18 nt, Salmonella enterica enterica serovar Typhi
ucuggcgcuuuuccagca

SEQ ID NO: 1681757 - RNA, 17 nt, Salmonella enterica enterica serovar Typhi
ucuggguaacgcucuua

SEQ ID NO: 1681758 - RNA, 14 nt, Salmonella enterica enterica serovar Typhi
ucuggcgagaacac

SEQ ID NO: 1681759 - RNA, 19 nt, Salmonella enterica enterica serovar Typhi
ucuggcgcauuccagaccc

SEQ ID NO: 1681760 - RNA, 14 nt, Salmonella enterica enterica serovar Typhi
ucuggccauuucau

SEQ ID NO: 1681761 - RNA, 17 nt, Salmonella enterica enterica serovar Typhi
ucuggccgucuggcgug

SEQ ID NO: 1681762 - RNA, 13 nt, Salmonella enterica enterica serovar Typhi
ucuggacaugucc

SEQ ID NO: 1681763 - RNA, 19 nt, Salmonella enterica enterica serovar Typhi
ucuggacgggccgccaucu

SEQ ID NO: 1681764 - RNA, 19 nt, Salmonella enterica enterica serovar Typhi
ucuggaaucaauuucccuu

SEQ ID NO: 1681765 - RNA, 15 nt, Salmonella enterica enterica serovar Typhi
ucuggccaguuucaa

SEQ ID NO: 1681766 - RNA, 17 nt, Salmonella enterica enterica serovar Typhi
ucuggccaauuuuucac

SEQ ID NO: 1681767 - RNA, 18 nt, Salmonella enterica enterica serovar Typhi
ucuggauagcgguuugca

SEQ ID NO: 1681768 - RNA, 17 nt, Salmonella enterica enterica serovar Typhi
ucuggauagucuucaag

SEQ ID NO: 1681769 - RNA, 22 nt, Salmonella enterica enterica serovar Typhi
ucugccucagcaagaaguuccg

SEQ ID NO: 1681770 - RNA, 14 nt, Salmonella enterica enterica serovar Typhi
ucugccucaacaag

SEQ ID NO: 1681771 - RNA, 15 nt, Salmonella enterica enterica serovar Typhi
ucugccugcagaccc

SEQ ID NO: 1681772 - RNA, 14 nt, Salmonella enterica enterica serovar Typhi
ucugcgccaccagc

SEQ ID NO: 1681773 - RNA, 13 nt, Salmonella enterica enterica serovar Typhi
ucugcgccaccag

SEQ ID NO: 1681774 - RNA, 17 nt, Salmonella enterica enterica serovar Typhi
ucugcgccgcaucgcca

SEQ ID NO: 1681775 - RNA, 20 nt, Salmonella enterica enterica serovar Typhi
ucugcgcgccgcaggccgga

SEQ ID NO: 1681776 - RNA, 23 nt, Salmonella enterica enterica serovar Typhi
ucugcgcuaagcguuacggaaaa

SEQ ID NO: 1681777 - RNA, 16 nt, Salmonella enterica enterica serovar Typhi
ucugauucaauagugc

SEQ ID NO: 1681778 - RNA, 15 nt, Salmonella enterica enterica serovar Typhi
ucugauggcgcugcg

SEQ ID NO: 1681779 - RNA, 16 nt, Salmonella enterica enterica serovar Typhi
ucugauggcuuugcug

SEQ ID NO: 1681780 - RNA, 14 nt, Salmonella enterica enterica serovar Typhi
ucugaugccugaag

SEQ ID NO: 1681781 - RNA, 23 nt, Salmonella enterica enterica serovar Typhi
ucugauuucgacgauaaaaaaag

SEQ ID NO: 1681782 - RNA, 20 nt, Salmonella enterica enterica serovar Typhi
ucugauuucgacgauaaaaa

SEQ ID NO: 1681783 - RNA, 17 nt, Salmonella enterica enterica serovar Typhi
ucugcaaaauauauaau

SEQ ID NO: 1681784 - RNA, 16 nt, Salmonella enterica enterica serovar Typhi
ucugccauuucugcuc

SEQ ID NO: 1681785 - RNA, 12 nt, Salmonella enterica enterica serovar Typhi
ucugccagguuc

SEQ ID NO: 1681786 - RNA, 16 nt, Salmonella enterica enterica serovar Typhi
ucugguacauacuguu

SEQ ID NO: 1681787 - RNA, 20 nt, Salmonella enterica enterica serovar Typhi
ucugguacggccaccaggcc

SEQ ID NO: 1681788 - RNA, 18 nt, Salmonella enterica enterica serovar Typhi
ucuggguuagcuguaucc

SEQ ID NO: 1681789 - RNA, 15 nt, Salmonella enterica enterica serovar Typhi
ucugguaucgagugg

SEQ ID NO: 1681790 - RNA, 23 nt, Salmonella enterica enterica serovar Typhi
ucuguuuuuggaaacuaugcaaa

SEQ ID NO: 1681791 - RNA, 15 nt, Salmonella enterica enterica serovar Typhi
ucuuauuauuauugu

SEQ ID NO: 1681792 - RNA, 15 nt, Salmonella enterica enterica serovar Typhi
ucuuaugccgcuuuu

SEQ ID NO: 1681793 - RNA, 23 nt, Salmonella enterica enterica serovar Typhi
ucuuagaauagaaucaauuucuc

SEQ ID NO: 1681794 - RNA, 19 nt, Salmonella enterica enterica serovar Typhi
ucuuaauuccucagaaucc

SEQ ID NO: 1681795 - RNA, 15 nt, Salmonella enterica enterica serovar Typhi
ucuuaauuauaaagc

SEQ ID NO: 1681796 - RNA, 14 nt, Salmonella enterica enterica serovar Typhi
ucuuccgccagguc

SEQ ID NO: 1681797 - RNA, 23 nt, Salmonella enterica enterica serovar Typhi
ucuuccgccauacccggcuccca

SEQ ID NO: 1681798 - RNA, 15 nt, Salmonella enterica enterica serovar Typhi
ucuucccgcagauau

SEQ ID NO: 1681799 - RNA, 17 nt, Salmonella enterica enterica serovar Typhi
ucuuccccgaucagaaa

SEQ ID NO: 1681800 - RNA, 11 nt, Salmonella enterica enterica serovar Typhi
ucuucaucaaa

SEQ ID NO: 1681801 - RNA, 13 nt, Salmonella enterica enterica serovar Typhi
ucuucaucagcca

SEQ ID NO: 1681802 - RNA, 16 nt, Salmonella enterica enterica serovar Typhi
ucuucaucagccagca

SEQ ID NO: 1681803 - RNA, 20 nt, Salmonella enterica enterica serovar Typhi
ucuucaguuccgccagacuc

SEQ ID NO: 1681804 - RNA, 14 nt, Salmonella enterica enterica serovar Typhi
ucuucaguaaccag

SEQ ID NO: 1681805 - RNA, 22 nt, Salmonella enterica enterica serovar Typhi
ucuucaguaauuucgaugauga

SEQ ID NO: 1681806 - RNA, 11 nt, Salmonella enterica enterica serovar Typhi
ucuuauuuucc

SEQ ID NO: 1681807 - RNA, 22 nt, Salmonella enterica enterica serovar Typhi
ucuucaacauugucgaacugca

SEQ ID NO: 1681808 - RNA, 12 nt, Salmonella enterica enterica serovar Typhi
ucuucaaagcca

SEQ ID NO: 1681809 - RNA, 15 nt, Salmonella enterica enterica serovar Typhi
ucuucucuucuucaa

SEQ ID NO: 1681810 - RNA, 17 nt, Salmonella enterica enterica serovar Typhi
ucuucuggcguuuuaau

SEQ ID NO: 1681811 - RNA, 16 nt, Salmonella enterica enterica serovar Typhi
ucuucugugauuaucc

SEQ ID NO: 1681812 - RNA, 19 nt, Salmonella enterica enterica serovar Typhi
ucuucuucgcguuuuucga

SEQ ID NO: 1681813 - RNA, 14 nt, Salmonella enterica enterica serovar Typhi
ucuucgccauuaca

SEQ ID NO: 1681814 - RNA, 22 nt, Salmonella enterica enterica serovar Typhi
ucuucgccgaagugugccagca

SEQ ID NO: 1681815 - RNA, 21 nt, Salmonella enterica enterica serovar Typhi
ucuucgcccauugccacccau

SEQ ID NO: 1681816 - RNA, 15 nt, Salmonella enterica enterica serovar Typhi
ucuucgcaaucuccg

SEQ ID NO: 1681817 - RNA, 21 nt, Salmonella enterica enterica serovar Typhi
ucuucgauuguugacugccag

SEQ ID NO: 1681818 - RNA, 18 nt, Salmonella enterica enterica serovar Typhi
ucuucgacacauuucagc

SEQ ID NO: 1681819 - RNA, 14 nt, Salmonella enterica enterica serovar Typhi
ucuucuccgccugc

SEQ ID NO: 1681820 - RNA, 15 nt, Salmonella enterica enterica serovar Typhi
ucuucuaaaucauac

SEQ ID NO: 1681821 - RNA, 14 nt, Salmonella enterica enterica serovar Typhi
ucuucuacaaugcg

SEQ ID NO: 1681822 - RNA, 16 nt, Salmonella enterica enterica serovar Typhi
ucuucuaccaccuuau

SEQ ID NO: 1681823 - RNA, 19 nt, Salmonella enterica enterica serovar Typhi
ucuucuuuagauaauuucg

SEQ ID NO: 1681824 - RNA, 23 nt, Salmonella enterica enterica serovar Typhi
ucuucuuugacccacgccagcag

SEQ ID NO: 1681825 - RNA, 15 nt, Salmonella enterica enterica serovar Typhi
ucuugauaucaucau

SEQ ID NO: 1681826 - RNA, 23 nt, Salmonella enterica enterica serovar Typhi
ucuugcaacccauauucgucuuc

SEQ ID NO: 1681827 - RNA, 14 nt, Salmonella enterica enterica serovar Typhi
ucuugccacuggcc

SEQ ID NO: 1681828 - RNA, 14 nt, Salmonella enterica enterica serovar Typhi
ucuugccgccaucu

SEQ ID NO: 1681829 - RNA, 16 nt, Salmonella enterica enterica serovar Typhi
ucuuuacgcagcaaga

SEQ ID NO: 1681830 - RNA, 22 nt, Salmonella enterica enterica serovar Typhi
ucuuuacgcagcaagaacagag

SEQ ID NO: 1681831 - RNA, 23 nt, Salmonella enterica enterica serovar Typhi
ucuuuaaugcccgguauuuuuuc

SEQ ID NO: 1681832 - RNA, 15 nt, Salmonella enterica enterica serovar Typhi
ucuuuacuaauaccu

SEQ ID NO: 1681833 - RNA, 12 nt, Salmonella enterica enterica serovar Typhi
ucuuucaauccu

SEQ ID NO: 1681834 - RNA, 19 nt, Salmonella enterica enterica serovar Typhi
ucuuucaauccuucuucug

SEQ ID NO: 1681835 - RNA, 13 nt, Salmonella enterica enterica serovar Typhi
ucuuuaugcguca

SEQ ID NO: 1681836 - RNA, 21 nt, Salmonella enterica enterica serovar Typhi
ucuuuaucuucugcugcuccc

SEQ ID NO: 1681837 - RNA, 20 nt, Salmonella enterica enterica serovar Typhi
ucuuuaaaaugacucaggac

SEQ ID NO: 1681838 - RNA, 18 nt, Salmonella enterica enterica serovar Typhi
ucuugguaccaaacagca

SEQ ID NO: 1681839 - RNA, 21 nt, Salmonella enterica enterica serovar Typhi
ucuugguuuuaucuguaauua

SEQ ID NO: 1681840 - RNA, 15 nt, Salmonella enterica enterica serovar Typhi
ucuugcucucaggca

SEQ ID NO: 1681841 - RNA, 11 nt, Salmonella enterica enterica serovar Typhi
ucuugcuauca

SEQ ID NO: 1681842 - RNA, 15 nt, Salmonella enterica enterica serovar Typhi
ucuugcuuuauuuuu

SEQ ID NO: 1681843 - RNA, 15 nt, Salmonella enterica enterica serovar Typhi
ucuuggagagcauca

SEQ ID NO: 1681844 - RNA, 17 nt, Salmonella enterica enterica serovar Typhi
ucuuggaugauuuucuu

SEQ ID NO: 1681845 - RNA, 20 nt, Salmonella enterica enterica serovar Typhi
ucuuugaccagcgacgauga

SEQ ID NO: 1681846 - RNA, 18 nt, Salmonella enterica enterica serovar Typhi
ucuuucugcgcacgagug

SEQ ID NO: 1681847 - RNA, 12 nt, Salmonella enterica enterica serovar Typhi
ucuuuggcgauu

SEQ ID NO: 1681848 - RNA, 17 nt, Salmonella enterica enterica serovar Typhi
ucuuuggcuuaaucauu

SEQ ID NO: 1681849 - RNA, 22 nt, Salmonella enterica enterica serovar Typhi
ucuuuggccaguaucgcgccgc

SEQ ID NO: 1681850 - RNA, 17 nt, Salmonella enterica enterica serovar Typhi
ucuuugccaaacugcug

SEQ ID NO: 1681851 - RNA, 19 nt, Salmonella enterica enterica serovar Typhi
ucuuugcaccgcuaaaaaa

SEQ ID NO: 1681852 - RNA, 20 nt, Salmonella enterica enterica serovar Typhi
ucuuugcagcuccuuuuaau

SEQ ID NO: 1681853 - RNA, 12 nt, Salmonella enterica enterica serovar Typhi
ucuuuccuuuuu

SEQ ID NO: 1681854 - RNA, 23 nt, Salmonella enterica enterica serovar Typhi
ucuuucagccgacuaucuucuuc

SEQ ID NO: 1681855 - RNA, 13 nt, Salmonella enterica enterica serovar Typhi
ucuuucccggcaa

SEQ ID NO: 1681856 - RNA, 14 nt, Salmonella enterica enterica serovar Typhi
ucuuucccaggccc

SEQ ID NO: 1681857 - RNA, 20 nt, Salmonella enterica enterica serovar Typhi
ucuuuugucguccccuggac

SEQ ID NO: 1681858 - RNA, 12 nt, Salmonella enterica enterica serovar Typhi
ucuuuugcaaua

SEQ ID NO: 1681859 - RNA, 23 nt, Salmonella enterica enterica serovar Typhi
ucuuuucugucguguccuugcca

SEQ ID NO: 1681860 - RNA, 12 nt, Salmonella enterica enterica serovar Typhi
ucuuuuauuauu

SEQ ID NO: 1681861 - RNA, 13 nt, Salmonella enterica enterica serovar Typhi
ucuuuucaauaaa

SEQ ID NO: 1681862 - RNA, 16 nt, Salmonella enterica enterica serovar Typhi
ucuuuuaucacccgga

SEQ ID NO: 1681863 - RNA, 15 nt, Salmonella enterica enterica serovar Typhi
ucuuuuauauguuga

SEQ ID NO: 1681864 - RNA, 17 nt, Salmonella enterica enterica serovar Typhi
ucuuuguccugaaggac

SEQ ID NO: 1681865 - RNA, 13 nt, Salmonella enterica enterica serovar Typhi
ucuuuuaacauaa

SEQ ID NO: 1681866 - RNA, 15 nt, Salmonella enterica enterica serovar Typhi
ucuuuuaacauaagu

SEQ ID NO: 1681867 - RNA, 23 nt, Salmonella enterica enterica serovar Typhi
ugaaccaucggcaaacgccgccu

SEQ ID NO: 1681868 - RNA, 17 nt, Salmonella enterica enterica serovar Typhi
ugaaccggguaguuuug

SEQ ID NO: 1681869 - RNA, 20 nt, Salmonella enterica enterica serovar Typhi
ugaaccgguaaagcagugca

SEQ ID NO: 1681870 - RNA, 12 nt, Salmonella enterica enterica serovar Typhi
ugaaauccucua

SEQ ID NO: 1681871 - RNA, 19 nt, Salmonella enterica enterica serovar Typhi
ugaaauccucuauuuuuua

SEQ ID NO: 1681872 - RNA, 22 nt, Salmonella enterica enterica serovar Typhi
ugaaaucgucagacggcuccag

SEQ ID NO: 1681873 - RNA, 18 nt, Salmonella enterica enterica serovar Typhi
ugaacagccagaagccug

SEQ ID NO: 1681874 - RNA, 18 nt, Salmonella enterica enterica serovar Typhi
ugaaaugacacccucuuu

SEQ ID NO: 1681875 - RNA, 11 nt, Salmonella enterica enterica serovar Typhi
ugaacaggcag

SEQ ID NO: 1681876 - RNA, 18 nt, Salmonella enterica enterica serovar Typhi
ugaacagucccaccagcg

SEQ ID NO: 1681877 - RNA, 14 nt, Salmonella enterica enterica serovar Typhi
ugaacguaguuagu

SEQ ID NO: 1681878 - RNA, 18 nt, Salmonella enterica enterica serovar Typhi
ugaacguuuucugagcgg

SEQ ID NO: 1681879 - RNA, 16 nt, Salmonella enterica enterica serovar Typhi
ugaacggcucaaaaua

SEQ ID NO: 1681880 - RNA, 19 nt, Salmonella enterica enterica serovar Typhi
ugaacgcugcuguuaaccu

SEQ ID NO: 1681881 - RNA, 14 nt, Salmonella enterica enterica serovar Typhi
ugaacucuuucaga

SEQ ID NO: 1681882 - RNA, 19 nt, Salmonella enterica enterica serovar Typhi
ugaacuacggcccuggcuc

SEQ ID NO: 1681883 - RNA, 19 nt, Salmonella enterica enterica serovar Typhi
ugaaggccaaguuuagaaa

SEQ ID NO: 1681884 - RNA, 14 nt, Salmonella enterica enterica serovar Typhi
ugaagcugccguag

SEQ ID NO: 1681885 - RNA, 11 nt, Salmonella enterica enterica serovar Typhi
ugaagccccaa

SEQ ID NO: 1681886 - RNA, 15 nt, Salmonella enterica enterica serovar Typhi
ugaagcuggagccac

SEQ ID NO: 1681887 - RNA, 13 nt, Salmonella enterica enterica serovar Typhi
ugaagcuguuuug

SEQ ID NO: 1681888 - RNA, 23 nt, Salmonella enterica enterica serovar Typhi
ugaaggagcaaugagauccacug

SEQ ID NO: 1681889 - RNA, 20 nt, Salmonella enterica enterica serovar Typhi
ugaagauuuuuauucccgcc

SEQ ID NO: 1681890 - RNA, 16 nt, Salmonella enterica enterica serovar Typhi
ugaagcauaaaaagac

SEQ ID NO: 1681891 - RNA, 22 nt, Salmonella enterica enterica serovar Typhi
ugaaaaacgguauuuccauuuu

SEQ ID NO: 1681892 - RNA, 13 nt, Salmonella enterica enterica serovar Typhi
ugaaaaacuggaa

SEQ ID NO: 1681893 - RNA, 16 nt, Salmonella enterica enterica serovar Typhi
ugaaaaagauagacca

SEQ ID NO: 1681894 - RNA, 15 nt, Salmonella enterica enterica serovar Typhi
ugaaaagcagccaga

SEQ ID NO: 1681895 - RNA, 23 nt, Salmonella enterica enterica serovar Typhi
ugaaaacaggccugcggaaaaag

SEQ ID NO: 1681896 - RNA, 13 nt, Salmonella enterica enterica serovar Typhi
ugaaaaauguuca

SEQ ID NO: 1681897 - RNA, 16 nt, Salmonella enterica enterica serovar Typhi
ugaaaaauauaaaaag

SEQ ID NO: 1681898 - RNA, 18 nt, Salmonella enterica enterica serovar Typhi
ugaaaggaagugcaacug

SEQ ID NO: 1681899 - RNA, 18 nt, Salmonella enterica enterica serovar Typhi
ugaaacucgacacacuca

SEQ ID NO: 1681900 - RNA, 19 nt, Salmonella enterica enterica serovar Typhi
ugaaacucgccaugccauc

SEQ ID NO: 1681901 - RNA, 23 nt, Salmonella enterica enterica serovar Typhi
ugaaagauuauuuuaucaucagc

SEQ ID NO: 1681902 - RNA, 16 nt, Salmonella enterica enterica serovar Typhi
ugaaaguuucaggaua

SEQ ID NO: 1681903 - RNA, 22 nt, Salmonella enterica enterica serovar Typhi
ugaaaguuugaaguguuccuga

SEQ ID NO: 1681904 - RNA, 19 nt, Salmonella enterica enterica serovar Typhi
ugaaauaauuguguaaucu

SEQ ID NO: 1681905 - RNA, 20 nt, Salmonella enterica enterica serovar Typhi
ugaaauaauuguguaaucuu

SEQ ID NO: 1681906 - RNA, 21 nt, Salmonella enterica enterica serovar Typhi
ugaaauaauuguguaaucuuu

SEQ ID NO: 1681907 - RNA, 22 nt, Salmonella enterica enterica serovar Typhi
ugaaauaccaggcggcuuuuuc

SEQ ID NO: 1681908 - RNA, 22 nt, Salmonella enterica enterica serovar Typhi
ugaaacaguccggcgaaaaaag

SEQ ID NO: 1681909 - RNA, 18 nt, Salmonella enterica enterica serovar Typhi
ugaaacguguuuaucccc

SEQ ID NO: 1681910 - RNA, 21 nt, Salmonella enterica enterica serovar Typhi
ugaaacguguuuauccccgcu

SEQ ID NO: 1681911 - RNA, 21 nt, Salmonella enterica enterica serovar Typhi
ugaaacgccguuuguuuauug

SEQ ID NO: 1681912 - RNA, 21 nt, Salmonella enterica enterica serovar Typhi
ugaaaaugcguccagaggauc

SEQ ID NO: 1681913 - RNA, 23 nt, Salmonella enterica enterica serovar Typhi
ugaaaaugugguauuaacccaga

SEQ ID NO: 1681914 - RNA, 23 nt, Salmonella enterica enterica serovar Typhi
ugcucgucggcaauuugacuaca

SEQ ID NO: 1681915 - RNA, 19 nt, Salmonella enterica enterica serovar Typhi
ugcucguagcguuuaaaga

SEQ ID NO: 1681916 - RNA, 22 nt, Salmonella enterica enterica serovar Typhi
ugcucguaaagcaucagacuac

SEQ ID NO: 1681917 - RNA, 19 nt, Salmonella enterica enterica serovar Typhi
ugcucuaccaacugagcua

SEQ ID NO: 1681918 - RNA, 14 nt, Salmonella enterica enterica serovar Typhi
ugcucuccuggcau

SEQ ID NO: 1681919 - RNA, 19 nt, Salmonella enterica enterica serovar Typhi
ugcucuccuggcauggcuc

SEQ ID NO: 1681920 - RNA, 16 nt, Salmonella enterica enterica serovar Typhi
ugcucuccacgccgca

SEQ ID NO: 1681921 - RNA, 15 nt, Salmonella enterica enterica serovar Typhi
ugcucugccagcgcc

SEQ ID NO: 1681922 - RNA, 17 nt, Salmonella enterica enterica serovar Typhi
ugcugaauagccagccc

SEQ ID NO: 1681923 - RNA, 16 nt, Salmonella enterica enterica serovar Typhi
ugcugaagauaaaauu

SEQ ID NO: 1681924 - RNA, 22 nt, Salmonella enterica enterica serovar Typhi
ugcugaaaaagaacaauaauca

SEQ ID NO: 1681925 - RNA, 21 nt, Salmonella enterica enterica serovar Typhi
ugcugaacacaaugaauccuc

SEQ ID NO: 1681926 - RNA, 13 nt, Salmonella enterica enterica serovar Typhi
ugcugaaagaaga

SEQ ID NO: 1681927 - RNA, 15 nt, Salmonella enterica enterica serovar Typhi
ugcugaaaugauaag

SEQ ID NO: 1681928 - RNA, 18 nt, Salmonella enterica enterica serovar Typhi
ugcugacggagcuggcac

SEQ ID NO: 1681929 - RNA, 17 nt, Salmonella enterica enterica serovar Typhi
ugcugaccuuaauccag

SEQ ID NO: 1681930 - RNA, 15 nt, Salmonella enterica enterica serovar Typhi
ugcugaccuuaaucc

SEQ ID NO: 1681931 - RNA, 18 nt, Salmonella enterica enterica serovar Typhi
ugcugacaaucugcugga

SEQ ID NO: 1681932 - RNA, 17 nt, Salmonella enterica enterica serovar Typhi
ugcugacacccucugcg

SEQ ID NO: 1681933 - RNA, 23 nt, Salmonella enterica enterica serovar Typhi
ugcugacaucucuuuuaauuuuc

SEQ ID NO: 1681934 - RNA, 15 nt, Salmonella enterica enterica serovar Typhi
ugcugauaauacugc

SEQ ID NO: 1681935 - RNA, 17 nt, Salmonella enterica enterica serovar Typhi
ugcugauggccuuugug

SEQ ID NO: 1681936 - RNA, 19 nt, Salmonella enterica enterica serovar Typhi
ugcugacguagauucugau

SEQ ID NO: 1681937 - RNA, 15 nt, Salmonella enterica enterica serovar Typhi
ugcugcccgccgccg

SEQ ID NO: 1681938 - RNA, 20 nt, Salmonella enterica enterica serovar Typhi
ugcugccgcagcacccgcuc

SEQ ID NO: 1681939 - RNA, 16 nt, Salmonella enterica enterica serovar Typhi
ugcugccagucugccc

SEQ ID NO: 1681940 - RNA, 16 nt, Salmonella enterica enterica serovar Typhi
ugcugccacgucacgc

SEQ ID NO: 1681941 - RNA, 15 nt, Salmonella enterica enterica serovar Typhi
ugcugccauuuuauc

SEQ ID NO: 1681942 - RNA, 20 nt, Salmonella enterica enterica serovar Typhi
ugcugaugcuguaggccggg

SEQ ID NO: 1681943 - RNA, 18 nt, Salmonella enterica enterica serovar Typhi
ugcugcaaauugauacca

SEQ ID NO: 1681944 - RNA, 16 nt, Salmonella enterica enterica serovar Typhi
ugcugcacgucgcgcu

SEQ ID NO: 1681945 - RNA, 17 nt, Salmonella enterica enterica serovar Typhi
aaauguaggccggauaa

SEQ ID NO: 1681946 - RNA, 16 nt, Salmonella enterica enterica serovar Typhi
aaaugguuuugcccau

SEQ ID NO: 1681947 - RNA, 17 nt, Salmonella enterica enterica serovar Typhi
aaaugguuuugcccauu

SEQ ID NO: 1681948 - RNA, 17 nt, Salmonella enterica enterica serovar Typhi
aaauguauacuccccuu

SEQ ID NO: 1681949 - RNA, 17 nt, Salmonella enterica enterica serovar Typhi
aaaugucaggaucagau

SEQ ID NO: 1681950 - RNA, 18 nt, Salmonella enterica enterica serovar Typhi
ugcuggccuguucaagug

SEQ ID NO: 1681951 - RNA, 20 nt, Salmonella enterica enterica serovar Typhi
ugcuggcgcgucacaacagc

SEQ ID NO: 1681952 - RNA, 21 nt, Salmonella enterica enterica serovar Typhi
ugcuggcgcgucacaacagcc

SEQ ID NO: 1681953 - RNA, 23 nt, Salmonella enterica enterica serovar Typhi
ugcuggcgcgucacaacagccgg

SEQ ID NO: 1681954 - RNA, 15 nt, Salmonella enterica enterica serovar Typhi
ugcuggcggcaaggc

SEQ ID NO: 1681955 - RNA, 11 nt, Salmonella enterica enterica serovar Typhi
ugcuggcagau

SEQ ID NO: 1681956 - RNA, 13 nt, Salmonella enterica enterica serovar Typhi
ugcugcugaaaga

SEQ ID NO: 1681957 - RNA, 16 nt, Salmonella enterica enterica serovar Typhi
ugcugcucgaagauga

SEQ ID NO: 1681958 - RNA, 22 nt, Salmonella enterica enterica serovar Typhi
ugcugcgguuauaauaauaauu

SEQ ID NO: 1681959 - RNA, 22 nt, Salmonella enterica enterica serovar Typhi
ugcugcggcacgaaaaauaaaa

SEQ ID NO: 1681960 - RNA, 14 nt, Salmonella enterica enterica serovar Typhi
ugcugcgcuuuguc

SEQ ID NO: 1681961 - RNA, 15 nt, Salmonella enterica enterica serovar Typhi
ugcugccuacugccc

SEQ ID NO: 1681962 - RNA, 16 nt, Salmonella enterica enterica serovar Typhi
ugcuguaauuuauaaa

SEQ ID NO: 1681963 - RNA, 13 nt, Salmonella enterica enterica serovar Typhi
ugcuguagcacau

SEQ ID NO: 1681964 - RNA, 22 nt, Salmonella enterica enterica serovar Typhi
ugcuguauaaacucagcaauau
